United States Patent 10,113,176 (ISOLATED POLYNUCLEOTIDES AND POLYPEPTIDES, AND METHODS OF USING SAME FOR INCREASING NITROGEN USE EFFICIENCY, YIELD, GROWTH RATE, VIGOR, BIOMASS, OIL CONTENT, AND/OR ABIOTIC STRESS TOLERANCE) - sequence listing, part 2

SEQ ID NO: 1501 - DNA, 2101 bp, Sorghum bicolor
aaaacgcattattgatcaggctggcggagcaagccacggaaagcaaagcaaagcaaagcgcacccatccagatacacacgagcacgcgcccgcgcccgcgcccgcacccgcatagcaccaccagtccaccaccaggccggcgccgcccaaaatctccgcgtccctctcgcccaccatggcctccttcttcggcgacgacggcgccgacgagctcccgcgcaccacctcccaccccttcgactccgacgacttcggcgccgccgcggccgacggcgacggcgccggcgggtacggcgggtacgcctccttcgccgaggggggcgtcgaggatgtggacgaggagatcaccgtcgagtccgacggggtcccgatccgccacgtctccgggggttactcgccctcgccgttctcccccgagctcgagcccaacggcggcgacggcccgatcctgccgccgcccaccgagatgcgggaggagggcatcctcctccgcgagtggcggaggaaaaatgctattgaacttgagaaaaaggaacagaaggagaaggagctacgtgcccaaataattgcagaagctgaagaattcaagaaagctttttttgagaagaggatacagaattgtgcgtcaaatatggtcaacaacagagaaagggagaagatttttgtagccagccaggagaaattccatgccaacgcagacaagcagtactggaaatcgatttcagatctcatcccacatgaaatagccaccattgagaagcggggaaagaaagacaaggacaagaagccatccatcacagttattcagggccccaagcctggcaagcccaccgacctctcccggatgcgccatatcttagtgaagctgaagcatgctccaccgccacatatgttgcaacctccaccagcacctgctgctaaagagggcgcaaaggatggtgccaaagaaggcgcaaaggatggcgccaaagaaggcgcggcagccccagcaaacggcgccaagcagccagcagagagccaagaaacccccgccaatggcccctctgaggccgagaaagagcagcctgcagcgtcagagtgaccggaaagggtagcactacagaaacacaagagccttgactgtcagtagatggaagcgtgttttatttcttgatgatttccagacccgtttgtcccgtactgatcttttgtagagatctgcatcaggatgtctttatatcagcgcagaacattcataattagtatcaccacagcagttgtatctttactgttttcctcttgtccaagcgtgtctttcactgagatgcctgtgatctcaagttcagatctgaaactgttaccgagagaactgaatactctatgatatgctacagcactaatatgataataatctcaagctgtgcaataagcagcaatcttgcattgctctggcatgaattcactaatctatatgtacaagatctagttgccgcatttgcaggaggaaacaacaccacacacattgcactcactctcttataccgtcagatcggtagctctacatagtcgccagttcacaagcaaggaattactcaatcacatttacatctgcctggtgttgcttcacctggggctcatctcagtcaccgttggtggcacaaccgtgctgaacatgttggaatcctcggacgccgagttcttgaacctgtagttgctggaaacggtggccctggacccggggctcctcctgctgctctcgtggaggtaacctggcgccgtcagctcgctgtcgttgatcctgatgggcttggacagcatggtcacgacctggggcatcgtcggccggcgagcggcggccgcctgtaagcagaagagggccaccttgatgtacctgatgacttcttcctcagggtaatctacaagggttggatccaccagttccttaaggctctttgcttcatatagctcccatgtcttctccaggagaaccttgtcatccatcaatatgctcctggaactacttgtgccactcactatctccaggacaaggataccaaagctgtatatatctgctttcttggttagctgaccatgccatgcatattcaggtgcaaggtagcct

SEQ ID NO: 1502 - DNA, 1357 bp, Zea mays
cacacaaatgcgcccgcacccgccaacgccaccaccagtgacaagtcaagtccaccaggccgggccgcgaatctctgcgtccccttcgccaaccatggcctccttcttcgccgacgacggcaccgatgacctcccacgcaccacttcccaccccttcgactccgatgacttcggcgccgccgcggccgacgtcgccgccgccgacggatacggcgggtacgcctctttcgccgaggggggtgtcgaggaggtggacgaggagatcaccgtcgagtccgatggggtcccgatccgccacgtctccggggggtactcgccctcgccgttctcccccgagctcgagcccaacggcggcgacggcccgatcctaccgccgcccaccgagatggggcgggacgagggaatcctcctccgcgagtggcggagaaaaaatgctatggaacttgagaaaaaagaacagaaggagagggagctacgtgcccaaataattgctgaagccgaagaattcaagaaagccttttttgagaagaggatacagaactgtgcgtcaaacatggtgaacaacagagagagggagaagatttttgtagccagccaggagaaattccacgccggcgcagacaagcagtactggaaatcgatttcagatctcatcccacatgaaatagccaccatcgagaagcgggggaagaaagacaaggacaagaagccatccatcacagttgtccagggccccaagcctggcaagcccaccgacctgtcccggatgcgccatatcttggtgaagctgaagcatgctccgccgccacatatgttgcagcctccaccaccagcacctgctgctaaagagggcacaaaggatggcagcgccaaaggtggtggaaaggacggcgccaaagaaggcggcgcggcagccccagcaaacggcgccaagcagcctgctgagagccaagaaaccaccgccaatggcccctcggaggcggagaaagagcagcctgcagcctcggagtgaccggaaagggtgtctttattaagacatacacaagagccttaactgtcagtagatggaaaagcgtgttttatttcagataatttccagactcgtctttcccgcgctgctgatctttttgtagaggagatctgcatccggatgtctttacatcatagcgcagaacattcatgattgtatcaccacagcagttgtatgtttactgctttcccccttgcccaagtgttgccttcactgagatgctgcctgtgatatcaagttcagacctgaaactgttactgagagttcgactgaataatactcctatgatatgtcaccgcgctaatacgacagtaatctcaagatgtg

SEQ ID NO: 1503 - DNA, 2061 bp, Setaria italica
aaaatgcatttattaatcagcagcctggcggggcaagcaaagcaaagcgcacccgtccagatacacacgcgcacgcacccgcacccgcaccaccagtccaccaggccggcgccgcccaaaacctccgcgtctcccctccaccatggcctccttcttcgccgacgacggcgccgacgagctcccgcgcaccgcctcccaccccttcgactccgacgacttcggcgccgccgaccccgccgcggccggcggcgacgacgccggggggtacggtgggtactcctccttcgccgacgggggagtcgaggaggtggaggaggagatcaccgtcgagtccgatggggtcccgatccgccacgtctccgggggttactcgccctcgcccttctcccccgacctcgattccaacggcggcgacggcccgatcctgccgccgccgaccgagatgggccgggaggagggcttcctcctccgcgaatggcggaggcaaaatgctatagaacttgagaaaaaggaacagagggagaaggagctacgtgcccaaataattgctgaagctgaagaattcaagatagctttctatgagaagaggatacagaactgcgagacaaataaggtccacaacagggaaagggagaagatttttgtagccagtcaggagaaattccatgctagcgcggacaagcagtactggaaatcgatttcagagctcattccgcatgaaatagccaccatcgagaagcgggggggaaagaaagacaaggacaagaagccatccatcacagttattcagggcccgaagccaggcaagcccacggacctctcccggatgcgccaggtcttagtgaagctgaagcatgctcctccgccacacatgctgcagcctccaccagcgcctgctgccaaagaaggcgcaaaggatggcgccaaagaaggtgcgaaggatggtgcgaaagaaggagcggcagccccagcaaacggcacaaagcagcctgcagagagcaaagagacccccgccaatggcccatccgaggcggagaaagagcagcctgcagcgtcggagtgacttaaaaaagggtagcattacagaaacacaagagccttgactgtgcgtagatggaagcttgttttatttctgatctgcagactatgtatcctgtagcgatcttttgtagagatttgcatcaggatggctttatatcagcgaagaacattcatgttagtatcacagcagctgtatctttactgttttctaccttgcccaaccaagtagtatgcttgtgatctcaagttcagatctgaaactgttacgagagcttaactgaatactggatgatagactactgctgcaacatgattactgatatctcaagctgtgcaataagcagcagtcttgcattgccctggcaagaatcactaatctatatgtacaagatctagatgccgcatttgcagttggaaaaacaacacaacacattgacacacatgcactctattataccgtcaggccggtcactctacatcgccagttcacaacgcaaggatagattacatctgctgcctggtgttccttcaccgggggctcatctcagtcaccgtcggtggaacgacggtgctgaacacgttggagtcctcagacgccgtgttcttggacctcgagtggctcgacgtactcgccttggactcattgctcttgtactcgtggatgtatcccggcgccgtcagctccctctcgttgatccggatcggcttggacagcatggtgacgacctgcggcatcgacggccgccggttcgccgccgcctgtatgcagaagagggccaccttgatgtaccggatgacttcttcttcagggtaatctccgatcgccgggtcgatcagctccttgagcttgttcgcttcgtatagctcccatatctgttgtgaatgttcagagttagacttggatggggggttgatacgtgcttttgaatgttcagagttagacttgggatgggggttgatatgtgtgtacaacttgtcagcaaatctttggccaggcactgctgttctgaagctgtttgc

SEQ ID NO: 1504 - DNA, 1158 bp, Panicum virgatum
caccagtccaccaggccggcgccgcccaaaacctccgcgtctcacctccgccatggcgtccttcttcgccgacgacggcgccgacgagctcccgcgcaccacctcccaccccttcgacgccgacgacttcggcgccgccgaccccgccgcggccggcggcgacgacgccgggggatacggcggctacgcctccttcgccgacgggggggtcgaggacgtggaggaggagatcaccgtcgagtccgatggggtcctgatccgccatgtctctggggggtactcgccctcgcccttctcccccgacctcgagcccaacggcggcgacggcccgatcctgccgccgccgaccgagatgggccgggaggagggcttcctcctccgtgaatggcggaggcaaaatgctatagaacttgagaaaaaggaacagatggagaaggagctacgtgcccaaataattgctgaagctgaggaattcaagatagctttctatgagaagaggatacagaactgtgggacaaataaggtccacaacagagaaagggagaagattttcatcgccagtcaggagaaattccatgctagtgcggacaagcagtactggaaatcgatttcagagctcattccgcatgaaattgccaccattgagaagcgtggaaagaaagacaaggacaagaagccatccatcacagttattcagggcccgaagccaggcaagcgcactgacctctcccggatgcgccagatcttggtgaagctgaagcatgctcctccgccacacatgctgcaacctccaccagcacctgctgctaaagaaggtgcaaaggatggcgccaaagaaggtgcaaaggatggtgctaaagaaggtgcggcagccccagcaaatggcactaagctgcctgcagagagtaaagaaacccccgccaatggtccatccgaggcagagaaagagcagcctgcagcgtccgagtgacttaagggtagcattacagagacacaagagccttgactgtgcgtagatggaagcgtgtttatttctgatttccggactcagtgtatcctgtagcgatcttttgtagagatttgcgtcagggtggatttatatcagcgaagaacattcatgttaatatcacagaagttgtatgtttactgttttctcct

SEQ ID NO: 1505 - DNA, 1349 bp, Panicum virgatum
gatcagcagcctggcgggccaagcaaagcaaagcaaacgcacccatccgcacgcacgcgcacagcaccaccaccagtccaccaggccggcgccgcccaaaacctccgcgtcgcgtctcccctccaacatggcctccttcttcgccgacgagctgccgcgcaccacgtcccaccccttcgacgccgacgacttcggcgctgccgaccccgcggcggccggcggcgacgacgccgggggatacggcggctacgcctccttcgccgacggggggatcgaggaggtggaggaggagatcaccgtcgagtccgatggggtcccgatccgccacgtctccggggggtactcgccctcgcccttctcccccgacctcgagcccaacgccggcgacggcccgatcctgccgccgccgaccgagatgggccgggaggagggcttcctcctccgtgaatggcggaggcaaaatgctatagaacttgagaaaaaggaacagagggagaaggagctacgtgcccaaataattgctgaagctgaagaattcaagatagctttctatgagaagaggatacagaactgtgagacaaataaggtccacaacagagaaagggagaagattttcgtggccggtcaggagaaattccatgctggtgcggacaagcagtactggaaatcgatttcagatctcattccgcatgaaattgccaccattgagaagcgtggaaagaaagacaaggacaagaagccatctatcacagttattcagggcccgaagccaggcaagcccaccgacctctcccggatgcgccagatcttggtgaagctgaagcatgctcctccaccacacatgctgcaacctccaccagcacctgctgctaaagaaggcgcaaaggatggagccaaagaaggtgcaaaggatggtgccaaagaaggtgctgcagccccagcaaatggcaccaagcagcctgcagagagcaaagaaacccccgccaatggcccatcggaggcagagaaagagcagcctgcagcgtctgagtgacttataagggtagcattacagagacacgagagccttgactgtgcgtagatggaagcgtgtttatttctgatttccagactcagtgtatcctgtagcgatcttttgtagagatttgcgtcaggatggctttatatcagcgaagaacattcatgttagtatcacagaagttgtatctttactgttttctccttgccaagtagctccactggatgcttgcgatgatctcaagttcagtcctgaaactgttatgagagcttaacccaatactggctgataattgcccgaatatgatatctcaagctgtggaatgagcaac

SEQ ID NO: 1506 - DNA, 1297 bp, Cenchrus ciliaris
  misc_feature (711)..(711): n is a, c, g, or t
  misc_feature (780)..(780): n is a, c, g, or t
  misc_feature (800)..(800): n is a, c, g, or t
  misc_feature (828)..(828): n is a, c, g, or t
  misc_feature (834)..(834): n is a, c, g, or t
  misc_feature (839)..(839): n is a, c, g, or t
  misc_feature (875)..(876): n is a, c, g, or t
  misc_feature (890)..(890): n is a, c, g, or t
  misc_feature (915)..(915): n is a, c, g, or t
  misc_feature (990)..(990): n is a, c, g, or t
  misc_feature (1004)..(1004): n is a, c, g, or t
  misc_feature (1030)..(1030): n is a, c, g, or t
  misc_feature (1047)..(1047): n is a, c, g, or t
  misc_feature (1100)..(1100): n is a, c, g, or t
  misc_feature (1124)..(1124): n is a, c, g, or t
  misc_feature (1141)..(1141): n is a, c, g, or t
  misc_feature (1157)..(1157): n is a, c, g, or t
  misc_feature (1163)..(1163): n is a, c, g, or t
  misc_feature (1176)..(1176): n is a, c, g, or t
cacgcaccgtcccgcacagccgcacaccgcaccaccagtccaccaggccggcgccgcccaaaacctccgcgtctcccctccaccatggcctccttcttcgccgacgacggcgccgacgagctcccacgcaccacctcccaccccttcgactccgatgacttcggcgccgccgaccccgccgcggccggcggcgacgacgccggtgggtacggcgggtactcctccttcgccgacgggggagtcgaggaggtggaggaggagatcaccgtcgagtccgatggggtcccgatccgccacgtctccgggggctactcgccctcgcccttctcccccgacctcgagcccaacggcggcgacggcccgatcctgccgccgcccaccgagatgggccgggaggagggcttcctcctccgcgaatggcggaggcaaaatgctatagaacttgagaaaaaagaacagagggagaaggagctacgtgcccaaataattgctgaagctgaagagttcaagatagctttctatgagaagaggatacagaactgtgagacaaataaggtccacaacagagaaagggagaagatttttgtagccagtcaggagaaattccatgctagcgcggacaagcagtactggaaatcgatttcagagctcattccgcatgaaatagccaccattgagaagcgtggggcaaagaaagacaaggacaagaanccatccatcacagttattcagggcccgaagccaggcaagcccaccgacctctcccggatgcgtcaggtnttagtgaagctgaagcatgntcctccgccacacatgctgcagcctccnccagcncctgntgccaaagaaggtgcaaaggatggtgccaaagaagnngcaaaggatggtgngaaaggagcagcggccccagcaaanggcacaaagcagcctgcagagagcaaagagacccctgccaatggcccgtttgaggcggagaaagagcagcctgcngcgtcggagtgacntgaaaaagggtagcattacagaaacncaagagccttgactgtngtagatggaagcttgttttatttttgatttgcagactgtgtcctgtagcgatnttttgtagagatttgcatcagganggctttatatcagtgangaacattcatgttagnatatcncagcagctgtatntttactgtttttttttttgcccaagtagctcccctggatgcttgggacctcaagttcagatttgaaactgttacgagtgcttaactgaatacaggatgatagactatactgctgcaacata

SEQ ID NO: 1507 - DNA, 1914 bp, Setaria italica
aagcaaagcaaagcgcacccgtccagatacacacgcgcacgcacccgcacccgcaccaccagtccaccaggccggcgccgcccaaaacctccgcgtctcccctccaccatggcctccttcttcgccgacgacggcgccgacgagctcccgcgcaccgcctcccaccccttcgactccgacgacttcggcgccgccgaccccgccgcggccggcggcgacgacgccggggggtacggtgggtactcctccttcgccgacgggggagtcgaggagggaggagatcaccgtcgagtccgatggggtcccgatccgccacgtctccgggggttactcgccctcgcccttctcccccgacctcgattccaacggcggcgacggcccgatcctgccgccgccgaccgagatgggccgggaggagggcttcctcctccgcgaatggcggaggcaaaatgctatagaacttgagaaaaaggaacagagggagaaggagctacgtgcccaaataattgctgaagctgaagaattcaagatagctttctatgagaagaggatacagaactgcgagacaaataaggtccacaacagggaaagggagaagatttttgtagccagtcaggagaaattccatgctagcgcggacaagcagtactggaaatcgatttcagagctcattccgcatgaaatagccaccatcgagaagcgggggggaaagaaagacaaggacaagaagccatccatcacagttattcagggcccgaagccaggcaagcccacggacctctcccggatgcgccaggtcttagtgaagctgaagcatgctcctccgccacacatgctgcagcctccaccagcgcctgctgccaaagaaggcgcaaaggatggcgccaaagaaggtgcgaaggatggtgcgaaagaaggagcggcagccccagcaaacggcacaaagcagcctgcagagagcaaagagacccccgccaatggcccatccgaggcggagaaagagcagcctgcagcgtcggagtgacttaaaaaagggtagcattacagaaacacaagagccttgactgtgcgtagatggaagcttgttttatttctgatctgcagactatgtatcctgtagcgatcttttgtagagatttgcatcaggatggctttatatcagcgaagaacattcatgttagtatcacagcagctgtatctttactgttttctaccttgcccaaccaagtagtatgcttgtgatctcaagttcagatctgaaactgttacgagagcttaactgaatactggatgatagactactgctgcaacatgattactgatatctcaagctgtgcaataagcagcagtcttgcattgccctggcaagaatcactaatctatatgtacaagatctagatgccgcatttgcagttggaaaaacaacacaacacattgacacacatgcactctattataccgtcaggccggtcactctacatcgccagttcacaacgcaaggatagattacatctgctgcctggtgttccttcaccgggggctcatctcagtcaccgtcggtggaacgacggtgctgaacacgttggagtcctcagacgccgtgttcttggacctcgagtggctcgacgtactcgccttggactcattgctcttgtactcgtggatgtatcccggcgccgtcagctccctctcgttgatccggatcggcttggacagcatggtgacgacctgcggcatcgacggccgccggttcgccgccgcctgtatgcagaagagggccaccttgatgtaccggatgacttcttcttcagggtaatctccgatcgccgggtcgatcagctccttgagcttgttcgcttcgtatagctcccatatcttctccagaagaatcttgtcatctatcagtatgctcct

SEQ ID NO: 1508 - DNA, 1880 bp, Pennisetum glaucum
tccgatctgtccaccaccaggccggcgcggtgtgcggcaaagcaaagcagagcgcaccccacgcggcggtggtcacgcgcacgcacccgcacagccgcacaccgcaccgcaccaccagtccaccaccaggccggcgccgcccaaaacctccgcgtcgcccccccccctccaccatggcctccttcttcgcggacgacggcgccgacgagctcccgcgcaccacctcccaccccttcgactccgacgacttcggcgccgccgaccccgccgcggccggcggcggggggtacggcgggtactcctccttcgccgacggggccgtcgaggacgtggaggaggaggaggatatcaccgtcgagtccgacggggtcccgatccgccacgtccccgggggcggctactcgccctcgcccttctcccccgacctcgagcccaacggcggcggcggcggcggcgacggcccgatcctgcccccgccgaccgagatgggacgggaggagggcttcctcctccgcgaatggcggaggcaaaatgctatagaacttgagaaaaaggagcagatggagaaggagctacgggctcaaataattgctgaagctgaagagttcaagatagctttctatgagaagaggatacagaactgtgagacaaataaggtccacaacagagaaagggagaagatttttgtagcgagtcaggagaaattccatgcaagtgcggacaagcagtactggaagtcgatttcggagctcattccacatgaaatagccaccattgagaagcgaggggcaaagaaagacaaggacaagaagccatccatcacggtggtccagggcccgaagccaggcaagcccaccgacctctcccggatgcgccaggtcttggtgaagctgaagcatgctcctccgccacacatgctgcagcctccaccagcgcctgctgccaaagatggtgcgaaggatggcgccaaagaaggtgcaaaggatggtgcgaaagaaggatccgcagccccggcaaacggcacaaagcagcccgcagagagcaaagagacccccgccaatggcccgtccggggcagagaaagagcagcctgcaccgtcggagtgacttaataaagggtagcattacagaaacacaaaagccttgactgtgcgtagatggaagcttgttttatttctgatttgcagactatgtatcctgtagcgatcttttgtagagatttgcttcaggatggctttatatcagcgaggaacattcatgttagtaatatcacagcagctgtatctttactgttctctcctttgcccaagtagctccaccagatctgaaattgttacgggagcttaactgaatactggatgatagaccactgctccaacatgattattgatatctcaagcttgtgcaacaagcagcaatcttgcattgccctggcaagaatcactaatctatatgtacaagatctagatgccgcgtttgcagttggaaaacaacatcacacacacatgcactctattgtaccgtcaggccggtcattcctctacatcgccagttcacaacgcaactgctgcctggtgtttcttcacctggggctcatctcggtcactgtcggtgggacaaccgtgctgaacgtgttggagtcctctgacgccgtgttcttggaccccgggtggctcgacgtactcgccttggactcattgctcttgtactcgtgcatgtaccccggcgccgtcagctccctctcgttgatccggatcggcttggacagcatggtgacgacctgcggcatcgacggccgccggttcgctgccgcctgtatgcagaagagggccaccttgatgtacctgatgacctcttcttcggggtaatctgcgatcgtcg

SEQ ID NO: 1509 - DNA, 1771 bp, Setaria italica
cttcctcgtttgcccctggacttccagagtattccaatccacgaccgaagcatccagaagcagccgcctcctgctctaaaaaaactcccccccttcttccggtcatcctccccgcaccacagaccacgcgcagatccaaacgcgacccgagcccgaccaaaccctaagccccgcctcccgcctccccactccgcgccaccatggccaagtacggcgagggcgacaagcggtggatcgtggaggagcgcgccgacggcaccaacgtccacaactggcactgggcggagcgcgactgcctcgagtggtcccgcgcgcgcctctccgccctgctcgcgggcctcaccgtcctcgacggcgagggcggcctcacgctccgcaccgtggccctcgacaagctcgacggcgaggcctacgtcaacatccgcaagggcaaggtcatcccggggtacgagctctccctcaccctctcctgggaggccgaggccgcctccgagtccggcgccgccaaggtcgccggcgccgccgaggtcccctacctcgccgacgagaacgccgacgaggaccccgacctccgcgtcaccgtccgcggcgacgagaccccgctcgcgcgccgcgcgaaggacgccttcctcgcccgcggcaagcccctcgtcctcgagaagatccgcgagttcgtcgccgccatggccaagggcggcccggccaaggacgagctcgagtccaagaagactcccgccaaggccggcgccgccccggctgcgaagaaggaggagccccccgctcctgcgccggctgcgaaggagaagaaggccaaggggaaggacaaggaggggttcaagacgattgagatgacggagaagttctactgccgcgccaaggacatatatgagatcttgatggatgagaacagatggaaggggttcacacagagcaatgcgaggatcagcagagaggtcggaggggaatttagcctatttgatgggtccatcaccggcatcaatgaggagctgcaggaagggaagctgattgcacagaagtggcggtttgggagctggccagacgacctttactcctcggtgaggttggtgttcgatgagcctgaatctggggttacaatcataaagctcaaacaaactgatgtgcctgaggaagacaagtatggcaattcaactgtggtagagaacacggagaggggctggagagaactcattttccagcggatacgcggagtgttcggtttcgggatctaaagaagtgatacagcctgaagctggatttctaatttttacggagtcaggctttgaatgccatagctatccatgttttactcacccagttgttccatgttgttaaaaggcaaaactcagcataccatgggggttaaaaacatctgttattcatcacgctagaatgtgtctgccttcgtactcttgtttgtttggtgaacatgatcgtgttgtgattgtctgccagtttcacaggatgacatgcctaatagcctgtagacaaggagctgcgattgaagttaggtttatgactgcagtagcgccatgcgccggtcacgatctgaagagagcttcattttcgatcatttccgataagcttcattcgcgatctggtagactggtactgtgtcagtagtgggctagtggcagatcgtatcagtcaacttcactaattacttgcctccaggttaagcgaccctccagttgatagtgttttattcaacattacttattcacttggattttatcccaaacaccagttttga

SEQ ID NO: 1510 - DNA, 1595 bp, Sorghum bicolor
gagagtattccgatccaccaccgaaccatccagaagcagccgccctcctgctctaaaaaaagctctcgtctccggtcatccattccacaccccccacaccacgaaacctcgcgcagatccaaacgaatccgagcccgtccaaaccctaagccccgcctccctctcccccctagcccaactccaccgcgcaccccatggcgaagtacggcgagggcgacaagcggtggatcgtggaggagcgcgccgacggcaccaacgtccacaactggcactgggcggagcgcgactgcctcgagtggtcccgcgcgcggctctcctccctgctcgcgggcctcaccgtcctcgacggcgagggcggcctcacgctccgcaccgtcgcgctcgacaagctcgacggcgaggcctacgtcaacatccgcaagggcaaggtcatcccggggtacgagctctcgctcaccctctcctgggaggccgaggccgccgccgccgcctcggagtccggagccgtgaaggtcgccggcgccgctgaggtcccctacctcgccgacgagaacgccgacgaggaccccgagctccgcgtcaccgtgcgcggcgacgagacgcccctcgcgcgccgcgccaaggacgccttcctcgcacgcggcaaacccatggtgctcgagaagatccgggagttcgtcgctgccatggccaagggtggaccggccaaggacgagctggagtccaagaaaactcccgcgaaggtcgcccctgcagcgcctggcgccgccccggcgaagaaggaggaggtggtggctcctgcgccggctgcggagaagaaaaaggccaaggggaaggacaaggaggggttcaagaccattgagatgacggagaagttctactgccgctcaaaggacatatatgagatcttgatggatgagaacaggtggaaagggtttacacagagcaatgcgaggatcagcagagaggttggaggggaatttagcctctttgatgggtccatcactggcatcaacgaggagctgcaggaagggaaactgattgcacagaagtggcggtttggaagctggccggacggcttgtactcctcggtaaggttgacgtttgatgagcctgagtctggagttacaatcataaagctcaaacaaaccgatgtgccagaggaagacaagtatgggaactcaactgtggtagagaacacggagagaggctggagagaactcatattccagcggatacgcggagtgtttggttttgggatctaaagaatctaaagaggcaacttggcatgaagttggatttcaaatttttatggggtcaggcctgaatgccatagcaatccaatgttttactcacccagtttttccatgtccttaaaacacaaaactctgcatatcatgggggtttaaaaacaactgttattcatcgcgttgtaacgatccttgctcccaatttctggtgttaaatgagtcaacgttgatctttgctgatgctgatggggttggtcctcttgttgcgtgattaaaaattggacattattgtgtcagtgcgaagcgttttagtggctatatatgttttcgttgcttttggacttc

SEQ ID NO: 1511 - DNA, 1937 bp, Sorghum bicolor
ttatggatggagggagtattccaccggtagaagagaagctaccagactcctgcgccttgtttgcccctgaacttcgagagtattccgatccaccaccgaaccatccagaagcagccgccctcctgctctaaaaaaagctctcgtctccggtcatccattccacaccccccacaccacgaaacctcgcgcagatccaaacgaatccgagcccgtccaaaccctaagccccgcctccctctcccccctagcccaactccaccgcgcaccccatggcgaagtacggcgagggcgacaagcggtggatcgtggaggagcgcgccgacggcaccaacgtccacaactggcactgggcggagcgcgactgcctcgagtggtcccgcgcgcggctctcctccctgctcgcgggcctcaccgtcctcgacggcgagggcggcctcacgctccgcaccgtcgcgctcgacaagctcgacggcgaggcctacgtcaacatccgcaagggcaaggtcatcccggggtacgagctctcgctcaccctctcctgggaggccgaggccgccgccgccgcctcggagtccggagccgtgaaggtcgccggcgccgctgaggtcccctacctcgccgacgagaacgccgacgaggaccccgagctccgcgtcaccgtgcgcggcgacgagacgcccctcgcgcgccgcgccaaggacgccttcctcgcacgcggcaaacccatggtgctcgagaagatccgggagttcgtcgctgccatggccaagggtggaccggccaaggacgagctggagtccaagaaaactcccgcgaaggtcgcccctgcagcgcctggcgccgccccggcgaagaaggaggaggtggtggctcctgcgccggctgcggagaagaaaaaggccaaggggaaggacaaggaggggttcaagaccattgagatgacggagaagttctactgccgctcaaaggacatatatgagatcttgatggatgagaacaggtggaaagggtttacacagagcaatgcgaggatcagcagagaggttggaggggaatttagcctctttgatgggtccatcactggcatcaacgaggagctgcaggaagggaaactgattgcacagaagtggcggtttggaagctggccggacggcttgtactcctcggtaaggttgacgtttgatgagcctgagtctggagttacaatcataaagctcaaacaaaccgatgtgccagaggaagacaagtatgggaactcaactgtggtagagaacacggagagaggctggagagaactcatattccagcggatacgcggagtgtttggttttgggatctaaagaatctaaagaggcaacttggcatgaagttggatttcaaatttttatggggtcaggcctgaatgccatagcaatccaatgttttactcacccagtttttccatgtccttaaaacacaaaactctgcatatcatgggggtttaaaaacaactgttattcatcgcgttgtaacgatccttgctcccaatttctggtgttaaatgagtcaacgttgatctttgctgatgctgatggggttggtcctcttgttgcgtgattaaaaattggacattattgtgtcagtgcgaagcgttttagtggctatatatgttttcgttgcttttggacttcaatttactcgctgtgagttctagatttcttccagtaacgatccgaccatggccttgtttcgttacacagttgccatttcgtcgttttgatgtcctgcgatccttccatactcctcgtcgactgtggttcatgtggttcggccagtggttcctagtgcttttcggcctgttcgttggatcgtttttgcggttgatttgtcattagagaaaggtacttgaaaaaatacgactgaggctttgtttagatctaaaacctttttggattttg

SEQ ID NO: 1512 - DNA, 1594 bp, Panicum virgatum
accacgcgcagatccaaacgcgacccgagcccgaccaaaccctaagccccgcctccccctccccctccccctccgcgcgagccatggccaagtacggcgagggcgacaagcggtggatcgtggaggagcgcgccgacggcaccaacgtccacaactggcactgggcggagcgcgactgcctcgagtggtcccgcgcgcggctctcctccctgctcgcgggcctcaccgtcctcgacggcgagggcggcctcacgctccgcaccgtcgcgctcgacaagctcgacggcgaggcctacgtcaacatccgcaagggcaaggtcatcccggggtacgagctctccctcaccctctcctgggaggccgaggccgcctccgaggccggcgccgccaaggtcgccggcgccgctgaggtcccctacctcgccgacgagaacgccgacgaggaccccgacctccgcgtcaccgtccgcggtgacgagaccccgctcgcgcgccgcgccaaggacgccttcctcgcccgcggcaagcccctcgtcctcgagaagatccgcgagttcgtcgccgccatggccaagggcggcccggccaaggacgagctcgagtccaagaagacccccaccaagggcgccgcccccgccgccgcgcctggcgccgccccggctgccaaggagcaggtccccgctcccgcgccggcggccaaggagaagaaggccaaggggaaggacaaggaggggttcaagacgattgagatgacggagaagttctactgccgcgccaaggacatatatgagatcttgatggatgagaacagatggaaggggttcacgcagagcaatgccaggatcagcagagaggttggaggggaattcagcctatttgatggctccatcaccggcgtcaatgaggagctgcaggaagggaagctgattgcccagaaatggcggtttgggagctggccagacggcctatattcctcggtgaggttggtcttcgatgagcctgaatctggagttacaatcataaagctcaaacaaactgatgtgcctgaggaagacaagtatggtaattcaactgtggtggagaacacggagaggggctggagagaactcattttccagcggatacgcggagtgtttggttttgggatctaaagaagtgatacagcctgaagctgggtctctaatttttactgagtcgggccttggatgccatagttgtccatgttttactcacccagttattccatgttgttaaaaggcaaaactcagcataccatgggggttaaaaacatcttttattcatcatgctagaatgcgtctgcttcatactcttgtttggttagtaaacatgattgcgtgtctgccagtgtcagaggatgacacgagtaatggaccgtagataaagggtgccgttgattcaagttagttttatgactgaagtatcgtatcagctattcgcttactgtctccagcctcgttttcgatcaggtataaagtataatgccagttgtgtgatgtggcagatcggatcagaggttgagtactcacaacctgagtaccgttgttcggtgttttgtaagcgtgcctccagctta

SEQ ID NO: 1513 - DNA, 1341 bp, Pennisetum glaucum
ccgcaccacagaccacgcgcagatccaaacgcaaccgagcccgaccaaaccctaagccccgcctcctccactccgcgccaccatggccaagtacggcgagggcgacaagcggtggatcgtggaggagcgcgccgacggcaccaacgtccacaactggcactgggcggagcgcgactgcctcgagtggtcccgcgcgcgcctctcctcccttctcgcgggcctcaccgtcctcgacggcgagggcggcctcaccctccgcaccgtggcgctcgagaagctcgacggcgaggcctacgtcaacatccgcaagggcaaggtcatccccgggtacgagctctccctcaccctctcctgggaggccgaggccgcctccgagtccggcgccgtcaaggtcgccggcgccgcggaggtcccctacctcgccgacgagaacgccgacgaggaccccgacctccgcatcaccatccgcggcgacgagaccccgcttgcgcgccgcgccaaggacgccttcctcgcccgcggcaagcccctcgtcctcgagaagatccgcgagttcgtcgccgccatggccaagggcggcccggccaaggacgagcttgactccaagaagactcccaccaaggccggcgccgctgcacctggcgccgccccggcttcgaagaaagaggaggcccccgctcctgcgcccgcggccaaggagaagaaggccaaggggaaggataaggaggggttcaagacgattgagatgacggagaagttctactgccgcgccaaggacatatatgagatcttgatggatgagaacagatggaaggggttcacacagagcaatgcgaggatcagcagagaggtcggaggggaattcagcctgtttgatgggtccatcaccggcatcaatgaggacctgcaggaagggaagttgattgcgcagaagtggcggtttgggagctggccagacggcctgtactcctcggtgaggttggtgttagatgagcctgaatctggggttacaatcataaagctcaaacaaactgatgtgcctgaggaagacaagtatggcaattcaactgtggtagagaacacggagagaggctggagagaactcattttccagcggatacgtggagtgttcggtttcgggatctaaagaagtgatacagcctgaagctggatctctaatttttatgagtcaggcttggaatgccatagttatccatgttttagtcacccagttgctccatgttgttaaaaggcaaaactctgcataccatgggggttaaaaacatctgttattcatcatgctagaatgcgtctgccttcttgctcttgtttgtttggtga

SEQ ID NO: 1514 - DNA, 1776 bp, Zea mays
atatttcttactttagttgtcattttagataaaatcaaatcattttaaatatttaggtactattaagtcatccacgtacagaaaacattaattatgttatttgagcccattttaacactgttgagtcattcatgctcgatttgtttcccttttgtcgaacttcgagattgttccgattcaccgtcgaaccatccagaagcagccgcctcctgcttctggtcctggactcgtctccggtccggtccggtccggtcatccattccccaatccccagtccccaccctcacaacaagtccacaactcacagcacgaaaccacgcgcagatccaaacgaatgcgagcccgtccaaacacttgaggcctcgagcccgcctctccctcctcttcctctcaacaccaccggcatacccatggcgaagtacggcgagggcgacaagcggtggatcgtggaggagcgcgccgatggcaccaacgtccacaactggcactgggcggagcgcgactgcatcgagtggtcccgcgcgcggctctcctcgctgctcgcgggcctcaccgtcctcgacggcgaggacggcctcacgctccgcaccgtcgcgctcgacaatctcgacggcgaggcctacgtcaacatccgcaagggcaaggtcatcccagggtacgagctctcgctcaccctctcttgggaggccgaggccgcttcggagtccggagctgtgaaggtcgccggcaccgccgaggtcccctaccttgccgacgagaacgctgacgaggaccccgacctccacatcaccgtgcgcggtgacgagacgcccctcgcgctccgcgccaaagatgccttcctctcccgcggcaaacccatggtgctcgaaaagatccgggagttcgttgctgccatggccaagggtggaccggcgaaggacgagctggattccaagaaaactcctgcgaaggtcgccgctgcagcgcctggcgccgctccggcgaagaaagaggaggtggtggctcctgcgccggctgcggggaagaaaaaggccaaggggaaggacaaggaggggttcaagaccattaagatgacggagacgttctactgccgctcaaaggacatatatgagatcttgatggatgagaacagatggaaagggtttacacagagcaatgcgaagatcagtagagaggttggaggggaatttagcctctttgatgggtgcatcactggcgtcaacgaggatctgcaggaaggaaaactgattgcgcagaaatggcggtttggaagctggcctgacggcttgtactcctcggtccggttgatgttggatgagcccgagtctggagttacagtcataaaactcaaacaaactggtgtgccagaggaagacaagtatgggaattcaactgtggttgagaacacggagagaggctggagagatctcatattccagcggatacgtgggatgtttggttttgggatctaaagagtctatagagaggcgatttaatttggcatgatgtcctaattcaaatttttacggggtcaggccatgaatgctatagcaatccatgtttctcacccagttttttttcttcatgtcggcaaaacgcaaaactctgcatatgatggggatttgaaaacatctgttattcatcaggctaaaacgctgcagtattccttgcccccagaccccagttttggtgttggcacaaactgaaggcaacgttgatctttgctgatgcagaaggggttggtacccttgttgcgtgattgaaaatgggacgttg

SEQ ID NO: 1515 - DNA, 1518 bp, Panicum virgatum
gcgtccaggcacacccaccacgcgcagatccaaacgcgacccgagcccgaccaaaccctaagccccgcctccccctccaccccctccgcctccgcgcgagccatggccaagtacggcgagggcgacaagcggtggatcgtggaggagcgcgccgacggcaccaacgtccacaactggcactgggcggagcgcgactgcctcgagtggtcccgcgcgcggctctccgccctgctcgcgggcctcaccgtcctcgacggcgagggcggcctcacgctccgcaccgtcgcgctcgacaagctcgacggcgaggcctacgtcaacatccgcaagggcaaggtcatcccggggtacgagctctcgctcaccctctcctgggaggccgaggccgcctccgaggccggcgcctccaaggtcgccggcgccgccgaggtcccctacctcgccgacgagaacgccgacgaggaccccgacctccgcgtcaccgtccgcggcgacgagaccccgctcgcgcgccgcgccagggacgccttcctcgcccgcggcaagcccctcgtcctcgagaagatccgcgagttcgtcgccgccatggccaagggcggcccggccaaggacgagctcgagtccaagaagacctccgcgaagggcgccgcccccgccgccgcgcctggcgccgccccggctgccaagagggaggaggtccccgcccccgcgccggcggccaaggagaagaaggccaaggggaaggacaaggaggggttcaagacgattgagatgacggagaagttctactgccgcgccaaggacatatatgagatcctgatggacgagaacagatggaaggggttcacgcagagcaatgcgaggatcagcagagaggttggaggggaattcagcctctttgatggctccattaccggcgtcaatgaggagctgcaggaagggaagctgattgcccagaaatggcggtttgggagctggccggatggcctgtattcctcggtgaggttggtcttcgatgagcccgaatctggagttacaatcataaagctcaaacaaactgatgtgcctgaggaagacaagtatggtaattcaactgtggtggagaacacggagaggggctggagagaactcattttccagcggatacgtggagtgttcggttttgggatctaaagaagtgatacagcctgagctgggtctctaatttttacggagtcgggccttggatgccatagttatccatgttttactcacccagttattccatgttgttaaaaggcaaaactcagcataccatgggggttaaaaacatctgttattcatcatgcatgcgtactcttgtttggttggtcaacatgatcgtgttgtgattgtgttgtgtctgccagtgtcacaggatgacacgagtaaatggaacgtagataaagagtgccgtgaattgaagttaggtttacgactgaagtatcgcaccagctatttgcttcttgtctccagcctcatttacgataaggtataaag

SEQ ID NO: 1516 - DNA, 1331 bp, Avena sativa
cgcccgaatcatccagaagcagccgccggcccaactctaaaagcttaccatctccggtctccgccccctacaccacgcgcagatccgagtatagaaaagcaaatcgagaccgaccaaaccctagcaccccaaccccatggcgaagttcggcgagggcgacgcccggtggatcgtgcaggagcgccctgacggcgcgaacgtccacaactggcactgggcggagcgcgactgcctggagtggtctcgcgcgcggctctccgccctcctcgccggtctccccgtcctatccggcgagggcggcctcaccctccgcaccaccaccctcgacaagctggacggcgaggcctatgtcaacatccgcaagggcaaggtcatcccggggtacgagctctccctcacgctctcctgggaagccgaggccacatctgagtccggggtcgcaaaggtcactggcgccgccgaggttccctaccttgctgacgagaacgccgacgaggatccagaactccgcatcactgtccgcggcgacgaagacccccttgcgcgccgtgccaaggatgccttcatcgcccgtggcaagcctcttgtccttgagaagatccgggagtatgtggccaccatggcaaagggtggccccgccaaggacgagctagattctaagaaaattcccaccaagacggcagcagcgactggtggcacggctaccgcccctgctccggcagtgaaggaggcggcggcgcctgcacccgcgcctgtatctaaggagaagaaggcaaaggggaaggagaaggaaggattcaaaactattgagatgaaagagaagttcaactgccgctccaaggacatttatgagatcttgatggatgagaacagatggaagggtttcacgcagagcaatgcgaggatcagcaaggaggttggtgggcagtttagcctctttgatgggtccataaccggcgtcaacgaggagctgcaggaagggaagctgatcgttcagaagtggcggtttgggagctgggctgatggcgtgtattctacagtcaggttggtatttgatgagcccgagtcaggagttacaatcataaagctcaaacaaactgacgtgccagaggaagacaggtatgggaactcaactgtggtggagaacaccgagagaggctggacagagctcatctttcagaggatacgtgcagtgttcggttttgggatctaatgaactcccgtctggattctggatgtctaccttttaggaagtgatccctgctttgtcatatggctctacctgttctgctgcctcagtttatcttatgctgatagacacacaaacttcg

SEQ ID NO: 1517 - DNA, 1541 bp, Avena sativa
cgcccgaatcatccagaagcagccgccggcccaactctaaaagcttaccatctccggtctccgccccctacaccacgcgcagatccgagtatagaaaagcaaatcgagaccgaccaaaccctagcaccccaaccccatggcgaagttcggcgagggcgacgcccggtggatcgtgcaggagcgccctgacggcgcgaacgtccacaactggcactgggcggagcgcgactgcctggagtggtctcgcgcgcggctctccgccctcctcgccggtctccccgtcctatccggcgagggcggcctcaccctccgcaccaccaccctcgacaagctggacggcgaggcctatgtcaacatccgcaagggcaaggtcatcccggggtacgagctctccctcacgctctcctgggaagccgaggccacatctgagtccggggtcgcaaaggtcactggcgccgccgaggttccctaccttgctgacgagaacgccgacgaggatccagaactccgcatcactgtccgcggcgacgaagacccccttgcgcgccgtgccaaggatgccttcatcgcccgtggcaagcctcttgtccttgagaagatccgggagtatgtggccaccatggcaaagggtggccccgccaaggacgagctagattctaagaaaattcccaccaagacggcagcagcgactggtggcacggctaccgcccctgctccggcagtgaaggaggcggcggcgcctgcacccgcgcctgtatctaaggagaagaaggcaaaggggaaggagaaggaaggattcaaaactattgagatgaaagagaagttcaactgccgctccaaggacatttatgagatcttgatggatgagaacagatggaagggtttcacgcagagcaatgcgaggatcagcaaggaggttggtgggcagtttagcctctttgatgggtccataaccggcgtcaacgaggagctgcaggaagggaagctgatcgttcagaagtggcggtttgggagctgggctgatggcgtgtattctacagtcaggttggtatttgatgagcccgagtcaggagttacaatcataaagctcaaacaaactgacgtgccagaggaagacaggtatgggaactcaactgtggtggagaacaccgagagaggctggacagagctcatctttcagaggatacgtgcagtgttcggttttggtatctaatgatctcccgtctggattctggatgtctaccttttaggaagtgatccctgctttgtcatatggctctacctgttctgctgcctcagtttatcttatgctgatagacacacaaacttcgagaattgcgagaattcaaaagtatctggtaccctgtattcatcaagctggattgtactggatattttgttatgtgttgaattcgtgattcatgtcgatcacttgatcagtgagttagcataatgtctggaccaagacgtctgtgtagaaaaaacagtaggaaaagtgtcctgtcctatcgtatctaagcctatatgagcggaatactaca

SEQ ID NO: 1518 - DNA, 1600 bp, Oryza sativa
acttccagactattccagtccacgaccgtcggaccgaaccgaaccatccagaagcagccgccgccccaattctaaagcatctcccccccacccatctccgatctccacccgcagatccgacggagacaagcgcaccaagcccccccaccaaaccctaatcctccttcccccccctcccatggcgaagtacggagagggcgacgcgcggtggatcgtgcaggagcgcgccgacggcaccaacgtccacaactggcactgggcggagcgcgactgcctcgagtggtcccgctcccgcctcacctccctcctcgccggcctccccgtcctctccggcgagggcggcctcgccctccgcaccaccgcgctcgacaagctcgacggcgaggcctacgtcaacatccgcaaggggaaggtcatcccggggtacgagctctccctcaccctcgcctgggaggccgaggccaccaccgagtccggcgtcgtcaaggtctccggcgccgccgaggtgccctacctcgccgacgagaacgccgacgaggacccggagctccgcgtcaccgtccgcggcgacgatggccccgtcgcccgccgcgccaaggacgccttcctcaccaagggcaagcctctggtcctcgagaagatccgggagtacgtcgccgccatggcgaagggcggcccggctaaggacgagctggattccaagaagacccccaccaaggccgcggcggtagaggccggtggcgcggccaccgcgcctgcccctgcggcggagaagaaggaggaggcgccggccgtgaaggagaagaaggcgaaggcgaaggacaaggaaggattcaagacgatcgagatgacggagaaattctactgccgtgcgaaggacatgtatgagatcttgatggatgagaacagatggaaggggttcacgcagagcaatgcgaggataagcagagaggtcggagggcagttcagcctcttcgatgggtcaatcagcggcgtcaatgaggagttgcaggaagggaagctgatcgtgcagaagtggcggttcggtagctggccagacggcgtgcactcgacggttaggttggtatttgatgagcctgagtcgggagttacagtcataagcctcaaacaaactgatgtgccagaggaagacagatatggaaattcaactgtggtggagaacacggagcgaggctggagagaactcatcttccagaggatacgcggagtgtttggttttgggatctaaagcagtactttgactcttgagctggatttctgcttttcaggaagtcgagcgttaccatgtcacagttatccctgtctttgctgtcgcagtttattcgatgttagacagaaactttgcatattacggggaagtcggaaaaaacatctgttattcatcacgctggaatgcgtctgcaatgtttgccaagtgttaatctgcaactgatggttgagtaaccttgtgttgtgttggttgatcgttgattgttctgcaatttcctgaacttttaagtgttgtcttgctgcggttgatgagaccaaattacgcaaagttttcatccgtgcagccgcactgtgctgccctaaaactcgc

SEQ ID NO: 1519 - DNA, 1502 bp, Oryza sativa
acttccagactattccagtccacgaccgtcggaccgaaccgaaccatccagaagcagccgccgccccaattctaaagcatctcccccccacccatctccgatctccacccgcagatccgacggagacaagcgcaccaagcccccccaccaaaccctaatcctccttcccccccctcccatggcgaagtacggagagggcgacgcgcggtggatcgtgcaggagcgcgccgacggcaccaacgtccacaactggcactgggcggagcgcgactgcctcgagtggtcccgctcccgcctcacctccctcctcgccggcctccccgtcctctccggcgagggcggcctcgccctccgcaccaccgcgctcgacaagctcgacggcgaggcctacgtcaacatccgcaaggggaaggtcatcccggggtacgagctctccctcaccctcgcctgggaggccgaggccaccaccgagtccggcgtcgtcaaggtctccggcgccgccgaggtgccctacctcgccgacgagaacgccgacgaggacccggagctccgcgtcaccgtccgcggcgacgatggccccgtcgcccgccgcgccaaggacgccttcctcaccaagggcaagcctctggtcctcgagaagatccgggagtacgtcgccgccatggcgaagggcggcccggctaaggacgagctggattccaagaagacccccaccaaggccgcggcggtagaggccggtggcgcggccaccgcgcctgcccctgcggcggagaagaaggaggaggcgccggccgtgaaggagaagaaggcgaaggcgaaggacaaggaaggattcaagacgatcgagatgacggagaaattctactgccgtgcgaaggacatgtatgagatcttgatggatgagaacagatggaaggggttcacgcagagcaatgcgaggataagcagagaggtcggagggcagttcagcctcttcgatgggtcaatcagcggcgtcaatgaggagttgcaggaagggaagctgatcgtgcagaagtggcggttcggtagctggccagacggcgtgcactcgacggttaggttggtatttgatgagcctgagtcgggagttacagtcataagcctcaaacaaactgatgtgccagaggaagacagatatggaaattcaactgtggtggagaacacggagcgaggctggagagaactcatcttccagaggatacgcggagtgtttggttttgggatctaaagcagtactttgactcttgagctggatttctgcttttcaggaagtcgagcgttaccatgtcacagttatccctgtctttgctgtcgcagtttattcgatgttagacagaaactttgcatattacggggaagtcggaaaaaacatctgttattcatcacgctggaatgcgtctgcaatgtttgccaagtgttaatctgcaactgatggttgagtaaccttgtgttgtgttggttgatcgttgattgttctgcaa

SEQ ID NO: 1520 - DNA, 1461 bp, Brachypodium distachyon
cctaccccgcccccatggcgaagttcggcgagggcgacgcccggtggatagtccaggaccgcgcggacggcgcgaacgtccacaactggcactgggcggagcgcgactgcctcgagtggtcgcgcgcccggctctctgctctgctcgccggcctccccgtcctctccggcgagggcggcctcaccctccgcaccaccaccctggacaagctcgacggcgaggcctacgtcaacatccgcaagggcaaggtcatccccgggtacgagctctccctcacgctctcctgggaggccgaggccacgtccgagtcgggggtcgtcaaggtcaccggcgccgccgaggtcccctatctcgctgacgagaacgccgacgaggaccccgaactccgcatcactgtccgcggcgacgaagggcctctggcgacccgcgccaaggacgccttcatcgcccgtggcaagcccctggtccttgagaagatccgggagtatgtagccatcatgtcgaagggtggcccagccaaggacgagctggatgctaagaagactcccacaaaggcggctacagcgactggtgtcacggctactgcccctgctccggtagcgaaggaggcgccggcgccggcgccagcagctaaggagaagaaggccaagggaaaggaaaaggaggggttcaagactattgagatgacagagaagctgaactgccgcgcggagcacatttatgagatcttgatggatgagaatagatggaaggggttcacacagagcaatgcaaggatcagcaaggaagtgggcgggcagtttagcctatttgatgggtccattaccggtgtcaacgaggagctgcaggaagggaaactgatcgtgcagaaatggcggtttgggagctggcccgacggcgtgcactctacagtcagattggtgtttgatgaaccggagtctggagttacaatcataaagctgaaacaaactgatgtgccagaggaagacaggtatggaaactcaactgtggtggagaacacggagagaggctggagggagctcatcttccagaggatacgcgcggtgtttggtttcgggatctaaagaagcgctcttgagtcttgactgctataaggatttcaatcccctaggaagccaagcctgccttgtcatagtttcctgtttcgttgcctcagtttattcaaatgctggtagacacaaaaattcccaaattgcggggggcaaaaagacatcagttactttgtattcatcacgctggattgtattgtggtgttctaaactcgtgattcagatggcggtgatggtgaatgtgttgatgagcatatactcgttgagttgttccttgcgtgggtatgatccttactagatgaacctgtgaagaacctggtcggggtgttggggatgcgacccggtttgaaagcttttaagttatctaaaaaaaaaatgtttagtggcgtgt

SEQ ID NO: 1521 - DNA, 1761 bp, Brachypodium distachyon
agaaaccatctctttcccccctaatcttccagacaattccaaacgaagacagaagcatccagaagcagccggcggcctaattctaaaagctccccatctccagtcttccttccgcccacaccacgcagcagatccggagcctaatcaaatctagcccgaccaaaccctaactaagcctaccccgcccccatggcgaagttcggcgagggcgacgcccggtggatagtccaggaccgcgcggacggcgcgaacgtccacaactggcactgggcggagcgcgactgcctcgagtggtcgcgcgcccggctctctgctctgctcgccggcctccccgtcctctccggcgagggcggcctcaccctccgcaccaccaccctggacaagctcgacggcgaggcctacgtcaacatccgcaagggcaaggtcatccccgggtacgagctctccctcacgctctcctgggaggccgaggccacgtccgagtcgggggtcgtcaaggtcaccggcgccgccgaggtcccctatctcgctgacgagaacgccgacgaggaccccgaactccgcatcactgtccgcggcgacgaagggcctctggcgacccgcgccaaggacgccttcatcgcccgtggcaagcccctggtccttgagaagatccgggagtatgtagccatcatgtcgaagggtggcccagccaaggacgagctggatgctaagaagactcccacaaaggcggctacagcgactggtgtcacggctactgcccctgctccggtagcgaaggaggcgccggcgccggcgccagcagctaaggagaagaaggccaagggaaaggaaaaggaggggttcaagactattgagatgacagagaagctgaactgccgcgcggagcacatttatgagatcttgatggatgagaatagatggaaggggttcacacagagcaatgcaaggatcagcaaggaagtgggcgggcagtttagcctatttgatgggtccattaccggtgtcaacgaggagctgcaggaagggaaactgatcgtgcagaaatggcggtttgggagctggcccgacggcgtgcactctacagtcagattggtgtttgatgaaccggagtctggagttacaatcataaagctgaaacaaactgatgtgccagaggaagacaggtatggaaactcaactgtggtggagaacacggagagaggctggagggagctcatcttccagaggatacgcgcggtgtttggtttcgggatctaaagaagcgctcttgagtcttgactgctataaggatttcaatcccctaggaagccaagcctgccttgtcatagtttcctgtttcgttgcctcagtttattcaaatgctggtagacacaaaaattcccaaattgcggggggcaaaaagacatcagttactttgtattcatcacgctggattgtattgtggtgttctaaactcgtgattcagatggcggtgatggtgaatgtgttgatgagcatatactcgttgagttgttccttgcgtgggtatgatccttactagatgaacctgtgaagaacctggtcggggtgttggggatgcgacccggtttgaaagcttttaagttatctaaaaaaaaaatgtttagtggcgtgtcgatatgagcttaccgtggtccccaactgccaagggttctcagttttggaggactgtatttcggaaagaacttttacctggttgtttgattcctataattgcaatcttagaaatttgtcggatga

SEQ ID NO: 1522 - DNA, 1344 bp, Hordeum vulgare
ggcgaagttcggcgagggcgacgcacggtggatcgtgcaggagcgcgccgacggtgccaacgtccacaactggcactgggcggagcgcgactgtctcgaatggtctcgcgcgcgtctctccgcgctcctcgcgggcctccccgtcctctccggggagggcggcctcaccctccgcaccaccaccctcgacaagcttgatggcgaggcctacgtcaacatccgcaagggcaaggttatcccagggtacgagctttccctcacgctcgcctgggaggccgatgccgcatccgagtcgggggtcgccaaggtcactggtacagctgagttaccctacctcgctgacgagaacgccgacgaggatcccgaactccgcatcaccgttcgcggtgacgacggccccttcgcgcgccgggccaaggatgccttcatcgcccatggcaagcctctggtcattgccaagatccgggagtatgtcgccgccatggcgaatggtggccccgcaaaggacgagatagattctaagaagctatccaccaaggctgccccagcggccggtggcgcagctgttgctcccgctccttcagtgaatgtgacagcagctccagtgcatgcgccagcagctaaggagaagaaggcgaatggcaaggataaggaaggattcaagactattgagatgacggagaagttcaactgccgctccaaggacatctatgagatcttgatggatgagaacagatggaagggtttcacacagagcaatgcgaggatcagcaaggatgttggtgggcagtttagcctctttgatgggtccatcacaggtgttaatgaggagctgcaggaagggaagctggttgtgcagaaatggcggtttgggagctgggctgatggtgtccattctacagtcaggttggtgtttgatgagcctgagtcaggagtgacaataataaagctcaaacaaactgatgtgccagaagaagacaggtatgggaactcaactgtggtggagaacaccgagagaggctggaaagagctcatcttccagaggatacgtgcagtgttcggttttggggtctgaaaaagcatctgacaccttgtatgaagtcgatcctgcctttccatggctatccatgttttgctgtcttagtttatttgatgctgatagacgcaccttgcattcatcacgctgggttgtgctttggagtcgtcactcatgaaagtttgacctcgtgactatgtaggccagcgaaattgttcacctaatggtcgctgagtgacttattttggttccttgcgtccgtatgatatggtaccagataagttgtattgaaggttataggtctacaa

SEQ ID NO: 1523 - DNA, 1645 bp, Sorghum bicolor
cccacccgtcttcgcttcttcgcgagcagaaggagagggtaggaggaggaggaggagggggacggccggacggggacgtttcgcgcatcctgcctcgccctcgccggcttcctccactcgagcggctcgctgaggaaatagtgaaagagaactatgagttcagtgagtggtacaaccaatggccatgggaaagaagcggcattttatgaggagcagctgtccaagattggtaaagttagaactgacctaggacaactatccggaaaatcagctctatattgctcagacgcttcaattgcaaggtacctgatagcaaggaactgggacgtaaagaaggctactagaatgctgaagaaaaccttaaaatggcgttcagaatataagccagatgaaatccgttgggatgacatatctgatgaagcggtgacgggaaaaacttaccgaactgattactttgacaagattgggcggagtatacttgtcatgagacctggatgccagaatacaaagaatcccaatgggcaagtcaagtacttggtgtactgtatggagaatgcaattctaaatctgccacatggtcaggatcagatggtttggctcattgattttgctggtttcaacttaggtaacttgtcaattcaggtgacaaagatgacggcagatgtcctacaaggccattatcctgaaagattgggtgtggcaattctttacaatgctccaaggttttttgagcctttctggaagatggcaagcccccttcttgagaagaagaccagaaacaaggtaaagtttgtatactcagacagacctgacaccatgaagatcatggaagaccttttcaacatggatgagttagaatgtgcatttggtggcaagaacccagctactttcaatataaatgattatgctgttaggatgagagaagatgacaagaagatgccattattctggagccctgagaattcagctctagcttctgagccatatctgatgagcagccaaaaggccctagaaagcatctcgggtgtgaagaccgaggaggctggatctggaaagagggaaaacctggagactgctcctgaaaagagtgaagaatcggataccgaatctgaaaaggaggaacaaacacggactgaatcaagcacagttgagcagaaaaacttgccaggagaagctaatgccccagcagataaaagtggcgtttaatctgatctctgagtatcaccatgaaacaaaaactctaaaaattgatagaatctctaccacagttcactaaaagatgaacacgaaaggcgatgagaaactcttttaacacggcaaatcgtcatgcctgacttgttttgtagtcaggcacctatttctctgtcctcacaattgaggaacccattatggtaaagaactaataccataatgttaccctcacttttcaattttcatgacagaatgtgatccggtgttcagtttctgctatgcccttgtatttactggggaaaaaatactattgtatctggcaggcatgttatatgctcgatagcaaaaccgcaagcgcttttcaccagcagctgttgggtgaaataccattgttcacttgtattctgttcagtaaccaccattgactttcagttagtataccacttggtacaag

SEQ ID NO: 1524 - DNA, 1728 bp, Sorghum bicolor
agggccagcgctgcacacagctcagcgcccggcgagtcgcgacgaccccactctgtcgtatgcgccggcaagtacgcgggcgtgggtccgtcccggccgtccaaatacgccacgtgagagccacaaccgacgggagccgtccgatgcgatgcgaccgcccccccacctcccgtcccattgcataggattttcctccccaggcatgggcagtccccatccccacccgtcttcgcttcttcgcgagcagaaggagagggtaggaggaggaggaggagggggacggccggacggggacgtttcgcgcatcctgcctcgccctcgccggcttcctccactcgagcggctcgctgaggaaatagtgaaagagaactatgagttcagtgagtggtacaaccaatggccatgggaaagaagcggcattttatgaggagcagctgtccaagattggtaaagttagaactgacctaggacaactatccggaaaatcagctctatattgctcagacgcttcaattgcaaggtacctgatagcaaggaactgggacgtaaagaaggctactagaatgctgaagaaaaccttaaaatggcgttcagaatataagccagatgaaatccgttgggatgacatatctgatgaagcggtgacgggaaaaacttaccgaactgattactttgacaagattgggcggagtatacttgtcatgagacctggatgccagaatacaaagaatcccaatgggcaagtcaagtacttggtgtactgtatggagaatgcaattctaaatctgccacatggtcaggatcagatggtttggctcattgattttgctggtttcaacttaggtaacttgtcaattcaggtgacaaagatgacggcagatgtcctacaaggccattatcctgaaagattgggtgtggcaattctttacaatgctccaaggttttttgagcctttctggaagatggcaagcccccttcttgagaagaagaccagaaacaaggtaaagtttgtatactcagacagacctgacaccatgaagatcatggaagaccttttcaacatggatgagttagaatgtgcatttggtggcaagaacccagctactttcaatataaatgattatgctgttaggatgagagaagatgacaagaagatgccattattctggagccctgagaattcagctctagcttctgagccatatctgatgagcagccaaaaggccctagaaagcatctcgggtgtgaagaccgaggaggctggatctggaaagagggaaaacctggagactgctcctgaaaagagtgaagaatcggataccgaatctgaaaaggaggaacaaacacggactgaatcaagcacagttgagcagaaaaacttgccaggagaagctaatgccccagcagataaaagtggcgtttaatctgatctctgagtatcaccatgaaacaaaaactctaaaaattgatagaatctctaccacagttcactaaaagatgaacacgaaaggcgatgagaaactcttttaacacggcaaatcgtcatgcctgacttgttttgtagtcaggcacctatttctctgtcctcacaattgaggaacccattatggtaaagaactaataccataatgttaccctcacttttcaattttcatgacagaatgtgatccggtgttcagtttctgctatgcccttgtatttactggggaaaaaatactattgtatctg

SEQ ID NO: 1525 - DNA, 1675 bp, Setaria italica
gccgaggaagaggaggaggaggagggggacgggcggctcctacccgcctcgcgtgctccgcggcccgcgcatcctgcctcgccgccttcctcgcccccggagccgcggctcgccgagggaatagcgaaaaggcgctatgagttcagcgagtggtgtgaccaatggtcatgggaaagaagcagcattatatgaggagcagaagtccaagatcggtaaagttaaaactgaactaggacagctatctggaaaatcagctctatattgctcagacgcttcaattgcaaggtacctgatagcaaggaactgggacgtgaggaaggccacaaaaatgctgaagaaaaccttgaaatggcgtttagagtataagccagatgagatccgctgggatgatatatctgatgaagctgtgactggaaaaatttaccgagctgattactttgacaagagtgggcggagtatccttgtcatgagacctggatgccagaataccaaggatgccaaagggcaagtcaagtacttggtgtactgtatggagaatgcaattctaaatctgccacatggtcaggatcagatggtttggctcattgattttgctggcttcaacttaggtaacctgtcaattaatgtgacaaagttgacggcagatgtccttcaaggtcattatcctgaaagattgggtgtggcaattctttacaatgccccaaagttttttgagcctttctggaagatggcaagccccattcttgagaggaagaccagaaacaaggtcaaatttgtatactcagataggcctgacaccatgaagatcattgaagatcttttcaacatggatgagttagaatgtgcttttggtggcaagaatccagctactttcaatataaatgattatgccgtgaggatgagagaagatgacaagaagatgccatcattctggagtcctgagaattcagctcttgcttccgagccatatctgatgagcaaccaaaagccccaagaaagcagctcctcgggtgtgaaggctgaagagactgaacctgaaaagagggaagaaacagatactgcacctgaaaagagggcagaatcggataccgaatctgaaaaggaggaagaaacacagactgaatcaagcacagttgagcagaaaagcttgccgggagaagatactgctccagcagataaaagtggcctttaatctgatctgtgagtatcaccatgaaacgtaaatggtaaatgttgataggagctctacaacagtgtgttctcattaatagatgaacatcaaaggcgatgagaaactcttttaacacatggcaggatcgttatgcctgacttgttttgtagtcagcgtcactctgtttctttcatccctcactatcccactccatttttctgccctcgtgattttatttgaagaaccctgttgtggcagaatgagatccaacagacggtaaagaactaatacaatattttgttaccctcagtttcatcgtaagattgctgtttcagtttattcattttccccacttgcgttgagtttatgctatgccagcgtgttttctgaatcttaagtactggctggctggcatcttctgcacctgatagcaagaccgcaagcactttccactggcagctgtggggtgaaaaaccatcgttcatttgtatttctggtcagtaa

SEQ ID NO: 1526 - DNA, 1528 bp, Pennisetum glaucum
ggcggctccgacccgcctcgcgtgctccgcggcccgcggatcccgcctcgccgtcctcttcgaccctggagcccagccgccgcggctcgccgaggaaatagcgaaaaggtgctatgagttcagcgagtggtgcgaccaatggccatgggaaagaagcagcattatatgaggagcagaagtccaagattggtaaagttagaactgaactagggcagctatctggaaagtcagctctatattgctcagatgcttcaattgcaaggtacctgatagcaaggaactgggacgtgaggaaggccacaaaaatgctgaagaaaaccttaaaatggcgtttagagtataagccagatgagatccgctgggatgatatatctgatgaagctgtgactggaaaaatttaccgaactgattactttgacaagagtgggcggagtatccttgtcatgagacctggatgccagaataccaaggatgccaaagggcaagtcaagtacttggtatactgtatggagaatgcaattctaaatctgccacagggtcaggatcagatggtttggctcattgattttgctggcttcaacttaggtaacctgtcaattcatgtgacaaagttgacggcagatgtcctacaaggccactatcctgaaagattgggtgtggcaattctttacaatgccccaaagttttttgagcctttctggaagatggcaagcccccttcttgagaggaagaccagaaacaaggtccagtttgtgtactctgataggcctgacaccatgaagatcattgaagatcttttcaacatggatgagttagaatctgcgtttggtggcaagaacccagctactttcaatataaatgattatgccgtgaggatgagagaagatgacaagaagatgccatcattctggagtcctgaaaattcagctcttgcttccgagccatacctaatgagcaaccaaaagctccacgaaagcagctcctcgtgtgtgaaggctgaagagactgatcctgaaaagagggaagaaacagatactgcacctgaaaagagggaagaattggataccaaatctgaaaaggaggaagaaacacagactaaatcaagcacagttgagcagaaaagcttgccaggagaagatactgctccagtggaaaaaagtgcccaataatctgatctgtgagcatcaccatgaaacgtaaacggtaaatgttgataggatctacgacagtgagttcacactaatagatgaacatcaaaggcgatgataaactttttaacacacggcaggattgtcatgcctgacttgttttgtagtcggcgccactctgtttgttttggccccactccatttttctgccctcttgattttatttgaagaacccttttgtggcagaaagagatcaccagacggtaaagaactaatacactattttgtcaccctcagtttcctaataagatagctgtttagttttttcttttccaaaagtaaaaaaaaaaaaaaaaaaagtaactactagcgttgatacc

SEQ ID NO: 1527 - DNA, 1369 bp, Panicum virgatum
ccgaggaggaggaggagggggcggctcggacccgcctcgcgtgctccgcggttcgcgcatcctgcctcgccgtcgcctccttcctcccccgctgagcggctcgccaaggaaataacaaaaaggcactatgagtttagggagtggtatgaccaatggacatgggaaagaagcagcattatatgagcagcagatgtcaaagattggtaaagttagaaatgaactaggacaactatctgcaaaatcagcactatattgctcagacgcttcaattgcaagatacctgatagcaaggaactgggacgtgaagaaggccacaaaaatgctgaagaaaaccttgaaatggcgttcagaatataagccagatgagatccgttgggatgatatatctgatgaagctgtgactggaaaaatttaccgaactgattactttgacaagagtggccggagtatacttgtcatgagacctggatgtcagaataccaagaatgccaatgggcaagtcaagtacttggtgtactgtatggagaatgcaattttgaatctgccacatggtcaggatcagatggtttggctcattgattttgctggcttcaacttgggtaacctgtcaattcacgtgacaaaattgacggcagatgtcctgcaaggccattatcctgaaagattgggcgtggcaattctttacaatgccccaaagttttttgagcctttctggaagatggcaagcccgcttcttgagaggaagaccagaaacaaggtcaaatttgtatactcagataagcctgacaccatgaagatctttgaagatcttttcaatatggatgagttagaatgtgcatttggtggcaagaacccagctactttcaacataaatgattatgctgtgaggatgagagaagatgacaagaagatgccatcattctggagccctgagaattcagctcttgcttcagagcgatatctgatgagcaaccaaaagcccagagaaagcagctccatgggtgtgaagaccgaagaaactgaatcggaaaagagagaagatgcagatactacggatactacacctgaaaataggaaagaatcggatactgaatctgaagaggatggcccaaaggatgaagaaacacagactgaatcaaccacagttgagcagaagagcttgccaggagaaggtactgccccagcagataaaagtggcccttaatctgatctgtgagtatcaccgtgaaacttcacgtaaatggtaaatgtcaataggagctctacctcagtgagtttttcactaatagatcatgaacatcaaaggtggtgtgaaagtcttttaacacacagcaggatcatcatgcccgtcttgttttgtagtcggcac

SEQ ID NO: 1528 - DNA, 1928 bp, Sorghum bicolor
cctccctccctgggccaaaaccgccgcttcccctcctcctcctcctccgccccgcctcgccccgcgccgcttcccctccccgctctttctgtgaggagggaagcgaggcggatgccgaggcgacgaggctcgcgcaccgcacgcgtgtgcccgccgccccggggccaggcgaggtggtgaggtgaggtgaggtcgcgcgcggttttaaattgcccgcccgcccttctcgccgtagtttttcagtggtagaagaaccaacgtcagggctgcttgcctgcctgcctgctgcggacatgggctccggtctcaagtaccgagctggcctctgcctcatcgtcgccgttgtgctgatttgggtcctctccgccgaggtcacgcaggggatattcacaaagtacaaacatccgtttgcaattacttacttgggggcctcccttatggtcatatatctccctttgtcatttctaaaagacttcatatacaactcaatgagacggcattctggaaacactagtgctttaaaaattgcaagcaaatcttcctttggtggtagtgcccctttgaagaatggtgaatttcagaaggtgttggaaatggaatcacagaaaactatagtgataaattgcactgatgtgagcattcctgtagtagaagagacaaaaccactcatatacggaatcactgaaatgaatgatggtgctttcaaggacaagcaactttccacaaaggagattgcaacttatggattgtatctttgccccttatggtttgtcacagagtatttatcgaatgcagcgcttgcaagaactagtgttgccagtaccaccgtactgtcttcaacttcaggactcttcactcttttcattggtgttttacttggccaagactccataaatgcggcgaaagttattgctgttttcattagcatggctggcgttgtaatgacaactatgggccagacgtgggcatctgatgaatcagaagtaggcaaatctggtgctacacagaggactcttctaggtgatatgtttggtcttatgtcagcaatcgcctatggcctatttactgtgctgcttaaaaaattttgtggagaggaaggagaaaaggttgatgtccaaaaactgtttggttatcttggactttttacccttgttgctctctggtggattgtctggccattaaccgcactaggcattgagccaaagttttcaatgccccactcagctaaagtggatgaagtggtggtggcaaatagcctaatcggaagtgtactatcagactacttctgggctctttctgttgtttggactactcccttggtggccaccctaggcatgtctctcacaattccgctagcaatggttgctgatatgatcattcacggccgtcactattcagcagtatatattcttggttctgtccaggtattttcaggatttgttatcgcgaaccttgcagatcggttttcacgttctctagggctattatagtttcataaaccaaaacaggtccttattagagtgtacatctggaagctcaaagattgggttggtttgacaaatacttcagaaaacgtgggttcttttccctttgctcctttgaacataggggcggtgaattttgccgtggtgggtagtgaaagccagcgttgtagcaaccctttgcaactgtaaattctcaactgcaaattgcgcgacagtgtaaactgccgtcgttctcggccatgtccacaggcttgcacgcttgtaaatttgcaatgcccctttattccttttcgacccatgttcatggcaattgcaaagaatgaattagcaggaaaaggaactacaagttgcagaaaaatgaatgggcaagtagtacaagttgccatatatgtgcgacaatgaaaaatgaaaagtgaaaatgatttactgcacaggcaacgtgaa

SEQ ID NO: 1529 - DNA, 2410 bp, Sorghum bicolor
aagcgaaccggtcgggtttccatccaatcccatcacgccgtgccatggcgagagtccgagatcaaccaaaactttgcccccgcgtccccacacggcaggagtgcgtgcgatgtgaccgagaccgagagcgaccgggagtcccctccgcatccgccgggacagcaacgcccgtgcgaacccgagcgccaccaccacctccacctgcgtccagcgcccgccaacgccaaccagccagagccaagccaaatactcccccccgcgccgcgcgcgcgcacctgcttcccagttcccacccaaaactcgccgtccgccaccgccaccgcgcccatagcaagctcgccttccacgccgaatccaccaccgccaccgcgcccatagcagcacgtttccccgttgcttgacgccgaatccaccaccacgcaggcggccaggccagcgccagcgcgtcgtccctcccggggccgctccgcctctccggtcgcgcccgccaggcctcggggcgaccaccaccaaaatagaaacttccgtgggtaggtcacccccggctggctttaccccccgccccaccccgcccacgcctcctccctccctgggccaaaaccgccgcttcccctcctcctcctcctccgccccgcctcgccccgcgccgcttcccctccccgctctttctgtgaggagggaagcgaggcggatgccgaggcgacgaggctcgcgcaccgcacgcgtgtgcccgccgccccggggccaggcgaggtggtgaggtgaggtgaggtcgcgcgcggttttaaattgcccgcccgcccttctcgccgtagtttttcagtggtagaagaaccaacgtcagggctgcttgcctgcctgcctgctgcggacatgggctccggtctcaagtaccgagctggcctctgcctcatcgtcgccgttgtgctgatttgggtcctctccgccgaggtcacgcaggggatattcacaaagtacaaacatccgtttgcaattacttacttgggggcctcccttatggtcatatatctccctttgtcatttctaaaagacttcatatacaactcaatgagacggcattctggaaacactagtgctttaaaaattgcaagcaaatcttcctttggtggtagtgcccctttgaagaatggtgaatttcagaaggtgttggaaatggaatcacagaaaactatagtgataaattgcactgatgtgagcattcctgtagtagaagagacaaaaccactcatatacggaatcactgaaatgaatgatggtgctttcaaggacaagcaactttccacaaaggagattgcaacttatggattgtatctttgccccttatggtttgtcacagagtatttatcgaatgcagcgcttgcaagaactagtgttgccagtaccaccgtactgtcttcaacttcaggactcttcactcttttcattggtgttttacttggccaagactccataaatgcggcgaaagttattgctgttttcattagcatggctggcgttgtaatgacaactatgggccagacgtgggcatctgatgaatcagaagtaggcaaatctggtgctacacagaggactcttctaggtgatatgtttggtcttatgtcagcaatcgcctatggcctatttactgtgctgcttaaaaaattttgtggagaggaaggagaaaaggttgatgtccaaaaactgtttggttatcttggactttttacccttgttgctctctggtggattgtctggccattaaccgcactaggcattgagccaaagttttcaatgccccactcagctaaagtggatgaagtggtggtggcaaatagcctaatcggaagtgtactatcagactacttctgggctctttctgttgtttggactactcccttggtggccaccctaggcatgtctctcacaattccgctagcaatggttgctgatatgatcattcacggccgtcactattcagcagtatatattcttggttctgtccaggtattttcaggatttgttatcgcgaaccttgcagatcggttttcacgttctctagggctattatagtttcataaaccaaaacaggtccttattagagtgtacatctggaagctcaaagattgggttggtttgacaaatacttcagaaaacgtgggttcttttccctttgctcctttgaacataggggcggtgaattttgccgtggtgggtagtgaaagccagcgttgtagcaaccctttgcaactgtaaattctcaactgcaaattgcgcgacagtgtaaactgccgtcgttctcggccatgtccacaggcttgcacgcttgtaaatttgcaatgcccctttattccttttcgacccatgttcatggcaattgcaaagaatgaattagcaggaaaaggaactacaa

SEQ ID NO: 1530 - DNA, 1835 bp, Saccharum officinarum
cctccctccctcggggccaaaaccgccgcttcccctcctcctccgcgccgccccgccccgcgccgcttcccctccccactctttctgtgaggagggaagcgaggcggatgccgaggcgacggggctcgcgcaccgcacgcgtgtgcccgccgccccggggccaggcgaggtggtgaggtgaggccgcgcgcggttttaaattgcccgcccgcccttctcgccgtagtttttcagtgacagtggaagggaggaacgaacgtcagggctgcctgcctgcctgcctgtggacatgggctccggcctcaagtaccgagctggcctctgcctcatcgtcgccgtcgtgctgatttgggtcctctccgccgaggtcacgcaggggatattcacaaagtacaaacatccgtttgcaattacttacttgggggcctcccttatggtcatatacctccctttgtcatttctgaaggactacatatacaattcaatgagacggcattctggaaacactagtgctttaaaaattgcaagcaaatcttcttttggtggtagtgcccctttgaagaatggtgaatttcagaaggtgttggaaatggaatcacagaaaactatagtgataaattgcactgaagtgagcattcctgtagtggaagagacaaaaccactcatatacggaatcactgaaatgaatgatggcgttttgaaggacaagcaactttccactaaggagattgcaacttatggattgtatctttgccccctatggtttgtgacagagtatttatcgaatgcagcgcttgcaagaactagtgttgccagtaccaccgtactgtcttcaacttcaggactcttcactcttttcattggtgttttacttggccaagactccataaatgctgccaaagttattgctgttttcattagcatggctggcattgtaatgacaactatgggccagacttgggcatctgatgaatcagaagtaggcaaatctggtgctacacagaggaatcttctaagtgatatggttggtcttatgtcagcaatcgcctatggactatttactgtgctgcttaaaaaattttgtggagaggaaggagaaaaggttgatgtccaaaaactgtttggttaccttggactttttacccttgttgctctctggtggattgtctggccattaaccgcactaggcattgagccaaagttttcgatgccccactcagctaaagtggatgaagtggtggtggcaaatagcctaatcggaagtgtactatcagactacttctgggctctttctgttgtttggactactcccttggtggccacccttggcatgtctctcacaattccactagcaatggttgctgatatgataattcacggtcgtcactattcagcagtatatattcttggttctgtccaggtattttcaggctttgttatcgcgaaccttgcagatcggttttcacgttctctagggctattatagtttcataaaacaaaacaggtccttactagagtgtacatctggaagttcaaagatcgggttggttagacaaatagtacttcagaaaacgtggattgggtaacgtgggttcttttccctttgctccttcgaacacgggcggtgaattttgccgtgatgaatagtgaaaagccagcagatgatgaagaaaacatatgttgtagcagccctttgcaactgtaaattctcttactacacattgcgcgacagtgtaaactgccgtcgtgcttcgccatgtccacaggcttgcacgcttgtaaatttgcaatgccccttattctttgtcgatccgtgtcatggcaatgcatatccc

SEQ ID NO: 1531 - DNA, 1752 bp, Setaria italica
ctccccctccccctccgcctcggcccctcccctccccgctctttctgtgaggagggaagagaggcggatgccggggcgacggggctcgcgcgccgcaagcatgacgccgctcggggcgcgaggccgcgcgcggttttaaaatcgccccgcgcctgccttctcgccgtagtttagtcgtagagctagctgtccctgcggagtgcggacatgggctccggtctcaagtaccgggcggggctgtgcctgattgtcgccgtcgtgctcatctgggtcatctccgcggaggtcacgcaggggatattcacaaagtacaaacatccgtttgcaattacttacttgggagcctcccttatggtcatatatctccccttgtcatttctaaaagactttatatacaattcaatgagacagcattctggaaacaccggtgcttcaaaaatcacaagcaaatcttcctttggcggtagtgcccctttgaagaatggtgaatttcagaagatgttggaaatggagtcacagaaaactatagtgattcctgtagttgaagagacgaaaccacttatttacggaatcactgaaattaatgatggcatcttgaaggagaagcagctttccactaaggagattgcaacttatggactgtatctttgtcccttgtggtttgtgacagagtatttatccaatgcagcgcttgcaagaactagtgttgccagtaccactgtactgtcttcaacttcaggactcttcactcttttcattggtgttttacttggccaagactccataaatgctgcaaaaattattgctgttttcattagcatggctggtgtcgtcatgacaactatggggcagacttgggcatctgatgaatcagaagtaggcaaatctggggctacagagaggactcttctaggtgatatgtttggtcttatgtcagcgatcgcatatggtctgtttactgtgcttctcaaaaaattttgtggagaggaaggagaaaaggttgatgtccaaaaactgtttggttatcttggactttttagtcttgttgctctctggtggcttgtctggccattaaccgcactaggcatcgaaccaaagttttcaatgccccactcagctaaagtggatgaagttgtggtggcaaatggcctaatcggaagtgtattatcagactacttctgggctctttctgttgtttggactactcccttggtggccaccttaggcatgtctctcacaattccactagcaatggttgctgacatgatcattcatggtcgtcactattcagcagtatatattcttggttctgtccaggtgttttcaggcttcgttattgcaaacctcgctgatcgcttttcacgttctctaggtctatagcttcatgaaataaaacttgtccttattagagtgtacatctggaagttcaaagtttgggtttgttagacaaagaccccagaaaactctggtctctagtttcatgcggattgggaaataccagaagcacttcttttccctttgccccatggccatggggatggtgaattttgccgacgtatagtgaaaaccagcagatggaagaaagatacagtatgttgtagcaacccttcacaactgtaaattctctcaccacagaatgcttgtcgatgtatactaccgtggttctcggccatgtccacagactttgcatgcttgcaaaggcaatgttccttgattccttgtcaatttgagttcatggcaaatttactttca

SEQ ID NO: 1532 - DNA, 1502 bp, Pennisetum glaucum
ggactgcggacatgggttccggtctcaagtacagggcggggctgtgcctgattgtcgccgtcgtgctcatctgggtcatctccgccgaggtcacacaggggatatttacaaagtacagacatccgtttgcaattacttacttgggagcctcccttatggtcatttatctccccttgtcatttctaaaggactttatatacaattctataagacggcattctggaagcactggtgcttcaaaaatcacaagcaaatcttcctttggcggtagtgcccctttgaaaaatggtgaattgaagatgttggaaatggagtcacagaaaactatagtgattcctgtagtagaagagaccaaaccacttatttatggaatcaccgagattaatgatggtgccttgaaggagaagcagctttccactaaggagattgcaacttatggactgtatctttgtcccttgtggtttgtgacagagtatttgtcgaatgcagcgcttgcacgaactagtgttgccagtaccactgtactgtcttcaacatcaggactcttcactctttttattggtgttttacttggtcaagactccataaatgctgcaaagattattgctgttttcattagcatggctggtgtcgtcatgacaactatgggccagacttgggcatctgatgaatcagaagtaggcaaatctggggctacagagaggactcttctaggtgatatgtttggacttatgtcagcaatcgcatatggtctgtttactgtgcttctcaaaaaattttgtggagaggaaggagaaaaggttgatgtccaaaaactgtttggttatcttggacttttcactcttgttgctctctggtggcttgtctggccattaaccgcactaggcatcgaaccaaagttttcaatgccccactcagctaaagtggatgaagttgtggtggcaaatggcctaatcggaagtgtattatcagactacttctgggctctttctgttgtttggactactcccttggtggccaccttaggcatgtctctaacaattccaatagcaatggttgctgacatgatcattcatggtcgtcattattcagcagtgtatattcttggttctgtccaggtattttcaggattcgttattgcaaaccttgcagatcgcttttcacgttatctaggcctatagcttcatgaaataaaacaggtcatccttagagtgtacatctggaagttcaaagtttgggtatgttagacaaagaccccagaaaactctggtctctagtttcatgcggattgggaaataccagtagcactcctccctttgccccatggccatggggatggtgaattttgccgtgacgtatagtgaaaaccagcagatgaagaatgatacagtatgttgtagcaaccttcacaactgtaaattctcactacagaatgcttgtcgatgtatattaccgtggttctcggccatgtccacaggctttgcatgcttgcaaatgcaatt

SEQ ID NO: 1533 - DNA, 1701 bp, Panicum virgatum
ctcgcccttccccctccccgctctttctgtgaggagggaagagaggcggatgccgaggcgacggggctcgcgcgccgcaagcatgacgccgctcggggggcaggtgaggtagcgcgcggttttaaatcgccccgcgcctgccatctcgccatactttagtcgtagaacagctgcctgcggacatgggctccggtctcaagtaccgggcggggctgtgcctgattgtcgccgtcgtgctcatctgggtcatctccgcggaggtcacgcagggaatattcacaaagtacaaacatccatttgcaattacttacttgggggcctctcttatggtcatatatctccctttgtcatttctaaaagactttatatacaattcaatgagacggcattctggaaacaccagtgcttcaaaagtcacaagcaaatcttcctttggtggtagtgcccctttgaagaatggtgaatttcagaagatgttggaaatggagtcacagaaaactatagtgattcctgtagtagaagagacaaaaccacttatttatggaatcactgaaattaatgatggcatcctgaaggagaagcagctttctgctaaggagattgcaacttatggactgtatctttgccccttatggtttgtcacagagtatttatcgaatgcagcgcttgcaagaactagtgttgccagtaccactgtactgtcttcaacttcgggactgttcactcttttcattggtgttttactcggacaagactccataaatgctgcaaaaattattgctgttttcattagcatggctggtgttgttatgacaactatgggccagacttgggcatctgatgaatcagaagtaggcaaatctggggatacacagaggactcttctaggtgatatgtttggtctcatgtcagccatctcatatggtctttttactgtgcttctcaaaaaaatttgtggagaggaaggagaaaaggtcgatgtccaaaaactgtttggttatcttggactttttagccttgttgctctctggtggcttgtctggccattaacagcactaggcattgaaccaaagttttcaatgccccactcaacaaaagtggatgaagtggtggtggcaaatggcctaattggaagtgtattatcagactatttctgggctctttctgttgtttggactactcccttggtggccaccttaggcatgtctctcacaattccactagcaatggttgctgatatgatcattcatggtcgtcactattcagcagtctatattcttggttctgtccaggtattttcaggcttcgttattgcaaaccttgcagatcgcttttcacgttctctagggctattatagcttcatgaaaataaagcaggttcttacaagagtgtaaatctggaagctcaaagtttcggttggttaggcaaggactctggtctctagtttcatgtggattgggaattgccagtagcacctcttttccctttgccccacggggatggtgaatttttgccgtgatcaatagtgaaagccagcagatcaagaaagatacagtatgttgtagcaacccttcacaactgtaaattctctcactacggagcgcttgtcaatgcatactacgtgtttcgtggccatacccagactctgcatgcttgcaagtgcattgtgccttgattctttctcgatttgtgttcatggc

SEQ ID NO: 1534 - DNA, 2888 bp, Zea mays
ccaccgcgcaactgcttccgtcctctgccaccggggcacgccgaaagctcgcctcgcaagcgcgcggccgcgccagcacaccacgcctcgcttcgtttacccgttgcttgccgccgaatcgaccacgctggcgaccaggccagcgccatcgcatcgtccccggaccgctccggtcgcgcccgccaggcctcggggctcgggtagaccaccaccaaaacagaaccttccctccggaccgaaaccgccgcttcccctccccgctctttctgtgaggagggaagcgaggcggatgccgaggcgacggggctcgcgcaccgcactcgtgtgcccgccgcccggggaccaggcgacgtggtgactggtgaggtgaggcaagcgcgcggttttaaattccccgcacgtccttctcgccgtagttttcagtccggaggtacatcaagggaggaacaaacgtgagggctgcctgcctccggacatgggctccagcttcaagtaccgagctggcctctgcctcatcgtcgccgtcgtgctgatttgggtcatatccgcggaggtcacgcaggggatattcacaaagtacaaacatccttttgcagttacttacttgggggcctcccttatggtcatatacctccctttgtcatttctaaaggattctggaaacaccagtgcttcataaattgcaagcaaaacttcctttggtggtggtgcccctttgaagaatgacgaatttcggaagactttagtgctaaattgcactgatgtgagcattcctgtagtgaaagagacaaaaccactcatatatggaatcactgaaatgaatgatggtgttttgaaggacaagcaactttcgactaaggagattgcaacttatggattgtatctttgccccttatggtttgtgacagagtatttatcgaatgcagcgcttgcaagaactagtgttgccagtaccaccgtactgtcttcaacttcagggctcttcactcttttcattggtgttttacttggccaagactccataagtgcttcgaaagttattgctgttttcattagcatggctggcgttgtaatgacaactatgggacagacttgggcatctgatgaatcagaagtaggcaaatctggggctacacaaaggactcttctaggtgatatgtttggttttatgtcggcaatcgcgtatggtctatttactgtgctgcttaaaaaattttgtggggaggaaggagaaaaggttgatgtccaaaaactgtttggttatcttggactttttacccttgttgctctctggtggattgtctggccattaaccgcactaggcattgagccaaagttttcgatgcctcactctgctaaagtggatgaagtggtggtggcaaatagcctaattggaagtgtactatcagattacttctgggccctttctgttgtttggactactcccttggtggccacgctaggcatgtctctcacaattccactggcgatggttgcggatatgatcattcacggccgtcactattcagcagtgtatattctttgttctgtccaggtattttcaggctttgtcatcgcgagccttgcagatcggctttcacgttctctagggctattatagtttcataaaacgaagcaggttcttgttagagtgtacatctggaagtttaaaggtcgggttggttagacaaaatacttgaggaaacacgggttgggatttgggaaatgccagtaattcgtttcccttttgctcctttaaacataggagcggtgaattttgccgcggcgaatagtaaaggccagcagacgaagaagaaaccgtatattgtagcaaccctttgcaactgtatattctcctactacaaattgagcgacagtgtaaactgccgtcgttctggccttgtcgatccgtgtcgattgcaaatttgcaaatgtcacttttatatccttgtcgatccgtgttcatggcaattgcgcgagttaacaaagaatgaatgggcaaaaaaaaaaaaaaaaaaaaaaaaaacggagctacaaattgcagcgaattgaatgggcaagttgtcatactcctatgcaaagtgtgcgacaatgcaaactgaaaagtgaaaatgacttactgcacaagcaacgtcaaattcaaagtgtacatgctactagcagcttagcgagcaactgaagttctcatagtcgccatgtcggagcgagatgcgatagacggcgaaggcggcactctgtccggggtcgcgcagcagcggcgtggtgaccctgtcgacctcgaccacctcaaaaccatgctcccgcagcacgtccatgcagtccagcacgctgtcccgcacctcgctcgccgcccaccccgcggtgccgccgccgccctcgtccgtccaccacataccccgcagcgtggccgccatcgccggcatgtcctcgggatcgtagaagacgtcggacaagagcacgacgcccaccctcccgtcgccgtcgtcgagcgggagcaggtcgccccagcggagctcgcgcacgcgggcccgcgcggcgctgaggccgttggcgtccgcgttggccctgaggcccggcagcagcgcggccacgtccgtgagcacgcagcgcgcggcgccgaggcaggccacggcggcgatgcccgggagccccgtgccggcgccgagctccacgacggtggcgccacggaggcggcgcctggcgcgggggtccgcggcgaggtgcgcggccaggaccagggacgactcccacagccaggagccggtgaggacgcggcccgtggccgggtcgctcgtgccgtcgcgctccaccaccgccagcgcgcgcccggccacggctacgtgcaggacctgcgggcacagcgcgtccattcccgttcccgcgcgcgg

SEQ ID NO: 1535 - DNA, 3021 bp, Oryza sativa
caggtacacaaggccccatcaatctcgcttccgccgcagcacaacaccgaaggcgacgcacgccgggctccccgcgcggccgcgtcccgcatccacaagtcgacaacagcaacggccgcccccgtcccactcccaccgacaccggcagtgcggcacaccgccaatcccaccacccacacgccacacgcccaaaacaccccgaatcgcacgccaaaaactcgcaatcccgccgtcccgccccgcgcccgtcgttccgttccgcctccgccgcgctgcccgcctcggtgcggcgtgggacgaaaattagaaacttccaccggtaggtcacgcccgctttaccccacccacctcgcctcgtccccctcctcctcgcctcgcatcccctctctcttttcgtgagcagggaagagcatcccctctctcttttcgtgagcagggaagagggggggggggggggggacgggcgggcgggcgatgaggcgaggaggggcgccgcggagctcacccaccgagagccgcgccgcaagcatgctgcctctcggtgaggaggggtgctagccccgccgctgcccgcgcggttaaattgctcgccgcgccccgcacccgcactcactccaccaccaggcggggcaagaggagagggttggattgatatgggttccaatctcaagtaccgtgctggcctcgtcctcatcgtcgccgtggtgctcatatgggtcacctccgcggaggtcacgcaggggatattcactaaatacaagcaaccctttgcaattacttacctgggggcctcccttatgatcatctatatacctctttcatttttaaaggattttatatgtaatttgttgagaaggtcttcttcaagtagtagagtttcaaaagttaccaacaaatcttctttcggtggttgtgctcctctgaagaatggtgaattccagaagatgttggaaatggaatctcaaaaaactatagtcataaactatactgatgtggatattcctgtaatagaagagacaaaacctcttatatgtggaatcactgaattcgatgacgttttgaaggagcaagaactttccactaaggagattgcaatgtatgggttgtatctttgtcccatatggtttgtgacggagtacttgtcaaatgcggcacttgcaagaactagtgttgctagtactactgtactatcttcaacgtcaggactcttcactcttttcattggtgtgctacttggccaagattctataaatgctgcaaaagttattgctgtttttattagcatggctggtgtggtaatgacaaccatggggcagacttgggcatcagatgaatcagaaatcagcaattctggtgccactcagagaactcttctaggtgacatgtttggtcttctgtcagctatgtcatatggtttattcactgtgcttctaaaaaagtttgctggagaggaaggagaaaaggttgatgtccaaaaactgtttggctacctcggacttttcagtcttgttcttctctggtggcttgtctggccattgaccgcattaggcattgaaccaaagtttacaataccccactcagccaaagtggatgaagtggtgttggcaaatggccttattggaagtgtattgtcagactacttctgggctctttctgttgtttggactactcctttggtggccaccttgggcatgtcactcacaattccactagcaatggtggctgatatgatcattcatggtcgtcgttattcagcggtctatatctttggttctgtccaggtattttctgggtttgtcattgcaaatcttgcggatcgcttttcacgttttctagggctctagtgtcacgaaatcaaccaggttttattagagtgtacatctgtgtggatcgttagacaaatacccttgtttcataagattgcgaaaatgttactgtagttttttttttctcttggccctttacacacaggaatggaaaatttttgtggcggtgaaatagaaaagagtgacttgaagaaactttatgctgtagcaacccttgcaactgtaaattcttttgctataaaatccttctcaatgtatactactgtagcttcctacagtagacttgcatatattaattgctatgtctttgtccccttgactcattgtggaacatttacaagtcctgcaaccgagaagaaagtacgtacaaaatggccttttggaaaataaaaggtcaaaggtgattctggtgccgttacaagcttggctttactgttacagagtgaaagtcaacacccggctgtagttatcggcgttggattggagacgatggacggcgaagttgtccggcgaaaaagacgatagacggcgaagtcggcggcctgctcggggtcgcgcagcagcggcctagtgaccctgtctacctcgaccacctcgaagccttgctctcgcagcacgtcgatacagtcctgcacgccgtcgcgcgcctcgctcgccgcccaccccaccgtgccgccgccgtcgctgtcgctgtcgccgtctcgccatagcccatgcagcgtgtccgccatcgccggcatgtcgtccgggtcgtagaacacgtcggacatgagcaccacgtccacctggacctcgggctcgaggtgcccaccccaccggagctcacgcacgtccgcctgctcggcggtgagcccgttggcgtcggcgttggccctgaggccggggaggagcgggcgcacgtcggtgagcacgcagcgcgcggcgccgaggcaggcgacggcggcgatgcccgggaggcccgtgccggcgccgagctcgaggacggtggcgccacggaggtggtggtggtggacgcaggacgcgaggtgggaggcgaggacgagggaggagtcccagagccatgagccggtgagcgcgcgccccgtggccgggtcgtgcgtgccgtcgcgctcagccacggccagcgtgcgcccggccacggctacgtgcagcgcggcgtccataatctcggtggctaccacctccatcatctcca

SEQ ID NO: 1536 - DNA, 3079 bp, Oryza sativa
aggccccatcaatctcgcttccgccgcagcacaacaccgaaggcgacgcacgccgggctccccgcgcggccgcgtcccgcatccacaagtcgacaacagcaacggccgcccccgtcccactcccaccgacaccggcagtgcggcacaccgccaatcccaccacccacacgccacacgcccaaaacaccccgaatcgcacgccaaaaactcgcaatcccgccgtcccgccccgcgcccgtcgttccgttccgcctccgccgcgctgcccgcctcggtgcggcgtgggacgaaaattagaaacttccaccggtaggtcacgcccgctttaccccacccacctcgcctcgtccccctcctcctcgcctcgcatcccctctctcttttcgtgagcagggaagagcatcccctctctcttttcgtgagcagggaagagggggggggggggggggacgggcagggcgggcgatgaggcgaggaggggcgccgcggagctcacccaccgagagccgcgccgcaagcatgctgcctctcggtgaggaggggtgctagccccgccgctgcccgcgcggttaaattgctcgccgcgccccgcacccgcactcactccaccaccaggcggggcaagaggagagggttggattgatatgggttccaatctcaagtaccgtgctggcctcgtcctcatcgtcgccgtggtgctcatatgggtcacctccgcggaggtcacgcaggggatattcactaaatacaagcaaccctttgcaattacttacctgggggcctcccttatgatcatctatatacctctttcatttttaaaggattttatatgtaatttgttgagaaggtcttcttcaagtagtagagtttcaaaagttaccaacaaatcttctttcggtggttgtgctcctctgaagaatggtgaattccagaagatgttggaaatggaatctcaaaaaactatagtcataaactatactgatgtggatattcctgtaatagaagagacaaaacctcttatatgtggaatcactgaattcgatgacgttttgaaggagcaagaactttccactaaggagattgcaatgtatgggttgtatctttgtcccatatggtttgtgacggagtacttgtcaaatgcggcacttgcaagaactagtgttgctagtactactgtactatcttcaacgtcaggactcttcactcttttcattggtgtgctacttggccaagattctataaatgctgcaaaagttattgctgtttttattagcatggctggtgtggtaatgacaaccatggggcagacttgggcatcagatgaatcagaaatcagcaattctggtgccactcagagaactcttctaggtgacatgtttggtcttctgtcagctatgtcatatggtttattcactgtgcttctaaaaaagtttgctggagaggaaggagaaaaggttgatgtccaaaaactgtttggctacctcggacttttcagtcttgttcttctctggtggcttgtctggccattgaccgcattaggcattgaaccaaagtttacaataccccactcagccaaagtggatgaagtggtgttggcaaatggccttattggaagtgtattgtcagactacttctgggctctttctgttgtttggactactcctttggtggccaccttgggcatgtcactcacaattccactagcaatggtggctgatatgatcattcatggtcgtcgttattcagcggtctatatctttggttctgtccaggtattttctgggtttgtcattgcaaatcttgcggatcgcttttcacgttttctagggctctagtgtcacgaaatcaaccaggttttattagagtgtacatctgtgtggatcgttagacaaatacccttgtttcataagattgcgaaaatgttactgtagttttttttttctcttggccctttacacacaggaatggaaaatttttgtggcggtgaaatagaaaagagtgacttgaagaaactttatgctgtagcaacccttgcaactgtaaattcttttgctataaaatccttctcaatgtatactactgtagcttcctacagtagacttgcatatattaattgctatgtctttgtccccttgactcattgtggaacatttacaagtcctgcaaccgagaagaaagtacgtacaaaatggccttttggaaaataaaaggtcaaaggtgattctggtgccgttacaagcttggctttactgttacagagtgaaagtcaacacccggctgtagttatcggcgttggattggagacgatggacggcgaagttgtccggcgaaaaagacgatagacggcgaagtcggcggcctgctcggggtcgcgcagcagcggcctagtgaccctgtctacctcgaccacctcgaagccttgctctcgcagcacgtcgatacagtcctgcacgccgtcgcgcgcctcgctcgccgcccaccccaccgtgccgccgccgtcgctgtcgctgtcgccgtctcgccatagcccatgcagcgtgtccgccatcgccggcatgtcgtccgggtcgtagaacacgtcggacatgagcaccacgtccacctggacctcgggctcgaggtgcccaccccaccggagctcacgcacgtccgcctgctcggcggtgagcccgttggcgtcggcgttggccctgaggccggggaggagcgggcgcacgtcggtgagcacgcagcgcgcggcgccgaggcaggcgacggcggcgatgcccgggaggcccgtgccggcgccgagctcgaggacggtggcgccacggaggtggtggtggtggacgcaggacgcgaggtgggaggcgaggacgagggaggagtcccagagccatgagccggtgagcgcgcgccccgtggccgggtcgtgcgtgccgtcgcgctcagccacggccagcgtgcgcccggccacggctacgtgcagcgcggcgtccataatctcggtggctaccacctccatcatctccatggcattctaaccttcatatgcttcttctaatcttaattagatggggctcgttgtactactaataat

SEQ ID NO: 1537 - DNA, 1808 bp, Triticum aestivum
aaaactgttctcctcctccgcctcgtggaagccgactctctttccgtggggagcgaagcggggcgggcgatgaggccgggggcgccaacgcggagctcacccacccagtccaccgcaagcatgtggccgggcaggtgaactccactcccccgctctccccacgcgccgcgcggttaaattgctcgcctcctccaccccgcagaccgcagcaggagaggccgatcgagccgcggcggcatgggtcccaacctcaagtaccgggctgggctcgtcctcatcgtcgccgtcgtgctcatatgggtcacctccgccgaggtcacgcaggggattttcgctaactacaagcaaccattcgcaattacttacttgggggcctcccttatggtgatctacatcccgttggcatttctgaaggattttatatacagattgctgagaaggaattctggaagcagcaaggcctcaaaaatcgcgagcaaatcttcatttggcggtagcgctcctctgaagaatggtgaatttcagaagatgctggaaatggaaccacagaaaaccgtggtgataaaaattactgatgtggacattcctgtactagaagagacgaaaccactcatctgtggaattggtgaatgtgagggtggggttttgaaggagcaacagctttccaccaaggagattgcaatttatgggttgtatctttgtcccatatggtttgtcacagagtatttgtcaaatgcggcacttgcaagaaccagtgtggcaagcactactgtactatcttcaacttcgggactcttcacccttttcattggtgtgctactgggccaagattccataaatgctgccaaagttattgctgtttttgttagcatggctggtgtggcaatgacaactatgggccagacttgggcaacagatgaatcagaagtaagcaattcaggggccacacagaggactcttctaggagacatgtttggtcttatgtcagctatgtcatatggtctattcacagtgcttctcaaaaagtttgctggaggagaaggatcagaaaaggttgatgtccaaaaattgtttggttttctcggacttttcagtctttgtcttctctggtggcttgtgtggccattaactgcacttggcattgagccaaagtttacaatgccccactcagctaaagtggatgaagtggtgctggcaaacggccttattgggagtgtgctatcagactacttttgggctctttccgtggtttggactaatcccttggtggccacgttaggcatgtcgctcacaattccactagcgatggttgctgacatggtcatccacggccgacattattcagcagtctacatttttggctctgtccaggtattttctgggttcgtcatcgccaatcttgccgaccgcgtttcacgtttcttaggtctatagtcgtgaaatgtacaaggttgaatcgtagtgtacatctggaaggttgggtagggttagtaacgaagtgtacattgggtgtttgggttagttagttataaggacagctctgtcttctctgtaaatcataaggatgggggaaatggcactgcagctctgtttcctttttaccttcggccccctttacacgcaggaatggataattttggtgtggtggaattgaaacagtgaaagcttagcatacgtaaggaacattatgaatttatgatctcgtggcagacctttgaaactgtaaattcttagcttttgctatgctatgttaacgcctgtatagcgcaaaaattttcagcgctctcacagaaaaagaaattaaataa

SEQ ID NO: 1538 - DNA, 1692 bp, Triticum aestivum
cctcgtggaactcgactctctttccgtggggagcgaagagggggcgggcgatgaggccgggggcgccaacgcggagctcacccacccagtccaccgcaagcatgtggccgggcaggtgaactccactgccccgctctccccccgcgccgcgcggttaaattgctcgcctccgccgccacctcctcccgcacagcagcagcaggagtggccgatcgagtcgcggcggcatgggtcccaacctcaagtaccgggctgggctcgtcctcatcgtcgccgtcgtgctcatatgggtcacctccgccgaggtcacgcaggggatattcgctaactacaagcaaccattcgcaattacttacttgggggcctcactcatggtcatctacatcccattggcatttctaaaggatttcatatacagattgttgagaaggaattctggaagcagcaaagcctcaaaaatcgcgagcaaatcttcatttggcggtagtgctcctctgaagaatggtgaatttcagaagatgctggaaatggaaccacagaaaaccgtggtgataaaaattactgatgtggaccttcctgtactagaggagacaaaaccacttatttgtggaattggtgaatgtgagggtgaggttttgaaggagcaacagctttccaccaaggagattgcaatttatggactgtatctttgtcccatatggtttgtcacagagtatttgtcaaatgctgcacttgcaagaactagtgtcgcaagcactactgtactatcttcaacttcgggactcttcacccttttcatcggtgtgctacttggccaagattccataaatgctgccaaagttattgccgtttttgttagcatggctggtgtggcaatgacaactatgggccagacttgggcaacagatgaatcagaagtaagcaattcaggggccacacagaggactcttctaggagacatgtttggtcttatgtcagctatgtcatatggtcttttcactgtgcttctcaaaaagtttgctggaggagaaggatcagaaaaggttgatgtccaaaaactgtttggttttctcggacttttcagtctttgtcttctctggtggcttgtctggccattaactgcacttggcattgagccaaagtttacaatgccccactcagctaaagtggatgaagtggtgctggcaaatggcctcattgggagcgtgctatctgactacttctgggctctttccgtggtttggactaatcccttggtggccacgttaggcatgtcgctcacaattccactagcgatggttgctgacatggtcatccacggtcgacattattcagcagtctacatttttggctctgtccaggtattttctgggttcgtcatcgccaatcttgccgaccgcgtttcacgtttcttaggtctatagccttgaaatctacaaggttgaatcggagtgtacatctggaaggttggatagggttagttacgaagtgtacattggatgtttgggttagttagttaaggacaactctgtcttctctgtaaatcataaggatgggggaaatggcattgcagctctgtttcctttacacgcaggaatggataattttggtgtggtggaattgaaacagtgaaagcttagcatacataaggaacattatggatgctgggcaaaccttggaactgtaaattct

SEQ ID NO: 1539 - DNA, 1716 bp, Triticum aestivum
cgcggagctcacccacccagtccaccgcaagcatgtggccgggcaggtgaactccactgccccgctctccccccgcgccgcgcggttaaattgctcgcctccgccgccacctcctcccgcacagcagcagcaggagtggccgatcgagtcgcggcggcatgggtcccaacctcaagtaccgggctgggctcgtcctcatcgtcgccgtcgtgctcatatgggtcacctccgccgaggtcacgcaggggatattcgctaactacaagcaaccattcgcaattacttacttgggggcctcactcatggtcatctacatcccattggcatttctaaaggatttcatatacagattgttgagaaggaattctggaagcagcaaagcctcaaaaatcgcgagcaaatcttcatttggcggtagtgctcctctgaagaatggtgaatttcagaagatgctggaaatggaaccacagaaaaccgtggtgataaaaattactgatgtggaccttcctgtactagaggagacaaaaccacttatttgtggaattggtgaatgtgagggtgaggttttgaaggagcaacagctttccaccaaggagattgcaatttatggactgtatctttgtcccatatggtttgtcacagagtatttgtcaaatgctgcacttgcaagaactagtgtcgcaagcactactgtactatcttcaacttcgggactcttcacccttttcatcggtgtgctacttggccaagattccataaatgctgccaaagttattgccgtttttgttagcatggctggtgtggcaatgacaactatgggccagacttgggcaacagatgaatcagaagtaagcaattcaggggccacacagaggactcttctaggtgacatgtttggtcttatgtcagctatgtcatatggtcttttcactgtgcttctcaaaaagtttgctggaggagaaggatcagaaaaggttgatgtccaaaaactgtttggttttctcggacttttcagtctttgtcttctctggtggcttgtctggccattaactgcacttggcattgagccaaagtttacaatgccccactcagctaaagtggatgaagtggtgctggcaaatggcctcattgggagcgtgctatctgactacttctgggctctttctgttgtttggactaatcccttggtggccacgttaggcatgtcgctcacaattccactagcgatggttgctgacatggtcatccacggtcgacattattcagtagtctacatttttggctctgtccaggtattttctgggttcgtcatcgccaatcttgccgaccgcgtttcacgtttcttaggtctatagccttgaaatctacaaggtggaatcggagtgtacatctggaaggttcgatagggttagttacgaagtgtacattggatatttgggttagttagttaaggacaactctgtcttctctgtaaatcataaggatgggggaaatggcactgcagctctgtttcctttttaatttcggccccctttacacgcaggaatggataattttggtgtggtggaattgaaacagtgaaagattagcatacgtaaggaacattatgatgttgtggcagacctttgcaactgtaaattattagcttttgctacgaaatgctctgtcaacgcgtactgtatagcgctgaaattttcagcgccctctcacagaaaa

SEQ ID NO: 1540 - DNA, 1920 bp, Triticum aestivum
ccaccacctcgccccgatcccctccaaaaaactcgccaccttcgccgtgcgcgtgcgctcccgtcgcttgactcctcgtctggctccaatcgagtgaaacttccggtggtaggtcaccccggctttacccacccaccccgcccccaaaacccgttctcctccctcctcgccgaacccctctctctttccgtggggagcgaagcggggcgggcgatgagccgggggcgccaacgcggagctcacccactcagtccaccgcaagcatgtggccgggcaggtgaactccactccccagctccccacacgcgcgcggttaaattgctcgcctccgccgcctcttcctcccgcacagcagcagcaggatcggagggcgagtcgcggcggcatgggtcccaacctcaagtaccgggccgggctggtcctcatcgtcgccgtcgtgctcatatgggtcacctccgccgaggtcacgcaggggatattcgctaactacaagcaaccatttgcaattacttacttgggggcctcccttatggtcatctacatcccgttggcatttctcaaggattttatatacagattgttgagaaggaattctggaagcagcaaagcctcaaaaatcgcgagcaaatcttcctttggcggcagcgctcctctgaagaatggtgaatttcacaagatgctcgaaatggaaccacagaaaaccgtggtgataaaaattactgatgtggaccttcctgtactagaagagacgaaaccgcttatttgtggaattggtgaatgtgagggtgaggttttgaaggagcaacagctttccaccaaggagattgcaatttatgggttgtatctttgtcccatatggtttgttacagagtatttgtcaaatgctgcacttgcaagaactagtgtggcaagcactactgtactatcttcaacttcggggctcttcacccttttcattggtgtgctacttggccaagattccataaatgctgccaaagttattgctgtttttgttagcatggccggtgtagcaatgacaactatgggccagacttgggcaacagatgaatcagaagtaagcaattcaggggccacacagaggactcttctaggtgacatgtttggtcttatgtcagctatgtcatatggtctattcactgtgcttctcaaaaagtttgctggaggagaaggatcagaaaaggttgatgtccaaaaactgtttggttttctcggacttttcagtctctgtcttctctggtggcttgtgtggccattaactgcacttggcattgagccaaagtttacaatgccccactcagctaaagtggatgaagtggtgctggcaaatggccttattgggagcgtgctatcggactacttctgggctctttccgtggtttggactaatcccttggtggccacgttaggcatgtcgctcacaattccactagcaatggttgctgacatggtcatccacggtcgacattattcagcagtctacatttttggctctgtccaggtattttctgggttcgtcatcgccaaccttgccgaccgcgtttcacgtttcttaggtctatagccttgaaatctacaaggttgaaatcggagtgtacatctggaaggttggatagggttagttacgaagtgtacattggacgtttgggttagttagttaaggacaactctgtcttctctgtaaatcataaggatgggggaaatggcactgcagctctgtttcctttacacgcaggaatggataattttggtgtggtggaattgaaacagtgaaagattagcatacgtaaggaacattatgatgttgtggcagacctttgcaactgtaaattattagcttttgctacgaaatgctctgtcaacgcgtactgtatagcgctgaaattttcagcgccctctcac

SEQ ID NO: 1541 - DNA, 1985 bp, Hordeum vulgare
gatcacaccgagagcggccccgtccgcatccgcccggacagcaacgcccgccccgcccgtatccggcacctccaagaacttgatccagccccgccgacaccgcccgccaccccgactcccccgcggcaacggctgaaataccccaccccacaccacgccaccccaccccagcgcgcgcgccaccgcccccaagaaaactcgccaccttcgccgcgcccgcgcgcgcgtgcgctgcccgtcgcttcactcctcgtctgccttccagtggaaacttccggtggtaggtcgcccgggctttaccccacccccaaaaccgtcctcctcctcctcctcctcgtggaacccgatcgactctctttccgtggggagggaagcggggcgggcgatgaggccgggggcgccaacacccacccagtccaccgcaagcatgtggccgggcaggtgaactccgctcccccactccccacgcgcgcgcggcgcggttaaattgctcgcctccgccgcagcaccgcagcagcaggagaggccgatcgagtcgcggcggcatgggcatggctcccaatctcaagtaccgggctgggctcgtcctcatcgtcgccgtcgtgctcatatgggtcacctccgccgaggtcacgcaggggatattcgctagctacaagcaaccgttcgcaattacttacttgggggcctcccttatggtcatctacatcccgttggcatttctaaaggatttcatatacaaattgttgagagggcattctggaagcagcaaagcctcaaagatcgcaagcaaatcttcctttggcggtagcgctcctgtgaagaatggtgaatttcagaagatgctggagatggaaccacagaaaaccgtggtgataaaaattactgatgtggaccttcctgtactagaagagacaaagccacttatttgtggaattggtgaatgtgagggtgatgttttgaaggagcaacagctttccactaaggagattgcaatttacggactgtatctttgtcccatatggtttgttacagagtatttgtcaaatgcagcacttgcaagaactagtgtggcaagcactactgtactatcttcaacttcgggactcttcacccttttcattggtgtgctacttggccaagactccataaatgctgccaaagttattgccgtttttgttagtatggctggtgtggcaatgacaactatgggccagacttgggcaacagatgaatcagaagtaagcaattcaggggccacacagaggactcttctaggtgatatgtttggtcttatgtcagctatgtcatatggtctattcactgtgcttctcaaaaagtttgctggaggagaaggatcagaaaaggttgatgtccaaaaactgtttggttttctcggacttttcagtctttgtcttctctggtggcttgtctggccattaactgcacttggcattgagccaaagtttacaatgccccactcagctaaagtggatgaagtggtgctggcaaacggcctcattggaagtgtgctatctgactacttctgggctctttctgttgtttggactaatcccttggtggccacgttaggcatgtcactcacaattccactagcaatggttgctgacatggtcatccacggtcgacattattcagcagtctacatttttggctctgtccaggtattttctgggttcgtcatcgccaatcttgccgaccgcgtctcacgtttcttaggcctatagtcgtcgtgaaatgtacaaggtcgaatcggagtgtacatctggaaggttggatagagttagttacgaagtgtacattggatgtttgggttagttagttatacaaggacaactctgtcttctctgtaaatcataaggatgggggaaatggcactgcagctctgttccccttttacctttggccccgtttacacgcaggaatggataattttggtgtggtggaatagaaacagtcaaagc

SEQ ID NO: 1542 - DNA, 2220 bp, Hordeum vulgare
gatcccaccgagggcggccccgtccgcatccgcccggacagcaacgcccgccccgtccgtatccggcacctccaagaacttgatccagccccgaccgacaccgcccgccaccccgactcccccgcggcaacggctgaaataccccaccccacaccacaccaccccagcgcgcgcgccaccgcccccaagaaaactcgccaccttcgccgcgcccgcgcgcgcgtgcgctgcccgtcgcttcactcctcgtctgccttccagtggaaacttccggtggtaggtcgcccgggctttaccccacccccaaaaccgtcctcctcctcctcctcgtggaacccgatcgactctctttccgtggggagggaagcggggcgggcgatgaggccgggggcgccaacacccacccagtccaccgcaagcatgtggccgggcaggtgaactccgctcccccactccccacgcgcgcgcggcgcggttaaattgctcgcctccgccgcagcaccgcagcagcaggagaggccgatcgagtcgcggcggcatgggcatggctcccaatctcaagtaccgggctgggctcgtcctcatcgtcgccgtcgtgctcatatgggtcacctccgccgaggtcacgcaggggatattcgctagctacaagcaaccgttcgcaattacttacttgggggcctcccttatggtcatctacatcccgttggcatttctaaaggatttcatatacaaattgttgagagggcattctggaagcagcaaagcctcaaagatcgcaagcaaatcttcctttggcggtagcgctcctgtgaagaatggtgaatttcagaagatgctggagatggaaccacagaaaaccgtggtgataaaaattactgatgtggaccttcctgtactagaagagacaaagccacttatttgtggaattggtgaatgtgagggtgatgttttgaaggagcaacagctttccactaaggagattgcaatttacggactgtatctttgtcccatatggtttgttacagagtatttgtcaaatgcagcacttgcaagaactagtgtggcaagcactactgtactatcttcaacttcgggactcttcacccttttcattggtgtgctacttggccaagactccataaatgctgccaaagttattgccgtttttgttagtatggctggtgtggcaatgacaactatgggccagacttgggcaacagatgaatcagaagtaagcaattcaggggccacacagaggactcttctaggtgatatgtttggtcttatgtcagctatgtcatatggtctattcactgtgcttctcaaaaagtttgctggaggagaaggatcagaaaaggttgatgtccaaaaactgtttggttttctcggacttttcagtctttgtcttctctggtggcttgtctggccattaactgcacttggcattgagccaaagtttacaatgccccactcagctaaagtggatgaagtggtgctggcaaacggcctcattggaagtgtgctatctgactacttctgggctctttctgttgtttggactaatcccttggtggccacgttaggcatgtcactcacaattccactagcaatggttgctgacatggtcatccacggtcgacattattcagcagtctacatttttggctctgtccaggtattttctgggttcgtcatcgccaatcttgccgaccgcgtctcacgtttcttaggcctatagtcgtgaaatgtacaaggtcgaatcggagtgtacatctggaaggttggatagagttagttacgaagtgtacattggatgtttgggttagttagttatacaaggacaactctgtcttctctgtaaatcataaggatgggggaaatggcactgcagctctgttccccttttacctttggccccgtttacacgcaggaatggataattttggtgtggtggaatagaaacagtcaaagcttggcatacgtaaggaacattatgttgttgtggtagacctttgcaactgtaaatcatttgctttggctactaaatgctctgtcaacgcgcactgtctagcgctgaaattttcagcaccctctcaaaaatatatctttgggcaccatactttatgtgtgataggactgcatttcaagataaaacatcttggtactcgttctataaagtttgtgtgcatccctaagttggtgtagagaccgggaaat

SEQ ID NO: 1543 - DNA, 1855 bp, Secale cereale
cgggcggccgccgcgccctgcggtccccgtcgcttgactccgaatccgcaacgcgggagccaccccgtagcaggggcgccgtacgcctacgtctgcctcgaatcgagtagaaacttccggtgtaggtcaccccggctttacccgccccccaaaaaccgttctcctcctcctccccgaacccctctctctttccgtggggagcgaagcggggcgggcgatgagccgatgagccgggggcgccaccgcggagctcacccacccagtccaccgcaagcatgtgccgggcaggtgaactccactccgccactccccacgctccgcgcggttaaattgctcgctttcgccgcctcttcctcctccccgcagtacagaggccgatcgagtcgcagcggcatgggtcccaacctcaagtaccgggccgggctcgtcctcatcgtcgccgtcgtgctcatatgggtcacctccgccgaggtcacgcaggagatattcgctagctacaagcaaccgttcgcaattacttacttgggggcctccctcatggtcatctacatcccgttggcatttctgaaggattttttatacagattgttgagaaggaattctggaagcagcaaagcctcaaaagtcgcgagcaaatcttcctttggcggtagcgctcctctgaagaatggtgaatttcagaagatgctggaaatggaaccacagaaaaccgtggtgataaaaattactgatgtggaccttcctgtactagaagagacgaaaccactcatctgtggaattggtgaatgtgagggtgatgttttgaaggagcaacagctttccaccaaggagattgcaatttatgggttgtatctttgtcccatatggtttgtcacagagtatttgtcaaatgcagcacttgcaagaactagtgttgcaagcactactgtactatcttcaacttcgggacttttcacccttttcatcggtgtgctacttggccaagactccataaatgctgccaaagttattgctgtttttgttagcatggccggtgtagcaatgacaactatgggccagacttgggcaacagatgaatcagaagtaagcaattcaggggccacacagaggactcttctaggtgacatgtttggtcttatgtcagctatgtcatatggtctattcactgtgcttctcaaaaagtttgctggaggagaaggatcagaaaaggttgatgtccaaaaactgtttggttttctcggacttttcagtctttgtcttctctggtggcttgtgtggccattaactgcacttggcattgagccaaagtttacaatgccccactcagctaaagtggatgaagtggtgctggcaaacggccttattgggagtgtgctatcagactacttttgggctctctctgttgtttggactaatcccttggtggccacgttaggcatgtcgctcacaattccactagcgatggttgctgacatggtcatccacggtcgacattattcagcagtctacatttttggctctgtccaggtattttctgggttcgtcatcgccaaccttgccgaccgcgtttcacgtttcttaggtctatagccttgaaatctacaaggtggaatcggagtgtacatctggaaggttcgatagggttagttacgaagtgtacattggatgtttgggttagttagttataaggacaactctgtcttctctgtaaatcacaaggatgggggaaatggcactgcagctctgttttcgcttgacctttggtccccctttacacgcaggaatggataattttggtgtggtggaattgaaacagtgaaagcttagcatacgtaaggaacattatgatgttgtg

SEQ ID NO: 1544 - DNA, 1837 bp, Secale cereale
agtagaaacttccggtggtaggtcaccccggctttaccccgcccccaaaaccgttctcctccctcctcctcctcgaacccctctctctttccgtggggagcgaagcggggcgggcgatgagccgatgaggccgggggcgccaccgcggagctcacccacccagtccaccgcaagcatgtggccgggcaggtgaactccactccgccactccccacgcgcgcgcggttaaattgctcgcctccgccgcctcctcctcctccccccgcacagcagcagcaggatcggagggcggcatgggtcccaacctcaagtaccgggccgggctggtcctcatcgtcgccgtcgtgctcatatgggtcacctccgccgaggtcacgcaggagatattcgctagctacaagcaaccgttcgcaattacttacttgggggcctccctcatggtcatctacatcccgttggcatttctgaaggattttttatacagattgttgagaaggaattctggaagcagcaaagcctcaaaagtcgcgagcaaatcttcctttggcggtagcgctcctctgaagaatggtgaatttcagaagatgctggaaatggaaccacagaaaaccgtggtgataaaaattactgatgtggaccttcctgtactagaagagacgaaaccgcttatttgtggaatcggtgaatgtgagggtgatgttttgaaggagcaacagctttccaccaaggagattgcaatttatgggttgtatctttgtcccatatggtttgtcacagagtatttgtcaaatgcagcacttgcaagaactagtgtcgcaagcactaccgtactatcctcaacttcgggactcttcacccttttcattggtgtgctactgggccaagactccataaatgctgccaaagttattgctgtttttgttagcatggccggtgtagcaatgacaactatgggccagacctgggcaacagatgaatcagaagtaagcaattcaggggccacacagaggactcttcttggcgacatgtttggtcttatgtcagctatgtcatatggtctattcactgtgcttctcaaaaagtttgctggaggagaaggatcagaaaaggttgatgtccaaaaattgtttggttttctcggacttttcagtctctgtcttctctggtggcttgtctggccattaactgcacttggcattgagccaaagtttacaatgccccactcagctaaagtggatgaagtggtgttggcaaacggcctcattggaagtgtgctatcggactacttttgggctctctccgtggtgtggactaatcccttggtggcaacgttaggcatgtcgctcacaattccactagcgatggttgctgacatggtcatccacggtcgacattattcagcagtctacatttttggctctgtccaggtattttctgggttcgtcatcgccaaccttgccgaccgcgtttcacgtttcttaggtctatagccttgaaatctacaaggtggaatcggagtgtacatctggaaggttcgatagggttagttacgaagtgtacattggatgtttgggttagttagttataaggacaactctgtcttctctgtaaatcacaaggatgggggaaatggcactgcagctctgttttcgcttgacctttggccccctttacacgcaggaatggataattttggtgtggtggaattgaaacagtgaaagcttagcatacgtaaggaacattatgatgttgtggcagacctttgctaactgtaaattcttagcttttgctacaaaacgctctgtcagcgcgtactgtatagcgctgaaatttttca

SEQ ID NO: 1545 - DNA, 1683 bp, Secale cereale
ctccctcctcctcccgaaccccctctctctttccgtggggagcgaagcgggcgggcgatgagccgatgagccgggggcgccaccgcggagctcacccaccccagtccaccgcaagcatgtggccgggcaggtgaactccactccgctactccccacgctccgcgcggttaaattgctcgctttcgccgcctcttcctcctccccgcagtacagaggccgatcgagtcgcagcggcatgggtcccaacctcaagtaccgggccgggctcgtcctcatcgtcgccgtggtgctcatatgggtcacctccgccgaggtcacgcaggagatattcgctagctacaagcaaccgttcgcaattacttacttgggggcctccctcatggtcatctacatcccgttggcattcctaaaggatttttatacagattgttgagaaggaattctggaagcagcaaagcctccaaaatcgcgagcaaatcttcatttggcggtagcgctcctctgaagaatggtgaatttcagaagatgctggaaatggaaccacagaaaaccgtggtgataaaaattactgatgtggaccttcctgcactagaagagacgaaaccgcttatttgtggaatcggtgaatgtgagggtgatgctttgaaggagcaacagctttccaccaaggagattgcaatttacggattgtatctttgtcccatatggtttgtcacagagtatttgtcaaatgcagcacttgcaagaactagtgttgcaagcactactgtactatcctcaacttcgggactcttcacccttttcatcggtgtgctacttggccaagactccataaatgctgccaaagttattgccgtttttgttagcatggctggtgtggcaatgacaactatgggccagacttgggcaacagatgaatcagaagtaagcaattcaggggccacacagaggactcttcttggcgacatgtttggtcttatgtcagctatgtcatatggtctattcactgtgcttctcaaaaagtttgctggaggagaaggatcagaaaaggttgatgtccaaaaactgtttggttttctcggacttttcagtctttgtcttctctggtggcttgtgtggccattaactgcacttggcattgagccaaagtttacaatgccccactcagctaaagtggatgaagtggtgctggcaaatggccttattggaagtgtgctgtcggactacttttgggctctttccgttgtttggactaatcccttggtggccacgttaggcatgtcgctcacaattccactagcgatggttgctgacatggtcatccacggtcgacattattcagcagtctacatttttggttctgtccaggtattttctgggtttgtcatcgccaacctcgccgaccgcgtttcacgtttcttaggtctatagccttgaaatctacaaggtggaaatcggagtgtacatctggaaggtcggatagggttagttacgaagtgtacattggatgtttgggttagttagtcatggacagctctgtcttctctgtaaatcataaggatgggggaaatggcactgcagctctgttttctctcgacctttgcccccctttacacgcaggaatggataattttggtgtggtgaaatggaaacagtgaaagctaagcacacgaaggaacatta

SEQ ID NO: 1546 - DNA, 1661 bp, Secale cereale
acccctctctctttccgtggggagcgaagcggggcgggcgatgagccgatgaggccggggctgccgcggagctcacccacccagtccaccgcaagcatgtggcggggcaggtgaactccactccccgactccccacgcgcgcgcggttaaattgctcgcctccgccgcctcctcctcctccccccgcacagcagcagcaggatcggagggcggcatgggtcccaacctcaagtaccgggccgggctggtcctcatcgtcgccgtcgtgctcatatgggtcacctccgccgaggtcacgcaggagatattcgctagctacaagcaaccgttcgcaattacttacttgggggcttccctcatggtcatctacataccgttggcatttctgaaggattttttatacagattgttgagaaggaattctggaagcagcaaagccttaaaagtcgcgagcaaatcttcctttggcggtagcgctcctctgaagaatggtgaatttcagaagatgctggaaatggaaccacagaaaaccgtggtgataaaaattactgatgtggaccttcctgtactagaagagacgaaaccacttatttgtggaattggtgaatgtgagggtgatgctttgaaggagcaacagctttccaccaaggagattgcaatttacggattgtacctttgtcccatatggtttgtcacagagtatttgtcaaatgcagcacttgcaagaaccagtgttgcaagcactactgtactatcctcaacttccggactcttcacccttttcatcggtgtgctacttggccaagactccataaatgctgccaaagttattgctgtttttgtgagcatggccggtgtagcaatgacaaccatgggccagacttgggcaacagatgaatcagaagtaagcaattcaggggccacacagaggactcttctaggtgacatgtttggtcttatgtcagctatgtcatatggtctattcactgtgcttctcaaaaagtttgctggaggagaaggatcagaaaaggttgatgtccaaaaattgtttggttttctcggacttttcagtctttgtcttctctggtggcttgtctggccattaactgcacttggcattgagccaaagtttacaatgccccactcagctaaagtggatgaagtggtgttggcaaacggcctcattggaagtgtgctatcggactacttttgggctctttccgtggtttggactaatcccttggtggccacgttaggcatgtctctcacaattccactagcgatggttgctgacatggttatccacggtagacattattcagcagtctacatttttggctctgtccaggtattttctgggtttgtcatcgccaaccttgccgaccgcgtttcacgtttcttaggtctatagccttgaaatctacaaggtggaatcggagtgtacatctggaagtttggatagggttagttacgaagtgtacattggatgtttggttagttagttataaggacaactctgtcttctctgtaaatcacaaggatggggaaatggcactgcagctctgttttctcttgacctttggcccctttacacgcaggaatggataattttgttgtggtgaaatggaaacagtgaaagctaagcacacgaaggaacatta

SEQ ID NO: 1547 - DNA, 1810 bp, Secale cereale
cgcgctccccgacgcttgacgccgaatcctgagcccacccgagcaggggcaccgtctcctcgtctggctcgaatcgagtagaaacttccggtggtaggtcaccccggctttaccccgcccccaaaaccgttctcctccctcctcctcgaacccctctctttccgtggggagcgaagcggggcgggcgatgagccgatgaggccggggctgccgcggagctcacccacccagtccaccgcaagcatgtggccgggcaggtgaactccactcccccactccccacgccgcgcggttaaattgctcgcctccgccgcctcctcctccctcgcacagcagcagcaggatcggagggcggcatgggtcccaacctcaagtaccgggccgggctcgtcctcatcgtcgccgtcgtgctcatatgggtcacctccgccgaggtcacgcaggagatattcgctagctacaagcaaccgttcgcaattacttacttgggggcctccctcatggtcatctacatcccgttggcatttctgaaggattttttatacagattgttgagaaggaattctggaagcagcaaagcctcaaaagtcgcgagcaaatcttcatttggcggtaacgctcctctgaagaatggtgaatttcagaagatgctggaaatggaaccacagaaaaccgtggtgataaaaattactgatgtggaccttcctgcactagaagagacgaaaccgcttatttgtggaatcggtgaatgtgagggtgatgttttgaaggagcaacagctttccaccaaggagattgcaatttatgggttgtatctttgtcccatatggtttgtcacagagtatttgtcaaatgcagcacttgcaagaactagtgttgcgagcactactgtactatcttcaacttcgggactcttcacccttttcatcggtgtgctacttggccaagactccataaatgctgccaaagttattgccgtttttgttagcatggctggtgtagcaatgacaactatgggccagacttgggcaacagatgaatcagaagtaagcaattcaggggccacacagaggactcttcttggcgacatgtttggtcttatgtcagctatgtcatatggtctattcactgtgcttctcaaaaagtttgctggaggagaagaatcagaaaaggttgatgtccaaaaattgtttggttttctcggacttttcagtctctgtcttctctggtggcttgtctggccattaactgcacttggcattgagccaaagtttacaatgccccactcagctaaagtggatgaagtggtgctggcaaacggccttattgggagcgtgctatcggactacttctgggctctctctgttgtttggactaatcccttggtggcaacgttaggcatgtcgctcacaattccactagcgatggttgctgacatggtcatccacggtcgacattattcagcagtctacatttttggttctgtccaggtattttctgggttcgtcatcgccaaccttgccgaccgcgtttcacgtttcttaggtctatagccttgaaatctacaaggtggaatcggagtgtacatctggaagtttcgatagggttagttacgaagtgtacattggatgtttgggttagttagtcatggacagctctgtcttctttgtaaatcataaggatgggggaaatggcactgcagctctgttttctctcgacctttgccccccctttacacgcaggaatggataattttggtgtggtgaaatgggaacagtggaagctaagcacacgaaggaacaaaaaagtc

SEQ ID NO: 1548 - DNA, 1860 bp, Brachypodium distachyon
caccccggtcgagcagcgtctcgtctcctccgtttctcttgctcgtttaataagaccagaatagaaacttccgctagtaggtcaccccggctcttccttttgcccccacccaccacccctcccccgcgtgaaaccgttctccttccttcctcttccccgcccccgctctctttccgtgggggagcgaagaggggcggacgatgaggcgagggaggccgcggacctcacccaccgcaagcatgtggcctactctcgccggccacccgggcaggcggtgacacaacccacaccacaccacgccccgcggttaaattgctcgcctcctccttcctccttcctccagtcctcccgcaccgcgccggggaagagagatcgttggtagggatcgggggcaggccgagaggtgttgtgatatggggtccaacgtcaagtaccgcgcgggattggtcctcatcgtcgccgtcgtgctcatatgggtcacctccgccgaggtcacgcaggggatattcgctaactacaagcaaccattcgcaattacttacttgggggcctcccttatggttatttacattcctttggcattcctaaaggattttatatacagattgttgacaaggcattctggaagcagcagagcttcaaaagtcacgagcaaatcttcctttggcggtactgcccctttgaagaatggtgaattccagaagatgctggaaatggaatcacagaaaactgtggtgataaattacactgacgtcaatcttcctgagctagaagagacaaaaccacttatttgtggaatcggtgaatgtggtggtgatgtgaaggagcaagaactttccactaagcagattgcaatttatggactgtatctttgtcccatatggtttgtgacagagtatttatcaaatgcagcacttgcaagaactagtgttgccagtactactgtactatcttcaacttcgggactcttcacactttttattggtgttcttcttggccaagattccataaatgttgcaaaagttattgctgtttttgttagcatggccggtgtagcaatgacaaccatgggccagacttgggcagcagatgaatcagaagtaagcaattcaggggccacacagaggactcttctaggtgatatgtttggtcttctgtcagctgtgtcgtatggtctatttactgtgctgctcaaaaagtttgctggaggggaaggatcaggaaaggttgatgtccaaaaactgtttggttttctcggacttttcagtctttgtcttctctggtggcttgtctggccattgactgcgcttggcattgaaccaaagtttacaatgcctcactcagctaaagtggatgaagtggtgctggcaaatggcctcattggaagtgtgctatcagattacttctgggctctttctgttgtttggaccaatcccctggtagccacattaggcatgtcgctcacaattccactagcgatggttgctgacatggtcatccatggtcggcattattcaacagtctatatttttggttctgtccaggtattttctgggtttgtcattgccaaccttgcagatcgattttcacgttttataggactatagtcccatgaaatcaaccagattgtattaaagtgtacatctgggaggttggatcggctagtgatggagtgtacatttggaagttcgggtttgttagtcgaatacaaatctggccttctgtttaaatcataagcatggggaaatggcactgcaactccgtttttcgtttacttggccctctttactcacaggaatggagaattttgttgagatgaaatagaaagattgtaagcttagcatgcgaaggaacagtcta

SEQ ID NO: 1549 - DNA, 2212 bp, Brachypodium distachyon
caagcaagaactcgccgtgccgtcgaatccatccacacgaacccgagcaccccggtcgagcagcgtctcgtctcctccgtttctcttgctcgtttaataagaccagaatagaaacttccgctagtaggtcaccccggctcttccttttgcccccacccaccacccctcccccgcgtgaaaccgttctccttccttcctcttccccgcccccgctctctttccgtgggggagcgaagaggggcggacgatgaggcgagggaggccgcggacctcacccaccgcaagcatgtggcctactctcgccggccacccgggcaggcggtgacacaacccacaccacaccacgccccgcggttaaattgctcgcctcctccttcctccttcctccagtcctcccgcaccgcgccggggaagagagatcgttggtagggatcgggggcaggccgagaggtgttgtgatatggggtccaacgtcaagtaccgcgcgggattggtcctcatcgtcgccgtcgtgctcatatgggtcacctccgccgaggtcacgcaggggatattcgctaactacaagcaaccattcgcaattacttacttgggggcctcccttatggttatttacattcctttggcattcctaaaggattttatatacagattgttgacaaggcattctggaagcagcagagcttcaaaagtcacgagcaaatcttcctttggcggtactgcccctttgaagaatggtgaattccagaagatgctggaaatggaatcacagaaaactgtggtgataaattacactgacgtcaatcttcctgagctagaagagacaaaaccacttatttgtggaatcggtgaatgtggtggtgatgtgaaggagcaagaactttccactaagcagattgcaatttatggactgtatctttgtcccatatggtttgtgacagagtatttatcaaatgcagcacttgcaagaactagtgttgccagtactactgtactatcttcaacttcgggactcttcacactttttattggtgttcttcttggccaagattccataaatgttgcaaaagttattgctgtttttgttagcatggccggtgtagcaatgacaaccatgggccagacttgggcagcagatgaatcagaagtaagcaattcaggggccacacagaggactcttctaggtgatatgtttggtcttctgtcagctgtgtcgtatggtctatttactgtgctgctcaaaaagtttgctggaggggaaggatcaggaaaggttgatgtccaaaaactgtttggttttctcggacttttcagtctttgtcttctctggtggcttgtctggccattgactgcgcttggcattgaaccaaagtttacaatgcctcactcagctaaagtggatgaagtggtgctggcaaatggcctcattggaagtgtgctatcagattacttctgggctctttctgttgtttggaccaatcccctggtagccacattaggcatgtcgctcacaattccactagcgatggttgctgacatggtcatccatggtcggcattattcaacagtctatatttttggttctgtccaggtattttctgggtttgtcattgccaaccttgcagatcgattttcacgttttataggactatagtcccatgaaatcaaccagattgtattaaagtgtacatctgggaggttggatcggctagtgatggagtgtacatttggaagttcgggtttgttagtcgaatacaaatctggccttctgtttaaatcataagcatggggaaatggcactgcaactccgtttttcgtttacttggccctctttactcacaggaatggagaattttgttgagatgaaatagaaagattgtaagcttagcatgcgaaggaacagtctactgtagcaaacctttgcaactgtaaattctcttgctacaaaatgctttgtcaatgcttactgtatagcggtgtagatcttatcgccggtaactgtgaacgtgatatgaattgcatccacggtgatatattgagtttagggaggaactccaaagttccccaagatgctgaagaaagaaaagaaaatcagaaaagaaaatcatagatgtgggttttcaatgtactccctctgatcctaaattgttgccgaaatattacatgtatctagacgttttttaagaatagatacatccatatttggacaaac

SEQ ID NO: 1550 - DNA, 1514 bp, Triticum aestivum
tggtcctcatcgtcgccgtcgtgctcatatgggtcacctccgccgaggtcacgcaggggatattcgctaactacaagcaaccattcgcaattacttacttgggggcctcccttatggtcatctacatcccgttggcatttctcaaggattttatatacagattgttgagaaggaattctggaagcagcaaagcctcaaaaatcgcgagcaaatcttcctttggcggtagtgctcctctgaagaatggtgaatttcagaagatgctggaaatggaaccacagaaaaccgtggtgataaagattactgatgtggaccttcctgtactagaagagacgaaaccgctcatctgtggaattggtgaatgtgagggtgatgttttgaaggagcaacagctttccaccaaggagattgcaatttatgggttgtacctttgtcccatatggtttgtcacagagtatttgtcaaatgctgcacttgcaagaactagtgtggcaagcactactgtactatcttcaacttcgggactcttcacccttttcattggtgtgctacttggccaagattccataaatgctgccaaagttattgctgtttttgttagcatggctggtgtggcaatgacaactatgggccagacttgggcaacagatgaatcagaagtaagcaattcaggggccacacagaggactcttctaggtgacatgtttggtcttatgtcagctatgtcatatggtcttttcactgtgcttctcaaaaagtttgctggaggagaaggatcagaaaaggttgatgtccaaaaactgtttggttttctcggacttttcagtctttgtcttctctggtggcttgtctggccattaactgcacttggcattgagccaaagtttacaatgccccactcagctaaagtggatgaagtggtgctggcaaatggccttattgggagcgtgctatcagactacttctgggctctctctgttgtttggactaatcccttggtggccacgttaggcatgtcgctcacaattccactagcgatggttgctgacatggtcatccacggtcgacattattcagcagtctatatttttggttctgtccaggtattttctgggttcgtcatcgccaatcttgccgaccgcgtttcacgtttcctaggtctatagccttgaaatgtacaaggttgaaatcggagtgtacatctggaaggttggatagggttagttactaagtgtacattggatgtttgggttagttagttataaggacaactctgtcaactctgtaaatcataaggatgggggaaatggcactgcagctctgtttcctttttacctttggccccctttacacgcaggaatggataattttggtgtggtggaattgaaacagtgaaagcttagcatacgtaaggaacattatgatgttgtggcagacctttgcaactgtaaattattagcttttgctacgaaatgctctgtcaacgcgtactgtatagcgctgaaattttcagc

SEQ ID NO: 1551 - DNA, 1617 bp, Sorghum bicolor
cttcgaggccctgccgttggctgtctcggtgtcatcctctcctctcctctcctctcgactcgtctcgttctcgtcacccccttgtcgcggagcagagcgagcagcggacctctccagggagcgcgccgcggacggaggtcagcgaagatgcccgggctcacggcgccgtccgactacgcggaggagccgccgcgtcacccggccctcaagatcaactccaaggagccattcaacgctgagcctcaccgatcagcgctagtcgcatcatacatcaccccagtggatttcttctacaagaggaaccatggacccatccctaaagtcgaggacctctcaagatacactgttaccatttctggtctcatcaacaagtctattcagctatccatgggtgacatttgggctcttccaaagtacaatgtcacagcaactttacagtgtgcgggaaacaggaggactgcgatgagtaatgtacggaaagtgagaggtgttggatgggacatatctgctcttggaactgcaacttggggaggtgccaaactatctgatgtccttgagctagttagaataccaaaactcagttcagtcacatctctaggcgggaagcacgttgagtttgttagcgttgacaagtgtaaagaggaaaaaggtggtccttataaggcatctattccattgaagcaggcaacagatcctgatgctgatgtattacttgcatatgaaatgaatggagaggtactcaatcgggaccatgggtacccactccgggttgttgtgcctggcgttattggtgcacgctctgtaaaatggttggacagtatcaacataaaagaggaggaatgccagggtttttttgtgcaaaaagattacaaaatgtttccaccaaccgtggactgggacaatattaattggtcaactagaaggccacagatggatttccctgtgcagtctgctatctgtacactggaagatgtagatgttatcaaggaaggaaaggctaggattgctggatatgcactttcaggtggtggccgtggcattgagagagtggatatatctgttgatgggggtaaaacatggattgaggctcgtcgatatcagaaagacaatgtggcgtacgtatcagatggacctcaaagtgataagtgggcttgggttctctttgaggctacattagacataccagcaaatgctgagatcgtagctaaggcggtggactcggctgcaaatgttcaaccggaaaaggtagaagacatatggaatctgagaggaatcctcaacacgtcttggcatcggatcaaaatacagaactcttcaggaagatctaagctgtgaaattaagtacgctgctgacaacttggagcaagcatggtgctgacccttgcgagtcttaccattgtactaaaataataagtcatttcaactttctgtatttctcgtttcttgtcaaaaaaaaaaaaactttctgtgtttctcgagtcaggctgtaccacgaatgttggagtggtgttctatgggatttgagctcacttgatttctacgtaatgtcagctgctgctgtttttttttaactgctgttatcggttggtctgatatcaacaattgcattctgcgttg

SEQ ID NO: 1552 - DNA, 1619 bp, Sorghum bicolor
gccttcgaggccctgccgttggctgtctcggtgtcatcctctcctctcctctcctctcgactcgtctcgttctcgtcacccccttgtcgcggagcagagcgagcagcggacctctccagggagcgcgccgcggacggaggtcagcgaagatgcccgggctcacggcgccgtccgactacgcggaggagccgccgcgtcacccggccctcaagatcaactccaaggagccattcaacgctgagcctcaccgatcagcgctagtcgcatcatacatcaccccagtggatttcttctacaagaggaaccatggacccatccctaaagtcgaggacctctcaagatacactgttaccatttctggtctcatcaacaagtctattcagctatccatgggtgacatttgggctcttccaaagtacaatgtcacagcaactttacagtgtgcgggaaacaggaggactgcgatgagtaatgtacggaaagtgagaggtgttggatgggacatatctgctcttggaactgcaacttggggaggtgccaaactatctgatgtccttgagctagttagaataccaaaactcagttcagtcacatctctaggcgggaagcacgttgagtttgttagcgttgacaagtgtaaagaggaaaaaggtggtccttataaggcatctattccattgaagcaggcaacagatcctgatgctgatgtattacttgcatatgaaatgaatggagaggtactcaatcgggaccatgggtacccactccgggttgttgtgcctggcgttattggtgcacgctctgtaaaatggttggacagtatcaacataaaagaggaggaatgccagggtttttttgtgcaaaaagattacaaaatgtttccaccaaccgtggactgggacaatattaattggtcaactagaaggccacagatggatttccctgtgcagtctgctatctgtacactggaagatgtagatgttatcaaggaaggaaaggctaggattgctggatatgcactttcaggtggtggccgtggcattgagagagtggatatatctgttgatgggggtaaaacatggattgaggctcgtcgatatcagaaagacaatgtggcgtacgtatcagatggacctcaaagtgataagtgggcttgggttctctttgaggctacattagacataccagcaaatgctgagatcgtagctaaggcggtggactcggctgcaaatgttcaaccggaaaaggtagaagacatatggaatctgagaggaatcctcaacacgtcttggcatcggatcaaaatacagaactcttcaggaagatctaagctgtgaaattaagtacgctgctgacaacttggagcaagcatggtgctgacccttgcgagtcttaccattgtactaaaataataagtcatttcaactttctgtatttctcgtttcttgtcaaaaaaaaaaaaactttctgtgtttctcgagtcaggctgtaccacgaatgttggagtggtgttctatgggatttgagctcacttgatttctacgtaatgtcagctgctgctgtttttttttaactgctgttatcggttggtctgatatcaacaattgcattctgcgttg

SEQ ID NO: 1553 - DNA, 1560 bp, Saccharum officinarum
cacccccttcgttttcgtttcgcggagcagagcgagcagcggacctccagggagagcgagtcgcggaggcaagcgaagatgcccgggctcacggcgccgtccaactacgcggaggagccgccgcgtcacccggccctcaagatcaactccaaggagccattcaatgccgagcctcaccgatcggcactagtagcatcttacatcaccccagtcgatttcttctacaagaggaatcatggacccatccctaaggtcgaggacctgtcaagatatactgtttccatttctggtctcgtcaacaagtctattcagctatccatggctgacattcgggctcttccaaagtacaatgtcacagcaactttacagtgcgcgggaaacaggaggactgcgatgagtaaggtacgaaaagtgagaggtgttgggtgggacatatctgctcttggaaatgcaacttggggaggtgccaaactatctgatgtccttgtgctagttggaataccagaactcacttcagtcacatctctaggagggaagcatgttgagtttgttagcgttgacaagtgtaaagaggaaaaaggtggcccttatacggcatctattccattaaagcaggcaacagatcctgatgctgatgtattacttgcatatgaaatgaatggagaggtactcaatcgggaccatggatacccactccgggttgttgtacctggcgttattggtgcacgctctgtaaaatggttggacagtatcaacataaaagaggaggaatgccagggtttttttatgcaaaaagattacaaaatgtttccaccaaccgtggactgggacaatattaattggtcaactagaaggccacagatggatttccctgtgcagtctgctatctgtacactggaagatgtagatgttatcaaggaaggaaaggctaggattgctggatatgcactttcaggtggtggccgtggcattgagagagtggatatatctgttgatggcggtaaaacatgggtcgaggctcgtagatatcagaaagacaatgtggcgtatgtatcagatggacctcaaagtgataagtgggcttgggttctctttgaggctacagtagacataccagcaaatgctgagatcgtagctaaggcggtggactcagctgcaaatgttcaacccgaaaaggtagaagacatatggaatctgagaggaatcctcaacacatcttggcatcggatcaaaatacagaactcttcatccgtaggaagatctaagatgtgaaattaagtacgcagttgaccacttggagcagcatggtggtgatcgttgagagtcataccattgttccaaaataataagtcatttcaactttctgtgtttctggcgtcaggctgtaccacgagtgttggagctgtgttctatgggatttgagctgtgttctatgggatttgagctcacttgatttctatgtaatgtcagctgctgctggtttttttgtgtgtgtcactgtggataactgctgttgtttgttggcctgatatcaagaaattacaattgcattctgcgttg

SEQ ID NO: 1554 - DNA, 1536 bp, Panicum virgatum
ttttgcggatcagcgaacccaaacgaacagggacagggagcgagctcggacctcggaggccacgcgcgacgagatgccggggctcacggcgccgtccgactacgcggaggagccgccgcgccacccggccctcaggatcaactccaaggagccgtttaatgctgagcctcaccggtcggcactagtcacatcttacattaccccggtggatttcttctacaagaggaatcatggacccattccaaaagtcgaggacctctcaagatacagtgtttacatttctggtcttgtcaacaagcctattcagctatccatggctgacatttgggctcttccaaagtacaatgtcactgcaactttacagtgtgctggaaacaggagaactgcaatgagtaaggtacggaaagtgagaggtgttggttgggacatatctgctcttggaaatgcaacttggggaggagcaaaactatctgatgtccttgagttagttggaatacccaaactcagttcggttacatctttaggagggaagcatgttgagtttgttagtgttgacaagtgtaaagaggaaaaaggtggtccttatactgcatctattccattaaagcaggcaacagatcctgatgctgatgtattacttgcatatgaaatgaatggagaggtcctcaatcgtgaccatggatacccactccgtgttgttgttcctggtgttattggtgcacgatctgtaaaatggctggacagtatcaatataatcgaggaagaatgtcagggtttttttacgcaaaaagattacaaaatgtttccaccaaccgtggactgggacaatattaactggtcaactagaaggccacagatggattttcctgtacagtctgctatctgtacacttgaagatgtggatgttattaaggaaggaaaggccaggattgctggatatgcactttcaggtggtggccgtggtattgagagagtggatatatctgttgatgggggtaaaacctgggttgaggctcgcagatatcagaaagacaacgtgccatatgtatctgatggacctcagagtgataagtgggcttgggttctcttcgaggctacattagacataccagcaaatgctgagatagtagcaaaggcggtggactcagctgcgaatgtccaacctgaaaaagtggaagacatatggaacctgagaggaatcctcaacacatcttggcatcggatcaaaatacagaattcgtcatgcattggaagatctaagctgtgaaataagcatgtctgaaatcgtggagcaattatggtggtgatccttacgaagtgttaccattgtaccaaaataataataagtgtcatttcagctttcagtgtttctcgcatcggactgtaacatacgtgatggggctgtgtcgtatggaattggagtttgactgtgacagtatgaatcatgtaccggcagcagcagctgaccccccgcccaaatacggataaatgcagatgtttggtatgtgatatcaagaaaatgttcctttcggattt

SEQ ID NO: 1555 - DNA, 2064 bp, Setaria italica
atgagcacggtagcgccgtgcctagcccggcacggtgatgctgccgtaccgtgcccgcccacgggctgcgccggcagcccgagcatgggcatggcggccgacgggccagctcaaagcacgaccggtggcaagctcacccgaggcacgacgagcctgcatggcttgctttctatgcgccgcggccatcgcctccagctcgacaagccgccgcccttggctccgtctacatgctcgctgtcactaccacctgcgggctgcgaccaagaaatgttgagggaggcggaggcgcatatgagaggtgtgcgccggccgctggagggaggcagagcccggagaggaggacggcggggagcagttgcagcagggggtggttgggtggatgggagggagcgagcgagagggaggcggcgatgggggagatcgggagaagaagtaaagagaaaaagggagcccacttcgaggccgcggcgttggctgtctcggtgtcatcgtctcgtctcgtcccccccgttatttttgcggagcggcgaacccaaacgagcagggagctcggaggccacgcacgagatgccggggctcacggcgccgtcgagctacgcggaggagccgccgcgccacccggccctcaagatcaactccaaggagccatttaatgccgagcctcaccgatcggcgctagtctcatcttacatcactccggtggatttcttctacaagaggaatcatggacccattccgaaagtcgaggacctctcaagatacagtgtttccatttctggtcttgtcaacaagcctatccaactatccatggctgacatttgggctcttccaaagtacaatgtcaccgcaactttacagtgtgcgggaaacaggagaactgcaatgagtaaggtacggaaagtgagaggtgttggttgggacatatctgctcttggaaacgcaacttggggaggagcgaaactgtctgatgtccttgagttagttggaatacctaaactcagttcagtttcatctttaggagggaagcatgttgagtttgttagtgttgacaagtgtaaagaggaaaaaggtggtccttatactgcatctattccattaaagcaggcaacagatcctgatgctgatgtattacttgcatatgaaatgaatggagagatcctcaatcgtgaccatggatacccactccgtgttgttgttcctggtgttattggtgcacgttctgtaaaatggctggacagtatcaacataagcgaggaagaatgccagggtttttttacgcaaaaagattacaaaatgtttccaccaaccgtggactgggacaatattgattggtcaactagaaggccacagatggacttccctgtacagtctgctatctgtacactggaagatgtagatgttatcaaggaaggaaaggctaggattgctggatatgcactttcaggtggtggccgtggcattgagagagtagatatatctgttgatgggggtaaaacctgggttgaggctcgcagatatcagaaagacaacgtgccatacgtatctgatggaccccaaagtgataagtgggcttgggtcctctttgaggctacattagacataccagcaaatgctgagatagtagcaaaggcggtggactcagctgcgaacgtccaacctgaaaacgtggaagacatatggaacctgagaggaatcctcaacacatcttggcatcggatcaaaatacagaattcgtcgtgcgttggaagatctaagctgtgaaataagaataagctgtgaaataagaacacgctgctgatcgcttggagcaatcgtggtggtgatccttgcaagtgttaccacaagcgttaccattgtaccaaaacaataataaagtcattgcagctttcagtgtttctcgcatcggactgtaacacaagtgttggagctgtgttgttcatgggatttgagtttgaccgtaactcctatgtaccgtcataactactgctgttgatttatctgatatcaagaaaatatgattgtattctgcattggagaattaatgtgcagcatactccttccaaa

SEQ ID NO: 1556 - DNA, 1631 bp, Setaria italica
gcaccacacacaaggagcccacttcgaggccgcggcgttggctgtctcggtgtcatcgtctcgtctcgttccccccgttatttttgcggagcggcgaacccaaacgagcagggagctcggaggccacgcacgagatgccggggctcacggcgccgtcgagctacgcggaggagccgccgcgccacccggccctcaggatcaactccaaggagccatttaatgctgagcctcaccgatcggcgctagtctcatcttacatcactccggtggatttcttctacaagaggaatcatggacccattccgaaagtcgaggacctctcaagatacagtgtttccatttctggtcttgtcaacaagcctatccaactatccatggctgacatttgggctcttccaaagtacaatgtcaccgcaactttacagtgtgcgggaaacaggagaactgcaatgagtaaggtacggaaagtgagaggtgttggttgggacatatctgctcttggaaacgcaacttggggaggagcgaaactgtctgatgtccttgagttagttggaatacctaaactcagttcagtttcatctttaggagggaagcatgttgagtttgttagtgttgacaagtgtaaagaggaaaaaggtggtccttatactgcatctattccattaaagcaggcaacagatcctgatgctgatgtattacttgcatatgaaatgaatggagagatcctcaatcgtgaccatggatacccactccgtgttgttgttcctggtgttattggtgcacgttctgtaaaatggctggacagtatcaacataagcgaggaagaatgccagggtttttttacgcaaaaagattacaaaatgtttccaccaaccgtggactgggacaatattgattggtcaactagaaggccacagatggacttccctgtacagtctgctatctgtacactggaagatgtagatgttatcaaggaaggaaaggctaggattgctggatatgcactttcaggtggtggccgtggcattgagagagtagatatatctgttgatgggggtaaaacctgggttgaggctcgcagatatcagaaagacaacgtgccatacgtatctgatggaccccaaagtgataagtgggcttgggtcctctttgaggctacattagacataccagcaaatgctgagatagtagcaaaggcggtggactcagctgcgaacgtccaacctgaaaacgtggaagacatatggaacctgagaggaatcctcaacacatcttggcatcggatcaaaatacagaattcgtcgtgcgttggaagatctaagctgtgaaataagaataagctgtgaaataagaacacgctgctgatcgcttggagcaatcgtggtggtgatccttgcaagtgttaccacaagcgttaccattgtaccaaaacaataataaagtcattgcagctttcagtgtttctcgcatcggactgtaacacaagtgttggagctgtgttgttcatgggatttgagtttgaccgtaactcctatgtaccgtcataactactgctgttgatttatctgatatcaagaaaatatgattgtattctgcattggagaattactgtgcagcatactccttcgaaa

SEQ ID NO: 1557 - DNA, 1512 bp, Pennisetum glaucum
tcaccacacacacaggaaacacacgggtagcccactcggaggccgcagcgttggctgtctcggtgtcatcgtttcgtctcttccgtaatttcgcggagcggcgaacccaaacgagagcagggagctcggaggccacgcgcgagacgagatgccagggatcacggcgccatcgaactacgcggaggagccgccgcgccacccggacctcaagatcaactccaaggagccatttaatgccgagcctcaccgatcggcgctagtcgcatcttacatcaccccagtggatttcttctacaagaggaatcatggacccatcccaaaagtcgaggatctctcaagatacagtgtttccatttctggtcttgtcaacaagcctattcagctaaccatggctgacatttgggctcttccaaagtacaatgtcaccgcaactttacagtgtgcgggaaacaggagaactgcaatgagtaatgtgcggaaagtgagaggtgttggttggggcatatctgctcttggaaacgcaacttggggtggagcgaaactgtctgatgtccttgagttagttggaatacctaaactcagttcagtttcatcttttggagggaagcatgttgagtttgttagtgttgacaagtgtaaagaggaaaaaggcggtccttatactgcatctattccattaaagcaggcaactgatcctgatgctgatgtattgcttgcatatgaaatgaatggagagatcctcaatcgtgaccatggatacccactccgtgttgttgttcctggtgttattggcgcacgttctgtaaaatggctggacagtatcaacataagcgaggaagaatgccagggtttttttatgcaaaaagattataaaatgtttccaccaaccgtggactgggacaatattgattggtcaactagaaggccacagatggacttccctgtacagtctgctatctgtacactggaagatgtagctgttatcaaggaacgaaaggctagggttgctgggtatgcactttcaggtggtggccgtggcattgagagagtagatatatctgttgatggtggtaaaacctgggtcgaggctcgcagatatcagaaagacaacgtgccatacgtatctgatgggcctcacagtgataagtgggcttgggttcactttgaagctacattagacataccaccaaatgctgagatagtagcaaaggcggtggactcagctgcaaacgtccaacctgaaaatgtggaagacatatggaacctgagaggaatcctcaacacttcttggcatcgtatcaaaatacagaattcatcatgtgttggaagatctaagctgtgaaataagcatacttctgaaatcttggagcaatcgtggtggtgatccttacaagtattaccattgtaccagaataataataaagtaatttcagctttcgtggagtaatgtttgtatggaatttgagtttgactgactcctatgtaccgtcagcggctgctgatgcccccccc

SEQ ID NO: 1558 - DNA, 1525 bp, Secale cereale
gtcacccaaattctgcgacaacaaaatactccccgtgcgtgcctgtcaaaaaaaccacggccagtgacgggaagacgaaggaagagagatgccggggctcacggcgccgtcggactacgcggaggagccgccgcgccacccggccctcaggatcaactccaaggagccatttaatgctgagcctcatcgatctgcgttagtttcatcttatatcactccagtagatttcttctacaagaggaatcatggaccaattcccaaagttgatgacatctcaagatacagtgtttccatcagtggcctcgtgaataagcatatccagctgtccatggatgacattaggatgcttccgaagtacaatgtcactgcaacattacagtgtgcaggcaataagagaactgcaatgagtaaggtacggaaagtgagaggtgttggatgggacgtatctgctcttggaaatgcaacttggggaggagcaaaactatctgatgtccttgaactagttggaatacataaactcagttcagtcacatctttaggaggcaaacacgttgagtttgtcagtgttgacaggtgtaaagaggagaaaggcggcccctataaggcatcaattccactaaagcaggcaacagatcctgatgctgatgtgttactcacatatgaaatgaatggagagaccatcaatcgtgaccatggatatccactccgtgttgtcgtacctggtgttataggcgcacgctccgtaaaatggcttgacagcatcaacataatcaaggaagaatgccagggtttttttatgcaaaaagattacaagatgttcccgcctaccgtagattgggacaatattaattggtcgactagaagaccacaaatggatttccctgtgcagtctgctatttgcaccctggaagatgtggatgttatcaaggaaggaaaggctagaattgctggatatgcagtctcaggtggcggccgtggcattgagagagtagatatatctgttgatgggggtaaaacatgggttgaggctcatagatatcagaaaagcaatgtgccatacgtctccgatggagctcaaagcgacaagtgggcatgggttctctttgaggccacattggacataccatcaaacgccgagatagtagctaaggcggtggactcggctgcaaacattcaacccgaaaaagtggaggacatatggaacctgagaggaatcctcaacacgtcttggcatcggatcaagatacagaattcatcctgcgtgtctagatccaaaatgtgaaggaagtatgttgatgtgcctagaacaagcagcacggcggccccaatgagtccatgatatctccaaataataaagctgctgcagcttaatatctgtgattttcgtatagaccttggcatggaagtgtgttggtttattaccagcgttacaaataactgcttgtgttggctgatatgatatgaggaaattgttatgactcgtgctttacgaatgcatgtctgaagtgctttaagaatgtgtcaa

SEQ ID NO: 1559 - DNA, 1512 bp, Triticum aestivum
aaggaagagagatgccggggctcacggcgccgtcggactacgcggaggagccgccgcgccacccggccctcaggatcaactccaaggagccatttaatgctgagcctcatcgatctgcgttagtttcatcttatatcaccccagtggatttcttctacaagaggaatcatggaccaattcccaaagttgatgatatctcaagatacagtgtttccatcagtggcctcatgaataagcatatccagctgtccatggatgacattaggatgcttccgaagtacaatgtcactgcaacattacagtgtgcaggcaataagagaactgcaatgagtaaggtgcggaaagtgagaggtgttggatgggacgtatctgctcttggaaatgcaacttggggtggagcaaaactatctgatgtccttgaactagttggaatacataaactcagttcagtcacatctttaggaggcaaacatgttgagtttgtcagtgttgacaggtgtaaagaggagaaaggtggcccctataaggcatcaattccactaaagcaggcaacagatcctgatgctgatgtgttactcgcatatgaaatgaatggagagaccatcaatcgtgaccatggatatccactccgtgtggtcgtacctggtgttataggtgcacgctccgtaaaatggcttgacagcatcaacataatcaaggaagaatgccagggtttttttatgcaaaaagattacaagatgttcccacctaccgtagattgggacaatattaattggtcaactagaagaccacaaatggattttcctgtgcagtctgctatttgcaccctggaagatgtggatgttatcaaggaaggaaaggctagaattgctggatatgcagtctcaggtggcggccgcggcattgagagagtagatatatctgttgatgggggtaaaacatgggttgaagctcatagatatcagaaaagcaatgtgccatacgtctctgatggagctcaaagcgacaagtgggcatgggttctatttgaggccacattggacataccagcaaatgccgagatagtagctaaggcggtggattcggccgcaaacattcaacccgaaaaagtggaggacatatggaatctgagaggaatcctcaacacatcttggcatcggatcaaaatacagaatacatcatgcgtatctagatccaaaatgtgaaggaagtatgttgatgtgcctagaacaagcagcacgccggtccagctgagtccatgatatctccaaataataaagccaccacggcttaatttctgtgattttcgtatagactttgtcatggaactatgttggtttgttaccagcgttacgaataactgcttttgttggctgatatgatatgaggaaatcgctatgacttgtgctttacgaatgcatgtttgaagtgctttaagaatgtgtcagcattgagcatgaaccacaaatttttgggcataacagcaggctgttcgatggagaattatcgtgg

SEQ ID NO: 1560 - DNA, 1575 bp, Hordeum vulgare
cccacaatcatcggggtcatcgtcacccaaattttgcgacaacaaaatacacactactcccgtgcgtgcctgccaaaaaaaccacggccagtgaccaaacgaagacgaaggaagggagatgccggggctcacggcaccgtcggactacgcggaggagccgccgcggcacccggacctcaggatcaactccaaggagccatttaatgccgagcctcatcgatctgcgttagtttcatcttatatcaccccagtggatttcttctacaagaggaatcatggaccaattccaaaagttgatgatatctcaagatacagtgtttccatcagtggcctcgtgaataagcatatccagctgtccatggatgacattaggatgcttccgaagtacaatgtcactgcaacattacagtgtgcaggcaataagagaactgcaatgagtaaggtacggaaagtgagaggtgttggatgggacatatctgctcttggaaatgcaacttggggaggagcaaaattatctgatgtccttgaactagttggaatacataaactcagttcagtcacatctttgggaggcaaacacgttgagtttgtcagtgttgacaggtgtaaagaggagaaaggtggcccctataaggcatcaattccactaaagcaggcaacagatcctgatgctgatgtgttactcgcatatgaaatgaatggagagactatcaatcgtgaccatggatatccactccgtgttgttgtacctggtgttataggcgcacgctctgtaaaatggcttgacagcatcaaaataatcaaggaagaatgccagggtttctttatgcaaaaagattacaagatgttcccacctaccgtagattgggacaatattaattggtcgactagaagaccacaaatggatttccctgtgcagtctgctatttgcaccctggaagatgtggatgttatcaaggaaggaaaggctagaattgctggttatgcagtctcaggtggcggccgcggcattgagagagtagatatatctgttgatgggggtaaaacatgggttgaggctcatagatatcagaaaagcaatgtgccatacgtctctgatggagctcaaagcgacaagtgggcatgggttctcttcgaggctacattggacataccaccaaatgccgagatattagctaaggcggtggactcggccgcaaacatccaacccgaaaaagtggaggacatatggaacctgagaggaatcctcaacacatcttggcatcggatcaaaatacaaaattcatcctgcgtatctagatccaaaatgtgaagcaagtatgttgatgtgcctagaacaatcagcacgctggtccatgatatctccaaataataagctactgcagcttaatttctgcgatttccatatagaccatgtcatggaactgtgttgatttatacaagtgttataaataactgcttgtgttggttgatctgatatgaggaaattgtcgtgcctcatgtgttacgaatgtgtctttcagcaaagtactttaagagtgtctcaccattgaggatgaaccacaatttttgggc

SEQ ID NO: 1561 - DNA, 1764 bp, Hordeum vulgare
cccgactcaccacacacccacaatcatcggggtcatcgtcacccaaattttgcgacaacaaaatacacactactcccgtgcgtgcctgccaaaaaaaccacggccagtgaccaaacgaagacgaaggaagggagatgccggggctcacggcaccgtcggactacgcggaggagccgccgcggcacccggacctcaggatcaactccaaggagccatttaatgccgagcctcatcgatctgcgttagtttcatcttatatcaccccagtggatttcttctacaagaggaatcatggaccaattccaaaagttgatgatatctcaagatacagtgtttccatcagtggcctcgtgaataagcatatccagctgtccatggatgacattaggatgcttccgaagtacaatgtcactgcaacattacagtgtgcaggcaataagagaactgcaatgagtaaggtacggaaagtgagaggtgttggatgggacatatctgctcttggaaatgcaacttggggaggagcaaaattatctgatgtccttgaactagttggaatacataaactcagttcagtcacatctttgggaggcaaacacgttgagtttgtcagtgttgacaggtgtaaagaggagaaaggtggcccctataaggcatcaattccactaaagcaggcaacagatcctgatgctgatgtgttactcgcatatgaaatgaatggagagactatcaatcgtgaccatggatatccactccgtgttgttgtacctggtgttataggcgcacgctctgtaaaatggcttgacagcatcaaaataatcaaggaagaatgccagggtttctttatgcaaaaagattacaagatgttcccacctaccgtagattgggacaatattaattggtcgactagaagaccacaaatggatttccctgtgcagtctgctatttgcaccctggaagatgtggatgttatcaaggaaggaaaggctagaattgctggttatgcagtctcaggtggcggccgcggcattgagagagtagatatatctgttgatgggggtaaaacatgggttgaggctcatagatatcagaaaagcaatgtgccatacgtctctgatggagctcaaagcgacaagtgggcatgggttctcttcgaggctacattggacataccaccaaatgccgagatattagctaaggcggtggactcggccgcaaacatccaacccgaaaaagtggaggacatatggaacctgagaggaatcctcaacacatcttggcatcggatcaaaatacaaaattcatcctgcgtatctagatccaaaatgtgaagcaagtatgttgatgtgcctagaacaatcagcacgctggtccatgatatctccaaataataagctactgcagcttaatttctgcgatttccatatagaccatgtcatggaactgtgttgatttatacaagtgttataaataactgcttgtgttggttgatctgatatgaggaaattgtcgtgcctcatgtgttacgaatgtgtctttcagcaaagtactttaagagtgtctcaccattgaggatgaaccacaatttttgtgcatgacagcaggcgtgttaattgcttagtggtcctatttcttcaattgggttgttttacagcatgcccgctatgcttattgcctgtgttgccatcaactctggggataattcttgtctgataaagaacacaataattccagtcgtaaagacgtgatctgcccctcgtctatgca

SEQ ID NO: 1562 - DNA, 1447 bp, Pseudoroegneria spicata
caaaaaaaccacggccagtgaccaagcgaagaagaaggaagagggatgccggggctcacggcgccgtcggactacgcggaggagccgccgcgccacccggacctcaggatcaactccaaggagccatttaatgctgagcctcatcgatctgcgttagtttcatcttatatcaccccagtggatttcttctacaagaggaatcatggaccaattcccaaagttgatgatatctcaagatacagtgtttccatcagtggcctcgtgaataagcatatccagctgtccatggatgacattaggatgcttccgaagtacaatgtcactgcaacattacagtgtgcaggcaataagagaactgcaatgagtaaggtacggaaagtgagaggtgttggatgggacgtttctgctcttggaaatgcaacttggggtggagcaaaactatctgatgtccttgaactagttggaatacataaactcagttcagtcacatctttaggaggcaaacatgttgagtttgtcagtgtcgacaggtgtaaagaggagaaaggtggcccctataaggcatcaattccactaaagcaggcaacagatcctgatgctgatgtgttactcgcatatgaaatgaatggagagaccatcaatcgtgaccatggatatccactacgtgttgtcgtacctggtgttattggcgcacgctccgtaaaatggcttgacagcatcaacataatcaaggaagaatgccagggtttttttatgcaaaaagattacaagatgttcccacctgccgtagattgggacaatattaattggtcgactagaagaccacaaatggatttccctgtgcagtctgctatttgcaccctggaagatgtggatgttatcaaggaaggaaaggctagaattgctggatatgcagtctcaggtggcggccgtggcatcgagagagtagatatatctgttgatgggggtaaaacatgggtcgaggctcatagatatcagaaaagcaatgtgccatacgtctctgatggagctcaaagcgacaagtgggcatgggttctatttgaggctacattggacataccatcaaatgccgagattgtagctaaggcggtggactcggccgcaaacatccaacccgaaaaagtggaggacatatggaatctgagaggaatcctcaacacatcctggcatcggatcaaaatacagaattcatcctgtgtatctagatccaaaatgtgaaggaagtatgttgatgtgcctagaacaagcagcacgctggtcccgagatgagtccatgatatctccaaataataagctactgcagcttagtttctgtgattttcgtatagaccatgtcatggaactttgttggtttattaccagtgttttaaataactgcttgtgttggttgatctgatatgaggaaatcgttgtgacttatgcttta

SEQ ID NO: 1563 - DNA, 2304 bp, Oryza sativa
gccgtcacccagcctcgcaattgccggccgagtcgatcaccacacaaccaaaaaaactccggcccacttggagttggagcccgtggcaaatccatccatccatcgcctctgcctcgcctccaccaccgagatgccggggctcaccgcgccggcgagctactccgacgagccgcctcgccaccccgccctcaagatcaactccaaggaaccatttaatgctgagcctcatcgatcagcattagtttcatcttatattaccccggtggatttcttctacaagagaaaccatggaccgataccaattgtggatgacctctcaagatacagtgtttccattactggtattgtcaacaagaatgtgcagctgtccatggctgacattaggagtctcccaaagtatgatgtaactgcaacgttacagtgtgcaggcaacaggaggactgcaatgagtaaggtacggaaagtgagaggcgttgggtgggacatatctgctcttggaaatgcaacatggggaggagcaaagctatctgatgtccttgaactagttggaatacctaaactcagctcagtcacatctttaggaggcaagcatgttgagtttgtcagtgttgacaggtgcaaagaagaaaaaggtggtccctataaggcatcaattccactaaagcaggcaacagatcctgaagctgatgtgttacttgcatacgaaatgaacggagagaccctaaaccgtgatcatggatacccacttcgtgttgttgtacctggagtaattggcgcacgctctgtaaaatggcttgacagtatcaacataattgaagaagaatgccagggtttttttgtgcaaaaagattacaagatgtttccaccctccgtagactgggacaatattaattggtcaactaggaggccacaaatggatttccctgtgcagtctgctatttgtaccctggaggatgtggatgttatcaaggaagggaaggctaggattgctggatatgcagtctcaggtggtggccgtggcattgagagagttgatatatctgtcgatggggggaaaacatgggtcgaggctcatagatatcagaaaagcaacgtgccatacatatctgatggacctcggagtgataagtgggcatgggttctattcgaggctacattagacgttccagcaaacgctgagatagtagctaaggcggtggactcagcagcaaatgttcaacctgaaaaggtggaagacgtatggaacctgagaggaatcctcaacacatcttggcatcggatcaaaatacagaattcttcgtgcgtgggaagatccaaaatgtgaaataagtaaactgcttggaatcagaagtcaagagtttatagtgcccggaataataagttattgcagcattcgatgattctcgcagactgtgctcctgtactatagtactatgttggaatcgtgttgctggcctgggcttatatgagacgaaacacaatttttgggagtgatgttaagaagatgattaatacgtactccagtatttatgttgtcttctaatggaaaatttgcagttcttgtgctccatatgataaaagaaaaaactcagtaaattcagttgcaaagatgtgacaagacattaacattccccgcatatgtggaaatgtaaggatttcagcatgcgttgacactgatacttccaatggatttcaatttacagatgaatcacctactaacttcttctacaaggaaagcttctaaacctacatttgctccttagggtaaatggatgcagtgaccaaagcctagatcaaactgcccaaggggaaaaatatctatcacaagacgcagagagacacgggatgttatctggtacagtttttctgctgcaaaatgtccctggagctaaagctaaaatgacaaaaacagcattttccattttcctaagtgcatcctgcagtctcttcatgtccattggtattgccctgcaaaagtatgaaagtaacattcagatgcaagaatgtagtgaaaatttgttattgcagaagggattggccaactcacagtgttggacgcttggcccttggttgagtacatatcctcgagcattttgtctaaagtatccttggttaactgaagcttcagttctttttccacaactgatgatttcccaccattctgaatctgcagaaaagacaattatttacagtatcaggtcatccatccaagtaatctgattgaacttctgataaacgagtaatctgattgtagaaatgttaggagcgtagtcagtgagactctaccatgaagttttaagcaaa

SEQ ID NO: 1564 - DNA, 2080 bp, Oryza sativa
ggccgagtcgatcaccacacaaccaaaaaaactccggcccacttggagttggagcccgtggcaaatccatccatccatcgcctctgcctcgcctccaccaccgagatgccggggctcaccgcgccggcgagctactccgacgagccgcctcgccaccccgccctcaagatcaactccaaggaaccatttaatgctgagcctcatcgatcagcattagtttcatcttatattaccccggtggatttcttctacaagagaaaccatggaccgataccaattgtggatgacctctcaagatacagtgtttccattactggtattgtcaacaagaatgtgcagctgtccatggctgacattaggagtctcccaaagtatgatgtaactgcaacgttacagtgtgcaggcaacaggaggactgcaatgagtaaggtacggaaagtgagaggcgttgggtgggacatatctgctcttggaaatgcaacatggggaggagcaaagctatctgatgtccttgaactagttggaatacctaaactcagctcagtcacatctttaggaggcaagcatgttgagtttgtcagtgttgacaggtgcaaagaagaaaaaggtggtccctataaggcatcaattccactaaagcaggcaacagatcctgaagctgatgtgttacttgcatacgaaatgaacggagagaccctaaaccgtgatcatggatacccacttcgtgttgttgtacctggagtaattggcgcacgctctgtaaaatggcttgacagtatcaacataattgaagaagaatgccagggtttttttgtgcaaaaagattacaagatgtttccaccctccgtagactgggacaatattaattggtcaactaggaggccacaaatggatttccctgtgcagtctgctatttgtaccctggaggatgtggatgttatcaaggaagggaaggctaggattgctggatatgcagtctcaggtggtggccgtggcattgagagagttgatatatctgtcgatggggggaaaacatgggtcgaggctcatagatatcagaaaagcaacgtgccatacatatctgatggacctcggagtgataagtgggcatgggttctattcgaggctacattagacgttccagcaaacgctgagatagtagctaaggcggtggactcagcagcaaatgttcaacctgaaaaggtggaagacgtatggaacctgagaggaatcctcaacacatcttggcatcggatcaaaatacagaattcttcgtgcgtgggaagatccaaaatgtgaaataagtaaactgcttggaatcagaagtcaagagtttatagtgcccggaataataagttattgcagcattcgatgattctcgcagactgtgctcctgtactatagtactatgttggaatcgtgttgctggcctgggcttatatgagacgaaacacaatttttgggagtgatgttaagaagatgattaatacgtactccagtatttatgttgtcttctaatggaaaatttgcagttcttgtgctccatatgataaaagaaaaaactcagtaaattcagttgcaaagatgtgacaagacattaacattccccgcatatgtggaaatgtaaggatttcagcatgcgttgacactgatacttccaatggatttcaatttacagatgaatcacctactaacttcttctacaaggaaagcttctaaacctacatttgctccttagggtaaatggatgcagtgaccaaagcctagatcaaactgcccaaggggaaaaatatctatcacaagacgcagagagacacgggatgttatctggtacagtttttctgctgcaaaatgtccctggagctaaagctaaaatgacaaaaacagcattttccattttcctaagtgcatcctgcagtctcttcatgtccattggtattgccctgcaaaagtatgaaagtaacattcagatgcaagaatgtagtgaaaatttgttattgcagaagggattggccaactcacagtgttggacgcttggcccttggttgagtacatatcctcgagcattttgtctaaagta

SEQ ID NO: 1565 - DNA, 1589 bp, Triticum aestivum
gcgaagacgagggaagagagatgccggggctcacggcgccatcggactacgcggaggagccgccgcgccacccggccctcaggatcaactccaaggagccatttaatgctgagcctcatcgatctgcgttagtttcatcttatatcaccccagtggatttcttctacaagaggaatcatggaccaattcccaaagttgatgatatctcaagatacagtgtttccatcagtggcctcattaataagcatatccagctgtccatggatgacattaggatgcttccgaagtacaatgtcactgcaacattacagtgtgcaggcaataagagaactgcaatgagtaaggtacggaaagtgagaggtgttggatgggacgtatctgctcttggaaatgcaacttggggtggagcaaaactatccgatgtccttgaactagttggaatacataaactcagttcagtcacatctttaggaggcaaacatgttgagttcgtcagtgttgacaggtgtaaagaggagaaaggtggcccctataaggcatcaattccactaaagcaggcaacagatcctgatgctgatgtgttactcgcatatgaaatgaatggagagaccatcaatcgtgaccatggatatccactccgtgtggtcgtacctggtgttataggtgcacgctccgtaaaatggcttgacagcatcaacataatcaaggaagaatgccagggtttttttatgcaaaaagattacaagatgttcccacctaccgtagattgggacaatattaattggtcaactagaagaccacaaatggattttcctgtgcagtctgctatttgcaccctggaagatgtggatgttatcaaggaaggaaaggctagaattgctggatatgcagtctcaggtggcggccgtggcattgagagagtagatatatctgttgatgggggtaaaacatgggttgaagctcatagatgtcagaaaagcaatgtgccatacgtctctgatggagctcaaagcgacaagtgggcatgggttctatttgaggccacattggacataccaccaaatgccgagatagtagctaaggcggtggattcggccgcaaacattcaacccgaaaaagtggaggacatatggaatctgagaggaatcctcaacacatcttggcatcggatcaaaatacagaatacatcgtgcgtatctagatccaaaatgtgaaggaagtatgttgatgtgcctagaacaagcagcacgccggtccagctgagtccatgatatctccaaataataaagctactgcagcttaatttctgtgattttcgtactccctccgttccaaaatagatgacccaactttatactaactttgtacaaaattgagtcatctattttggaacggagggagtatgtactttgtcatggaactgtgttggtttgttaccagcgttacaaataactgcttgtgttggctgatagaatcgctatgacttgtgttttaggaatgcatgtttgaagtgctttaagaatgtgtcagcgttgagcatgaaccacaaatttttgggcataacagcaggctgttcgatggagaattaa

SEQ ID NO: 1566 - DNA, 3164 bp, Sorghum bicolor
ggattgggcgccaacccaactaaatagccgccctccatcactgcagaggccttccttcttctacctgctctgctccggctttccaatcctcccttcaccactccaccactcttctcccacctcttggctaagcttcttggttcttgcttgcacacttgtccaagtgtaaaaacagcaagcgctacctgatccaaaagctatagggctggtaaaagatcaaaagcgcgcgcggcgcagcaggtaaaattaaagaatcggaaaccaggaacgcattcccactcgatatcacccagcagcagagctcagatataagcaagctcaccagcaccaccctttcccatcctctcccactcccttctcctgtccaggcgtccactgccattgcctctctgcaagaagaacagggagggagagccagtaggccgccaaaggcccagagctgccaccgcaccatgatgtccggcggcgtgctcttcctggccctgctggcggcggcggcggcgttggccatcatcgtcgccccgtccccagccaatgcggcggtgtcgtacgaccacagggcggtggtgatcaacgggcagcgccggatcctcatctccggctccatccactacccacgcagcacgccggagatgtggccggaccttctccagaaggccaaggacggcggcctcgacgtggtccagacctacgtcttctggaacgggcacgaaccccagcagggccagtactacttcggcgaccgctacgacctcgtccgcttcgtcaagctcgccaagcaggccggcctcttcgtgcacctccgcatcgggccctacgtctgcgccgagtggaacttcggcggcttccccgtgtggctcaagtacgtccccggcgtcagcttccgcaccgacaacgcgccgttcaaggcggcgatgcaggcgttcgtggagaagatcgtgtcgatgatgaaggcggaggggctcttcgagtggcagggcgggcccatcatcctcgcgcaggtggagaacgagtacgggcccatggagtccgtcatgggcggcggcgccaagccctacgccaactgggcggccaagatggccgtcgccaccggcgccggcgtgccctgggtcatgtgcaagcaggacgacgcaccggaccccgtgatcaacacctgcaatggcttctactgcgattacttcagccccaactccaacagcaagcctacaatgtggaccgaggcctggaccggctggttcacggcgttcggtggcgcggtgccacaccggccggtggaggacatggccttcgccgtggcgcgcttcatccagaagggcggctccttcgtcaactactacatgtaccatggaggcaccaacttcgaccgcacctccggcgggccgttcatcgccaccagctacgattacgatgcgccgatcgacgaatacggtctgctgaggcagccgaaatggggtcacctgagggacctgcacaaggccatcaagcaagccgagccggcgctggtctccggcgaccccaccatccagaccatcgggaactacgagaaggcgtacgtgtacaagtcgagcagcggcgcgtgcgcggcgttcctgtccaactaccacaccaacgcggcggcgcgggtggtgttcaacgggcggcgctacgacctcccggcgtggtccatcagcgtgctgccggactgcaggacggccgtgttcaacacggcgacggtgagctcgccgtcggcgccggcgaggatgacccccgcgggcggcttctcgtggcagtcgtacagcgaggccaccaactcgctggacgaccgcgccttcaccaaggacggcctggtggagcagctcagcatgacgtgggacaagtccgactacctgtggtacaccacctacgtgaacatcaactcgaacgagcagttcttgaagtccggacagtggccgcagctgaccatctactccgccggccacgccctgcaggtgttcgtcaacgggcagtcctacggcgccgcgtatggcggctacgacagcccgaagctgacatacagcgggtacgtgaagatgtggcagggcagcaacaagatctccatcctcagcgcagcagtcggcctccctaaccagggcacccactacgaggcgtggaacgtcggcgtgctcggtccggtgacgctgtccggcctcaacgagggcaagagggacctcagcaaccagaaatggacctaccagatcggcctgcacggcgagtcgctgggcgtgcactccgtcgccgggagctcgtccgtcgagtggggcagcgccgccgggaagcaacccttgacatggcacaaggcctacttcaacgcgccgtccggcaacgcgccggtggccctggacatgagcagcatggggaagggccaggcgtgggtgaacggccaccacatcggccggtactggtcgtacaaggccaccggcggcagctgcggcggctgcagctacgcggggacgtacagcgagaccaagtgccagaccggctgcggcgacgtctcgcagaggtactaccatgtcccgcgctcctggctcaaccccagcggcaacctgctggtggtgctcgaggagttcggcggcgacctgtccggcgtcaagctcgtcaccaggacgacatgattgattttggaaatggagatcaggttgtgaataattaatttgcttgctgggaagagaattagagaagggagaggagggcacacgcacacacacatgacaccaaattctttcttgctcatatggtatctatagatacggcgtacatacggacacaattcgtgctcacaatacgtacgtacaaaaaagattagtactagtattgtctactggagtctggagatcaatctgttcttggagttggccgtcgtccggcacggctgcaggaactgcagctcacggccggccggtatacaagtcgctgttgaatggtggtagtagtatgattttgctctgcagtctgtccacatagacttcattttcttagtagaaatttgcaacaatgagctgcaaaggaggttatttattcctaccatgtatgtatgatatcttattgtgtgaattaatgtcacaaagagaaataatgattctttccccacatctgggtcccttatttcctttcaacttcatttttccccccatgaacttcctttatcc

SEQ ID NO: 1567 - DNA, 3008 bp, Sorghum bicolor
cacctcttggctaagcttcttggttcttgcttgcacacttgtccaagtgtaaaaacagcaagcgctacctgatccaaaagatcaaaagcgcgcgcggcgcagcaggtaaaattaaagaatcggaaaccaggaacgcattcccactcgatatcacccagcagcagagctcagatataagcaagctcaccagcaccaccctttcccatcctctcccactcccttctccctccccctcgtccagtccacacccattgggcgagaagccgagaaggacagggagggagcggaagctagccaggccgtcccgtccagagccgcatgatgtccggcggcgtgctcttcctggccctgctggcggcggcggcggcgttggccatcatcgtcgccccgtccccagccaatgcggcggtgtcgtacgaccacagggcggtggtgatcaacgggcagcgccggatcctcatctccggctccatccactacccacgcagcacgccggagatgtggccggaccttctccagaaggccaaggacggcggcctcgacgtggtccagacctacgtcttctggaacgggcacgaaccccagcagggccagtactacttcggcgaccgctacgacctcgtccgcttcgtcaagctcgccaagcaggccggcctcttcgtgcacctccgcatcgggccctacgtctgcgccgagtggaacttcggcggcttccccgtgtggctcaagtacgtccccggcgtcagcttccgcaccgacaacgcgccgttcaaggcggcgatgcaggcgttcgtggagaagatcgtgtcgatgatgaaggcggaggggctcttcgagtggcagggcgggcccatcatcctcgcgcaggtggagaacgagtacgggcccatggagtccgtcatgggcggcggcgccaagccctacgccaactgggcggccaagatggccgtcgccaccggcgccggcgtgccctgggtcatgtgcaagcaggacgacgcaccggaccccgtgatcaacacctgcaatggcttctactgcgattacttcagccccaactccaacagcaagcctacaatgtggaccgaggcctggaccggctggttcacggcgttcggtggcgcggtgccacaccggccggtggaggacatggccttcgccgtggcgcgcttcatccagaagggcggctccttcgtcaactactacatgtaccatggaggcaccaacttcgaccgcacctccggcgggccgttcatcgccaccagctacgattacgatgcgccgatcgacgaatacggtctgctgaggcagccgaaatggggtcacctgagggacctgcacaaggccatcaagcaagccgagccggcgctggtctccggcgaccccaccatccagaccatcgggaactacgagaaggcgtacgtgtacaagtcgagcagcggcgcgtgcgcggcgttcctgtccaactaccacaccaacgcggcggcgcgggtggtgttcaacgggcggcgctacgacctcccggcgtggtccatcagcgtgctgccggactgcaggacggccgtgttcaacacggcgacggtgagctcgccgtcggcgccggcgaggatgacccccgcgggcggcttctcgtggcagtcgtacagcgaggccaccaactcgctggacgaccgcgccttcaccaaggacggcctggtggagcagctcagcatgacgtgggacaagtccgactacctgtggtacaccacctacgtgaacatcaactcgaacgagcagttcttgaagtccggacagtggccgcagctgaccatctactccgccggccacgccctgcaggtgttcgtcaacgggcagtcctacggcgccgcgtatggcggctacgacagcccgaagctgacatacagcgggtacgtgaagatgtggcagggcagcaacaagatctccatcctcagcgcagcagtcggcctccctaaccagggcacccactacgaggcgtggaacgtcggcgtgctcggtccggtgacgctgtccggcctcaacgagggcaagagggacctcagcaaccagaaatggacctaccagatcggcctgcacggcgagtcgctgggcgtgcactccgtcgccgggagctcgtccgtcgagtggggcagcgccgccgggaagcaacccttgacatggcacaaggcctacttcaacgcgccgtccggcaacgcgccggtggccctggacatgagcagcatggggaagggccaggcgtgggtgaacggccaccacatcggccggtactggtcgtacaaggccaccggcggcagctgcggcggctgcagctacgcggggacgtacagcgagaccaagtgccagaccggctgcggcgacgtctcgcagaggtactaccatgtcccgcgctcctggctcaaccccagcggcaacctgctggtggtgctcgaggagttcggcggcgacctgtccggcgtcaagctcgtcaccaggacgacatgattgattttggaaatggagatcaggttgtgaataattaatttgcttgctgggaagagaattagagaagggagaggagggcacacgcacacacacatgacaccaaattctttcttgctcatatggtatctatagatacggcgtacatacggacacaattcgtgctcacaatacgtacgtacaaaaaagattagtactagtattgtctactggagtctggagatcaatctgttcttggagttggccgtcgtccggcacggctgcaggaactgcagctcacggccggccggtatacaagtcgctgttgaatggtggtagtagtatgattttgctctgcagtctgtccacatagacttcattttcttagtagaaatttgcaacaatgagctgcaaaggaggttatttattcctaccatgtatgtatgatatcttattgtgtgaattaatgtcacaaagagaaataatgattctttccccacatctgggtcccttatttcctttcaacttcatttttc

SEQ ID NO: 1568 - DNA, 2853 bp, Saccharum officinarum
ccttctccctcctcctgtccactgccattgcggcctctctccgagaagccgagaaaaagacagggagggagagctaactaggccgccaaaggccggcccagcgtcaccgcaccatgtccggcggcgtgcccctcctggccctggcggctctgctggcggtggcggccatcatcatcgttccgtccccagccaatgccaccgtgtcgtacgaccacagggccgtggtgatcaacgggcagcgccgcatcctcatctcggggtccatccactacccgcgcagcacgccggagatgtggccggacctgctccagaaggccaaggacggcgggctggacgtggtccagacgtacgtgttctggaacgggcacgaacccgtgcaggggcagtactacttcggcgaccgctacgacctcgtccgcttcgtcaagctcgccaagcaggcggggctctacgtgcacctccgcatcgggccctacgtctgcgccgagtggaacttcggtggcttccccgtgtggctcaagtacgtccccggcatcagcttccgcaccgacaacacgcccttcaaggcggcgatgcagacgttcgtggagaagatcgtgtcgatgatgaagtcggaggggctcttcgagtggcagggtggccccatcatcctggcgcaggtggagaacgagtacgggcccatggagtccgtcatgggcggcggcgccaagccctacgccagctgggcggccaagatggccgtcgccaccggcgccggcgtgccttgggtcatgtgcaagcaggacgacgcaccggaccccgtgatcaacacctgcaacggcttctactgcgactacttcagccccaactccaacagcaagcctaccatgtggaccgaggcctggaccggctggttcacggcgttcggcggcgcggtgccgcaccggccggtggaggacatggccttcgccgtggcgcgcttcatccagaagggcggctccttcatcaattactacatgtaccatggaggcaccaacttcgaccgcacctccggcgggccgttcatcgccaccagctacgattatgatgcgccgatcgacgaatacggtcttctgaggcagccgaaatggggtcacctgagggacctgcacaaggccatcaagcaagctgagccggcactggtctccggcgaccccaccatccagtccatcgggaactacgagaaggcgtacgtgttcaagtcgagcagcggcgcctgcgcggcgttcctgtccaactaccacaccagcgccgcggcgcgggtggtgttcaacgggcggcgctacgacctcccggcgtggtccatcagcgtgctgccggactgcaagaccgccgtgttcaacacggcgacggtgcgcgagccgtcggcgccggcgaggatgagccccgtgggcggcttctcgtggcagtcgtacagcgaggccaccaactcgctggacgaccgcgccttcaccaaggacggcctggtggagcagctcagcatgacgtgggacaagtccgactacctgtggtacaccacctacgtgaacatcaactcgaacgagcagttcttgaagtccggacagtggccgcagctgaccatctactccgccggccacgccctgcaggtgttcgtcaacggccagtcctacggcgccgcgtatggcggctacgacagcccgaagctgacatacagcgggtacgtgaagatgtggcagggcagcaacaagatctccatcctcagcgcggcagtcggcctccctaaccagggcacccattacgaggcgtggaacgtcggcgtgctcggtccggtgacgctgtccggcctgaacgaggggaagagggacctcagcaaccagaaatggacctaccagatcggcctgcacggcgagtcgctgggcgtgcactccgtcgccgggagctcgtccgtcgagtggggcggcgccgccgggaagcaacccttgacatggcacaaggcctacttcaacgcgccgtccggcaacgcgccggtggccctggacatgggcagcatggggaagggccaagcgtgggtgaacggccaccacatcggccggtactggtcgtacaaggcctccggcggcagctgcggcggctgcagctacacggggacgtacagcgagaccaagtgccagaccagctgcggcgacatctcccagaggtactaccatgtcccgcgctcctggctcaacccaagcggcaacctgctggtggtgctggaagagttcggcggccgacctgtccggggtcaagcttcgtaccaagaccggatgatcggaaatggagatcaagttgtgaattaattggcttggaaaagaatttaaggagggaggcgcacccacccacaccatgacaccaattctttcttgctcaaacggtatctataggatacgggggtactacggaaacatattcttgctcttattagacgtatccagaatataaagaatgtgttttttgattggaacactgttcttttatttgcgctctgctctacgaccgattgtatgaatctacctctccggcgggctggtttcttaaaaatatatttgtgttcctggcttccgggagtgattaattgtttagtatatcttaccttgtctcggcccttggcttattaaataaaatctttttatgtttctcggtcaatgaatgttagatagattttcatctttctttcgtgcacagtcgtggctaactagtacgaatttttctacaaccatatcagtcgtctctcgtctctatacgacatacaaattatttcatagtcttccgtgggtgtcgagacggttggaaagattgaacaattatgtatttctcgtctctgttgtcgtgtgc

SEQ ID NO: 1569 - DNA, 3131 bp, Setaria italica
ccgccctccctcactgcagaggccggccttcttctacctgctctgcttcggctttccgcttctggcttcaccaccccaccactcctcttgcttgcggcctcgtccagcggtaaacaccgagcgctgatccaaaagcgaggggaaaagatctaaagcgcggcaggtgaaagaatcggaaaccaggaacgcattcccactcctcgcccagcacggctcagatataagctcgccatcaccagaaccacccctttccgtcctcctctcccactccctccctcttccctcctcccgccctctgccattgcccctcgacgaagagagagagagagagagcgcgagcgagccgggccgccccaggccgtcgtagctaggtgacgccaccatgtccggcggcgcgctcctcgtcgccctgctggcggcggcggcggtcatcatcgtctcgtcccctgccccggccaatgccgcggtgtcgtacgaccaccgcgccgtgaccatcaacgggcagcggcgcgtgctcatctccgggtcaatccactacccgcgcagcacgccggagatgtggccggacctgctgcagaaggccaaggacggcggcctcgacgtggtccagacgtacgtgttctggaacgggcacgagccggtgcaggggcagtactacttcggcgaccgctacgacctcgtccgcttcgtcaagctcgccaagcaggccggcctcctcgtccacctccgcatcggcccctacgtctgcgccgagtggaacttcggtgggttccccgtgtggctcaagtacgtccccggcatcagcttccggacggacaacgggccgttcaaggcggcgatgcaggcgttcgtggagaagatcgtgtcgatgatgaaggcggaggggctcttcgagtggcagggcgggcccatcatcctggcgcaggtggagaacgagtacgggcccatggagtccgtcatgggcggcggcgcccagccctacgccagctgggcagccaagatggccgtcgccaccggcgcccgcgtgccctgggtcatgtgcaagcagacgacgcccccgaccccgtgatcaacacctgcaacgggttctactgcgactacttcacccccaactccaacagcaagcccaccatgtggacggaggcctggagcggttggttcacggcgttcggcaagccggtgccgcaccgcccggtggaggacctcgccttcgccgtggcgaggttcatccagaagggcgggtccttcgtcaactactacatgtaccatggcggcaccaacttcgaccggacctccggcgggcccttcatcgccaccagctacgactacgatgcgccaatcgacgaatacggtctgctgaggcagccgaaatggggtcacctgagggacctgcacaaggccatcaagcaggccgagccggcgctcgtctccggcgacccgacggtccagtccatcggcaactacgagaaggcgtacgtgttcaagtcgagcggcggcgcgtgcgcggcgttcctgtccaactacaagacgaacgcgccagcgaccgtggtgttcaacgggcggcgctacgaactgccggcgtggtccatcagcgtgctgccggactgcaagaccgccgtgttcaacaccgcgacggtgaaggagccgtcggcgccggcgacgatgagccccgccggcggcttctcgtggcggtcgtacagcgaggccaccaactccctggacgaccgcgccttcaccaaggacggcctggttgagcagctcagcatgacgtgggacaagtccgactacctgtggtacaccacctacgtcaacatcgactcgagcgagcagttcttgaagtccggcaagtggccgcagctgaccatctactccgccggccatgccctgcaggtgttcgtcaacgggcagtcatacggcaccgcgtatggcggctacgacagtcccaagctgacgtacagcgggtacgtcaagatgtggcagggcagcaacaagatctccatcctcagcgccgccgtcggcctccctaaccagggcacccactacgagacgtggaacgtcggcgtcctcggcccggtgacgctgtccggcctgaacgaggggaagcgggacctcagcaaccagaaatggacgtaccagatcggcctccacggcgagtcgctgggcgtgcacaccgccgccgggagctcctccgtcgagtggggcggcgccgccgggaaccagccgctgacatggcacagggcctacttcaacgcgccggccggcggcgcgccggtggcgctggacctgggcagcatggggaagggccaggcgtgggtgaacgggcaccacatcgggcggtactggtcgtacaaggccgccggcggcggcgggtgcggcggctgcggctacgccggcacctacagcgagaccaagtgccagagcggctgcggcgacatctcacagcggtactaccacgtccccaggtcgtggctcaaccccagcggcaacctcgtcgtgctgctcgaggagttcggcggcaacctctccggcgtcacgctggtgaccaggacggcatgaggagggagagggaagattggaagaagacgaggaggaggaggaggaggaggaattgtgaataattttctgggaacttggaagagacgaggaaagggcacacacatgataccgattgtttcttgttcgtatctatacgaatacggcgtacatacggacacgattggtgagtcgttgcgattatacgtacgtacacagaaaaaagtagtatttattggagatgtattattggagttggccgccggcacggctgcaggaactgcagctccggaacggccggccggtacacaatctctgttgaattgaatacagtagtatgattttgctctgcattctgcagaatgccttggttcacgcagaaattcattttatttggagaaatttgcagcattgagttgtaaatgggttatttattcctgccattatgtatatgaaggaactaagtattcttttaccccttttttaccactgtctaatcatgcaattgattattatctttttccttctggggagattttgaacctgcaataatgcagatagaaggcaacttgatctgcacagctgagaagatgacgagc

SEQ ID NO: 1570 - DNA, 2813 bp, Brachypodium distachyon
ctcttctcctccgttgcttgcctctccaggaagccaacaatttgagccagttcacacactgggagcagagagagatagataggccgagagagaagaacagagccgggccccaggcggcccccaactccccaagctgggcaccatgtccggcggcgtcttgctgctcgtgctgctcgtggcggctgccgctgtcttcgcgtccccggccaatgccgccgtgtcctacgaccacaaggccatcgtcatcaatggccagcgccgcatcctcatgtccggctccatccactacccacgcagcacccccgagatgtggccggacctgatccagaaggccaaggacggcgggctggacgtgatccagacctacgtgttctggaacgggcacgagccggtgcaggggcagtactacttcggcgaccgctacgacctcgtccgcttcgtcaagctcgccaagcaggccggcctctacgtccacctccgcatcggcccctacgtctgcgccgagtggaacttcggtggattccctgtctggctcaagtatgtgcccggcatcagcttccggactgacaacggccccttcaaggcggcgatgcagacgttcgtggagaagatcgtgtcgatgatgaagtcggagggcctcttcgagtggcagggcgggcccatcatcctggcccaggtggagaacgagtacgggcccatggagtcggtcatgggcggcggcgccaagccctacgccaactgggccgccaagatggccgtcgccaccggcgccggcgtgccctgggtcatgtgcaagcaggacgacgcccccgaccccgtgataaacacctgcaatggcttttactgcgactacttcaccccgaactccaacggcaagcccaacatgtggaccgaggcctggagcggctggtttacggctttcggcggcgcggtgccgcaccggccggtggaggacctggccttcgccgtggcgaggttcgtccagaagggcggctctttcgtcaactactacatgtaccatggaggcacgaacttcgaccggaccgccggtggccccttcatcgcgacgagctacgactacgacgcgccgatcgacgaatacggtctgcttaggcagccgaaatggggtcacctgagggaccttcacaaggccatcaagcaggcagagccggcgatggtctccggcgaccccacgatccagtccatcgggaattacgagaaggcctacgtgttcaagtcgagcaccggagcctgcgcggcgttcctgtccaactaccacacgagctccccggcgaaggtcgtctacaacggccggcggtacgagctcccggcctggtccatcagcatcctgccggactgcaagaccgccgtctacaacacggccacggtgaaggagccgtcggcgccggcgaagatgaacccggcggggggtttctcgtggcagtcgtacagcgaggacaccaactcgctggacgacagcgccttcaccaaggacggcctggtggagcagctcagcatgacctgggacaagtccgacttcctgtggtacaccacctacgtgaacatcgactcgagcgagcagttcttgaagtccggacagtggccgcagctcaccatcaactccgccgggcacaccctgcaggtgttcgtcaacgggcaatcatacggcgccggctacggcggttacgacagcccgaagctgtcgtacagcaagtacgtgaagatgtggcaaggcagcaacaagatctccatcctgagctccgcagtcggcctcgcgaaccaagggacccattacgagaactggaacgtgggcgttcttggcccggtgacgctgtcagggctgaaccaggggaagagggacctgagcaaccagaaatggacataccagatcgggctgaaaggcgagtcgctgggcgtgcactccatcaccgggagctcgtccgtcgaatggggcagcgccaacggcgcacagccgctgacatggcacaaggcctacttcagcgcgccggcgggcggcgctccggtggccctggacatgggcagcatgggcaagggccagatctgggtgaacgggcggaacgccggcaggtactggtcgtacaaggcctccggcagctgcggcagctgcagctacacgggcacctacagcgagaccaagtgccagaccaactgcggcgacatctcccaaagatggtaccacgtgccacggtcatggctcaaccccagcgggaacctgctggtggtgctcgaagagttcggcggcgatctgtcgggcgtcaaactgatgacgaggacaacataaaagagagtggacatatcggcctgtgaataatttgcagggggagttcagttggagggcacagagatacaccattgctttttcgtcacatatatccatacagacggcgtagatacggatgacacagttggtgctacgtagatacgtacagagactagctgcggtatttattagtattatatgggagggctatgttggggcttggccgccggagcggttgcaggaactgcaactccggtacgacggcgggccggtacacagtcgctgttgattactataatttcgagcccactttgtagatttgctctgcggtctgtgcgtgcatgcccggtttatattgcaaaattcctcttggttcgtgctatatcctcttttgttccacgaaaattttgcaacgtggagctgcaaatgtggatgagctctggttgtttgtttacatccattgatccttatgaatgataactgatatgttactcaccggaatggttataagaacaaataattattcgttgtg

SEQ ID NO: 1571 - DNA, 3080 bp, Brachypodium distachyon
ctcatcttattctccccacttctactcttccggggcggtaaacaacatcgagtaatccaaaagagaggggaaaagatcaaaggggagcagttaaacaagccaaaaagattccaaaaatcaagaacacgttcccaccgggcaccggcgccgtccgtccgcccgccttcctggccagcccgagccggccaattggtaaactcgtctgcagcggcatcacatataagccccacaacaccacaccttccctcctctcccatcactcttctcctccgttgcttgcctctccaggaagccaacaatttgagccagttcacacactgggagcagagagagatagataggccgagagagaagaacagagccgggccccaggcggcccccaactccccaagctgggcaccatgtccggcggcgtcttgctgctcgtgctgctcgtggcggctgccgctgtcttcgcgtccccggccaatgccgccgtgtcctacgaccacaaggccatcgtcatcaatggccagcgccgcatcctcatgtccggctccatccactacccacgcagcacccccgagatgtggccggacctgatccagaaggccaaggacggcgggctggacgtgatccagacctacgtgttctggaacgggcacgagccggtgcaggggcagtactacttcggcgaccgctacgacctcgtccgcttcgtcaagctcgccaagcaggccggcctctacgtccacctccgcatcggcccctacgtctgcgccgagtggaacttcggtggattccctgtctggctcaagtatgtgcccggcatcagcttccggactgacaacggccccttcaaggcggcgatgcagacgttcgtggagaagatcgtgtcgatgatgaagtcggagggcctcttcgagtggcagggcgggcccatcatcctggcccaggtggagaacgagtacgggcccatggagtcggtcatgggcggcggcgccaagccctacgccaactgggccgccaagatggccgtcgccaccggcgccggcgtgccctgggtcatgtgcaagcaggacgacgcccccgaccccgtgataaacacctgcaatggcttttactgcgactacttcaccccgaactccaacggcaagcccaacatgtggaccgaggcctggagcggctggtttacggctttcggcggcgcggtgccgcaccggccggtggaggacctggccttcgccgtggcgaggttcgtccagaagggcggctctttcgtcaactactacatgtaccatggaggcacgaacttcgaccggaccgccggtggccccttcatcgcgacgagctacgactacgacgcgccgatcgacgaatacggtctgcttaggcagccgaaatggggtcacctgagggaccttcacaaggccatcaagcaggcagagccggcgatggtctccggcgaccccacgatccagtccatcgggaattacgagaaggcctacgtgttcaagtcgagcaccggagcctgcgcggcgttcctgtccaactaccacacgagctccccggcgaaggtcgtctacaacggccggcggtacgagctcccggcctggtccatcagcatcctgccggactgcaagaccgccgtctacaacacggccacggtgaaggagccgtcggcgccggcgaagatgaacccggcggggggtttctcgtggcagtcgtacagcgaggacaccaactcgctggacgacagcgccttcaccaaggacggcctggtggagcagctcagcatgacctgggacaagtccgacttcctgtggtacaccacctacgtgaacatcgactcgagcgagcagttcttgaagtccggacagtggccgcagctcaccatcaactccgccgggcacaccctgcaggtgttcgtcaacgggcaatcatacggcgccggctacggcggttacgacagcccgaagctgtcgtacagcaagtacgtgaagatgtggcaaggcagcaacaagatctccatcctgagctccgcagtcggcctcgcgaaccaagggacccattacgagaactggaacgtgggcgttcttggcccggtgacgctgtcagggctgaaccaggggaagagggacctgagcaaccagaaatggacataccagatcgggctgaaaggcgagtcgctgggcgtgcactccatcaccgggagctcgtccgtcgaatggggcagcgccaacggcgcacagccgctgacatggcacaaggcctacttcagcgcgccggcgggcggcgctccggtggccctggacatgggcagcatgggcaagggccagatctgggtgaacgggcggaacgccggcaggtactggtcgtacaaggcctccggcagctgcggcagctgcagctacacgggcacctacagcgagaccaagtgccagaccaactgcggcgacatctcccaaagatggtaccacgtgccacggtcatggctcaaccccagcgggaacctgctggtggtgctcgaagagttcggcggcgatctgtcgggcgtcaaactgatgacgaggacaacataaaagagaatggacatatcggcctgtgaataatttgcagggggagttcagttggagggcacagagatacaccattgctttttcgtcacatatatccatacagacggcgtagatacggatgacacagttggtgctacgtagatacgtacagagactagctgcggtatttattagtattatatgggagggctatgttggggcttggccgccggagcggttgcaggaactgcaactccggtacgacggcgggccggtacacagtcgctgttgattactataatttcgagcccactttgtagatttgctctgcggtctgtgcgtgcatgcccggtttatattgcaaaattcctcttggttcgtgctatatcctcttttgttccacgaaaattttgcaacgtggagctgcaaatgtggatgagctctggttgtttgtttacatccattgatccttatgaatgataactgatatgttactcaccggaatggttataagaacaaataattattcgttgtgtattgctg

SEQ ID NO: 1572 - DNA, 2674 bp, Panicum virgatum
actgccattgcccttgcccctccaagaaccgagagaacggaagacatcgacccgggccgtcgtcccaggccggcccggcgccacccccgccccagccatgcccggcggcgccgcgctcctccttgccctgctggcgctggccgccatcggcccgtccccggccaatgccgcggtgtcgtacgaccaccgcgccgtggtcatcaacgggcagcgccgcgtcctcatctccggctccatccactacccgcgcagcgcgccggagatgtggccggacctgctccagaaggccaaggacggcggcctcgacgtggtgcagacgtacgtcttctggaacgggcacgagcccgtccagggacagtactacttcggcgaccgctacgacctcgtccgcttcgtcaagctcgcccaccaggccggcctctacgtccacctccgcatcggcccctacgtctgcgccgagtggaacttcggggggttcccggtgtggctcaagtacgtgccggggatcagcttccggacggacaacgggccgttcaaggcggcgatgcaggcgttcgtggagaaggtggtgtcgatgatgaaggcggaggggctgttcgagtggcagggcgggcccgtcatcctggcgcaggtggagaacgagtacgggcccatggagccctccatgggcgccggcgccaagccctacgccgcctgggccgccaggatggccgtcgccaccggcgccggcgtgccctgggtcatgtgcaagcaggacgacgcccccgaccccgtcatcaacacctgcaacgggttctactgcgactacttcagccccaactccaacagcaagcccaccatgtggacggaggcctggagcggctggttcacggcgttcggcaagccggtgccgcaccgccccgtggaggacctcgccttcgccgtcgccaggttcatccagaagggcggatccttcgtcaactactacatgtaccatggcggcaccaacttcgaccggacctctggcgggccgttcatcgccaccagctacgactacgatgcgcccatcgatgaatacggtttgctgaggcagccgaaatggggacacctgaaggacctgcacgcggccatcaagcaggccgagccggcgctcgtcgccggcgacccgacggtccagtccctcggcaactacgagaaggcgtacgtgttcaagtcgagcggcggcgcgtgcgcggcgttcctgtccaactacaagaccgacgcggcggcgacggtggcgttcaacgggcggcgctacgagctgccggcgtggtccatcagcgtgctgccggactgcaagaccgccgtgttcaacaccgcgacggtgcgggcgccgtcggcgccggcgcggatgagccccgccgccgccggcctcgcgtggcggtcctacggcgaggccaccaacgcgctggacagccgcgccttcaccaaggacggcctcgtcgagcagctcggcatgacgtgggacaagtccgactacctgtggtacaccacctacgtcaacatcgactcgaacgagcagttcttgaagtcggggaagtggccgcagctgaccatctactccgctggccacgctctgcaagtgttcgtcaacgggcagtcatacggcgcagcgtatggcggctacgacagcccgaagctgacgtacagcgggtacgtgaagatgtggcagggcagcaacaagatctctatcctcagcgccgccgtcggcctcccgaaccagggcacccactacgagacctggaacgtcggcgtgctcgggccggtgacgctctccggcctgaacgagggcaagcgggacctcagcggccagaaatggacgtaccagatcggcctccacggcgagtcgctgggcatctactccgcggccgggagctcctccgtcgcgtggggcggcgccgccgggagccagcccctgacatggcacaaggcctacttcgacgcgccggcgggcggcgcgccggtggcgctggacctgggcagcatgggcaagggccaggcgtgggtgaacggccggcacgtcggccggtactggtcgtacagggcggccggcggcgggtgcggcggctgcggctacgccggcacgtacagcgagaccaagtgccagagcggctgcggcgaggtctcccagcggtactaccacgtcccgcgggcgtggctcagccccggcggcggcaacctgctcgtgctgctcgaggagttcggcggcgacctcgccggcgtcacggtggtgacgaggacgacgtgaaggttgaagaggaggaaggtgaaggtggagctgtgaataatctggtgggaagatgcaaacggaggaagggcgcaaatgaatacgtgatacggattaattctttcttgctcatatctatattgatacggcgtacatacgtactgtacgtacaccaaaaaaaaaagtggtagtatttattggattggagttggccggcggcacggctggccggtatatatacatccgctgctgaatactagtattattttgctctgcagtctagcacgaatctcaaggttcacgctggcattcattcttctttgacaaaaattgcagcatcaagttgtaaatgggctatttatgaatttatccctgccgttctctgtgataaacttttttcgcgactgtgtctgagcacgtttttttatt

SEQ ID NO: 1573 - DNA, 2287 bp, Pennisetum glaucum
cgcggtgtcgtacgaccaccgcgccgtgaccatcaacgggcagcggcgcgtcctcatctccgggtccatccactacccgcgcagcacgccggagatgtggccggacctgctgcagaaggccaaggacggcggcctcgacgtggtccagacgtacgtgttctggaacgggcacgagcccgtgcaggggcagtactacttcggcgaccgctacgacctcgtccgcttcgtcaagttcgccaagcaggccggccttctcgtccacctccgcatcggcccctacgtctgcgccgagtggaacttcggtgggttcccggtgtggctgaagtacgtccccggcatcagcttccggacggacaacgggccgttcaaggcggcgatgcagacattcgtggagaagatcgtgtcgatgatgaagtcggaggggctcttcgagtggcagggcgggcccatcatcctggcgcaggtggagaacgagtacgggcccatggagtccgtcatgggcggcggcgccaagccctacgccaactgggcagccaagatggccgtcgccaccggcgccggcgtgccatgggtcatgtgcaagcaggacgacgcccccgaccccgttatcaacacctgcaacgggttctactgcgattacttcacccccaactccaacagcaagcccaccatgtggacggaggcctggagcggctggttcacggcgttcggcaagccggtgccgcaccgcccggtcgaggacctggccttcgccgtcgccaggttcatccagaagggagggtccttcgtcaactactacatgtaccatggcggcaccaacttcgaccggacctccggtggcccgttcatcgccactagttacgactacgatgctcccatcgacgaatacggtctgctgaggcagccaaaatggggccacctgagggacctgcacaaggccatcaagcaggcggagccggcgctggtctccggcgacccgacggtccagtccatcggcaactacgagaaggcttacgtgttcaagtcgagcggcggtgcgtgcgcggcgttcctgtccaactacaagaccaacgcgccggctaccgtggtgttcaacgggcggcgctacgacctcccggcgtggtccatcagcgtgctgccggactgcaagaccgccgtgttcaacaccgcgacggtcaaggagccgttggtgccggcgacgatgagccccgccggcggcttctcgtggcggtcctacagcgaggccaccaactccctggacgaccgcgcctttaccaaggacggcctggttgagcagctcagcatgacgtgggacaagtccgactacctgtggtacaccacctacgtcaacatcgactcgagcgagcagttcttgaagtcggggaagtggccgcagctgaccatctactccgccggccacgccctgcaggtgttcgtcaacggacagtcatacggcaccgcgtatggcggctacgacaatcccaagctgacgtacagcgggtacgtcaagatgtggcagggcagcaacaagatcgccatcctcagcgccgccgtcggcctccctaaccagggcacccactacgagacgtggaacgtgggcgtgctcggtccggtgacgctgtccggcctcaacgaggggaagcgtgacctcagcaaccagaaatggacgtaccagatcgggctgcacggcgagtcgctgggcgtgcacaccgccgccgggacctcctccgtcgagtggggcggcgccgccgggaaccagccgctgacatggcacagggcctacttcaacgcgccggccggcggcgcgccggtggcgctggacctgggcagcatggggaagggccaggcgtgggtgaacgggcaccacatcggccggtactggtcttacaaggcctccggcggcggctgcggtggctgcggctacgccggcacctacagtgagaccaagtgccagagcggctgcggcgacgtctctcagcggtactaccacatcccgcggtcgtggctcaaccccagcggcaacctcgtcgtcctgctcgaggagttcggcggcgacctctccggcgtcaagctggtgaccaggacggcatgaggattggaagaagaacacgacgacgaggaggtagaattgtgaataatttaccgggaactgggaagagacgatgaaggaagagcagacacacatgataccaattctttcttgttcgtatctacaaatacagcgtacatatacggacacgattcgtgatcattatacgtacgtgcacaaaaaaagagtagtatttat

SEQ ID NO: 1574 - DNA, 2805 bp, Secale cereale
tccgtccgtccagccggccagccgatagatagaccccgtcatcggcacatataagcccagcgccacccacgcctcccctccctccctccctccattgcccctccaggaagccaaccaccagttggagttggctcacactgtccaagcagtcggtccaccgaggcggagagaacagagccaggcgccaccatgccctccggcggcgcgggcgcgctcctcctcctcgccctgctcgccgcggcggcggccgctggcgtcgccaatgccgccgtgtcctacgaccaccgggccgtggtcatcaacgggcagcgccgcatcctcatgtccggctccatccactacccgcgcagcaccccggagatgtggccgggcctcatccagaaggccaaggacggcggcctcgacgtgattcagacctacgtcttctggaacggccacgagccggcgcgcgggcagtaccacttcgccgaccgctacgacctcgtccgcttcgtcaagctcgccgggcaggccggcctctacgtccacctccgcatcggcccctacgtctgcgccgagtggaacttcggtggattccctgtttggctcaagtacgtgcccggcatcagcttccggacggacaacggccccttcaaggcggagatgcagaggttcgtggagaagatcgtatcgatgatgaagtcggagggcctgttcgagtcgcagggcgggcccatcatcctcgcccaggtggagaacgagtacgggcccatggagtcggccatgggcgccggcgccaagccctacgccaactgggccgccaagatggccgtcgccaccgacgccggcgtgccctgggtcatgtgcaagcaggacgacgcccccgaccccgtgataaacacctgcaatggcttctactgcgactacttcagccccaactccaacagcaagcctaccatgtggaccgaggcctggactggatggttcacggcgttcggcggcccggtgccgcaccggccggtggaggacatggcgttcgccgtggcgaggtttatccagaagggcggctccttcgtcaactactacatgtaccatggaggcacaaacttcgaccggaccgctggtggcccgttcatcgcgacgagctacgactacgatgcgcccatcgatgaatacggtctgatcaggcagccgaaatggggtcacctgagggacctgcacaaggccatcaagcaggccgagccggcgctcgtctccggcgatcccaccgtccagcgcatcggcaactacgagaaggcgtacgtgttcaagtcgagcaccggagcgtgcgcggcgttcctgtccaactaccacacgagctccgccgcaagggtcgtgtacaacggccggcggtacgacctcccggcctggtccatcagcatcctgccggactgcaagaccgccgtcttcaacaccgccacggtgaaggagccgtcgttgccggcgaggatgaacccggcggggggcttcgcatggcagtcgtacagcgaggacaccaacgcgctggactcgagcgccttcaccaaggacggcctggtggagcagctcagcatgacctgggacaagtccgactacctgtggtacaccacctacgtcaacatcgactcgagcgagcagttcctcaagtccggccagtggcctcagctcaccatcaactccgccggccactcggtgcaggtgttcgtcaacggccaatccttcggcgtcgcctatggcggctacaacagcccgaagctgacgtacagcaagtccgtgaagatgtggcagggcagcaacaagatctccatcctcagctccgcaatgggcctccccaaccaagggacccactacgaggcctggaacgtgggcgtcctcggcccggtgacgctgtcggggctcaaccaggggaagagggacctcagcaatcagaaatggacgtaccagatcggcctcaaaggcgagtcgctcggcgtcaactccatcagcgggagctcctccgtcgagtggagcagcgccagcggcgcgcagccgctcacatggcacaaggcatacttcgcggcgccggcgggcagcgctccggtggcgctggacatgggcagcatggggaagggccagatctgggtgaacgggaacaacgccggccggtactggtcgtacagggcctccggcagctgcggcgcctgcagctacaccggcaccttcagcgaggccaagtgccagaccaactgcggcgacatctcccagcggtggtaccacgtgccgcggtcgtggctcaagcccagcggcaacctgctcgtcgtgctcgaggagttcggcggcgacctgtcgggcgtcacgcttatgacgaggacgacatgagaagcgggaagaagaagaagaaggcatgcaaaaagaattgtgaataatcttgcagggaaatggatggatggaggaagagggcacacgaatacagaatttcttcgtagtatatcagtacatacggcctggatacggatacaattggtatacgtacagtcgtacaaagactagtaggtgtagtatttattggagagctaattaaaaagtgttggccggcgcggtcgccggaacagtagctcaggcgcggcggccggccgtcctgccggtacgccatcgttgattcattgtcgatcacatatatttcgagccgtaggtgggtggatctgctctcaggcctgcgcacgcaagtgctttctgaagtaaactgaatccctcttgggggaattgttttctgaatcatcattcattccttctgaatattcttcagaagtgcagaagttatatggcaaa

SEQ ID NO: 1575 - DNA, 2802 bp, Hordeum vulgare
gaaagatcgatcaaacgagagcggttaaacaggcgcaagagattccagaaaccaagaacacgttgccacccgggcaccggcgccgtccgcccgcccgtccagccgatagataggccccgtcatcggcacacacacgcatataagcccagcgccatccacgcctcccctcctctccctccattgcccctccaagaagccaaccaaccaccggctggagttggttcacactgtccgagcagtccatcgaggcggagagaacagagccggccaccatgcgttccggcgccctcctcctcgccctgctcgccgccgccgccgccgccgtcgtcaatgccgcggtgtcctacgaccacagggcggtggtcatcaacgggcagcgccgcatcctcatgtccgggtccatccactacccgcgcagcaccccggagatgtggccggacctcatccagaaggccaaggacggcggcctggacgtgatacagacctacgtcttctggaacggccacgagccggcgcgcgggcagtaccacttcgccgaccgctacgacctcgtccgcttcgtcaagctcgccaggcaggccggcctctacgtccacctccgcatcggcccctacgtctgcgccgagtggaacttcggtgggttccctgtatggctcaagtacgtgcccggcatcagcttccggacggacaacggtcccttcaaggcggagatgcagaggttcgtggagaagatcgtgtcgatgatgaagtcggaggggctgttcgagtggcagggcgggcccatcatcctcgcccaggtggagaacgagtacgggcccatggagtcggccatgggcgccggcgccaagccctacgccaactgggccgccaacatggccgtcgccaccgacgccggcgtgccctgggtcatgtgcaagcaggacgacgcccccgaccccgtgataaacacctgcaatggcttctactgcgactacttcacccccaactccaacagcaagcccaccatgtggaccgaggcatggactggatggttcacggcgttcggcggcccggtgccgcaccggccggtggaggacatggcgttcgccgtggcgaggttcattcagaagggcggctccttcgtcaactactacatgtaccatggaggcacaaacttcgaccggaccgccggcggcccgttcatcgcgacgagctacgactacgacgccccgatcgacgaatacggtctgatcaggcagccgaaatggggccacctgagggacctgcacaaggccatcaagcaggccgagccggcgctcgtctccggcgacccgactatccagcgcatcggcaactatgagaaggcgtacgtgttcaagtcgagcaccggagcctgcgcggcgttcctgtccaactaccacaccagctccgccgcgaggatcgtgtacaacggccggcggtacgacctcccggcctggtccatcagcatcctgccggactgcaagaccgccgtcttcaacaccgccacggtgaaggagccgacggcgccggcgaagatgaacccggcggggggcttcgcgtggcagtcgtacagcgaggacaccaacgcgctggactcgaccgccttcaccaaggacggcctggtggagcagctcagcatgacctgggacaagtccgactacctgtggtacaccacctacgtcaacatcgactcgagcgagcagttcctcaagaccggccagtggccgcagctcaccatcaactccgccggccactccgtgcaggtgttcgtcaacggccaatccttcggcgtcgcctatggcggctacaacagccccaagctgacgtacagcaagccggtgaagatgtggcagggcagcaacaagatctccatcctcagctccgcaatggggctccccaaccaagggacccattacgaggcctggaacgttggcgtcctcggcccggtgacgctgtccgggctcaaccaggggaagagggacctcagcaaccagaaatggacgtaccagatcggtctcaaaggcgagtcgctcggcgtcaactccatcagcgggagctcctccgtcgagtggagcagcgccagcggcgcgcagccgctcacatggcacaaggcatacttcgcggcgccggcgggcagcgctccggtggcgctggacatggggagcatggggaagggccagatctgggtgaacgggaacaacgccggtaggtactggtcgtacagggcctccggcagctgcggcggctgcagctacgccggcaccttcagcgaggccaagtgccagaccaactgcggcgacatctcccagcggtggtaccacgtgccccggtcgtggctcaagcccagcgggaacctgctcgtcgtgctcgaggagttcggcggcgacctgtcgggcgtcacgctcatgactaggacgacataaggagcgggaagacgggaggaagaagaaggcatgcatgcagaaactgtgaataatctgaagaagagggcacgcgaatataccagtacatacggcctagatacggatacgattggtatacgtacagtcgtacaaagactagtgggtgtagtatttattcatggagagctaaaaaaggtgttgggcggcgcggctgccggaacagtagctgaggtgcggcggccggccgtgctgccgctgccggtataggatcgttgattcgttgtggatcacagatgtggagccgttggtaggtgggtggacctgctctcagtctcaggcctgcgcacgcaagtgctttctgaagtaaactgaatcccttttgggggaattttattttctc

SEQ ID NO: 1576 - DNA, 2559 bp, Secale cereale
aggaagccaaccaccagttggagttggctcacactgtccgagcagtcggtccaccgaggcggagagaacagagccaggcgccaccatgccctccggcggcggaggcctcctcttcctcgccctgctcgccgcggcggcggccgctggcgtcgtcaatgccgccgtgtcctacgaccaccgggccgtggtcatcaacgggcagcgccgcatcctcatgtccggctccatccactacccgcgcagcaccccggagatgtggccgggcctcatccagaaggccaaggagggcggcctggacgtgattcagacctacgtcttctggaacggccacgagccggcgcgcggccagtaccacttcgccgaccgctacgacctcgtccgcttcgtcaagctcgccgggcaggccggcctctacgtccacctccgcatcggcccctacgtctgcgccgagtggaacttcggtggattccctgtttggctcaagtacgtgcccggcatcagcttccggacggacaacggtcccttcaaggcggagatgcagaggttcgtggagaagatcgtgtcgatgatgaagtcgagggcctgttcgagtcgcagggcgggcccatccatcctcgcccaggtggagaacgagtacgggcccatggagtcggccatgggcgccggcgccaagccctacgccaactgggccgccaagatggccgtcgccaccgacgccggcgtgccctgggtcatgtgcaagcaggacgacgcccccgaccccgtgataaacacctgcaatggcttctactgcgactacttcagccccaactccaacagcaagcctaccatgtggaccgaggcctggactggatggtttacggcgttcggtggcgcggtgccgcaccggccggtggaggacatggcgttcgcggtggcgaggttcgttcagaagggcggctccttcgtcaactactacatgtaccatggaggcacaaacttcgaccggaccgctggtggcccgttcatcgcgacgagctacgactacgatgcgcccatcgatgaatacggtctgatcaggcagccgaaatggggtcacctgagggacctgcacaaggccatcaagcaggccgagccggcgctcgtcgccggcgatcccaccgtccagcgcatcggcaactacgagaaggcgtacgtgttcaagtcgagcaccggagcctgcgccgcgttcctgtccaactaccataccagctccgccgcgagggtcgtgtacaacggccggcggtacgacctcccggcctggtccatcagcatcctgccggactgcaagaccgccgtcttcaacaccgccacggtgaaggagccgtcgttgccggcgaggatgaacccggcggggggcttcgcgtggcagtcgtacagcgaggacaccaacgcgctggactcgagcgccttcaccaaggacggcctggtggagcagctcagcatgacctgggacaagtccgactacctgtggtacaccacctacgtcaacatcgactcgagcgagcagttcctcaagtccggccagtggccgcagctcaccatcaactccgccggccactcggtgcaggtgttcgtcaacggccaatccttcggcgtcgcctatggcggctacaacagcccgaagctgacgtacagcaagcccgtgaagatgtggcagggcagcaacaagatctccatcctcagctccgcaatgggcctccctaaccaagggacgcactacgaggcctggaacgtgggcgtcctcggcccggtgacgctgtcggggctcaaccaggggaagagggacctcagcaatcagaaatggacgtaccagatcggcctcaaaggcgagtcgctcggcgtcaactccatcagcgggagctcctccgtcgagtggagcagcgccagcggcgcgcagccgctcacatggcacaaggcatacttcgcggcgccggcgggcagcgctccggtggcgctggacatgggcagcatggggaagggccagatctgggtgaacgggaacaacgccggccggtactggtcgtacagggcctccggcagctgcggcgcctgcagctacaccggcaccttcagcgaggccaagtgccagaccaactgcggcgacatctcccagcggtggtaccacgtgccgcgctcgtggctcaagcccagcggcaacctgctcgtcgtgctcgaagagttcggcggcgacctgtcgggcgtcacgcttatgacgaggacgacatgagaagcgggaagaagaagaagaaagcatgcaaaaagaattgtgaataatcttgcagggaaatggatggatggaggaagagggcacacgaatacagaatttcttcgtagtatatcagtacatacggcctggatacggatacaattggtatacgtacagtcgtacaaagactagtaggtttagtatttattggagagctaattaaaaagtgttggccggcgcagtcgccggaacagtagctcaggcgcggcggccggccgtcctgccggtacgccatcgttgattcattgtcgatcacatatatttcgagccgt

SEQ ID NO: 1577 - DNA, 3112 bp, Oryza sativa
agccaaaaactcctcccatgcagacttcttcttcctcccctgcttcttctgcttcacgctttcaccatttcacccctcacgccttgctctctctctcttccctctccaatggtgaacagaatggcggtaatccaaaagcgagggaatacaatcaaaccaagaaattaaatttaaatgagaagaaaaaatgcacagataatataaattgagacaccgaaatcaagaactcgtataaaaagcccaccaccaccaccgcttctctcctctcccactcctctccttctccttctccttcttcttcctccattggcatctccaagaaacccaagcctttctacgtgcttcgagctcggccaccggccggcggacgcgcgcgcgccagccaccatgtccggcggcgccgtcgccttcctcctgctcgtcgccgccgccgccgtggccaatgccgccgtcacctacgaccacaggtcgctcaccatcaatggccagcgccgcatcctcatctccggctccatccactaccctcgcagcacccccgagatgtggccggacctgatccagaaggccaaggacggcggcctcgacgtgatccagacctacgtcttctggaacggccacgagccagtgcagggacagtactacttcagcgacaggtacgacctggtgaggttcgtgaagctggtgaagcaggcagggctctatgtcaacctccgcatcggcccctacgtctgcgccgaatggaactacggtgggtttcctgtctggctcaagtacgtcccgggcatcagcttcaggactgacaatggtccattcaaggcggcgatgcagacgttcgtggagaagatcgtgtcgatgatgaaatcggaagggctgttcgagtggcagggcggcccgatcatcctcgcccaggtagagaacgagtacgggccgatggagtcggtgatgggcagcggcgcgaagtcgtacgtcgactgggcggcgaagatggccgtcgccaccaacgccggcgtgccctggatcatgtgcaagcaggacgacgcccctgaccccgtgatcaacacctgcaacggattctactgcgacgacttcacccccaactccaagaacaagccttccatgtggacagaggcctggagcggctggtttacggctttcggtggcacggtgccgcagcggccagtggaggatctggcgttcgccgtggcgaggttcatccagaagggcggctccttcatcaactactacatgtaccatggcggcaccaactttgaccggacagctggcggcccgttcatcgcgacgagctacgattatgatgcgccgatcgatgaatacggtctgcttcggcagcccaaatggggtcacctgacgaaccttcacaaggccatcaagcaggccgagacggcgctcgttgccggcgacccgaccgtccagaacatcggcaactacgagaaggcatacgtgttcaggtcgagcagcggcgactgcgcggcgttcctgtccaacttccacacgagcgcggcggcgagggtggcgttcaacgggcggcggtacgacctcccggcgtggtccatcagcgtgctgccggactgcaggaccgccgtgtacaacaccgcgacggtgacggcggcgtcgtcgccggcgaagatgaacccggcgggcgggttcacctggcagtcgtacggcgaggccaccaactcgctggacgagacggccttcaccaaggacggcctcgtcgagcagctcagcatgacgtgggacaagtccgactacctgtggtacaccacctacgtcaacatcgactccggcgagcagttcttgaagtccggccagtggccgcagctgaccgtctactccgccgggcacagcgtgcaggtgttcgtcaacgggcaatacttcggcaatgcgtatggtggctacgacgggccgaagctgacgtacagtgggtacgtcaagatgtggcagggcagtaacaagatctccatcctcagctccgccgtcggcctcccgaacgtcggcacgcattatgagacgtggaacatcggcgtgctcggcccggtgacgctgtccggcctcaacgaggggaagagagacctcagcaaacagaaatggacataccagattggcctgaagggggagaagctgggggtgcactccgtcagcgggagctcctccgtggagtggggcggcgccgccggcaagcagccggtgacgtggcacagggcctacttcaacgcgccggccggcggcgcgccggtggcgctggacctcggcagcatggggaagggccaggcgtgggtgaacggccacctcatcggccgctactggtcctacaaggcctccggcaactgcggcggctgcagctacgccggcacctactccgagaagaagtgccaggccaactgcggcgacgcctcccagagatggtaccatgtcccaagatcatggctgaatcctagcgggaacctggtggtgctgctggaagagttcggcggcgacttgtccggggtcacgttgatgacgaggacgacatgaacaggaggaagaattgaagtggagatgatttgaattgtggataatttagcagggggaattgcagaattggggatttgggagcgaaggaaagtgggggcgtatagcaattatctatacatacggcgtagatacggatacggctgggtatacgtacatacgtatacgtatatgaactggtagagtactgttatttattgatggctgccgcgctggccggccgtacgccggagcggctgcaggaactgcggctccggtcacggctgccggcggccggtgtacggtcgccgtcgattatttattattttactagttatttattctgagccgtggatgatggctttgagatcagtgcacaggtgcttggagccttggatcgctttactctctctctctctccaattttcttcagttctatgagaaaatttgcaacgttgagttgtaaatgggaacagcacttagaattatgaatgataaattattgtcacctgatttataccaagagggaataattattcttttgtactatattgcaagttttctttgtccttcccagtaattaaatggtgagatttatacg

SEQ ID NO: 1578 - DNA, 3060 bp, Oryza sativa
agccaaaaactcctcccatgcagacttcttcttcctcccctgcttcttctgcttcacgctttcaccatttcacccctcacgccttgctctctctctcttccctctccaatggtgaacagaatggcggtaatccaaaagcgagggaatacaatcaaaccaagaaattaaatttaaatgagaagaaaaaatgcacagataatataaattgagacaccgaaatcaagaactcgtataaaaagcccaccaccaccaccgcttctctcctctcccactcctctccttctccttctccttcttcttcctccattggcatctccaagaaacccaagcctttctacgtgcttcgagctcggccaccggccggcggacgcgcgcgcgccagccaccatgtccggcggcgccgtcgccttcctcctgctcgtcgccgccgccgccgtggccaatgccgccgtcacctacgaccacaggtcgctcaccatcaatggccagcgccgcatcctcatctccggctccatccactaccctcgcagcacccccgagatgtggccggacctgatccagaaggccaaggacggcggcctcgacgtgatccagacctacgtcttctggaacggccacgagccagtgcagggacagtactacttcagcgacaggtacgacctggtgaggttcgtgaagctggtgaagcaggcagggctctatgtcaacctccgcatcggcccctacgtctgcgccgaatggaactacggtgggtttcctgtctggctcaagtacgtcccgggcatcagcttcaggactgacaatggtccattcaaggcggcgatgcagacgttcgtggagaagatcgtgtcgatgatgaaatcggaagggctgttcgagtggcagggcggcccgatcatcctcgcccaggtagagaacgagtacgggccgatggagtcggtgatgggcagcggcgcgaagtcgtacgtcgactgggcggcgaagatggccgtcgccaccaacgccggcgtgccctggatcatgtgcaagcaggacgacgcccctgaccccgtgatcaacacctgcaacggattctactgcgacgacttcacccccaactccaagaacaagccttccatgtggacagaggcctggagcggctggtttacggctttcggtggcacggtgccgcagcggccagtggaggatctggcgttcgccgtggcgaggttcatccagaagggcggctccttcatcaactactacatgtaccatggcggcaccaactttgaccggacagctggcggcccgttcatcgcgacgagctacgattatgatgcgccgatcgatgaatacggtctgcttcggcagcccaaatggggtcacctgacgaaccttcacaaggccatcaagcaggccgagacggcgctcgttgccggcgacccgaccgtccagaacatcggcaactacgagaaggcatacgtgttcaggtcgagcagcggcgactgcgcggcgttcctgtccaacttccacacgagcgcggcggcgagggtggcgttcaacgggcggcggtacgacctcccggcgtggtccatcagcgtgctgccggactgcaggaccgccgtgtacaacaccgcgacggtgacggcggcgtcgtcgccggcgaagatgaacccggcgggcgggttcacctggcagtcgtacggcgaggccaccaactcgctggacgagacggccttcaccaaggacggcctcgtcgagcagctcagcatgacgtgggacaagtccgactacctgtggtacaccacctacgtcaacatcgactccggcgagcagttcttgaagtccggccagtggccgcagctgaccgtctactccgccgggcacagcgtgcaggtgttcgtcaacgggcaatacttcggcaatgcgtatggtggctacgacgggccgaagctgacgtacagtgggtacgtcaagatgtggcagggcagtaacaagatctccatcctcagctccgccgtcggcctcccgaacgtcggcacgcattatgagacgtggaacatcggcgtgctcggcccggtgacgctgtccggcctcaacgaggggaagagagacctcagcaaacagaaatggacataccagattggcctgaagggggagaagctgggggtgcactccgtcagcgggagctcctccgtggagtggggcggcgccgccggcaagcagccggtgacgtggcacagggcctacttcaacgcgccggccggcggcgcgccggtggcgctggacctcggcagcatggggaagggccaggcgtgggtgaacggccacctcatcggccgctactggtcctacaaggcctccggcaactgcggcggctgcagctacgccggcacctactccgagaagaagtgccaggccaactgcggcgacgcctcccagagatggtaccatgtcccaagatcatggctgaatcctagcgggaacctggtggtgctgctggaagagttcggcggcgacttgtccggggtcacgttgatgacgaggacgacatgaacaggaggaagaattgaagtggagatgatttgaattgtggataatttagcagggggaattgcagaattggggatttgggagcgaaggaaagtgggggcgtatagcaattatctatacatacggcgtagatacggatacggctgggtatacgtacatacgtatacgtatatgaactggtagagtactgttatttattgatggctgccgcgctggccggccgtacgccggagcggctgcaggaactgcggctccggtcacggctgccggcggccggtgtacggtcgccgtcgattatttattattttactagttatttattctgagccgtggatgatggctttgagatcagtgcacaggtgcttggagccttggatcgctttactctctctctctctccaattttcttcagttctatgagaaaatttgcaacgttgagttgtaaatgggaacagcacttagaattatgaatgataaattattgtcacctgatttataccaagagggaataattattcttttgtacta

SEQ ID NO: 1579 - DNA, 2928 bp, Triticum aestivum
gatcaatgaaggcgtaagaaacagttaaaaaagcgacgcaaagcagaggttttgtactgcgccattgccagttgccatttgccaccctcgctcgattaattctccctccagtcccccacgcctcttcccattgccaccgccgctccgctccaagaagcgcacttcactcgcttcccccaaagccagcaactgagccgccgcacgcaaagaaagggaggctgccggagcggagaggcgcgtgcgtggccccaaccaaggctggccatggtgccgcccctcgtcgccggcggcggcctgctgctcgccgccttcgtggcattctccctcgcggcctcctcggccaatgccgccgtctcctacgaccaccgctccctcctcatcaacggccggcgccgcatcctcatctccggctccatccactacccgagaagcacaccagagatgtggccggggctcatccagaaggccaaggacggcggcctcgacgtcatccagacctacgtcttctggaacggccacgagccggtgaagggccagtactacttcagcgaccggtacgacctggtccggttcgtgaagctggcgaagcaggccggcctctacgtccacctccgcatcggcccctacgtctgcgccgagtggaactttggtggctttcctgtttggctcaagtatgtgcccggcatcagcttcaggacagacaatggcccgttcaaggcagagatgcagaggttcgttgagaagattgtgtccatgatgaaatccgagaggctgttcgaatggcaaggcggtccgatcatcatgtctcaggtggagaacgagtttgggccgatggagtctgtcgggggcagcggcgccaagccgtatgcgaactgggctgccaagatggctgtcgcgaccaacaccggcgtgccatgggtgatgtgcaaacaagaagacgccccagaccccgtgattaacacttgcaatggcttttactgtgattacttcaccccaaacaagaagaacaagccgaccatgtggaccgaggcctggaccgggtggtttacgtcgttcggaggggcggtccctcaccggccggtggaggacatggcctttgcggtggccaggttcatacagaagggtggctccttcgtcaactactacatgtaccacggaggaaccaactttggacgtaccgcgggcggtcccttcatcgcaaccagctacgattacgacgccccgatcgacgaatatggtttgcttaggcagccgaaatggggtcacttgagggacctgcacaaagccatcaagcaggctgagcctgtactggtctctggtgatccgactgtccagtcgctagggaactacgagaaggcatacgtcttcaagtcgaagaatggagcttgcgccgcgttcctgtcaaattaccacatgaatgctgcagtgaaagtcaggttcaatgggagacactatgacctccctgcttggtccatcagcattctgccggactgcaaaacagcggttttcaacaccgcgacggtgaaggagccaacactgctgccaaaaatgcatccggtggtgcggttcgcttggcagtcgtatagcgaggacacaaactcactcgacggcagcgccttcacgaagaatggcctggttgagcagctgagcatgacatgggacaagtcagactacctgtggtacaccacatacgtcaacattggtgccaatgagctcgcaaagaacggccagtggcctcagctcaccatctactccgctgggcactcgatgcaagtcttcgtcaacggaaaatcatacggttctgtttatggcggttacaacaacccgaagctgacgtatgacgggcatgtgaagatgtggcaagggagcaacaagatctccatcctgagttcagcagttggccttcctaatgacgggaaccatttcgagaggtggaatgtcggcgtcctcgggccggtgaccgtctccgggctaaattcggggaagagagacctgagccatcagaaatggacatatcaggttggcctgaaaggcgagtcgctggggctccacaccgtcgccggaagctcctccgtggagtggggcggtcctggtaacaagcagccactgacctggcacaaggccttgttcaccgcgccggtggggagcgacccggtggcgctggacatggggagcatggggaaggggcagatgtgggtgaacggccaccacgtcggccggtactggtcgtacaaggccccctccggcggctgcggccggtgcagctacgccgggacgtaccgccaggacaagtgccgctccaactgcggcgagctctcccagagatggtaccacgtgccgcgctcgtggctgaagccgggcggcaacctgctggtggtgctggaggagtacggcggcgacctcaccggcgtcgccatggccacgagaaggacgacatgagctcacaaagatactactagtagtagtaccaccgccctgctgattggttcgtttcatttcttgacgatacatacgtaccgtaccgcgatggacgtgtcacgtgagctcgtccacttcgcggtgtctacacacaggaacaaacagtgccaagctagagattttttagtagaggtggagaagagagagagggccagggagagggatggtattgatagcgcagagcggaaggggtggtggttggccatcagtgcggctgcggctgcaggaaggggcatgtgcagtgcgcctgcaatcaatcagccagctttcgatcaagttttcttcttcacgtgactcagggatacccagtagtagagtattgtgcatgaggtattcaattgtttgttaccgctcgtgacaacctttttgtaccacacaacttgtgttgcaggtgtggccaacatttgtagcctggtttcccgaaggataataataagtaaacaaccccaa

SEQ ID NO: 1580 - DNA, 2983 bp, Triticum aestivum
gatcaatgaaggcgtaagaaacagttaaaaaagcgacgcaaagcagaggttttgtactgcgccattgccagttgccatttgccaccctcgctcgattaattctccctccagtcccccacgcctcttcccattgccaccgccgctccgctccaagaagcgcacttcactcgcttcccccaaagccagcaactgagccgccgcacgcaaagaaagggaggctgccggagcggagaggcgcgtgcgtggccccaaccaaggctggccatggtgccgcccctcgtcgccggcggcggcctgctgctcgccgccttcgtggcattctccctcgcggcctcctcggccaatgccgccgtctcctacgaccaccgctccctcctcatcaacggccggcgccgcatcctcatctccggctccatccactacccgagaagcacaccagagatgtggccggggctcatccagaaggccaaggacggcggcctcgacgtcatccagacctacgtcttctggaacggccacgagccggtgaagggccagtactacttcagcgaccggtacgacctggtccggttcgtgaagctggcgaagcaggccggcctctacgtccacctccgcatcggcccctacgtctgcgccgagtggaactttggtggctttcctgtttggctcaagtatgtgcccggcatcagcttcaggacagacaatggcccgttcaaggcagagatgcagaggttcgttgagaagattgtgtccatgatgaaatccgagaggctgttcgaatggcaaggcggtccgatcatcatgtctcaggtggagaacgagtttgggccgatggagtctgtcgggggcagcggcgccaagccgtatgcgaactgggctgccaagatggctgtcgcgaccaacaccggcgtgccatgggtgatgtgcaaacaagaagacgccccagaccccgtgattaacacttgcaatggcttttactgtgattacttcaccccaaacaagaagaacaagccgaccatgtggaccgaggcctggaccgggtggtttacgtcgttcggaggggcggtccctcaccggccggtggaggacatggcctttgcggtggccaggttcatacagaagggtggctccttcgtcaactactacatgtaccacggaggaaccaactttggacgtaccgcgggcggtcccttcatcgcaaccagctacgattacgacgccccgatcgacgaatatggtttgcttaggcagccgaaatggggtcacttgagggacctgcacaaagccatcaagcaggctgagcctgtactggtctctggtgatccgactgtccagtcgctagggaactacgagaaggcatacgtcttcaagtcgaagaatggagcttgcgccgcgttcctgtcaaattaccacatgaatgctgcagtgaaagtcaggttcaatgggagacactatgacctccctgcttggtccatcagcattctgccggactgcaaaacagcggttttcaacaccgcgacggtgaaggagccaacactgctgccaaaaatgcatccggtggtgcggttcgcttggcagtcgtatagcgaggacacaaactcactcgacggcagcgccttcacgaagaatggcctggttgagcagctgagcatgacatgggacaagtcagactacctgtggtacaccacatacgtcaacattggtgccaatgagctcgcaaagaacggccagtggcctcagctcaccatctactccgctgggcactcgatgcaagtcttcgtcaacggaaaatcatacggttctgtttatggcggttacaacaacccgaagctgacgtatgacgggcatgtgaagatgtggcaagggagcaacaagatctccatcctgagttcagcagttggccttcctaatgacgggaaccatttcgagaggtggaatgtcggcgtcctcgggccggtgaccgtctccgggctaaattcggggaagagagacctgagccatcagaaatggacatatcaggttggcctgaaaggcgagtcgctggggctccacaccgtcgccggaagctcctccgtggagtggggcggtcctggtaacaagcagccactgacctggcacaaggccttgttcaccgcgccggtggggagcgacccggtggcgctggacatggggagcatggggaaggggcagatgtgggtgaacggccaccacgtcggccggtactggtcgtacaaggccccctccggcggctgcggccggtgcagctacgccgggacgtaccgccaggacaagtgccgctccaactgcggcgagctctcccagagatggtaccacgtgccgcgctcgtggctgaagccgggcggcaacctgctggtggtgctggaggagtacggcggcgacctcaccggcgtcgccatggccacgagaaggacgacatgagctcacaaagatactactagtagtagtaccaccgccctgctgattggttcgtttcatttcttgacgatacatacgtaccgtaccgcgatggacgtgtcacgtgagctcgtccacttcgcggtgtctacacacaggaacaaacagtgccaagctagagattttttagtagaggtggagaagagagagagggccagggagagggatggtattgatagcgcagagcggaaggggtggtggttggccatcagtgcggctgcggctgcaggaaggggcatgtgcagtgcgcctgcaatcaatcagccagctttcgatcaagttttcttcttcacgtgactcagggatacccagtagtagagtattgtgcatgaggtattcaattgtttgttaccgctcgtgacaacctttttgtaccacacaacttgtgttgcaggtgtggccaacatttgtagcctggtttcccgaaggataataataagtaaacaaccccaacatttgtccatgtccaacattttggagtaatttactacgcgtttcagttcaggcc

SEQ ID NO: 1581 - DNA, 2813 bp, Hordeum vulgare
cgccactgcgctgcctcactcgctcgcttgccccaacgccagcaactgagccgcagtgccgcacgcaaagttgccggagtgcaggggtgcgtggccccaacgaacggctggccatggcgccgccccttgttgccggcggccgcctgcttctcgccaccttcgtggcattctacctcgcggcctcctgggccaatgccgccgtttcctacgaccaccgctccctcgtcatcaacggccggcggcgcatcctcatctccggctccatccactacccgagaagcacaccagagatgtggccggggctcatccagaaggccaaggacggcggcctcgacgtcatccagacctacgtcttctggaacggccacgagccggtcaagggccagtactacttccgcgaccggtacgacctggtccggttcgtgaagctggccaagcaggccggcctctacgtccacctacgcatcggcccctacgtctgcgccgagtggaactttggtggctttcctgtttggctcaagtatgtgcccggcatcagcttcaggacagacaatggcccgttcaaggcagagatgcagaggttcgttgagaagattgtgtcgatgatgaaatccgaaaggctcttcgaatggcaaggcggtccgatcatcatgtctcaggtggagaacgagtttgggccgatggagtccgtcgggggcagcggcgccaagccgtataccaactgggccgccaagatggccgtcgcgaccaacaccggtgtgccgtgggtgatgtgcaagcaagaagacgcccctgaccccgtgattaacacttgcaatggtttttactgtgattacttcaccccaaacaagaagaataagccgaccatgtggaccgaggcctggactgggtggtttacctcgttcggaggggcggtccctcaccggccggtggaggacatggcctttgcagtggccaggttcatacagaagggtggctctttcgtcaactactacatgtaccacggaggaaccaactttggacgtaccgcaggcggtcccttcatcgccaccagctacgattacgacgccccgatcgacgaatttggtttgcttaggcaaccgaaatggggccacttgagggacctgcacaaggccatcaagcaggctgagcctatactggtttctggtgatccgactatccagtcgctagggaactacgagaaggcatatgtcttcaagtcaaagaatggagcttgcgctgccgcgttcctttcaaactaccacatgaatgctgcagtgaaagtcaggttcaatgggaggcactacgacctccctgcttggtccatcagcattctgccagactgcaaaacggcggttttcaacaccgcgacggtgaaggaaccaacactgctcccaaaaatgcatccggtggtatggttctcttggcagtcgtatagcgaggacacaaactcgctcgacgacagcgccttcacgaagaatgggctggttgagcagctaagcatgacatgggacaagtcagactacctgtggtacaccacatacgttaacattggtgccaatgagctcccgaagaacggccagtggcctgagctcaccatctactccgctgggcactcgatgcaggtcttcgtcaacggaaaatcatacggttctgtttacggcggttacgaaaaccccaagctgacatatgatgggcatgtgaagatgtggcaagggagcaacaagatctccatcctgagttcagcagtcggccttcctaacgacgggaaccatttcgagaggtggaacgtcggcgtcctcgggccggtgaccgtctccgggctaaacacggggaagagagacctcagccatcagaaatggacatatcaggtcggcctgaaaggtgagtcgctgggcctccacaccgtcaccggaagctcctccgtggagtggggcggtcctggtaacaagcagccactaacatggcacaaggccttgttcaacgcgccggcggggagcgacccggtggcgctggacatggggagcatggggaaagggcagatgtgggtgaacggccaccacgtcggccggtactggtcgtacaaggccccctccggcggctgtggccggtgcagctacgccgggacgtaccgccaggacaagtgccgctccaactgcggcgaaccctcacagagatggtaccacgtgccccggtcgtggcttaagccgggcggcaacctgctagtggtgctggaggagtacggcggcgatctcgccggcgttgccatggccacgagaaggacatgagctgattggattggttcatttcatttcttgatacgtacgtacgtacgtgccgcgattgacgtgtcacgtcacgtgtggataatactacaatgttcacgaggagctcgtctgacggtgtctacacacacaaacaaagaatcgttgaggtggagaagggagagagagagggccaggggtggagtattcattgcgcagagtgaaagaggtggtagttggctggctggtttcgcttcagccatcatcagtgcgcccatgtgcactgcgctggtgtgcaatcaatcaaccagcccaagtttttttcttcttcacgtgactaggggatagagtacttactattatccctagtagtataatgcatgaggtattcaattgtttgttactgctcgtgacagcctttttgtagtacggcacttgtgcatttgcaacacctgcgttgcaggtgtggccaacatttgttcgatgaccgtgtaacctgcttttcggaaggataatattaataagtaaacaactcccagcatttgtcca

SEQ ID NO: 1582 - DNA, 2417 bp, Setaria italica
cggtgcaggggcagtactacttcggcgaccgctacgacctcgtccgcttcgtcaagctcgccaagcaggccggcctcctcgtccacctccgcatcggcccctacgtctgcgccgagtggaacttcggtgggttccccgtgtggctcaagtacgtccccggcatcagcttccggacggacaacgggccgttcaaggcggcgatgcaggcgttcgtggagaagatcgtgtcgatgatgaaggcggaggggctcttcgagtggcagggcgggcccatcatcctggcgcaggtggagaacgagtacgggcccatggagtccgtcatgggcggcggcgccaagccctacgccagctgggcagccaagatggccgtcgccaccggcgccggcgtgccctgggtcatgtgcaagcaggacgacgcccccgaccccgtgatcaacacctgcaacgggttctactgcgactacttcacccccaactccaacagcaagcccaccatgtggacggaggcctggagcggttggttcacggcgttcggcaagccggtgccgcaccgcccggtggaggacctcgccttcgccgtggcgaggttcatccagaagggcgggtccttcgtcaactactacatgtaccatggcggcaccaacttcgaccggacctccggcgggcccttcatcgccaccagctacgactacgatgcgccaatcgacgaatacggtctgctgaggcagccgaaatggggtcacctgagggacctgcacaaggccatcaagcaggccgagccggcgctcgtctccggcgacccgacggtccagtccatcggcaactacgagaaggcgtacgtgttcaagtcgagtggcggcgcgtgcgcggcgttcctgtccaactacaagacgaacgcgccagcgaccgtggtgttcaacgggcggcgctacgaactgccggcgtggtccatcagcgtgctgccggactgcaagaccgccgtgttcaacaccgcgacggtgaaggagccgtcggcgccggcgacgatgagccccgccggcggcttctcgtggcggtcgtacagcgaggccaccaactccctggacgaccgcgccttcaccaaggacggcctggttgagcagctcagcatgacgtgggacaagtccgactacctgtggtacaccacctacgtcaacatcgactcgagcgagcagttcttgaagtccggcaagtggccgcagctgaccatctactccgccggccatgccctgcaggtgttcgtcaacgggcagtcatacggcaccgcgtatggcggctacgacagtcccaagctgacgtacagcgggtacgtcaagatgtggcagggcagcaacaagatctccatcctcagcgccgccgtcggcctccctaaccagggcacccactacgagacgtggaacgtcggcgtcctcggcccggtgacgctgtccggcctgaacgaggggaagcgggacctcagcaaccagaaatggacgtaccagatcggcctccacggcgagtcgctgggcgtgcacaccgccgccgggagctcctccgtcgagtggggcggcgccgccgggaaccagccgctgacatggcacagggcctacttcaacgcgccggccggcggcgcgccggtggcgctggacctaggcagcatggggaagggccaggcgtgggtgaacgggcaccacatcgggcggtactggtcgtacaaggccgccggcggcggcgggtgcggcggctgcggctacgccggcacctacagcgagaccaagtgccagagcggctgcggcgacgtctcccagcggtactaccacgtccccaggtcgtggctcaaccccagcggcaacctcgtcgtgctgctcgaggagttcggcggcaacctctccggcgtcacgctggtgaccaggacggcatgaggagggagagggaagattggaagaagacgaggaggaggaggaggaggaggttgaattgtgaataattttctgggaacttggaagagacgaggaaagggcacacacatgataccgattgtttcttgttcgtatctatacgaatacggcgtacatacggacacgattggtgagtcgttgcgattatacgtacgtacacagaaaaaagtagtatttattggagatgtattattggagttggccgccggcacggctgcaggaactgcagctccggaacggccggccggtacacaatctctgttgaattgaatacagtagtatgattttgccctgcattctgcagaatgccttggttcacgcagaaattcattttatttggagaaatttgcagcattgagttgtaaatgggttatttattcctgccattatgtatatgaaggaactaagtattcttttacaactcaatgctgcaaatttctccaaataaaatgaatttctgcg

SEQ ID NO: 1583 - DNA, 2593 bp, Triticum aestivum
ctcatccagaaggccaaggacggcggcctggacgtgatacagacctacgtcttctggaacggccacgagccggcgcgcgggcagtaccacttcgccgaccgctacgacctcgtccgcttcgtcaagctcgccaagcaggccggcctctacgtccacctccgcatcggcccctacgtctgcgccgagtggaacttcggtggattccctgtttggctcaagtacgtgcccggcatcagcttccggacggacaacggtcccttcaaggcggagatgcagaggttcgtggagaagatcgtgtcgatgatgaagtcggagggcctgttcgagtggcagggcgggcccatcatcctcgcccaggtggagaacgagtacgggcccatggagtcggccatgggcgccggcgccaagccctacgccaactgggccgccaagatggccgtcgccaccgacgccggcgtgccctgggtcatgtgcaagcaggacgacgcccccgaccccgtgataaactcctgcaatggcttctactgcgactacttcagccccaactccaacggcaagcccaccatgtggaccgaggcctggactgggtggttcacggcgttcggtggcccggtgccgcaccggccggtggaggacatggcgttcgccgtggcgaggttcattcagaagggcggctccttcgtcaactactacatgtaccatggaggcacaaacttcgaccggaccgccggtggcccgttcatcgcgacgagctacgactacgacgcgccgatcgacgaatacggtctgatcaggcagccgaaatggggccacctgagggacctgcacaaggccatcaagcaggccgagccggcgctcgtctccggcgatcccaccgtccagcgcatcggcaactacgagaaggcgtacgtgttcaagtcgagcaccggagcctgcgccgcgttcctgtccaactaccacacgagcgccgccgcgagggtcgtgtacaacggccggcggtacgacctcccggcctggtccatcagcatcctgccggactgcaagaccgccgtcttcaacaccgccacggtgaaggagccgtcgttgccggcgaagatgaacccggcggggggcttggcgtggcagtcgtacagcgaggacaccaacgcgctggactcgagcgccttcaccaaggacggcctggtggagcagctgagcatgacctgggacaagtccgactacctgtggtacaccacctacgtcaacatcgactcgagcgagcagttcctcaagtcggggcagtggccgcagctcaccatcaactccgccggccactcggtgcaggtgttcgtcaacggccagtccttcggcgttgcctatggcggctacaacaacccgaagctgacgtacagcaagcccgtgaagatgtggcagggcagcaacaagatctccatcctcagctccgcaatgggcctccctaaccaagggacccattacgaggcctggaacgtgggcgtcctcggcccggtgacgctgtccgggctcaaccaggggaagagggacctcagcaatcagaagtggacgtaccagatcggcctcaaaggcgagtcgctcggcgtcaactccatcagcggcagctcctccgtcgagtggagcagcgccaccggcgcgcagccgctcacatggcacaaggcctacttcgcggcgccggcgggcagcgctccggtggcgctggacatgggcagcatggggaagggacagatctgggtgaacgggaacaacgccggccggtactggtcgtacagggcctccggcagctgcggcgcctgcagctacgccggcaccttcagcgaggccaagtgccagaccaactgcggcgacatctcgcagcggtggtaccacgtgccgcggtcgtggctcaagcccagcggcaacctgctcgtcgtgctcgaggagttcggcggcgacctgtccggcgtcacgctcatgacgaggacgacatgagaagcgggaggacgggaggaggaagatggcatgcagaaattgtgaataatctggaggggaatggagggaggcagaaagagggcacacgaaggcacacaactttcgtagtatatatatcagtacatacggcctggatacggatacgattggtatacgtacagtcgtacaaagactagtaggcgtagcagtatttattcatggagagcgggaaaagtgttgggcggcgcggtcgccggaacagtagctcaggcgcggcggccggcgtcctgccggaatacgatcgttgattcattgccaatcacaaatatttcgagacgttggtgggtgggtggatctgctctcgggcctgcgcacgcaagtgctttctgaagcatactgaacccctttggggggaattattttctgaatcattcgttccttctcaacatgttcttcagaaattactacgtatatggcttctaaagtgactgcttgacgccagaattgttcgcttctgtagttctcggtgatcactcgccagcaaaaattcatgtttcctctcctgaaatttaatcgagatctgacctaatttgtaaaaatttcaggatatgacatttttgctattgccagg

SEQ ID NO: 1584 - DNA, 2600 bp, Brachypodium distachyon
gccaatatatggcgccgccccgtgttgccggcggccgcggcctgctgctgctgctggccgtcctcgcggcgctctgcttcgccgtcgccaatgccgccgtctcctacgaccaccgctccctcgtcatcaacggccgccgccgcatcctcatctccggctccatccactacccgcgaagcacgcccgagatgtggccggggctgatccagaaggccaaggacggcggcctcgacgtcgtccagacctacgtcttctggaacggccacgagccggtcaagggccagtactacttcagtgaccgctacgacctgatccggttcgtgaagctggtgaagcaggccggcctctacgtccacctccgcatcggcccctacgtctgcgccgagtggaactttggtggctttcctgtttggctcaagtatgtgcccggcatcagcttcaggacagacaatggccccttcaaggcggagatgcagaggtttgtcgagaagatcgtgtcgatgatgaaatccgagaggctgtttgaatggcagggtggtccgatcatcatgtctcaggtggagaatgagttcgggccaatggaatccgctgggggcgtcggcgccaagccttacgcgaattgggctgctaagatggctgtggccaccaacaccggtgtgccgtgggtgatgtgcaaacaagaagatgcccctgaccccgtgattaacacttgcaatggcttttactgcgattacttcaccccaaataagaagaacaagccagccatgtggaccgaggcctggaccgggtggtttacgtcgttcggaggggcagtgcctcaccgtccggtggaggacatggcctttgcggtggcaaggttcatacagaagggtggctccttcgtgaattattacatgtaccatggaggaaccaactttggacgcacagcaggcggtcccttcgtcgcaaccagctacgattatgatgccccgatcgacgaatttggtttgcttaggcagccgaaatggggtcacttgagggacctgcacaaggccatcaagcaggctgagcctacccttgtttctggtgatcctacaatccagtcactgggaaactacgagaaggcatatgtcttcaagtcgaaaaatggagcttgtgccgcgttcctgtcaaactaccacatgaattcagccgtgaaagtcaggttcaatggaagacactatgacctccctgcttggtctatcagcattctgccagactgcaaaaccgtggttttcaacactgcaacagtgaaggaaccaactctgctgccaaagatgcacccggtggtacgtttcacttggcagtcgtacagcgaggacacaaactcactggatgacagcgcattcacaaaggatggtctggtcgagcagcttagcatgacatgggacaagtcagactacctatggtacaccacattcgttaacattggtcccggtgagctctcgaagaatggccagtggcctcagctcactgtatactccgctgggcactcgatgcaggttttcgtcaatgggaaatcatatggttctgtctatggtggtttcgagaaccccaagctgacatatgatggacatgtgaagatgtggcaaggtagcaacaagatctccattctgagttcagcagttggccttcctaatgtcggggaccattttgagaggtggaacgtcggtgtcctcggaccggtgaccctctccggcctaagtgaggggaagagagacctgagccatcagaaatggacatatcaggtcggcctgaaaggcgaatcgctggggatccacactgtctctgggagctccgccgttgagtggggcggtcctggcagcaagcagccactaacttggcacaaggccttgttcaacgcgccgtcggggagcgacccggtggcgctggacatggggagcatggggaaagggcagatgtgggtgaacggccaccacgtcggccggtactggtcctacaaggcgccctcccgcggctgcggcggctgcagctacgccgggacgtaccgcgaggacaagtgccggtccagctgcggcgagctctcccagagatggtaccacgtgccgcggtcgtggctgaagccgggtggcaacctgctggtggtgctggaggagtacggcggcgacgtcgccggcgtcaccctggcgacaagaacacaatgaagaaagatatccctgctgattcatctcttactatatttcacattctgcgatggacatgcgagataggataggagtagcatggtcacgcggtgctcgcccaaggactttccacagataacactagtgcacacgcagacgcaggcagcagctacaggtaaaaagcaggagatggtatttattggatgcgagtggaaatagttggttgaggtgccatccatcagtgattgcggccgcagaaacggcagctgcacctgcacttgcaatcaatctgccagccagccgattcaattcttttgaatctcatgtgactcaaaaataggaataacactttgctaccaccacagtactccagtgtatgaggtgtttactgttactgcttgtgacaggttttttgtactgcatttgcaacatttgggt

SEQ ID NO: 1585 - DNA, 2835 bp, Zea mays
gccacctcacgcccttcccatccatcccatcgccactccactcgcactcggccaagaaagaagcggcaggtcactgcccactgctgctccaggagcgagaaaggccagccaaggagggagctttgctttcaggaggagaggagcggcgaggtgggcggcgggcgccatggccgcagcgccgcgtagtcttgtcacctgcagcggcgggggcagtagcagtagtcgcatcctgctcgccgtcttcctggcggccgccctcttggcgtccgcggccaatgcggccgtctcgtacgaccaccgctccctcgtcatcaacggccgccgccgcatcctcatctccggctctatccactacccgagaagcgcccccgagatgtggcccgggctgatccagaaggccaaggacggcggcctcgacgtcgtccagacctacgtcttctggaacgggcacgagccggcgcaggggcagtactacttcgccgaccgctacgacctcgtccgcttcgtcaagctcgtcaggcaggccggcctctacgtccacctccgcgtcggcccctacgtctgcgcggagtggaacttcggtggctttccagtttggctcaagtatgtgccgggcatcaggttcaggacagacaatggcccattcaaggcggcaatgcagaagttcgtggagaagatagtgtccatgatgaagtcggaggggctgttcgagtggcagggaggcccgatcatcatggctcaggtggagaacgagttcgggccaatggagtccgtcgtgggcagtggcggcaagccatacgctcactgggcggcccagatggctgtcgggaccaacgccggcgtgccgtgggtgatgtgcaagcaggatgacgccccggaccccgtgatcaacacttgcaatggcttctactgcgactacttcacgccaaacaacaagcacaagccgaccatgtggaccgaagcctggactggatggttcaccaagttcggcggcgcggcgcctcaccggccggtggaggacctggccttcgccgtggcacggttcgttcagaaaggaggctccttcgtgaactactacatgtaccatggaggaacgaactttgggcgcaccgccggtggccccttcatcgcgaccagctacgactacgatgcccccattgacgagtttggtctgctcaggcaaccgaaatggggtcacttgaggaacatgcacagagctatcaagcaggccgagcctgcgttggtttctggcgatccaacgatacgatctattggaaactacgaaaaggcatatgtcttcaagtcaaagaatggagcctgtgctgcgttcctgtcgaactaccacgttaaatctgctgtgaggatcaggtttgacgggcgtcactatgacctcccggcttggtccatcagcattctgcccgactgcaaaaccgcagtcttcaacaccgcgacggtgaaggagccgactctgctgccgaagatgagcccggtgatgcatcgcttcgcttggcagtcctacagcgaggacacgaactcgctggatgacagcgcgtttgcaagggatggcctgatcgagcagctcagcttgacatgggacaagtcggactacctgtggtacaccacccatgtcaacattggttccaacgaacgattcctcaagtctggccagtggcctcagctcagtgtgtactctgctggacactccatgcaggtgttcgtcaatgggaggtcatatggatctgtttacggcggctacgacaacccgaagctaacattcagtgggtatgtgaagatgtggcagggcagcaacaagatctccattctaagctcagcagtgggccttcctaacaacggtgaccatttcgagctgtggaacgtcggcgtcctcgggccagtgaccctctccggcctgaacgaggggaagagggacctgagccatcagagatggatataccaggtcggcctgaaaggcgagtcgctcggcctccacaccgtgaccggaagctccgccgtggaatgggccggccccggcggcggcacgcagccgctgacttggcacaaggccctgttcaacgcgccggcggggagcgatccggtggccctggacatgggcagcatgggcaagggccaggtgtgggtgaacgggcgccacgccgggcgctactggtcgtacagggctcactcccgcggctgcgggcggtgcagctacgccgggacgtaccgcgaggaccagtgcacgtccaactgcggcgacctctcccagagatggtaccacgtgccgcggtcgtggctgaagccgagcgggaacctgctggtggtgctggaggagtacggcggcgacctcgccggcgtcagtctcgcgacacggactacgtgaacaaggcaggcgaacgacacgcgttgcatctaactcgtacatgtatactatactccgacgtgcgagtatatacatcgattggtatttgtttagtgaggtgaggccatggcgaggaggagcaagcataccgaccatgccgtattcgcggaccgtatttatacacacgacaccgtacattacactcgcgtgatagcaatggttatactgcaaggggaaggtaaggatggcatttaagtgcagagcggagagggtgggtgcctgggtggtctccggccatcagtgcggcggcaggaccggcagctagctagctgcgccggcgcggcacacacttcgaggccaattcaattcaactgtttcaattcatgtaactggcactctggcagcgggtgtttgctgctgcttgctgtgtttttttgaagacgtgaacatgaaatacaaaactgagcttgttttgtcca

SEQ ID NO: 1586 - DNA, 2306 bp, Sorghum bicolor
ttcggaggagaggagcgttgaggtgggcggcgggcaccatggccgcagcgcggcgtcttcttgccgcctgcagcagcggcggcggcgccggcgccggcgccggtagtcgcatcctgctcgctgtcttcttcctggcggcctcgctcttggcctccgcggccaatgcggccgtctcgtacgaccaccgctccctcgtcatcaacggccgccgccgcatcctcatctccggctctatccactacccgagaagcacccccgagatgtggcccgggctgatccagaaggccaaggacggcggcctcgacgtcatccagacctacgtcttctggaacggccacgagccggtgcaggggcagtaccacttcgccgaccgctacgacctcgtccgcttcgtcaagctcgtcaggcaggccggcctctacgtccacctccgcatcggcccctacgtctgcgccgagtggaacttcggtggctttcctgtttggctcaagtatgtgccgggcatcaggttcaggacagacaatggccccttcaaggctgcaatgcagaagttcgtcgagaagatagtgtccatgatgaagtcggaggggctatttgagtggcagggaggcccaatcatcatggctcaggtggagaacgagttcgggccgatggagtctgttgtgggcagtggcgccaagccatatgctcactgggcggcccagatggctgttgggaccaacaccggtgtgccgtgggtgatgtgcaagcaagatgacgcccctgaccctgtgatcaacacttgcaatggcttctattgcgactacttcacaccgaacaggaagtacaagccaaccatgtggaccgaagcctggactggatggtttaccaagtttggtggtgcgttgcctcaccggcctgtcgaagacctggccttcgctgtggcacggttcattcagaaaggaggctccttcgtgaactactacatgtaccatggagggacaaactttgggcgcacggctggtggcccttttatcgcaaccagctacgactatgatgcccccatcgatgaatttggtctgcttaggcaaccaaaatggggtcacctgagggacctgcacagggctatcaagcaggctgagcctgcgttgatttctggcgatccaacaatacaatcaattggaaactatgagaaggcatacatcttcaagtcgaagaatggagcctgtgctgcattcctgtcgaactaccacatgaagactgctgtgaaaatcaggtttgatgggcgtcattatgacctccctgcttggtccatcagcattcttcctgactgcaaaaccgcggtcttcaacactgcgacggtgaaggagccaactctgctgccaaagatgaacccagtgttacactttgcttggcagtcctacagcgaagacacaaactcgctggatgacagtgcgtttacaaggaatggcctggttgagcaactcagcttgacatgggacaagtcggactatctgtggtacaccacccatgtcagcattggtggcaatgaacaattcctgaagtctggccagtggcctcagctcactgtgtactcggctggacactcgatgcaggtgttcgtcaatgggagatcatatggatctgtttatggcggctatgacaacccgaaacttacgttcaatgggcatgtgaagatgtggcagggcagtaacaagatctccatcctaagctcggcagtgggccttcctaacaacgggaaccattttgagctgtggaacgtcggcgtcctcgggccggtgaccctctctggcctgaatgaggggaagagggacctcagccatcagaaatggacataccaggtcggcctgaaaggcgaatcgctcggcctccacaccgtgactggaagctccgccgtggaatgggccggccctggcggcaagcagccactgacttggcacaaggccttgttcaacgcgccggcggggagcgatccggtggctctggacatgggcagcatgggcaaaggccagatttgggtgaacgggcaccacgccgggcggtactggtcgtacagggcctactccggcagctgccggcggtgcagctacgccgggacgtaccgcgaggaccagtgcttgtccaactgcggcgacatctcccagagatggtatcacgtgccgcggtcgtggctgaagccgagcgggaacctgctggtggtgctggaggagtacggcggcggcgacctcgccggcgtcaccctcgcgacgcggaccacatgaacatggcgagccgcacacacacacattgcgtctaactcgtacata

SEQ ID NO: 1587 - DNA, 3251 bp, Sorghum bicolor
cactccactccaccattcccgtgcacgcgcacacacactccacagcccaagctcggagcagcagctcaccgccggcggtaaaccatccaaaagcggcccgcacaaacaaggataaaacaacaagcaaaagcagcagcataaaaaaaaagctcacgcactcctgactcctcccgtcgccattgccgccccctctcgacgaaaaacgccaccacctcacgcctttcccattgccactccgctcggccaagaagccgcaggtcactgctccagcctccaggagcgaggaacacctcttcggaggagaggagcgttgaggtgggcggcgggcaccatggccgcagcgcggcgtcttcttgccgcctgcagcagcggcggcggcgccggcgccggcgccggtagtcgcatcctgctcgctgtcttcttcctggcggcctcgctcttggcctccgcggccaatgcggccgtctcgtacgaccaccgctccctcgtcatcaacggccgccgccgcatcctcatctccggctctatccactacccgagaagcacccccgagatgtggcccgggctgatccagaaggccaaggacggcggcctcgacgtcatccagacctacgtcttctggaacggccacgagccggtgcaggggcagtaccacttcgccgaccgctacgacctcgtccgcttcgtcaagctcgtcaggcaggccggcctctacgtccacctccgcatcggcccctacgtctgcgccgagtggaacttcggtggctttcctgtttggctcaagtatgtgccgggcatcaggttcaggacagacaatggccccttcaaggctgcaatgcagaagttcgtcgagaagatagtgtccatgatgaagtcggaggggctatttgagtggcagggaggcccaatcatcatggctcaggtggagaacgagttcgggccgatggagtctgttgtgggcagtggcgccaagccatatgctcactgggcggcccagatggctgttgggaccaacaccggtgtgccgtgggtgatgtgcaagcaagatgacgcccctgaccctgtgatcaacacttgcaatggcttctattgcgactacttcacaccgaacaggaagtacaagccaaccatgtggaccgaagcctggactggatggtttaccaagtttggtggtgcgttgcctcaccggcctgtcgaagacctggccttcgctgtggcacggttcattcagaaaggaggctccttcgtgaactactacatgtaccatggagggacaaactttgggcgcacggctggtggcccttttatcgcaaccagctacgactatgatgcccccatcgatgaatttggtctgcttaggcaaccaaaatggggtcacctgagggacctgcacagggctatcaagcaggctgagcctgcgttgatttctggcgatccaacaatacaatcaattggaaactatgagaaggcatacatcttcaagtcgaagaatggagcctgtgctgcattcctgtcgaactaccacatgaagactgctgtgaaaatcaggtttgatgggcgtcattatgacctccctgcttggtccatcagcattcttcctgactgcaaaaccgcggtcttcaacactgcgacggtgaaggagccaactctgctgccaaagatgaacccagtgttacactttgcttggcagtcctacagcgaagacacaaactcgctggatgacagtgcgtttacaaggaatggcctggttgagcaactcagcttgacatgggacaagtcggactatctgtggtacaccacccatgtcagcattggtggcaatgaacaattcctgaagtctggccagtggcctcagctcactgtgtactcggctggacactcgatgcaggtgttcgtcaatgggagatcatatggatctgtttatggcggctatgacaacccgaaacttacgttcaatgggcatgtgaagatgtggcagggcagtaacaagatctccatcctaagctcggcagtgggccttcctaacaacgggaaccattttgagctgtggaacgtcggcgtcctcgggccggtgaccctctctggcctgaatgaggggaagagggacctcagccatcagaaatggacataccaggtcggcctgaaaggcgaatcgctcggcctccacaccgtgactggaagctccgccgtggaatgggccggccctggcggcaagcagccactgacttggcacaaggccttgttcaacgcgccggcggggagcgatccggtggctctggacatgggcagcatgggcaaaggccagatttgggtgaacgggcaccacgccgggcggtactggtcgtacagggcctactccggcagctgccggcggtgcagctacgccgggacgtaccgcgaggaccagtgcttgtccaactgcggcgacatctcccagagatggtatcacgtgccgcggtcgtggctgaagccgagcgggaacctgctggtggtgctggaggagtacggcggcggcgacctcgccggcgtcaccctcgcgacgcggaccacatgaacatggcgagccgcacacacacacattgcgtctaactcgtacatatactccgatgtgtgagtatatcgattagtatttactacattatttactgagcccatggcgaggagcagataaaagcacgccgtatttgtggacggtatttatacacataccaccgtagtacactacactcacatcatagcaaaggtagtatacactctacaactacaaggagggtgagagggagggaggctggcatttactgtagtgcagagcggcgagggtggttgccggccatcagtgcggcacacacttcgaggtcaattggatttttttttcggtttctacagggtatgtcgctgctcgcggcaggccactgcatgctgtgttgttttttttttgaacatgtgacgtgattacatgaaacactgatcaatgcagcttgatttgtttatggaatggtaataacctgccaactactattttactgtcgtactgttggcatttctctgtatgctgtactgtatgtcaaactgtacttattcactgtggtcaaactgccgtgctagtgctagaggtcggcacagtactctgttgctgttgctgcatctgatgatctgacgcaatgcgagtctgacgagagaatccattataaaaacgctggtgttctgttcacgcgtcctatgcgagtgttgagctgcaagaaacagagtgg

SEQ ID NO: 1588 - DNA, 2677 bp, Setaria italica
ttcttggacgagaggtgaggtgaggtgaggcgcgcggcgggcgccatggccggggcgccgcctcttcttgtctccgcctccggcggcgggcgcaccctgctcgctgccttcctggcggcctccctcctcgccgccgctgccaatgcgtccgtcttgtacgaccaccgctccctcgtcatcaacggccgccgccgcatcctcatctccggctccatccactaccccaggagcacgcccgagatgtggcccgggctgatccagaaggccaaggacggcggcctcgacgtcatccagacctacgtcttctggaacggccacgagccggtgcaggggcagtaccacttcgccgaccgctacgacctcgtccgcttcatcaagctcgtcaagcaggccggcctctacgtccacctccgcatcggcccctacgtctgcgcggaatggaacttcggtggttttcctgtttggctcaagtatgtgcctggtatcaggttcaggacggacaatggccccttcaaggccgcaatgcagaagttcgtcgagaagatagtgtcgatgatgaagtccgaggggctattcgagtggcagggaggcccaatcatcatggctcaagtggaaaatgagttcgggccgatggagtccgttgttggcagcggcgcccagccttatgcaattgggcagcccagatggcggttgggaccaacaccggcttgccttgggtaatgtgcaagcaggatgatgctcctgaccctgtgatcaatacttgcaatggcttctattgtgactacttcaccccgaacaagaagtacaagcctaccatgtggaccgaggcgtggactggatggtttaccaagtttggaggtgctgtgcctcaccggccggtggaggaccttgcctttgccgtggcacggttcattcagaagggagggtcgttcgtgaactattacatgtaccatggaggaacaaactttgggcgcacagccggtggcccttttatcgcaaacagctatgactatgatgccccgatcgacgaatttggcctgcttaggcaaccgaaatggggtcacctgagggacctgcacagggccatcaagcaggccgaacctgtgttggtttctggtgatccgacaatccaatcacttggaaactatgagaaggcacatgtcttcaagtcaaagaatggagcctgtgccgcattcttgtcaaactaccacatgaattctgctgtgaaagtcaggttcaatggacgtcactatgacctccctgcttggtccatcagcattctgcctgactgcaaaactgcggtcttcaacactgcgacagtgaaggagccaactctgctgccgaagatgactcccgtgttacagttcgcatggcagtcctacagcgaggacacaaactctctggatgacagcgctttcacaaaggatggcttagttgagcagctcagcttgacatgggacaagtcggattatctgtggtacaccacccaggtcaacattggtgcgaacgagcagttcctgaagtctggccagtggcctcagctcactgtctactctgctggacactccatgcaagtgtttgtcaatgggagatcatacggatccgtttatggcagctacgagaacccgaaactaacgttcaatgggcatgtgaagatgtggcagggcagcaacaagatctccatcctaagctcagcagttggccttcctaacaccgggaaccatttcgagtcgtggaacgtcggcgtcctgggaccggtgaccgtctccgggctgaacgaggggaagagggacctcagccatcagaaatggacatatcaggtcggcctgaaaggcgagtcgctcggcctccacaccgttaccgggagctccgccgtcgagtgggccggtcccggcggcaagcagccgctgacatggcacaaggccttgttcaacgcgccggcggggagctcgccggtggcgctggacatgggtagcatgggcaagggccaggtgtgggtgaacgggcaccacgccgggcggtactggtcgtaccgggccgccgccggcggctgtgggcggtgcagctacgccgggacgtaccgcgagggccggtgcctctccggctgcggcgacccctcccagaggtggtaccacgtgccgcggtcgtggctgaagcccagcggcaacctcctggtggtgctggaggagtacggcggcgacctcgccggcgtcgccctcgccacgcggaccacatgaacgtccaagaacaaggcgcgttctaccatcagactcgtacatactcgtaccacaccgtacactcggaaccacagcaacggtatactactacaagaggatggatgagcatttagtgccgggcggaggagagggtgggtggttgccggccatcactgcggcggcagggacggcagccggccggctgcaccggcacacacttcgagctcaattcaattggattcttttttcgattatgaatgctactacagtgtatgtgtgcatgtgtatggcactatggcagcaatgcttggtgctgcttgcagcaggctacctgctgcataccgtgtttatgcagacgtcaacatgaacacctatcattacaaaaaaaaaaaacatgaacactgaagtaatcactggttcatctagcttgatatggaagggtaaatgcctttgtgactcca

SEQ ID NO: 1589 - DNA, 3202 bp, Oryza sativa
cagctcagctcagcttcacactgcaccctctcccataaaaacctcgcccccatctactgcagctgctagcctgcaactgctcccacttcactcctcttctcgcgagtcgagtccaaggatcaaaattaagcagttaaaaactgagagagaaaaaaaaaacaagaaaagaaaggcgagctctccctccatcgccattgccaccctccacaaaacaccgtgcggcgctcttcacgttgccgcctcgcacgcattgctcctctccaagaagcagctcactgctctctctctctctctctctctgtcgtccctctctctctctcacgccaagagagagggtgagcagaggagaggtagctagctcggagctttctttggagaggggacacacttgcaatggcgccggcgccgactccggctgccgccgccggccgccgcgtggcagtgctggccgcggcgctcgtggcggcctccctcgcggcgagcgtgggcgtcgccaacgcggccgtgtcgtacgaccgccggtcgctcgtcatcaacggccgccgccgcatcctcctctccggctccatccactacccgcggagcacccccgagatgtggccggggctgatacagaaggccaaggacggcggcctcgacgtcatccagacctacgtcttctggaacggacacgagcccgtccagggccagtactacttcagcgaccggtacgatcttgtcaggttcgtcaagctggtgaagcaggccggcctctacgtccacctccgcatcggcccctacgtctgcgccgagtggaactttgggggctttcctgtctggctgaaatatgtgccgggggttagcttcaggacggacaatggcccgttcaaggcggaaatgcagaagtttgtggagaagattgtgtcgatgatgaaatccgaggggctgttcgagtggcagggcggcccgatcatcatgtctcaggtggagaatgagtttgggccgatggagtcggtcggtggcagcggtgccaagccgtatgcaaattgggccgcaaagatggccgtcgggaccaacactggcgtgccgtgggtgatgtgcaagcaggacgacgcccctgacccagtgatcaacacttgcaatggattttactgcgactacttcagcccaaacaagaattacaagccgtccatgtggactgaggcctggaccggctggtttacatcgttcggaggtggggtgccgcatcggccagtggaggatctggcttttgccgtggcgaggttcatacagaagggtggctctttcgtgaactattacatgtaccatggaggaaccaattttggccggacagctggtggtcccttcattgcaaccagctatgattatgatgctccgattgacgaatttggtctgcttaggcaaccgaaatggggtcacttgagagaccttcacagggccatcaagcaggctgagcctgtgctggtttctgccgatccgacaatagagtctattggcagctatgagaaggcatatgtcttcaaggcaaagaatggagcatgcgcggcgttcctgtcgaactaccacatgaacactgcagtcaaagtcaggttcaatgggcagcagtacaaccttcctgcttggtccatcagcattctgccggactgcaaaactgccgtcttcaacactgcaacggtgaaggagccaacattgatgccaaagatgaacccagtggttcgattcgcttggcagtcatatagcgaggacacaaactcgctgagcgacagcgcgttcacgaaggatggccttgttgagcagctgagcatgacatgggacaagtcagactacctgtggtacaccacatacgtcaacattggtacaaatgacttgaggtctggtcagtctcctcagctcactgtctactccgctgggcactcgatgcaggtgttcgtgaacgggaaatcatatggatctgtttatggtggttacgacaacccgaagctgacatacaatggacgtgtcaagatgtggcagggcagcaacaagatctccatcctaagttcagcagttggcctccctaatgttggcaaccattttgagaactggaatgtcggagtgctcggaccggtgaccctctccagcctaaatgggggcacaaaagacctcagccatcagaaatggacctatcaggtcggcctgaaaggcgaaacgctgggtctccacaccgtcaccggaagctccgcagtcgaatggggtggccctggcggctaccagccactgacttggcacaaggctttcttcaacgcgccggccgggaacgacccagtggcgctcgacatgggcagcatggggaagggccagctctgggtgaacggccaccacgtcggccggtactggtcgtacaaggcctccggtggctgcggcggctgcagctacgccgggacgtaccacgaggacaagtgccggtccaactgcggcgacctgtcccaaagatggtaccatgtgccgagatcatggctgaagccgggcggcaacctgctggtggtgctggaggagtacggcggcgacctcgccggcgtcagcctggcgacgagaaccacatgaacgaattgcagcgagagatcatcaccaccatttgatacagtcgtcgacggccgcgtgaacagcttcctcctgtagcacgcagaattcgtcgatggtatttacacacacagacgaacaccttacaagtaaaaaaaaaaaaacacaggagcagcagcaacaggtgtgtatttattggggagtcggagaggtggttgtctcgctcgccggtggccttcactgcggctgcagcgacggcagtggcatcaccggccaccggccggcatgcagacgctgttcagttgtttgcgttgctcgggaatttgttacggtgcatagagcatttgttattgtaacttgtaatctttgtcgacattataaattactagtattactagttgtgagaattgattatgcaggaaatcacaaatagttttgtcaatccgttattgtctgtagctatccatttttaggaaaactgtttgatgtgttggagattttacgagaagttgaagttgttaaaagctctctagagggccaatttaggatacattctaaacagcttatcagaacagtttacttccccgttctctgtggcatagtttcagtcagaaatgttttgtgaaaaaaagagtttttttat

SEQ ID NO: 1590 - DNA, 3167 bp, Oryza sativa
aaaaacctcgcccccatctactgcagctgctagcctgcaactgctcccacttcactcctcttctcgcgagtcgagtccaaggatcaaaattaagcagttaaaaactgagagagaaaaaaaaaacaagaaaagaaaggcgagctctccctccatcgccattgccaccctccacaaaacaccgtgcggcgctcttcacgttgccgcctcgcacgcattgctcctctccaagaagcagctcactgctctctctctctctctctctctctccgtccctctctctctctcacgccaagagagagggtgagcagaggagaggtagctagctcggagctttctttggagaggggacacacttgcaatggcgccggcgccgactccggctgccgccgccggccgccgcgtggcagtgctggccgcggcgctcgtggcggcctccctcgcggcgagcgtgggcgtcgccaacgcggccgtgtcgtacgaccgccggtcgctcgtcatcaacggccgccgccgcatcctcctctccggctccatccactacccgcggagcacccccgagatgtggccggggctgatacagaaggccaaggacggcggcctcgacgtcatccagacctacgtcttctggaacggacacgagcccgtccagggccagtactacttcagcgaccggtacgatcttgtcaggttcgtcaagctggtgaagcaggccggcctctacgtccacctccgcatcggcccctacgtctgcgccgagtggaactttgggggctttcctgtctggctgaaatatgtgccgggggttagcttcaggacggacaatggcccgttcaaggcggaaatgcagaagtttgtggagaagattgtgtcgatgatgaaatccgaggggctgttcgagtggcagggcggcccgatcatcatgtctcaggtggagaatgagtttgggccgatggagtcggtcggtggcagcggtgccaagccgtatgcaaattgggccgcaaagatggccgtcgggaccaacactggcgtgccgtgggtgatgtgcaagcaggacgacgcccctgacccagtgatcaacacttgcaatggattttactgcgactacttcagcccaaacaagaattacaagccgtccatgtggactgaggcctggaccggctggtttacatcgttcggaggtggggtgccgcatcggccagtggaggatctggcttttgccgtggcgaggttcatacagaagggtggctctttcgtgaactattacatgtaccatggaggaaccaattttggccggacagctggtggtcccttcattgcaaccagctatgattatgatgctccgattgacgaatttggtctgcttaggcaaccgaaatggggtcacttgagagaccttcacagggccatcaagcaggctgagcctgtgctggtttctgccgatccgacaatagagtctattggcagctatgagaaggcatatgtcttcaaggcaaagaatggagcatgcgcggcgttcctgtcgaactaccacatgaacactgcagtcaaagtcaggttcaatgggcagcagtacaaccttcctgcttggtccatcagcattctgccggactgcaaaactgccgtcttcaacactgcaacggtgaaggagccaacattgatgccaaagatgaacccagtggttcgattcgcttggcagtcatatagcgaggacacaaactcgctgagcgacagcgcgttcacgaaggatggccttgttgagcagctgagcatgacatgggacaagtcagactacctgtggtacaccacatacgtcaacattggtacaaatgacttgaggtctggtcagtctcctcagctcactgtctactccgctgggcactcgatgcaggtgttcgtgaacgggaaatcatatggatctgtttatggtggttacgacaacccgaagctgacatacaatggacgtgtcaagatgtggcagggcagcaacaagatctccatcctaagttcagcagttggcctccctaatgttggcaaccattttgagaactggaatgtcggagtgctcggaccggtgaccctctccagcctaaatgggggcacaaaagacctcagccatcagaaatggacctatcaggtcggcctgaaaggcgaaacgctgggtctccacaccgtcaccggaagctccgcagtcgaatggggtggccctggcggctaccagccactgacttggcacaaggctttcttcaacgcgccggccgggaacgacccagtggcgctcgacatgggcagcatggggaagggccagctctgggtgaacggccaccacgtcggccggtactggtcgtacaaggcctccggtggctgcggcggctgcagctacgccgggacgtaccacgaggacaagtgccggtccaactgcggcgacctgtcccaaagatggtaccatgtgccgagatcatggctgaagccgggcggcaacctgctggtggtgctggaggagtacggcggcgacctcgccggcgtcagcctggcgacgagaaccacatgaacgaattgcagcgagagatcatcaccaccatttgatacagtcgtcgacggccgcgtgaacagcttcctcctgtagcacgcagaattcgtcgatggtatttacacacacagacgaacaccttacaagtaaaaaaaaaaaaacacaggagcagcagcaacaggtgtgtatttattggggagtcggagaggtggttgtctcgctcgccggtggccttcactgcggctgcagcgacggcagtggcatcaccggccaccggccggcatgcagacgctgttcagttgtttgcgttgctcgggaatttgttacggtgcatagagcatttgttattgtaacttgtaatctttgtcgacattataaattactagtattactagttgtgagaattgattatgcaggaaatcacaaatagttttgtcaatccgttattgtctgtagctatccatttttaggaaaactgtttgatgtgttggagattttacgagaagttgaagttgttaaaagctctctagagggccaatttaggatacattctaaacagcttatcagaacagtttacttccccgttctctgtggcatagtttcagtcagaaatgttttgtgaaaaaaagagtttttttat

SEQ ID NO: 1591 - DNA, 2073 bp, Saccharum officinarum
gtggtgctggtgccgcggtggtggaggtggagttggatcgggctgtgcggatcggaggaggtcatgatcaactaatgcccattcatctattatggacttgcaccagttgttaaagtacagattaactggtgataacgtcttctacgaatttcctacagagaacaacttagcaaacactccttggccagctagtccactgaagtctgagttcagcagctccccatacactcctctttcatcccagcttgagtgtgataatttgtctgctctcagcaatactccagataaccagagctccacagaaaccatttcagcacaaccaatatcaccactggaagtagacagctcatacagacaagcagctatccttcgggagaacacccaagtgagacctgatccattgtacgcaacatcaaggcataatatgcaacacgctttacgggaaatagagactgttctgatggcacctgatgctgaggatgcagccactagcaccaagcatgaatttgtggaacataaacctgctcagctgatgaggcagcggtcgaggacatggagtcatgaatcaaggcagccatcaccaggagttgtacggacacaatttgcatctggataccccacagcaagctatgaattccgcccagagaaacggctaagggagttaagggaagatccgcagagcatggtgaagcagctattgaccaagtgtgctgaagcattaagtgaggagaggatagaggagttccttaaccttgttcagcaagctcgtgcagttgtatcaattactggagagccaatccagcggttaggtgcttaccttcttgagggtttggttgctagacatgcaaactcaggtacaaacatatatcgtgctctgaagtgccgggagccagagagtaatgaactcttgtcttacatgaagattttatataatatctgtccgtacttcaagtttggctatatggctgccaatggggcaattgcagaagcattaagaaatgaggacaaaatccatataattgatttccagattgctcaagggacacaatggataacactgatacaagcgctcgctgcaaggcctgggggtccaccacatgtgcggatcactggaatagatgatccagtgtcagaatatgctcgtggtgaaggtctggaccttgtagggaagatgttgaaaagcatgtctgaagaattcaagatacctttggagtttacccctctgcctggtatttacgcaactcaagttacaaaagaaatgctcgacatcaggccaggcgaagcacttgctgtcaacttcactctgcagctgcaccacaccccagatgagagtgtggacgtgaacaacccacgggacgggctacttcggatggtgaaaggtctgtctccaaaggtgaccacacttgtggaacaggagtcgcacaccaacacgaccccgttcttgatgcggttcaccgagaccttggactactactcggccatgtttgagtcgatcgacacgaatctgccacgggaaaacaaggagcggatcaatgtggagcagcactgcctcgccaaggacattgtgaacatcatcgcctgcgaggggaaggaccgggtggagaggcacgagctcctgggtaagtggcggtcaaggctgaccatggccgggttcagaccatacccgctgagctcgtacgtgaactcggtgatcaggaagctccttgcctgctactcggacaagtacaccctggaggaaaaggatggcgcgatgctgctcggctggaagaacaggaagttgatatctgcttctgcgtggcactgactacaagttttcaggaggacagaagtaaacatcaactcttgtgaattacttggtctgctttatcagaaaggatgccctttgttgtacatgtacatgatgctgtacccttagtttttcctaaagtgcagaccagagaacattgacattagattgtagctgtataattttcttgtgctctcatgtattcacccctgtcatagccttccggtatcttcgattacttctccaagggtattcacccccgatcagcaaacctgctgagatgctta

SEQ ID NO: 1592 - DNA, 2245 bp, Sorghum bicolor
aattattattcgcagcacacaaaaagagggggcgcaagcaagagaaggattgggacacgagaactagcacaagagagagaagaagaaaaagcgagcgagagagagagagagagagagagaggtggtggtggtgccgcggtggtggtggaggtggagttggatcgggttgtgcggatcggaggaggtcatgatcaactaatgcccattcatttattatggacttgcaccagttgttaaagtacagattaactggtgctaacgtcttctacgaatttcctacagagaacaacttagcaaacactccttggccagctagtccactgaagtctgagttcagcggctccccatacactcctctttcatcccagcttgagtgtgataatttgtctgctctcagcaatactccagataaccagagctccacagaaaccatttcagcacaaccaatatcaccactggaagtagatagctcatacagacaagcagctatccttcgggagaacacccaagtgagacctgatccattgtatgcaacatcaaggcataatatgcaacacgctttacgggaaatagagactgttctgatggcacctgatgctgaggatgcagccactagcaccaagcatgaatttgaggaacataaacctgctcagctgatgaggcagcggtcgagaacatggagtcatgaatcaaggcagccatcaccaggagttgtgcggacacaattcgcatctgggtaccccacagcaagctacgaattccgcccagagaaacggctaagggagttaagggaggatccacagagcatggtgaagcagctattaaccaagtgtgctgaagcattaagtgaggagaggatagaggagttccttacccttgttcagcaagctcgtggagttgtatcaattactggagagccaatccagcggttaggtgcttaccttcttgagggtttggttgctagacatgcaaactcaggcacaaacatatatcgtgctctgaagtgccgtgaaccagagagcaatgaactcttgtcttacatgaagattttatataatatctgtccgtacttcaagtttggctatatggctgccaatggggcaattgcagaagcattaagaaatgaagacaaaatccatataattgatttccagattgctcaagggacacaatggataacactgatacaagcgctcgctgcaaagccagggggtccaccacatgtgcggatcactggaatagatgatccagtttcagagtatgctcgtggtgaaggtctggaccttgtagggaagatgttgaaaagtatgtctgaagaattcaggatacctttggagtttacccctctgcctggtatttatgcaactcaggttacaaaagaaatgctcgacatcaggccaggcgaagctctcgctgtcaacttcactctgcagctgcaccacaccccagatgagagtgtggacgtgagcaacccacgggacgggctacttcggatggtgaaaggtctgtctccaaaggtgaccacacttgtggagcaggagtcgcacaccaacacgaccccgttcctgatgcggttcaccgagaccttggactactactcggccatgttcgagtcgatcgatgcgaacctgccacgggaaaacaaggagcggatcaatgtggagcagcactgcctcgccaaggacattgtgaacatcatcgcctgcgaggggaaggaccgggtggagcggcacgagctcctgggtaagtggcggtcaaggctgaccatggccgggttcagaccatacccgctgagctcgtacgtgaactcggtgatcaggaatctccttgcctactactcggacaagtacaccctggaggagaaggatggcgcgatgctgctcggctggaagaacaggaagttgatatctgcttctgcgtggcattgacaacatgttttcaggaggacagcagtaaacatcaactcttacatatatgaatatatatatatatatagtgaattacttggtctgctttcccaaaaaggatgcccttttgttgtacatgtacatgatgctgtacccttagttttcctaaagtgcagaccagagaacattgacattagattgtagctgtatggtaattacaattttcttgtgctctcatgtattcacccctgtcatagccttccggcatcttcggtgtacttctccaacattactcttgctgatcattaaacctgctgagatgcttagcttttctttca

SEQ ID NO: 1593 - DNA, 2337 bp, Sorghum bicolor
ctctcttcaagatatacaattattattcgcagcacacaaaaagagggggcgcaagcaagagaaggattgggacacgagaactagcacaagagagagaagaagaaaaagcgagcgagagagagagagagagagagagaggtggtggtggtgccgcggtggtggtggaggtggagttggatcgggttgtgcggatcggaggaggtcatgatcaactaatgcccattcatttattatggacttgcaccagttgttaaagtacagattaactggtgctaacgtcttctacgaatttcctacagagaacaacttagcaaacactccttggccagctagtccactgaagtctgagttcagcggctccccatacactcctctttcatcccagcttgagtgtgataatttgtctgctctcagcaatactccagataaccagagctccacagaaaccatttcagcacaaccaatatcaccactggaagtagatagctcatacagacaagcagctatccttcgggagaacacccaagtgagacctgatccattgtatgcaacatcaaggcataatatgcaacacgctttacgggaaatagagactgttctgatggcacctgatgctgaggatgcagccactagcaccaagcatgaatttgaggaacataaacctgctcagctgatgaggcagcggtcgagaacatggagtcatgaatcaaggcagccatcaccaggagttgtgcggacacaattcgcatctgggtaccccacagcaagctacgaattccgcccagagaaacggctaagggagttaagggaggatccacagagcatggtgaagcagctattaaccaagtgtgctgaagcattaagtgaggagaggatagaggagttccttacccttgttcagcaagctcgtggagttgtatcaattactggagagccaatccagcggttaggtgcttaccttcttgagggtttggttgctagacatgcaaactcaggcacaaacatatatcgtgctctgaagtgccgtgaaccagagagcaatgaactcttgtcttacatgaagattttatataatatctgtccgtacttcaagtttggctatatggctgccaatggggcaattgcagaagcattaagaaatgaagacaaaatccatataattgatttccagattgctcaagggacacaatggataacactgatacaagcgctcgctgcaaagccagggggtccaccacatgtgcggatcactggaatagatgatccagtttcagagtatgctcgtggtgaaggtctggaccttgtagggaagatgttgaaaagtatgtctgaagaattcaggatacctttggagtttacccctctgcctggtatttatgcaactcaggttacaaaagaaatgctcgacatcaggccaggcgaagctctcgctgtcaacttcactctgcagctgcaccacaccccagatgagagtgtggacgtgagcaacccacgggacgggctacttcggatggtgaaaggtctgtctccaaaggtgaccacacttgtggagcaggagtcgcacaccaacacgaccccgttcctgatgcggttcaccgagaccttggactactactcggccatgttcgagtcgatcgatgcgaacctgccacgggaaaacaaggagcggatcaatgtggagcagcactgcctcgccaaggacattgtgaacatcatcgcctgcgaggggaaggaccgggtggagcggcacgagctcctgggtaagtggcggtcaaggctgaccatggccgggttcagaccatacccgctgagctcgtacgtgaactcggtgatcaggaatctccttgcctactactcggacaagtacaccctggaggagaaggatggcgcgatgctgctcggctggaagaacaggaagttgatatctgcttctgcgtggcattgacaacatgttttcaggaggacagcagtaaacatcaactcttacatatatgaatatatatatatatatagtgaattacttggtctgctttcccaaaaaggatgcccttttgttgtacatgtacatgatgctgtacccttagttttcctaaagtgcagaccagagaacattgacattagattgtagctgtatggtaattacaattttcttgtgctctcatgtattcacccctgtcatagccttccggcatcttcggtgtacttctccaacattactcttgctgatcattaaacctgctgagatgcttagcttttctttcagctcctgagcatgcaatggtgttgttaacaacttaattaacatgcctctgcgagggaagatggaagctcagtctt

SEQ ID NO: 1594 - DNA, 2263 bp, Setaria italica
ataattattcgcagcacacaaaaagagggggcgcaagcaagagaaggattaggacacgagaactcgcggaagagagagaagaaaagctagggagggagggagagagaggtggtgcccgtgccgaggtggtggagttgggtcggcctgtgcggatcggaggaggtcatgaacagctaatgcccattcatttattatggatttgcaccagttgttaaagtacagattaactggtgctaacgtcttctacgaatttcccacagagaacaacttagcaaacaatccctggccaggtactccactgaagtcggaattcagcaactccccgtacactcccctttcagcccagcttgagtgtgacaatttgtctgctattagcaacactccagataaccagagttccacagaaaccatttcagcacaaccaatatcaccgctagaagttgacagctccaacagacaggcaggtatactttgggaaaacacccaagtgagacctgatcacttgtacactacatcaaggcataatatgcaacacgctttacggaaaatagagactgttctgatggcacctgatgctgatgatgctgccactagcaccaagcatgagtttgaggaacacaaacctgctccgctgatgaggcagcggtcaaggacatggagtcatgaattaaggcagccatcaccaggagttgtccggacacaatttgcatctggataccccacagcaagctatgaattccgcccagaaaagcgacaaagggagttaagggaagatccgcagagcatggtgaagcagttgttaacaaagtgcgctgaagcattaagtgaggagaggatagaggagttccttaagcttgttcagcaagctcgtggagttgtatcaattactggggaaccaatacagcggttaggtgcttaccttcttgagggtttggttgctagacatggaaactcgggtacgaacatatatcgtgctttgaagtgccgtgagccggagagtaatgaacttttgtcctacatgaagattttatacaatatctgtccgtacttcaagtttggctatatggctgctaatggggcaattgcagaggcattgagaaatgaggacaaaatccatatagttgatttccagattgctcaagggacacaatggataacactgatccaagcactagctgcaaggcctgggggtccaccacatgtgcggatcactggaattgatgatccagtgtcagagtacgcccgtggtgaaggtctggaccttgtagggaagatgttgaaaagcatgtccgaagaattcaggatacctctggagtttacccctctacccggtgtctatgccacccaagtcacaaaagaaatgctagacatcaggccaggcgaagcacttgctgtcaacttcactctgcagctacaccacaccccagatgagagcgtggacgtcaacaacccacgggacgggctactccggatggtgaaagggctgtccccgaaggtgaccacgctggtggagcaggagtcgcacaccaacacgacaccgttcctgatgaggttcagcgagaccatggactactactcggccatgttcgagtcgattgacgcgaacttgccacgggacagcaaggagcggatcaacgtggagcagcactgccttgccaaggacatcgtgaacatcatcgcctgtgaggggaaggaccgggtagagcggcacgagctcctgggcaagtggaagtcgaggctgaccatggctgggttcaagccgtacccgctaagctcgtacgtgaactcggtgatcaggaagctcctcgcctgctactccgacaagtacaccctggaggagaaggatggcgctatgctgctcggctggaagagcaggaagttgatatctgcttctgcgtggcactgacaataagtttcagaaaaacataagtaaacaccttctcttacatataaatatatatagtgaattccctggtctgttttcccagaaaaggttttctttgttgtacttgtacaggatgctgtatccttagtttttccctaaattgtagaccaggataaacattgacattagattgtagctgtatgataattacaattttcttatgtccgcccctatcagtcttatggtatgtacctctcgaagcttgctcttgttgatcggcaacctgctgagatgcttaacttttaatgctctttagtcttgagtatgcaatgtgtcttggtaacatgcccctgggaaggaagatggaatttcagtctt

SEQ ID NO: 1595 - DNA, 2226 bp, Panicum virgatum
ggagatataattattcgcagcacacaaaaagagggggcgcaagcaagagaagacacgagaactagcggaagagagagaagaaaagcttagggagagagggagaggcgtgtggtggtggagttggatcggcctgtgcggatcggaggaggtcatgaacagctaatgcccattcatttattatggacttgcaccagttgttaaagtacagattagctggtgctaacgtcttctacgagttccctacagaaaacaacttagcaaacattccctggccagttagtcccctgaagtccgagttcagcaactccccatacactctttcagcccagcttgagtgtgacaatttgtctgctattagcaacactccagataatcagagctccacagaaaccatttcagcacaaccaatatcaccattggaagttgacagttcatacagacaggcaggcatccttcgagaaaacacccaagtgagacctgatccattgtacgcaacatcaaggcataatatgcaacacactttacgggaaatagagactgttctgatggctcctgatgctgatgatgcagccaatggcaccaagcatgagtttgaggaacacaaacctactcagctgatgaggcagcggtcaaggacatggagtcatgaatcaagacagccatcaccaggagttgtccgcacacaatttggatctggataccccacagcaagctatgacttccgcccagaaaagcggcaaagggagttaagggaggatccgcagagcatggtgaagcagctattaaccaagtgtgctgaagcattaagtgaggagaggatagatgagttcttcaagcttgttcagcaagctcgcggagttgtatcaattactggggagccaatacagcggttaggtgcttaccttcttgagggtttggttgctagacatggaaactcgggtacgaacatatatcgtgctctgaagtgccgtgagccggagagtaatgaacttttgtcctacatgaagattttatacagtatctgtccgtacttcaagtttggctatatggctgccaatggggcaattgcagaggcattgagaaatgaggataaaatccatataattgatttccagattgctcaagggacacaatggataacactgatccaagcactagctgcaaggcctgggggtccaccacatgtgcggatcactggaatagatgatccagtgtcagagtacgctcgtggtgaaggtctggaccttgtagggaagatgttgaagagcatgtccgaagaattcaggataccattggagtttacccctctacctggtttctatgccactcgagtcacaaaagaaatgctagacatcaggccaggcgaagcacttgctgtcaacttcactctgcagctacaccacacaccagatgagagcgtggatgtcaacaacccacgggacgggctactccggatggtgaaagggttgtccccgaaggtgactacgctggtggagcaggagtcacacaccaacacaactccattcctgatgaggttcagcgagactatggactactactcggccatgttcgagtcaatcgacgtgaacctgccacgggacagcaaggagcggataaacgtggagcagcactgccttgccaaggacattgtgaacatcatcgcctgtgaggggaaggaccgggtggagcggcatgagctcctgggcaagtggaagtcgaggctgaccatggctgggttcaagccgtacccgctaagctcatacgtgaactcggtgatcaggaggctcctcgcatgctactctgacaagtacaccctggaggagaaggacagcgcgatgctgctcggctggaagaataggaaattgatatcagcttctgcgtggcactgacaataagttttcagaagaacataagtaaacaccttctcttacatataaatatatatagtgaattccctggtctgctttcccaggaaaggttctctttgttgtgtacatgtacaggatgttgcatccttagttttttccccctaaattgtaaaccaggataaacattgacattagattctagctgtatgataattacaattttcttgtgttctcccgtcagagtcttatggtatcttggattggatgtatctctcaaagctaactcatgttgatcggcaaacatgctgagatgctcaacttttaatgttgctgagtatgcagtgtgcgtctttgtaac

SEQ ID NO: 1596 - DNA, 2223 bp, Pennisetum glaucum
cacaaaaagagggggcgcaagcaagagaaggattaggacacgagaactcacggaagagagagagaggacaaaagctgagagagagagagagagagagcgggtggtgctcttgccgcggcggcggatttggatcggcctgtgcggatcgtaggaggtcatgaacagctgatgcccattcgttcattatggacttgcaccagttgttaaagtacagattaactggtgctaacgtcttctacgaatttcccacagagaacaacttagcaaacaatccttggccaggtactccagttaagtcgcaattcagcaactgcactcccctgtcaacccagctcgagtgtgacaatttgtctgctatttgcaacacttcggataaccagagctctacagaaaccatttcagcacaaccaatatcaccgctagaagttgacagttccaacagacaggcaggtatacttcgggaaaacacccaagtgagacctgatcaactgtacactacatccaggcataatatgcaacacactttgcgggaaatagagacggttctgatggcacctgatgctgatgatgctgccactatcaccaagcatgagtttgaggaacacaaacctgctctgctgatgagacagcggtcaaggacatggagtcgtgaatcaagacagccatcaccaggagttgtccgggcacaatttgcatctaggtaccccacaacaagctgtgaattccgcccagaaaagcgacaaagggaggatccacagagcatggtgaagcaattgttaacaaagtgcgctgaagcattaagtgaggagaggatagaggagttccttaagcttgttcaacaagctcgtggagttgtatcaattactggggaaccaatacagcggttaggtgcttaccttcttgagggtttggttgctagacatggaaactcgggaacgaacatatatcgtgctctgaagtgccgtgagccggagagtaatgagcttctgtcctacatgaagattttatacaatatctgtccatacttcaagtttggttatatggctgctaatggggcaattgcagaggcattgagaaatgaggacaacattcatataattgatttccaaattgctcaagggacacaatggataacactgatccaagcactagctgcaaggccggggggtccaccacatgtgcggatcactggaatagatgatccagtgtcagagtacgcccgtggtgaaggtctggaccttgtagggaagatgttgaaaagcatgtctgaagaattcaggatacctctggagtttacccctctacctggtgtctatgccacggaagtcacaaaagaaatgctggacatcaggccaggcgaagcacttgctgtcaacttcactctgcagctacaccacaccccagatgagagcgtggatgtcaacaacccacgggacgggctactccggatggtgaaagggctgtccccgaaggttaccacgctggtggagcaggagtcacacaccaacacgacaccgttcctgatgaggttcagtgagaccatggactactactcggctatgttcgagtcgattgatgcaaacttgccacgggacagcaaggagcggatcaacgtggagcagcactgccttgccaaggacattgtgaacatcatcgcctgcgaggggaaggaccgggtagagcggcatgagctcctgggcaagtggaagtcaaggctgaccatggctgggttcaagccgtacccgctaagctcgtacgtgaactcggtgatcaggaagctcctcggctgctactccgacaagtacaccctggaggagaaggatggcgctatgctgctcggctggaaaagcaggaagttgatatctgcttctgcgtggcactgacaataagtttcagaagaacataagtaaacaccttctcttacatataaatatatatagcgaattccctggtctgtttttccagaaagattttctttgtacttgtacaggatgctgtaatgatgtatccttagtttttccctaaattgcagaccaggataaacattgacattagattgtagctgtatgataattacaattttcttgtttcaacccctatcagagtcttatggtatcttggatgtactctccaagcttgctcttgttgatcggcaacctgctgagatgcttaacttgtactcctcgagtctcagagcatgcaatatgaatgttccagtcttag

SEQ ID NO: 1597 - DNA, 2880 bp, Oryza sativa
aaggggagagagagagagagagagagagagagggggggggggtataaaatgcgtggcacctccggctcgggtataattatcgcagcacacgaaaagagaaccagagagagagagagagagagagagagagagagaggagtggaagtggatcggggcatcgctgcggcgtcggggctgtgcagatcggaggaggtcatgaacgactaatctccgttcatttattatggacttgcaccagttattaaagtacagattgactggcgctaacgttgtgtacgaaattcctacagagaacaacttgcaaaactctccctggcaagctaacccactgaagtacgagttcagcgattccccatacacccctctctcttcccaatttgagtgtgacaatttgtctgctcttaccaacactccagataaccagagctctacagaaaccatttcagcccaaccaatctccccattggaagcagacagctcatatagacaggcgggtattcttctccaggagaacattcaagtgggagctgatccgttgtatgctacatcaagacataatatgcaacacgccttacgggagattgagactgttctgatggcacctgatacagatgatgcaacaactagcaccaagcatgagtttgaggaaatcaagcctgctcagcttgtgaggcagcggtcgagaacatggagtcatgaatcacggcagccgttacctggagttggtcggtcacagtttgcatctggtggataccccacagcaagctatgaatttcgtccagagaaacggcaaagggagttaagggaagaccctcagataattgtgaagcagctattaaccaggtgtgctgaggctctgagtgaggacaggacagaggagttccataagcttgttcaggaggctcgtggagtggtctcaatcaacggggaaccaatccaacgtctaggtgcttacctactggagggtttggttgctagacatggaaactctggcacaaacatctaccgtgctctgaagtgccgtgagccagagagcaaggagctcctgtcctacatgagaattctatacaatatctgcccttacttcaagtttggctatatggcagccaatggggcgattgcagaagcattgagaactgagaacaatatccacataattgattttcagattgctcaagggactcaatggatcacactgatacaagcattagctgcaaggcctggtggtcctcctcgtgtgcggatcaccgggatagatgacccagtgtcagagtatgctcgtggtgaaggtcttgacattgtggggaaaatgttgaaaagcatgtctgaagaattcaaaatacctctggagtttacgcctctgtctgtctatgccacacaagtcacgaaagagatgcttgagatcaggccaggtgaagcactgtctgtaaacttcacactccagctacaccacaccccggacgagagcgtggatgtcaacaacccacgcgatggtctgctccggatggtgaaagggctgtccccgaaggtgactactttggtagagcaggagtcacacaccaacacaacgcctttcttgatgaggtttggggagaccatggagtactactccgccatgttcgagtcgatcgacgccaacctgccgcgggacaacaaggagaggatcagcgtggagcagcactgcctcgccaaggacatcgtcaacatcatcgcctgcgaggggaaggacagggtggagaggcatgagctgcttggcaagtggaagtcgaggctgaccatggccggcttcaggccttacccgttgagctcgtacgtcaactcggtgataaggaagcttctcgcctgctactccgataaatacacattggatgagaaggacggcgcgatgcttctcggctggaggagcagaaagctgatatctgcttctgcgtggcactgacagtagtatgttgagaagaagaaatgatagagagcatatatatacataccgattccctggtccaatttacagaatgataccctttgatgtaccctcagtttgattgacagcgggtgttgccttcatttatagaccaggatcaaacattgacattagatttgtagagaagttgtatgataataattttctttgcgattcaatgtatgatgtatccatggctgccatagttaataatattcttgcatagtcatattgatcggctaatcacccgtggattagcgttgtgtctgtcttgacaataaatttctacttgttggcttgttgctgtccaatgcacaatgaatcatcattcatcgatttgtgctgcaaccaactttgtgcacataatatcagcatgtattatcaccaagagcgttctcttttgttactgtctggaaggacaatggcagacagacatgttgctatcgtcgttcatcagcaaagacattgtgaataggggacaaagaccaattaatcagcgttgtggctacttgtccaagaatgccgacataagaaggggaccttgtgtttaagagagattgttgcattgctgccgacctgaacctgccaaatggaacgctcagcgacaattttgcctccttatgacccctgaaatgttgaaaaaattatggctatgtcgctccaaagtcgtcgtgactttagacatactctacgtgccactgtttttagcagcaccagcacggcatgagtagaaccaaaaatatgcaagccaacgaattgacttcctccagccttcaagtcccgtgccacaaccctccaaagtccagagtgttgagctaacgagatttatgaccggtttgatcctacccttggaggaaagggagcacagtgttgtcacttgtgagatttcatgtaatgacaatgcaggagcaattcttaaa

SEQ ID NO: 1598 - DNA, 2146 bp, Oryza sativa
gcacctccggctcgggtataattatcgcagcacacgaaaagagaaccagagagagagagagagagagagagagagagagaggagtggaagtggatcggggcatcgctgcggcgtcggggctgtgcagatcggaggaggtcatgaacgactaatctccgttcatttattatggacttgcaccagttattaaagtacagattgactggcgctaacgttgtgtacgaaattcctacagagaacaacttgcaaaactctccctggcaagctaacccactgaagtacgagttcagcgattccccatacacccctctctcttcccaatttgagtgtgacaatttgtctgctcttaccaacactccagataaccagagctctacagaaaccatttcagcccaaccaatctccccattggaagcagacagctcatatagacaggcgggtattcttctccaggagaacattcaagtgggagctgatccgttgtatgctacatcaagacataatatgcaacacgccttacgggagattgagactgttctgatggcacctgatacagatgatgcaacaactagcaccaagcatgagtttgaggaaatcaagcctgctcagcttgtgaggcagcggtcgagaacatggagtcatgaatcacggcagccgttacctggagttggtcggtcacagtttgcatctggtggataccccacagcaagctatgaatttcgtccagagaaacggcaaagggagttaagggaagaccctcagataattgtgaagcagctattaaccaggtgtgctgaggctctgagtgaggacaggacagaggagttccataagcttgttcaggaggctcgtggagtggtctcaatcaacggggaaccaatccaacgtctaggtgcttacctactggagggtttggttgctagacatggaaactctggcacaaacatctaccgtgctctgaagtgccgtgagccagagagcaaggagctcctgtcctacatgagaattctatacaatatctgcccttacttcaagtttggctatatggcagccaatggggcgattgcagaagcattgagaactgagaacaatatccacataattgattttcagattgctcaagggactcaatggatcacactgatacaagcattagctgcaaggcctggtggtcctcctcgtgtgcggatcaccgggatagatgacccagtgtcagagtatgctcgtggtgaaggtcttgacattgtggggaaaatgttgaaaagcatgtctgaagaattcaaaatacctctggagtttacgcctctgtctgtctatgccacacaagtcacgaaagagatgcttgagatcaggccaggtgaagcactgtctgtaaacttcacactccagctacaccacaccccggacgagagcgtggatgtcaacaacccacgcgatggtctgctccggatggtgaaagggctgtccccgaaggtgactactttggtagagcaggagtcacacaccaacacaacgcctttcttgatgaggtttggggagaccatggagtactactccgccatgttcgagtcgatcgacgccaacctgccgcgggacaacaaggagaggatcagcgtggagcagcactgcctcgccaaggacatcgtcaacatcatcgcctgcgaggggaaggacagggtggagaggcatgagctgcttggcaagtggaagtcgaggctgaccatggccggcttcaggccttacccgttgagctcgtacgtcaactcggtgataaggaagcttctcgcctgctactccgataaatacacattggatgagaaggacggcgcgatgcttctcggctggaggagcagaaagctgatatctgcttctgcgtggcactgacagtagtatgttgagaagaagaaatgatagagagcatatatatacataccgattccctggtccaatttacagaatgataccctttgatgtaccctcagtttgattgacagcgggtgttgccttcatttatagaccaggatcaaacattgacattagatttgtagagaagttgtatgataataattttctttgcgattcaatgtatgatgtatccatggctgccatagttaataatattcttgcatagtcatattgatcggct

SEQ ID NO: 1599 - DNA, 2333 bp, Brachypodium distachyon
atttctctttctctctttgctgagatattaattttatcggcgcacgcgaaaagaggaggggggttccgcaaagggaagaggagaaagggattaggacacgagaaccagaacacagagagaagcaaagttagagagagagagagagagaggagggaaggaaaagcgagaaggagattggtggagcgagctggatcagggcatcgggctggttgtgcagatcggaggaggtcatgaacaactaatcaacgttcatttattatggatttgcaccagttgttaaagtacagattgactggtgctaacgtcttgtacgaaattcctacagagaacaacttaacaaactcttcctggccagctagtccactgaagttagagtacaacaactctccatacacccctctttctacccagcttgagtgtgacaatttatctgctctcagcaacactccggataaccagagctctacagaaaccatttcagcccaaccaatctccccgctcgaagcagacagctcatacatacagccaggtagccatcttcgtgagaacatccaagtgagagctgatccattgtatgcgagatcaagacataatatgcaacacgctttgcgtgagattgagaccgttttgatggcacctgatgctgatgatgcaacaactagcgccaagcatgagtttgaggaaaccaagcctgctcagctcatgaggcagcggtcaaggacatggagccatgagtcacgacagccattgcctggagtcgttcggccacaatttgcatctggtgggtaccccatggcaagctatgaatttcgtccagagaaacgacaacgggagttaagggatgatccacaaatcattgtgaagcagctgttaaccaagtgtgctgaggccttaagtgaggacaggacagaggagttcctaaagcttgttcaggaagctcgtgggattgtttcaattaacggggaaccaatccagcgtctaggtgcttacctactcgagggtttggttgctagacatggaaactctggtagaaacatctaccgtgctctgagatgccgcaaaccagagagcaaggagcttctctcgtacatgaaaattttatacaatatatgtccttacttcaagtttggatacatggcagctaatggggcgattgcagaggcattgagaagcgaggacaacatccacataattgattttcagattgctcaagggactcaatggatcacactgatacaagctttagctgcaaggcctgggggtccacctcatgtgcggatcactggaatagatgacccagtatcagagtatgcccgaggtgaaggtctggaaattgttgggaacatgctgaagggcatgtctaaagaattcaatatacctctggaatttacccctctacctgtctatgccacccaagtcacaaaagaaatgctcgagattagaccaggtgaagcacttgctgtcaacttcaccctccagctacaccacaccccagatgagagcgtggacgtcaacaacccacgggacgggttgctccggatggtaaaagggctgtccccaaaggtaactacattggtggagcaggagtcgcacaccaacacgacacctttcatgatgagatttgccgagaccatggattactactctgccatgttcgagtctattgacgccaacttgcctcgagacaacaaagagaggattagtgtggagcagcattgtctggccaaggacatcgtgaacatcatcgcctgtgaggggaaggaccgggtggagaggcacgagctccttggcaagtggaaatcaaggttgaccatggctggcttcaagccttacccgctgagttcgtacgtgaactctgtgataaagaagcttctcgcgtgctactctgacaagtacacgctggaggagaaggatggggcgatgctcctcggctggaagaaaaggaagttgatatctgcatctgcatggcactgacaattacctgttcagcaccaaagaaagcaaaacagaggttatacaccaaaagtccctggtctcctttccaaactccctttggatgtacctgtacatgatgctgtaccctcagtgtttcctaagtgtagaccaggaattgaacattgacattagattgtagaagttgtatgataattattacaattttgttgcgcttccttgtattgaccatccttgctgttgatgatatgttggatgtaattttccagtcatgctcttgttgataggcaagtgtttccagtccatggagcatgccttgagaatgcagagcataccgcatttctgggagtgaagaaaggatttttgcaactgttttctta

SEQ ID NO: 1600 - DNA, 2403 bp, Brachypodium distachyon
atttctctttctctctttgctgagatattaattttatcggcgcacgcgaaaagaggaggggggttccgcaaagggaagaggagaaagggattaggacacgagaaccagaacacagagagaagcaaagttagagagagagagagagagaggagggaaggaaaagcgagaaggagattggtggagcgagctggatcagggcatcgggctggttgtgcagatcggaggaggtcatgaacaactaatcaacgttcatttattatggatttgcaccagttgttaaagtacagattgactggtgctaacgtcttgtacgaaattcctacagagaacaacttaacaaactcttcctggccagctagtccactgaagttagagtacaacaactctccatacacccctctttctacccagcttgagtgtgacaatttatctgctctcagcaacactccggataaccagagctctacagaaaccatttcagcccaaccaatctccccgctcgaagcagacagctcatacatacagccaggtagccatcttcgtgagaacatccaagtgagagctgatccattgtatgcgagatcaagacataatatgcaacacgctttgcgtgagattgagaccgttttgatggcacctgatgctgatgatgcaacaactagcgccaagcatgagtttgaggaaaccaagcctgctcagctcatgaggcagcggtcaaggacatggagccatgagtcacgacagccattgcctggagtcgttcggccacaatttgcatctggtgggtaccccatggcaagctatgaatttcgtccagagaaacgacaacgggagttaagggatgatccacaaatcattgtgaagcagctgttaaccaagtgtgctgaggccttaagtgaggacaggacagaggagttcctaaagcttgttcaggaagctcgtgggattgtttcaattaacggggaaccaatccagcgtctaggtgcttacctactcgagggtttggttgctagacatggaaactctggtagaaacatctaccgtgctctgagatgccgcaaaccagagagcaaggagcttctctcgtacatgaaaattttatacaatatatgtccttacttcaagtttggatacatggcagctaatggggcgattgcagaggcattgagaagcgaggacaacatccacataattgattttcagattgctcaagggactcaatggatcacactgatacaagctttagctgcaaggcctgggggtccacctcatgtgcggatcactggaatagatgacccagtatcagagtatgcccgaggtgaaggtctggaaattgttgggaacatgctgaagggcatgtctaaagaattcaatatacctctggaatttacccctctacctgtctatgccacccaagtcacaaaagaaatgctcgagattagaccaggtgaagcacttgctgtcaacttcaccctccagctacaccacaccccagatgagagcgtggacgtcaacaacccacgggacgggttgctccggatggtaaaagggctgtccccaaaggtaactacattggtggagcaggagtcgcacaccaacacgacacctttcatgatgagatttgccgagaccatggattactactctgccatgttcgagtctattgacgccaacttgcctcgagacaacaaagagaggattagtgtggagcagcattgtctggccaaggacatcgtgaacatcatcgcctgtgaggggaaggaccgggtggagaggcacgagctccttggcaagtggaaatcaaggttgaccatggctggcttcaagccttacccgctgagttcgtacgtgaactctgtgataaagaagcttctcgcgtgctactctgacaagtacacgctggaggagaaggatggggcgatgctcctcggctggaagaaaaggaagttgatatctgcatctgcatggcactgacaattacctgttcagcaccaaagaaagcaaaacagaggttatacaccaaaagtccctggtctcctttccaaactccctttggatgtacctgtacatgatgctgtaccctcagtgtttcctaagtgtagaccaggaattgaacattgacattagattgtagaagttgtatgataattattacaattttgttgcgcttccttgtattgaccatccttgctgttgatgatatgttggatgtaattttccagtcatgctcttgttgataggcaagtgtttccagtccatggagcatgccttgagaatgcagagcataccgcatttctgggagtgaagaaaggatttttgcaactgttttcttactttcttgtgtcattacattacctttctgtctgtgtgacagtgtgagcaagtttctgcaacatcagacat

SEQ ID NO: 1601 - DNA, 2649 bp, Secale cereale
taggacacgagaacctgaagagagagagagagaagcaaagttagagagagaagaaaagcgagagggagggagattgctggagctggatcggggcgccgggccggctgtgcagatcggtggaggtcatgaacaactaatcgacactcatttattatggatttgcaccagctattcaagtacagattgactggtgctaacgtcttctgcgaaattcccacagagaacaatttagcgaactcttcctggcaaactagtccactgaagttagagttcagcaactctccatacacccctctttctacccagcttgagtgtgataatttgtctgctcttagcaacactccagataaccagagctctactgaaaccatttcagcccaaccaatctccccgcttgaagcagacagctcatacataaaggcaggtagcatccgtgagaacatccaagtgagatctgatccattgtatgcaacatcaagacataatatgcaacagactttgcgggacattgagaacgttctgatggcacctgatgctgatgatgcaacgacgagcacaaagcatgagtttgaggacaccaagcctgctcagctcatgcggcagcggtcgaggacatggagccatgagtcacgacagccgttgcctggagttgttcggccacactttgcatctggtggataccccacggcaagctatgagttccgcccagagaaacgacaaagggagttaagggacgatcgacaacacattgtgaaggatctattaaccaagtgtgctgaggcattaagtgaggacaggacagaggagttcctaaagcttgttcaggaggctcgtgggactgtttcaattaacggggaaccgatccagcgtctaggtgcttacctactcgagggtttggttgctaggcatgggaactctggtacaaacatctaccgtgctctgaaatgccgggagccggagagcaaggagcttctctcctacatgaagattttatacaatatctgtccttacttcaagtttggatacatggcagctaatggggcgattgcagaggcattgagaagcgaggacaacatccacataattgattttcagattgctcaagggactcaatggatcacactgatacaagctctagctgcaagacctgggggtccacctcatgtgcggatcactggaatagatgacccggtgtcagagtatgcccgaggtgaaggcctggagatagttggaaacatgctgaaaagcatgtctaaagagttcaatatacctttggagtttacacctctatctgtctatgctactcaagtcacaaaggaaatgcttgagatcagaccaggtgaagcagttgctgtcaacttcaccctccagctgcaccataccccagatgagagcgtggacgtcaacaacccacgggacgggttgctccggatggtgaaagggctgtccccgaaggtgaccacgttggtggaacaggagtcgcacaccaacacgacgcctttcttgatgaggtttttggagaccatggattactactccgccatgttcgagtctatcgacgccaacttgcctcgagacagcaaagagaggataagtgtggagcaacactgcctggccaaggatatcgtgaacatcatcgcctgcgaggggaaggacagagtggagaggcatgagctgcttggcaagtggaaatcaaggctgagcatggcaggcttcaagccttacccgctgagctcgtatgtgaactcggtgatcaagaagctcctcgcgtgctactcggacaagtacacgctggaggagaaggatggggcaatgctcttgggctggaagaccaggaagttgatatctgcctctgcgtggcactgacagttgcccagcggaagaagaaaagaaaacagaggttatagagcgaagtccctggtctcctttcttttttgatgtaccacctgtacatgatgctgtacactctcatttgttgcctaaatgtagaccgggaattgagcattgagaattagattgtagaagttgtatgataattacagtcttcctgcgcttcccgtgtagtattcgtggtgattatgttggatgtaatttcccaggcatgctcttgttggtcggcaaagttttccactcacggagcatgctctgaggatgcagagtataccctggtcattgggggcctgtgaagataagttttgcaaggggtttctcttatgtcagtaccgttacatgagcaagtggtgtaagatcagggcgtgcctaggcaaaatgtgattgggctttgggtcgagatttggatgcatgtacccgaaggtgttgtacgttctacactgtgaggatgataggcaattctgttgccgctgtgctgcgtcgtgcaggcgacacgaatccattgtcccaaaatccagatgctcggcgacaattatttttttgggcaatgatattccgggcggaagcggcacggtggctgcaggataggcaagcgaacaaaatggagtttagctgattgcctccgagtcccatggcatacaaccctccaaactcccaagtctgagctagcgacatttcagatcggcgtacagcagcgaactctcagatggttacattctttgtgatgaaccagtccatcagggtttaagtcatagactt

SEQ ID NO: 1602 - DNA, 2912 bp, Triticum aestivum
ctccttctctcttgtgtgaggaagcagatattaattatcgcgcacacgaaaagagggagggggcgcaaagagagaagggactaggacacgagaaccagaagagagagagagagagaagaaaagcgagagagattgctggagctggatcggggcgccgggccggctgtgcagatcggaggaggtcatgaacaactaatcgacactcatttattatggatttgcaccagctattcaagtacagattgactggtgctaacgtcttctgcgaaattcccacagagaacaatttagcgaactcttcctggcaaactagtccactgaagttagagttcagcaactctccatacacccctctttctacccagcttgagtgtgacaatttgtctgctcttagcaacactccagataaccagagctctactgaaaccatttcagcccaaccaatctccccgcttgaagcagacagctcatacataaaggcaggtagcatccgtgagaacatccaagtgagacctgatccattgtatgcaacatcaagacataatatgcaacagactttgcgtgacattgagaacgttctgatggcacctgatgctgatgatgcaacaacgagcacaaagcatgagtttgaggacaccaagcctgctcagctcatgcggcagcggtcgaggacatggagccatgagtcacgacagccgttgcctggagttgttcggccacactttgcatctggtggataccccacggcaagctatgagttccgcccagagaaacgacaaagggagttaagggacgatcgacaacacattgtgaagggtctattaaccaagtgtgctgaggcattaagtgaggacaggacagaggagttcctaaagcttgttcaggaggctcgtgggactgtttcaattaacggggaaccgatccagcgtctaggtgcttacctactcgagggtttggttgctaggcatgggaactctggtacaaacatctaccgtgctctgaaatgccgggagccggagagcaaggagcttctctcctacatgaagattttatacaatatctgtccttacttcaagtttggatacatggcagctaatggggcgattgcagaggcattgagaagcgaggacaacatccacataattgattttcagattgctcaagggactcaatggatcacactgatacaagctctagctgcaaggcctgggggtccacctcatgtgcggatcactggaatagatgacccggtgtcagagtatgcccgaggtgaaggcctggagatagttggaaacatgctgacaagcatgtctaaagagttcaatatacctttggagtttacacctctatctgtctatgctacccaagtcacagaggaaatgcttaagatcagaccaggtgaagcagttgctgtcaacttcaccctccagctgcaccataccccagacgagagcgtggacgtcaacaacccacgggacgggttgctccggatggtgaaagggctgtccccgaaggtgaccacgttggtggaacaggagtcgcacaccaacacgacgcctttcttgatgaggtttttggagaccatggattactactccgccatgttcgagtctatcgacgccaacttgcctcgagacagcaaagagaggataagtgtggagcaacactgcctggccaaggacatcgtgaacatcatcgcctgcgaggggaaggacagagtggagaggcatgagctgcttggcaagtggaaatcaaggctgagcatggcgggcttcaagccttacccgctgagctcgtatgtgaactcggtgatcaagaagctcctcgcgtgctactcggacaagtacacgctggaggagaaggatggggcaatgctcttgggctggaacaccaggaagttgatatctgcctctgcgtggcactgacagttgctcagcggaagaagaaaagaaaacagaggttatagagccaagtccctggtctcctttcttttgatgtaccacctgtacatgatgctgtacaccctcatttgttgcctaaatgtagaccaggaatcaagcattgacaattagattgtagaagttgtatgataattacagttttcctgcgcttcccgtgtagtattcgtggtgattatgttggatgtaattttccaggcatgctcttgttggtcggcaaagttttccactcacggagcatgctctgaggatgcagagtataccctggtcatggggcctgtgaagataggttctgcaagggttttctcttatgtcagtaccgttacatgagcaagtggtgtaggatcagggcgtgcctaggcaaaatgcgattgggctttgggtcgagatttggatgcatgtacccgaaggtgttgcacgttcgttctacactgcgaggatgatgggcaattctgttgccgctgtgctgcgtcgtgcaggcgacaggataggcaagcgaacaaaatggagtttagctgattgcctcccgagtcccatgacatacaaccctccaacgtccaaactcccaagtctggcgacattttcaggtcggcatattgcagcgaatgagctatggttacgttctctgtggtgaaccacgtatttttttgaatttattttaggcttccggcgatactcattcagtgtgaggagaagttttcgtggcgtttatggtggcttcgccaatctcaagataatatgccggttcaatctcttaaacatgctcatagggtaaaaagtgtgtaattgcttttatagggataaatatatgtgagtatgtatgtgtttgcatctatattgtgtttaaaaatagacaaaatgttgcacaatttactagtgatgaattgctatgtgcatcacttgatacaaaaggtcagagataatccttttcttttttaaaagtagacgttgcac

SEQ ID NO: 1603 - DNA, 2369 bp, Hordeum vulgare
cgccgtcttgcttgtgatagatattaattatcgcgcacacgaaaagagggagggggcgcaaagagagaagggactaggacacgagaaccacaagagagagagaagaaaagcgagagagaaagggagggagattgctggaggtggatcgaggcgccgggccggccgtgcagatcggaggaggtcatgaacaactaatcggcactcatttattatggatttgcaccagctattcaagtacagattgactggtgctaacgtcttctgcgaaattcccactgagaacaatttagtgaactcttcctggcaaactagtccactgaagttagagttcagcaactctccatacacccctctttctacccagcttgagtgtgacaatttgtctgctcttagcaacactccagataaccagagctctactgaaaccatttcagcccagccaatctccccgcttgaagcagacagctcatacataaaggcaggtggcatcagtgagaacatccaagtgagatctgatccattgtatgcaacatcaagacataatatgcagcagactttgcgtgacattgagaacgttctgatggcacctgatgctgatgatgcaacaacgagcgcaaatcatgagtttgaggacaccaagccttctcagctcatgcggcagcggtcgaggacatggagccatgagtcacggcagccgttgcctggagttgttcgaccacaatttgcatctggtggattccccacggcaagctatgagttccgcccagagaaacgacaaagggagttaagggaggatccacaactcattgtgaagcatctattagtcaagtgtgctgaggcattaagtgagaacaggacagaggagttcctaaagcttgttcaagaagctcgtgggactgtttcaattaacggggaaccgatccagcgtctaggtgcttacctacttgagggtttggttgctaggcatggaaactctggtacaaacatctaccgtgctctgaaatgccgggagccggagagcaaggagcttctctcctacatgaagattttatacaatatctgtccttacttcaagtttggatacatggcagctaatggggcgattgcagaggcattgagaagtgaggacaagatccacataattgattttcagattgctcaagggactcaatggattacactgatacaagctctagctgcaaggcctgggggtccacctcatgtgcggatcactggaatagatgacccggtgtcggagtatgcacgaggtgaaggtctggaattagttgggaacatgctgaaaaacatgtctgaagagtttaatatacctttggagtttacacctctatctgtctatgccactcaagtcacaaaggaaatgcttgagattagaccaggtgaagcagttgctgtcaacttcaccctccagctacaccataccccagatgagagcgtggacgtcaacaacccgcgggacgggttgctccggatggtgaaagggctgtccccgaaggtgaccacattggtggagcaggagtcgcacaccaacacgacgcctttcttgatgaggtttgtggagaccatggattactactctgccatgtttgagtccatcgacgccaacttgcctcgagacagcaaagagaggataagtgtggagcaacactgcctggccaaggacattgtgaacatcatcgcctgcgaggggaaggacagagtggagaggcatgagctccttggcaagtggaaatcgaggctgagcatggctggcttcaagccttacccgctgagctcgtatgtgaactcggtgatcaagaagcttcttgcatgttactcggacaagtacacgctggaggagaaggatggggcgatgctcctgggctggaagagcaggaagttgatatccgcctctgcgtggcactgacggttatatgctcattggaagaagaaaagaaaacagaggttatagagccaagtccctggtctcctttgatgtaccacctgtacatgatgctgtacacccctcatttgttgcctaaatgtagaccaggaattgagcattgacagttagattgtagaagttgtatgataattacagttttcctgcggttcccgtgtagtattcgtggtgattatgttggatgtaattttccaggcatgctcttgttgatcggtcaaattttccccactcacggagcatgctgtgaggctgcagaccacagagcataccatagtcatgggtctgtgaagatggttttgcaagtgttttctcttatgtcactaccattacatgagcaggtagtgtgagatcagtgtttgcctaggcaaaatatgattgggctttggatcgagatttggatgcatgtacg

SEQ ID NO: 1604 - DNA, 694 bp, Saccharum officinarum
ggagtaaccgggtcgacccacccgtccgatccggttccgttcaatcctcgtctcgcaaggtcaaggtcgccatggcgggaggcaaggtttactcgtttgaggaggtgaggaagcacagcgattgcaaggattgctggctcatcatcgccggcaaggtgtacgacgtcacgccgttcatggaggagcacccgggcggcgacgaggtcctgctggcgtgcgtcggcaaggacgccaccgccgacttcgaggacatcggccacaccgactccgccaaggagctgatgccgcagtactgcatcggcgaggtcgacgcggcaaccatcccggccaagctcacccacgtcgttaccaaggacgcaagcaggtccgagaaggccacgacgagcgccgccggcaattgggcaacgctcctgcagctcgccgtgcccgtcctgctgctggccctggccttcgcgctgcagaactactccagggccaaggcagagtagacaagacaagatagataccatcgttgattccgctgtgtcgcgggcctgcggcctcttggaagcatctgaaagctggagcagttggtgatgcgagtgtgacgtactgtgacaaagtatatcgaacaggatgtattatactgctaattaagccgctcgtggtatcgttactttcgtaataatgggtgaaatttgttctggtaaaaaaa

SEQ ID NO: 1605 - DNA, 721 bp, Sorghum bicolor
cgggcacacgggatcaaccggccaaacggtggtatagctacagcagagtcatcatcccttgaggcgcgccctgctgctcgacctgtgagcctgtgaagcaaggtcgccatggcgggaggcaaggtttactcgttcgaggaggtgaggaagcacagcgatcgcaaggattgctggctcatcatcgccggcaaggtgtacgacgtcacgccgttcatggaggagcacccgggcggcgacgaggtcctgctggcgtgcgtcggaaaggacgccaccgccgatttcgaggacatcggccacaccgactccgccaaggagctgatgccgcagtactgcgtcggcgaggtcgacgcggctaccatcccggccaagctcacccacgccgtcgtcaccaaggacgccgccagcaggtccgagaagaccacgacggcgagcgccggcacctgggccacgctcctgcagctcgccctgcccgtcctgctgctggccctggccttcgcgctgcagaactatagcagggccaaggcagcgtagacaagatagatagctaccgtcgttgattccgcctgtgtgagtgataccgtcgttgattccgctgtgccgcgggcctgcggcctcttggaagcatctgaaagctggagcagttgttgatgcgagtgtgacgtactgtgacaaagtatatcctaaagtgctaattaattaagccgctcgtggtatcgttact

SEQ ID NO: 1606 - DNA, 817 bp, Sorghum bicolor
acgggatcaaccggccaaacggtggtatagctacagcagagtcatcatcccttgaggcgcgccctgctgctcgacctgtgagcctgtgaagcaaggtcgccatggcgggaggcaaggtttactcgttcgaggaggtgaggaagcacagcgatcgcaaggattgctggctcatcatcgccggcaaggtgtacgacgtcacgccgttcatggaggagcacccgggcggcgacgaggtcctgctggcgtgcgtcggaaaggacgccaccgccgatttcgaggacatcggccacaccgactccgccaaggagctgatgccgcagtactgcgtcggcgaggtcgacgcggctaccatcccggccaagctcacccacgccgtcgtcaccaaggacgccgccagcaggtccgagaagaccacgacggcgagcgccggcacctgggccacgctcctgcagctcgccctgcccgtcctgctgctggccctggccttcgcgctgcagaactatagcagggccaaggcagcgtagacaagatagatagctaccgtcgttgattccgcctgtgtgagtgataccgtcgttgattccgctgtgccgcgggcctgcggcctcttggaagcatctgaaagctggagcagttgttgatgcgagtgtgacgtactgtgacaaagtatatcctaaagtgctaattaattaagccgctcgtggtatcgttactttcgtataataatggttgaattttgttcctggtaaagtttgttactcttgtgtgctgaaactcatatattcaggctttcttcaactcatatattcaggctttc

SEQ ID NO: 1607 - DNA, 1213 bp, Sorghum bicolor
cgatcgcccactgcagtgcagtctccaaagcaaccgccggccggatcgagccctccacacactcgatcgatcactccacagtacgtacctaatggtcggcatgggcaagcagcagcagcagcagggagaggcggaggggaagatcgtcctccaggaggagacggcgccggtgccgccgccggaggaggacaaggaggccgaggcggcgctggtgcacaagatctccagccttgccgccgccatcgggaagcttccgtccctgagcccgtcgccggaggtgaacgctctcttcaccgagctggtgacggcgtgcatcccgcgcagcaccgtcgacgtggagcgcctgggcccggagctgcaggagatgcgcggccgcctgatccgcctctgcgccgacgccgagggcctcatggaggcgcactactccgacctgctcgccgcgttcgacaacccgctggaccacctgtcgctcttcccctacttcaacaactacatcctgctcagccagctggagcacggcctgctggcgcgccacgtcccggcgccgccgccgtcccgcgtcgccttcgtcggctccggcccgctcccgctcagctccctcgtcctggcggcgcgccacctcccggccgcctccttcgacaactacgacatcagcggggacgccaacgaccgggcgcgtcgcctggtgcgcggcgacgccgcgctccaggcgcgcatggcgttccgcacctccgacgtggccaacgtcaaccgggagctcgcctcgtacgacgtcgtcttcctcgcggcgctcgtgggcatggccgccgaggacaaggcccgcgtcgttgagcacctcgggaggcacatggcccccggcgctgcgctcgtggtgcggagcgcgcacggggcgcgcggcttcctctaccctgtggtcgaccccgaggagatccggcgcggcggctttgacgtgctcgccgtgcaccacccggagggggaggtcatcaactccgtcatcatcgcgcgcaagcctgtcgccgtcgacggggtgggagtcgccgaactgggacacgcgcacgcgcacggcgccgtgctcagccgcccctgcctctgctgcgagatggaagcccgggcgcaccagaagatggaggaggtggccatggagcagctgccgtcctaggcacgacgtcgtgcttgcctttcttgttcgattgccccgtcgccgccgccggcc

SEQ ID NO: 1608 - DNA, 1912 bp, Sorghum bicolor
ccctctcgctgcgccacttgggccccatgcaccacacgcacacgcacggcctttgttggcctgccatgccatgccatgccatctatatatgctgcctcagctcgatcgcccactgcagtgcagtctccaaagcaaccgccggccggatcgagccctccacacactcgatcgatcactccacagtacgtacctaatggtcggcatgggcaagcagcagcagcagcagggagaggcggaggggaagatcgtcctccaggaggagacggcgccggtgccgccgccggaggaggacaaggaggccgaggcggcgctggtgcacaagatctccagccttgccgccgccatcgggaagcttccgtccctgagcccgtcgccggaggtgaacgctctcttcaccgagctggtgacggcgtgcatcccgcgcagcaccgtcgacgtggagcgcctgggcccggagctgcaggagatgcgcggccgcctgatccgcctctgcgccgacgccgagggcctcatggaggcgcactactccgacctgctcgccgcgttcgacaacccgctggaccacctgtcgctcttcccctacttcaacaactacatcctgctcagccagctggagcacggcctgctggcgcgccacgtcccggcgccgccgccgtcccgcgtcgccttcgtcggctccggcccgctcccgctcagctccctcgtcctggcggcgcgccacctcccggccgcctccttcgacaactacgacatcagcggggacgccaacgaccgggcgcgtcgcctggtgcgcggcgacgccgcgctccaggcgcgcatggcgttccgcacctccgacgtggccaacgtcaaccgggagctcgcctcgtacgacgtcgtcttcctcgcggcgctcgtgggcatggccgccgaggacaaggcccgcgtcgttgagcacctcgggaggcacatggcccccggcgctgcgctcgtggtgcggagcgcgcacggggcgcgcggcttcctctaccctgtggtcgaccccgaggagatccggcgcggcggctttgacgtgctcgccgtgcaccacccggagggggaggtcatcaactccgtcatcatcgcgcgcaagcctgtcgccgtcgacggggtgggagtcgccgaactgggacacgcgcacgcgcacggcgccgtgctcagccgcccctgcctctgctgcgagatggaagcccgggcgcaccagaagatggaggaggtggccatggagcagctgccgtcctaggcacgacgtcgtgcttgcctttcttgttcgattgccccgtcgccgccgccggccgcccattcgatttcggatcatccatctctatcagctggtcgatctatagtatcgatcctctgcatctacatatccacatatgcatggtaataatctgcaggttgaccgcatatgcatatcatgtctcatcctagctccatccctttgcatcgtagtaattactagctctagctggtgtattattaattaatttgtctgctactgttatcacctgatgagtactctctccgtatgcatgtgtggagatgagtcatggagtggttaatttttattagtaaactctcgatgcttaaatttgtcagtctgactgtatccagcaggttattattaataatatatatataagccataacaattccatctcttcttgttcttgttactatgggacgacagttattagtactcctacgtactacacgcataaatacaagccgctccattgtttgttttgacgcggtatatgttatatatgcatcgtgtggcgttgctgtttttttgtccggcaaatgctttgtttcgaggctgcattgctttctacatcatgtaaatctgatggttgccacttgtcatgttgatgtttggatccataaagctaat

SEQ ID NO: 1609 - DNA, 1208 bp, Sorghum bicolor
gcaatcgcctagctagctagacccacactgtgatcacagtacactgcacgcggccaccatggtcgtcatgggcaaggaggaggagaagcaccaccagcagcagcagctgaaggaggaggaggtccaagaagaagcacgagtcgtcgtcgagccggacatgacggcggacgaggaggcgctggtgcagaagatctccggcctggccgcggccatcgcgaagctgccgtcgctgagcccgtcgccggaggtgaacgcgctcttcaccgccctcgtgacggcgtgcatcccgcgcagcacggtggacgtggagcgcctgggccctgagctgcaggccatgcgcgcggggctcatccgcctctgcgccgacgccgaggcactgctggaggcgcactactccgacctgctggcgggcttcgacaacccgctggaccacctcacgctcttcccctacttcagcaactacctgctgctgagcgagctggagcacggcctgctggcgcgccacgtcccgggaccgccgccggcgcgcgtcgccttcgtcggctccggcccgctcccgctcagctccctcgtgctcgcggcgcgccacctcccggccgcggccttcgacaactacgacatctgcggggacgccaacgaccgcgcgcgccgcctcgtgcgcgccgacgcggcgctcgccgcgcgcatggcgttccgcacctccgacgtggccgacgtcaccagggacctggccgggtacgacgtcgtcttcctggcggcgctcgtgggcatggccgccgaggagaaggcccgcgtggtggagcacctcgggaggcacatggcgcccggcgccgcgctggtggtgcggagcgcgcacggcgcgcgcggcttcctgtaccccgtcgtggaccccgaggagatccgccgcggcggcttcgacgtgctcgccgtgcaccacccggaaggggaggtgatcaactccgtcatcatcgcgcgcaagcctgtcccgcccgtcgacgcgcacgccgtcgccgtcgccgccgccggggtggggcacgcgcacgcgcacgcgcacggcgccgtgctcagccggccctgcctctgctgcgagatggaggcccgggcgcaccagaagatggaggaggtggccgtggagcagctgccgtcctaggcactggcacaccacaagacaagatggattgccccggccggccacccattcagttgca

SEQ ID NO: 1610 - DNA, 2094 bp, Sorghum bicolor
ggggaatggtatgaagtaaagaaaagataaggcaacgacatggaacttgaattattgttttgtgggggtatcgatcgtatagctactgttccatccattccacagcaatatatatctcgatcatgatagaagaagaaataatgaaatggatcctcactcgcccaagttgttgtacgcgcgtgtgttgtcgccactgcgacaaggacgtgacgctcgatcgccgttgcgtgtgtggagaaaaatacgccgaggcttgtggcgggcacgggtcttccacgatcacatggcgagctacgggacagggacgccattattccttgccaccagtatatatacactgtagtatgcctctcccactccaaagcgatcgaagcagctagcaatcgcctagctagctagacccacactgtgatcacagtacactgcacgcggccaccatggtcgtcatgggcaaggaggaggagaagcaccaccagcagcagcagctgaaggaggaggaggtccaagaagaagcacgagtcgtcgtcgagccggacatgacggcggacgaggaggcgctggtgcagaagatctccggcctggccgcggccatcgcgaagctgccgtcgctgagcccgtcgccggaggtgaacgcgctcttcaccgccctcgtgacggcgtgcatcccgcgcagcacggtggacgtggagcgcctgggccctgagctgcaggccatgcgcgcggggctcatccgcctctgcgccgacgccgaggcactgctggaggcgcactactccgacctgctggcgggcttcgacaacccgctggaccacctcacgctcttcccctacttcagcaactacctgctgctgagcgagctggagcacggcctgctggcgcgccacgtcccgggaccgccgccggcgcgcgtcgccttcgtcggctccggcccgctcccgctcagctccctcgtgctcgcggcgcgccacctcccggccgcggccttcgacaactacgacatctgcggggacgccaacgaccgcgcgcgccgcctcgtgcgcgccgacgcggcgctcgccgcgcgcatggcgttccgcacctccgacgtggccgacgtcaccagggacctggccgggtacgacgtcgtcttcctggcggcgctcgtgggcatggccgccgaggagaaggcccgcgtggtggagcacctcgggaggcacatggcgcccggcgccgcgctggtggtgcggagcgcgcacggcgcgcgcggcttcctgtaccccgtcgtggaccccgaggagatccgccgcggcggcttcgacgtgctcgccgtgcaccacccggaaggggaggtgatcaactccgtcatcatcgcgcgcaagcctgtcccgcccgtcgacgcgcacgccgtcgccgtcgccgccgccggggtggggcacgcgcacgcgcacgcgcacggcgccgtgctcagccggccctgcctctgctgcgagatggaggcccgggcgcaccagaagatggaggaggtggccgtggagcagctgccgtcctaggcactggcacaccacaagacaagatggattgccccggccggccacccattcagttgcatctacctgatcgatcgagtaaacagtaatcccctactactactatgtctacgtgtgtccacaccacatgcatggtcataatctgcaggttgaccttgctactggctggtgtattgttgccgtgattatactaaggtcccgtttaacaaggagtcggagctggtgaaaggaaaaatagtgaagagatttaaaaaaaaacagagtgcaccaagaagtcaaggcctgagatctagcaaacagagcctaatttgtccgttaatgttacatgtgtgtgtgagtgatgatgatcgagtggttaatttgaagtaactcccgtgcttaatttgtcagtttgggagtattattagcacgtaaatgcataaatacaggccattccggtccattggttgttttgacgcgatatatatgcatcatggtcatggcctcgaagttttgttcggagggacgaagccaggaaaaaaaataggaggggctcaacaaaaatactacatggatttagttttactat

SEQ ID NO: 1611 - DNA, 1685 bp, Zea mays
aaagcgaagcagcaaccagcaaagtgatcagtgtgatcgatcacacactgccatggccgtcatgggcaaggaggaggaggagcagcagcagcagcacaaggaggaggaggtggtccaaggagatgtgcgagtcgtcgtccagcaggagacggcggcggacgaggaggccgagtcggcgctggtgcgcaagatctccggcctggccgccgccatcgccaggctgccgtcgctgagcccgtcgccggaggtgaacgcgctcttcaccgacctcgtcacggcctgcatcccgcgcagcaccgtggacgtggagcgcctgggcccggagctgcagcgcatgcgcgcgggcctcatccgcctctgcgccgacgccgaggcgctgctggaggcgcactactccgacctgctggccgccttcgacaacccgctggaccacctgccgctcttcccctacttcaccaactacctcctgctgagccagctggagcacggcctgctggcgcgccacgtcccgggcccgcccccctcccgcgtcgccttcgtcggctccggcccgctcccgctcagctccctcgtgctcgcctcgcgccacctccccgccgccgccttcgacaactacgacatctgcggggacgccaacgaccgcgcgcgccgcctcgtgcgcgccgacgccgcgctcgccgcgcgcatggcgttccgcacctccgacgtcgcccacgtcacccgggaactggccgcctacgacgtcgtcttcctggcggcgctcgtgggcatggccgccgaggagaaggcgcgcgtcgtcgagcacctcggcaggcacatggcgcccggcgccgcgctggtggtgcggagcgcgcacggcgcgcgcggcttcctgtaccccgtggttgaccccgaggagatccgccgcggcggcttcgacgtgctcgccgtgcaccacccggagggggaggtgatcaactccgtcatcatcgcccgcaagcccctcccggtcgtcgacgagcacgccgtcgccggggtggggcacgcgcacgcgcacggcgccgtgctcagccggccctgcctttgctgcgagatggaggcccgggctcaccagaagatggaggaggtggccatggagcagctgccgtcctaggcacaagatggattgccccggccggcagcccatgcaatcgcattgcatctatctcatcgatctacttacgtgtctacaccacatgcgtgataataatctgcagattgacctggctactagctggtatattgtccccgtgattgtattaagtttttgtttaacaaaagggtagaagtcgaagtccgagccggcgaaagaaaaaatactggagaaaaaaaaagagtgcacgaaggagacggaggcgagcgaacaggctggcctaatttcatttgtatgctaatgttacgtgtgtcaatgatgatggagtggttaaattattagtaattctcgatgcctaatttgtcagcctggatactgttattagcatgtagcttagctccaagggtcattgggtcagtacgacagtaccgtcaccttagagatgccaaatgagcggtttggcttggcacgacacctaagagaaaaaaaataccataaagaagctcgtggtcgtagccactacccaggtttattttcttataagattatataattcaacttatagattatctaa

SEQ ID NO: 1612 - DNA, 1846 bp, Setaria italica
tgcccattggtcgccaagcagcagcaaacctgctctgctgcagcagtcacaaacaacaagtcactgcctagccttgcttgttgagagctgagactgtgactgaccgtacgtgcccgccacgcgccatggtcgacatggggaacaagcaggaggaggaggtccaggtaccagtcccggaggaggggatggcgtcggatgaggaggcggcgctcgtgcacaagatcgccgggctcgccgctgccatcgccaagctgccgtcgctgagcccgtcccccgaggtgaacgcgctcttcacggagctggtgacggcctgcatccctccaagcgccgtcgacgtggagcgcctcggccccgagctgcaggagatgcgcgcgcggctgatccgcctctgcgccgacgccgagggcctgctggaggcccactactcggacctcctcgccggcttcgacaacccgctcgaccacctggggctcttcccctacttcaacaactacatcctgctgagcgagctggagcacggcctgctggcgagccacgttccggggccggtgccggcgcgcgtcgccttcgtgggctccggcccgctcccgctgagctccctggtgctggcggcgcgccacctgccggccgcgtccttcgacaactacgacatctgcggcgaggccaacgagcgggcgcgccgcctggtgcgcgccgacgccgggctgggcgcgcgcatggcgttccgcacctccgacgtggcgcacgtgacgcgggacctggcgtcctacgacgtcgtcttcctggcggcgctcgtgggcatggccgccgaggagaaggcgcgcgtggtggagcacctcggccgccacatggcccccggcgccgcgctcgtggtgcggagcgcgcacggcgcccggggcttcctgtacccggtggtggacccggaggagatccgccgcggcggcttcgaggtgctggccgtgcaccacccggagggcgaggtgatcaactccgtcatcatcgcgcgcaagcccgtgcccgccgacgcgcaggccggcggcggcgtggcccacgcgcacgcgcacggcgccgtgctgagccggccctgcctctgctgcgagatggaggcacgggcgcatcagaagatggaggaggtggccctggagcagctgccatcctaattgcttcatcgatccatcctaatatgatgatgatatgcatcatcatcatattcatagtattactatctatctatctatcatggggattactatgatttacatctagcactactagccattaattaatcttaatttatcccctctatcatatctgtatcatcgacggacgacatgatgcatgctaataatctgcttgaccgcatgcatgtcgttgctattgaattgctctagtaatttgtgtttgcgtgagtgatgaagagtcgtcgttattagcagtgtgatgattcctgaatcctgatgatatataatttgtctgactgtctccgtgtttgatctcatccgatttagcagcgtgtcatccgttgtctgttttgatgcgacggcgttggtgctctgtccggcaacggcaaatgctatgttccgagcctgggcttctccggctgtgcatgcctttgctttctttgtcctaggctctacgcagcaggatgctctcggcagggcagtgtagccaaatgattcaactactagctagaaacgtaaggaggcaagcaagactgctgaaaattggctctccacacacctgcagtattctgttgtgatgcagagtaataaggttatcctccttcgtatatatcagatagaaatgcaattctatcagtacactggtatgtacggtattttgaata

SEQ ID NO: 1613 - DNA, 1059 bp, Setaria italica
cgtacgtgcccgccacgcgccatggtcgacatggggaacaagcaggaggaggaggtccaggtaccagtcccggaggaggggatggcgtcggatgaggaggcggcgctcgtgcacaagatcgccgggctcgccgctgccatcgccaagctgccgtcgctgagcccgtcccccgaggtgaacgcgctcttcacggagctggtgacggcctgcatccctccaagcgccgtcgacgtggagcgcctcggccccgagctgcaggagatgcgcgcgcggctgatccgcctctgcgccgacgccgagggcctgctggaggcccactactcggacctcctcgccggcttcgacaacccgctcgaccacctggggctcttcccctacttcaacaactacatcctgctgagcgagctggagcacggcctgctggcgagccacgttccggggccggtgccggcgcgcgtcgccttcgtgggctccggcccgctcccgctgagctccctggtgctggcggcgcgccacctgccggccgcgtccttcgacaactacgacatctgcggcgaggccaacgagcgggcgcgccgcctggtgcgcgccgacgccgggctgggcgcgcgcatggcgttccgcacctccgacgtggcgcacgtgacgcgggacctggcgtcctacgacgtcgtcttcctggcggcgctcgtgggcatggccgccgaggagaaggcgcgcgtggtggagcacctcggccgccacatggcccccggcgccgcgctcgtggtgcggagcgcgcacggcgcccggggcttcctgtacccggtggtggacccggaggagatccgccgcggcggcttcgaggtgctggccgtgcaccacccggagggcgaggtgatcaactccgtcatcatcgcgcgcaagcccgtgcccgccgacgcgcaggccggcggcggcgtggcccacgcgcacgcgcacggcgccgtgctgagccggccctgcctctgctgcgagatggaggcacgggcgcatcagaagatggaggaggtggccctggagcagctgccatcctaattg

SEQ ID NO: 1614 - DNA, 2089 bp, Saccharum officinarum
cgctccgctccccacctcgtgctctctccctttccttcgccgattcctactcagccgcgcgggggagaagacaagcgctttctccccggaattccgcgcccaccacctcgtcctcctgtgcatttggcagcgcagatcccgccgctcccgtccagccatcatcctcttcgcagttctcccttgctctgctaggccttgactgttctcgactcccctaatcaccagctcggtctcctcttcctcgccgcgttccgctcggtctccgctccaacacgccatctgctgccgcgtaaacaccgggaaatacctggcctttctggtgtgtgtgtgtgtgtaaccgagtttcaactccccaagtttgctgcttttggccaatcttttctgggctttcaggtctcagcatcacctggccagctggccccttttactgcgatctttctgtccgatcactgcaattttaagcttcgagtacctcctttttgggaaaattcagtctctgatgataaagctgttgagtgagcggttcatgcaccacaccaccagtagcttcagctaagatctcatctccccatgccacaaactcctccaggaccgtcagccatggcaaagctgctatagcgctgctccggctggcctgcataagctgcgaaattcgggtcctttcccggcatcccgcgcccatggacggcctccccgacgccgacgcggcgccgttggcggctgcgccgccgcagaagcgcgacgagtggagcgagagcggcatcgtgcgcctgctcgaggcctacgaggccaagtggttgctgcggaaccgcgccaagctcaagtggagcgactgggtcgacatcgcccgcgaggtgtccgtgcattgcgccgacgacgccgcggcagcggggaagccccccggcggcggcggcggcaacagcgccaagacccccaaccagtgcaagaacaagatcgagtccatgaagaagcggtaccgggccgagtccgccgcggtggcgcgcgcggggcccgccgctgccggtccgtcgtggaggttcttcgcgcgcatggacggcctgctcaaagggccggccgtctgctctgcccaggtgcagcaaccggagctgattaacagcatagacttgcgagctccggcgaaaccagaggtggccgaggtcgaagctgattttgccacgcagttgcgggatgcagttccaggtgcattctctgatctgatgaacattgacacgaatggcgctgtcccggataaagcggagaaggttgacaacagcatgcagaaggaggtcaggcctgctgatagcgatgccaacgtgagctctccaaggagtaaggtggccaacgaggacgtggaggaggtgaacaatgtctgggaccggaccaagaagagaaagagcacagactttgacatagcgaagagcatcgagctgctggctagctcgttcttgaagattgagcacgccaggttggagatgtacagggagacagaaaggatgagggttgaagctgagattaagaagggggagatggagctcaagagaactgagatcatggcgaaaacgcacctgcagatcgccaggctttttgcaaagaaattgaaacagagcagtggcaagaatggcggcagttcgtcagtaacagctgaagtggacacccttaccaagaaaggcgagaatggttagtgtcaacacaacatcctgataaaatggttatacttttgctaaaagttgctaaaatttattatatggatactccatggcaaagcaaaattttccctcgagagtacatagctttctctgtgtcagaatcccccatttgttaggtctgtacctctgtgtctgttcctgaatacattaatagaattgggagcttcagcctaaattcgttatagcagttcactgtatcagaggttgattattatgtaatgtttgtgacaatttgagagtttgtgcagtggtagggctgtaacatttcaattttgctgctgttgtctgcttttcattattgtcgactaattcttagaaatgaagtcttaattgttattgtgagtcaagattttccatagtaaatggacataatgctcgtgttc

SEQ ID NO: 1615 - DNA, 2136 bp, Sorghum bicolor
cgccgattcctactcatcagccgcgcgccggggagagaagacaagcgctttctttctccccggaattccgcgcccacctcctcctcctcctgtgcatttggcagcgcagatcccgccgctcccgtccagctagccgatcctcctcttctctgttctccccttgcgctactactaggccttgactgttctcgactcccctaatcaccagcggctcggtcggtctccctcttcctcgccgcgttcccttcggtctccgctccaacacgccatctgctgccgcgcaaacaccgggaaataccttggcctttctggtgtaaccgtgtaagcgagtttcgactccccaagtttgctgcttttggccaatcttttctgggctttcaggtctcagcatcacctgccccgcttttaccgcgatctttctgtccgatcactgcaattttcagcttcgagtacctcctttttcgggaaattcagtctctgctgataaagctgttgagtgagcggctcatgcaccacaccaccagtagcttcagctaagatctccatctccccatgccacaaactcctccaggaccgtcagccatggccaagctgctatagcgctgctgctccggctggcccgtgtgagctgcgaaattcggggggtccctctccggcttcccgcgcccatggacggcctccccgaccccgacgcggcgccgttggcggctgcgccgccgcagaagcgcgacgagtggagcgagagcggcatcgtgcgcctgctcgaggcctacgaggccaagtggctgctgcggaaccgcgccaagctcaagtggagcgactgggtcgacatcgcccgcgaggtgtccgtgcattgcgccgacgacgccgcggccgctgggaagccccccggtggcggcggcggcggcaacagcgccaagacccccaaccagtgcaagaacaagatcgagtccatgaagaagcggtaccgggccgagtccgccgccgtggcgcgcgcgggccccgccgctgccggtccgtcgtggaggttctttggccgcatggacggcctgctcaaagggccgcccgtctgctctgcccaggtgcagccgccggagctggttaacagcatagacttgcgagctccggcgaaaccagaggcggctgaggttgaagctgatttccccacgcagttgcgggatgcagttccaggtgcattatctgatctgatgaacattgacgcgaatggcgctgctgttccggaaaaagcggagaaggttgacaacagcatgcacaaggagtgcaggcctgctgatagcgatgccaacgtgagctctccgaggagtaaggtggccaacgaggacgtggaagaggtgaacaatgtctgggaccggaccaagaagagaaagagcacagactttgacatagccaagagcatcgagctgctggctagctcgttcttgaagattgagcacgccaggttggagatgtacagggagacagaaaggatgagggttgaagctgagattaagaagggggagatggagctcaagagaacagagatcatggcgaaaacgcacctgcagatcgctaggctttttgcaaagaaattgaaacagagcagtggaaagaatggtggcagttcgtcagtaacagctgaagtggacacccttaccaagaaaggcgagaatggttccgggtgatgtggcatgcccagcagctgtcctcagcgtacatggtgtacatgacatctcactttccctgtgcagcaagtgtagtagtctgattgatgcaacttcgtgagtggagaaatggtcagctgtaaacttacagatgcaataatgagagcgatgatttgactgtttcgcccattgcgggattattattatagaagcgatttttgaatcagtgacttcctagtctgaaagtttccgtcctctgttcctgtagcaatttgctgacgagtgacaactatcatttgtatataagcctatgtccatgcagtgtagaaatgaagcagcagtcgccaatgctgtggttgactatgcggatccaattcaaaggtccgctaaatgaacaagaaaagtactcgctccgatcgtttatacacgatggggatgtagcatttccaatagttttcaaaaccaaattccaatc

SEQ ID NO: 1616 - DNA, 2820 bp, Sorghum bicolor
ccgcgctgccggccagccgtagccagcggcaacaaaagccgccgccccgccgcgcgctcattcgtgacacggattcctcccgtgatctcccactccggcactccgcgccgcggacgcgtttccgttccaactccccgtcccgtcccgtcacggcccgcggtctccgcgctggctgctgctggcgccgtccgccgtcggccctggggacggaacgggaaacggatccggtcagcgctggcgtcacgccccactgactccgtccccgccccggcgggcgcccggcctgcctaacctaatgcggtccgacgcgcgcctccactccagtactccaccccgcaacgggcaggcagcgcgcggtccacggcgccccgcctggctgacgcgcggggcccccgggtcccccagctggcgcgcggcggcaggtggcgcgccgggcgcacgcgggcggtggaagcgggaaggaagaggaagaggaagacgacgacgggacggacgggcccggccagtcctctcggttccggtctcccactttccgcggctgcctgcctgcctgccccgctcccccacctcgtgctctctccctttctttcgcgaacgccccgcgggccgccgattcctactcatcagccgcgcgccggggagagaagacaagcgctttctttctccccggaattccgcgcccacctcctcctcctcctgtgcatttggcagcgcagatcccgccgctcccgtccagctagccgatcctcctcttctctgttctccccttgcgctactactaggccttgactgttctcgactcccctaatcaccagcggctcggtcggtctccctcttcctcgccgcgttcccttcggtctccgctccaacacgccatctgctgccgcgcaaacaccgggaaataccttggcctttctggtgtaaccgtgtaagcgagtttcgactccccaagtttgctgcttttggccaatcttttctgggctttcaggtctcagcatcacctgccccgcttttaccgcgatctttctgtccgatcactgcaattttcagcttcgagtacctcctttttcgggaaattcagtctctgctgataaagctgttgagtgagcggctcatgcaccacaccaccagtagcttcagctaagatctccatctccccatgccacaaactcctccaggaccgtcagccatggccaagctgctatagcgctgctgctccggctggcccgtgtgagctgcgaaattcggggggtccctctccggcttcccgcgcccatggacggcctccccgaccccgacgcggcgccgttggcggctgcgccgccgcagaagcgcgacgagtggagcgagagcggcatcgtgcgcctgctcgaggcctacgaggccaagtggctgctgcggaaccgcgccaagctcaagtggagcgactgggtcgacatcgcccgcgaggtgtccgtgcattgcgccgacgacgccgcggccgctgggaagccccccggtggcggcggcggcggcaacagcgccaagacccccaaccagtgcaagaacaagatcgagtccatgaagaagcggtaccgggccgagtccgccgccgtggcgcgcgcgggccccgccgctgccggtccgtcgtggaggttctttggccgcatggacggcctgctcaaagggccgcccgtctgctctgcccaggtgcagccgccggagctggttaacagcatagacttgcgagctccggcgaaaccagaggcggctgaggttgaagctgatttccccacgcagttgcgggatgcagttccaggtgcattatctgatctgatgaacattgacgcgaatggcgctgctgttccggaaaaagcggagaaggttgacaacagcatgcacaaggagtgcaggcctgctgatagcgatgccaacgtgagctctccgaggagtaaggtggccaacgaggacgtggaagaggtgaacaatgtctgggaccggaccaagaagagaaagagcacagactttgacatagccaagagcatcgagctgctggctagctcgttcttgaagattgagcacgccaggttggagatgtacagggagacagaaaggatgagggttgaagctgagattaagaagggggagatggagctcaagagaacagagatcatggcgaaaacgcacctgcagatcgctaggctttttgcaaagaaattgaaacagagcagtggaaagaatggtggcagttcgtcagtaacagctgaagtggacacccttaccaagaaaggcgagaatggttagtgtcaacagaacatcctgataaaatggttatacttatgctaaaagttgctaaattttattatatggatactgcatggcaaagcaaaattttccctcgagagtacatagctttctgtgtcagaatcccccattcgttaggtctgtaccactgtttctgttcctgaatacatgaatagaattgggagcttcagcctaaattagttatagcagttctctttatcagaagttgattattatgtaatgtttgtgacaattcgagagtttgtgcagtgtggtagggctgtaacgttccaactttgctgctcttgtctgcttttcattattctcggctaattcgtataaatgaactcttagctgttattgtaagtcaagatctttccatagtaaatggatataatgctcgtgttctgggaattgggatcatatgtttatttacttgtgcatagaagggattcatcgcagactcatagcacttgtgataggagtgtaataatggaagtgtcatgttcagctctagtgcaagatttgtttcagact

SEQ ID NO: 1617 - DNA, 1626 bp, Zea mays
gccgttgagcggctcacgcaccacaccaccagtagctagcttcagctaagatctccatcttcccccatgctacaagctcctccaggaccgtcagccatggcagagctatagcggttgctccagttggcccgctcaagccgcgaaattcgggaccccttcccggctcccgcgccatggacggcctccccgacgccgacgcggcgccgttggcggccgcgccgccgcagaagcgcgacgagtggagcgagagcggcatcgcgcgcctgctcgaggcctacgaggccaagtggctgctgcggaaccgcgccaagctcaagtggagcgactgggtcgacatcgcccgcgaggtgtccgtgcattgcgccgacgacgccgcggccgcggggaagccccccggcggcgtcggtagcagcgccaagacccccaaccagtgcaagaacaaggtcgagtccatgaagaagcgctaccgggccgagaccgccgcggtggcgcgcgccggcccggccgccgccggcccgtcgtggaggttcttcgcccgcatggacggcctgctcaagggaccgcccgtcggccctgaccaggtgcagcagcagcaggcgctgactaacagcagaatagacttgcgagctccggcgaaaccggaggccgaggcagaagctgactttgccgcgcagctgcgggatgcggttccaggtgcattcactgatctgatgaacatggacgcgaatggcgccgtcccggataaagcggagaaggctgacaacagcatgcagaaggagagcgggcctgctgatagcgatgccaacgtcagttctccgaggagtaaggtggcgaacgaggacgtggaggaggtggaggacaaggtctgggaccggcccaagaagagaaagagcacagacttcgatatagccaagagcatcgagctgctggctagctccttcttgaaggttgagcaggccaggatggagatgtacagggagacagaaagaatgagggttgaggctgagatcaagaagggggagatggagctcaagaggactgagatcatggcgaaaacacacctgcagatcgctaggcttttcgcgaggaagttgaagcagagcagtggaaagaacggtggcagttcgtcagtaacggctgaagtggacacccttaccaagaagggcgagaatggttagtgtcaacgcaacatcatgataaaatggttatagttttgcaaaaagttcctagaatttgttatatggcaaaagcaaaaaattcccctatagagtacatacctttctctgtcagcattgaacttcagccagaattaacgctagcacttctctttatcagaaattgattattatgtaaattcggggacagtttgggagtttttgcagtgggatggctgtgtaacataccaactttgctgctgttgtccgctttcaactattctcggccaattcttagaaatgaagtcttaatggttattgcgagtcaagatctttccgcagtaaatggacatagtgctcgtgttctgagatcatgttttatttacttgtcatagaagggattgatagcacttgtaaaaggagtacaatggaagcttcttatcgagctctaatttaagatttgtttcagact

SEQ ID NO: 1618 - DNA, 2117 bp, Setaria italica
gctctctctctctctctctgtgtgtgtgtgtgtgtgtgtctcgttctaggccttactgttctctctcagtcaccgccagctcgatctcctcttcctcgccgcgttgcgttccttctgctcgcttgcctaggattggaataggacttggcacgcgggcttctttccgctgaaatctctgccgtgttccgagcaatttctgctcgagcgcgccatctgttgccacttgccagcaaaaaaacagtggaaaccgccttgcctttctagtgtaagcaagctttcacctcccggaatttgcttcttttggtcaatcttttcggggcttccaggtctcagcatcaccagtgccccttttgccgcgatctttctgtctgatcactgcagtttaagctcggagcacctccttttcagacaattcagtccgctagctgttgatcccatgcggcggtagcttcagcaaagatcctaccatgccgcaggctcctacagagccgttcgccgtggcgtagctgtagcctcgctgaccccgattggcctgcgcgggctccgagattcggattcgggttccttcttttcggctcccgcgcccgccatgaacggcctccccgacgccgacgctgcggcgccgctggcgaccgccgcgccaccgcagaagcgcgacgagtggagcgagggcggcatcgtgcgcctgctcgaggcctacgaggccaagtggctgctgcggaaccgcgccaagctcaagtggagcgactgggtcgacatcgcccgggaggtgtccgcgcattgcgccgacgacgccgcggccgcggggaaggcccccggcggcggaggcggcaacagcgccaagacccccaaccagtgcaagaacaagatcgagtccatgaagaagcggtaccgggccgagtccgccgcggtggcgcgcgcaggccccgccgccgccggcccgtcgtggcggttctttgcccgtatggacggactccttaagggtccggccatctgctctggtcaggtgccacaggcagagttgggtaacagtatagacctgcgagctccggcgaaagcagaggccgaggtagtagaagcagattttgccgcgcagttgccggatgcgggtcctggtgcattctctgatctgatgaacattgacacaaatggcgctgtcccggagaaagcggagaaggttgacaacagcgtgcagaaggagagcagggctgcagatagcgatgccaacgtgagctctccaaggagtaaggtggcgaacgaggacgtagaggaggtggacaaggtcagggaccggcccaagaagagaaagagcacagagtttgatatagccaagagcatcgagctgctggctagctcatacttgaagattgagcacgccagaatggagatgtacagggagacagagaggatgagggctgaagctgagattaagaagggggaaatggagctcaagagaacagaaatcatggcaaaaacgcacttgcagatcgctaagctttttgcaaagagattgaaggagggcagtggcaagactggtggcagctcgtcagtaacagctgaagtggacacccataccaagaaaggcgagaatggttcagggtgatgtgccattctctcatgctcagcagctgattctattaccaaagcaggctagccttaggtgtccttggtattgcactgttcatgtgcaccaaatgtatgtctgattgatccaacttcactgcgagcgtggaggaaaaaaaagtcacaaaattagaatacagatgctataatggcagcgacgatatggttgttacccggtttgtggaattacagaagcaaattttgtatcagtgagttacaagcctgaaagctatccccttctgtccctgaagtaatctactgacatccattatttgtataagtccatctccatgttgtgaagaaatgaagcagcggtcgccaatgctgtgataaactgtatcttgctgaagccctttcccccttgactatgtattgtaactagattttggagagtttgactatagggatccaaaacaaaggtcggctaagtgaagaacaaaagtataaactgaactgtacatttttttgggaaaattataaaaatgacttgtcct

SEQ ID NO: 1619 - DNA, 1259 bp, Setaria italica
tttcggctcccgcgcccgccatgaacggcctccccgacgccgacgctgcggcgccgctggcgaccgccgcgccaccgcagaagcgcgacgagtggagcgagggcggcatcgtgcgcctgctcgaggcctacgaggccaagtggctgctgcggaaccgcgccaagctcaagtggagcgactgggtcgacatcgcccgggaggtgtccgcgcattgcgccgacgacgccgcggccgcggggaaggcccccggcggcggaggcggcaacagcgccaagacccccaaccagtgcaagaacaagatcgagtccatgaagaagcggtaccgggccgagtccgccgcggtggcgcgcgcaggccccgccgccgccggcccgtcgtggcggttctttgcccgtatggacggactccttaagggtccggccatctgctctggtcaggtgccacaggcagagttgggtaacagtatagacctgcgagctccggcgaaagcagaggccgaggtagtagaagcagattttgccgcgcagttgccggatgcgggtcctggtgcattctctgatctgatgaacattgacacaaatggcgctgtcccggagaaagcggagaaggttgacaacagcgtgcagaaggagagcagggctgcagatagcgatgccaacgtgagctctccaaggagtaaggtggcgaacgaggacgtagaggaggtggacaaggtcagggaccggcccaagaagagaaagagcacagagtttgatatagccaagagcatcgagctgctggctagctcatacttgaagattgagcacgccagaatggagatgtacagggagacagagaggatgagggctgaagctgagattaagaagggggaaatggagctcaagagaacagaaatcatggcaaaaacgcacttgcagatcgctaagctttttgcaaagagattgaaggagggcagtggcaagactggtggcagctcgtcagtaacagctgaagtggacacccataccaagaaaggcgagaatggttcagggtgatgtgccattctctcatgctcagcagctgattctattaccaaagcaggctagccttaggtgtccttggtattgcactgttcatgtgcaccaaatgtatgtctgattgatccaacttcactgtgaagaaaaaaaatagtcacaaaattagaatgcagatggtataatggcagcggatatggttgttacccggtttgtggaattacagaagcaaattttgtatcagtg

SEQ ID NO: 1620 - DNA, 1224 bp, Pennisetum glaucum
gcgccgccgcagaagcgcgacgagtggagcgagggcggcatcgtgcgcctgctcgaggcctacgaggccaagtggctgctgcggaaccgcgccaagctcaagtggagcgactggatcgacatcgcccgcgtggtgtccgcgcattgcgccgacgacgccgcggcagccgggaaggcccctggcggcggaggcggcaacagcgccaagacccccaatcagtgcaagaacaagatcgagtccatgaagaagcggtaccgggcggagtccgccgcggtggcacgtgcaggccccgccgccgccggcccgtcgtggcggttctttgctcgcatggacgggctgctcaaagggccggccgtctgctctggtcaggtgcaacaggcagagtttggtaacagtatagacctgcgagctccggcgaaagcagaggccgaggttgtagtagaagcagattttgcctcgcagttgccggatgtgggtcctggtgcattctctgatctgatgaacattgacacaaatggcgctgtcccagagaaagcggagaaggttgacaacagcgtgcagaaggagagcagagccgcagatagcgatgccaacgtgagctccccgaggagtaaggtggcgaacgaggacgtagaggaggtggacaaggtctgggaccggcccaagaagaggaagagcacagagtttgacatagccaagagcatcgagctgctggctagctcatacttgaagattgaacacgctagaatggagatgtatagggagacagagaggatgagggttgaagctgagattaagaagggggaaatggagctcaagagaacagaaatcatggcaaaaactcacttgcagattgccaagctttttgcaaagagattgaaggagggcagtggcaagactggtggcagttcgtcagtaacagctcatgtggacacccatactaagaaaggcgagaatggttcagggtgatgcactgatgtgccattctctcatgatcagcagctgattctgttaccaaaagcaggccttaggtgcccttgtatcgcgtgttgctgtgcaccaaatgtatgtgtctgattgatccaacttcactgtgtacttggagaaaaagttagttgcaaaattagaaactagaatacagatgcaataattggagtgatgatatttagtgggattacagaagcaggccttaggtgcccttgtatcgcgtgttgctgtgcacca

SEQ ID NO: 1621 - DNA, 1311 bp, Panicum virgatum
  misc_feature (808)..(808): n is a, c, g, or t
  misc_feature (846)..(846): n is a, c, g, or t
  misc_feature (864)..(864): n is a, c, g, or t
  misc_feature (930)..(930): n is a, c, g, or t
  misc_feature (1028)..(1028): n is a, c, g, or t
  misc_feature (1116)..(1116): n is a, c, g, or t
  misc_feature (1152)..(1152): n is a, c, g, or t
  misc_feature (1154)..(1154): n is a, c, g, or t
  misc_feature (1192)..(1192): n is a, c, g, or t
  misc_feature (1208)..(1208): n is a, c, g, or t
  misc_feature (1212)..(1212): n is a, c, g, or t
  misc_feature (1219)..(1219): n is a, c, g, or t
  misc_feature (1225)..(1225): n is a, c, g, or t
  misc_feature (1230)..(1230): n is a, c, g, or t
gcgccgccgcagaagcgcgacgagtggagcgagagcgggatcgtgcgcctgctcgaggcctacgaggccaagtggctgctgcggaaccgcgccaagctcaagtggagcgactgggtcgacatcgcccgcgaggtgtccgcgcattgcgccgacgacgccgccgccgcggggaagccgcccggcggcggtaacagcgccaagacccccaaccagtgcaagaacaagatcgagtccatgaagaagcggtaccgggcggagtccgccgcggtggcgcgcgcaggccccgcagccgccggcccgtcctggcggttctttgcccgcatggacgggctgctcaaagggccggccgtctgctccggtcaggtgcaacagtcagatttgagtaacagtatagacctgcgagctccggccaaagcagaggccgaggtagaagcagattttgtcgcgcagttgacggatgcgggtccaggtgcattctctgatctgatgaacattgacacaaatggcgctgccccggagaaagcggagaaagttggcaacagcgtgcagaaggagagcagggctgcagatagcgatgccaacgtcagctctccgaggagtaaggtggcgaacgaggacgtcgaggaggtggacagggtctcggaccggcccaagaagagaaagagcacagagtttgatatagcaaagagcatcgagctgctggctagctcatacttgaagattgagcacgcaagaatggatatgtacagggagacagagaggatgagggttgaagctgagattaagaagggggagatggagctcaagngaacagaaatcatggcaaaaacgcacttgcagatcgcnaagctttttgcaaagagnttgaaggagggcagtggcaagactggtggcagttcgtcagtaacagctgaagtggacacccatacnaagaaaggcgagaatggttcagggttgacacaacatcctgataacatgtttataattcttcaaaagttcctaaaattggatcgctgtgtagttttctntctgtgagagtgcaccatttcctaagtctgtacctgaaattcatcgataggacggaaacttcagcctaaattaattatagcagttttntctgtgagaagttgattattatgtaaaattgtaggncnccttgagagtttatgtagtggtaggactgtaacatttntatttcactgttgttncctnccttttnttattnttatntgggtgttagcaatccatttgtggatcatcatttctccattaagactcaaactatcagtacaaaatattaaccatgtctgt

SEQ ID NO: 1622 - DNA, 1328 bp, Zea mays
ggcggccgcgccgtgacgacgacgacgaccgcgccgccatgaccaccaccaccacggcggcggcggcggccgtgaacgtggccgcggtcgcgcagctctgcgccgggccacggcggcgcaagccggcggcaggggctcgggtcgacctgcgctgggcgcgcctgctccgcctcgccgtcgtcaccagggtgctcggcgtcgtgcgcgaccagctgctcgcctgctcctcctgcggcggcgggggcggtggcgccgcccgccgccggtacctccgccttggcccgcccgccggagccaacgccggtcccgtgctgtcaccggtcgacagggacgacgactgcgccgccgacgccgaagccgcggcccctcgcgacgcggccgacgacgttgacaacgtcgtcagcctcaaggtcagcctgctcggcgactgccagattggcaagaccagcttcatggttaagtatgtgggagatgacggggaggaccagaacggcttgcagatgacgggcctgaatctcatggacaagatgatggccgtcaggggagctaagattgcctacagcatctgggatgtggcaggagaccaccagtccgtcgaccacatcccaatcgcgtgcaaggacgccgtggcgatcctgtacatgttcgatctcacgagccgctgcacgcttaataacatcgtagattggtacgagagggcgaggaaatggaataagacggctattccaatcctaatcgggacaaagttcgatgactttgcccagcttcctcttgaaatgcaatggaccattgttaaccaggccagagcatacgcaagagcgatgaaggcgaccctcttcttctcgagcgcgacgcacaacatcaacgtgaacaagatcttcaagttcatcacggccaagctcttcgacctgccgtggacggtggagcgcaacctcaccatcggcgagcccatcatagacttctgacgacctcctccgctagctaagtaattagacagcacacacgacgatccttgttggtatcacgggttgacagggtcgtcgcctcctcttgccctgtgcgagtcgccggaggcatgaagttgaagtgaccgagcatgcccgtcgtcctcttcctcctgattgccgacagcagcaggcaggatgtcctctgtacataggtgacgtttccgcatgagggagcatcgtcaaaatggcaagaccgcgaggtgtgactgtagtagtgtaacacccgtctgtaacattcgccagactgtataggaatccatgttaattagagctagtttggcagccacatttttaaaagggatttccattttcctttccctt

SEQ ID NO: 1623 - DNA, 1372 bp, Sorghum bicolor
cgacgaccgcgccgccatgaccaccaccacgacaacggcgccggcggcgaccatgaacgttaccacggtcgcgcagctctgcgcggggccacggcagcgcaagccggcggcaggggctcgggtcgacctgcgctgggcgcgcctgctccgcctcgccgtcgtcaccagggtgctccgcatcgtgcgtgaccagctgctcgcctgctcctcctgcggcggcggcggcgggggcggtaccgcccctcccgccagtgatcggaaccgccacctcggcccgcccgacgacagtcccacgctgccaccgctagataggtacgatcacgactgcgccgccgatgccgacgctgacgccgaagccgcccctcgcgacgcggctgacgatgtcgataacgtcgttagcctcaaggtcagcctgctcggcgattgccagattggcaagaccagcttcatggttaagtatgtgggagacgacggggaggagcagaacggtttgcagatgactggcctgaatctcatggacaagacgatggccgtcaggggagctaggattgcctacagcatctgggatgtggcaggagaccaccagtctgtcgaccacatcccgatcgcttgcaaggacgccgtggcgatcctctacatgtttgatctcacgagccgctgcacgcttaataacattgtagattggtacgagagggcaaggaaatggaataagacggctattccaatcctaatcgggacaaagtttgatgactttgctcagcttcctcttgaaatgcaatgggccatcgttaaccaggccagagcatacgcaagagcgatgaaggcgaccctcttcttctcgagcgcgacgcacaacatcaacgtgaacaagatcttcaagttcatcactgccaagctcttcaacctgccgtggacggtggagcgcaacctcaccatcggcgagcccatcatagacttctgacgaccttcctcctcctcctctaatctgactaagtaattaggcagcacacacgacgacgacccttggtaccgttcatggatcgacaagtgtcgtcgtctcttccttgatcttgccctgtgtgagtcgccggagcaattgaagtgaccgagcatgcccgtcgtcctcttcctcctgatggccggctgcagcaggcaagacgttctttgtacatacataggtgacggttccgcttgcgtgcaggagcgtcgtcaaaatgggaaaaccgcgaggtgtgactgtaatgtaacaccccgtctgtaacattcgccagagtgtataggaatccatatatgttaatatacgctccgtttccactgacagagacatgcgctggccgcctgccggtgcagggcttcagccgttccacctctt

SEQ ID NO: 1624 - DNA, 1902 bp, Sorghum bicolor
cgcacgcacgctatcgcattccccgcaggatcccaacgcgccaccgccaccgccaacgtgacatccaccccggcacgcacaccacacgccccgcgctcccgcctcgcctatccgtcccttgtccgcgcgcatcgcgagccgagccgagccgagccctcgcccacgggccacggccacgccctgacgcccccaggtcgagaaaggcgtgcgcatgccgtctatggcgcctccgctataaggaggagaagcaagcgcgaggccagcaaaaaagcgtcgcggggccacgacgaccacgaccacgaccctattttggcccgcccgcccgcctcctccgcctatacgccgcgcccgcgaccgcgccggggaggtcgctcgctgctccctccggctcaccttcccgttcccttccctctctacctctctctgtcccgtcccgcccgctccgccgcctctcccacctgccccccgcaaccaaccaaggccctcctgcacggcgccggtggtgcatgggcggcggccgagccaggacgccgacgccgacgaccgcgccgccatgaccaccaccacgacaacggcgccggcggcgaccatgaacgttaccacggtcgcgcagctctgcgcggggccacggcagcgcaagccggcggcggcagcagcagcggcaggggctcgggtcgacctgcgctgggcgcgcctgctccgcctcgccgtcgtcaccagggtgctccgcatcgtgcgtgaccagctgctcgcctgctcctcctgcggcggcggcggcgggggcggtaccgcccctcccgccagtgatcggaaccgccacctcggcccgcccgacgacagtcccacgctgccaccgctagataggtacgatcacgactgcgccgccgatgccgacgctgacgccgaagccgcccctcgcgacgcggctgacgatgtcgataacgtcgttagcctcaaggtcagcctgctcggcgattgccagattggcaagaccagcttcatggttaagtatgtgggagacgacggggaggagcagaacggtttgcagatgactggcctgaatctcatggacaagacgatggccgtcaggggagctaggattgcctacagcatctgggatgtggcaggagaccaccagtctgtcgaccacatcccgatcgcttgcaaggacgccgtggcgatcctctacatgtttgatctcacgagccgctgcacgcttaataacattgtagattggtacgagagggcaaggaaatggaataagacggctattccaatcctaatcgggacaaagtttgatgactttgctcagcttcctcttgaaatgcaatgggccatcgttaaccaggccagagcatacgcaagagcgatgaaggcgaccctcttcttctcgagcgcgacgcacaacatcaacgtgaacaagatcttcaagttcatcactgccaagctcttcaacctgccgtggacggtggagcgcaacctcaccatcggcgagcccatcatagacttctgacgaccttcctcctcctcctctaatctgactaagtaattaggcagcacacacgacgacgacccttggtaccgttcatggatcgacaagtgtcgtcgtctcttccttgatcttgccctgtgtgagtcgccggagcaattgaagtgaccgagcatgcccgtcgtcctcttcctcctgatggccggctgcagcaggcaagacgttctttgtacatacataggtgacggttccgcttgcgtgcaggagcgtcgtcaaaatgggaaaaccgcgaggtgtgactgtaatgtaacaccccgtctgtaacattcgccagagtgtataggaatccatatatgttaatatacgctccgtttccactgacagagacatgcgctggccgcctgccggtgcag

SEQ ID NO: 1625 - DNA, 1624 bp, Setaria italica
cgcctccgctataaggcgaaggcgagggaggaaaacctccagccccagccagcgagagcttcgcgcggcaggccaccaacctatttttgcacgccccgtcgccccgccgccgctgcttatacgcctccgcgtccggggcccctgctcccgtctcttcttcttcctctccctctcacctcccgctcccgcgcccaccgcctcctccgcgccccccgcaccaaggccagcctccccgcacggcgccggcggtgcatgggaggcgggacgacggcggtgacgaccaccgcggcgccatgaccaccaccaccgcggcggcggccatgaacgtggcggcggtcgcgcagctctgcggcggcggcggccggcgcggccggaaggcgcagggcccccgggtcgacctgcgctgggcgcgcctgctccgcctcgccgtcgtcagccgggtgctccgcatcgtgcgggaccagctgctcgcgtgctcctcctgcggcggcgggggaggcgcgggcggcggcgggggccggggcggcggacggtaccgccgcctcggcccgccagcgcacgccgggggcgccatgctggcaccggtccataggggcgacgagtgcgtccccggcgccgccggtgacgcggcgccttgcgacgccgccgccgcggacggcgagaacgttgtcagcctcaaggtcagcctgctcggcgactgccagatcggcaagaccagcttcatggttaagtatgtgggagatgacggggaggagcagaacggcttgcagatgacgggcctgaatctcatggacaagacgatggccgtccggggagctaggattgcctacagcatctgggacgtcgcaggagacgtccagtctgtcgatcacatcccaatcgcgtgcaaggatgccgttgcgatcctttacatgttcgatctcacgagccggtgcacgcttaataatattatagattggtacgagagggcgaggaaatggaataagacggctattccaatcctaatcgggacaaagtttgatgactttgctcagcttcctcttgaaatgcaatgggccattgttaaccaggcccgggcatacgcaagagcgatgaaggcgaccctcttcttctcgagcgcgacgcacaacatcaacgtgaacaagatcttcaagttcatcacggcgaagctcttcaacctgccgtggacggtggagcgcaacctcaccatcggcgagcccatcatagacttctgacggcctccacttcttcctcctaacagataattaggcagcgcacacgacccttggggtcggatcgtgtcttcctcttgctctgctcctgctgacctcctccgccatgagccagcgagcgagcgacgacctcgccccgtcgtcctcggtcatcctctcgatttctcgagggccgggtgcaggcaaggcgagatgcctttgtacatataggtgacggtgtcccctgcgcgtgtaggaccccggttgtaacatttcgccagagtgtataggaatccatgcatgtttccattactccgtaccatctacagtcctgcatcatgttgtacgaatcaactccatgatccttttcgtttcgatggatcaacctgacggggagcaaagtgctcgcctca

SEQ ID NO: 1626 - DNA, 1170 bp, Pennisetum glaucum
cgccatgaacgtggcggcggtcgcgcagctctgcggcggccggcgcggccggaaggcgcagggggggcccagggtcgacctgcgctgggcgcgcctgctccgcctcgccgtcgtcagcagggtgctccgcatcgtgcgggaccagctgctcgcgtgctcctcctgcggcggcggcggtggaggaggaggaggaggaggaggcgcgggcggtggcggggcaaggggcaggggcggaaggtaccgccgcctcggcccgccaccgcacgccggggccgccgtgctggtgccggtcgacagggacgacgactgcgccgacggtgccgcggcgccttgcgacgcctccgcccccgccgacgggggcgagaacgtcgtcagcctcaaggtcagcctgctcggcgactgccacatcggcaagaccagcttcatggttaagtatgtgggagatgacggcgaggagcagaacggcttgcagatgacgggcctgaatctcatggacaagaccatggccgtccggggagctaggattgcctacagcatctgggacgtcgcaggagatgtccagtctgtcgatcacatcccaatcgcgtgcaaggatgccgtggcgatcctgtacatgttcgacctcacaagccgctgcacgcttaataacattatagattggtacgagagggcgaggaaatggaataagacggctattccaatactaattgggacaaagtttgatgactttgctcagcttcctcttgaaatgcaatgggccattgttaaccaggcccgggcatacgcgagagcgatgaaggcgaccctcttcttctcgagcgcgacgcacaacatcaacgtgaacaagatcttcaagttcatcacggcgaagctcttcaacctgccgtggacggtggagcgcaacctcaccatcggcgagcccatcatagacttctgacgaccttccctcctaacacataattaggcagcgcgcgcatacgacccctggggtcggatcgtgtcttcttcctcttgctctgctcctgctgctgagctcctccgccatgagccagtgagtgagcgagcgacttcgcccccgtcgtcctcggtcatcctgtcggtttctcgagggccggggtgcaggcaaggcgagatgcctttgtacatataggtgacggcgcccccttgcgc

SEQ ID NO: 1627 - DNA, 1721 bp, Secale cereale
actgccatctatcatcccatccatggcgcctctgccgtgagcaggaggaggcaggcgacaccacatcaaaagcgtcgcgcgggcaacaagccttcctttttatagcgcgacccctttgtttagcctccgattctcgagttttaataccatcgccatcgtgctctgggcgcctccctccggcctctctccgtgcgtgtaatccattcctcctccggcctgctacgccgcaccgcaccgggggcggccttggtgtgcatgggcgccgcggcgccatgaccacgacagctgccatgaacgtggccgtcacgcagctatgtggccggggtcgccgccgcaggccggccgggctgcgcctcgatctccggtgggcgcgcctgctccgcctcgccgtcgccaccagggtcgtgcgcctcgtctgggaccagctgctcgcctgctcctcctgcggcgggggcggcgccgcacggtaccgccggctcggccccccgcacggaccggacgtgctgacccccgtcgccatggatgacgacgccggcgctgccgccgacgcccacgccgacgccgacgcggcggatgtcgaggacgtggtcggcctcaaggtcagcctgctaggcgattgccagatcggcaagaccagcttcatggttaagtatgttggggatggggaggagcagaacgggggcttgcagatgacgggcctgaatctgatggacaagacgctcgcagttcggggcgccaggctcgccttcaacatctgggatgtggcaggagacagccagtccgccgaccacgtcccgatcgcgtgcaaggacgccgtggcgatcttgttcatgttcgatctcaccagccggtgcacgctcaataatgttaccgattggtatgagagggccaggaaatggaataagacggctattccaatcctcataggaacgaagtttgacgacttcgctcagcttcctcttgagatgcaatggaccattgttgatgaggccagagcatacgcaagggcgatgaaggcgaccctcttcttctcgagcgcgacgcacaacatcaacgtgaacaagatcttcaagttcatcatggccaagctcttcaaccttccttggacggtggagcggaacctcaccgtcggcgagcccatcatagacttctgaacaccaactaaccactcctacgaccaaccaacctctcgccgccgctcgcgctcggtgtctggtcgatcgaggcagcgctgtacataggtgtatgttgagttggttatggttcatgtacatgcgcatcccttcttcctggagaggaaaccgcgagatgttggccgctccatgcatctcgcatgtacagtatgtgtagggaatccatgcatgtactgtactgtaatatacacgccccgttttcccgcttcacaggacaggatcactgtgcctgtgcgttgtgcgatcgtgtggcgtagtggtagctcgcacacgggccggcctgtgcacgaatgatgcagattcaacatactaaaaaaaaaaaaaacaaaaaaaaaaaaacaaaaaaaaaaaacgaaaaaaaaaaacaaaaaaaaaaaacaaaaaaaaaacaaaaaaaaaaacaaaaaacaaaaacaacaacacaacagacaacacaacagacagaacataaacgacacacaacacgaactacgaccgtaagcgtaacacgtacaggtaccgtaatagaacctataacagtcaggtaac

SEQ ID NO: 1628 - DNA, 1300 bp, Triticum aestivum
aggcgtgtaatttatccctcctcaccgggggcgcccttggtgtgcatgggcgccgcggcgccatgacgaccacagctgctgccatgaacgtggctgtcacgcagctatgtggccggggtcgccggcgcaggtcggccgcgctgcgccacgatcaccggtgggcgcgcctgctccgcctcgccgtcgccaccagggccgtgcgccttgtctgggaccagctgctcgcctgctcctcctgcggcgggggcggcggcgcccgctaccgccggctcggcccgccgcacggaccggacgtgctgacccccgtcgccatggatgacgacgccgccgcccacgcccacgccgacgccgacgcggcagatgtcgaggacgtggtcggcctcaaggtcagcctgctcggggactgccagatcggcaagaccagcttcatggttaagtatgttggggacggggaggagcagaacgggggcttgcagatgacgggcctgaatctgatggacaagacgctggcagttcggggcgccaggctcgccttcaacatctgggacgtggcaggagacagccagtccgccgaccacgtcccgatcgcgtgcaaggacgccgtggcgatcttgttcatgttcgatctcaccagccggtgcacgctcaataatgttaccgattggtacgagagggccaggaaatggaataagacggctattccaatcctaataggaaccaagtttgacgacttcgcccagcttcctcttgagatgcaatggaccattgtcgatgaggccagagcatacgcaagagcgatgaaggcgaccctcttcttctcgagcgcgacgcacaacatcaacgtgaacaagatcttcaagttcatcacggccaagctcttcaacctcccttggacggtggagcggaacctcaccgtcggcgagcccatcatagacttctgagcaccaactaaccactccttccccgtcttacaactacgactacgaccaaccaacctctcgccgccgctcgcgctcggtttcttctccgtcgaggcaaggtgcgcagcgttgtacataggtgtatgttgagttggttatggttcatgtacatgtgcatcccttcttcctggagaggaaaccgcgagatgttcgtcgctccatgcatctcgcatgcactgtatgtgtacggagtccatgcatgtaatatacacgccccgttttcccgcttcacagggcaggatcactgtgcctgtgcgttgtgcgatcgtgtggcgtagtggtagctcgcacacggcccggccctgtgcacgaatgatgca

SEQ ID NO: 1629 - DNA, 1151 bp, Sorghum bicolor
gtgggcaacctctgcgagggatggagatggagtcgacgactcttcctctgctgacaccgtacaagatgggcgagttcaacctggcacacagggttgtgctggcgccgctgacgaggtgccgggcgtacgggaacgtgccgcagccggagcacatggccgtctactactgccagcgcgcgacgccgggcgggctcctcatcgccgaggcctgcgccgtgtcggagagcgcgcgcgggtacccggacgttccggggctgtggaccgaccaacaggtggaggcctggaagcccatcgtcgacgccgtccacgccagcggcgccgtcttcttcgcccagatctggcacaccggacgagcctccgccccagaattccaaccaaatgggcaggcaccgatctcaagcacggacaagcaaatcccaccgcaggtgagccatgccggcgtcgtcaacaccttcgcggtgcctcgaagaccggaaacagaggagataccacacgtcgtcaacgacttccggattgccgccagaaacgccatcaaagctggctttgacggagtggagatccacgcggcaaacgggtacctgttcgaccagttcatgaaggacagcaccaatgaccgtgacgatgcctacgggggcagcctggagaaccgatgccgtttcaccgccgaggtgacggcagctgtggcggctgaggtcggcggtgaccggctgggcgtgcgcctctctccgttcgccgactacatggactgccatgactctgatccagaggcgcttgggcttcatgtcatcgacaagacgctgaacccgctcggcgtgctctactgccacatggtagaggcaaggatgcgggtgaacccagaggacggcaacaaaatgaccctccagcagatgctactgccgttcaggagggcgtttcgggtgacgttcatagctagcggaggatacgaccgtgaggaaggcaacgccgccatcgcccatggttatgccgacctgatcgcgtacggccggatgttcctggccaacccggatcttccggcgcgttttgccaagaaggccgcgctgaacaagtatgacaggagcaccttctacacctcggatcctgtggttggctacactgattacccattcctcgatcaattctagatgattggc

SEQ ID NO: 1630 - DNA, 1407 bp, Setaria italica
gcagcagcactcgttagccggctgagcaacacatcgatctaaccggcgatcgctctatccgcgcgcagcgagggatcacggatcagagatggagtcgactcctcctctcctgacaccatacaagatgggcgagttcaacctggcacacagggttgtgctggcgccgctgacgaggtgccgggcgtatgggaacgtgccgcagccggcgcacatgtccctttactactgccagcgcgcgacgccaggcggcttcctcatctccgaggcctgcgccgtgtcggagaccgcacgagggtaccccgatgtgccggggctgtggaccgacgagcaagtggaggcatggaagcccatcgtcgacaccgtgcacgccaagggcgccgtcttcttcgcgcagatatggcacaccggccgcgtctccgcgccagagttccaaccaaatgggcaggcaccgatctcgagcacggacaagcaagtcccaccacaggtgagccaggacggtcacgtcagcacgttcgcggtccctcggaggctggaaacaactgagataccacaagtcgtcaacgacttccggattgccgctagaaacgcgatcaaagcaggctttgacggtgtggagatccacgcggctaacggatacctcttcgaccagttcatgaaggatagcgtcaacgaccgggacgatacatacgggggcaccctggagaaccggtgccgcttcactgcagaggtggtcgcggccgtggccggcgaggtgggcgcggatcgcctgggcgtgcggctctccccgttcacggactacatggactgcagcgactccgacccggaggcgctggcgttgcatgtcatccgcagcacgctgaacccgcttggcgtgctgtactgccacatgctcgagccgcggatgcgcgtgaacccggacgatggcaagctgaccttgcctcacatgctgttaccatttaggaaggcgttccagggcacgttcatcgtcagcggagggtatgaccaggaggaaggcaacactgcggtcaccgatggctacggtgacctggttgcatacggacggctgtttctcgccaacccggacctcccggcacggattgcaaggaacgccgggctgaacaactacgacaggagtaccttctacacctccgatccggtcgttggatacaccgattacccgttcctcgattaacactagatgattgaaatccttgtaatgccgatggttaagctagtgcaccagttgaattagagctcgtacaactaatctttacctattattaaagcaagcaacgcctctgccatatttttcgtacgtcgtggtaattttgcagaaaaacccctgatgttttgtgtaatcaacccgcagtccgagtctgggtgtcggattgaaaaaggaggaaagag

SEQ ID NO: 1631 - DNA, 1055 bp, Sorghum bicolor
aaaagccattcaatcattcaagagaaacaaccaagagcccgcactctcactgtgactccgtgagcacactcgccgcaccagctcagctcagtaatcatggctcgcccgggtagtagtgccgctgctcccctcctcctgctgctcgccgccgcggcggcgtcgatcctggcagcggcagccgcgtcgccggcgccgagcgacttcgtccgcaagtcgtgccgcgcgacgcagtacccgtcggtgtgcgagcagagcctggcgtcgtacgggggctccccggcgccgcggagcccgcgggagctggcgcgcgccgcgctgtcggtgagcgcggaccgcgcgcgcgccgcgtcggcctacgtgggccgcctgtgcggcggctccagcagctccgccggccacaagaagggcgctgctgcgaggaagggcggcgcgcccgggtcggcggcgggacccgtgcgcgactgcctggagaacctggcggacagcgtgggacacctccgcgacgcggcgcaggagatgggcggcgccgggatgtcccgctccgggacgcccgcgttcaagtggcacctcagcaacgtccagacctggtgcagcgccgcgctcaccgacgagaacacctgcctcgacggcctctcctcccgcggcgtcgacgccggcacgcgcgccgccatccgcggcaaggtcgtcgacgtcgcgcaggtcaccagcaacgccctcgcactcgtcaacaaggtcgggccagggtactagcccaggcccaggcccagcccaaatagccctcgctacttagtccatacacgtattatacttcggtgcgtcggttaagtacgtagaccagttttccacgtgttgcttctgcttatgattcctcgtgtttgtaagatgtcgttaagggcgacaatgataaagcttgtaatattatggacttatgacaacaagtacagtaagcatgtactacaaaataagtctcatcgttacgttcatatggtcttcgagaaacgaaaattttcttttactaccgatctttctccaatgtgggggtgtcactcattttt

SEQ ID NO: 1632 - DNA, 1124 bp, Sorghum bicolor
aggtggttgatctcaaaagccattcaatcattcaagagaaacaaccaagagcccgcactctcactgtgactccgtgagcacactcgccgcaccagctcagctcagtaatcatggctcgcccgggtagtagtgccgctgctcccctcctcctgctgctcgccgccgcggcggcgtcgatcctggcagcggcagccgcgtcgccggcgccgagcgacttcgtccgcaagtcgtgccgcgcgacgcagtacccgtcggtgtgcgagcagagcctggcgtcgtacgggggctccccggcgccgcggagcccgcgggagctggcgcgcgccgcgctgtcggtgagcgcggaccgcgcgcgcgccgcgtcggcctacgtgggccgcctgtgcggcggctccagcagctccgccggccacaagaagggcgctgctgcgaggaagggcggcgcgcccgggtcggcggcgggacccgtgcgcgactgcctggagaacctggcggacagcgtgggacacctccgcgacgcggcgcaggagatgggcggcgccgggatgtcccgctccgggacgcccgcgttcaagtggcacctcagcaacgtccagacctggtgcagcgccgcgctcaccgacgagaacacctgcctcgacggcctctcctcccgcggcgtcgacgccggcacgcgcgccgccatccgcggcaaggtcgtcgacgtcgcgcaggtcaccagcaacgccctcgcactcgtcaacaaggtcgggccagggtactagcccaggcccaggcccagcccaaatagccctcgctacttagtccatacacgtattatacttcggtgcgtcggttaagtacgtagaccagttttccacgtgttgcttctgcttatgattcctcgtgtttgtaagatgtcgttaagggcgacaatgataaagcttgtaatattatggacttatgacaacaagtacagtaagcatgtactacaaaataagtctcatcgttacgttcatatggtcttcgagaaacgaaaattttcttttactaccgatctttctccaatgtgggggtgtcactcatttttaacagatggagtaaatattattgttcactgaacaacgtttttgctaatgctgatg

SEQ ID NO: 1633 - DNA, 1280 bp, Zea mays
gaaatgtttccattcacataaaatcagatcagatcaccaaatgcatggttgatgttcgaagcccaaaagcaataatgcaaaatgagagaaatatagcatacactactgcctgcctccggatttttttttgctttctaaaaaaatcatctccgaaaactgcacatattccaaatctccctatataagcagacacagctaggtgggtgattacaataggcattcaatcattcaagcgaagcagccaccactctctccactgtgactccgtgacctgcctgccctgctgcacaagcacagcacacacaccccgcacaccgcaccagctcagctcagctcaccaagacaatcaatcatggctcgcccgcgcagtgtcgctgccgctgccgctgcccccctcctgctgctgctcgccgccgccgcagcggggctcgtgtccgccgcgtcgccggcagccagcgacttcgtccgcaagtcgtgccgcacgacgcagtacccgtcggtgtgcgagcagagcctggcgtcgtacggcgggtcgccgccgccgcggagcccgcgggagctggcgcgcgccgcgctgtcggtgagcgcggaccgcgcgcgcgccgcgtcggcgtacgtgggccgcctgtgcggcgccagcaacggcaaaggcgcgaagaaggggtcgggatcggggtcggggtcggcgtcggcaggtcccgtgcgagactgcctggacaatctggcggacagcgtgggccacctccgcgacgcggcgcaggagatgggcggcgccgggatgggccgcgcggggacgccggcgttcaggtggcacctcagcaacgtgcagacctggtgcagcgccgcgctcaccgacgaggacacctgcctcgacggcctctcgtcccgcgccgtcgacgccggcacgcgcgccgccatccggggcaaggtcgtcgaggtcgcgcaggtcaccagcaacgcgctcgcgctcgtcaataaggtcgggcctgggtactaacacggtgaggggacccaagatccaggcccaggcccaggccagataccacacccgctactagtataatactaggcgcctccacacctccacggcgttgggtgtttctcgttcgttaatagctcggtttgctttgcttgtgtttgtgtaagatatacattagttaagggcaataagcttgtactattatgagtggcggccgaggagtacagacttacagtacgttcttctctgtccgatcatgccatcattaacattaattaatgtgggagatatcttttgtcca

SEQ ID NO: 1634 - DNA, 755 bp, Sorghum bicolor
ggccaccacactttccccatccctcccaagatccatccatccatcaatcagcagcagcagcagcagcatcatcatccaagaagaggcgcagccatggcgagcgagcacgcggcggcgggtgaggggaagcacgagaagcagagtctgatggacaaggcgaaggagttcgtcgccgacaagatcgcgcacatcccgaagccggaggcgacgctggacgcggtgacgttcaaaggtctgagcagggagtgcatcacgctgcacagcagcgtgaacgtgtccaacccctacgaccaccgcctccccatctgcgaggtgacctacacgctccggtgcgccggcagggaggtggcgtcggggaccatgccggaccccgggtggatcgccgccagcggcaccacctcgctggagatccccgccaaggtgccctacgacttcatcgtctccatcgtccgcgacgttggtagggactgggacctcgactacgagctccaggtcgggctcaccgtcgacctccccatcgttggcaacttcaccatcccgctctccacctccggcgagttcaagctacccactctcaaggacttgttctgatctgatagcttgctttctgttctgtcgtcgcctgagctgagagcctgagacggatgagtgacagcgatctgtactgtactctgtgttgtgcgtgatctgaatgatccctacgacgaacgcaccatatcttgttgcaaataaacgcaggtcctctgttccattcc

SEQ ID NO: 1635 - DNA, 1310 bp, Sorghum bicolor
cgccgcgtgggcttcccgcgccgaatcttctcttccgcttcctccggtcctactcggacgatgctccgattccacgcggccacgcacgtggtgcccacgcacacgccgcgggatcgccgtgtcctcctctccccttccgctttcatatatacgcggccaccacactttccccatccctcccaagatccatccatccatcaatcagcagcagcagcagcagcatcatcatccaagaagaggcgcagccatggcgagcgagcacgcggcggcgggtgaggggaagcacgagaagcagagtctgatggacaaggcgaaggagttcgtcgccgacaagatcgcgcacatcccgaagccggaggcgacgctggacgcggtgacgttcaaaggtctgagcagggagtgcatcacgctgcacagcagcgtgaacgtgtccaacccctacgaccaccgcctccccatctgcgaggtgacctacacgctccggtgcgccggcagggaggtggcgtcggggaccatgccggaccccgggtggatcgccgccagcggcaccacctcgctggagatccccgccaaggtgccctacgacttcatcgtctccatcgtccgcgacgttggtagggactgggacctcgactacgagctccaggtcgggctcaccgtcgacctccccatcgttggcaacttcaccatcccgctctccacctccggcgagttcaagctacccactctcaaggacttgttctgatctgatagcttgctttctgttctgtcgtcgcctgagctgagagcctgagacggatgagtgacagcgatctgtactgtactctgtgttgtgcgtgatctgaatgatccctacgacgaacgcaccatatcttgttgcaaataaacgcaggtcctctgttccattccattgctttccagtttgtttcccaatgaatgaatgcaaaaggaagatggtttgattgcaaataaaacagcgagaggtctgaatttcatttgggtctgtcagtggaactgttttttttctcgtgatggttattgtgcatcggttctttattaggtaagcatttgattcatttcaaagaaagagaactgaagtcgatctgagtgagggggtagagaaggaaagttttggaggtgtgggcttgagagctgtgactttgacagagcaccgggcatccacaccaccacttgggatgtgattgtgatgtgcctgccacattcgtccacacatctgctctcctctgagccgacctacggaacacggtgtttgaacacaccttaaaatttcgcgacaccgtagcactttc

SEQ ID NO: 1636 - DNA, 780 bp, Triticum aestivum
cagcagcagcagcatcatcatccaagaagaggcgcagccatggcgagcgagcacgcggcggcgggtgaggggaagcacgagaagcagagtctgatggacaaggcgaaggagttcgtcgccgacaagatcgcgcacatcccgaagccggaggcgacgctggacgcggtgacgttcaaaggtctgagcagggagtgcatcacgctgcacagcagcgtgaacgtgtccaacccctacgaccaccgcctccccatctgcgaggtgacctacacgctccggtgcgccggcagggaggtggcgtcggggaccatgccggaccccgggtggatcgccgccagcggcaccacctcgctggagatccccgccaaggtgccctacgacttcatcgtctccatcgtccgcgacgttggtagggactgggacctcgactacgagctccaggtcgggctcaccgtcgacctccccatcgttggcaacttcaccatcccgctctccacctccggcgagttcaagctacccactctcaaggacttgttctgatctgatagcttgctttctgttctgtcgtcgcctgagctgagagcctgagacggatgagtgacagcgatctgtactgtactctgtgttgcgcgtgatctgaatgatccctacgacgaacgcaccatatcttgttgcaaataaacgcaggtcctctgttccattccattgctttccagtttgtttcccaatgaatgaatgcaaaaggaagatggtttgattgcaaataaaacagcgagaggtctg

SEQ ID NO: 1637 - DNA, 1015 bp, Saccharum officinarum
gccacgctccgcgcgctggggccgccgtgtcctcctactctccccgcttgttcttgattatatacgcacgcgacgcggccaccactttcctcacctcaccatccctcccaagatccatctaatttccgccatccaattccaagaagagccccagccatggcgagcgagcacgcggcgggtgaggggaagcagaagcagagcctgatggacaaggcgaaggagttcgtagcagacaagatcgcgcacatcccgaagccggaggcgacgctggacgcggtgacgttcaaggggctgagccgggagtgcatcacgctgcacagcaccgtgaacgtgtccaacccctacgaccaccgcctccccatctgcgaggtgacctacaccctgaaatgcgccggccgggaggtggcgtcggggaccatgccggaccccgggtggatcgccgccagcggcaccacctcgctggagatccccgccaaggtgccctacgacttcctcgtctccctcgtccgcgacgtcggcagggactgggacctcgactacgagctccaggtcggcctcaccgtcgacctccccatcgttgggaacttcaccatcccgctctcctcctccggcgagttcaagctccccaccctcaaggacttgttctgatctagcttgctttctgtcgtcgcctgagctgagagcctgagacggctgagtgagggcgtgcaccggcgatctgtaccctgtgtccctgtgttgtgtgtgatctgaatgatccctacgacgaacgcaccgtatcttgtttgcaaataaacgcagctcctctgttccattccattgctttccagtttgtttcccaatgaatgaatgcaaaaggggatggtttgattgcgaataaacagcgagaggtttgaatttcacttgaactgttttttttttcgtgatggtccactccatcgatcctttatgtaagtatttcattcatttcaaagaaacagaactacgccgatttgagcgaaaaaaaaaaaaaaaa

SEQ ID NO: 1638 - DNA, 829 bp, Panicum virgatum
ggacctacagatatttcccagccatcctcctgccgcggttcgcgttgctacaccacgatccaggaccaggatccaggaagataatcgaggaggagggcggagccatggcgagcgagcacgcggaggcggagccgaagcagaagcagagcctgatggacaaggccaaggagttcgtggcggacaagatcgcgcacatccccaagccggaggcgacgctcgacggcgtctccttcaagagcatgagccgcgagtgcatcaccctgcacagcaacgtcaacgtctccaacccctacgaccaccgcctccccatctgcgaggtcacctacaccctcaagtgcgccggcaaggttgtggcgtccggcaccgtgcccgaccccggctggatcgccgccagcgacaccaccaagctggagatccccgccaaggtgccctacgacttcctcatctcgctcatgaaggacgtgggcagggactgggacatcgactacgagctccaggtcgggctcaccgtcgacctccccatcatcggaaacttcaccatcccgctctccaccagcggcgagttcaagctcccaaccctcaaggacatgttctaataattcatcagattccgtggcgtcgaccatgtaccaccaatgtaactctgtcatcccatccccacggctgtatgaatcctagtgccgtcttgcaaataaaggcagatgctctgtttcagttctaccacatactgctacggcataccagtatcagctgcctgaacatctgtttctgaatgcatgcctaatggttgcaataaagagatagatgcctgaatttcaggtttcagtgg

SEQ ID NO: 1639 - DNA, 832 bp, Panicum virgatum
gacctacagatatttcccaggcatccactcctgccgcggttcgcgttgccgcaccacgatccaggaaggaagagaatcgaggaggaggagggcggagccatggcgagcgagcacgcggagccgaagcagaagcagagcctgatggacaaggccaaggagttcgtggcggacaagatcgtgcacatccccaagccggaggcgacgctcgacggcgtctccttcaagagcatgagccgcgagtgcatcaccctgcacagcaacgtcaacgtctccaacccctacgaccaccgcctccccatctgcgaggtcacctacaccctcaagtgcgccggcaaggttgtggcgtccggcaccatgcccgaccccggctggatcgccgccagcgacaccaccaagctggagatccccgccaaggtgccctacgacttcctcgtctcgctcatgaaggacgtgggcagggactgggacatcgactacgagctccaggtggggctcaccgtcgacctccccatcatcggaaacttcaccatcccgctctccaccagcggcgagttcaagctcccaaccctcgaggacatgttctaataattcattagcttcagtggcatcgacggaccatgtcaccaatgtaactctgtcatctcatcctcactgctgtatgaatcctagtaccatcttgcaaataaaggcagatgctctgtttcagttctaccataccacatactgccacggcataccagtatatcagctgtactgaacatctgtttctgaacgcatgcccaatggttgcaataaagagctagatgcctgaatttcaggtttcagtggacaa

SEQ ID NO: 1640 - DNA, 787 bp, Cenchrus ciliaris
  misc_feature (674)..(674): n is a, c, g, or t
cgactctttcccagccatcctagctgccttgcgtttcgttgccgcaacatcactgccacaacgatcaaagagaggctcgaagagcggggacaagaggagccatggcgagcgagcacgcggagccgaagcagaagcagagcctgatggacaaggccaaggagttcgtggcggacaagatcgcgcacatccccaagccggaggcgtcgctggacagcgtctccttcaagagcatgagccgcgagtgcatcaccctccacagcaacgtcaacgtctccaacccctacgaccaccgcctccccatctgcgaggtcacctacaccctcaagtgcgccggaaaggtcgttgcgtccggcaccatgcccgaccccggctggatcgccgccaacgacagcaccaagctggagatcccggccaaggtgccctacgacttcctcatctcgatcgtcaaggacgtgggcagggactgggacatcgactacgagctccaggtggggctcaccgtcgacctccccatcatcggcaacttcaccatcccgctctccaccagcggcgagttcaagctccctaccatcaaggacatgctgttcggtagcagtactacaacggagtcgtcggaggcgacttaactctgtcatctgatccgacgaatgtgtcctgctatcttgcaaataaangcagctcctctgtttactgccgctgcattgtatggtgtcagctgtcagctcaactggacctctgtttctgaatgcatgcctcatggttgcaataaagagttagtcgatgcctg

SEQ ID NO: 1641 - DNA, 692 bp, Cynodon dactylon
aaaagagagcaagaaaggaagccgccatggcgtcggaggctggggagggcgaggcgaagcagaagcagagcctgatggacaaggccaagaacttcgtggcggagaagatcgcgcacatccccaagccgaaggcgtcgctggacggcgtcagcttcaagagcatgagcagggagtgcatcacgctgcacagcaacgtcaacgtcaacaacccctacgaccaccgcctgcccatctgcgacgtcacctacacgcttaagtgcgccggcaaggtcgtcgcctcggggaccctgccggaccccggatggatcgcagccagcggggataccaagctcgagatcccggccaaggtgccctacgacttcctcatctccatcatcaaggacgtcggacgcgactgggacgtcgattacgtcctcgacgtcgggctcaccatcgacctgcccatcgtcgggaacttcaccatcccgctctccaccagcggagagttcaagctacccacactcaaggacatgttctaatacgtacttatcacccatcaatccatcatccctgtcactgatgatgtaccctgcgtctgatgcgtgcaaataatgctttcttctcagataattacaagctactggaggcctagattctcaggtctcttcagagttttcttccttccccccccgtaagataagaagattgatgcc

SEQ ID NO: 1642 - DNA, 875 bp, Pennisetum glaucum
ccggccccggctggatcgccgccagcgacagcaccgaccatctgcagatatttcccagccatcctatagccgccgcgttccgccgattgccaccaccaccaccaccacgatccaagaagagattcgaagagcaagggcaaaggagccatggcgagcgagcacgaggagccgaagcagaagcagagcctgatggacaaggccaaggagttcgtggcagatcgcgcacatccccaagccggaggcgtcgctggacagcgtctccttcaagagcatgagccgcgagtgcatcaccctccacaacccctacgaccaccgcctccccatctgcgaggtcacctacaccctcaagtgcgccggaaaggtcgttgcgtccggcaccatgcccgaccccggctggatcgccgccagcgacagcaccaagctggagatcccagccaaggtgccctacgacttcctcatctcgatcgtcaaggacgtcggcagggactgggatatcgactacgagctccaggtggggctcaccatcgacctccccatcgtcggcaacttcaccatcccgctctccactagcggcgagttcaagctcccaaccatcaaggacatgctgttcggtggcagtaccacatcggagtcggaggcgaaataactctgtgatttgatccgacgaatgtatcctgctatcttgcaaataaaggctgctcctctgtttcagttccacgcgctactgctactgcgttgtatcagctgtcagcttaactgaacctctgtttctgaatgcatgcctcatggttgcaataaagagttagtagatgcctgaatttcaggtttctttggaaattgtgatgttcaatttgaggaggaacttttcttgttga

SEQ ID NO: 1643 - DNA, 1194 bp, Setaria italica
atgcagcccaccaatcatgccgcaacaacgtatcgcccactgcgatacataaccgcacccgcggcgagatgccgattcagcaccgtccgtttgggggcatcgcgccgcgtggggctccgcgtccgcgccgaagccgaaccttcttccctcctccctcctcccgcttttcccaaattcccctgcctcgcatcaaattcacggaacccaaaagcttcgggtcccaaccaaaccttacgcgcctcggctcgggcaccgacgcgggatatcgcaaagtttcacgtacccggacggcaacgacccactgggatgatacggattccacgcggctctgcacgtggtgcccacgccgcgcggccgccgcccgtaaatttcccagccatcctgtcgcgtttggccgttgctgcaaccaccgcgatccataatccaagagagagtcgaagagcaaggtttgccatggcgagcgagcacgcggagccgaagcagaagcagagcctgatggataaggccaaggagttcgtggtggacaagatcgcgcacatccccaagccggaggcgtcgctggacagcgtctccttcaagagcatgagccgcgagtgcatcaccctgcacagcaacgtcaacatctccaacccctacgaccaccgcctccccatctgcgaggtcacctacaccctcaagtgcgccggaaaggtcgttgcgtccggcaccatgcccgaccccggctggatcgccgccagcgacagcaccaagctggagatcccggccaaggtgccctacgacttcctgatctcgatcgtcaaggacgtgggcagggactgggacatcgactacgagctccaggtggggctcaccatcgacctccccatcgtcggcaagttcaccatcccgctctccaccagcggcgagttcaagctcccaaccatcaaggacatgctgttcagtcgcaccccatcagaggcgagctaactctgtgatctgatccgacgaatgtatcctatcttgcaaataaaaggcagctcctctgtttcagttccacatgctactgctactgcattgtatcagctgtcagctcaactgaacctctgtttctgaatgcatgcctcatggttgcaataaagagctagacgcctgcatttcaggtttctttggaaactgattgtgatttttaatttgagaatgaactgttcttgttga

SEQ ID NO: 1644 - DNA, 2509 bp, Sorghum bicolor
tcattgcagacttgcaagcttccctctcccccgatcgggtgatcatatccacccacctactactaccctgctaggcagacccataccgtatgaacaaaatcctccctatttaagacgggcggcgttggcttcaaatacactggtctctcctcggtccaaaagtctccccaatctccacccgttccagaattttctcccttattccagcgtgtcctcgtttcgggcccgcggttccgctgttccacttcttttgatttcggagtggggggagcttacatcttgctggataaagattggattttgagcgatttgggggcgcttgcctgattcgccccccctgcgaggtagggccgggccggggcggggggattagatttcggggggaagttttggtggtttgattgagattcggcttggccggagccggaatgacgatcgacatgtccatgcccgggagctccgggctcctgaacgctgcggggaagagggacatgaagttcttcagcaacccctacgttcttgcgctcacgggcgctgcaggaatcggtggattcctctttggctacgacacaggtgtcatatctggggcccttctgtatatccgtgatgattttccagcggtcagggataattacttcttacaggaaacgattgttagcatggccttagtcggagctatgcttggagctgctgggggtggttggatcaatgatgcatatggtcgcaagaagtccactcttcttgctgatatgatgtttgctcttggctcacttgtcatgtgtgctgctgctggtccttacattctaattattggaaggctcctcgttggtttgggtgtgggtgttgcatcagtcacggcaccagtatacattgctgaagctgctccttcagaaatcaggggaggtttggtgtcaactaatgtactcatgattactggtggccaattcttctcctatcttatcaatctcggctttactgaggttcctggaacatggcgctggatgcttggtgttgctgctgtccctgccattgtacagtttgtgctgatgctttttctgccagaatctccccgttggctttactggaaggatgagaaggcaaaagctattgctgtccttgagaagatctatgactctgatcgtttggaggaagaggtagagctgcttgcttcatcctccatgcatgaattccagtccaacaatgctggaagctatttggatgtcttcaagtcaaaagaattgaggctagctttctttgctggggctggtcttcaggccttccagcaatttactgggatcaacaccgtcatgtattacagccccacgatagtccagatggctggtttctcttccaacaggttggccttgcttctttccctcatcgtcgctgccatgaatgccgctgggaccattgttggaatctacctaatcgaccgttgcggccgccgccgcctggcccttacaagcttgtctggggttgtgatctcccttgtcattcttgccttggccttcatactgcagtcatcatccggcctctgcatgagtgctgctaatggcacatgccaaggcgtgctaggctggttcgcggtggcaggccttgctctgtacatcgccttcttctctccaggcatggggcctgtcccatgggctgtgaactcggaaatctaccctgaggcataccgtggaatgtgcggtggcatgtcggccactgtcaactggatctctaacctcatcgtggcacagacgttcctgtcgatcgtggggctggtcgggactggtccgaccttcctgatcattgccgggatcgcggtgctcgccttcatcttcgtggccatgtacgtgccagagacgaagggcttgagctttgagcaggtggagcagatgtggaaggagagagcgtgggggaacagcggcaactgccagagacttttgggtgctgctgcgccgtaggctacctgtcagcattgatcaagcgcggaagcaatggcggcgacacttttaagatggccgccttgcgcttgattacctccgtcctagtatagtaggaagaaagtacatacgaaagtggagatgcagatccaaactgttttatgtgatggctcatgttgcttatattattgctatccttttgcctgattgtacgtgttgtcatcgtgggaaatgttcagtgcgagtaaaagtatcaggtcgtaccgtgatgtcaaactattatgccaaaaggtctgttgtatgatccagatgggtgattatattttttttgtacagtttccggaataatgtcctggagagtcagtagggcagttgggtaggcgcttttttttttcttggccaagcgcccaagtgagtagtggtggtgagttggcgtttgggtcggtctttgtattggattagagttgtctgggggtgatatgtgacactcctagttgaaaaaaaaactagacaaacacttgatttttctgtattctcctcatatattttgcagtaaaacttttgcctcactttcaatgttc

SEQ ID NO: 1645 - DNA, 2676 bp, Sorghum bicolor
agcatatactgtacgcacgagcaaaacatgcgagaagttgattgagcgatcaggcctcttccgatttccacggagggaaatcaccgtaataatttctacaagcaagtccaagttgattgagcgatgctaaaggctcaaacggatcattgcagacttgcaagcttccctctcccccgatcgggtgatcatatccacccacctactactaccctgctaggcagacccataccgtatgaacaaaatcctccctatttaagacgggcggcgttggcttcaaatacactggtctctcctcggtccaaaagtctccccaatctccacccgttccagaattttctcccttattccagcgtgtcctcgtttcgggcccgcggttccgctgttccacttcttttgatttcggagtggggggagcttacatcttgctggataaagattggattttgagcgatttgggggcgcttgcctgattcgccccccctgcgaggtagggccgggccggggcggggggattagatttcggggggaagttttggtggtttgattgagattcggcttggccggagccggaatgacgatcgacatgtccatgcccgggagctccgggctcctgaacgctgcggggaagagggacatgaagttcttcagcaacccctacgttcttgcgctcacgggcgctgcaggaatcggtggattcctctttggctacgacacaggtgtcatatctggggcccttctgtatatccgtgatgattttccagcggtcagggataattacttcttacaggaaacgattgttagcatggccttagtcggagctatgcttggagctgctgggggtggttggatcaatgatgcatatggtcgcaagaagtccactcttcttgctgatatgatgtttgctcttggctcacttgtcatgtgtgctgctgctggtccttacattctaattattggaaggctcctcgttggtttgggtgtgggtgttgcatcagtcacggcaccagtatacattgctgaagctgctccttcagaaatcaggggaggtttggtgtcaactaatgtactcatgattactggtggccaattcttctcctatcttatcaatctcggctttactgaggttcctggaacatggcgctggatgcttggtgttgctgctgtccctgccattgtacagtttgtgctgatgctttttctgccagaatctccccgttggctttactggaaggatgagaaggcaaaagctattgctgtccttgagaagatctatgactctgatcgtttggaggaagaggtagagctgcttgcttcatcctccatgcatgaattccagtccaacaatgctggaagctatttggatgtcttcaagtcaaaagaattgaggctagctttctttgctggggctggtcttcaggccttccagcaatttactgggatcaacaccgtcatgtattacagccccacgatagtccagatggctggtttctcttccaacaggttggccttgcttctttccctcatcgtcgctgccatgaatgccgctgggaccattgttggaatctacctaatcgaccgttgcggccgccgccgcctggcccttacaagcttgtctggggttgtgatctcccttgtcattcttgccttggccttcatactgcagtcatcatccggcctctgcatgagtgctgctaatggcacatgccaaggcgtgctaggctggttcgcggtggcaggccttgctctgtacatcgccttcttctctccaggcatggggcctgtcccatgggctgtgaactcggaaatctaccctgaggcataccgtggaatgtgcggtggcatgtcggccactgtcaactggatctctaacctcatcgtggcacagacgttcctgtcgatcgtggggctggtcgggactggtccgaccttcctgatcattgccgggatcgcggtgctcgccttcatcttcgtggccatgtacgtgccagagacgaagggcttgagctttgagcaggtggagcagatgtggaaggagagagcgtgggggaacagcggcaactgccagagacttttgggtgctgctgcgccgtaggctacctgtcagcattgatcaagcgcggaagcaatggcggcgacacttttaagatggccgccttgcgcttgattacctccgtcctagtatagtaggaagaaagtacatacgaaagtggagatgcagatccaaactgttttatgtgatggctcatgttgcttatattattgctatccttttgcctgattgtacgtgttgtcatcgtgggaaatgttcagtgcgagtaaaagtatcaggtcgtaccgtgatgtcaaactattatgccaaaaggtctgttgtatgatccagatgggtgattatattttttttgtacagtttccggaataatgtcctggagagtcagtagggcagttgggtaggcgcttttttttttcttggccaagcgcccaagtgagtagtggtggtgagttggcgtttgggtcggtctttgtattggattagagttgtctgggggtgatatgtgacactcctagttgaaaaaaaaactagacaaacacttgatttttctgtattctcctcatatattttgcagtaaaacttttgcctcactttcaatgttctggagagacaaaatggacttgttt

SEQ ID NO: 1646 - DNA, 2008 bp, Pennisetum glaucum
cttctgtgaggtaaggccaagggttggtgagtggatttggagggcgtttctgccggattcggggcctctcacttctgtgaggtaaggccaagggttgaattttggggcaggagatttttggtggcccattcagattcggccggggcgaagatgacgatcgacatgtccatgcccgggagctccgggcttctggacgccgcggggaagaggaacatgaagttcttcagcaaccgctacgtgctcgcgctcacgggcgccgcaggaatcggcggattcctcttcggctacgacacaggtgtcatatctggagcccttttgtatatccgtgatgagtttccagctgtcagagacaattacttactgcaggaaactattgttagcatggccttagtaggggccatgcttggagctgctgggggtggttggatgaatgatgcatatggtcgcaagaagtctactcttcttgctgatttgatgtttgcgcttggctcaattgtaatgtgtgctgctggtggtccttacattctgattctaggaaggctcctagttggtttgggtgtgggtgtagcatcggtcacggcaccagtatatatcgctgaagctgctccatcagaaatcaggggaggtttggtttcaactaatgtactcatgattactggtggccaattcttctcctaccttatcaatcttggctttactgaggttcctggaacatggcgctggatgcttggagttgctgctgtgcctgccattgtacagtttgtgctgatgctttttctgccagaatctccccgttggctttactggaaggatgagaaggcacaagctattgctgtcctcgagaagatctacgaccctgatcgtttggaggaagaagtagagctgcttgcttcatcttccatgcatgaattccagtctgacaatactgcaagctatttggatgtcttcaagtcaaaggaattaaggctagcgttttttgctggagctggacttcaggccttccaacaatttactgggatcaacactgtcatgtattacagccccactatagttcagatggctggtttcacctccaataaattggccttgctcctttctctcatcgtcgctgcgatgaacgctgctggaaccattgttggaatctaccttatcgaccgttgtggtcgccgccgcctggcccttacaagcttgtcgggggttgtgatctcccttgtcatccttgccatggcctttatactgcagtcatcatccaacctctgtatggctgccgccaatggcacctgccaaggcatcctaggctggttagcggtggcaggccttgccctgtacatcgccgccttctctccaggcatgggcccggtcccgtgggctgtgaactctgagatctaccccgaggcgtaccgtggaatgtgtgggggtatgtcagcaaccgtcaactggatctccaacctcatcgtggcacagacgttcctctcaatcgtggggctggttgggactggcgtcaccttcctgatcatcgctggaatcggtgtgctggccttcatcttcgtggccctgtacgtgccggagacgaagggtctgagtttcgagcaggtggagcagctctggaaggagagagcatggggaagccgtggcgactgccagagccttttgggtgctgcgccgtaggctgtaaacttgatcaccgatcaagcatggaagcaatggcggcaacagttttaagatggccgtgttgcacttgattgcctccccgcctgggtaggaaggaagttcataaggagcaggatgaagatccaaactgttgtacgtatgttgtggtccctaggttggtgttctattgcttgattgtatgtaatagcctcagtactgaaaatattcggtcgagtaatggatcagatcgtcctcgtgacgcttgatagtgctaggaagcatgcccaattgtccatacacccagttttgggttatatctgtacagttttcggtgccccatgtgccggagataacaaaa

SEQ ID NO: 1647 - DNA, 2286 bp, Setaria italica
cccggctggtggcttacgtagacttcttccgttttattccagacttacaagcttcgctctcctccgctccgatcatatccacccaccaacccagccgtatgaacaaaatcctccacgggcgtcgctgcctcgctggcttcaagtacgcccgaatcccctcccacgttccggaccggttctagaaaattttcctcggttccagaaatttctggcgtatttcggtccggcggttgcaccgctccgctgctcctaggtttgattttggagcgggagcttgcatctccgtggataaagattggattttgagcggatttgggggggcgtttctgcctgattaagggcccggggttggattttggggtaggagatttttggtggcctattcagattcggcaggagcgaagatgacgatcgacatgtccatgcccgggagctccgggcttctgaacgccgcggggaagaggaacatgaagttcttcagcaacagctacgtgctcgcgctcacgggcgccgcaggaatcggcggattcctcttcggctacgacacaggtgtcatatctggagcccttttgtatatccgtgatgaatttccagctgtcagagacaattacttcctgcaggaaactattgttagcttggcattagtcggggccatgcttggagcagctgggggtggttggataaatgatgcatatggtcgcaagaagtctactcttcttgctgacttgatgtttgctcttggctcaattgtcatgtgtgctgctcctggcccttacgttctgattctcggaaggctgttcgttggtttgggcgtgggtatagcatcggtcacggcaccagtatacattgctgaagctgctccatcagaaattaggggaggcttggtgtcaactaatgtactcatgattactggtggccaattcttctcctaccttatcaatcttgggtttactgaggttcctggaacatggcgctggatgcttggagttgctgctgtgcctgccattgtgcagtttgttctgatgctttttctgccagaatctccccgttggctttactggaaggataagaaggcacaagctattgctgtcctcgagaagatttacgactctgatcgtttggaggaagaactagagctgcttgcttcatcttccatgcatgaattccagtctgacaatactgcaagctatttggacgtcttcaagtcaaaggaattaaggctagcgttttttgctggagctggttttcaggccttccaacaattcactgggatcaacaccgtcatgtattacagccccactatagtccagatggctggtttcacttccaacaagttggccttgctcctttccctcatcgtcgctgcgatgaacgctgctggaaccattgttggaatctaccttatcgaccgttgtggccgccgccgcctggcccttacaagcttgtccggggttgtgatctcccttgtcatccttgccatggccttcatactgcagtcatcatccagcctctgcatggctgccgctaatggcacctgccaaggcatactaggctggttcgcggtggcaggcctcgccctgtacattgccgccttctctccaggcatgggcccggtcccgtgggctgtgaactctgagatctaccccgaggcgtaccgtggaatgtgcgggggcatgtcggccaccgtcaactggatctccaacctcatcgtggcgcagacgttcctctcgatcgtggggctggtcgggactggcgtcaccttcctgatcatcgccggaatcggggtgctggccttcatcttcgtggccctgtatgtgccggagacgaagggtctgagcttcgagcaggtggagcagctctggaaggagagagcatggggaagccatggcgattgccagagccttttgggtgctgcgccctaggctgtacatttcagcaaagatcaagcatggaagcaacggcggtgacagttttaagatagccctgttgcgctccgtctgggtaggaaggaagttcataaggagctggatgaagatccaaactgttctatgttgtggactgtggtccctagattgctgttctgttttctgattgtatgtaatagcctcagtggaaaaatgttcagtgcgggtaaaggatcagatcgtccccgtgacgtcgattgtgcttggaggcatgtagacccagagttgggtcatatctgtacagttttcggcgcccccgatgtgacggagagaacaaaattgaattgtttctgtggaaatggagaaaaagttgcattatcat

SEQ ID NO: 1648 - DNA, 2805 bp, Oryza sativa
ggtctgtggtccgtctctcgccgtctcgcggtctcgctcggtttccccctccgaattccgaatttccgatccccacggtggcgtctccctatatctttcgtcaaccaatcaaaaggaaactcgaagcgtatcggcttcatcgccaatcgatgatgcgacgatgctgatctgatcatctgaacccaacaaaatttctccttcaaaacctgcaagctcaccttcttctcccccagctctctcctccgatcatttgcccaaccaccacccagcccgccagccgtgcgagcgcagctttcctatttaagccgcgcctcgctggctcgctgccgctgcccctgcctcttccccgaatgctggtctctcgtcgccccgtcccctggaatctctccctttctaccttggtccgggaccgcggctcctgaaatctctctctgtccctagaaatttctgcgcgcgtcttccgttcttctccccggtttggttggttcccgagcctgtgacctcgggggcggccgaaaggttggattttgtagagcaggctttacttgcatctgggcaaagattggattttttttgtggagcgattttggggtcgttgttttttggtgcttgtttgctgaagtttggattttgggaggagtttggggggggggggggggggttcggtcagatttggtgggagcggagggcatgacgatcgatttgtccatgcccgggagctccgggctcctggacgacgtaggggggaagaagcacatgaatttcttcagcaaccgctacgtgctcgcgctcacgggcgccgcaggaatcggcgggttcctctttggctacgacacaggtgtcatatctggagcccttttgtatattcgggatgactttccagcagtcagagacaattatttcttacaggagacaatcgttagcatggcattggtaggagccatcattggagcagctggcggcggctggatcaatgatacatacggccgtaggaagtctactcttgtggctgacatgctgtttgcacttggctcacttgttatgtgtgctgctggtggtccttacattctgattcttggaaggcttcttgttggcttgggtgtgggtatagcatcagtcacagcgccagtttacattgctgaagctgctccttcggaaattaggggaggtttggtgtcaactaatgtactcatgattactggtggtcaattcttctcctacctcatcaatcttggctttactgaggttcctggaacatggcgctggatgctcggagttgctgctgtgcctgcaattctacagtttgttctgatgctttttttgccagaatctccccgttggcttttctggaaggatgagaaagcaaaagctatttctgtcctagagaagatttatgactctgaccgtctagaggaagaggtagagcttcttgcttcttcttcaatgcatgaatttcagtctgatggtactgggagctatttggacattttcaagtcaaaggaactaaggctagcattttttgctggagctggtcttcaggcgttccagcaatttactggcatcaacactgtcatgtactacagcccaacaattgtccagatggctgggtttacctccaacaagttggcattgctcctttccctcatagtcgctggtatgaatgccgctgggaccattgttggaatctacctgattgaccgctgtggccggcgtcgcctggcccttacaagcttggctggtgtggtggtctccctcgccatcctagcaatggccttcatactgcagtcatcatcagatatctgttcgaatgcactcaatggtgcctgccaaggtgcactgggatggttcgcggtggcgggactcgctctatacatcgccttcttctccccaggcatggggccagttccatgggcagtgaactccgagatctaccccgaggcataccgtggaatgtgtggtggcatgtcagccactgtcaactgggtatctaacctgattgtggcacaaacattcctctcgatcgtcgggttggttgggaccggcctgaccttcctgatcatcgccggaatagcggtgctggccttcatcttcgtggctctctacgtgccggagactaaaggcctcagctttgagcaggttgagctcctgtggaaggagagagcatggggaaaccagggcaatcgccagagccttttgggcgctgcaccgtagtgagccagctctcatcctgcttgcccttgctggcaagggtcggtggctggctccctttttaagatggccgtgccaccctcagtttctatcggctctctctagctgggaagttttaggaagatctggatgcagaccaaattttattacgtggtagcgactagatcattgttctgtcacctggcatgtattgtcaatttctcatggtggaaactgggataatttcagcattgggtgggtgaagaatcaggttgtgttggtgtcgaatcttgtatacatgggaaggactgtacgagctatactggttgtgcattgccgtcacaagtgtatagttccggtgctagatgtgccggggagacggttaaaaacctgttatggacagaaacaggaatgaaaattatcgctttaatattcttgctcgttattcctccaccaggtgtatctgacttggcaaaccttgagagttatatgcagatgatgtattttgtaactaatgtgtctgtacaatggaattttcttttcttttctccatttttacctgtctgacaggatctagtatggcgcaagatttgttgccaggaaatggtttgttaagca

SEQ ID NO: 1649 - DNA, 2618 bp, Oryza sativa
ggtccgtggtccgtctctcgccgtctcgcggtctcgctcggtttccccctccgaattccgaatttccgatccccacggtggcgtctccctatatctttcgtcaaccaatcaaaaggaaactcgaagcgtatcggcttcatcgccaatcgatgatgcgacgatgctgatctgatcatctgaacccaacaaaatttctccttcaaaacctgcaagctcaccttcttctcccccagctctctcctccgatcatttgcccaaccaccacccagcccgccagccgtgcgagcgcagctttcctatttaagccgcgcctcgctggctcgctgccgctgcccctgcctcttccccgaatgctggtctctcgtcgccccgtcccctggaatctctccctttctaccttggtccgggaccgcggctcctgaaatctctctctgtccctagaaatttctgcgcgcgtcttccgttcttctccccggtttggttggttcccgagcctgtgacctcgggggcggccgaaaggttggattttgtagagcaggctttacttgcatctgggcaaagattggattttttttgtggagcgattttggggtcgttgttttttggtgcttgtttgctgaagtttggattttgggaggagtttggggggggggggggggggttcggtcagatttggtgggagcggagggcatgacgatcgatttgtccatgcccgggagctccgggctcctggacgacgtaggggggaagaagcacatgaatttcttcagcaaccgctacgtgctcgcgctcacgggcgccgcaggaatcggcgggttcctctttggctacgacacaggtgtcatatctggagcccttttgtatattcgggatgactttccagcagtcagagacaattatttcttacaggagacaatcgttagcatggcattggtaggagccatcattggagcagctggcggcggctggatcaatgatacatacggccgtaggaagtctactcttgtggctgacatgctgtttgcacttggctcacttgttatgtgtgctgctggtggtccttacattctgattcttggaaggcttcttgttggcttgggtgtgggtatagcatcagtcacagcgccagtttacattgctgaagctgctccttcggaaattaggggaggtttggtgtcaactaatgtactcatgattactggtggtcaattcttctcctacctcatcaatcttggctttactgaggttcctggaacatggcgctggatgctcggagttgctgctgtgcctgcaattctacagtttgttctgatgctttttttgccagaatctccccgttggcttttctggaaggatgagaaagcaaaagctatttctgtcctagagaagatttatgactctgaccgtctagaggaagaggtagagcttcttgcttcttcttcaatgcatgaatttcagtctgatggtactgggagctatttggacattttcaagtcaaaggaactaaggctagcattttttgctggagctggtcttcaggcgttccagcaatttactggcatcaacactgtcatgtactacagcccaacaattgtccagatggctgggtttacctccaacaagttggcattgctcctttccctcatagtcgctggtatgaatgccgctgggaccattgttggaatctacctgattgaccgctgtggccggcgtcgcctggcccttacaagcttggctggtgtggtggtctccctcgccatcctagcaatggccttcatactgcagtcatcatcagatatctgttcgaatgcactcaatggtgcctgccaaggtgcactgggatggttcgcggtggcgggactcgctctatacatcgccttcttctccccaggcatggggccagttccatgggcagtgaactccgagatctaccccgaggcataccgtggaatgtgtggtggcatgtcagccactgtcaactgggtatctaacctgattgtggcacaaacattcctctcgatcgtcgggttggttgggaccggcctgaccttcctgatcatcgccggaatagcggtgctggccttcatcttcgtggctctctacgtgccggagactaaaggcctcagctttgagcaggttgagctcctgtggaaggagagagcatggggaaaccagggcaatcgccagagccttttgggcgctgcaccgtagtgagccagctctcatcctgcttgcccttgctggcaagggtcggtggctggctccctttttaagatggccgtgccaccctcagtttctatcggctctctctagctgggaagttttaggaagatctggatgcagaccaaattttattacgtggtagcgactagatcattgttctgtcacctggcatgtattgtcaatttctcatggtggaaactgggataatttcagcattgggtgggtgaagaatcaggttgtgttggtgtcgaatcttgtatacatgggaaggactgtacgagctatactggttgtgcattgccgtcacaagtgtatagttccggtgctagatgtgccggggagacggttaaaaacctgttatggacagaaacaggaatgaaaattatcgctttaat

SEQ ID NO: 1650 - DNA, 2596 bp, Brachypodium distachyon
gaaagagagatgaatatggggtggacctagcagactcgtgttctacatttatcttaagcacgagcagaagtcgcatagcataataatctttgacgacgacgagggttgttctctcccgattctcaaggaggcacaaattctgcttctttttggtggtagcttcagcaatcgactttccttgccctctcctccgatcattcccatgccgcatgaccaacaagacttttctatttaagtcgtggctcgctggcttgcccggtcttcaaatgctggtctctgctcgcttaattgcctgaggaatttctccggttcgcggccggttcccgaaatttctccctgcttctggaattctctggcccggccccgccgcgtcctggccgcctcaagttgggattttggagtccaggcttgcgtcctggcagataaagattgagatcttttgagcgatctcctaggggcgctttcctgcttgggtgcccgctgagctagaggttggattttgggaggcgaatcggtgagagcgagcatgacgattgatttgtccaccatgcccggcagctccgggctgctggacaccgccgggaggagggacatgaacttcttcagaaaccgatacgtgcttgggctcacgggcgtcgcgggaatcggcgggttcctcttcgggtacgacacaggtgtcatatctggagctcttttgtatattcgggacgaattccctgctgtcaaagacaatttattcttgcaggagacaattgttagcatggcattacttggagccatgcttggagcagctggaggtggttggataaatgatgtgtatggtcgtaagaagtctactcttcttgctgacatgatgtttgcacttggttcacttgttatgtgtgctgctggcggtccttacattctgattcttggaaggctctttgtcgggttgggtgtgggcatagcatctgtcacggctccagtttacattgctgaagctgctccttcagaaattaggggaggtttggtgtcaactaatgtcctcatgattactggtggccaattcttctcctacctggtcaatcttggctttactgaggttcctggaacatggcgctggatgctcggagttgctgctgtgccagcatgcatacagtttgtgctgatgctttttctgccagaatctccccgctggctttaccggaaggatgagaaggcaaaggctattgcagtcctggagcagatttatgactccgatcgtctagaggaagaggtagagatgcttgcttcgtcttccatgcatgaattccagtctaactgtactgggagctatttggacatattcaagtcgaaggaactaaggctagctttttttgcgggagctggtcttcaggctttccagcaatttactggcatcaacactgtcatgtactacagccccacgatcgtccagatggccggattcacttccaacaggttggccttgctgctttccctcatcatcgctgccatgaatgccagtggaaccattgtcggaatctacctcatcgatcgttgtggccgccgccgcctggcccttacaagcttagctggcgttgtgatttcccttgtcattctcgccatggccttcatactgcagtcatcatccatcctctgtgagagcatgttccttggttcttgccaaggcatgctgggatggtttgcagtggcaggcctcgctctatacatcgccttcttttctccagggatggggccagtcccgtgggccgtgaactccgagatctaccccgaggcataccgtggtatgtgcgggggcatgtcagccactgtcaattggatttccaacctgatcgtggcgcagacgttcctctcgattgtggggtgggtcggtaccggccctacatttctgatcatcgccggtatcgcggtgctggccttcatctttgtggccctgtacgtgccagagacaaagggcctgagcttcgagcaggtcgagctgatgtggaaggagagagcttggggaaaccagggcgaccgcgagagtctcttgggtgctgcaccgtagacaattctccagctctcatcctgcacggcggtgcagtggcgcggtgcctcccttttaagatggtgcgccgcgccatgccaggttggtcccggaaggtaagtcctgaaaagaactggattggatgcagatacaaacctgtagtacgttagtgttctatatcgcttttatgttgttacctggttgagtgggtgtatgttttgttgtcgtgtgtttcacgccgaatctttctctgcattggcggaccaagtgtacagccatgatgataccaagaacaaagagctacgctagctggcaggaacaagtggacggacaaaactggtgtcttcagcagtctatatagtagtagtactgttgtttgtgttgtctgcttgtaactcgtgaactggtaccccaaattgccggttctatgtccctaaatggctaaatcgatcttttcttgctttctgcaaagccgggcctcgttgctgccgtgtaaaattaagcgtgcagttgttcctggtgctcgacgtgccaggagatgacagccaagatttctcatccagagggatc

SEQ ID NO: 1651 - DNA, 2293 bp, Triticum aestivum
caataatttgctccgaacctcctcccaccattgccatgcccacccgcccgcacactttcccatttcagtcgcggctccgtggcagggccgtgcttcaaatgccggtctccgctcgcttcattattcgcctgagcatgcagtaattcctccggctcggcaccggttcctgaaatttcgtcccacttccagaattatcttggcccggcgccgcgtcgaggctggatttttagagtcaaacattggaatcttcgccgacacggactggactttctttgagcaaaatcgcttgcctgctacccacccgctgagctagagattggattcgcgggggcgttccggcggggggcgagcatgacgatcgatttgtccaccatgcccgggagctcctcctcccgtctcctggacgccgccgcggggaggaaggacatgaacttcttcaaaaaccgctacgtgcttgggctcaccggcgtcgccggaatcggcggcttcctctttggatacgacacaggtgtcatatctggagcccttctgtatatccgggacgaatttcctgctgtcaaagacaatctattcttgcaggagacaattgttagcatggctttacttggagccatccttggagcagctgggggcggttggataaatgatgcctacggtcgtaagaagtctactcttcttgctgacctgatgttcgcacttggttcactggttatgtgcgctgctggcggtccttatgttctgattcttggaaggctctttgttggattgggtgtgggaatagcatcagtcactgcccccgtttacatcgctgaagctgctccttcagaaatcaggggaggtttggtgtcaactaatgtcctcatgattaccggtggccaattcttctcctacttggtgaatcttggctttactgaggttcctggaacatggcggtggatgctcggagttgctgccgtgccagcaatcatacagtttgtgctgatgctttttctgccagaatctccccgctggctttaccggaaggatgagaaagcaaaagctattgctgtcctggagcagatatatgactctggtcgtctggaggaagaggttgagctgcttgcgtcggcttccatgcatgaattccagtctaactgtactgggagctatttggacatattcaggttgaaggaattaaggctagctttttttgctggggctggccttcaggccttccagcaatttactggcatcaacaccgtcatgtactacagccccacgatcgtccagatggctgggttcacttccaacaggctggccctgctgctgtccctcgtcgtcgccgccatgaatgccagtggaaccatcgtcggaatctacctcatcgaccgttgtggccgccgccgcctggcccttacaagcctagccggggtcgtgctctccctcgtcatcctcgccacggccttcatactgcagtcatcgtccagcctctgcgggagcctgttcagcggttcctgccaaggcgtgctggggtggttcgcggtcggagggctcgctctgtacatcgccttcttctctccgggcatggggccggtgccgtgggccgtgaactcggagatctaccccgaggcgtaccgcggcatgtgcggcggcatgtcggccaccgtcaactggatctccaacctgatcgtggcgcagacgttcctgtcgatcgtggggtgggtcggcaccggccccacgttcctgatcatcgccgggatcgccgtgctggccttcatcttcgtggccctgtacgtgccggagaccaagggcctgagcttcgaggaggtcgatctgctgtggaaggagagggcctggggaagccagggcagccacgagagcctcctgggtgctgcgccgtaagaccacccgccggctctggtcctgcacggcggcgcgtcgcaggcataacatggctccgcggctgcgccccgccgcgcctggctggctcgcggtgatcgctggcctctagctaggaagggagtcttagaaagaactggatggacgcaatatcatacacaaatcacgaacctgtatcaatggcggtgtgttctgtgcctcgttatatatgttgtcgtagtcgcgtgttcacttcgaatatggttgagttgaagcgaccgtatgaccgagaagtggcagtattgtttgtgcattgccggcacgagtgtacccaagaaccaaagagcaagagctccgctggcagtgatggttggtagatggacaaaactgatgtcttcagcagtttatttttcgtttgggttctttcttagatcta

SEQ ID NO: 1652 - DNA, 2310 bp, Triticum aestivum
cgcacatcaaaaatctcgcgacgacgaaacgtcgccctcctctcccccgatccgcacgccggcaccgttttctttccttctctatccactggcaacttcggcgaccgattcatgcccaacacgcaataatttgctccgaacctcctcccaccattgccatgcccacccgcccgcacactttcccatttcagtcgcggctctgtggcagggccgggcttcaaatgccggtctccgctcgcttccttactcgcccgagcgagcaataattcctcctgctcggcaccggttcctgaaatttcgccccgcttccagaattatctcggcccggcgccgcgtcaaggctggatttttagagtcaaacattggaaccttcgcagacacggactggggtttctttgagcaaaatcgcttgcctgctacccacccgctgagctggagattggattcgcgggggcgttccggtgggggcacgagcatgacgatcgatttgtccaccatgcccgggagctcctcctcccgtctcctggacgccgccgcggggaggaaggacatgaacttcttcagaaaccgctacgtgcttgggctcaccggcgtcgccggaatcggcggcttcctctttggatacgacacaggtgtcatatctggagcccttctgtatattcgggacgaatttccagctgtcaaagacaatctattcttgcaggagacaattgttagcatggcattacttggcgccattcttggagcagctgggggtggctggataaatgatgcctacggtcgtaagaagtccactcttcttgctgacctgatgttcgcacttggttcactggttatgtgcgctgctggcggtccttatgttctgattcttggaaggctctttgttggattgggtgtgggaatagcatcagtcactgcccccgtttacatcgctgaagctgctccttcagaaatcaggggaggtttggtgtcaactaatgtcctcatgattactggcggccaattcttctcctacttggtcaatcttggctttactgaggttcctggaacatggcggtggatgctcggagttgctgccgtgccagcaatcatacagtttgtgctgatgctttttctgccagaatctccccgctggctttaccggaaggatgagaaagcaaaagctattgctgtcctggagcagatatatgactctggtcgtctggaggaagaggttgagctgcttgcgtcggcttccatgcatgaattccagtctaactgtactgggagctatttggacatattcaggttgaaggaattaaggctagctttttttgctggagctggccttcaggccttccagcaatttactggcatcaacaccgtcatgtactacagccccacgatcgtccagatggctgggttcacttccaacaggctggccctgctgctttccctcatcgtcgccgccatgaacgccagcggaaccatcgtcgggatctacctcatcgaccgttgtggccgccgccgcctggccctcacaagcctagccggcgtcgtgctttccctcgtcatcctcgccacggccttcatactgcagtcgtcgtccagcctctgcgggagcctgttcagcggttcctgccaaggcgtgctggggtggttcgcggtcggagggctcgctctgtacatcgccttcttctctccgggcatggggccggtgccatgggccgtgaactcagagatctaccccgaggcctaccgcggcatgtgcggcggcatgtcggccaccgtcaactggatctccaacctgatcgtggcacagacgttcctgtcgatcgtggggtgggtcggcaccggccccacgttcctgatcatcgccgggatcgccgtgatggccttcatcttcgtggccctgtacgtgccggagaccaagggcctgagcttcgaggaggtcgatctgctgtggaaggagagggcctggggaggccagggcagccacgagagcctcctgggttctgcgccgtaagaccagccgccggctctggtcctgcacggcggcgcgtcgccggcgccccttttaacatggctctgcggctgcgccccgccgcgccttggctggctcgcgccgaacgctggcctctagctaggaagggagtcttggaaagaactggatggacaatatcatacacgaactacgaacctgtatcaatggcggtgtgttctgtgcctggttatatatgtcgtcgtcgtcgcgtgttcacgtcgaagcgaccgtaaatattgtttctgcattgccggcacgagtgtaccaagaaccaaagagcaagagct

SEQ ID NO: 1653 - DNA, 2528 bp, Triticum aestivum
aaaatcttgcgacgacgaaacgtcgccctcctctcccccgatccgcacgccggcaccgttttctttccttctctatccactggcaagttcggcaaccgattcatgcccaacacgcaataatttgccatgcccaacctcctcccaccattgccatgcccacccgcccgcacactttcccatttcagtcgcggctccgtggcagggccgtgcttcaaatgccggtctccgctcgcttcattattcgcctgagcatgcagtaattcctccgggtcggcaccgggttcctgaaatttcgctccacttctagaattatattggcccgacgccgcctcaaggttggatttttagagtcaaacatcggaatcttggccgacacggactgggtttctttgagcaaaatcgcttgcctgctacccacccgctgagctagagattggattcgcgggggcgtttcggtggggggccgagcatgacgatcgatttgtccaccatgcccgggagctcctcctcccgtctcctggacgccgccgcggcgaggaaggacatgaacttcttcaaaaaccgctacgtgcttgggctcaccggcgtcgccggaatcggcgggttcctctttggatacgacacaggtgttatatctggagcgcttctgtatattcgggacgaatttccagctgtcaaagacaatctattcttgcaggagacaattgttagcatggcattacttggagccatgcttggagcagctgggggcggttggataaatgatgcctacggtcgtaaaaagtccactcttcttgctgacctgatgttcgcacttggttcactggttatgtgtgctgctggcggtccttacattctgatacttggaaggctctttgttggattgggtgtgggaatagcatcagtcactgccccagtttacatcgctgaagctgctccttcagaaatcaggggaggtttggtgtcaactaatgtcctcatgattactggcggccaattcttctcctacttggtcaatcttggctttaccgaggttcctgggacatggcgctggatgctcggagtagctgctgtgccagcaatcatacagtttgtgctgatgctttttctgccagaatctccccgctggctttaccggaaggatgagaaagcaaaagctattgctgtcctggagcagatatatgactctggtcgtctggaggaagaggttgagctgcttgcgtcggcttccatgcatgaattccagtctaactgtactgggagctatttggacatattcaggttgaaggaattaaggctagcttttttgctggagctggtcttcaggcctttcagcaatttactggcatcaacaccgtcatgtactacagccccacgatcgtccagatggctgggttcacttccaacaggctggccctgctactttccctcatcgttgccgccatgaatgcgagtggaaccatcgtcggaatctacctcatcgaccgttgtggccgccgccgcctggcccttacaagcctagccggggtcgtgctctcccttgtcatcctcgccacggccttcatactgcagtcatcctccagcctctgcgggagcctgttcagcggctcctgccaaggcgtgctggggtggttcgcggtcggagggctcgctctgtacatcgccttcttctctccgggcatggggccggtgccatgggccgtgaactcggagatctaccccgaggcctaccgcggcatgtgcggcggcatgtcggccaccgtcaactggatctccaacctgatcgtggcgcagacgttcctctcgatcgtggggtgggtcggcaccggcccaacattcataatcatcgccgggatagccgtgatggccttgatcttcgtcgccctctacgtgccggagaccaagggcctgagcttcgaggaggtggacctcctgtggaaagagcgggcctggggaagccagggcagccacgagagcctcctgggtgctgcgccgtaagaggtaagaccaccacctgctggctctggtcctgcacggcggtgcatcggcggcgcccttttagtatggttctgcggctgcgccccgccgcgcctggctggctcgcggcggtcgctggcttctagctaggacgggagtcttagaaagaactggatggacaatatcatacacgaatcacgaacctgtatatcaatggcggtgtgttatgttgtcgtcgcgtgttcaagtcgaatattgttgagtcaaagcgaccgtatgactgagacgcagcaatattgtttctgcattgccggcatgagtgcaccaagaaccaaagagcaagagctccgctggcggtgatgggtggtagatggacaaaaccgatgtcttcagcagtttattttgcgtgggttttgtgtttctaattcgtaaactggtatcccaaattgccagttctatctccatgtacctaagagcacagtgctggccctgtgttttggaaggccctaggcgaactcggtgacatgggcccctatataaatttcaaccaa

SEQ ID NO: 1654 - DNA, 2567 bp, Hordeum vulgare
gactcacgttgtttcgtttcggcaatccacatccattttgctccgagcacgagcagaagacgcaaaatcccgcgacgacgaaacgtcgccctcctctcccccaatccgcacgccggcgccatttttcttccttcccttttccatctagtggtaacccgggcaaccgattcatgcccagcacgcaataacctcctccgaacctcccccgaccattgccatgcccacccgcccgcacactttcccattccagccgcggctctgtggcagggcggggctccaaatgctggtcgcccctcgctccattattcgcaataattcctccggctcggcaccggttgctgaaatttcgccccgcttctagaatcgtcttgccccgacgccgcgtctgggttggattcttggagtcaaccactggaatcttcgcaggtacggattgaaatctttatcgagcgagggatttccctgggggggtgcttgcctgcttgggcgcctgctgagctagaggttggattcggggaggcgttccggtttcggatgacgatcgatttgtccaccatgcccgggagctccgcccgtctcctggacgccgccgcggggaggaaggacatgaacttcttcacgaaccgctacgtgcttgggctcaccggcgtcgccggaatcggcggcttcctctttggatacgacacaggtgtcatatctggagcccttctgtatattcgggacgaatttcctgctgtcaaagacaatctatttttgcaggagacaattgttagcatggcattacttggagccattcttggagcagccgggggtggttggataaatgatgcctacggtcgtaagaagtccactcttcttgctgacctgatgttcgcacttggttcactggtgatgtccgccgctggtggtccttacattctgatacttggaaggctctttgttggattgggtgtgggaatagcatcagtcactgccccagtttacattgctgaagctgctccttcagaaataaggggaggtttggtgtcaactaatgtcctcatgattactggtggccaattcttctcctacttggtcaatctttgctttactgaggttcctgggacatggcggtggatgctcggagtagctgctgtgccggcaatcatacagtttgttctgatgctttttctaccagaatctccccgctggctttaccggaaggatgagaaagcaaaagctattgctgtcatggagcagatatatgactctggtcgcctagaggaagaggtcgatctgctcgcgtcggcttccatgcatgaattccagtctaactgtactgggagctatttggacatattcaggttgaaggaattaaggctagccttttttgctggagctggtcttcaggccttccagcaatttactggcatcaacaccgtcatgtattacagccccacgatcgtccagatggctgggttcacttccaacaggctggccttgctgctttccctcattgtcgccgccatgaacgccagtggaaccatcgtcgggatctacctcatcgaccgttgtggccgccgccgcctggccctcacaagcctagccggggtggtgctttcccttgtcatcctcgccacggccttcatactacagtcatcatccagcctctgcgggagcctattcagcggttcctgccaaggcgtgctgggatggtttgcggtcggagggctcgccctgtacatcgccttcttctctccgggcatggggccggtgccatgggcggtgaactcggagatctaccccgaggcctaccgcggcatgtgcggcggcatgtcggccactgtcaactggatctccaacctgatcgtggcgcagacgttcctctcgatcgtggggtgggtcggcaccggccccacgttcctgatcatcgccgggatcgccgtgatggccttcatcttcgtggccctgtacgtgccggagaccaagggcctgagcttcgaggaggtggatctcctgtggaaggagagagcctggggaaaccagggcagccacgagagcctccttggtgctgcgcggtaagaacacacgccggctctggtcctgcatggcggtgcaccggcggcgccgcttttaatatgtctctgcggctgcgccccgccgcgcctgtctggctcccggcgatcgctggtctctagttagagagaactggatggacgcaatatcatacacgaattacgaacctgtatcaatggcggcgttacacgaattacgaacctgtatcaatagtggtgtgttctgtgcctggttatatgtttgtcgtcctcgcgtattcacgtcaaatattgttgagtccgagcgaccgtataaccgagaagtggcagtattgtttctgcattgccggcacgagtgtacccaagaaccaacgagcaagagctccgctggtggtgatggttgctatggacaagactgatatcttcggtagtttatttttcgtttcggttttgtgtttgtaattcgtaaactggtatcctaaattgccagttctatctctatgtagtcatctctagccgataccttataattta

SEQ ID NO: 1655 - DNA, 1805 bp, Setaria italica
ggaacatgaagttcttcagcaacagctacgtgctcgcgctcacgggcgccgcaggaatcggcggattcctcttcggctacgacacaggtgtcatatctggagcccttttgtatatccgtgatgaatttccagctgtcagagacaattacttcctgcaggaaactattgttagcttggcattagtcggggccatgcttggagcagctgggggtggttggataaatgatgcatatggtcgcaagaagtctactcttcttgctgacttgatgtttgctcttggctcaattgtcatgtgtgctgctcctggcccttacgttctgattctcggaaggctgttcgttggtttgggcgtgggtatagcatcggtcacggcaccagtatacattgctgaagctgctccatcagaaattaggggaggcttggtgtcaactaatgtactcatgattactggtggccaattcttctcctaccttatcaatcttgggtttactgaggttcctggaacatggcgctggatgcttggagttgctgctgtgcctgccattgtgcagtttgttctgatgctttttctgccagaatctccccgttggctttactggaaggataagaaggcacaagctattgctgtcctcgagaagatttacgactctgatcgtttggaggaagaactagagctgcttgcttcatcttccatgcatgaattccagtctgacaatactgcaagctatttggacgtcttcaagtcaaaggaattaaggctagcgttttttgctggagctggttttcaggccttccaacaattcactgggatcaacaccgtcatgtattacagccccactatagtccagatggctggtttcacttccaacaagttggccttgctcctttccctcatcgtcgctgcgatgaacgctgctggaaccattgttggaatctaccttatcgaccgttgtggccgccgccgcctggcccttacaagcttgtccggggttgtgatctcccttgtcatccttgccatggccttcatactgcagtcatcatccagcctctgcatggctgccgctaatggcacctgccaaggcatactaggctggttcgcggtggcaggcctcgccctgtacattgccgccttctctccaggcatgggcccggtcccgtgggctgtgaactctgagatctaccccgaggcgtaccgtggaatgtgcgggggcatgtcggccaccgtcaactggatctccaacctcatcgtggcgcagacgttcctctcgatcgtggggctggtcgggactggcgtcaccttcctgatcatcgccggaatcggggtgctggccttcatcttcgtggccctgtatgtgccggagacgaagggtctgagcttcgagcaggtggagcagctctggaaggagagagcgtggggaagccatggcgattgccagagccttttgggtgctgcgccctaggctgtacatttcagcaaagatcaagcatggaagcaacggcggtgacagttttaagatagccctgttgcgctccgtctgggtaggaaggaagttcataaggagctggatgaagatccaaactgttctatgttgtggactgtggtccctagattgctgttctgttttctgattgtatgtaatagcctcagtggaaaaatgttcagtgcgggtaaaggatcagatcgtccccgtgacgtcgattgtgcttggaggcatgtagacccagagttgggtcatatctgtacagttttcggcgcccccgatgtgacggagagaacaaaattgaattgtttctgtggaaatgga

SEQ ID NO: 1656 - DNA, 2370 bp, Secale cereale
tttctttccttttctatctataccggcaacttcggcagccgattcatgcccagcacgcagtaattccctccgaaccacctccgaccattgccatgcccacccgcccgcgcactttcccatttcagtcgcggctctgtggcagggcggggttcagctgccggtctccgctcgcttcattattcgcctgagcgagcaataattcctccggctcggcaccggttcctgaaatttcgccccgcttccagagttatcttggcccgacgccgcgtcgaggttggatgacttttggggtcaaacattggaatcctcgcagatacgggctgaaatcttcatcgagcgagagatttcctggggggcgggtgcttgcctgcttgggcgcctgctgagctagaggttgggttcggggaggcgttccggtttcggtggggggcgggcatgacgatcgatttgtccaccatgcccgggagctccgcccgtctcctggacgccgccgcggggaggaaggacatgaacttcttcaaaaaccgctacgtgcttgggctcaccggcgtcgccggaatcggcggcttcctctttggatacgacacaggtgtcatatctggagcccttctgtatattcgggacgaatttccagctgtcaaagacaatctattcttgcaggagacaattgttagcatggcattacttggagccatgcttggagcagctgggggtggttggataaatgatgcctacggtcgtaagaagtccactcttcttgctgacctgatgttcgcacttggttcgctggttatgtccgctgctggcggtccttacattctgatacttggaaggctctttgttggattgggtgtgggaatagcatcagtcactgccccagtttacatcgctgaggctgctccttcagaaatcaggggaggtttggtgtcaactaatgtcctcatgattactggcggccaattcttctcctacttggtcaatcttggctttactggggttcctggaacatggcgctggatgctcggagttgctgctgtaccagcaatcatacagtttgtgctgatgcttttcctgccagaatctccccgctggctttaccggaaggatgagaaagcaaaagctattgctgtcctggagcagatatatgactctggtcgtctggaggaagaggtcgatctgcttgcgtcggcttccatgcatgaattccagtctaactgtactgggagttatttggacatattcaggttgaaggaattaaggctagctttttatgctggagctggtcttcaggcctttcagcaatttactggcatcaacaccgtcatgtactacagccccacgatcgttcagatggctgggttcacttccaacaggctggccctgctgctttccctcgtcgtcgccgccatgaatgccagcggaaccatcgtcggaatctacctcattgaccgttgtggccgccgccgcctggcccttacaagcctagccggggtcgtgctctcccttgtcatcctcgccacggccttcatactgcagtcatcgtccagcctctgcgggagcctatcctgccaaggcgcgctggggtggttcgcggtgggagggctggctctgtacatcgccttcttctctccgggcatggggccggtgccatgggccgtgaactcggagatctaccccgaggcctaccgcggcatgtgcggcggcatgtcggccaccgtcaactggatctccaacctgatcgtggcgcagacgttcctgtcgctcgtggggtgggtcggcaccggccccacgttcctgatcatcgccgggatcgccgtgatggccttcatcttcgttgccctgtacgtgccggagaccaagggcctgagcttcgaggaggtcgatctgctctggaaggagagagcctggggaagccagggcagccacgagagcctcctgggtgccgcgccgtaagaccacccgccggctctggtcctgcacggcggtgcatcggcggcgccccttttagtatggctctgcggctgcgccccgccgcgcctggctggctcgcggcgatcgccggcctctagctaggaagggagtcttggagagaactggatggacgcaatatcatacacgaattacgaacctttatcaattcaatgtcggtgtgttgtacagtacgtatgtgtagtcgtcgcgtgttcacgtcgaatattgttgagtcgaagcgaccgtatgactgagaagtggcaatattgtttttgcattgccggcactagtgtacccaaaaccaaagagcatctctagctgatacctttaacttagcccattataccttaactcatccttctatttgagaagttaaaaaaaatgcaaacttaacaagtc

SEQ ID NO: 1657 - DNA, 2668 bp, Brachypodium distachyon
gaaagagagatgaatatggggtggacctagcagactcgtgttctacatttatcttaagcacgagcagaagtcgcatagcataataatctttgacgacgacgagggttgttctctcccgattctcaaggaggcacaaattctgcttctttttggtggtagcttcagcaatcgactttccttgccctctcctccgatcattcccatgccgcatgaccaacaagacttttctatttaagtcgtggctcgctggcttgcccggtcttcaaatgctggtctctgctcgcttaattgcctgaggaatttctccggttcgcggccggttcccgaaatttctccctgcttctggaattctctggcccggccccgccgcgtcctggccgcctcaagttgggattttggagtccaggcttgcgtcctggcagataaagattgagatcttttgagcgatctcctaggggcgctttcctgcttgggtgcccgctgagctagaggttggattttgggaggcgaatcggtgagagcgagcatgacgattgatttgtccaccatgcccggcagctccgggctgctggacaccgccgggaggagggacatgaacttcttcagaaaccgatacgtgcttgggctcacgggcgtcgcgggaatcggcgggttcctcttcgggtacgacacaggtgtcatatctggagctcttttgtatattcgggacgaattccctgctgtcaaagacaatttattcttgcaggagacaattgttagcatggcattacttggagccatgcttggagcagctggaggtggttggataaatgatgtgtatggtcgtaagaagtctactcttcttgctgacatgatgtttgcacttggttcacttgttatgtgtgctgctggcggtccttacattctgattcttggaaggctctttgtcgggttgggtgtgggcatagcatctgtcacggctccagtttacattgctgaagctgctccttcagaaattaggggaggtttggtgtcaactaatgtcctcatgattactggtggccaattcttctcctacctggtcaatcttggctttactgagaagaaccatgtcaaaagttcagtctgttatgttgtactaaagatgaactctcttgagaaagctttcagcatggttcctggaacatggcgctggatgctcggagttgctgctgtgccagcatgcatacagtttgtgctgatgctttttctgccagaatctccccgctggctttaccggaaggatgagaaggcaaaggctattgcagtcctggagcagatttatgactccgatcgtctagaggaagaggtagagatgcttgcttcgtcttccatgcatgaattccagtctaactgtactgggagctatttggacatattcaagtcgaaggaactaaggctagctttttttgcgggagctggtcttcaggctttccagcaatttactggcatcaacactgtcatgtactacagccccacgatcgtccagatggccggattcacttccaacaggttggccttgctgctttccctcatcatcgctgccatgaatgccagtggaaccattgtcggaatctacctcatcgatcgttgtggccgccgccgcctggcccttacaagcttagctggcgttgtgatttcccttgtcattctcgccatggccttcatactgcagtcatcatccatcctctgtgagagcatgttccttggttcttgccaaggcatgctgggatggtttgcagtggcaggcctcgctctatacatcgccttcttttctccagggatggggccagtcccgtgggccgtgaactccgagatctaccccgaggcataccgtggtatgtgcgggggcatgtcagccactgtcaattggatttccaacctgatcgtggcgcagacgttcctctcgattgtggggtgggtcggtaccggccctacatttctgatcatcgccggtatcgcggtgctggccttcatctttgtggccctgtacgtgccagagacaaagggcctgagcttcgagcaggtcgagctgatgtggaaggagagagcttggggaaaccagggcgaccgcgagagtctcttgggtgctgcaccgtagacaattctccagctctcatcctgcacggcggtgcagtggcgcggtgcctcccttttaagatggtgcgccgcgccatgccaggttggtcccggaaggtaagtcctgaaaagaactggattggatgcagatacaaacctgtagtacgttagtgttctatatcgcttttatgttgttacctggttgagtgggtgtatgttttgttgtcgtgtgtttcacgccgaatctttctctgcattggcggaccaagtgtacagccatgatgataccaagaacaaagagctacgctagctggcaggaacaagtggacggacaaaactggtgtcttcagcagtctatatagtagtagtactgttgtttgtgttgtctgcttgtaactcgtgaactggtaccccaaattgccggttctatgtccctaaatggctaaatcgatcttttcttgctttctgcaaagccgggcctcgttgctgccgtgtaaaattaagcgtgcagttgttcctggtgctcgacgtgccaggagatgacagccaagatttctcatccagagggatc

SEQ ID NO: 1658 - DNA, 1111 bp, Sorghum bicolor
agcgcgctgtccgcgcgataaaagcgccggcgcctcctctcgcgtggcctcccgaaggttccagactcgattggacggatcggagcagcactcctccacggctccccacctacagccctgactgatccggtctctcttgagatcaatatgagaaggggctacagttacagcccttcaccaccaaggggctacaggagaagggagcgcagcccaagcccccgtgattattatggtggccgtggtagggatctcccaaccagtcttctggtcaggaatctccgtcgggactgcaggccagaagacctccgtcggccatttggacaatttggtcgacttaaagatatatatcttccaagagattattacactggggagcctcgagggtttggatttgtccagtattatgatcctgatgatgctgctgatgcaaagtattatatggatgggcaggtagttcttggtaggcaaataacagttgtttttgcagaagagaacagaaagaagcctcaagagatgagagctagagatagagtcaggggtcattcttatgatcggaggtattctcgctctaggtcccctcgttattatagaggtggctctccttcacgcagccgaagctactcaaggtctccttcacctcgggatccaaaacacagacttagagagaggtcgtactccggctcacctgtggacagcatatcaagaagtgggagcccgtatgaggatggatatcccagatcatcacaaagggagagatctgtttctgtcagcggatgaagcagttttacagtctagagctactgctgtgaatctacgcatggtggcctacttgttatgtctttctgaaccatatatattctgtctagattatcattcccagtaccagagaagtatcgtgagactgtttgctgtacttattagtcttgaggatacagaacgggggtcaccaattctcagtagatggactatgaccactaagctacgccagtgccactgctttgtgtatttatagaattataggcagttttgtggtatgaataaaattggttggattgtgaaagctaattggtaacttttttatggatcatgaaacgaacgttttacatcactg

SEQ ID NO: 1659 - DNA, 1279 bp, Sorghum bicolor
caagatcttaacgaccctcacggcccagcagcgcccgcatccgccgcgcataaccccattccgttacaacgcgtgtcgcgatccaacggttctccagcgcgctgtccgcgcgataaaagcgccggcgcctcctctcgcgtggcctcccgaaggttccagactcgattggacggatcggagcagcactcctccacggctccccacctacagccctgactgatccggtctctcttgagatcaatatgagaaggggctacagttacagcccttcaccaccaaggggctacaggagaagggagcgcagcccaagcccccgtgattattatggtggccgtggtagggatctcccaaccagtcttctggtcaggaatctccgtcgggactgcaggccagaagacctccgtcggccatttggacaatttggtcgacttaaagatatatatcttccaagagattattacactggggagcctcgagggtttggatttgtccagtattatgatcctgatgatgctgctgatgcaaagtattatatggatgggcaggtagttcttggtaggcaaataacagttgtttttgcagaagagaacagaaagaagcctcaagagatgagagctagagatagagtcaggggtcattcttatgatcggaggtattctcgctctaggtcccctcgttattatagaggtggctctccttcacgcagccgaagctactcaaggtctccttcacctcgggatccaaaacacagacttagagagaggtcgtactccggctcacctgtggacagcatatcaagaagtgggagcccgtatgaggatggatatcccagatcatcacaaagggagagatctgtttctgtcagcggatgaagcagttttacagtctagagctactgctgtgaatctacgcatggtggcctacttgttatgtctttctgaaccatatatattctgtctagattatcattcccagtaccagagaagtatcgtgagactgtttgctgtacttattagtcttgaggatacagaacgggggtcaccaattctcagtagatggactatgaccactaagctacgccagtgccactgctttgtgtatttatagaattataggcagttttgtggtatgaataaaattggttggattgtgaaagctaattggtaacttttttatggatcatgaaacgaacgttttacatcactgaacaaaggcggggatacgattttttttcttttttccttttgaagaacaacttggcaaacctgcgtcttattaa

SEQ ID NO: 1660 - DNA, 1020 bp, Panicum virgatum
ggaagtttccagacacgagccgactaatcgaagcgctcctccagtcctcctccccctccccctcgagctgccgactgatccgtcctcgtttgcgatcaatatgagaaggggctacagttacagtccttcaccaccaaggggttacgggagaagggctcgcagcccaagcccccgtgatcattatggtggccgtggtagagatctcccaaccagtcttttggtcaggaatctccgtcgggactgcaggccagaagaccttcgtcgcccattcggacagtttgggcgacttaaagatatatatctaccaagagattattacactggggagccccgaggatttggttttgtccagtattatgatccagaagatgctgctgatgcaaagtactacatggatgggcagctggttcttggcaggcaaataactgttgtatttgcagaggagaataggaagaagcctcaagagatgagagttagggacagagtcagaggtcgttcttatgatcggaggtactctcgctctaggtcccctctttattccaggggccgttctccttcccgcagctactcaaggtctccttcacctccgaatcccaaacacagactcagggagaggtcgtactcccgctcgcctgttgacagcagatcaagaagcgggagcccctatgaggagcaataccgcagatcctcccgaagagagaggtctctctgtgttgccggatgaagtagtgttagtgatgtagagctagcgctatgaatcaacgcttggtagtggtacttgcctcgtctttctgaacaatatggtgtgtggtgtatcattcccagtagtatcgtcagagtacactttaccttgaggatttagaattcaggttactgattcggagtgcggagctgctgccttctggtcactgctcagtatgatgcgtatgtaccttgagccttgtcgtgtgatttgcttcgggtaaaacatgaagatttatatttacagtatgaataaagttgttggattgtgattgctca

SEQ ID NO: 1661 - DNA, 1601 bp, Panicum virgatum
ggaagtttccagacacgagccgactaatcgaagcgctcctcctcctccccctcgagcttccgactgatccgtcctcgtttgcgatcaatatgagaaggggttacagttacagtccttcaccaccaaggggttacaggagaagggctcgcagcccaagcccccgtgatcattacggtggccgtggtagagatctcccaaccagtcttttggtcaggaatctccgtcgggactgcaggccagaagaccttcgtcgcccattcggacagtttgggcgacttgaagatatatatctaccaagagattattacactggggagcctagaggatttggttttatccagtattatgatccagaagatgctgctgatgcaaagtactacatggatgggcagctggttcttggcaggcaaataactgttgtatttgcagaggagaataggaagaagcctcaagagatgagagctagggacagagtcagaggtcgttcttatgatcggaggtactctcgctctaggtcccctctttattctaggggtcgttctccttcccgcagctactcaaggtctctttcacctccaaatcccaaacacaggcttagagagcggtcctactcccgctcacctgttgacagcagatcaagaagcgggagcccctacgaggaggaataccgcagatcctcacgaagagagaggtctctctctgctaccggatgaagtagtgttgatgtggagctagcgctatgaatcagcgcacggtactggtacttgcctcgtctgtctttctgaacaatatggtgtgtggtgtatcattcccagtagtatcgtcagagtacactttacctggaggatttagaatgcaggttactgattcggagtacggagctgctgcgttctgatcactagtagttccgaagtgaacgcacactgtcgtgtgattgcttcgggtaaaacaggaaggtttaattattgtatgaataaagttggttggattgtgaatggctcagtgtgatgcgttgggggtgccggacttgtggcaacgtctcgtttgtttgcaagctgcgacagatgcagagtactgttaggcatgacaaccatgtgagatgataacattagcaactgcgcgtagatcagctgtcactgtaatctcccgctgtctgggcacgcacgcgctcgttttgagggagttgcgcgcgtgctgcttgcgtgaactcgccggcagggcgcgctagctaactgggctgtatcgcacggggacgcggtgctgggttgggctccaggtccagcagctcctccagctccagcctctgctgctgcgaccgaacctagcagaaaacttgcttgaccgcgatcacccggcgaagcaaaagcgcgcgtggcgtggtggtggtgtgtgtgaacgagcaccacatgacggacagcgcgcgcgggctagctgtttccatcctgagccaggtgcccgaaccccaagtgcggattgcgttcgtgcgtgcggccacgaggacgccgtgtggccaatgtcactgttttaggcagttgtactttctgcaagctgctaaagtaatgccatgttaaatagataaacatagttggccttttcatgac

SEQ ID NO: 1662 - DNA, 968 bp, Setaria italica
tctgctcatgttattgatttatcctagatcaatatgagaaggggttacagttacagtccttcgccaccaaggggttacaggagaagggctcgcagcccgactccccgtgattataatggtgaccgtggtagagatctaccaaccagtcttttggtcaggaatctccgtcgggactgcaggccagaagaccttcgtcgcccattcgcacagtttggtcgagttaaagatatatatctcccaagagattattacactggggagccccgaggatttgggtttgtgcagttttatgatcctgaagatgctgctgatgcaaagtactacatggatgggcaaatagttcttggcaggcaaataactgttgtatttgcggaggagaataggaagaagcctcaggagatgagagctagggacagagtcagaggtcgttcctatgaccggagatattctcgctctaggtcccctccttattctaggggccgttctccttcacgcagctactcgaggtctccttcacctccgaatccaaaacacaggctcagggagaggtcctactcacgctcacctgttgacagcagatcaagaagcgggagcccctatgaggagcgataccgcagatcctcaccaagagagaggtctctccctgttagcggatgaagtagtcttatgatctggagctactactgtgaaatcagcgcttgccgagtggtgacctacttgctgtgtatttctgaaccatatgatctgtggtgtatccaagataattcccagtagtatcgacagactatcgtcagagtatggcaattcagaacgtttgttaccaattcggaccatctgttgtctgtagagtgattgctttgggtgtaataggctggtttacggtatgaataaagttggttggattacgatagctgtgtgatgcgctggggttgaacaatttacacggccgagttatggtaacgttggat

SEQ ID NO: 1663 - DNA, 875 bp, Cenchrus ciliaris
  misc_feature (352)..(352): n is a, c, g, or t
cgccagactaatcgaagcgctcctcctcccgtcgagctcccgaccgatccggccttgtttgcgatcaatatgagaaggggttacagttacagcccttcaccaccaaggggttacaggagaagggatcgtagcccgagtccccgtgatcattatggcggccgtggtagagatctcccaaccagtcttttggtcaggaatctgcgtcgggactgcaggccagaagaccttcgtcgcccattcgcacaatttggtcgacttaaagatatatatcttccaagagattattacactggggagccccgaggatttgggtttgtgcagtattatgatcctgaagatgctgctgatgcanagtactacatggatgggcagatggttcttggcaggcaaataactgttgtatttgcagaggagaataggaagaggcctcaagagatgagggctagggacagagtcagaggtcgttcctatgaccggagatattctcgctctaggtcccctccttattctaggggccgttctccatcacggagctactcgaggtctccttcacctccgcttccaagacgcaggctcagggagaggtcctactcacgctcacctgtagacagcagatcaagaagtgggagcccctacggggagcgatactacagatcctcacgaagagagaggtctctctctgttagcggatgaagtagtcttcatgatctagagctactactgtgaagtcagcgcgtgccgagtggctacctgctacttgctgtgtatttctgaaccatattgatctctgtggtgtattgtcagactatgcactatcgtcagagctagtgttcttgacctggagcattgagaacgctgggtaccaattcagagca

SEQ ID NO: 1664 - DNA, 1047 bp, Pennisetum glaucum
gtttgcgatcaatatgagaagaggttacagttacagaccaatcgaggcgctcctcctcccccatcctccttcgagctcccgactgatccggcctcgtttgcgatcaatatgagaagagggtacagttacagtccttcaccgccaaggggttacaggagaagggatcgtagcccaagtccccgtgatcattatggtggccgtggtagagatctcccaaccagtcttttggtcaggaatctccgtaaggactgcaggccagaagaccttcgtcgtccattcgcacagtttggtcgacttaaagatatatatctcccaagagattattacactggggaaccccgaggatttgggtttgtgcagtattatgatcctgaagatgctgctgatgcaaagtactacatggatgggcagatggttcttgggaggcaaataactgttgtatttgcagaggagaacaggaagaagccacaggagatgagagctagggacagagtcagaggtcgttcctatgaccagagatattctcgctctaggtcccctctgtattctaggggccgttctccaccttcccgcagctactcaaggtctccttcacctcgggatccaaaacacaggctcagggagaggtcctactcacgctcacctatcgacagcaggtcaagaagtgggagcccctacgaggagcgataccacagatcctcacgaagagagaggtctctctccgttagtggatgaagtagtagtctttatgatgtgaaatcagcgcgtgccggattgatgacctacttgccgtgtatctctgaaccatatgatcttgtggtgtgtcgacggactaattaatatatgcattatcgtcagagctaatacttgggtcgtaccaattcggagaatctgcttagtgattgctttttgggtgtgtaagatgaaggggtgtctgcctgtctggtatgaataaagtttggttggattatgatggctcagcgtggtgggtttggggtcgaacaatgtagatggccgagttatggcaacgttgcattgaggcctttc

SEQ ID NO: 1665 - DNA, 696 bp, Sorghum bicolor
gagacactgcctatgccaacacaagagccgcttcgacgcgaccctgagcgtttcctgacagcgtcgacgccagccatggcggcgccacagtcctccaccggttcgctggttccgccactccgccgccgcccgcgccgcctcgtcttcgaccgccgctacggctggatcttcgacgagtggacggaccccgccgaccaagccctctccggcggccgcggaatgttctgtgcggtgacgatggcgcgctcgctggtggacgctgcggcgtcctcgattaactatgctgccagttcgatcagcagagttcttgaacaccccaaaagactccgcaagaagcagcaagcctggtttcgtgaacttgaatgctctggagtcgtagctgatcttaagttagtacactgttgtactcattctgtactggaatgtacagcaactgattgcctctgtttaacaaagaagcatggtcatctgtaagcaatgcatcagaaaattataagacacttatccttagaaaaagctgatttgttatctatatcttgtttctactctaatgcggtaaatgatgacgcagctgtttactggggtgctagtcatgaactcatgacagtactgaatgacaagctgaatcaatgtagcaaatgaaaaggatagtgcccaactatgacttttataatgttcttacacttcgaatagaat

SEQ ID NO: 1666 - DNA, 847 bp, Sorghum bicolor
gccagccacaaacaaagcgtccaataatcggccggctaacaagtgtactacgttgcagctaataactgggtgtgtgttcctgcagtacacgttcgtgcgcgtgtgacacagagcgcattagagctcagaactgagatatacagatggaggcgaggaggagcagcgcagcgctggtgggcgtggccgtggtcgcgctgctggtggtgctcgtgcccgagacgtcccgcgcggagcggttcgtcgtcggcgacgcggcgcggtggacgtgggggtacaactacacggactgggtcatcaagaagggacccttcttccagaacgacaccctggtgttcatgtacgacccgccgaacgcgacggtgcacgcgcacagcgtctacctgatgcgcaacgccgcggactaccagtcgtgcaacctcaaggcggccaagctggtggccaacgtcatgcagggcgcgggctcagggttcgagttcgtgctcaagaagcgcaagcagcactacttcgtgtgcggcgagcgcggcggcatccactgcaccatggggaacatgaagttcgtcgtcaagcccaagagctccgcctgccgcgacgactgacctcgtcgtcgccggcgttttcatcgacccatcgacgccgatgtgtgtgtggtctttcgccttccttctctgcatgccaccttctgattcctcctgttcaattgttgcgcgtgcttgtaagttattgttaattggtggatttacacagcgttgacgtatattcgtgctgtctgatacagtggtatttatggaccaaaggttggttgaataaactagtcagtgtctttatttgtgaggtgtcaagtgtggtt

SEQ ID NO: 1667 - DNA, 865 bp, Sorghum bicolor
aagcaagtcgccccctggctcctgccggctgctgctatatatacctgctcggcgttgcgccatgtcatgccagccacaaacaaagcgtccaataatcggccggctaacaagtgtactacgttgcagctaataactgggtgtgtgttcctgcagtacacgttcgtgcgcgtgtgacacagagcgcattagagctcagaactgagatatacagatggaggcgaggaggagcagcgcagcgctggtgggcgtggccgtggtcgcgctgctggtggtgctcgtgcccgagacgtcccgcgcggagcggttcgtcgtcggcgacgcggcgcggtggacgtgggggtacaactacacggactgggtcatcaagaagggacccttcttccagaacgacaccctggtgttcatgtacgacccgccgaacgcgacggtgcacgcgcacagcgtctacctgatgcgcaacgccgcggactaccagtcgtgcaacctcaaggcggccaagctggtggccaacgtcatgcagggcgcgggctcagggttcgagttcgtgctcaagaagcgcaagcagcactacttcgtgtgcggcgagcgcggcggcatccactgcaccatggggaacatgaagttcgtcgtcaagcccaagagctccgcctgccgcgacgactgacctcgtcgtcgccggcgttttcatcgacccatcgacgccgatgtgtgtgtggtctttcgccttccttctctgcatgccaccttctgattcctcctgttcaattgttgcgcgtgcttgtaagttattgttaattggtggatttacacagcgttgacgtatattcgtgctgtctgatacagtggtatttatggaccaaaggtt

SEQ ID NO: 1668 - DNA, 750 bp, Saccharum officinarum
accgaacgaagcgtccaatcggcctgctaacgagtgtacgtagctaacgtgtttgtacgcgtgacatatatagagctcagaaagaactgagatagatggaggcgaggaggaggagcgcagcgctcgtgggcgtggccgtcgccgcgctgctggtggtgctcgtgcccgagacgtcccgcgcggagcggttcatcgtcggcgacgcggcgcggtggacgtgggggtacaactacacggactgggtcatcaggaagggacccttcttccagaacgacaccctggtgttcatgtacgacccaccgaacgcgacggtgcacgcgcacagcgtctacctgatgcgcaacgccgcggactaccagtcgtgcaacctcaaggcggccaagctggtggccaacgtcatgcagggcgccggctccggcttcgagttcgtgctcaagaagcgcaagcagcactacttcgtgtgcggcgagcgcggcggcatccactgcaccatggggaacatgaagttcgtcgtcaagcccaagagctccgcctgccgcgacgactgacccgcccggccgccggtgctgttgctgtcccgtcgaccgatcgacacctttcctcttcgttctctgcatgccaccttctggttcctcctgtcctgtccaatttgttgcgcgtgcttgtaagttattggtaattggtggatttacacaggggtgatgtattcgtgctctctgatacagtagtatttatggatgaaaaaaggtt

SEQ ID NO: 1669 - DNA, 906 bp, Setaria italica
aaacccaaggcgtccaatcagctcacaattgttgcagctaactgagtgcgcgcttggactcggagtacgtgtggtgtgacaggctagagctttgatctcttggttgaggtaagatcgatggcggaggcgaggagcggcgccgcgctcgtggccgcggcggccgtcgtcgcgctgctggtgctggcgctggcgcccgaggggtcccgggcggagcggttcatcgtcggggacgcggcgcggtggacgtgggggtacaactacaccgactgggtcatcaagaagggccccttcttccagaacgacaccctggtgttcatgtacgacccgccgaacgcgacggtgcacgcgcacagcgtgtacatgatgcgcaacgccgccgactaccagtcgtgcaacctcaaggcggccaagctggtggccggcgtcacgcagggcgccggctcgggcttcgagttcgtgctcacgaagcgcaagaagcactacttcgtctgcggggagcgcggcgggatccactgcaccatggggcagatgaagttcatcgtcaagcccaagagctccgcctgccgcgacgactgacctgcacaactggtgaccggccgtcgtcgtcgcaggcttcttctgcatgccgccttctgattcctctcctgttcaatcgttgttcgtgcttgtattaagttattaattgctgtacttacacggtgtcgtgtggtgtacctgtagtgtttggtatttatgcatgaatggttggctgaataaaggagtgtcttagtgagttgtaagttgtcgttaatttgtttcaggggagaatgtaatgagaattgaggaactacacgtagttgttgctttaagctgcctgctttactgctttgtttcgactgaacatcagactcagtcaaattacatcag

SEQ ID NO: 1670 - DNA, 894 bp, Pennisetum glaucum
aaacccaggcgtccaatcagctagctaacaagcggtgttgcagctagctcagtgcgcgcttggggctttggactcggagtacgtgtggcacaccatctccatccagagcttttttgttggttgaggtgagagcctgagatcatcgatggcggcggcgaggagcggagccgcgctcgtggccgtggcggccggcgtcgcgctgctggtgctggcgctggcgcccgaggcgtcccgcgccgagcggttcgtcgtcggggacgcggcgcggtggacgtgggggtacaactacaccgactgggtcatcaagaagggccccttcttccagaacgacaccctcgtgttcatgtacgacccgccgaacgcgacggtgcacgcgcacagcgtgtacatgatgcgcaacgccgccgactaccagtcgtgcaacctcaaggcggccaagctggtggccggcgtcacgcagggctccggcgccggcttcgagttcgtgctcaggaagcgcaagaagcactacttcgtctgcggggagcgcggcgggatccactgcaccatggggcagatgaagttcatcgtcaagcccaagagctccgtctgccgcgacgactgacctggacgcctgtgctggcacggtgaccggccgccagagtccggtctgccgccgccgctgccttcttctgcatgccgccttctgattcttgttcaatcgttgttcgtgcttgccttgtactaaactattataagttattaattgctgtacttacacggtgctgtgtggtgtacttgtagtgtctggtatttatgaatgaatcgttggctgaataaaggagtgtgttagtgacttgtcaagtggtgttaatttgtttcaggggagaatgtaatgagaattgaggaattcac

SEQ ID NO: 1671 - DNA, 1045 bp, Oryza sativa
gggtgtgggtcaactttgcgacatcattacgtccccaaagctacctgcagcttggctatcctatttataccagcatgctcgatctcgatcgccatgtcattgctcatcacaagcatctccatccattcatccagttaattaattagctaagctagctttgccggagactgaagagaatttgttggttaattagagtgaggatttcgttgggatcgatggaggggaggattagcagtgcaacgctggtggtggcagcggtgttggcgatgctggtgctggtgccggcggcggcgcgcgccgagcggttcgttgtcggcgacgcggcgcggtggacgtggggttacaactacaccgactgggtcatcaagaagggccccttcttccaaaacgacagccttgtgttcatgtacgacccgccgaacgcgacgacgcacgcgcacagcgtgtacatgatgcggaacgcggcggactaccagtcgtgcaacctcaaggcggcgaagctggtggccaacgtgatgcagggcgccgggtcgggctacgagttcgtcctccggaagcgcaagccccactacttcgtctgcggcgagcgcggcggcatccactgcaccatgggccagatgaagttcatcgtcaagcccaagagctccgcctgccgcgacgactgacccggcccccgcccacccctctccgccgccggccgccggccgccgccaccgagatgttgggttggtcgccgccggccatggtgcggctgctagcctacgtcgatcttcttcttcttctgcatgccaccttctgggagttctggttcgatatcagaacatcattgtgctttgataatattgtaagttattaattgcaatatatactatatgtctaattgtgttgcgttgcgtgtggtgtatttgtatgggtcattcggttgaaataaacgatcgagggattaattgtactgcgcatgttcgtggcgtgtgttgatttttgtatatatgcagtcgctttgtctcactgtcacgggtatccttcaacgcactttctttagcta

SEQ ID NO: 1672 - DNA, 920 bp, Oryza sativa
atgtcattgctcatcacaagcatctccatccattcatccagttaattaattagctaagctagctttgccggagactgaagagaatttgttggttaattagagtgaggatttcgttgggatcgatggaggggaggattagcagtgcaacgctggtggtggcagcggtgttggcgatgctggtgctggtgccggcggcggcgcgcgccgagcggttcgttgtcggcgacgcggcgcggtggacgtggggttacaactacaccgactgggtcatcaagaagggccccttcttccaaaacgacagccttgtgttcatgtacgacccgccgaacgcgacgacgcacgcgcacagcgtgtacatgatgcggaacgcggcggactaccagtcgtgcaacctcaaggcggcgaagctggtggccaacgtgatgcagggcgccgggtcgggctacgagttcgtcctccggaagcgcaagccccactacttcgtctgcggcgagcgcggcggcatccactgcaccatgggccagatgaagttcatcgtcaagcccaagagctccgcctgccgcgacgactgacccggcccccgcccacccctctccgccgccggccgccggccgccgccaccgagatgttgggttggtcgccgccggccatggtgcggctgctagcctacgtcgatcttcttcttcttctgcatgccaccttctgggagttctggttcgatatcagaacatcattgtgctttgataatattgtaagttattaattgcaatatatactatatgtctaattgtgttgcgttgcgtgtggtgtatttgtatgggtcattcggttgaaataaacgatcgagggattaattgtactgcgcatgttcgtggcgtgtgttgatttttgtatatatgcagtcgctttgtctcactgtc

SEQ ID NO: 1673 - DNA, 521 bp, Setaria italica
cgtggccgcggcggccgtcgtcgcgctgctggtgctggcgctggcgcccgaggggtcccgggcggagcggttcatcgtcggggacgcggcgcggtggacgtgggggtacaactacaccgactgggtcatcaagaagggccccttcttccagaacgacaccctggtgttcatgtacgacccgccgaacgcgacggtgcacgcgcacagcgtgtacatgatgcgcaacgccgccgactaccagtcgtgcaacctcaaggcggccaagctggtggccggcgtcacgcagggcgccggctcgggcttcgagttcgtgctcacgaagcgcaagaagcactacttcgtctgcggggagcgcggcgggatccactgcaccatggggcagatgaagttcatcgtcaagcccaagagctccgcctgccgcgacgactgacctgcacaactggtgaccggccgtcgtcgtcgcaggcttcttctgcatgccgccttctgattcctctcctgttcaatcgttgttcgtgctt

SEQ ID NO: 1674 - DNA, 2327 bp, Setaria italica
tccgcccccgcgcgcgcgccatggtgttcgacgcgggcgccggcagctcgccggcggcggcggcgccgtcggggaaccccctgcgcgtgatcctgacgcgcgggttcgcgcggcaggtgctggtgggccggtggttcacggtgttcgcgagcctgctcatcatggcggcgtccggggcgacctacatcttcgggtcctactccggcacgctcaagtcgtcgctggagtacgaccagcacacgctcaacaccgtctccttcttcaaggacctgggcgccaacctgggcgtcttctcggggctcatcaacgaggtcaccccgccctgggtcgtgctcgccatgggcgccaccatgaacctctccggctacctcatggtctacctcgccgtgtccggccgcacggcgcgcccgcccgtgtggctcgtctgcctctacttcttcatcggcgccaactcgcagtcgttcgccaacacgggggcgctcgtcacctgcgtcaagaacttcccggagagccgcggcgtggtgctcgggatcctgaaggggttcgtcggcctcagcggcgccgtgtacacgcagctgtacctcgccttctacggcggcgacgacgccgagtcgctgatcctcctcatcgcgtggctgcccgcggcggtgtccgtcgtgttcgtgcacaccatccggtacatgccgtacccgcgccgccgcggcgggcaggagacgagcccggaccccttcttctgcttcctctacctctccatcgcgctcgcgtccttcctcctcgtcatgatcgtcgtgcagaagcaggtccccttctcccgcgaggcctacggcctcgccgccacgccgctgctcatcctcctcctcatgcccctcggcgtcgtcgtcaagcaggagtacaagatcttccgcgagaggcagctcgacgccgccctcctcgccgccggcccgccgcccaccattaccgtcgccggcgccgccaacgacaacattcagatgtcaacggacaccaagaaaacagagcagcagcagccggcgccgccgacgtcgacctcctcatcttgtttggggaggttcggcgggtgtgtgaggaccatgttccggccgccggcgcgcggcgaggactacacgatcctccaagccctggtgagcgtggacatgctggtcctcttcgtggcctccatctgcggcgtgggcgggacgctgacggcgatcgacaacatgggccagatcggccaatccctgggctacccatccaagagcatcaacaccttcgtctccctgatcagcatctggaactacgccggccgcgtgaccgcccgggtacgcctcggaggccgtcctcgcccgctaccgcttcccgcgccccctcctcctcacgctcgtcctcctcctcgcctgcgccggccacctcctgatcgccttcggcgtcccccagtccctctacgccgcctccgtgatcatcgggttctgcttcggcgcgcagtggccgctggtgttcgccgccatctccgagatcttcgggctcaagtactactccacgctctacaacttcggcggcatggcgagccccgtggggtcctacatcctcaacgtgcgcgtcgcggggcggctctacgacgccgaggccgcgcggcaggggaacgtcgttggcgtcggcgcgggggggacgaagcacgagagggtgtgcctcggggtggagtgcttcaagaggtcgttcctgatcatcacggcggcgacggtggtcggcgcggcggtgtcgctggtgctggtgtggcggacctgggggttctacaagggggacatctacgcgaggtttcgtgaggaggccgccggcggcggggaggggcggggacaggtcgacgggcgcctgccggtcgggcagccgcggcggcgggtggaagctgcggcggaggaggaagaggaccgcgaggcaggagcggtcaacagcaggaaagggtgagcgggactgcgggagcaagagcaagtagcgggatgccagctcggatgcttgactcggtcaaaggtgacactggtgggtgtttgactgtttgggctccgctttctacggctaagactgctgacgtggagggcagcagtaggacccgccggagcgggcgtgtgaggcagttggtcactccgtccgtccacactacacgagtatgctgtgctttacagaagccgttgaaatctccgtccgtccacacttcacgagtatgctgtgctttacagaagccgttgaaatcttacggctgatgctgagcagccttttataagaacgatgacaagtgggggccatccggccatacatgtacatatacatatacatccctg

SEQ ID NO: 1675 - DNA, 2016 bp, Zea mays
acacacacccaacagacaccaaccagcgcccatcagtcacccgcgccggacatccctcgcgctagctgccagtcgtcgtcgccacgccaccatggtgttcgccgcgagcggcggcagctcgccggcgacggcggcgccggggagcgctctgggcgtgatcctgacgcgcgggttcgcccggcaggtgctggtggggcggtggttcacggtgttggcgagcctgctgatcatggcgtcgtccggcgcgacgtacgtcttcgggagctactcgggcgcgctcaagtcgtcgctcgggtacgaccagcgcacgctcaacacggtgtccttcttcaaggacctcggcgcgaacctgggcgtcctcccggggctgctcaacgaggtgacgccgccgtgggtggtgctggccacgggcgccggcatgaacctgttcggctacctcatggtgtacctggccgtgtcggggcgcaccgcgcgcccgccgccgtgggccgtgtgcgcctacttcttcgtgggcgccaactcgcaggcgttcgccaacacgggcgcgctcgtcacgtgcgtcaacaacttccccgagacccgcggcgtggtgctcggcatcctcaagggattcgtcggcctcagcggcgccgtgtacgcgcagctgtaccaggcgctgtacggcggcgaggacgccgagtcgctcatcctgctcgtcgcctggctccccgcggccgtgtccgtcgcgttcgtccacaccatccgctacatgccgtacccgcggcggcggcgcagcggcggcggcggtgggcaggagacgagctccgaccccttcttctgcttcctctacctgtccatcgcgctggcgtgcttcctcctcgtcatgatcgtggtgcaggggcaggtgcccttctcccgcgccgcgtacggggtcgccgccgcgccgctgctcatcctcctcctcatgcccctcggcgtcgtcgtcaagcaggagtacaagatctaccgcgagcgccagctggacgccgccgccgacccgccccctaccatcgccgtcgtggacgccggcgctccaccagtaccgtccagcgtccagatgtcatcagcagccgccaccgccgccgttgaggagacagagcagcagcagcaggcggcgacgtcgagcgcgtcgtcgtcgtgttgcctggggtcgttgggtggttggggcgtgaggaccatgttccggccgccggcccggggcgaggactacacgatcctgcaggcgctggtgagcgtggacatgctggtgctgttcgtggcgaccacctgcgggatgggcggcacgctgacggcgatcgacaacatggggcagatcggcaagtcgctggggtacccggcgaagagcgtcaacacgttcgtctccctgatcagcatctggaactacgcggggcgcgtggccgccgggtacgtgtcggaggcggcgctggcgcggcaccgcgtgccacggccgctgctgctgaccggggtgctgctgctggcgtgcgcggggcacgcgctgatcgcgctgggcgcgccgcggtcgctgtacgcggcgtcggtggtcgtcgggttctgcttcggcgcgcagtggccgctggtgttcgccatcgtctccgagctgttcgggctcaggcgcttctccacgctgcacaacttgggcggcctggccagccccgtggggtcgtacatcctgaacgtgcgcgtggcggggcggctctacgacgcggcggccgcgcggcagcgcggcgggagcgggagggtgtgcctcggggtcgagtgctacaggcggtcgttcctcatcatcacggcggccacggcggcgggcgcgctggtgtcgctggtgctggtgtggcggacgtggcggttctacaggggcgacatctacgcccggttccgggatggcgacgggcgcctgccggtggaccggcagcaggaggagagggagaaggcgacagcggccaacggtaggtaggaagggatgatgaggcagagcggagagcgggagaggaggaggccagc

SEQ ID NO: 1676 - DNA, 2545 bp, Sorghum bicolor
ataattcagacataaacacacatccaacagacaccaaccaacgcccatcacccgcgccggacatcctgctcccccgggcgcgcacgggcgagcgctagctgccagcagtcgtcgcgcgccaccatggtgttcgacgcgagcggcagcagctcgccagcgacggcgccgccgccgtcggggaaccctctgggcgtgatcctgacgcggcggttcgcgcggcaggtgctcctgggccggtggttcacggtgttcgcgagcctgctcatcatggcggcctccggcgcgacgtacatcttcgggagctactccggcacgctcaagtcgtcgctcgggtacgaccagcgcacgctcaacacggtctccttcttcaaggacctcggcgccaacctgggcgtcttctcgggcctcatcaacgaggtgacgccgccgtgggtggtgctggccatgggcgccggcatgaacctcttcggctacctcatggtgtacctcgccgtgtcgggccgcacgtcgcgcccgccgctgtggctggtgtgcctctacttcttcgtcggctccaactcgcagtcgttcgccaacacgggcgcgctggtcacctgcgtcaagaacttcccggagagccgcggcgtggtgctgggcatcctcaagggcttcgtcggcctcagcggcgccgtgtacacgcagctgtaccaggcgctctacggcggcgacgacgccgagtcgctgatcctcctcatcgcgtggctccccgccgcggtctccgtcgtgttcgtccacaccatccggtacatgccgtaccctccgcggcggcggcggcggcgcggcggcggcggcggaggagggcaggagacgagctccgacccgttcttctgcttcctctacctgtccatcgcgctggcgtgcttcctcctcgtcatgatcgtggtgcagcatcaggtccccttctcccgcgacgcgttcggcgtcgccgccacgccgctgctcatcctcctcctcatgcccctctgcgtcgtcgtcaagcaggagtacaagatctaccgcgagcgccagctcgacgccgccgaccccacgccgcccaccatcaccgtcgacgacggtggtgccggtactgctcctcctccaccaccaccatcatcatcatccagcgtcctccagatgtcagcagcagcaacggacgacaccaccaccaccaccaccaagaaaacagagcagccgtcctcgtcgtcgtcttgcctggggtcgttgggcaagtgcgtgcggaccatgttccgtccaccacctcgcggcgaggactacacgatcctacaagcactagtgagcgtagacatgctcgtcctgttcgtggcgaccatctgcggcgtgggcggcacactaacggcgatcgacaacatggggcagatcggggagtcgctgggctacccatccaagagcatcaacaccttcgtctccctcatcagcatctggaactacgccggccgcgtgaccgccggctacgcctcggaggccgtgctggtccggtaccgcgtgccacgcccggtgctcctgacggcggtgctcctgctggcgtgcgcggggcacgtggtgatcgccctgggcgtcggcaacgggctgtacgcggcgtcggtggtcatcgggttctgcttcggcgcgcagtggccgctcgtgttcgccatcatctccgaggtgttcgggctcaagtactactccacgctctacaacttcggcggcatggccagccccgtcgggtcgtacatcctcaacgtgcgcgtcgccgggaggctctacgacgccgccgccgcgcggcagcgtaacggcgccggtggaggagggaagcacgacaagctgtgcctcggggtggagtgctataagaggtccttcttgatcatcacggcggcgacggtggccggcgcggccgtgtcgctggtgctggtgtggcggacgtggaggttctacaggggcgacatctacgcgaggttccgggacggcgacggcggcgagggcgagggcacgggaaaggacgggcggctgccggtggaccggcggggggtgggagaggaggaggaggaggaggaggaggagagggagaaggcggccaatggcaggaaggggtgagccggtgaggtggcggagcgggaggggaaggaaggcccacagctcgggtgtgttgacttggtcgacgcagatgcggtggcttgattccactggcgggtttgactcggggctccgtttcccaggggccacggctaggtagatgctgaagcagtgaagcgggagcctagtagtagtagtacatacacgtcctccttggtgaaacgcacagtactcctactactgtcgtgctgtacaaaagtacaaaagctaaaatatactactagaaaagcacgtatacggcgtggaaggccactcttggaagaatgacgagtggggtctactagtgttgcattcacccgtgatgactgatgatgggaacacaacaggtactagtatactcctctgtcctagtatataaggcataactacttcgggttcaaagaccaagaatacattt

SEQ ID NO: 1677 - DNA, 3937 bp, Sorghum bicolor
ggaatagattcttaaacagttaaacctgttttttttttaaaaaaaaaatctctgctacaggtgtaaggaaatcccctagctgtattccttactccatggtctacggcgcccaaaaattctttcagacgttagcgtagttctagatataaaacattgcacctttctcaagatccaaattttcaatttggcagttcatcctaacctcctacctcaagataataacagtgtgaaagagacataacacactaacacagcacgcctcaagcccgtcactcgatccacactcctttctccctcaatcagctccttaaatacaacagcaagtgtgtgtgtaaacaagctcataataattcagacataaacacacatccaacagacaccaaccaacgcccatcacccgcgccggacatcctgctcccccgggcgcgcacgggcgagcgctagctgccagcagtcgtcgcgcgccaccatggtgttcgacgcgagcggcagcagctcgccagcgacggcgccgccgccgtcggggaaccctctgggcgtgatcctgacgcggcggttcgcgcggcaggtgctcctgggccggtggttcacggtgttcgcgagcctgctcatcatggcggcctccggcgcgacgtacatcttcgggagctactccggcacgctcaagtcgtcgctcgggtacgaccagcgcacgctcaacacggtctccttcttcaaggacctcggcgccaacctgggcgtcttctcgggcctcatcaacgaggtgacgccgccgtgggtggtgctggccatgggcgccggcatgaacctcttcggctacctcatggtgtacctcgccgtgtcgggccgcacgtcgcgcccgccgctgtggctggtgtgcctctacttcttcgtcggctccaactcgcagtcgttcgccaacacgggcgcgctggtcacctgcgtcaagaacttcccggagagccgcggcgtggtgctgggcatcctcaagggcttcgtcggcctcagcggcgccgtgtacacgcagctgtaccaggcgctctacggcggcgacgacgccgagtcgctgatcctcctcatcgcgtggctccccgccgcggtctccgtcgtgttcgtccacaccatccggtacatgccgtaccctccgcggcggcggcggcggcgcggcggcggcggcggaggagggcaggagacgagctccgacccgttcttctgcttcctctacctgtccatcgcgctggcgtgcttcctcctcgtcatgatcgtggtgcagcatcaggtccccttctcccgcgacgcgttcggcgtcgccgccacgccgctgctcatcctcctcctcatgcccctctgcgtcgtcgtcaagcaggagtacaagatctaccgcgagcgccagctcgacgccgccgaccccacgccgcccaccatcaccgtcgacgacggtggtgccggtactgctcctcctccaccaccaccatcatcatcatccagcgtcctccagatgtcagcagcagcaacggacgacaccaccaccaccaccaccaagaaaacagagcagccgtcctcgtcgtcgtcttgcctggggtcgttgggcaagtgcgtgcggaccatgttccgtccaccacctcgcggcgaggactacacgatcctacaagcactagtgagcgtagacatgctcgtcctgttcgtggcgaccatctgcggcgtgggcggcacactaacggcgatcgacaacatggggcagatcggggagtcgctgggctacccatccaagagcatcaacaccttcgtctccctcatcagcatctggaactacgccggccgcgtgaccgccggctacgcctcggaggccgtgctggtccggtaccgcgtgccacgcccggtgctcctgacggcggtgctcctgctggcgtgcgcggggcacgtggtgatcgccctgggcgtcggcaacgggctgtacgcggcgtcggtggtcatcgggttctgcttcggcgcgcagtggccgctcgtgttcgccatcatctccgaggtgttcgggctcaagtactactccacgctctacaacttcggcggcatggccagccccgtcgggtcgtacatcctcaacgtgcgcgtcgccgggaggctctacgacgccgccgccgcgcggcagcgtaacggcgccggtggaggagggaagcacgacaagctgtgcctcggggtggagtgctataagaggtccttcttgatcatcacggcggcgacggtggccggcgcggccgtgtcgctggtgctggtgtggcggacgtggaggttctacaggggcgacatctacgcgaggttccgggacggcgacggcggcgagggcgagggcacgggaaaggacgggcggctgccggtggaccggcggggggtgggagaggaggaggaggaggaggaggaggagagggagaaggcggccaatggcaggaaggggtgagccggtgaggtggcggagcgggaggggaaggaaggcccacagctcgggtgtgttgacttggtcgacgcagatgcggtggcttgattccactggcgggtttgactcggggctccgtttcccaggggccacggctaggtagatgctgaagcagtgaagcgggagcctagtagtagtagtacatacacgtcctccttggtgaaacgcacagtactcctactactgtcgtgctgtacaaaagtacaaaagctaaaatatactactagaaaagcacgtatacggcgtggaaggccactcttggaagaatgacgagtggggtctactagtgttgcattcacccgtgatgactgatgatgggaacacaacaggtactagtatactcctctgtcctagtatataaggcataactacttcgggttcaaagaccaagaatacatttaattctctctcacagcaagcactagtagtactgtatttatgtttgtgagagagcacgccttatattataggacatgagcaaaaattggttacgccttatatactaggacgggacggagggattaacaccgtcggtccagtcgaaatccatggtcatggtgccctgcgtgctccagccgtccaggtcggtgggaacggatggcgccgtgcaaccaactccttgcgtgctgtgcgcaggtcgggcaagtgatggcccgtgtcctgtcgacagcaaccacaggaggccccgggtctttgtcgcgtagtactggtctttgccccgggtctttggtgctcagcaccacgtagcacgccgcacccgcacggaccgtgctgtgcgtcacgcgtaccgtgcgggccggatacggtgggggagcctgatccacctccagatctctcttcgcctgactggcccggccggagtgctggaccactctagtacggtatgcacacgccacgccaccgccaccgcggacggatgtcttccaagtctttattttaaccctaattttacttagtaagtactaatcatcactaccaggtttacatagacggcgcccaacctgcgtgtactgtagacgccatgccaagacaccccatacgaagacgaagacaaacgcaaagcttcgattcgtgaagcgctacagattccatatttccattccatgggggaccaaagttagccagccaactcgcttgcgcacacgtcccagtcccagtccggccccagcggctttgaatacgccatgtgcatcgcaccggatcgacacatataggaggagtacctgtactattccacaaccacaagcctgctgctccaacattttcattttcacgcatgggccgcttatctagttggtggtgatgatcgaggctttctttagttccaaattttttggaaaatcgataccgtagcactttcgtttgtatttgacaaatattatccaatcatagactaactagtcttaaaagattcgtctcgtcaattccaaccaaactgtgtaatta

SEQ ID NO: 1678 - DNA, 2095 bp, Sorghum bicolor
tcttccgccccaccagaccatcaccaccaccctccggctgctacttttgccgtctccaccgcccttctccaaagccccaaccgactgccgcgttccctcccaaacgcatcccctcctctcctccagtgacagcctccttcctaagcctgcgcctcctcgggctccccccctccagcccgtgccactgcacttgctgtgccgacccgagctgcggtcgagtgagtgagtaatggagccgcggcggcggcggccaccgaggctgccgctccatgtgctcttcttggttgccgctgcttggccgctcgggagctcagggactggaagctttggagttggtgctgagagcaatggagcttcgtctagttttaggaattcaaggagactgcagcagattggagacagaaacgaagatggcctatttcatctcccacatccacggactctcacgcacaagagcagatctcatagaagagttccagcaccagcaccagcaccagcatctgctccagcaccatcaccatccatgtcgtcaccagaaggctcaccgtctccatcaccacatggttcacaatcaatgccacgtcaatcaacttcgcatcgtcatccatccgtggcccctccacatttggtcaggcctgagcctaggcaagatgaaaatgatccaatagttgatactccacctcattctcgtcataagaattcctggacaacctatggtttagttgcagcggggattgctgttttccttttggtatcagcagctagtattctctgcttccgagctaagaaaatgggaactgtgaggccatgggcgacaggtctaagtggacaattgcagaaagcttttgtaactggtgtaccttcgctgaaacgatcagagttggaaacggcatgcgaggatttcagcaatataattggctctacctctacctgcatgctgtacaagggaactttatctagtggagttgaaattgcagtggcttcaagcttggtaacatctgcaaaggattggtcgaaagaaaatgaatcacagtacaggaaaaagatcacgagcttgtccaaagtaagtcacaaaaattttatgaacttgcttggctactgtgaggaagagcatccctttaccagggtgatggtatttgaatatgctccaaatgggacactttttgagcatctccatgtcagggaagcagagaagcttgactggatggcacggctcaggatatccatgggcattgcttactgtcttgagcacatgcatcagctgaaaacaccacttgtgctgaggaactttgactcaactacagtataccttactgatgacttcgctgcaaaagtctcagatcttgaattttggaatgatgcaaagggatataattcaaccaacaatgaactggctttctccctggacctggagaacattgtgcacaagtacggcatggtgttgctggagatattgacaggaaaagttccttgttctgaggatgatgggccactggaaaactgggcgtctcgctattttgaaggtgagatgcgtcttgaggagttgattgactctagcatcggtttcttccccgaagacactgcacgtgccctttgtgaggttgtaagatcctgcattgatcgggatccaaagaagagaccgcagatgcaagaggttgcagctcggatgagagagatcaccgcgttggggcctgatggggcgactccgaaggtgtcaccgctctggtgggctgagcttgagatcatgtcttctgagagctgagtttggacgcatgccagatgatattgtttctcctagtgtgactgagaattctttgagctattggttgctgctaatcttgtttgtggaattggtgattaggtagaagaagttgagaatttgttatgtgtgcaaaattgcatatagggagtggtattgtacttgtacatgtcaggaaggttaacattacaacatactgatatgcaggcattctagccgagtgagcaatagaaagcatgtgtggcttgtttttgctgcaatagctcttttgtcaagcaattggtactggtatcgccttaatctattgaggttgaaatagcaaatccttatggctca

SEQ ID NO: 1679 - DNA, 2250 bp, Sorghum bicolor
gccgcctcctttccttctccacctcttccgccccaccagaccatcaccaccaccctccggctgctacttttgccgtctccaccgcccttctccaaagccccaaccgactgccgcgttccctcccaaacgcatcccctcctctcctccagtgacagcctccttcctaagcctgcgcctcctcgggctccccccctccagcccgtgccactgcacttgctgtgccgacccgagctgcggtcgagtgagtgagtaatggagccgcggcggcggcggccaccgaggctgccgctccatgtgctcttcttggttgccgctgcttggccgctcgggagctcagggactggaagctttggagttggtgctgagagcaatggagcttcgtctagttttaggaattcaaggagactgcagcagattggagacagaaacgaagatggcctatttcatctcccacatccacggactctcacgcacaagagcagatctcatagaagagttccagcaccagcaccagcaccagcatctgctccagcaccatcaccatccatgtcgtcaccagaaggctcaccgtctccatcaccacatggttcacaatcaatgccacgtcaatcaacttcgcatcgtcatccatccgtggcccctccacatttggtcaggcctgagcctaggcaagatgaaaatgatccaatagttgatactccacctcattctcgtcataagaattcctggacaacctatggtttagttgcagcggggattgctgttttccttttggtatcagcagctagtattctctgcttccgagctaagaaaatgggaactgtgaggccatgggcgacaggtctaagtggacaattgcagaaagcttttgtaactggtgtaccttcgctgaaacgatcagagttggaaacggcatgcgaggatttcagcaatataattggctctacctctacctgcatgctgtacaagggaactttatctagtggagttgaaattgcagtggcttcaagcttggtaacatctgcaaaggattggtcgaaagaaaatgaatcacagtacaggaaaaagatcacgagcttgtccaaagtaagtcacaaaaattttatgaacttgcttggctactgtgaggaagagcatccctttaccagggtgatggtatttgaatatgctccaaatgggacactttttgagcatctccatgtcagggaagcagagaagcttgactggatggcacggctcaggatatccatgggcattgcttactgtcttgagcacatgcatcagctgaaaacaccacttgtgctgaggaactttgactcaactacagtataccttactgatgacttcgctgcaaaagtctcagatcttgaattttggaatgatgcaaagggatataattcaaccaacaatgaactggctttctccctggacctggagaacattgtgcacaagtacggcatggtgttgctggagatattgacaggaaaagttccttgttctgaggatgatgggccactggaaaactgggcgtctcgctattttgaaggtgagatgcgtcttgaggagttgattgactctagcatcggtttcttccccgaagacactgcacgtgccctttgtgaggttgtaagatcctgcattgatcgggatccaaagaagagaccgcagatgcaagaggttgcagctcggatgagagagatcaccgcgttggggcctgatggggcgactccgaaggtgtcaccgctctggtgggctgagcttgagatcatgtcttctgagagctgagtttggacgcatgccagatgatattgtttctcctagtgtgactgagaattctttgagctattggttgctgctaatcttgtttgtggaattggtgattaggtagaagaagttgagaatttgttatgtgtgcaaaattgcatatagggagtggtattgtacttgtacatgtcaggaaggttaacattacaacatactgatatgcaggcattctagccgagtgagcaatagaaagcatgtgtggcttgtttttgctgcaatagctcttttgtcaagcaattggtactggtatcgccttaatctattgaggttgaaatagcaaatccttatggctcaatctttcaaaaattatggcaaatgttagtccaaaaatgaaaagtaaacagcaatgtttactgatgttgaatggcaaatccttattgtccaatcttcaaaaaattatggcaaatgttagcccaaaaacgaaaa

SEQ ID NO: 1680 - DNA, 471 bp, Sorghum bicolor
attttttttcccccgcgcagaaggttccggaagcaagagacgcttccggatacaaggcgttccgttctctccagctgtataaattccgtccccaccctggcctctcccgcacggctgccggcctcacgttttcttgccctgcttccagaggcttcctccccccaccactccccactctcccagtcagcccgcgtccccgtctctctccctcccttcctcccaacacagttgagaagtcagcacaatgactcgcggcgaccagagggagcgcgaccggcagagggcgcaggcgcggcggcccgcggccaaggggcgcgacgacgggctcacgccggagcagcggcgggagcgggacgccaaggcgctgcaggagaaggctgccaggaaggcggcgcaggccgcggggggcggcgccgacgccaagggcggcaagaacgccaaaggcaagaagtagtagccggggtctccgga

SEQ ID NO: 1681 - DNA, 529 bp, Sorghum bicolor
tttcttgccctgcttccagaggcttcctccccccaccactccccactctcccagtcagcccgcgtccccgtctctctccctcccttcctcccaacacagttgagaagtcagcacaatgactcatatccttggccacacatgattttcttgtccccctctgttttttttttttcctgtcgttctatcgattcttgcaggggcttttcttttcgtctctgccagattctttttccttttgatattttctgttgtaaagtagaagtagaaccggtgtgtttcggatgacgttgctgtttttgtccttgacctgagctggcgggctgcacgcggcgaccagagggagcgcgaccggcagagggcgcaggcgcggcggcccgcggccaaggggcgcgacgacgggctcacgccggagcagcggcgggagcgggacgccaaggcgctgcaggagaaggctgccaggaaggcggcgcaggccgcggggggcggcgccgacgccaagggcggcaagaacgccaaaggcaagaagtag

SEQ ID NO: 1682 - DNA, 759 bp, Sorghum bicolor
gcacggctgccggcctcacgttttcttgccctgcttccagaggcttcctccccccaccactccccactctcccagtcagcccgcgtccccgtctctctccctcccttcctcccaacacagttgagaagtcagcacaatgactcatatccttggccacacatgattttcttgtccccctctgttttttttttttcctgtcgttctatcgattcttgcaggggcttttcttttcgtctctgccagattctttttccttttgatattttctgttgtaaagtagaagtagaaccggtgtgtttcggatgacgttgctgtttttgtccttgacctgagctggcgggctgcacgcggcgaccagagggagcgcgaccggcagagggcgcaggcgcggcggcccgcggccaaggggcgcgacgacgggctcacgccggagcagcggcgggagcgggacgccaaggcgctgcaggagaaggctgccaggaaggcggcgcaggccgcggggggcggcgccgacgccaagggcggcaagaacgccaaaggcaagaagtagtagccggggtctccggatttgtgcaggaggtttcgtttctcctcctgatctggcgaaattggttgggtttgtcttggcagttggtgattgtgagaaagctgtgtgttcgtgctggaacttgtaggaagatctgtattgcttggatctggaaaatctggaatgcaatgcgattttattggtgttgtcactttgccttgcaagtgttctgc

SEQ ID NO: 1683 - DNA, 558 bp, Panicum virgatum
gatctcccctccttctagacgcttcctccctcctctctctgactctatcgtctcactacagtacaacttaaagaagtcagcacgatgactcgcggcgaccagcgggagcgggaccggcagagggcgcaggcgcggcggccggtggccaaggggcgcgacgacgggctcacgccggagcagcggcgggagcgggacgccaaggcgctgcaggagaaggcggccaggaaggcggcgcaggccgcgggaggcggcgacgccaagggcgcgggcaagaacgccggcaagtagccggtgtcgccggatccggcgttgtgttgtagcggctaggtggtggaatctctgttcatgttgcaagatctgtgtgttccgtggatctagaaaaaaaaatcggaagtgggatgcgatttcttcagtgttggcgcttgcttcgcccagaacatgcattttgcaaaagcacagcaataacggctgatcaggccctgtttggttctcctactatcttactatgatattttgaccattaattattagtattaaataaaagtaatttgtaaaatt

SEQ ID NO: 1684 - DNA, 2468 bp, Setaria italica
caagcctttgagtctgcatatcggtgggcatttgcagagaaaatcgacaaaagacatcagtaggaaccaatgggttacggcatgagtaggctagaagatgaatactatgagcctgaagggcaggatgctgatggatctagttcagatcaagtgaatgatgagttctcaaaattacataacgatattttccatatgactcgaatgagatcaggacttagtgaaagcatttacaagtccgtgggtgccaacagaggcataatatcaacagccaagttgttatctggaagggaggttgattgttctggaaagggaaagttctcttcaggtgaccgtgcatttgttcttggtcgctatgttccaatgaacggtcctgaattgttggataggatggattctcgtgcttatgtttcacagttttctgctgatggtactctttttgttgctggttttcagggaagtcatataagaatatatgatgttgacagagattggaggatacacaaggacattcatgctagaaatttgagatggacaatcagtgatgtatccttatcacctgatcagcgatatcttgtctactctagtctagcacctattatccatattgtcaatgttgggaatgctgcaagagaatcctatgctaatgtcactgacattcatgatggattggatttttcacagcatgaagatgttcaatattcatttggaatattctctgtgaaattctcctctgatggccgggaacttgttgctggcagcaatgatgaatcaatatatgtctatgacctgcatgcaaacaaattgacattgcgtttacctgctcatacatctgatgtcaacacagtagcatttgctgatgaaagtggccatctcatatattctggaagtgacgacactttatgcaaagtctgggacagacgatgtttgtctgcaggacaagctgccggagttttgtctggacatttgcatggggtaacacatattgatagccgtggagatggccgaagtttcatatccaatggaaaggaccaagcaatcaaattgtgggacattaggaaaatgatgtctaatgctgatagttgtgcagatgatgcccccacttgggactacagactttcgaggtatccacagcagaataaacaattaaagcatccccatgatcagtcattagctacataccggggtcattcagtcctccgcacattgatccgttgctacttttctcctgcgtatagcacggggcaaaagtacatatatacaggatcatatgattcgagcatttacatctatgatgtggtaagcggatcgcaagtagcgaaacttaaagggcatcaaacggcgattcgagactgcagctggcacccatttgaacccacgcttgtgagctcatcctgggacggccgggtcgctaaatggaccggtgcccgtgacgagaagagttctgatgtcgattgagcctagtgtgcagtgatcagcaatacttcgtggtctgcgaaaacatacgcaatcttatatacgggaaaactaagaatagctcttcaaaacaacagaaggatcatgtgttgtaaattgtaaatactgaacacagaaaccatgttgagtgcataagcactactgtgtcctcttaaatactctgcataaaaagcttcctgtccctacggacgtgtgtcctcttaattgtcgatgttccgctgattatttggttcttagatcatcggaagctcatcctttctgtaaatgaattttcatggggtcgtccttttgtaaatgaaaattaccttagcatatcttttgatgggaatgcggcaagtaatcggtattctaacccggtagatgcaaggcgaacaccgacgaaacctaattccattccagatttttccatatccaagcaacacagatcttccaacacggacagagagagatttcatcgtctatccgctacgacaccacgcaattttaacagatccggcgacaccggctaaacccgatgcctcctctctaaatctgaagatccccggctacttcttgacgccgttcttgccggcgcccttgccgcccttggcgtcggcgccccccgcagcctgcgccgccttccttgcagccttctcctgcagcgccttggcgtcccgctctcgccgctgctccggcgtgagcccgtcgtcgcgccccttggccaccggccgccgcgcctgcgccctctgccggtcccgctcccgctggtcgccgcgtgcagccccccgctcaggtcaaggacaacaccatccaaaaacacaccgaaacaaaaggaaagaaaaaaaaagattctaccaagatctaaggataacagaacaagaagatgaaaatccaaagagagagagagaaattctacgcatggtgtggtggaggatatgagtcattctgctgacttctgaactgtagagagagaaggaagatgcgtgtgaatggcgaggaagcgtctagacgcaagg

SEQ ID NO: 1685 - DNA, 668 bp, Panicum virgatum
cacgatctcccctctgcttctagacgctccccctccttgctctcttgtcataataaagaagtcagcacaatgactcatatccttcaccacacataatctcttttgtgtcttttttatttaatatcttatcttgttcagttcttggatctattctggcgaggacgatcgctgttctttgctaggagtagtagtagatcttcgtagaatctttgttttctttgccctttgtgttctatcggtgtgtgtgttttggatgatgttgctgttgtccttgacctgagcgcggggctgcacgcggcgaccagcgggagcgggaccggcagagggcgcaggcgcggcggccggtggccaaggggcgcgacgacgggctcacgccggagcagcggcgggagcgggacgccaaggcgctgcaggagaaggcggccaggaaggcggcgcaggccgcgggaggcggcgacgccaagggcgcgggcaagaacgccggcaagtagtagcctgtgtcgccggatccggcgagatcgcgttgtgtggccgggtggtgaaatctctgtaatcatgttgcaagatctgtgtgttggttggatctggaaaaaaaaatcgggagtgggatgcgatttcgtcagtgttggcacttgcttcgcctagaacatgcattgcaaaagcacaac

SEQ ID NO: 1686 - DNA, 777 bp, Panicum virgatum
gacctcacgatctcccctccttctagacgcttcctccctcctctctctgactctctcgtctcactacagtacaacttaaagaagtcagcacgatgactcatatccttcatcgcacataatcatctccttttattttattattttgttcagttcttcaatccattcttgcgaggacaatcactattctttgctaggagtagtagatcttcgtagattctttcttttctttgccctgtctattctgtatcggcgtgtgtgctttggatgatgttgctgttgtccttgacctgagcgcggggcggctgcacgcggcgaccagcgggagcgggaccggcagagggcgcaggcgcggcggccggtggccaaggggcgcgacgacgggctcacgccggagcagcggcgggagcgggacgccaaggcgctgcaggagaaggcggccaggaaggcggcgcaggccgcgggaggcggcgacgccaagggcgcgggcaagaacgccggcaagtagccggtgtcgccggatccggcgttgtgttgtagcggctaggtggtggaatctctgttcatgttgcaagatctgtgtgttccgtggatctggaaaaaaaaatcggaagtgggatgcgatttcttcagtgttggcgcttgcttcgcccagaacatgcattttgcaaaagcacaacaataacggctgatcagccctgtttggttctccactaatagttgtactaggaaattttgatcattaattattggtattaaataaaaataatttgtaaaact

SEQ ID NO: 1687 - DNA, 412 bp, Saccharum officinarum
cgcggcgaccagagggagcgcgaccggcagagggcgcaggcgcggcggcccgtggccaaggggcgcgacgacgggctcaccccggagcagcggcgggagcgggacgccaaggcgctgcaggagaaggctgccaggaaggcggcgcaagccgcgggaggcggcggcggaggcgccgacgccaagggcggcaagaacgccggcaagaagtagcagccgggatcttcggatttgcaggaggtttctcctgatctggcgaaattagttgggttctcttagcagttttattagaagatgatggtggagaaagctatgttcgtgtattgcttgaatctggaatgcaatgcgatttcgtcggtgttgttactttgctttgcaattgttttgcagtaacggtacgataccggaaagagct

SEQ ID NO: 1688 - DNA, 1066 bp, Setaria italica
ccttgcgtctagacgcttcctcgccattcacacgcatcttccttctctctctacagttcagaagtcagcagaatgactcgcggcgaccagcgggagcgggaccggcagagggcgcaggcgcggcggccggtggccaaggggcgcgacgacgggctcacgccggagcagcggcgagagcgggacgccaaggcgctgcaggagaaggctgcaaggaaggcggcgcaggctgcggggggcgccgacgccaagggcggcaagggcgccggcaagaacggcgtcaagaagtagccggggatcttcagatttagagaggaggcatcgggtttagccggtgtcgccggatctgttaaaattgcgtggtgtcgtagcggatagacgatgaaatctctctctgtccgtgttggaagatctgtgttgcttggatatggaaaaatctggaatggaattaggtttcgtcggtgttcgccttgcatctaccgggttagaataccgattacttgccgcattcccatcaaaagatatgctaaggtaattttcatttacaaaaggacgaccccatgaaaattcatttacagaaaggatgagcttccgatgatctaagaaccaaataatcagcggaacatcgacaattaagaggacacacgtccgtagggacaggaagctttttatgcagagtatttaagaggacacagtagtgcttatgcactcaacatggtttctgtgttcagtatttacaatttacaacacatgatccttctgttgttttgaagagctattcttagttttcccgtatataagattgcgtatgttttcgcagaccacgaagtattgctgatcactgcacactaggctcaatcgacatcagaactcttctcgtcacgggcaccggtccatttagcgacccggccgtcccaggatgagctcacaagcgtgggttcaaatgggtgccagctgcagtctcgaatcgccgtttgatgccctttaagtttcgctacttgcgatccgcttacctgtaacatgaaacgaagttgagaaacaaatatgcaaagagttcttgacgttgttt

SEQ ID NO: 1689 - DNA, 543 bp, Triticum aestivum
ttcgtcgagacccggacctcacgatccaagccaacaacaattatactacgacccgacccgacccgaccagcgccctccctctttccatcaatctttctcccgtcccccaaatctctcgatctcggagcagcgatgactcgcggcgaccagagggagcgggacaggcagagggcgcaggcgcggaagccgggggccaagggccgcgacgacgggctcacgccggagcagcgacgagagagggacgccaaggcgctgcaggagaagacagccaagaaggcggcgcaagccacgcagggggccgacgacgccaagaagaacgccgccggcaagaaatagtagttcggatccggataccggcccagcggcatattggatctgttctgtctgtctcgtgaattgtcatgaagtggagagatgttctgatgtagaatttctgtgcgatgtggttgcgcccggcttgtagcacaattctttcggcgcctccagatcgggcccgtgttgttgatgcgtaattcgtgaatctttgatgcaatgagattaatt

SEQ ID NO: 1690 - DNA, 2583 bp, Oryza sativa
tgcaagtcgaacgggaaatgggaaaaaaaaaatctctcatatccgactgactccgagaagtccggtgacgagagagatcgagagaacactcgccttagctcttcttcttctcccttctctacggggagttgcggctccggcgggcgcgcgacgagaggatcgccgaagagtgcccagaactgagattttgagtttctaatatcgattttcattccaagggagaattgatatacatatgaaactctgagaaggatgggttatggcatgagtaggatggaggaggaatacagcgagcatgaagatcagaataatggtggatctaattcacaagtgaataatgagttcttaaacacacataatgatattttccatatgactcaaataagatcaggacctagtgaaagtcttcgcaagtctattggtacaagcaaagatgtgatatcgacaaccaggttattgtctggaagggaaattaattcttcaggaaatgggaagttctcttcagttgatcgtgcgtttcttcttggtcgttatcttccagttgatggccctgaaatagtggacaggatggattcccgagcttatgtttcacagttttctgctgatggatctctttttgttgctggttttcagggaagccacataagaatatatgatgttgataaaggttggaaagtacatagggacattcatgctagaagtttgagatggaccattagtgacgcatcactttcccctgatcaacagtttcttgtctactccagtctagcaccgattatccatatcgtcaatgttgggactgctgcaaaacaatcatatgctaatatcactgacatccacgatggactagatttttcacagcatgaagatgttcgatatacatttggaatattttctgttaaattctcttctgatggccgagagcttgttgctggcagtaacgatgattcaatatatgtttatgaccttgtggcaaacaaactaacgttgcgtttgcctgctcatcattctgatgtcaacacagtagcatttgctgacgaaactggccatctcatatattctggaagtgatgataatttatgcaaggtctgggataggcgatgtttatccacagaagaacctgctggagttttgactgggcatttgcatggcattactcatattgatagccgtggagatggtcggtgtttcatatcaaatggaaaagaccaagctatcaaaatgtgggacatcaggaaaatgacatccaatgctgatagttatgaagacagaacctcaaattgggactatagatattcaagatatccacaacagtataagcaactaaagcatccccatgatcagtcaatagctacatactggggccattcagttcttcgtacattgatccgttgctatttttctcctgcatatagcacaggacagaagtacatatatacaggatcctatgattctagtgtttgtatctacgatgtggtgagcggatcacaagttgcaaaactcaaaggatatcatcagctggcaattcgagactgcagttggcatcccttcgaccctatgcttgtcagctcatcctgggacggccgggttgccaagtggtccaggtcttcctgtcagcaagaagagactactgatctcgattgattcggtgcttgcgatcttccattagcatatatgcagataatggcacgaaacaaatgggtttaaacagattacacagtttggctagatattagatatattgtgaagaagatggcgcgtcgtaaaaaatggatactcgtagtcagagtcatgcgctcgtccgggaatacacagagttttctttggttgtctgtacagcgtttcccttggtggagctttacatgtggtccgtatacatgtcaatctgtatatgtcactgatttatggagcatgagctgggagttaatttgatccgtgcaggagcggagtaaatttgctttcacaatctacataaatttgtaatgcaatttccaaagatccaagaaatagcagtacagatctgccaacatgggcaggatcaggagcagatgacgatcgaaagaacggtgttgtcacacgcaaccagacgtgaggtgagaacagatcaaatgccggcatatgccgatgcctacttcttcccgccgctctttcccttggcgccggcgccgccgttgccgccctgcccggtggcctgcgccgccttcctggccgccttctcctgcagcgccttggcgtccctctcgcggcgctgctccggcgtgagcccgtcgtcgcgccccttcacaaccggcttccgcgcctgcgccctctgcctgtcccgctccctctggtcgccgcgagtcatagcggtgaaattataagaggtcgcaagagcgtgggggacgagacggtggcaaggaggaaagaaatggaggaagaagtatctagaagcagcgggcggctgctgttgacaaacttttgtgtcgtgaggccgagacgggcggagcgctcgggtgcccgggatttatgcaggggagagatccgcggccgagtctgtttccagaagcgtccacccgttctggaaccttcccaacaccgtaaaag

SEQ ID NO: 1691 - DNA, 577 bp, Hordeum vulgare
gggagaggcgcttccggaacctaccccgcggccctacatatacaccgccacacgccccacccccgttccgacctcacgatccaaaaccacaacaattatactacgacctgccccctccctctctccgtcaatctttctcccgtcccccaaatctctctacctcggagcggccatgactcgcggcgaccagagggagcgggacaggcagagggcgcaggcgcggaagccggggagcaagggccgcgacgacgggctcacgccggagcagcgacgagagagggacgccaaggcgctgcaggagaagaccgccaagaaggcggcgcaggcaacgaagggggccgacgacgccaagaagaacgccgccggcaagaaatagtagcacccgggttccgtccctgcggcatgttggatctggtctgtcatgacgtcgagatgttctgatgtaaaattctgtccgatctggtcgctccctgcttgtaacacaaactcgttcagcgcctccagatcggcccccgtgttgttgatgcctgattcgtggatcttaaatgaaatgagattaaggcccagttcgttttag

SEQ ID NO: 1692 - DNA, 542 bp, Secale cereale
cctacgacccaacctaaaccaacttaattacgttacgaggtacccggaccgacgtaccccgtaccctctcctccatcctaaatctttctcccgtcccccaaacctctcgatctcggagcagcgatgactcgcggcgaccagagggagcgggaccggcagagggcgcaggcgcggaagccgggggccaagggccgcgacgacgggctcacgccggagcagcgacgagagagggacgccaaggcgctgcaggagaagaccgccaagaaggcggcgcaggccacgcagggggccgacgacgccaagaagaagaacgccgccggcaagaaatagtagttcggatccgggttccgtcccagcggcatattggatctgttctgtctgtctcatgaattgtgatgtaaaatttcggtgcgatgaggttgcgcccggcttgtagcacaattctttcggcgcctccagatcgggcccgtgttgttgatgcgtaattcgtggatctttgatgcaatgagattaatttcgttgttacatccaaaaaagtcgta

SEQ ID NO: 1693 - DNA, 670 bp, Secale cereale
tcctctctccatcaatctttctcccgtcccccaaacctctcgatctcggagcagcgatgactcgcggcgaccagagggagcgggaccggcagagggcgcaggcgcggaagccgggggccaagggccgcgacgacgggctcacgccggagcagcgacgagagagggacgccaaggcgctgcaggagaagaccgccaagaaggcggcgcaggccacgcagggggccgacgacgccaagaagaagaacgccgccggcaagaaatagtagcatccgggttccgtcccagcggcatattggatctgttctgtctgtctcatgaattgtcatcaagtggagagatgttctgatgtagaatttctgtgcgatgtggttgcgcccggcttgtagcaaaattctttcggcgtccagatcgggcccgtgttgttgatgcgtaattcgtggatctttgcaatgagattaatttcgtcgttacatcctctaaagcttcccttttcatccggaaaagtcacaggaattcctgaccagcgtctttgtcctcctcggttggacaaagattcggtgtagcttctgatttgtgcgggaatccaactctatcctgtattacgcctccgacatcctcacacacacacaaaaattctcctacctcttctgagcttctaaccagttttgaa

SEQ ID NO: 1694 - DNA, 583 bp, Brachypodium distachyon
gacctcacgatccaaaccacaagacaccttccaggcttttccacctctatctttctcccgtctcgcaatctcttgatccccggagcagcgatgactcgcggcgaccagagggagcgggatcggcagagggcgcaggcgcggaagccgtcgaccaaagggaaagacgacgggctcacgccggagcagcggcgagagagggacgccaaggcgctgcaggagaagaccgccaagaaggccgcgcaggccgcgcaaggggccgccgccgacgcaaagaagaaaaacgccgggaagaaatagtattgggatctgattcgaacgccgcgctggatctgttcccgttccgtcgcatggatttgttatactgtactactatgttcttgttaggacgtcgaggtgttcttctgatgtaaatcggtgagatgcgagagcttgttaagacaattctttccaccgtgatcggcctcagattacgcccgtgtcggtactcgttggatctttgatggactgatttcatctgtaggtcagtttctctttctctcaaaaccttatgggactcaacgtattaacattacgacttgtcttt

SEQ ID NO: 1695 - DNA, 2636 bp, Brachypodium distachyon
gcggggccctacaaactcccaagataattggtggcaaaaatcactccgctcgattctcacggcagagaaggagcaggcagagccccgcgtgtcgagtgacggagtgagcaacgacgggagagtcgacacgagaggtttggctcgattccgctcgaggtcgattcgattcgattctgcggcctcttcctgctcccggtcgaaccccccttcttgcgcggtttggattctgcatgtcgatgggcatttcaaaggagcattgatatataaaagttggaaaggatgggttatggcatgagtaggctagaggatgaatacagcgaacatgaagggcagagtagtgacggactaagttcagcccaaatgaataatgaattttccaaattgcataatgatattttccatatgactcatctaagatcaggacctagtgaaagcatccgcaagtcgattggtatcaacaaacatgcagtctcagtaactaggttattacgtggacgggaagttaattcttcaggaactgggaagttcttttcggttgaccgtgcattcattcttggtcactatcttccagtggatggtccagaaatagtggacaggatgaactcacgagcatatgtttcacagttttctgccgatggttctctttttgttgctggttttcagggtagccacataagaatatatgatgtcgacaaaggttgggaagtacataaggacattcatgctagaagtttgagatggacaattagtgatgtatcgttatcaccagatcaaaggtttcttgtctacgctagtctggcacctattatccatattgtcaatgttgggactgcttcaaaagaatcatatgctaatgtcactgacatacacgatggattggatttttcacagcatgaagatgttagatattcatttggactgttttcagttaaattctccactgatggccgagagcttgtcgctggcagtaacgatgattctatatatgtgtatgaccttcaggcagacaaactgacattgcgtttgcctgctcatacatctgatgtcaatactgtagcatttgcggatgaaactggtaatctcatttattctggaagtgatgataatttgtgcaaggtctgggataggcgttgtttgtccacaggggagcctgctggagttttgactggacatttgcatggcattactcatatcgacagccgtggagatggtcgatgtttcatatcaaatggaaaagatcaggctattaaaatgtgggacatcagaaaaatgacatccaatgctgatggttccgagaacagagtgcctgcttgggactacacaaattcaagatacccacaacaatacaagcaacaaaagcatccgcatgatcagtcactagctacataccggggccattcagttctacgcacattaatccgttgctacttttctcccacatatagcacaggacagaagtatatatatacaggatcttatgatgccagtatctgcatctatgatgtggtaagtggatcacaagttgccaaactgcacaaaggtcatgagctggcagttcgagattgcagctggcatccgttcgatccaatgcttgttagttcatcctgggatggtcggattgctaaatggtctagaacttgttccgagcaagatacttgtgaactcgattgaggatactttctgtgtgaggtaatcttcaggtagcttacggaccttgcgctgtgcaacaaaacagtgggtaaatacatccctgtacatgtcatttgtgaaaatatgttcataccgtatctgttctgtactttcgacgggcatgcgtagcccatactgttccgtgcttttgttccagcaaaatgtagcctgtgtatatatgaatctctaccgggggaaatatagtggtcctgccctccattagtttgcttttatttcattatttgtactcaatactctactccaggttctcaatagaaaagacaagtcgtaatgttaatacgttgagtcccataaggttttgagagaaagagaaactgacctacagatgaaatcagtccatcaaagatccaacgagtaccgacacgggcgtaatctgaggccgatcacggtggaaagaattgtcttaacaagctctcgcatctcaccgatttacatcagaagaacacctcgacgtcctaacaagaacatagtagtacagtataacaaatccatgcgacggaacgggaacagatccagcgcggcgttcgaatcagatcccaatactatttcttcccggcgtttttcttctttgcgtcggcggcggccccttgcgcggcctgcgcggccttcttggcggtcttctcctgcagcgccttggcgtccctctctcgccgctgctccggcgtgagcccgtcgtctttccctttggtcgacggcttccgcgcctgcgccctctgccgatcccgctccctctggtcgccgcgagtcatcgctgctccggggatcaagagattgcgagacgggagaaagatagaggtggaaaagcctggaaggtgtcttgtggtttggatcgtgaggtcgagacggctgtgatgcgtgtggccttgtatatgtaaggggccgttggggcagcttccggaagcgtctctcggttctggaacgttcct

SEQ ID NO: 1696 - DNA, 489 bp, Avena sativa
atcgccttccgatccatcccacctcgccctgcccctctcttgttcccttctcgcaaatttcttgatctcggagcggccatgactcgcggcgaccagagggagcgggacaggcagagggcgcaggcgcggaagccggggagcaagggccgcgacgacgggctcacgccggagcagcgacgagagagggacgccaaggcgctgcaggagaagaccgccaagaaggcggcgcaggcaggcgccgccgccgacgccaagaagaaggacgccggcaagaaatagtattcggatctgattccgaacgcacgcaggggcgttggatctgtactctttgtctcatgggtctaggacgcctggatgttctgatgtaagatcggtgtggtctgaattggatgttctgatgttcttgcaaggcaattctatgaacgcgtccggcccggtcgatttgtcgattcttatcttcagtggaatttgtgcccgaatttcaaccag

SEQ ID NO: 1697 - DNA, 543 bp, Avena sativa
atcgccttccgatccatcccacctcgccctgcccctctcttgttcccttctcgcaaatttcttgatctcggagcggccatgactcgcggcgaccagagggagcgggacaggcagagggcgcaggcgcggaagccggggagcaagggccgcgacgacgggctcacgccggagcagcgacgagagagggacgccaaggcgctgcaggagaagaccgccaagaaggcggcgcaggccggcgccgccgccgacgccaagaagaaggacgccggcaagaaatagtattcggatctgattccgaacgcacgcaggggcgttggatctgtactctttgtctcatgggtctaggacgcctggatgttctgatgtaagatcggtgtggtctgaattggatgttctgatgttcttgcaaggcaattctatgaacgcgtccggcccggtcgatttgtcgattcttatcttcagtggaatttgtgcccgaatttcaaccagcaaagctgccctcttcctcaagaagagaacggaaataatttttctacctttgaa

SEQ ID NO: 1698 - DNA, 802 bp, Saccharum officinarum
tcaagaaaacagcaaagatccagtgcagagagagaaagagagggggagagagagagagcaagaaaccccatggcactctgaacaagagaagaaagagctagagagggatctcagtcagtctcccacaatgccggaaaccacgaagctgatcttgctctcaagggcatgggcagcagcgtcactcatcctgctgctgctgctcgtcctccatgggaggggaggccactgcatcggcctgggcatggaggcggagctggagatggactcggaagcgcaccggcggctgttgtgggaggcgaccaccgggcagaggtacatcagctacgccgccctgaggggcgacgtggtgccgtgctccaggaccggggtgccgtactacaactgcaggatctcgaccaccgccaacccctacacccggggttgcgagagcatcactaggtgcagggacgcagatccctagattcttgctccatcgcttgcaaggaaatcgaaggggctcctgcctcctgcaacgcaaggtgttgctaaatgctaatgaaatgtaatattttgtgttatatctcttttcttggtccttcctcctttgctggaatattagtaagtgtagtaaggaaggactaatggatgaatttcatgtttgaggtgctctagacttctattaccttgagatcttttgctgttggcagtgcaagatgttgatgagcaatgctttagattattatcggagagacttcattgagttttcagtttgttgaaaaagagtttttcgggaatatgcaactaatgtcgttatagtttttgg

SEQ ID NO: 1699 - DNA, 586 bp, Panicum virgatum
gagagggagactccatgacactctgaacaagaaacatagagagagatcccagtcagtctcccccaatgccggctaccaccaagctgatcttgctcttcagagcatgggcggcagcgtcgctcctgctgattctggtgcttgccctccatgggaggggaggccactgcggcggcctgagtttggacgcggagatggagatggactccgaggcgcaccggcggctgctgtgggaggcgaccaccggccggcgttacatcagctacgacgcgctgaggggcgatgtggtgccgtgctccaggaccggggtgccctactacaactgcaggatctcaaccaccgccaacccctacacccggggctgcgagagcatcaccaggtgcagggacgcaggtccctagatggagatgggcgaaactcctgcctgcgaggggagggagggctccatcaactgtaatgtgtgttgctaattatgtatgttatctatctctctctctctctctctctctctcgtccttcctcctttgctggaatagtagtaagtgtagtatgggaggattaattgatgagtttcatgtttgaggatgcc

SEQ ID NO: 1700 - DNA, 813 bp, Setaria italica
cagtccctcctcacaggacaagggagagagaaagcccagcagccctccaagaaaacagcaaagatccaggacaagggagagagagagagagagagagagagagagagagaagatcttcatgacactctgaacaagaaagagagagagagatctcagtcagtctctcccacaatgccggcaaccaccaagctgatatcgctctccagggcatgggcgaccgcgtcgctcctgctgatgctggtgctcgccctccatggcaggggaggccactgcgtcggcctgggcatggatgcggcggagatggagatggactcggaggcgcaccggcggctgctgtgggaggcgaccggcggccggcgatacattagctacgacgcgctgaggggcgacgtggtgccgtgctccaggaccggtgtgccgtactacaactgcagggtctccaccaccgccaacccctacacccggggctgcgagagcatcaccaggtgcagggacgcaggcccctagatggacaaactcttgcttgcaaggcagcaaggggagggagggctccggcaactgcgatgtgttgctaattatgtgtaatcttttctgttttctctctgttttctttttgttggtccttcctcctttgctggaatattagcaagtgtggtatggaaggattaatggatgcgtttcatgattgaggatgccgttagattcatcctcacctcaaatcttttgctcttactgtggaggtgaaagtgtgtgtttatgtaactgtgtaatataattcgattggggctacacggaagagccagtggcaatttc

SEQ ID NO: 1701 - DNA, 872 bp, Setaria italica
gaaagcccagcagccctccaagaaaacagcaaagatccaggacaagggggagagagagagagagagagagagagaagatcttcatgacactctgaacaagaaagagagagagagatctcagccagtctctcccacaatgccggcaaccaccaagctgatatcgctctccagggcatgggcgaccgcgtcgctcctgctgatgctggtgctcgccctccatggcaggggaggccactgcgtcggcctgggcatggatgcggcggagatggagatggactcggaggcgcaccggcggctgctgtgggaggcgaccggcggccggcgatacattagctacgacgcgctgaggggcgacgtggtgccgtgctccaggaccggtgtgccgtactacaactgcagggtctccaccaccgccaacccctacacccggggctgcgagagcatcaccaggtgcagggacgcaggcccctagatggacaaactcttgcttgcaaggcagcaaggggagggagggctccggcaactgcgatgtgttgctaattatgtgtaatcttttctgttttctctctgttttctttttgttggtccttcctcctttgctggaatattagcaagtgtggtatggaaggattaatggatgcgtttcatgattgaggatgccgttagattcatcctcacctcaaatcttttgctcttactgtggaggtgaaagtgtgtgtttatgtaactgtgtaatataattcgattggggctacacggaagagccagtggcaatttcatcaagtaccactgcatgatgatgatgaacaatgctatagattgtaaactagaaaaaggaagacaaagctactaatctgtttgagaatatgcag

SEQ ID NO: 1702 - DNA, 600 bp, Panicum virgatum
  misc_feature (302)..(302): n is a, c, g, or t
  misc_feature (461)..(461): n is a, c, g, or t
  misc_feature (597)..(597): n is a, c, g, or t
gaaagcccagcagcccctccatcaagatcaagaaaacagcaaagatccagtgcagagagagagagagagactctgaacaaaatagagatctcagtcagtctcccccaatgccggcaaccaccaagctgatcttgctcttcagagcatgggcggcagcgtcgctcctactgattctggtgcttgccctccatgggaggggaggccactgcggcggcctgagcttggacgcggagatggagatggactcggaggcgcaccgtcagctgctgtgggaggcgaccaccagccggcgttacatcagntacgacgcgctgaggggcgatgtggtgccgtgctccaggactggggtgccctactacaactgcaggatctcaactaccgccaacccctacacccggggctgcgagagcatcaccaggtgcagggacgcaggtccttagatggagatggacaaactcctncctgcgaggggtgggagggctccggcaactgtaatgtgtgttgctaattatgcatctctttttcttcttctcctttgtttgaatattagtaagtgtaatatgtgaggattaattgatgagtttcatgtttgaggangtc

SEQ ID NO: 1703 - DNA, 1558 bp, Saccharum officinarum
cgacggtatccgagcaggtggttggttcagcgatcagctcagtgcccagcccagtaggcagacacaatcacacaacggctgtttcggtatcgcagtagcatctcagttcccagcagtctgctgccgcctcgagctctagcggagtgtccaccgtccatcgagtccagcggaggatggagagcagcttgcttgacaccgccgtggccgccggtctttgcccggcggcggccgggcgccgccgagccgggagcacggcgagcttcctcagctgctcctgctcctccagagactgcagggtgagcgcgtcctactcccactccatcagccggatgctgagcggggtgcggtcggcggcgcgcaagaagctcttccggaccgacccggcggcggccgacctgctgggcatcgccaactggtcggatgagacgagcggcggcgccgggggccaccagcagcagcagcactggtggacggcgctggagaacaacttcgtgctggaggccaccgacgacgagtacggcggggtcgtcgtcgacgccgacaggctgcccgacgacaaggccgccttcgcgcgctcgctcgcggcgtcgctctcttactggaagtctgtggggaagaaaggggtgtggttgaaattgccggtggatcgagccgagttcgtccctttagcagtgaaggaaggtttcaagtaccaccacgcggaggaagcgtacctgatgatgacgtactggatccctgatgatgaaccaaatatgctcccagcaaatgcttctcatcaggttggagttgggggttttgtgatcaatgaccaaatggaggtcctagtggtgcaagagaagtatcgcggttcgtcgctggatggcgtctggaaactccccacaggcttcattcttgcctcagaggaaatctacacgggagccagcagagaggtgaaagaggaaaccggggtcgacaccgaattcgttgatgtcgttgctttcaggcatgcccacaacgtggcctttcagaagtcggaccttttcttcatctgcatgctgcggcctgtgtcgagtgagatcaagattgacgagacagagattcaggcagcaaagtggatggcgctggaggagttcgtgaagcagcccttcatccaggaagaccacatgttccagaagatcatggacatatgcatccagcgcctccgcaagtgctactgcggcctgatgccgcaccacgtcgtctccaagttcgacgacaggacgtcgacgctctactacaatgtcgccgagcctgaggacgtcaactgcagcgccgcctgatatatgatgggagattgggagggatagccaccccagcatctagtctagttcttgctgcgcaaagtttcatgatgcagcagttgcgattgctgagagtgaaatactagtagcagattgcgcaaggcaatagtgctgttgccgagcctgtacatatacgtgtagagcataacttgcgagagctgtatatcggtagctctgctctgtcgtgtgttctgataaacgatggagccgtttgatcggttgtgatctgcgaaacgaat

SEQ ID NO: 1704 - DNA, 1556 bp, Setaria italica
cgcgtcgaccacggcggtatccgagcgagcaagcaggtacagtagttcagttcagtagcgcccagtaggcaggcaacgcgcgcgcaacggttgtagcagtatcgccgtagcatcatctccgttccaaagcagtttgggggtgcctcgagctatcgtggagtgtacagccgaggatggagagcagcctgctcgacaccgccgtggctgccgccagcctctacccggcggcggccaggcgccgccgcgccgggagcacggcgagcttcctcagctgctcctcctgctcctccagagactgcagggtgagcgcgtcctactcccactccatcagccggatgctgagcggggtgcggtcggcggcgcgcaagaagctgttcagggccgacccggccgacctgctgggcgtcgccaactggccggagacgggcggcggccaccagcagcactggtggacggcgctggagcacaacttcgtgctggaggccaccgacgacgagtacggcggggtcgtcgtcgacgccgacaggctgccggccgacaaggccgccttcgcgcgctcgctcgcggcgtcgctgtcctactggaagtccgtggggaagaaaggggtgtggctgaaattaccagtggatcttgccgagttcgtgcccttggcagtaaaggaaggtttcaagtaccaccacgctgaggaatcgtacttgatgatgacgtactggatccccgacgagccaaacatgctcccagcaaatgcttctcatcaggttggagttgggggctttgtgatcaatgatcaaatggaggtcctagtggttcaagagaagtatcacggttcatcgctggatggtgtgtggaaactccccacaggtttcattcttgcgtcggaggaaatctatacaggagctagcagagaggtgaaggaggaaactggggtcgacaccgaattcgtcgatgtcgttgctttcaggcatgcccacaacgtggcgttccagaagtccgacctgttcttcatctgcatgctgaggcccgtttcaagtgagatcaagattgatgagacagagattcaggcagcaaagtggatgccgctggaggagttcgtgaagcagcccttcatccaggaagaccacatgttccagaagataatggacatctgcatacagcgcctgcggaagtgctactgcggcctgacgccgcaccacgtcgtctccaagttcgacgaccggacgtccacgctgtactacaacgtggctgagcccgaggacgtgaactgcagcgccgcttgacgaacggatcgccgcccagcccatccatagattttgctgcgccaagttcgtaatgcagcagcaatgttagtgacgccattattgctgagtgtgtgaaacagctgaaagcgcgaggcaatagcgttgccgagcctgtaaatatatttctaggatacttaggcgatgacgaatcggtagctgcagtttggacagtgaatatctgtattcaaatcctcaacaataaaagaatccaagccggtgctaccgatccgaaaagaatccaaagccggtgctactgat

SEQ ID NO: 1705 - DNA, 1749 bp, Sorghum bicolor
ggagctcagccattcgcacggcggtatccgattgcgagcaggtggttcagcgatcagctcagtgccccagccccagtaggcagacacaacacaatcacacgacggctgtttcggtttcgcagtagctcagttcgctgcttcctcgagctctcgccccggagtgtctactgtccagtctcgagtccagcgggggatggagagcagcttgcttgacaccgccgcggccgccggtctctgcccggcggcggccgggcgccgccacgctgggagagcggcgagcttcctcagctgctcctgcgcctccagggactgcagagtgagcgcgtcctactcccactccatcagccggatgctgagcggggtgcggtcggcggcgcgcaagaagctcttccggaccgaccaggcggccgacctgctgggcatcgccaactggtcggatgagacgagcggcggcgccggaggccacggccaccaccagcagcagcactggtggacggcgctggagcacaacttcgtgctggaggccaccgacgacgagtacggcggggtcgtcgtcgacgccgacaggctgccagacgacaaggccgccttcgcgcgctcgctcgcggcgtcgctctcttactggaagtccgtgggcaagaaaggggtgtggttgaaattgccggtggatcgagccgagttcgtccctttggcagtcaaggaaggtttcaagtaccaccacgcagaggaagcgtacctgatgatgacgtactggatccctgatgaaccgaatatgctcccagcaaatgcttctcatcaggttggagtcgggggttttgtgatcaatgaccagatggaggttctagtggtgcaagagaagtatcgcggttcgtcgctggatggcgtctggaaactacccacaggcttcattcttgcgtcagaggaaatctatacgggagccagcagggaggtgaaagaggaaaccggggttgacaccgaattcgttgatgtcgttgctttcaggcatgcccacaacgtggcgtttcagaagtcggaccttttcttcatctgcatgctgaggcctgtatcgagtgagatcaagattgacgagacagagattcaggcagcaaagtggatggcgctggaggagttcgtgaagcagcccttcatccaggaagaccacatgttccagaagatcatggacatctgcatccagcgcctccgcaagtgctactgtggcctgacgccgcaccacgtcgtctccaagttcgacgacagaacgtccacgctctactacaatgtcgccgagcctgaggacgtcaactgcagcgccacctgatatatgatgggagattgggagggatagtctagcttttgctgcgcaaagtttcatgatgcagcaatggcgattgctgagagtgaaatgctagctagtacgtagcagattgcgcaaggcaataacagtgttgccaagcctgtacatatacgtgtagggcataacaagcgagagctgtatatcggtagctctgctctgtcgtgtgttctgataaacgatggagccgtgtttgatcgtttgcgacttgcgaaacgaattctgcatcgaatcaaacgcggtactcgatcgccctcaccatctgtcctcttggccatcctcgccgctatgcactagagccgaacctcaccatgctaaccattttttgtttgttttggtaaaaccgattatgtggcatcacgattcacgactacctataatacaacaaaagaacactc

SEQ ID NO: 1706 - DNA, 2008 bp, Sorghum bicolor
ccggcctcgtgagactgacgtggaccctcgcggcgattttttataagccccccggcaagcagcgtcgtgtggagctcagccattcgcacggcggtatccgattgcgagcaggtggttcagcgatcagctcagtgccccagccccagtaggcagacacaacacaatcacacgacggctgtttcggtttcgcagtagctcagttcgctgcttcctcgagctctcgccccggagtgtctactgtccagtctcgagtccagcgggggatggagagcagcttgcttgacaccgccgcggccgccggtctctgcccggcggcggccgggcgccgccacgctgggagagcggcgagcttcctcagctgctcctgcgcctccagggactgcagagtgagcgcgtcctactcccactccatcagccggatgctgagcggggtgcggtcggcggcgcgcaagaagctcttccggaccgaccaggcggccgacctgctgggcatcgccaactggtcggatgagacgagcggcggcgccggaggccacggccaccaccagcagcagcactggtggacggcgctggagcacaacttcgtgctggaggccaccgacgacgagtacggcggggtcgtcgtcgacgccgacaggctgccagacgacaaggccgccttcgcgcgctcgctcgcggcgtcgctctcttactggaagtccgtgggcaagaaaggggtgtggttgaaattgccggtggatcgagccgagttcgtccctttggcagtcaaggaaggtttcaagtaccaccacgcagaggaagcgtacctgatgatgacgtactggatccctgatgaaccgaatatgctcccagcaaatgcttctcatcaggttggagtcgggggttttgtgatcaatgaccagatggaggttctagtggtgcaagagaagtatcgcggttcgtcgctggatggcgtctggaaactacccacaggcttcattcttgcgtcagaggaaatctatacgggagccagcagggaggtgaaagaggaaaccggggttgacaccgaattcgttgatgtcgttgctttcaggcatgcccacaacgtggcgtttcagaagtcggaccttttcttcatctgcatgctgaggcctgtatcgagtgagatcaagattgacgagacagagattcaggcagcaaagtggatggcgctggaggagttcgtgaagcagcccttcatccaggaagaccacatgttccagaagatcatggacatctgcatccagcgcctccgcaagtgctactgtggcctgacgccgcaccacgtcgtctccaagttcgacgacagaacgtccacgctctactacaatgtcgccgagcctgaggacgtcaactgcagcgccacctgatatatgatgggagattgggagggatagtctagcttttgctgcgcaaagtttcatgatgcagcaatggcgattgctgagagtgaaatgctagctagtacgtagcagattgcgcaaggcaataacagtgttgccaagcctgtacatatacgtgtagggcataacaagcgagagctgtatatcggtagctctgctctgtcgtgtgttctgataaacgatggagccgtgtttgatcgtttgcgacttgcgaaacgaattctgcatcgaatcaaacgcggtactcgatcgccctcaccatctgtcctcttggccatcctcgccgctatgcactagagccgaacctcaccatgctaaccattttttgtttgttttggtaaaaccgattatgtggcatcacgattcacgactacctataatacaacaaaagaacactcacaagagactcccatcgtgccagcgttagacaaaacagaaagcctaacaaatactaccttgtctctcagtaattaggatcataggatggactgatatgatggagtagtttacttattattatttttagttagtgactggctgtctcttttggatgacgccaagtctaaaagcaatctcgctatttcctg

SEQ ID NO: 1707 - DNA, 1474 bp, Panicum virgatum
gggtcgacccacgcgtccgggtggttcagtgaccactgaccagtagcgcgggcaacaggcgcgcaacacggttgcatcagttcgtgttgagctcagcatccctagctcgcttggagtgtactacgagtctacgactgagctgaggatggagagcagcctgctcgacaccgccgcagctgccgccagtctctgcgcggcggcgggcgggcgccgccgcgccgggagcacggcgagcttcctcagctgctcctgctccccaagagactgcagggtgagcgcgtcctactcccgctccatcagccggatgctgagcggggtgcggtcggcggcgcgcaggaagctgttcagggccgacccggcagacctgctgggcgtcgccaactggcccgaggcgggcggcgccgggcaccagcagcagcagcactggtgggcggcgctcgagcacaacttcgtgctggagtccaccgacgacgagtacggcggggtcgtcgtcgacgccgacaggctgccaaccgacaaggccgccttcgcgcgctcgctcgccgcgtcgctctcctactggaagtccgtggggaagaaaggggtgtggttgaaattaccagtagatcgtgccgagttcgttcccttggcagtaaaggaaggtttcaagtaccaccacgctgaggaatcgtacttgatgatgacgtactggatccccgacgagccaaacatgctcccagcaaatgcttctcatcaggttggagttgggggctttgtgatcaatgatcaaatggaggtcctagttgtgcaggagaagtattgcggttcgttgctggatggtgtgtggaaactccccacaggtttcattcttgcgtcggaggaaatctatacgggggctagcagggaggtgaaggaggaaaccggggtcgacaccgagttcgttgatgtcgttgctttcaggcatgcccacaacgtcgcgtttcagaagtccgacctgttcttcatctgcatgctgaggcctctatcgagtgagatcaagattgatgagacagagattcaggcagcaaagtggatgccgctggaggagttcgtgaagcagcccttcatccaggaagaccacatgttccagaagatcatggacatctgcatccagcgcttgcgcaagtgctactgcggcctgacgccgcaccacgtcgtctccaggttcgacgaccggacgtcgacgctgtactacaacgtcgccgagccagaggacgtgaactgcagcgccacctgacggagatggatcgccgcccagcctataccttagtagtacgattgctgcgagtgtggaaacagctgatgaaactgcaaggcaatagtgttgccgagcctgtaaatatatttctaggactccaaggcgatgacaggatcggtggctgcagtttggatagtgaatatctatctgtattcagatcctcggcaataaagaggtccgaacctgtgcgcccgatcc

SEQ ID NO: 1708 - DNA, 1456 bp, Pennisetum glaucum
ccggcagcctctacccggcagcggcggccgggcgcacggcggcgggcttcctcagctgctccagctcgtccagagactgcagggtgagcgcgtcctactcccactcaatcagccggatgctgagcggggtgcggtcggcggcgcgcaagaagctcttcagggccgacccggcggagctgctgggcgtcgccagctggccggagacgggcggcgccgggcaacagcagcagcactggtggacggcgctggagcacaacttcgtgctcgaggccatcgacgacgagtacggcggggtcgttgtcgacgccgacaggctgccggccgacaaggccgccttcgagcgctcgctcgcggcgtcgctgtcctactggaagtccgtggggaagaaaggggtgtggctgaaattacctgtagatcgtgccgagttcgtgcccttggcagtaaaggaaggtttcaagtatcaccacgctgaggaatcgtacttgatgatgacgtactggatccccgacgagccaaacatgctcccagcaaatgcttcccatcaggttggagttgggggctttgtgatcaatgatcagatggaggtcctagtggtgcaagagaagtatcacggttcgtcgttggatggtgtgtggaaactccccactggtttcattcttgcgtcggaggaaatctacacgggagctagcagagaagtgaaggaggaaactggggtcgacaccgagttcgtcgatgtcgttgccttcaggcatgcccacaacgtcgcgtttcagaagtccgacctattcttcatttgcatgctgaggccggtatcgagtgagatcaagattgacgagacagagattcaggcagcaaagtggatgccgctggaggagttcgtgaagcagcccttcatccaggaagaccacatgttccagaagatcatggacatctgcatccagcgcctgcggaagtgctactgcggcctgacgccgcaccacgtcgtctccaagttcgacgaccggacgtcgacgctgtactacaacgtcgccgagccagaggacgtgaactgcagcgccgcttgatggacggatcgccgggcggcccgaacatagatttttgctgcgccaagtttcgtgatgcagcagcaatgttagtgacgccattatagctgtgtgtgtgaagcagctgaaagcgcgaggcatatagcgttgccaagcctgtaaatataattctaggataggcgatgacggatcggtagctgcagtttggatagggaatatctgtattcggatcctcgtcagcaataaaagaatccaagcaggtgctaccgatccgagaagaaaatgccctcccagtgtgtcagagaatcagcagtttgcagcacgaactcagccggagcatcaacttcagaatgctgtcaatggcggcgtcctgcctgacggcctcgccgctcgtacaaaagcgggatgttgag

SEQ ID NO: 1709 - DNA, 1486 bp, Brachypodium distachyon
cggacatcgcaaggcacccccaccgtatcagttcctagcagccgagttcacttccgacgcagccagcgcaaacaacggcaaactgctgtttctgttcccgcacttgggcagttggatagcgcttcttccttaatctcatcagttaagatagatagcactttgcatcaacgatggagagctgcagcttggtcgacacggccacggccactctctgctcgacggcaggcgggcgccgccgtgcccggagcggcaccaggttcttgaactgctcgagctcctccaaagagcacggagtgagcgcgtcctgctccatcggccggatgctgagcggggcgaagtcggcggcgcggaggaagctgttcaggagcgaacccgactggctgggcttggactggtcggacaccagcggcgccgccggccaccattggtggacgactctggagaacaacttcgtgctggaggcttcagaggacgagtacggcggggtcgtcgttgacgccgacaggctgccgtccgaccaggccgccttcgccggttcactcgccgcttcgctctcctactggaaatccgtgggtaagaaaggggtgtggctgaagctaccggtggatcgctctgaatttgtccccatagcagtgaaggaaggattcaagtaccaccacgcggaggagtcgtacttgatgctgacatactggatccccgacgagccgtctctactcccagcaaatgcttctcaccaggttggcgttgggggcttcgtgatcaacgatcaaatggaggtcctagtggtgcaagagaagtatcgcggttcgcccatggacggtgtttggaaactacccacgggtttcattctcgcgtcagaggaaatatttacaggagctatcagagaagtcaaggaggagacgggggttgacactgaatttgtggacgtggttgctttcaggcatgcgcacaacgtggcatttcagaagtccgacctgttcttcatctgcatgctgagacccgtatcaagccagatcaagatcatcgacgagacagagattcaggctgcgaagtggatgccgctggaggagttcgtgaagcagccgttcatccaagaggaccacatgttccagaagatcatggacatctgcatccagcggctgaggaagtgctactgcggcctcacggcgcacgacgtcgtctccaagttcgacggcagggcgtccaccttgtactacaacgtagacgaacccgaggatgtgaactgcagcgccgcttgacgacgggtcgcctgcctctttcacttttgctgtgcagcgcgaagtttcagcgtgcagcagcggcaggcaatggaaccgaggggacaagaaatgcattagagcaactgaattggcctctgtgtatatatgcgtagaagctgacaatcttctttagataaaggcaaggcgggttagctctgtcatgtcgtgtaatattcatcaatgaagcaatttgacggacggttgca

SEQ ID NO: 1710 - DNA, 1890 bp, Brachypodium distachyon
tcagccattcgccctcggacatcgcaaggcacccccaccgtatcagttcctagcagccgagttcacttccgacgcagccagcgcaaacaacggcaaactgctgtttctgttcccgcacttgggcagttggatagcgcttcttccttaatctcatcagttaagatagatagcactttgcatcaacgatggagagctgcagcttggtcgacacggccacggccactctctgctcgacggcaggcgggcgccgccgtgcccggagcggcaccaggttcttgaactgctcgagctcctccaaagagcacggagtgagcgcgtcctgctccatcggccggatgctgagcggggcgaagtcggcggcgcggaggaagctgttcaggagcgaacccgactggctgggcttggactggtcggacaccagcggcgccgccggccaccattggtggacgactctggagaacaacttcgtgctggaggcttcagaggacgagtacggcggggtcgtcgttgacgccgacaggctgccgtccgaccaggccgccttcgccggttcactcgccgcttcgctctcctactggaaatccgtgggtaagaaaggggtgtggctgaagctaccggtggatcgctctgaatttgtccccatagcagtgaaggaaggattcaagtaccaccacgcggaggagtcgtacttgatgctgacatactggatccccgacgagccgtctctactcccagcaaatgcttctcaccaggttggcgttgggggcttcgtgatcaacgatcaaatggaggtcctagtggtgcaagagaagtatcgcggttcgcccatggacggtgtttggaaactacccacgggtttcattctcgcgtcagaggaaatatttacaggagctatcagagaagtcaaggaggagacgggggttgacactgaatttgtggacgtggttgctttcaggcatgcgcacaacgtggcatttcagaagtccgacctgttcttcatctgcatgctgagacccgtatcaagccagatcaagatcatcgacgagacagagattcaggctgcgaagtggatgccgctggaggagttcgtgaagcagccgttcatccaagaggaccacatgttccagaagatcatggacatctgcatccagcggctgaggaagtgctactgcggcctcacggcgcacgacgtcgtctccaagttcgacggcagggcgtccaccttgtactacaacgtagacgaacccgaggatgtgaactgcagcgccgcttgacgacgggtcgcctgcctctttcacttttgctgtgcagcgcgaagtttcagcgtgcagcagcggcaggcaatggaaccgaggggacaagaaatgcattagagcaactgaattggcctctgtgtatatatgcgtagaagctgacaatcttctttagataaaggcaaggcgggttagctctgtcatgtcgtgtaatattcatcaatgaagcaatttgacggacggttgcagtagcacacggaaaggatgcgtggcaaagttgccaacaatcggaaaaactgaaagttagcccaacactttcgaagaaaacaacaatgtaaacttcgcttcaacaagaaagccatcgaggctgactaacaagttgacctcccgacgaaagcctaggggatcggattgaggtttgcacatatctgattattcactccgtcctgattcaacacttggaactaagttggtttcgatggaatataccgtacttcctccatttcacaaaaaatagcgcccacgttttccgaggtcgaattttgaccaatgattagatcaattgtacgtagattatatgttataaattttatatcgttggaaaagtttttaaaatacgaatctaatgatataattt

SEQ ID NO: 1711 - DNA, 1716 bp, Secale cereale
cgtggccccttatctccgtgacagtgacgtggaccgcctgggcttgggcagagatttttataagctcctcggccgctctgtggagctcagccattcgctctcgggcatcgcaaggcacgcacgccgtatcagttcataccccaacggtagcatcgctcgtgaagtcgtgatagcaccgcaacttgggtatcactttactaccttgatctcagtcgggagggaagggattggtcgagctacaacttgccagcgatggagagctgcagcttggtcgacacggccgccgccgccgctctgtgctcgacgccgggcgggcgccgccgcggccgcgccgggagcgcgcgaggttctcaactgctccagctcctccagagagcacggggtgagcgcgtcctactccatcggccggatgctgagcggggtgaggtcggcggcgcggaggaagctgttcaggagcgagcccgagtggatgggcgtcaactggccggactccgccggccaccattggtggaccactctagagaacaacttcgtgctggaggcttccgaggacgagtacgcggggtcgtcgtcgacgccgacaggctgccggccgacgaggccgccttcgcccggtcactcgcggcgtccctctcctactggaaatccgtgggaaagaaaggggtctggctgaaattgcctgtggatcgatctgagtttgttcccatagcagtcaaggaagggttcaagtaccaccacgcggaggaggcctacttgatgctgacgtactggatccccgacgagccgtctctgctcccagcgaacgcttctcatcaggtcggcgtcgggggcttcgtgatcaatgatcaaatggaggtcctcgtggtgcaagagaagtaccgcggctgggcgttggatggtgtctggaaactccccacggggttcatccaggagtcagaagaaatatatacgggagccatcagagaggtccaggaagaaacaggggttgacactgaattcgtggatgtggttgccttcaggcacgcgcacaacgtggcgtttcagaagtcggacttgttcttcatctgcatgctgaggcctctgtcgagcgcgatcaagatcgacgaaacagagattcaggcagccaagtggatgccgctagaggagttcgtgaagcagccgttcatccaggaggaccacatgttccagaagatcatggacatctgcatccagcggctgaggaagtgctactgcggcctcacggcgcacaacgtcgtctccaagttcgacggcaggcagtccaccctctactacaacgtgggcgaacccgaggatgtcaactgcgatgctgcatgacgggtcgcctgattttttctttgctctgcgacctctgccgtttaggcattgtgcggtaccaaacttctaccagcattaaggcaagcctctgtatatatgtgtaggaaactgtaattagacatcggcgggatgggttagctctgtcgtttagtgatatgtgtatgtatgtattcgtcagtggaccggcttgatgggtacgggtggtggcaattatctactagtagtaggaatgcagaggccgggggtcttcctcgttttctaaaaaaaaaatctactagtagtaggagtacaagaaaatggcaatgatctataagagatattttctttaaaaaaaaaaaaaaaaaaaaaaaaaaaaaaaaaaaaaaaaaaaaaaaaaaaaaa

SEQ ID NO: 1712 - DNA, 1451 bp, Secale cereale
tcaggccgtatcagttcataccccaacggtagcatcgctcgtggtagcaccgcaacttgggtatcactttactaccttgatctcagtcgggagggaagggattggtcgagtcacagcttgccagcgatggagagctgcagcttggtcgacacggccgccgccgccgctctgtgctcgacgccgggcgggcgccgccgcggccgcgccgggagcgccgcgagattcttcaactgctccagctcctccagagagcacggggtgagcgcgtcctactccatcggccggatgctgaacggggtgaggtcggcggcgcggaggaagctcttcaggagcgagcccgagtggatgggcgtcaactggccggactccgccggccaccattggtggaccaccctggagaacaacttcgtgctggaggcttccgaggacgagtacggcggggtcgtcgtcgacgccgacaggctgccggccgacgaggccgccttcgcccggtcactcgcggcgtccctctcctactggaaatccgtggggaagaaaggggtgtggctgaaattgccggtggatcgatctgagtttgttcccatagcagtcaaggaaggattcaagtaccaccacgcggaggaggcctacttgatgctgacgtactggatccccgacgagccgtctctgctcccagcgaacgcttctcatcaggtcggcgtcgggggcttcgtgatcaatgatcaaatggaggtcctagtggtgcaagagaagtaccgcggctgggcgttggatggtgtctggaaactccccacggggttcatccaggagtcagaagaaatatacacgggggccatcagagaggtccaggaagaaacaggggttgacactgaattcgtggatgtggttgccttcaggcacgcccacaacgtggcgtttcagaagtcggacctgttcttcatctgcatgctgaggccattgtcgagcgcgatcaagatcgacgaaacagagattcaggcagcaaagtggatgccgctggaggagttcgtgaagcagccgttcatccaggaggaccacatgttccagaagatcatggacatctgcatccagcggctgaggaagtgctactgcggcctcacggcgcacaacgtcgtctccaagttcgacggccggcagtcgaccctctactacaacgtgggcgaacccgaggatgtcaactgcgacgctgcatgacgggtcgccggattcttttcttttgccctgggacctctaccgtttaggcattgtgcggtaccaaacttctaccagcattaaggcaagcctctgtatatatgtgtaggaaactgtaattagacatcggcgggatgggttagctctgtcgtttagtgatatgtatgtatgtattcgtcagtggaccggcttgatgggtacgggtggtggcaattatctactagtagtaggagtacaagaaa

SEQ ID NO: 1713 - DNA, 1478 bp, Triticum aestivum
agttcatactcacacgcgcaacggtagcatcgctcgtgatagcactgcaacttgggtggcgctttgtctttgatctcagtccggagggaagggattggtcgagccaccacttgccagcgatggagagctgcagcttggtcgacacggccgccgccgccctctgctcgacggcgggcgggcgccgccgcggcagcgccggaaacaccatgaggttcttcaactgctccagctcatccagagagcacggggtgagcgcgtcctactccatcggccggatgctgagcggggtgaggtcggcggcgcggaggaagctgttcaggagcgagcccgagtggatgggcgtcaacttgcccgactccaccggccaccattggtggaccaccctggagaacaacttcgtgctggaggcctccgaggacgagtacggcggggtcgtcgtcgacgccgacaggctgccgtccgacgaggccgccttcgcccggtcgctcgcggcgtccctctcctactggcagtccgtgggaaagaaaggggtgtggctgaaattgccagtggatcgatctgagtttgttcccatagcagtcaaggaaggattcaagtaccaccacgcggaggaggcctacttgatgctgacgtactggatccccgacgagccgtctctgctcccagcgaacgcttctcatcaggtcggcgtcgggggcttcgtgatcaatgatcaaatggaggtcctagtggtgcaagagaagtatcggggctgggcgttggatggcgtctggaaactccccacggggttcattcaggagtcagaagaaatatacacgggagccatcagagaggtccaggaagaaacaggggttgacactgaattcgtggatgtggttgccttcaggcacgcgcacaacgtggcgtttcagaagtcggacctgttcttcatctgcatgctgaggcctctgtcgagcgcgatcaagatcgacgaaacagagattcaggcagcaaagtggatgccgctggaggagttcgtgaagcagcccttcatccaggaggaccacatgttccagaagatcatggacatctgcatccagcggctgaggaagtgctactgcggcctcacggcgcacaacgtcgtctccaagttcgacggcaggcagtccaccctctactacaacgtgggcgagcccgaggatgtcaactgcgacgctgcctgacgggtcgccggattctttttttctttgctctgcgaccgtctaggcgttgtgcggtgcaaagttgtagcattaaggaggcaactggattggcctctgtatatacgtgtaggagactgtaattagacatgggcgggacgggttagctctgtcgcgtagtaatgtgtactactattcgtcagtgtaccggtggtggcaattatctagaagaaatggcagtgatctggaagatatatctttctttcagtttcagtgtattgtgcactttgaaaaaaaaaa

SEQ ID NO: 1714 - DNA, 1495 bp, Triticum aestivum
caacggtagcatcgctcgtgatagcactgcaacttgggtggcgctttgtctttgatctcagtccggagggaagggattggtcgagccaccacttgccagcgatggagagctgcagcttggtcgacacggccggcgccgccgctctctgctccacgccgggcgggcgccgccgcggcagcgccggaaacaccatgaggttcttcaactgctccagctcatccagagagcacggggtgagcgcgtcctactccatcggccggatgctgagcggggtgaggtcggcggcgcggaggaagctgttcaggagcgagcccgagtggatgggcgtcaactggcccgactccaccggccaccattggtggacgaccctggagaacaacttcgtgctggaggcctccgaggacgagtacagcggggtcgtcgtcgacgccgacaggctgccggccgacgaggccgccttcgcccggtcgctcgcggcgtccctctcctactggcagtccgtgggaaagaaaggggtgtggctgaaattgccagtggatcgatctgagtttgttcccatagcagtcaaggaaggattcaagtaccaccacgcggaggaggcctacttgatgctgacgtactggatccccgacgagccgtctctgctcccagcgaacgcttctcatcaggtcggcgtcgggggcttcgtgatcaatgatcaaatggaggtcctagtggtgcaagagaagtatcgcggctgggcgttggatggtgtctggaaactccccacggggttcattcaggagtcagaagaaatatacacgggagccatcagagaggtccaggaagaaacaggggttgacactgaattcgtggatgtggttgccttcaggcacgcgcacaacgtggcgtttcagaagtcggacctgttcttcatctgcatgctgaggcctctgtcgagcgcgatcaagatcgacgaaacagagattcaggcagcaaagtggatgccgctggaggagttcgtgaagcagcccttcatccaggaggaccacatgttccagaagatcatggacatctgcatccagcggctgaggaagtgctactgcggcctcacggcgcacaacgtcgtctccaagttcgacggcaggcagtccaccctctactacaacgtgggcgagcccgaggatgtcaactgcgacgctgcctgacgggtcgccggattctttttctttgctctgcgaccgtctaggcgttgtgcggtgcaaagttgtagcattaaggaggcaactggattggcctctgtatatacgtgtagaagactgtaattagacatgggcgggacgggttagctctgtcgcgtagtaatgtgtactactattcgtcagtgtaccggtggtggcaattatctagaagaaatggcagtgatctggaagatatatctttctttcagtttcagtgtattgtgcactttgaaaagaccatgtttctccacgctcctctaattgcattgattttc

SEQ ID NO: 1715 - DNA, 1977 bp, Oryza sativa
cccccacgcatttggcgtgtccccttatcctcgtgagcgtgacgtgccctcgtcgacgcgatttttataagcatcttgtggagctcagcgatcagccactgccgcatcgcaagctggagcagcgagcaccgtagcagcagcagcagcagcctcctggtacacactgcactacacagcgcagcagctagcgatagtgtatcgcacttactggatacgcagtcgagcatctccagcagcagcagcagcggagtgatcagcgatggagagcagcttggtcgacacagccgccgccactctctgcctggcggcggccgtcggcgggcggcgccgcgccggcagcttcttgaactgctcgtgctcctccaaagagtacagggtgagcgcatcctactccattgggcggatgctgagcggggtgaggtcggcggcgcgcaagaagctgttcaggagcgagccggccgacctgctggggatcagctggtcgccggactcgccgccgtcgaacggcaccgacggcggccaccaccaccattggtggacggctctcgagaacaacttcgtcctcgagtcctccgaggacgagtacggcggggtcgtcgtggacgccgacaggctgccgtccgacaaggccgccttcgcgcgctcgctcgcggcgtcactctcctactggaagtccgtgggaaagaaaggggtttggctaaagttaccagtggatcgctcagagtttgttcctatagcagtgaaggaaggtttcaagtaccaccatgccgaggaagcatatgtgatgctgacatactggattcctcatgaagagccatgtatgctccctgcaaatgcatctcaccaggttggagttggggggtttgtgatcaacgatcaaatggaggtcctagtggtgcaagaaaagtactgtggttcatctttggatggtgcttggaaactccccacagggttcattcttgcgtcggaggaaatatttacaggagctactagagaagtcaaggaagaaactggggttgacactgaatttgtggacgttgttgcttttaggcatgcacacaacgtggcatttcagaagtccgacctgttcttcatctgcatgctaaggcctacatcaaacaatatcaaaatcgacgaaacagagattcaggcagcgaagtggatgccgctggaggagttcgtcaagcagccgttcatccagggggaccacatgttccagaagatcatggacatctgcatccagaggctcaggaagtgctactgcggcctgaccgcgcacaacgtcatctccaggttcgacggcaggaggtcgacgctgtactacaacgtttctgaacctgaggatgtgaactgcaatgcttcttgacaacggatcgcccaaccttccgtcaggttcgcgttgtgatctagcattaggctctgtgcaatgcagtgcagagtctcgagtacagcgacctgggtaactgcttgtgaagcagaaatcctctgtaaatatgaaaagaagataggatttatggcaggtcgggtagctctgaccggctgttgcagtttcacgtagattgcagctgaactgaagaagatcttgaagacttttcagaaaatttcgtttctgtgtatgcgctcacgctaagcagctgcttaatgtgtatctagtgttgctatggcgaaagcaaaggacacgtacacaccaagaaccaggacactagtaggatgtgattgcgctccgagttctgcacttacgcgaacagtgtgccaaaatttaggtacttgcaacattgcaagtatcaaatgtgtatgcaaccccttctttgcgcgtgcaaagtataattgaagaacctcctgaatgtctcatcactattctgtaagtgtgattttgcagccatacatgacacaacacattcgagtcttcgacgccttgtctgctgtattaatcagttttctccatttggaaatgaaagacgggttgaatgattttgg

SEQ ID NO: 1716 - DNA, 1811 bp, Oryza sativa
actgccgcatcgcaagctggagcagcgagcaccgtagcagcagcagcagcagcctcctggtacacactgcactacacagcgcagcagctagcgatagtgtatcgcacttactggatacgcagtcgagcatctccagcagcagcagcagcggagtgatcagcgatggagagcagcttggtcgacacagccgccgccactctctgcctggcggcggccgtcggcgggcggcgccgcgccggcagcttcttgaactgctcgtgctcctccaaagagtacagggtgagcgcatcctactccattgggcggatgctgagcggggtgaggtcggcggcgcgcaagaagctgttcaggagcgagccggccgacctgctggggatcagctggtcgccggactcgccgccgtcgaacggcaccgacggcggccaccaccaccattggtggacggctctcgagaacaacttcgtcctcgagtcctccgaggacgagtacggcggggtcgtcgtggacgccgacaggctgccgtccgacaaggccgccttcgcgcgctcgctcgcggcgtcactctcctactggaagtccgtgggaaagaaaggggtttggctaaagttaccagtggatcgctcagagtttgttcctatagcagtgaaggaaggtttcaagtaccaccatgccgaggaagcatatgtgatgctgacatactggattcctcatgaagagccatgtatgctccctgcaaatgcatctcaccaggttggagttggggggtttgtgatcaacgatcaaatggaggtcctagtggtgcaagaaaagtactgtggttcatctttggatggtgcttggaaactccccacagggttcattcttgcgtcggaggaaatatttacaggagctactagagaagtcaaggaagaaactggggttgacactgaatttgtggacgttgttgcttttaggcatgcacacaacgtggcatttcagaagtccgacctgttcttcatctgcatgctaaggcctacatcaaacaatatcaaaatcgacgaaacagagattcaggcagcgaagtggatgccgctggaggagttcgtcaagcagccgttcatccagggggaccacatgttccagaagatcatggacatctgcatccagaggctcaggaagtgctactgcggcctgaccgcgcacaacgtcatctccaggttcgacggcaggaggtcgacgctgtactacaacgtttctgaacctgaggatgtgaactgcaatgcttcttgacaacggatcgcccaaccttccgtcaggttcgcgttgtgatctagcattaggctctgtgcaatgcagtgcagagtctcgagtacagcgacctgggtaactgcttgtgaagcagaaatcctctgtaaatatgaaaagaagataggatttatggcaggtcgggtagctctgaccggctgttgcagtttcacgtagattgcagctgaactgaagaagatcttgaagacttttcagaaaatttcgtttctgtgtatgcgctcacgctaagcagctgcttaatgtgtatctagtgttgctatggcgaaagcaaaggacacgtacacaccaagaaccaggacactagtaggatgtgattgcgctccgagttctgcacttacgcgaacagtgtgccaaaatttaggtacttgcaacattgcaagtatcaaatgtgtatgcaaccccttctttgcgcgtgcaaagtataattgaagaacctcctgaatgtctcatcactattctgtaagtgtgattttgcagccatacatgacacaacacattcgagtctt

SEQ ID NO: 1717 - DNA, 893 bp, Sorghum bicolor
agcttttagtttagtggttcacaagagaacaagtcggcacccatcctttcccaccggcgacttgcccccaccaatccactagtgctacatgcctacacctccatgcaatccatccatctccatcctccttggctccttcgcatcgctgggccttagcatactgtcaggctaccagcaagcgaagtagccagccatgctcggcctccgcggcctccccgccgcgccaccggccgccgcagcaccgccgaaggggcgatgcagcgccgccgccccgccaccagcgatgacaggccggctgtcgctggctgtcccggcggctgtctcgctctcgctcgtcctctggtccagtccagtgaacgccggcatcctgtccggcttctcggggctggagtcgactccaggccccgacctcccccggctcgagttcctggagaaatggaatgcggagaaccagaagaagtacgccgagttcgataacaggttcaagaagtccaaggtgctgcaggacctgctcgagaagtccaagaagaacaaagagaagaatgagaggatgatccaggacaagtactgcctgcggggcgccgagtggggcgtcggggactgctccacggagggcatgaccgaccaggagagggaggacttcatttcggagctcaagaagagaaccggagcagaatagctagctgagcacatcattcagtttcagcaggggaaatacccttaccaggggaaatacgcaaacaatctagaccagccctaaggccactaggagtgcgagaatgttcaccaaaataatgggagctccgaatttgcaaaacatatgtacccattgtaaaatgcacttggcaccagtaaattaccatctactctaattctcaagagccccaaattcc

SEQ ID NO: 1718 - DNA, 1265 bp, Sorghum bicolor
gaaaaagaaaaataacttcaatcatgaagttgttttagaaaaaaatgtttagaaaaaaaaggtcataaagttattatgagctatgtcaaacatgcacgtaattctcagggccgaactcaattttttgccctaattctcagggtccaaccgtaaaagacgtcttgttctactaattaatcatcagatgtaatcctaagaaatgtaacctcctagaagcagtttgctgcctttaatgttgtccatgtttcttcgtaaaaaaaaatcgtcagatttaaaattcaccatctatacatatataaactcgagcagcaaagacaaactaccaagacaagtgcacgcaaaaaaaagatcaaggagtgtaatccccagatggtgttttagcttttagtttagtggttcacaagagaacaagtcggcacccatcctttcccaccggcgacttgcccccaccaatccactagtgctacatgcctacacctccatgcaatccatccatctccatcctccttggctccttcgcatcgctgggccttagcatactgtcaggctaccagcaagcgaagtagccagccatgctcggcctccgcggcctccccgccgcgccaccggccgccgcagcaccgccgaaggggcgatgcagcgccgccgccccgccaccagcgatgacaggccggctgtcgctggctgtcccggcggctgtctcgctctcgctcgtcctctggtccagtccagtgaacgccggcatcctgtccggcttctcggggctggagtcgactccaggccccgacctcccccggctcgagttcctggagaaatggaatgcggagaaccagaagaagtacgccgagttcgataacaggttcaagaagtccaaggtgctgcaggacctgctcgagaagtccaagaagaacaaagagaagaatgagaggatgatccaggacaagtactgcctgcggggcgccgagtggggcgtcggggactgctccacggagggcatgaccgaccaggagagggaggacttcatttcggagctcaagaagagaaccggagcagaatagctagctgagcacatcattcagtttcagcaggggaaatacccttaccaggggaaatacgcaaacaatctagaccagccctaaggccactaggagtgcgagaatgttcaccaaaataatgggagctccgaatttgcaaaacatatgtacccattgtaaaatgcacttggcaccagtaaattaccatctactctaattctcaagagcccc

SEQ ID NO: 1719 - DNA, 679 bp, Saccharum officinarum
  misc_feature (575)..(575): n is a, c, g, or t
  misc_feature (593)..(593): n is a, c, g, or t
aagcgaagtagctagccatgctcggcctccgcggtgtccccgccgcgccaccggccgcctcagcaccgtcgaaggggcgatgcagcgccgccccgccaccaccagcgatgacaggccgggtgttgctggctctccctgcggctgtctcgctctcgctcgtcctctggtccagtccagtgaacgccggaatcctgtccggcttctcgggactggagtcgactcccggccccgacctcccccggctcgagttcctggagaaatggaatgcggagaaccagaagaagtacgccgagttcgataacaggttcaagaagtccaaggtgctgcaggagctgctcgagaagtccaagaagaacaaagagaagaacgagaggctgatccaggacaagtactgcctgcggggcgccgagtggggcgtcggggactgctccacggaaggcatgacagaccaggagagggaggacttcatttcggagctcaagaagagaaccggagcagaatagcgagctgagcacatcatgcagtttcagtaggggaaatacccaaacaatctagaacagcccataggccactangagtacgagaatgttcancaaaataatgggagctcagaatttgcaatgcatttgtacccattgttaaatgcatttagcaccagtaaattaacatctacactaat

SEQ ID NO: 1720 - DNA, 989 bp, Setaria italica
aaaacccacatcgtcttatcgtttagtggttcacaagaggacagctcgacggcacctatctttcccgtcgtcagcaacttccttcacccgggccaagctagcagtgctccatccatccacccaccccatcctctaccagtaccagcgagcgaaggagctagccatgctcggcctcgtcgcggcgcccgcaccggccgcagcagcgccaccgagggggaggtgcggcgctgccgcgccgtcggagaaggccggcagggttgccttggccgtccccgcggccgccactctctcgctggtcctctggtccagtccagcgaacgccggcatcctgtcaggtttctccgggttggagtcgaggccaggcccggacatgccccggctcgagttcctggagaaatggaatgccgagaaccagaagaagtacgccgagttcgataacaggttcaagaactccaaggtgctgcaggacctgctcgagaagtccaagaagaacaaagagaagaacgagaggatgatccaggacaagtactgcctgcggggcgccgagtggggcgtcggggactgctcaacggaggggatgtctgaccaggagcgggaggacttcatttcggagctcaagaagagaactggagcggaatagggagctgacgatctcgtctttagcagatataaacgaggtggagcgcagagcacctcgccgctgtagggttccggggaatggccttcttacaccatcattgtagcctgattaccatggggaattggattctaggaaggcaggatgtacaccaagaaaatgctctttttttctccagaggccattaggagcatcaggagaatgtacacgagcatcacgcgggctcagaatttacaatgtatatgcgcgctatgcgtaaaatgcatctgcagaatgtagcagcaaattaccgttggcacagcatcgctagttcttgaagaagcggaagtgcgttactgacgcaatattgcaa

SEQ ID NO: 1721 - DNA, 839 bp, Cynodon dactylon
ggggaggtcggcacatatcttttcccgggacgcaccagccactgcgccgttgctcactccatccatcccgctcgcgctgctcagcttccgcgagcaagcagtacccagcaagcgaggtaacgcgccatgcttggcctcggcgggctcctcgctgcgtccccggccgccgcagcaccgcccaggacacggtgcagcgccgccacgccgccggaaagaaccggccgagcggtgtccttggccatccccgcggccgcgtcgctctcgctcgtcctctggtccagtccagtcaacgccggaatcttgtcaggttccacaggattggagtcggttccaggccctgacctgccccgggtcgagttcctggagaaatggaatgcggagaatcagaagaagtacgccgagtttgataacaggttcaagaactccaaggtgctgcaggagctgctcgagaggtccaagaagaacaaggagaagaacgagaggcagatccaggacaagtactgcttgcgcggtgccgaatggggcgtcggcgactgctccacggagggaatgacggaccaggagagggaggacttcatttcggagctcaagaaaagaactggggcagaatgaggagctgatgcaaacgaagggttcagtgcactgcagtgtgttgccgagaatgacctgccgagaattgtgatagccgaccggttgccacgagattgaattgacaagaagcaaggcacgaacgtagacagataatttgtcccagaatgtttttggtagggtaccaggagaaacctctgaaagatgcattgttttgggcagcctttgttttgtactatgtcttgtagtag

SEQ ID NO: 1722 - DNA, 1698 bp, Sorghum bicolor
aaaagttgcagcggcagtgttgaggccaccgatccacctctctcctagcactagcagcagcagcagcagcaatggcggtggagatcctcgagtcctgcatggtgaaacccagcgacgacgcggggacgacgacgacacccatgcacgtggtctggctctccaacctcgacctgctcgtggccaggagccacacgcccaccatctacgtgtaccggcggcccgccagccctgacgtcccgggcttcttctcgccggacgtcctcaaggccgccctgtccaaggcgctcgtccccttctaccccctcgccggccggctcgcgcaggacggcgctggtcgcccggagatccactgtaccggcgacggcgcgctcttcgtcaccgcgcgcgccgacgttaccctccaggacctcgccaccgccggcgggctcgccccgtcggatgagctgcggcagatgcttgtcccctccgcagccgacgacggcgaagaccgcgccggcatcttggccatgttccaggtgacgtccttcaagtgcggcggggtgtgcgtgggcgcggcgatccaccacacggcggcggacggcctcgcggcgctcgacttcgtcaacacgtgggccgccatcgccagcaagggcgtcgacgaggccgcgccgcgcccgtggctggaccgcacgctcctccgcgcgcgctcccctcccgacgtgcgcttcgaccacagcgagtactcccggcgcggcggcggcgatccaaaggcggcgagggtcccgttcgactccgccatcctgcccatgtctaaggcccagctggacgcgctcaagggcggcggcggcgaaggcagcaagaaggtgtccacgttcaaggccgtggtcgcccacgtgtggcggtgcgcgtgcacggcgcgcgggctggcgcaagacgaggacacgcgtctgtacatgaccgccgacgcgcggtcccgcgtccggccgccgctcccggaaggctacctcggcaacgccatcttccgcgcgtcgacggtggccaaggcgggggacgtcgtctcggagccgctcgacgccgtcgcgggcagggtgtccggcgccaccgcgcggctggacgacgagtacgtgcggtcgctggtggactgcctggagcaggtggtgagcgacgcggcggggctgcgcaagggggagtgggtcatgccggagaccgacctgtgggtgataagctggcaggggctgcccatctacgacgccgacttcggctggggccgcccggcgttcatgggccgggcgtgcctccagttcagcggcctcgtgtacctcgtccccggccccgacggcgacggccgcctcgacgtcgtcgtggccatggagcccaagagcctggccaggttcaaggagctgttctatgagctcgagggtgcagctgttccgtgcatggccaactgagctgctgtattccgtgctggccaggttcaaggagctgttctaccggccggcaaaacgatttttttttatccttacattgcgtatctacttcgacatctacggtagtactcagacgacatccttccttcgttttctgtgctagtactgcagcatttggcaaaagtaggagactgttcctggtcatgaaaaagtgggtgtgggtgggggatggttgcaactttattcgttttttcattatacttctctggccctgttcggaagatgtaattct

SEQ ID NO: 1723 - DNA, 2214 bp, Sorghum bicolor
tttatatttaatactccatgcatggttcaaagattcgatgtgatgaaaaatattgaaaaattttggcaaattttggaaactaaacaaggccttaattccacctcatcctagagctcctggccttgtacttgttcctgcaagcctgcaacagaaaaatcatgaatgcaacatcatcgatctccatggatgaacacctacgatggaagatcggcaaaacataacaatatagcacgcagcaggtactcgacgagatcgaacttcgagttcgactcattctaacataccaactaataatactgtgggagctcgtgcagtagcaatgtcgaacgatcctttgcccgtgaaaccaacttttttgcatttcgatcgggttcaccctcaccggctccggtccctcagcacgaacccctgtcgaacgatcgatcctttaataccaatgcaatataccatccgaccaaattaaaagttgcagcggcagtgttgaggccaccgatccacctctctcctagcactagcagcagcagcagcagcaatggcggtggagatcctcgagtcctgcatggtgaaacccagcgacgacgcggggacgacgacgacacccatgcacgtggtctggctctccaacctcgacctgctcgtggccaggagccacacgcccaccatctacgtgtaccggcggcccgccagccctgacgtcccgggcttcttctcgccggacgtcctcaaggccgccctgtccaaggcgctcgtccccttctaccccctcgccggccggctcgcgcaggacggcgctggtcgcccggagatccactgtaccggcgacggcgcgctcttcgtcaccgcgcgcgccgacgttaccctccaggacctcgccaccgccggcgggctcgccccgtcggatgagctgcggcagatgcttgtcccctccgcagccgacgacggcgaagaccgcgccggcatcttggccatgttccaggtgacgtccttcaagtgcggcggggtgtgcgtgggcgcggcgatccaccacacggcggcggacggcctcgcggcgctcgacttcgtcaacacgtgggccgccatcgccagcaagggcgtcgacgaggccgcgccgcgcccgtggctggaccgcacgctcctccgcgcgcgctcccctcccgacgtgcgcttcgaccacagcgagtactcccggcgcggcggcggcgatccaaaggcggcgagggtcccgttcgactccgccatcctgcccatgtctaaggcccagctggacgcgctcaagggcggcggcggcgaaggcagcaagaaggtgtccacgttcaaggccgtggtcgcccacgtgtggcggtgcgcgtgcacggcgcgcgggctggcgcaagacgaggacacgcgtctgtacatgaccgccgacgcgcggtcccgcgtccggccgccgctcccggaaggctacctcggcaacgccatcttccgcgcgtcgacggtggccaaggcgggggacgtcgtctcggagccgctcgacgccgtcgcgggcagggtgtccggcgccaccgcgcggctggacgacgagtacgtgcggtcgctggtggactgcctggagcaggtggtgagcgacgcggcggggctgcgcaagggggagtgggtcatgccggagaccgacctgtgggtgataagctggcaggggctgcccatctacgacgccgacttcggctggggccgcccggcgttcatgggccgggcgtgcctccagttcagcggcctcgtgtacctcgtccccggccccgacggcgacggccgcctcgacgtcgtcgtggccatggagcccaagagcctggccaggttcaaggagctgttctatgagctcgagggtgcagctgttccgtgcatggccaactgagctgctgtattccgtgctggccaggttcaaggagctgttctaccggccggcaaaacgatttttttttatccttacattgcgtatctacttcgacatctacggtagtactcagacgacatccttccttcgttttctgtgctagtactgcagcatttggcaaaagtaggagactgttcctggtcatgaaaaagtgggtgtgggtgggggatggttgcaactttattcgttttttcattatacttctctggccctgttcggaagatgtaattcttgttttttttctaaaatcaattgatttaaagtttgattgaaactaaataaaaaaa

SEQ ID NO: 1724 - DNA, 2205 bp, Sorghum bicolor
tttatatttaatactccatgcatggttcaaagattcgatgtgatgaaaaatattgaaaaattttggcaaattttggaaactaaacaaggccttaattccacctcatcctagagctcctggccttgtacttgttcctgcaagccaactaataatactgtgggagctcgtgcagtagcaatgtcgaacgatcctttgcccgtgaaaccaacttttttgcatttcgatcgggttcaccctcaccggctccggtccctcagcacgaacccctgtcgaacgatcgatcctttaataccaatgcaatataccatccgaccaaattaaaagttgcagcggcagtgttgaggccaccgatccacctctctcctagcactagcagcagcagcagcagcaatggcggtggagatcctcgagtcctgcatggtgaaacccagcgacgacgcggggacgacgacgacacccatgcacgtggtctggctctccaacctcgacctgctcgtggccaggagccacacgcccaccatctacgtgtaccggcggcccgccagccctgacgtcccgggcttcttctcgccggacgtcctcaaggccgccctgtccaaggcgctcgtccccttctaccccctcgccggccggctcgcgcaggacggcgctggtcgcccggagatccactgtaccggcgacggcgcgctcttcgtcaccgcgcgcgccgacgttaccctccaggacctcgccaccgccggcgggctcgccccgtcggatgagctgcggcagatgcttgtcccctccgcagccgacgacggcgaagaccgcgccggcatcttggccatgttccaggtcacgcgcgtgcgccgtgatgatttgatcagatcaccgcacgtaccttacctactagtagtagcgcttcgtacggtcatgcggcggcgctagctgacctcacgtttgcatctgcctgcctacgtatactcaggtgacgtccttcaagtgcggcggggtgtgcgtgggcgcggcgatccaccacacggcggcggacggcctcgcggcgctcgacttcgtcaacacgtgggccgccatcgccagcaagggcgtcgacgaggccgcgccgcgcccgtggctggaccgcacgctcctccgcgcgcgctcccctcccgacgtgcgcttcgaccacagcgagtactcccggcgcggcggcggcgatccaaaggcggcgagggtcccgttcgactccgccatcctgcccatgtctaaggcccagctggacgcgctcaagggcggcggcggcgaaggcagcaagaaggtgtccacgttcaaggccgtggtcgcccacgtgtggcggtgcgcgtgcacggcgcgcgggctggcgcaagacgaggacacgcgtctgtacatgaccgccgacgcgcggtcccgcgtccggccgccgctcccggaaggctacctcggcaacgccatcttccgcgcgtcgacggtggccaaggcgggggacgtcgtctcggagccgctcgacgccgtcgcgggcagggtgtccggcgccaccgcgcggctggacgacgagtacgtgcggtcgctggtggactgcctggagcaggtggtgagcgacgcggcggggctgcgcaagggggagtgggtcatgccggagaccgacctgtgggtgataagctggcaggggctgcccatctacgacgccgacttcggctggggccgcccggcgttcatgggccgggcgtgcctccagttcagcggcctcgtgtacctcgtccccggccccgacggcgacggccgcctcgacgtcgtcgtggccatggagcccaagagcctggccaggttcaaggagctgttctatgagctcgagggtgcagctgttccgtgcatggccaactgagctgctgtattccgtgctggccaggttcaaggagctgttctaccggccggcaaaacgatttttttttatccttacattgcgtatctacttcgacatctacggtagtactcagacgacatccttccttcgttttctgtgctagtactgcagcatttggcaaaagtaggagactgttcctggtcatgaaaaagtgggtgtgggtgggggatggttgcaactttattcgttttttcattatacttctctggccctgttcggaagatgtaattcttgttttttttctaaaatcaattgatttaaagtttgattgaaactaaataaaaaaa

SEQ ID NO: 1725 - DNA, 2202 bp, Setaria italica
agacaactgagctgcaaagttagcctctgaggagcgaggacatcgatccacctccctctcctagcagaaatggcggtggtggagatcctcgagtcttgcatggtgacgcccagcgacgcggccacgcccaagcatggcgtgtggctctccaacctcgacctcctcgtggccaggagccacacgcccaccatctacgtgtaccgacccagccccgggccgggccttcttctcgccggacgtcctcaaggccgccctgtcccaggcgctactcggtactaccccctcgccggccggttagggcttgacggcgctggccgcccggagatccactgcaccggcgacggcgtgctcttcgtcaccgcgcgcaccgacgccgccctccaagacctcggaggcttcgtcccgtccgacgagctgcggcggatgcttgtcccctcggccgacggcggcggcgacgagcgtgccggcattctggccatgttccaggtgacgttcttcaagtgcggcggcgtgtgcgtcggcgcggcgatccaccacatggcggcggacggcctcgcggcgctggacttcgtcaacacgtgggccgccatcgcgagaggcgccggcggcgaggccgcgccgcgccgcccttggctggaccgcacgctcctccgcgcgcgctcccctcccgacgtgcgcttcgaccacgccgagtactcccggcgcggaggcggcggttcgaaggccccgttcgactccgccatcctgcccgtgtccagggcccaggtcgacgcgctcaagggcggcaagaagctgtccacgttcaaggccgtggtcgcccacgtgtggcggtgcgcgtgcagggcgcggggcctcgcggcggcggaggacacccgcctgtacatgaccgccgacgcgcgctcccgcgtcaccccgccgctccccgacggctacctcggcaacgccatcttccgcgcgtcggcggtggccaaggtgggcgacgtcgtctccgggtctctcgacgccgccgcggacatgatctccggcgccaccgcccggctggacgacgagtacgtccggtcgctggtggaccacctggagcaggtggtgagcgacgcggcgggcctgcgcaagggggagtgggtcatgccggagacagacctgtgggtgattagctggcaggggctgccgatctacgacgcggacttcggctggggccggccggcgttcatgagccgggcctgcctccagttcagcggcctcgtgtaccttgtgcccggcccggacggcgacggccggctcgacgtcgtggtggccatggagcccaagagcctagcccggttcaaggagctgctctacgaggacctcaatccaaagcacaccaattggaacatgatggcaacgagcaacgtttcgcaccaagctgcgacaccgcccgagccgctccgaggccgggtggccatcgtgacgggcggctccggcggcatcggcgccgcggtcaccgcgcacctggcgtccctcggcgcccgcgtcgtggtcggctacgtcggcgacccggcccccgcggaccagctcgtcgcggcgctcaactcggggtcccgccctcccgcggcgccgccgcgcgccgtcgcggtggacgcggacgtgtccgacccggcgcaggtggcgcgcctgttcgacgcggcggaggcggcgttcgggccagacctgcacgtcctagtggccgccgcgggggtgcaggacgcggcgtacccgcgcatcgccgacaccacccccgagcagtgggacgccgcgttcggcgtgaacgcgcgcggcgccttcctgtgctgccgcgaggcggcgcggcggctggtccgcggcggcggcggccgcatcgtgaccttctcgtcgtccaacgtggggtcgctgcgcccggggtacggcgcgtacgtggcgaccaaggcggccgtggaggccatgaccaaggtgctggcaaaggagctcgccgggacggggatcacggccaacagcgtcgcgccggggccgatcgccacgcccatgttctacgcggggaagacggaggagcgcgtggcggccgccgcgcgggagtgccccatggggaggatcggcgagccggaggacgtggcgccggtggtgggcttcctgtgcaccgacgaagccgggtggatcaacgggcaggtcattcgtgtcaacggtggctacgtgtagagacatcagacacga

SEQ ID NO: 1726 - DNA, 1820 bp, Sorghum bicolor
gcagcttagcgccgacgctcatcttcctcgcagcgccgctcaggctcggtcccttagcgcagatcttctgctccttcccccactagcgctcaggctcggtcccaggatcggatcttccgcgcgtcggcggcttcccctcggcggcgtccagcgacggaggggcagtccccggctcggcggcggcgtccagcgacggaggggcagtcccaggctcggcggcggcgtcggcggctccctgcaccttctctcgccagtcgcctcgcgccctcgcctgcgtcctccgcgcaccggccggcgaccctgcgtacgcacctccctctcccctcctccgcctctgttgttcccgtgggagctcggccagctgcccagggtggccgggccttggctccgccggtggcttacatgtaattgcagagatgaacgtagtggtgccaccacaatctccacatcttcgcctatatgaattcgccaagagtgctctcatcagaatttttgcctttccttatgccacggtatgtgacctgtattgcgacggtggagtggatacagacaagtggtgtgattgccaggttggccactacataggcatcgatgcctctgcgtccggtgtcaatgatgcccgtgagctatgggacaacaagaggaaacctttcaccgctgaattcatcgagttggatcctactgatgatggttttgaagctcaagtgcaggaaaagggcatccaagcagatatggtttgctgtatgcagcacttgcagttatgctttgagagtgaagaacgggccaagaagcttctgaacaatgtatcatcacttctcaaacctggaggctacttttttggcttgactccagattcatctacaatatggacaaagtatcaaaagaatgttgaggcttcacataataagggtctgaaggctgttccaaatagcattcgctcagagaactatacaattacctttgaagtcgaggaagaaaagtttcccgtttttggaaagaagtaccaactcaaatttgcgagtgatgcagtgtttgaaaatcactgcctagttcactttcccagccttttgagattagcaagggaagctggacttgaatatgtggagattcagaatttaaccgagttttatgatgataacagaacacaatttgctccaatgcttggtggttacagtgcaagttttttggatgctcgtgggaagcttgttgctcgttcctacgacattttaggcttgtattcaacatttgtattccagaagcctgatccagatgcaataccaccgattgtatctcccgacttgcatgatcctgataatgctcatgaagagcaagaatggctccagccacagcaggcatcagtggaagatgagaggcgcttgcatgcggatgtgcttcccatagacccagcgaaaggcatcctgggtcctggacctgcagacatgaggctttagttgctggaaattcaaatgcagctgaacctgggtagtgatgttttttcatgtgcggtgttaccactttccactaaggacattttcccatagccccatgtggccatgggacccatatgagttcagaaaaatatcaaacaacattacaaggctatgtaatgttcgtagttttgaggcttgaccagatcttgccgtaaacgacatgttttatgaccagaatgagtaccattttttaatgtcctaaaattatttctggctgcaaggctcaacgaaatcagttcagtgtatgctctcgtctctgtcttagggcagctgaactgccgaaatgatccaaactttaacaaataatgcaatatatttcataatctgttt

SEQ ID NO: 1727 - DNA, 1873 bp, Setaria italica
gcttccaccccttcgccgcctctatcgtcgcggctttatcccggccgcctctctgctcccgcgtcggcgacgagcggccaccgggctgcgtctcggccaccgcgaggccccaccaccctgatcttctatcccggtggcgcggccctggcagacgttgtggtcccccggcgcaccgtaccaggtcccggctgccgcccgttgccccttggcggccgccggtagacacggtcctcccagctgccgccctgcgctggtgccggcgctctgtgccctggtcgtggatcccacctcccggccgtcggcctgcacccccacccaagccgccgccccacgcctctcccggccacagtccggcggcctgcggtagtagtggtcaagagatgaacgtggcagtgccaccaccaccaccaccacatcttcggctatatgaatttgccaagaccgccctcatcaaaattttttcctttccttatgctacggtctgtgacttgtattgcgatggtggagttgatactgacaagtggtgtgatgcccaggttggccactacataggaatcgatgcctctgcatcgggtgtcagtgatgcccgtgagctatgggagaacaagaggaaacctttcactgctgagttcatcgagttggatccttctgatgatgattttgaagctcaagtgcaggaaaagggcatccaagcagatatagtttgttgtatgcagcacttgcagttatgcttcgagagtgaagaacgggcaaagaagcttctgaataatgtatcatcacttctcaaacctggaggctacttttttggcatgactcctgattcatctacaatatggacaaaatatcaaaagaatgttgaggcttcacataacaaaggtctgaagactgttccaaatagcattcgctcggagaattataccattacctttgaagttgaggaagaaaagtttcctttcttcgggaaaaagtaccaactcaaatttgcgagtgaagcagtatttgaaaatcactgcctggtccactttcccagccttatgagattagcaagggaggctggacttgaatatgtggagatccagaatttaactgagttttatgatgataacagaatacaatttgctccaatgcttggtggttacagtgcaagttttttggatgctcgtggaaagcttgttactcgttcctatgacattttaggcttgtattcaacttttgtatttcagaagcctgacccagatgcaataccacctattgtaacacccgacttgcatgatactgataatgctcacgaagaggaatggctccgacggcagcaggcatcagcagatgatgggaggcgctcccatacggatgtgcttcccttggatcatgagaaaggcatcctgggtcctggacctgcagatatgaggctttgatggtggtaattcaaatcctgcttgaactcgggtgatgatgcttttagtatttgtttttcctcccactgaggacaatttctggtgtgtgcactaagagttcacgaaaatatcaaacaacattaggaggctcccaatcctggcagagacgggttttctagctcttcgagtttgtccaactttcaaggccccaaggtgccttgaaacccttccgatgtaagccttcatcttcagagacaacaacatattctggttgcaaggggttatcaagcgtaagtatcaggctgttagttgttaacaatggccaacagcaaggaatctcttcttcatcagatccttttgcttccataatttcttgccactatatatcacttgaaccgtgttggtccatctgctccactgtatgagtagtaaaatgcacccaaagcagacaggaagtcttctcgtcagctcttaatcac

SEQ ID NO: 1728 - DNA, 814 bp, Saccharum officinarum
atttgaccaaccgttcaccactttgccttgttcccgttctcctcgtcgcatccctctcgtccgtacgccgccgcctggctcgccccgccgacagcgtctcagcccagatcgagcctcccccttcccaagacgggttctagttgggctcccgccaccgccgccctacaccaagtgacgaggccttcgccgacctcttcgccggcgaagagcgcccagcagagatgaacgtggtggtgccaccacaacctgcacatcttcgcctatatgaatttgccaagagtgccctcatcagaatttttgcctttccttatgctacggtatgtgacctgtattgcgacggtggagtggatacagacaagtggtgtgatgcccaggttggccattacataggcatcgatgcctctgcaacgggtgtcaacgatgcccgtgagctatgggagaacaagaagaaacctttcactgctgaattcatcgagttggatccttctgatgatggttttgaagctcaagtgcaggaaaagggcatccaagcagatatggtttgctgtatgcagcacttgcagttatgctttgagagtgaagaacgggcaaagaagcttctgaacaatgtatcatcacttctcaaacctggaggctactttttggcatgactccagattcatctacaatatggacaaaatatcaaaagaatgttgaggcttcacataataagggtctgaagactgttccaaatagcattcgctcagagactatacaatacctttgaagtcgagaagagaagttcccctttttggaaagaagtacaactcacatc

SEQ ID NO: 1729 - DNA, 1344 bp, Panicum virgatum
ggtccgcccctgattacagagatgaacgtggcagcgccaccacccccaccaccacatcttcgcctatatgaattcgccaagaccgctctcgtcaaaatttttgcctttccttatgccacggtctgtgacttgtattgcgatggtggagttgatacggacaagtggtgtgatgcccaggttggccactatataggaatcgatgcctctgcatcgggtgtcagcgatgcccgtgagctatgggagaacaagaggaaacctttcactgctgagttcattgagttggatccttctgatgatgatttcgaagctcaagtgcaggaaaagggcatccaggcagatattgtttgttgtatgcagcacttgcagttatgctttgagagtgaagaacgggcaaagaagcttctgaataatgtatcatcacttctcaaacctggtggctactttttcggcatgactcctgattcgtcaacgatatggacaaaatatcaaaagaatgttgaggcttcgcataataaaggtctgaaggctgttccaaatagcattcgctcggagaattataccattacctttgaagttgaggaagaaaagtttcccttctttggaaagaagtaccaactaaaatttgcaagtgaagcagtatctgaaaatcactgcctggttcactttcccagccttatgagattagcaagggaagctggacttgaatacgtggagatccagaatttaaccgaattttatgatgataacagaacacaatttgctccaatgcttggtggttacagtgcaagctttttggatgctcgtggaaagcttgttactcgttcctatgacattttaggcttgtattcaacttttgtattccagaagcctgacccagatgcaataccacctattgtaacacccgacttgcatgatactgacaatgctcaggaagaggattggctccggcggcagcaggcagccgatgacgggaggtgtccgcatgcggatgtgcttcccttggatcatgagaaaggcatcctgggtcctggacctgcagatatgagactttagctgctggtaattcaaatccggcttgaactaggagtaatgatgcttttatcgttttttccctcccacttacgaaaatctctggtgcttccactaagagttcacgaaaatataaaacaacgttactgagggtagccaatcttggcagagacacgttttctttgtacgctgggtgtattttcctactcgtacggttaagctggtggacaaatacggttgaattgtacccagacagaagtgtagagtggccgcaagctgacttgaaactaatccagtgcaagccctcgtccccgc

SEQ ID NO: 1730 - DNA, 1696 bp, Sorghum bicolor
tcaggctcggtcccttagcgcagatcttctgctccttcccccactagcgctcaggctcggtcccaggatcggatcttccgcgcgtcggcggcttcccctcggcggcgtccagcgacggaggggcagtccccggctcggcggcggcgtccagcgacggaggggcagtcccaggctcggcggcggcgtcggcggctccctgcaccttctctcgccagtcgcctcgcgccctcgcctgcgtcctccgcgcaccggccggcgaccctgcgtacgcacctccctctcccctcctccgcctctgttgttcccgtgggagctcggccagctgcccagggtggccgggccttggctccgccggtggcttacatgtaattgcagagatgaacgtagtggtgccaccacaatctccacatcttcgcctatatgaattcgccaagagtgctctcatcagaatttttgcctttccttatgccacggtatgtgacctgtattgcgacggtggagtggatacagacaagtggtgtgattgccaggttggccactacataggcatcgatgcctctgcgtccggtgtcaatgatgcccgtgagctatgggacaacaagaggaaacctttcaccgctgaattcatcgagttggatcctactgatgatggttttgaagctcaagtgcaggaaaagggcatccaagcagatatggtttgctgtatgcagcacttgcaggcgagttggttgttctctggaactttatgctttgagagtgaagaacgggccaagaagcttctgaacaatgtatcatcacttctcaaacctggaggctacttttttggcttgactccagattcatctacaatatggacaaagtatcaaaagaatgttgaggcttcacataataagggtctgaaggctgttccaaatagcattcgctcagagaactatacaattacctttgaagtcgaggaagaaaagtttcccgtttttggaaagaagtaccaactcaaatttgcgagtgatgcagtgtttgaaaatcactgcctagttcactttcccagccttttgagattagcaagggaagctggacttgaatatgtggagattcagaatttaaccgagttttatgatgataacagaacacaatttgctccaatgcttggtggttacagtgcaagttttttggatgctcgtgggaagcttgttgctcgttcctacgacattttaggcttgtattcaacatttgtattccagaagcctgatccagatgcaataccaccgattgtatctcccgacttgcatgatcctgataatgctcatgaagagcaagaatggctccagccacagcaggcatcagtggaagatgagaggcgcttgcatgcggatgtgcttcccatagacccagcgaaaggcatcctgggtcctggacctgcagacatgaggctttagttgctggaaattcaaatgcagctgaacctgggtagtgatgttttttcatgtgcggtgttaccactttccactaaggacattttcccatagccccatgtggccatgggacccatatgagttcagaaaaatatcaaacaacattacaaggctatgtaatgttcgtagttttgaggcttgaccagatcttgccgtaaacgacatgttttatgaccagaatgagtaccattttttaatgtcctaaaattatttctggctgcaag

SEQ ID NO: 1731 - DNA, 1430 bp, Sorghum bicolor
gacagaagccttcccgcgtcgcgctcgcgcacgccgtcctgcccgccccttttcacacccccgacgcaaccgcgcatcgccgcgcccgcccgccctctatatcctcccctcctcctcctccgtcccctctctgtcctcctcagcacaccagacaccgcccgccgcgaacaccaagcctgatcagcatcccagcccagatgttcctcgccgacaagtacagctcgctgctgccctccctccaccagcaccactccaagcccagccgccgccggagccagcagctgaagggggaggcggaccggttcggcgcggcgctggccgcgcgcctccggggcctgctgccgctgccggcctcccagctcgcggcgctcgcgcgggtggccgacctcctcgctctcacgctcgcggacgccggcgacgcgctcgccggcgccggcgagggcgacgcgtccgctgctgcggtcgccgcacaccttgacgccggggtcgcgctcctcgacgcctgcaacgccatcgccgtccgcctcgaccgcctccgcaggcgccgccttctcgcgcgcctcgcgctccacctcctttcatcaacctcctcctcgccgtccgggcgcgcgcgcgcgcgcgcggcgctcgcggaccgcggtgaccacccagcggcgtccccgtcccctctggcgccgctcccttcgctcccgttcgagcagccccgcgggcggctctcggccgccgcgcgcgtgcttgccgccgtggacgccgtctcctcgctcgcggcagcggccgcggccgccatcctcgtcggaggacccgccagcttcccccgggtatccggcggcggcgacctcccctgggcagagccgttcaacgcggtgtccggccagctcgcggcgctcgaaggcgccggcgaggtgggcgccgtcgacgaggccgtccggagtctcgcgtcggcgctggacgccgggaccgacaacgaggcggcggtgcgccccgcggcacaggagttggagaggcgcaccgaggagctcgcgccgcggctagaccgcctgtcggacgccgtcggcggcgtgttccgcgccgcgctgggcctccgcaacgccgagctcggctgcttcatggtgggacccgcggggaagccgtgtagtaaatacccgtagtcgtagctgtatatgtatacttacaatactgtactgggatactgctacagctgtaagtggagtgaagttgatgagtcgtgcagtacagggcgagttgggtgtgggatcatgtgtgtcagtgtcaaaggacgaggaggccactagttgcattttgcataattttggatatgtggcatccactgctgtatctgtatgggaaaggggaaaaaatgttgcaatctggtggtgtaatttcgcggcatataatattcatgtatagtttgaggagaaaccatcttcagg

SEQ ID NO: 1732 - DNA, 2256 bp, Sorghum bicolor
ccagttggggcaataagcactccagatcacttgtatttttcccgaaaaaggagacgataatagataaataaaaaataaaaaaaataatcggacaaagaggagggaagcgtcaaggcgcgggagacccgtaggtagacaggccaggccgcagcgcaacgagacaaagcgtcccgcagacgcgtcttacgcggcgggcccgcgcagcgacctcccggctcccgccacatcccctccgcttcccggaaacgcagacttgccggagacagaagccttcccgcgtcgcgctcgcgcacgccgtcctgcccgccccttttcacacccccgacgcaaccgcgcatcgccgcgcccgcccgccctctatatcctcccctcctcctcctccgtcccctctctgtcctcctcagcacaccagacaccgcccgccgcgaacaccaagcctgatcagcatcccagcccagatgttcctcgccgacaagtacagctcgctgctgccctccctccaccagcaccactccaagcccagccgccgccggagccagcagctgaagggggaggcggaccggttcggcgcggcgctggccgcgcgcctccggggcctgctgccgctgccggcctcccagctcgcggcgctcgcgcgggtggccgacctcctcgctctcacgctcgcggacgccggcgacgcgctcgccggcgccggcgagggcgacgcgtccgctgctgcggtcgccgcacaccttgacgccggggtcgcgctcctcgacgcctgcaacgccatcgccgtccgcctcgaccgcctccgcaggcgccgccttctcgcgcgcctcgcgctccacctcctttcatcaacctcctcctcgccgtccgggcgcgcgcgcgcgcgcgcggcgctcgcggaccgcggtgaccacccagcggcgtccccgtcccctctggcgccgctcccttcgctcccgttcgagcagccccgcgggcggctctcggccgccgcgcgcgtgcttgccgccgtggacgccgtctcctcgctcgcggcagcggccgcggccgccatcctcgtcggaggacccgccagcttcccccgggtatccggcggcggcgacctcccctgggcagagccgttcaacgcggtgtccggccagctcgcggcgctcgaaggcgccggcgaggtgggcgccgtcgacgaggccgtccggagtctcgcgtcggcgctggacgccgggaccgacaacgaggcggcggtgcgccccgcggcacaggagttggagaggcgcaccgaggagctcgcgccgcggctagaccgcctgtcggacgccgtcggcggcgtgttccgcgccgcgctgggcctccgcaacgccgagctcggctgcttcatggtgggacccgcggggaagccgtgtagtaaatacccgtagtcgtagctgtatatgtatacttacaatactgtactgggatactgctacagctgtaagtggagtgaagttgatgagtcgtgcagtacagggcgagttgggtgtgggatcatgtgtgtcagtgtcaaaggacgaggaggccactagttgcattttgcataattttggatatgtggcatccactgctgtatctgtatgggaaaggggaaaaaatgttgcaatctggtggtgtaatttcgcggcatataatattcatgtatagtttgaggagaaaccatcttcaggttggtcttcactcttctcgacgagtcactgccatcggacgagacgcacgtatacgtccatgcgatgcgccgaattcgcagttcgcaccgcgttgacgcacggaggaaccgcgtctgcaaaagcacctcgaaatgggctcgtcggcgtcggtcggtcgcagcgcgagcggcaccggcggcaaccgaaggaatgcgtgcgcttcgaagcaaccagcacacccgccaaaaatgtcagcgtgagcggcacacgacgacgacgccggccggccggaacggaaatagacgcgcggacggctctctgccgaaaggcccctcgcgcgcgcgaggtgttgatgctcaacgtcggccagccggccaggtcaagtgcccccgccgtgccgccgaacgtgtggtggccgcagccgtcacgcaagagagagcacgcgcgcgcacgggggcggataggcagccaactccagcgcagcggttgagactttagggccgtgtttagttcgctgaggaaaaaaaatttatgtagcactttcgtttgtttgtcttaattattatctaatcatagactaactagg

SEQ ID NO: 1733 - DNA, 1236 bp, Sorghum bicolor
gtctggtagtgacagatatctcccccgcgcgcgtcccagctccaggagtcctcgatggcgcccgcggccgcggctgtcgtcgcagcggcgagcccggccgcgctccttggctcgtcgtccccaaggagccgacgtccccagggccgtgcctgctcgtttcggtgcgacgggccgacactcgtgtcctcttctctgaagtcgtcgagctgcgccggccatcatccccggattcggcagccgtacggacggccgcactgcagccagcagcaggcggaagtggtgggcagcagcaccgtcgacgacgacgaggcgtgcgagctggtgagcggctcggacctcgtcatcggcgagggcgacgacagcgtcagcgcctaccttttcaaggccgtcaagaacaacaacggcaccggcatcctcctcctctccgacatcttcggcttcgaggactccgccacgcgcgacttcgcctaccgcgtcgcctgcaatggctacaatgtcctggttcccgacttgttccgagggaacccgtggaagctgaacctcccattcgacggcgacagcttccagcaatggctggccggacatgcgccggggcgggtgtccggcgacatcgacgcgtgcacgcggtggctggtggacgagttcaaagccgcgggggtgtccaagaagctgggcgtggtcgggttctgctacggcggcgggcgcctcgtcgagacgctggcgcgcgacgcggacagctgcttcagcgccggggtctgcttctacgggtcacggatggacgcgtccctgggcgaccgcatcgcggcgcccgtcctcttcgtgtgcggcgacggcgacccgctgtgcgccgtggagacggtgcgggagctggagagacgcgcgagaggcggcgcacgggcggcggtgtacgccggcaggggccatgggttcgcgcaccggccgcagtcggtggaggaggacgcggacgccgagaacgccttcaacgtgatgcgggggtggctgcacgaccacctgctcgcctgatcagacggtgtgtagacaagcgcggtacacgggggttgggtgttttgtacgtacgtacgtactaatgtggcagtggagtgcaaatcaaggatgttactaagtactagattgctagtaaagagtttgagtgaattcagtaatactcccgaatgcgaaagtgctatttatggtacttctaagacaatgcagaagctggatctttgttccattatc

SEQ ID NO: 1734 - DNA, 1486 bp, Sorghum bicolor
tgcggcgctgagcaagtggtggtctggtagtgacagatatctcccccgcgcgcgtcccagctccaggagtcctcgatggcgcccgcggccgcggctgtcgtcgcagcggcgagcccggccgcgctccttggctcgtcgtccccaaggagccgacgtccccagggccgtgcctgctcgtttcggtgcgacgggccgacactcgtgtcctcttctctgaagtcgtcgagctgcgccggccatcatccccggattcggcagccgtacggacggccgcactgcagccagcagcaggcggaagtggtgggcagcagcaccgtcgacgacgacgaggcgtgcgagctggtgagcggctcggacctcgtcatcggcgagggcgacgacagcgtcagcgcctaccttttcaaggccgtcaagaacaacaacggcaccggcatcctcctcctctccgacatcttcggcttcgaggactccgccacgcgcgacttcgcctaccgcgtcgcctgcaatggctacaatgtcctggttcccgacttgttccgagggaacccgtggaagctgaacctcccattcgacggcgacagcttccagcaatggctggccggacatgcgccggggcgggtgtccggcgacatcgacgcgtgcacgcggtggctggtggacgagttcaaagccgcgggggtgtccaagaagctgggcgtggtcgggttctgctacggcggcgggcgcctcgtcgagacgctggcgcgcgacgcggacagctgcttcagcgccggggtctgcttctacgggtcacggatggacgcgtccctgggcgaccgcatcgcggcgcccgtcctcttcgtgtgcggcgacggcgacccgctgtgcgccgtggagacggtgcgggagctggagagacgcgcgagaggcggcgcacgggcggcggtgtacgccggcaggggccatgggttcgcgcaccggccgcagtcggtggaggaggacgcggacgccgagaacgccttcaacgtgatgcgggggtggctgcacgaccacctgctcgcctgatcagacggtgtgtagacaagcgcggtacacgggggttgggtgttttgtacgtacgtacgtactaatgtggcagtggagtgcaaatcaaggatgttactaagtactagattgctagtaaagagtttgagtgaattcagtaatactcccgaatgcgaaagtgctatttatggtacttctaagacaatgcagaagctggatctttgttccattatcttaagatttgtgacactgacgctgctaaaaccatgcccccgtgccgccatggatgctggcgcttgggacatgcgtggacgcgagaattggaggctctcattttcctttgttcctcacgcttgtgtgtcgtcttcctctactctaaggccttgtctgcatcagttgttcttaaaaacatgtttttgtctctagtttctaaaacctagattctaagcaaaaactgataaag

SEQ ID NO: 1735 - DNA, 2309 bp, Sorghum bicolor
gaaacgaaaagaaaaacggaagaaaacgagactaccctcccctgtccgtacatggtccctccaatctctcctctctgcagactgcaatcagactccggtcacacaggaagcggaagcggcggcgggcgaagcgcgcgacgcagcgcagcgtaacaccaggccgccgggcgctccacggatcatcctctcctcttcttgccggagatccaccaccggggcggccattttccccttcctcaatcaagccgcgctcgagatcgacggccgctgcttgcagcaattcttcgtccgttgccgtgcgaccgagaataaactgaggctcaggcatgagctttcgggaccaggagagtggcggggaggatgcgggcaggacgtcctccgcgtccgacctgcggaagccgctcctgaacaccgggagctggtaccgcatgccgccgccgggcggcatgatgggctcgcggcagtcgagcctcatggagcgcctaggctcctctgccttctccctccgagacgttgctatctcggcgacgctctgcacgctcattgtggctctaggtcctatccagttcggtttcacctgcggttactcctctcccacgcaggacgccatcattgctgacctcggcctctcactctccgagttctctctgttcggatcgttatcaaatgtaggggcgatggtaggtgccatctccagtgggcaacttgcagagtatatcggccgcaaggggtctctcatgattgctgcaattccaaacataattgggtggcttgcgatatcatttgcaaaagattcctcattcttgtttatgggccggctgctagaaggatttggagtgggtgtaatatcttatacagtaccggtttatattgcagaaatcgctcctcaggatcagaggggagctcttggttctgtcaatcagctctccgtcacagttggtatattgcttgcctacctgtttggcatgtttgttccctggagaattcttgctgttctaggcattttaccttgttcaatcctgattcctggactgttctttgtccctgaatccccaaggtggctggcaaaaatggggaagatggaggattttgaatattcactgcaagttctgcgaggatttcagacggacattacagcagaagtaaatgaaataaagagatcagtagcatcatcaaggaggaggacaaccgccataaggtttgctgatatcaagcagaagagatacagtgttccccttgcgataggaatcggtctccttgtcctgcagcagctaagtggtgtcaatggcattctattttatgctgggagcatcttcaaagctgctggtattacaaacagtaatctagcaacctttggtttgggggctgttcaggtgattgctactggagtgacaacctggttgactgacaaagctggtcgaaggcttcttctcattatttctaccacaggaatggtcattactcttgtcattgtttctgtgtcattttttgtgaaggacaacataactgccggttctcacttatactctgcaatgagtatgctttcactggctggacttgtggcatttgtgattgcattttctcttggcttgggagcaattccatgggtcattatgtctgagattcttcctgttaacattaagagccttgctggaagtgttgcaacccttgcgaactggctaacagcatgggccattacaatgactgcaagcctaatgttaaactggagcaatggaggaacctttgctatctatgccgctgtgtctgccatggccctcattttcgtgtgtttgtgggtgccggagaccaagggaagaacattagaggaaatcgcattctcattccgctgacacgtcatgatctaggtatgagaagccaccatgtgctattgagtcatgccacagggccattcagttcatggattccgcggcaatcttgcagccattctttgcttggatgtatcatcttcagtgttcatatgaatgtacattgtacaatatgaggccatagtagaaggcaagtgtgtttatatatatatatgtatgaggtacgatggaatagtagcagaggcattcaacccttgcacgggttgtggaggagagcaatttatttgttgtattcatcagctataatatgtccggttaaataccgggcacgcattggaattttgaaacaataaattttgagcaaatttgtacccgtggtgtttagagcctgtttggcaatggctccaaagccaaactctaggctagagctgggtggagctagccaaacatccgaactccaaaaaaatgttggagcagcccaac

SEQ ID NO: 1736 - DNA, 2510 bp, Sorghum bicolor
aaaaaaagaaacatgcagagcatgccatgcccaggtggcctctctctcccaatccggtcgaagcacaccccagatctacccgcgcaggcgcaggacacggccgaaacgaaaagaaaaacggaagaaaacgagactaccctcccctgtccgtacatggtccctccaatctctcctctctgcagactgcaatcagactccggtcacacaggaagcggaagcggcggcgggcgaagcgcgcgacgcagcgcagcgtaacaccaggccgccgggcgctccacggatcatcctctcctcttcttgccggagatccaccaccggggcggccattttccccttcctcaatcaagccgcgctcgagatcgacggccgctgcttgcagcaattcttcgtccgttgccgtgcgaccgagaataaactgaggctcaggcatgagctttcgggaccaggagagtggcggggaggatgcgggcaggacgtcctccgcgtccgacctgcggaagccgctcctgaacaccgggagctggtaccgcatgccgccgccgggcggcatgatgggctcgcggcagtcgagcctcatggagcgcctaggctcctctgccttctccctccgagacgttgctatctcggcgacgctctgcacgctcattgtggctctaggtcctatccagttcggtttcacctgcggttactcctctcccacgcaggacgccatcattgctgacctcggcctctcactctccgagttctctctgttcggatcgttatcaaatgtaggggcgatggtaggtgccatctccagtgggcaacttgcagagtatatcggccgcaaggggtctctcatgattgctgcaattccaaacataattgggtggcttgcgatatcatttgcaaaagattcctcattcttgtttatgggccggctgctagaaggatttggagtgggtgtaatatcttatacagtaccggtttatattgcagaaatcgctcctcaggatcagaggggagctcttggttctgtcaatcagctctccgtcacagttggtatattgcttgcctacctgtttggcatgtttgttccctggagaattcttgctgttctaggcattttaccttgttcaatcctgattcctggactgttctttgtccctgaatccccaaggtggctggcaaaaatggggaagatggaggattttgaatattcactgcaagttctgcgaggatttcagacggacattacagcagaagtaaatgaaataaagagatcagtagcatcatcaaggaggaggacaaccgccataaggtttgctgatatcaagcagaagagatacagtgttccccttgcgataggaatcggtctccttgtcctgcagcagctaagtggtgtcaatggcattctattttatgctgggagcatcttcaaagctgctggtattacaaacagtaatctagcaacctttggtttgggggctgttcaggtgattgctactggagtgacaacctggttgactgacaaagctggtcgaaggcttcttctcattatttctaccacaggaatggtcattactcttgtcattgtttctgtgtcattttttgtgaaggacaacataactgccggttctcacttatactctgcaatgagtatgctttcactggctggacttgtggcatttgtgattgcattttctcttggcttgggagcaattccatgggtcattatgtctgagattcttcctgttaacattaagagccttgctggaagtgttgcaacccttgcgaactggctaacagcatgggccattacaatgactgcaagcctaatgttaaactggagcaatggaggaacctttgctatctatgccgctgtgtctgccatggccctcattttcgtgtgtttgtgggtgccggagaccaagggaagaacattagaggaaatcgcattctcattccgctgacacgtcatgatctaggtatgagaagccaccatgtgctattgagtcatgccacagggccattcagttcatggattccgcggcaatcttgcagccattctttgcttggatgtatcatcttcagtgttcatatgaatgtacattgtacaatatgaggccatagtagaaggcaagtgtgtttatatatatatatgtatgaggtacgatggaatagtagcagaggcattcaacccttgcacgggttgtggaggagagcaatttatttgttgtattcatcagctataatatgtccggttaaataccgggcacgcattggaattttgaaacaataaattttgagcaaatttgtacccgtggtgtttagagcctgtttggcaatggctccaaagccaaactctaggctagagctgggtggagctagccaaacatccgaactccaaaaaaatgttggagcagcccaactctatggagtttatggagctctattgtattttttcggaccatctctttccctactctagaactcttcaaaatagacctagacatggagttttggtgaaa

SEQ ID NO: 1737 - DNA, 2064 bp, Saccharum officinarum
ctctcctctctgcagactgcaatcaaactccggtcgcacagggccaaccccggaagcggcggcgggcgaagcgcgcgacgcagcgcagcgtaacaccaggccgccggtcgctcctcggctcctcctctccccttctcgccggagatccactaccggggcggcctaggttcccttcctcaatcaagtcgcgctcgagattgacggacgctcctcgcagcaattcttcgtccgttgcggtgcggccgagaagaaactaaggctcaggcatgagctttcgggaccaggagagtggcggggaggatgcgggcaggacgtcctcctcgtccgacctgcggaagccgctcctgaacaccgggagctggtaccgcatgccgccggcgggcggcatgatgggctcgcggcagtccagcctcatggagcgcctaggctcctctgccttctccctccgcgacgtcgccatctcggccacgttctgcacgctcattgtggctctaggtcccatccagttcggtttcaccagcgggtactcctcccccacgcaggacgccatcattgctgacctcggcctctccctctccgagttctcgctcttcggatcgttatcaaacgtaggggcaatggtaggcgccatctccagtgggcaacttgcagagtatatcggtcgcaaggggtctctcatgatcgctgcaattccaaacataattgggtggctcgcgatatcattcgcaaaagattcctctttcttgtttatgggtcggctgctagaaggatttggagtcggtgtaatatcttatacagtaccggtttatattgcagaaatcgctcctcaagatcagaggggagttcttggttctgtcaatcagctctcagtcacaattggtatattgcttgcctacctgtttggcatgtttgttccctggagaattcttgctgttctaggcgttttaccttgttcaatactgattcctggactgttctttgtccctgaatccccaaggtggctggcaaaaatggggaagatggaggattttgaatattcactgcaagttctgcgaggatttcagacggacatcacagcagaagtaaatgaaataaagagatcagtagcatcatcaaggaggaggacaaccataaggtttgctgatatcaagcagaagagatacagtgttccccttgcgataggaatcggtctccttgtcctgcagcagctaagtggtgtcaatggcattctattttatgctgggagcatcttcaaagctgctggtattacaaacagtaatctagcaacctttggtttgggggttgttcaggtgattgctactggagtgacaacctggttgactgacaaagctggtcgaaggcttcttctcattatttctaccacaggaatggtcattactcttgttattgtttctgtgtcattttttgtgaaggacaacataactgctggttctcacttatactctacaatgagtatgctttcactggctggacttgtggcatttgtgattgcattttctcttggcttgggagcaattccctgggtcattatgtctgagattcttcctgttaacatcaagagccttgctggaagtgttgcgacccttgcgaactggctgacagcatgggccattacaatgactgcaagcctaatgttgaactggagcaatggaggaacctttgctatctatgctgctgtgtctaccatggccctcattttcgtgtgcttgtgggtaccggagaccaaaggaaggacactagaggaaatcgcattctgattccgctgacacgtcatgatcttaggtatgagaagccaccatgtgctagtcatgcctcagggccattcagttcatggattcagccgctcttcttggatgtaccatcttcagtgttcatatgaatgtacattgtacaatatgaggccgtaccaaaaagcaagtgtggttatatatatttgtatatgggacgatggatagtagcagaacgcactcaaccctcgcaccgggttgcggaggagagcaattcatttggtggattcatcagctataatatgtccggttaaac

SEQ ID NO: 1738 - DNA, 2074 bp, Panicum virgatum
gccgcccttccctcaaaaatctctccgcaatcaaaccgcggtcgctcggacccatcgcgaaaccgccggccgaagcgcgaacgctatccgctgctgccggggagatccatccggccctggtttcttcttccttttgtcgcggctgagcgctcaagatcggcgctgattggtgccacggccaattaaatttggcgccctgagaagaattgggaggtccaggcatgagcttccgggaccaggagagtggcggggaggatggggtccggacgtcctccgcgtcggacctgcggaagccgctcctcaacaacgggagctggtaccggatgccgccgccggggggcataatgggctcacggcaatccagcctcatggagcgcctaggctcctccgccttctccatccgcgacgtctctgtctcggccacgctctgcacgctcatcgtcgcgctaggtcccatccaatttggcttcacctgcggatactcctcgcccacccaggacgccgtggttgctgacctcggcctctccctctccgagttttccctgttcggatcactgtccaacgttggggcgatggtgggagccattgccagtgggcagattgcagagtatatcggacgcaaggggtctctcatgatcgctgcgatcccgaatattatagggtggcttgcgatatcttttgcaaaagattcatcctttctgtttatgggacggctcctagaagggtttggagttggtgtaatatcttatacggtacctgtttatattgcagaaattgccccacaggaccagaggggagctcttggtgctgtctttcagctctcagttacgattggtatattgcttgcatacctgtttggcatgtttgttccctggagaattcttgctgttctaggcattttaccttgttcaatcctgattcctgggttgttctttgttcctgaatctccaaggtggctggcgaaaatgggaaagatggaagattttgagtactcgctgcaagttctgcggggatttcagactgacatcacagcagaagtaaatgaaataaagcgatcagtggcatcatcaaggaggaggacaaccattaggtttgctgatatcaagcagaagagatatagtgttcctcttatgataggaattggtctcctcgtgctgcagcaactaagtggtgtcaatggcatcctattttatgctgcaagtatcttcaaagctgctggtattacaaatagtaatctagcaacatttggtttgggagttattcaggtgattgctactggagtgacaacctggctgagtgacaaagctggtcgaaggcttcttctcattatttctactactggaatgaccattactctcgtcgttgtttctgtgtcattttttgttaaggacaacataactgctggctcacacttatactctgtaatgagtatgctttcgttggctggacttgtggcatttgtgatttcgtttaatcttggattgggagccattccctggatcattatgtctgagattcttcctgttagtattaagagtcttgctggaagtgttgccacccttgcaaactggctgggagcatgggccgttactatgaccgcaagtttgatgttgagctggagcaatggaggaacttttgctatctatgctgccgtgtgtaccatggctctcatttttgtgtgcttgtgggtgccggagaccaaaggaagaacgctcgaggaaattgcattttcattccgctgaagcagtccaatgttctgagaccaagcatcatcatgagagtctgagatctccccatgtgctatcaagacgtgccatttgggacgctgaacccatgaagtccgcagcaatcttgcagccatgttttgtttggatgtaccatcttgtgtctgtacattgtacaatatgattctttagcaggaggcagctgtgtttatatgtgtaagatataatggaatattaggcactgaaaacccttgcacgggttacggaagagagcgatttgtttatttcattgagacacatttagaataatttttttgagcaaatacatctcaaggctatgttgttgttgt

SEQ ID NO: 1739 - DNA, 2154 bp, Setaria italica
cttccctggccgtctgtctctcttccctcaaaaatctctccgcaatcaaaccgcggtctctcggacccatcgcgaaaccggcgggcgaagcgcgaacgctctatccgctgctgccggggagatccatccgaccctggtttctccttctttttgtcgcgctcaagatcggcgacgctgcttgacaccacggccgatcaaatttcgtgcgctgagaagaattgaggtccaggcatgagcttccgggaccaggagagtggcggggaggatgggggccgggcggacctgcggaagccgctcttgaacaccgggagctggtaccggatgccgccggcggggggcatgatgggctcgcggcaatccagcctcatggagcgcctaggctcctccaccttctccctccgcgacgtctctgtctcggccacgctctgcacgctcattgttgcgctaggtcccatccagttcggcttcacctgcggctactcttcgcctacacaggacgcggtcattgctgacctcggcctctctctctccgagttttccctgttcggatcactgtccaacgtaggggcgatggtgggcgccattgccagtgggcagattgcagagtacattggccgcaaggggtctctcatgattgccgcgatcccgaacattattgggtggctcgcaatatcatttgcaaaagattcctcctttttgtttatgggccggctgctagaaggatttggtgttggtgtaatatcttatacagtacctgtatatattgcagaaattgccccacaggaccagaggggagctcttggtgctgtctttcagctctcagttacgattggtatattgctttcctacctgtttggcatgtttgttccctggagaattcttgctgttctaggcgttttaccttgtacaatcctgattcctgggttgttctttgttcctgaatctccaaggtggctggcaaaaatgggaaagacggaagattttgagtactcactgcaagttctgcggggatttcagactgacatcacagcagaagtgaatgaaataaagagatcggtagcatcatcaaggaggaggacaaccattaggtttgccgatatcaagcagaagagatatagtgttccccttatgataggaattggtctccttgtactgcagcaactaagtggtgtcaatggcattctattttatgctgcaagtatcttcaaagctgctggtattacaaatagtaatctagcaacatttggtttgggtgttgttcaggttattgttactggagtgacaacctggctgtctgacaaagctggtcgaaggcttcttctcattatttctactacaggaatgaccattactcttgttgtcgtttctgtgtcattttttgttaaggacaacataactgctggctctcatttgtactctgtaatgagtatgctttcgctggctggacttgtggcatttgtgatttcattcaatcttggcttgggagccattccctggatcattatgtctgagattcttcctgttagtattaagagtcttgctggaagtgttgcgacccttgcgaactggttgggagcatgggtcattactatgactgcaagcttgatgttgagctggagcaatggaggaacctttgctatttacgccgcagtgtgtaccatggccctcatttttgtgtgcttgtgggtgccggagaccaagggaaggacgcttgaggaaattgcattttcattccgttgaagctacaagggagggtcaactgttctgagaccaagcatcatcatcaaagtctgagatcaccccatgtgctatcaagccatgccattgggacggtgaatccaagaattttgcagcaatcttgcagcctcgttttaattgggtgtaccatcttgtgtatctatatttatgtacattgtacaaaatgatgctatagcaggaggcaggtgtgtttatatgtgtataagatattataagatggtagcagaaggcactgaacccttgcacgggtttgcggcggagagcaatttgtttatttcattgattgctgctacatatatgtcctgttgaatatcagaggcagattcaaattgataaattttgagcaaatacatctccgaagctgtcggtgccagcctctagtcctatgcttgagtc

SEQ ID NO: 1740 - DNA, 1834 bp, Pennisetum glaucum
gggggccgggcggacctgcggaagccgctcttgaacaccgggagctggtaccggatgccgccgccggcggggggcatgatgggctcgcggcaatccagcctcatggagcgcctaggctcctcaaccttctccctccgcgacgtatctgtctcggccacgctctgcacgctcattgttgcgctaggtcccatccagttcggctttacctgcggttactcttcgcctacccaggacgcggtcattgctgacctcggcctcactctctccgagttttccctgttcggatcactgtccaatgtaggggctatggtgggtgccattgccagtgggcagattgcagagtacatcggccgcaaggggtctctcatgatcgccgcgatcccgaacattattgggtggcttgcaatatcatttgcaaaagattcctcctttttgtttatgggccggctgctagaaggatttggtgttggtgtaatatcttatacagtacctgtttatattgcagaaattgccccacaggaccagaggggagctcttggtgctgtctttcagctctcagttactattggtatattgctttcctacctgtttggcatgtttgttccctggagaattcttgctgttctaggcattttaccttgcacaatcctgattcccgggttgttctttgtccctgaatctccaaggtggctggcaaaaatgggaaagacagaagattttgagtactcacttcaagttctgcggggatttcagactgacatcacagcagaagtgaatgaaataaagagatcggtagcatcatcaaggaggaggacgaccattaggtttgccgacatcaagcagaagagatatagtgtcccccttatgataggaattggtctccttgtactgcagcaactaagtggtgtcaatggcattctattttatgctgcaagtatcttcaaagctgctggtattacaaatagtaatctagcaacatttggtttgggtgttgttcaggttattgctactggagtaacaacctggctgtctgacaaagctggtcgaagggttcttctcattatttctactacaggaatgaccattactcttgttgttgtttccgtgtcattttttgttaaggacaacatagctgctggctctcatttatactctgtaatgagtatgctttcgctggctggacttgtggcatttgtgatatcattcaatcttggcttgggagccattccctggatcattatgtctgagattcttcctgttagtattaagagtcttgctggaagtgttgcgacccttgcaaactggttgggagcatgggctgttactatgactgcaagcttgatgttgagctggagcaatggaggaacctttggtatttatgccgctgtgtgtaccatggctctcatttttgtgtgcttgtgggtgccggagaccaagggaaggacgctcgaggaaattgcgttttcattccgctgaagctacgagggtaaaatgttctgagaccaagcatcatgatcaaagtctgagatcacccccatgtggtataaagccattccattgggacggtgaatccaggaattttgcagcattctggcagccatgtgtttgtttgggtgtatcatcttgtgtatctatatttatgtacattgtacaatatgatgctacggcaggaggtgggtgtgtttatatgtgtataagatatcatgaaatggtagaaggcactgaacccttgcacgggtttgcggaggacagcaatttgtttattcattagaacagctatttatatgtctggttaaatatcggtggcacattcaaaatgataaattttgagtaa

SEQ ID NO: 1741 - DNA, 2113 bp, Brachypodium distachyon
tgtctttcttcctcttccctgacctccccccaatcaggcaatccatccatcaatcactggagccaccgacggacacgggatcggcgtcgcgcaccgcaaggaaaggaagcaccgaatcccaacccgatccgcgtagctcgccgctcgaaggcggcagcgatgagcttccgggacgagagcggcggcgaggatggcggcggcgcgtccgacctgcggaagccgctgctgcacacggggagctggtaccggatgtccgccgcggccgggctcggctcgcgccagtcgtccagcctcatggaccggctcggctcctccgcctacgcgctccgcgacggcgccgtctccgccgtgctctgcacgctcatcgtcgccctcgggcccatccagttcggcttcacctgcggctactcctcgcccacccaggacgccatcatcgccgacctcggtctctccctctccgagtttgcgttgtttggatccttgtccaatgtcggggccatggtaggcgccattgcgagtggccagatcgccgagtacatcggacggaaagggtctctgatgatcgctgcgattccaaacatcattgggtggctcgctatatcatttgcaaaagattcctcatttttgtttatgggtcggttgctggaaggatttggagtcggtgtaatatcctatacggttccagtttatatagcagaaattgctccacagaacatgagaggagctcttggtgctgtcaatcagctatctgttacaatcggtatattgcttgcgtacacgttgggcatgtttgttccctggagaattctttctgttctcggcattttaccatgctcaatcctgatacctggattgttcttcatccccgaatcaccaaggtggctggcaaaaatgggaaagatggaggattttgaatcttcactgcaggtcctgcgaggatttgaaagagacatcacagctgaagtaaatgaaataaagagatcagttgcgtcatcgagaaggaggacaaccataagatttgcagatatcaagcagaagagatatagtgttcctcttatgataggaattggtctccttgtgcttcagcagctaagtggtgtcaatggcattctgttttatgcggcaagtatcttcaaagctgctggtatccaaaatagtaatctagcaacatgtggtttgggagcagttcaggtgattgcgactggaataacaacctggttgactgacaaagctggccgacgactacttctcattatctctactacaggaatgaccattactctcgtcgttgtttcagtctcattttttgtgaaggacaacgtaacagagggttctcatttatactctataatgagcatgctttcgttggctggacttgtggcatttgtgatctcattttctcttggcttgggagctatcccgtggataataatgtctgagattcttcctgttaatattaagagccttgctggaagcgtggccacccttgcgaactggatgacatcatggctcatcacgatgaccgcgagcttgatgttaagctggagcaatggaggaaccttcgctatatacgccgcggtgtgtaccggtacccttcttttcgtatgcttgtgcgtgcctgagaccaagggaagaacgctcgaggagatcgccttctcgttccgctgaaagcccagaagtacacggaggccaaactacgagcaattatacacacgacggctgtttcaggccggcccagtatactgtttgatttaaacttcggcatccgccaaaattttgagcagaattggctccatgagctacctgagtcggtccacgaggttctgtagccgtgcggccatgctttgcttggatctgtatcaccatgtgttgttgtaatagtgtatgtgcaaatgtgcaatagaatgggagatgggggtggaaagcagcagatagaagagacacacggctactactagacccttttgcaggggagtgtgcagtagaaagagcaatttgttggtttgattcagcggctgagctttatagaataatggagatgtaatgccaaataataaagatgtagaggtaccctggaagtcagctgcatccaatttttttgcctggttacatt

SEQ ID NO: 1742 - DNA, 2244 bp, Brachypodium distachyon
ccagctcagatcagatctcatccaatcttcatgcagagaaaaaaatcggaaagaagaagcagcgaattctaacctgaccacaaaactcggtcttttgtctttcttcctcttccctgacctccccccaatcaggcaatccatccatcaatcactggagccaccgacggacacgggatcggcgtcgcgcaccgcaaggaaaggaagcaccgaatcccaacccgatccgcgtagctcgccgctcgaaggcggcagcgatgagcttccgggacgagagcggcggcgaggatggcggcggcgcgtccgacctgcggaagccgctgctgcacacggggagctggtaccggatgtccgccgcggccgggctcggctcgcgccagtcgtccagcctcatggaccggctcggctcctccgcctacgcgctccgcgacggcgccgtctccgccgtgctctgcacgctcatcgtcgccctcgggcccatccagttcggcttcacctgcggctactcctcgcccacccaggacgccatcatcgccgacctcggtctctccctctccgagtttgcgttgtttggatccttgtccaatgtcggggccatggtaggcgccattgcgagtggccagatcgccgagtacatcggacggaaagggtctctgatgatcgctgcgattccaaacatcattgggtggctcgctatatcatttgcaaaagattcctcatttttgtttatgggtcggttgctggaaggatttggagtcggtgtaatatcctatacggttccagtttatatagcagaaattgctccacagaacatgagaggagctcttggtgctgtcaatcagctatctgttacaatcggtatattgcttgcgtacacgttgggcatgtttgttccctggagaattctttctgttctcggcattttaccatgctcaatcctgatacctggattgttcttcatccccgaatcaccaaggtggctggcaaaaatgggaaagatggaggattttgaatcttcactgcaggtcctgcgaggatttgaaagagacatcacagctgaagtaaatgaaataaagagatcagttgcgtcatcgagaaggaggacaaccataagatttgcagatatcaagcagaagagatatagtgttcctcttatgataggaattggtctccttgtgcttcagcagctaagtggtgtcaatggcattctgttttatgcggcaagtatcttcaaagctgctggtatccaaaatagtaatctagcaacatgtggtttgggagcagttcaggtgattgcgactggaataacaacctggttgactgacaaagctggccgacgactacttctcattatctctactacaggaatgaccattactctcgtcgttgtttcagtctcattttttgtgaaggacaacgtaacagagggttctcatttatactctataatgagcatgctttcgttggctggacttgtggcatttgtgatctcattttctcttggcttgggagctatcccgtggataataatgtctgagattcttcctgttaatattaagagccttgctggaagcgtggccacccttgcgaactggatgacatcatggctcatcacgatgaccgcgagcttgatgttaagctggagcaatggaggaaccttcgctatatacgccgcggtgtgtaccggtacccttcttttcgtatgcttgtgcgtgcctgagaccaagggaagaacgctcgaggagatcgccttctcgttccgctgaaagcccagaagtacacggaggccaaactacgagcaattatacacacgacggctgtttcaggccggcccagtatactgtttgatttaaacttcggcatccgccaaaattttgagcagaattggctccatgagctacctgagtcggtccacgaggttctgtagccgtgcggccatgctttgcttggatctgtatcaccatgtgttgttgtaatagtgtatgtgcaaatgtgcaatagaatgggagatgggggtggaaagcagcagatagaagagacacacggctactactagacccttttgcaggggagtgtgcagtagaaagagcaatttgttggtttgattcagcggctgagctttatagaataatggagatgtaatgccaaataataaagatgtagaggtaccctggaagtcagctgcatccaatttttttgcctggttacattaaaaaccatccgtatcacattttttttggggcaatt

SEQ ID NO: 1743 - DNA, 2052 bp, Oryza sativa
cgaaagcgaaagcgtcagctactcgctcttcctaacggagaaaacgggaaaaaaagaaaaagaaaaaaacgagaaaaggagcagaaaatcagcgtaccactcgctcttcccctcaatcaatcaagcttaagctaagctgggcgcgacagcgagagagaaacgagggatcgatcgcgtccacgcacgcccgatcccggccgcgagatgagcttccgcggcgaggagagcggcggcgaggatggggggcggacggcgtcggcgtcggacctgcggaagccgttcctccacacggggagctggtacaagatgtcgtcggcgggcggcggcggcgggatggggtcgcgcctcggctcctccgcctactccctccgcgactcctccgtctccgccgtcctctgcaccctcatcgtcgccctcggccccatccagttcggcttcacctgcggcttctcctcgcccacccaggacgccatcatctccgacctcggcctcaccctctccgagttctcgctgttcgggtcgctgtcgaacgtcggggcaatggtgggcgccatcgccagcggccagatcgccgagtacatcggccgcaaggggtctctcatgatcgcggcaattcctaacattattgggtggctcgcaatatcttttgcaaaggactcatcctttttgtttatgggccgattgctggaaggatttggggtcggcgtgatatcctatgtggtgccagtttatatagcagaaattgctccacaaacaatgagaggagctcttggttcagtcaatcagctttctgttactattggcatattgcttgcctacttgttaggcatgtttgttccctggagaattctctccgttctcggtattttaccatgttcaattctgatacctggattgttctttatccctgaatcaccaaggtggctggcaaaaatgggaaagatggaggattttgaatcctcgctgcaagtattgcgaggatttgaaacagacatcgctgtagaagtaaatgaaataaagagaacagttcaatcatcacggaggaggacgacaatacgatttgcagatatcaagcagaagagatatagtgtacctctaatgataggaattggtctccttgtactgcagcagttaagtggtgtgaatggcattctattttatgctgctagtatcttcaaagccgccggtcttacgaatagtaatctagcaacatttggtctgggggttgttcaggtggttgctactggagtgacaacttggttgactgacaaagctggtcgacgactcctcctcattatctctactacagggatgaccattactcttgttgttgtttctgtgtcattttttgtgaaggacaacataactaatggttctcatttatactctgtaatgagtatgctttcgctggtcgggcttgtggcatttgtgatttcattttctcttggtttgggagccataccatggatcataatgtctgagattcttcctgtaaatatcaagagccttgctggaagcgttgcaacccttgcaaactggttgacggcttggctcattacgatgacagcaagcttgatgttaagctggagcaatggaggaacatttgctatctatgctgctgtgtgtgccgggaccctcgttttcgtatgcctgtgggtgccggagactaaaggaagaacacttgaggaaattgcattttctttccggtgaagctcaggccaacgttgtctggcgatcagcctggtgcacgtcagtcggcaacagatttggctccgtgagctatcggattaggcatcaagatttgaattcttgagttcatgtgtatctaaggcaagcgtgtattggttgcatttgtaattttgtatcatgtgttcatgtatgtgcaatagaaatatagaatggagcagtagcaagagacaatataatggaccattgcaagttgtcacgcacgccatgtggatggatggaacaatgaagatgccaatatgtcatgccgtatgatgaattttgagcaaatatatagctgagggttgttagttctgattatgtgca

SEQ ID NO: 1744 - DNA, 1994 bp, Oryza sativa
aaagaaaaaaacgagaaaaggagcagaaaatcagcgtaccactcgctcttcccctcaatcaatcaagcttaagctaagctgggcgcgacagcgagagagaaacgagggatcgatcgcgtccacgcacgcccgatcccggccgcgagatgagcttccgcggcgaggagagcggcggcgaggatggggggcggacggcgtcggcgtcggacctgcggaagccgttcctccacacggggagctggtacaagatgtcgtcggcgggcggcggcggcgggatggggtcgcgcctcggctcctccgcctactccctccgcgactcctccgtctccgccgtcctctgcaccctcatcgtcgccctcggccccatccagttcggcttcacctgcggcttctcctcgcccacccaggacgccatcatctccgacctcggcctcaccctctccgagttctcgctgttcgggtcgctgtcgaacgtcggggcaatggtgggcgccatcgccagcggccagatcgccgagtacatcggccgcaaggggtctctcatgatcgcggcaattcctaacattattgggtggctcgcaatatcttttgcaaaggactcatcctttttgtttatgggccgattgctggaaggatttggggtcggcgtgatatcctatgtggtgccagtttatatagcagaaattgctccacaaacaatgagaggagctcttggttcagtcaatcagctttctgttactattggcatattgcttgcctacttgttaggcatgtttgttccctggagaattctctccgttctcggtattttaccatgttcaattctgatacctggattgttctttatccctgaatcaccaaggtggctggcaaaaatgggaaagatggaggattttgaatcctcgctgcaagtattgcgaggatttgaaacagacatcgctgtagaagtaaatgaaataaagagaacagttcaatcatcacggaggaggacgacaatacgatttgcagatatcaagcagaagagatatagtgtacctctaatgataggaattggtctccttgtactgcagcagttaagtggtgtgaatggcattctattttatgctgctagtatcttcaaagccgccggtcttacgaatagtaatctagcaacatttggtctgggggttgttcaggtggttgctactggagtgacaacttggttgactgacaaagctggtcgacgactcctcctcattatctctactacagggatgaccattactcttgttgttgtttctgtgtcattttttgtgaaggacaacataactaatggttctcatttatactctgtaatgagtatgctttcgctggtcgggcttgtggcatttgtgatttcattttctcttggtttgggagccataccatggatcataatgtctgagattcttcctgtaaatatcaagagccttgctggaagcgttgcaacccttgcaaactggttgacggcttggctcattacgatgacagcaagcttgatgttaagctggagcaatggaggaacatttgctatctatgctgctgtgtgtgccgggaccctcgttttcgtatgcctgtgggtgccggagactaaaggaagaacacttgaggaaattgcattttctttccggtgaagctcaggccaacgttgtctggcgatcagcctggtgcacgtcagtcggcaacagatttggctccgtgagctatcggattaggcatcaagatttgaattcttgagttcatgtgtatctaaggcaagcgtgtattggttgcatttgtaattttgtatcatgtgttcatgtatgtgcaatagaaatatagaatggagcagtagcaagagacaatataatggaccattgcaagttgtcacgcacgccatgtggatggatggaacaatgaagatgccaatatgtcatgccgtatgatgaattttgagcaaatatatagctgagggttgttagttctgattatgtgca

SEQ ID NO: 1745 - DNA, 2078 bp, Secale cereale
gaaaacacagcgacactccacaaagctcgcacctttgtcttcctcctcctccccccaatcacgcccgcgaatcgtgccacgcacggaagcgagcgagcccagccaggccaatccgatccgagcccgcgcggcggcgcgatgagcttccgggacgagagcggcggggaggacggcagcgggggccggtcgtcgtcggcgtccgacctgcgcaagccgttcctgcacacggggagctggtacaggatgtccgcggccggcggcggcgccatggaccggctcggctcctccgcctacggcctgcgcgacagctccatctccgcgctgctctgcaccctcatcgtcgcgctcggccccatccagttcggcttcacctgcggctactcctcgcccacccaggacgccatcatggccgacctcggcctcaccctctccgagttctctttattcggatccctgtccaacgtcggggccatggtgggcgccattgccagtggccagatcgccgagtacatcggccgtaaagggtctctgatgatcgccgcaatcccgaacatcattgggtggcttgcaatatcatttgcaaatgattcctcattcttgttcatgggccggttgctggaaggatttggggtcggtgtgatatcctacacggtaccagtttatatagcagaaattgctccacagaacatgagaggagctcttggttcagtcaatcagctctctgtcacaatcggtatattgcttgcctacacattaggcatgtttgttccttggagaattctctctgttcttggcattttaccttgctcaatcctgatacctgggctgttcttcatccctgaatcaccaaggtggctggcaaaaatgggaaagatggaagattttgaatcgtcactgcaggtcctccgtggatttgaaactgatatctcagcagaagtaaatgaaataaagagatcagttgcctcatctaggaggaggacaaccatacgatttgcagagatcaaacacaagagatatagtgttcctcttatgataggaattggtctccttatacttcagcaactaagtggtgtcaacggcattttcttctatgctgcaagtatcttcaaagctgctggtcttaaaaatagtaatctagcaacatgtggtttgggggctgttcaggtggttgctactggaataacaacctggttgactgacaaagctggtcgacggctacttctcattatctctgctgtagggatgacagtcagtcttctcgttgtttccgtgtcattttttgtgaaggacaacatagatgaagcttctcatttacactctgtgatgagtatactttcactggctgcacttgtggcatttgtgtttgcattttcccttggcatgggagccatcccatggattataatgtctgagattcttcctgttaacatcaagagccttgccggaagcacggccaccctcgcaaactggatgacgtcgtggctcatcacgatgaccgcgagcttgatgctaaactggagcaatggaggaacctttgctatatacgcggcggtgtccatgggcaccctcctcttcgtgtgcctgtgcgtgccagagaccaaggggagaaccctcgaagagatcgcgttctcgttccgctgaagcccggaaccatggcgcgtagggtagacaggcggcagccgtgttttttgcagggacatttgtatcatgtatttgtgtaatagtgtactatcagtgtaccatttgtgtatgtgcaatagaatgggggaggggtggaatgtagcaaggggcagacagacagacagggcacacctccccctttgcagtcagtcagccagtcaggggagtcagcagtaagtagaagaagagcaaaatctggtggttagtacatttggttgatgtatacagcagcagctgctgtggccaatagaataataattcagatgtaatgttcaagaacaaattttgtgctactttcagtgtgctgcattatggatggagtgtgcatgtgcatgccagttcccagaaactattgcctgaaagtgttgttgaggagaaataaaaaagaaatgttgtgc

SEQ ID NO: 1746 - DNA, 2125 bp, Secale cereale
cagatctcgcgcacacagcaaaaccggaccggaggagaaaacacagcgacactccacaaagctcgcacctttgtcttcctcctcctcccccaatcacgcccgcgaatcgtgccacgcacggaagcgagcgagcccagccaggccaatccgatccgagcccgggcggcggcgcgatgagcttccgggacgagagcggcggggaggacggcagcgggggccggtcgtcgtcggcgtccgacctgcgcaagccgttcctgcacacggggagctggtacaggatgtccgcggccggcggcggcgccatggaccggctcggctcctccgcctacggcctgcgcgacagctccatctccgcgctgctctgcaccctcatcgtcgcgctcggccccatccagttcggcttcacctgcggctactcctcgcccacgcaggacgccatcatggccgacctcggcctcaccctctccgagttctctttattcggatccctgtccaacgtcggggccatggtgggcgccattgccagtggccagatcgccgagtacatcggccgtaaagggtctctgatgatcgccgcaatcccgaacatcattgggtggcttgcaatatcgtttgcaaatgattcctcattcttgttcatgggccggttgctggaaggatttggggttggtgtgatatcctacacggtaccagtttatatagcagaaattgctccacagaacatgagaggagctcttggttcagtcaatcagctctctgttacaatcggtatattgcttgcctacaccttaggcatgtttgttccttggagaattctctctgttcttggcattttaccttgctcaatcctgatacctgggctgttcttcatccctgaatcaccaaggtggctggcaaaaatgggaaagatggaagattttgaatcgtcactgcaggtcctccgcggatttgaaactgatatctcagcagaagtaaatgaaataaagagatcagttgcctcatctaggaggaggacaaccatacgatttgcagagatcaaacacaagagatatagtgttcctcttatgataggaattggtctccttatacttcagcaactaagtggtgtcaacggcattttcttctatgctgcaagtatcttcaaagctgctggtcttaaaaatagtaatctagcaacatgtggtttgggggctgttcaggtggttgctactggaataacaacctggttgactgacaaagctggtcgacggctacttctcattatctctgctgtagggatgacagtcagtcttctcgttgtttccgtgtcattttttgtgaaggacaacatagatgaagcttctcatttacactctgtgatgagtatactttcactggctgcacttgtggcatttgtgtttgcattttcccttggcatgggagccatcccatggattataatgtctgagattcttcctgttaacatcaagagccttgccggcagcacggccacccttgcaaactggatgacgtcgtggctcatcacgatgaccgcgagcttgatgctaaactggagcaatggaggaacctttgctatatacgcggcggtgtccatgggcaccctcctcttcgtgtgcctgtgcgtgccggagaccaaggggagaaccctcgaagagatcgcgttctcgttccgctgaagcccggaaccacggcgcgtagggtagacaggcaggcaggcggcagccgtgttttttgcagggacatttgtatcatgtgtttgtgtaatagtgtactatcagtgtaccatttgtgtatgtgcaatagaatgggggaggggtggaatgtagcaaggggcagacagacagacagggcacacctccccctttgcagtcagccagtcaggggagtcagcagtaagtagaagaagagcaaaatctggtggttagtacatttggttgatgtatacagcagcagctgctgtggccaatagaataataattcagatgtaatgtccaagaataatttttttgctactttcggtgtgctgcattatggatggagtgtgcatgtgcatcccagttcccagaaacctattgtcctagaaagtgttgttgaagtaaggaaaaaagatgttgtgctagaaaaa

SEQ ID NO: 1747 - DNA, 2011 bp, Secale cereale
cgcccgcgaatcgtgccacgcacggcacggaagcgagcgagcccagccaatccgatccgagcccgcgcggcggcggcgcgatgagcttccgggacgagagcggcggggaggacggcagcggggccggtcgtcgtcggcgtccgacctgcgcaagccgttcctgcacacggggagctggtacaggatgtccgcggcgggcggcggcgccatggaccggctcggctcctccgcctacggcctgcgcgacagctccatctccgcgctgctctgcaccctcatcgtcgcgctcggccccatccagttcggcttcacctgcggctactcctcgcccacccaggacgccatcatggccgacctcggcctcaccctctccgagttctctttattcggatccctgtccaacgtcggggccatggtgggcgccattgccagtggccagatcgccgagtacatcggccgtaaagggtctctgatgatcgccgctatcccgaacatcattgggtggcttgcaatatcgtttgcaaatgattcctcattcttgttcatgggccggttgctggaaggatttggggtcggtgtgatatcctacacggtaccagtttatatagcagaaattgctccacagaacatgagaggagctcttggttcagtcaatcagctctctgttacaatcggtatattgcttgcctacaccttaggcatgtttgttccttggagaattctctctgttcttggcattttaccttgctcaattctgatacctgggctgttcttcatccctgaatcaccaaggtggctggcaaaaatgggaaagatggaagattttgaatcgtcactgcaggtcctccgcggatttgaaactgatatctcagcagaagtaaatgaaataaagagatcagttgcctcatctaggaggaggacaaccatacgatttgcagagatcaaacacaagagatatagtgttcctcttatgataggaattggtctccttatacttcagcaactaagtggtgtcaacggcattttcttctatgctgcaagtatcttcaaagctgctggtcttaaaaatagtaatctagcaacatgtggtttgggggctgttcaggtggttgctactggaataacaacctggttgactgacaaagctggtcgacggctacttctcattatctctgctgtagggatgacagtcagtcttctcgttgtttccgtgtcattttttgtgaaggacaacatagatgaagcttctcatttacactctgtgatgagtatactttcactggctgcacttgtggcatttgtgtttgcattttcccttggcatgggagccatcccatggattataatgtctgagattcttcctgttaacatcaagagccttgccggaagcacggccacccttgcaaactggatgacgtcgtggctcatcacgatgaccgcgagcttgatgctaaactggagcaacggaggaacctttgctatatacgcggcggtgtccatgggcaccctcctcttcgtgtgcctgtgcgtgccggagaccaaggggagaaccctcgaagagatcgcgttctcgttccgctgaagcccggaaccatggcgcgtagggtagacaggcaggcaggcagccgtgttttttgcagggacatttgtatcatgtgtttgtgtaatagtgtactatcagtgtaccatttgtgtatgtgcaatagaatgggggaggggtggaatgtagcaaggggcaggcagacagacagggcacacctccccctttgcagtcagtcagccagtcaggggagtcagcagtaagtagaagaagagcaaaatctggtggttagtacatttggttgatgtatacagcagcagctgctgtggccaatagaataataattcagatgtaatgttcaagaataaattttgtgctactttcagtgtgctgcattatggatggagtgtgcatgtgcatgccagttcccagaaactattgcctgaaagtgttgttgaggagaaataaaaa

SEQ ID NO: 1748 - DNA, 2091 bp, Triticum aestivum
cagcaggagagacaaaatctggctccttttatttttgttggcctcggacaaaactggattattcttccagctcagacacgggcttgtcccaaatccggcaccaacttccggctgacctcttcttcccactgtcgctcttgctcctctcgtcgtctccctccgatcttgtcgccaccccctcgcggttgcagcctagcttgttgcctcggcgatgaacggcggcggcgatgagagcggcagcgaccatgagggtggcggcggcacgcggaagccgctgctgctcaagaacacgggcagctggtacaggatggtggggtcgtcgtcgcggcagatagtcggcgcctcctccatggcggtgctgcgcgagtcccacgtctcggcgctcctctgcacgctcatcgtcgccctcggccccatccagttcggcttcacctgcggctactcctcgcccacccaggacgccatcatggccgacctcggcctcaccctctccgagttctctttattcggatccctgtccaacgtcggggccatggtgggcgccattgccagtggccagatcgccgagtacatcggccgtaaagggtctctgatgatcgccgcaatcccgaacatcattgggtggcttgcaatatcgtttgcaaatgattcctcatttgtgttcatgggccgattgctggaaggatttggggtcggtgtcatatcctacacggtgccagtttatatagcagaaattgctccacagaacatgagaggagctcttggttcagtcaatcagctctctgttacaatcggtatactgcttgcctacacattaggcatgtttgttccctggagaattctctcagttcttggcattttaccttgctcaatcctgatacctggactgttcttcattcctgaatcaccaaggtggctggcaaaaatgggaaagatggaagattttgaatcttcactgcaggtcctgcgcggatttgaaactgatatctcagcagaagtaaatgaaataaagagatcagttgcctcatctaggaggaggacaaccatacgatttgcagagatcaaacacaagagatatagtgttcctcttatgataggaattggcctccttatacttcagcaactaagtggtgtcaacggcattttcttctatgctgcaagtatcttcaaagctgctggtcttaaaaatagtaatctagcaacatgtggtttgggggctgttcaggtggttgctactggaatcacaacctggttgactgacaaagctggtcgacggctacttctcattatctctgctacagggatgacaatcagtcttctcgttgtttctgtgtcattttttgtgaaggacaacatagaggaagcttctcatttacactttgtgatgagtatgctttcactggctggacttgtggcatttgtgcttgcattttcccttggcatgggagccatcccatggattataatgtctgagattcttcctgttaacatcaagagtcttgccggaagcaccgccacccttgcaaactggatgacgtcgtggctcatcacgatgaccgcgagcttgatgctaaactggagcaacggaggaacctttgctatatacgcggcggtgtccatgggcaccctcctcttcgtgtgcctgtgcgtgccggagaccaagggaagaacgctcgaggagatcgcgttctcgttccgctgaagcccggaaccacggcgcgtagggtagacaggcaggcaggcgggcgtcgtgctacttgatggctgtttcgggtcaggcctcggggcctggatcaggtagtcgcgcagccgtgttttttgcaggagggatatttgtatcatgtgtttgtgtaatagtgtactatcagtgtaccatttgtgtatgtgcaatagaatgggggaggggtggaatgtagcaagggacagacaggtcacccagccccttttgcaggcagtcagtcagtcaggggagtgtgcagtcagtagaagagcaatttggtggtcagtacattgggtttcatatatacagcagcagctgtggccaaaggaataattcagatgtaatgtcaaacaataaattttgagctagtt

SEQ ID NO: 1749 - DNA, 677 bp, Saccharum officinarum
actcctcctcttcctcttccttccccagtcgcggaggaagacaaggcgcgcgcgctgaaccacctgctctgctcaggctgacaggctcgattcaggttcaggaggactcaagagggagggggcctttttccgccggcgacatggcggaggagaagggcgcgctgcagtcggcgagggagtgggtcgtggagcacaagctccgggccgtcggcacgctgtggctcagcggcatcgtcggctccatcgcctacaactggtccaggccgggcatgaagaccagcgtcaagatcatccacgccaggctgcatgctcaggctctgacactggctgccttggctgggtctgcgctggtggagtactacgatcatcaacaagggtcaggatccagagtccaccaatatgcaaagcagttcctatcatctgatagcagtagcagcccacaaaaggagtagctagtgttggtgggtcagccagacgccctgaccttacgaagtaccagcagtggagtgggtgttgttttctgatcaaataattttgcctatggcattctgtgggaacttaggcggacctttgcctgcttttctatgtaatgtaagctgctgaaacatgtgcacttcaaatgctgttgtggttgcatatgtttccctgaatgtcttgaaatgaaataaatggttttt

SEQ ID NO: 1750 - DNA, 668 bp, Saccharum officinarum
ggacccgctcactatttccttcctcttcctcttcctcttccttccccagtcgcggaggaacacaagacgcgcgcgctgaaccacctgctctgctcaggctgacaggctcgattcaggttcaggaggactcaagagggaggggccctttttccgccggcgacatggcggaggagaagggcgcgctgcagtcggcgagggagtgggtcgtggagcacaagctccgggccgtcgggacgctgtggctcagcggcatcgtcggctccatcgcctacaactggtccaggccgggcatgaagaccagcgtcaagatcatccacgccaggctgcatgctcaggctctcacactggctgccttggctgggtctgcgctggtggagtactacgatcatcaacaagggtcagggtcgaaagttcaccaatatgcaaagcagttcctatcatctgatagtgatagccatagcagcccacaaaaagagtagctagtgttggtgggtgttattttcggatcaaataattttgcctatggcattctgtgggaacttaggcggacctttgcctctgcttttctatgtaatgtaatgtaaactgctgaaacctgcacttcgaatgttgttgtggatgcagatggtaccatgcatgtgtttccctgaatgtcttgaaatgaaata

SEQ ID NO: 1751 - DNA, 1367 bp, Panicum virgatum
gtgagcttcgtacgactcttccgattccattcccctccgcgccaccgcgctcactattaagatcccaacccccttcccctcttcttccaccgccgcagcccgcagtctagcagggatcgcacacgcaagcgcaagcagctggattcgggggctcggctcggtccgtgaggaagctttccggcgagatggcggaggagaagagcgcgctgcagtcggcgagggagtgggtcgtcgaccacaagctccgggccgtcgggacgctgtggctgagcggcatcgtgggctccatcgcctacaactggtccaggccgggcatgaagaccagcgtcaagatcatccatgccaggttgcatgcccaggctctgacactggctgccttggctgggtctgcactggtggagtactatgatcatcagcaaggatcgggatcaaaggttcaccaatatgcaaagcagatcctatcatctgacggcagctcacaaaaagagtaggcagtgtgggtgagttaggcgttggtgacaaattagcagcagtgagacatggaatggatcggatgttattttccgatcaaataatttgtctgtgaaattctgtgggaacttctgaaagctttacctgctgatggctgcccacttctatgagtaaattctgtgggaacttctgaaagctttgcctgctgatggctgcctacttttatgtgtaagctactgaaccagcatttgggatgttgcaatatgccgatagcagatgttccaaatatcttgaatggaatgcccttcatctgccgcttgttcttcagccaaattagcagcggggctaatttctaacagcgacaggcctcggccctcgggaacctgattgaataagttggaggccttgcagagaagctactgtaccaatccatgggttgtagttgcccgtgtcctgcttcttccttgctgtgtattgctgacagttacctgcacctgctctgcgcctctgctcttgtgctgtggcggagttgcactttgtgttcttctcttcacctcacaaccggtgcagacctgaagaaacaagacgacgccatgttcaagttgatgttctgcgtcttcttcagtcgtcgagctgaaggcctgatgtttcgaggtactgcgatttcagctttcgcagtggtgctgggccctgtttggtttcatgtagcgcaacttgcgctacgttggaatcttaaatgcatggagcactaaacgatgtttatttgcaaaaaaaattcacggatgagtgtaacttttcgcgacgaatttaatgacgataattaatgctacagtaccatctaatcatgcggccaaatgtctcgttaaattcgtctcgtgaagtagcgcaggggttgt

SEQ ID NO: 1752 - DNA, 659 bp, Panicum virgatum
cctccgcgccaccgcgctcaccgctattaatcccaaccctccgctcccctcttcttccaccgcagcagtctagcagagatcgcacacgcaagcgcaagcacctggattggggagctcggctcggttcgtgacgaagctttccggcgagatggcggaggagaagagcgcgctgcagtcggcgagggagtggatcgtcgaccacaagctccgggccgtcgggacgctgtggctcagcggcatcgtgggctccatcgcctacaactggtccaggccgggcatgaagaccagcgtcaagatcatccatgccaggttgcatgctcaggctctgacactggctgccttggctgggtctgcactggtggagtactatgatcatcagcaaggatcaggatcaaaggttcaccaatatgcaaagcagttcctatcatctgatggcagctcacaaaaagagtaggcagtgtgggtgagttaggcgttggtgacaaattagcagcagtgagacatggaatggatcggatgttattttctgatcaaataatttgtctgtgaaattctgtggcaacttctgaaagctttgtctgctaatggccgcccacttttatgtgtaagctactgaactagcatttcggatgttgcaatatgccgatatcagatgttcc

SEQ ID NO: 1753 - DNA, 741 bp, Setaria italica
gatccccccgtttcccctcctcttccttccaccgtcgcagtccagcagaggtcgcactcggaagcagctggattggattaattggggtcggtgcggctcgggaggaagctttccggcgagatggcggaggagaagagcgcattgcagtcggccagggagtgggtcgtcgaccacaagctccgggccgtcgggacgctgtggctgagcgggatcgttggctccatcgcctacaactggtccaggcccggtatgaagaccagcgtcaagatcatccatgccaggctacatgctcaggctctgacactggctgccttggctgggtccgcactggtggagtactatgatcatcagcaaggatcaggatcaaaggttcaccaatatgcgaagcagttcatatcatctgacggcagctcacaaaacaagtaggcagcaaggttgggttaggcatgggtgacgaattagcagcagtgagacatggaacgggtcggatgctatttgttatactccgatcaaataatttgcctgtgacattctgtgggaacttctgaaaactttgcctgctgatgggctgccactttttctatgtaagctactgaatcagcatttcagatgatgtgatatgctgaattgctgatagcagatgttccctgaatgtcttgaatggaatggctttcatctgctgctggtaatttgcggcaaactcttgtcgactgtgtttttaatgaccctgatcgattgccc

SEQ ID NO: 1754 - DNA, 829 bp, Sorghum bicolor
tgcgtgccgcgtgggcgtgtccgctttcacgaccacgacgagctcgccgccgcggcgtgacccagcgtagtacggctctcatccgcccacccagaccgctcgctatttcctttcccccctactcctcctcttccttcccccgtcgcggaggaagacaaagacacgcgtggagaagcaaaggctcggggctagatttgggaggttcaggaggactcactcaggagggaagctttttccggtcggccggcgacatggcggaggagaagagcgctctgcagtcggcgagggagtgggtcgtggagcacaagctccgggccgtcgggacgctgtggctcagcgggatcgtcggctccatcgcctacaactggtccaggccgggcatgaagaccagcgtcaagctcatccacgccaggctgcatgctcaggctctcacactggctgccttggctgggtctgggctggtggagtactacgatcaccaacaagggtcaggatccaaagtccaccaatacgcaaagcagttcctatcatctgatgctgatagcagtagcagcccacaaaaagagtagcagccttacgaagtaccatctgtggagtgggtcagtgggtgttattctctgatcaaataattttgcctatggcattctgtggcaacttaggcggagcttcgcctgattttctatgtaatgtaagctgctgaaacctgaattaccgtgtatgaagatggtaccatgcatatgttttcctgaatgtcttgaaatgaaataaatggttttttttttatcggctgctaggtatgcatcatgagccgtcacgccgatttaggcct

SEQ ID NO: 1755 - DNA, 1015 bp, Sorghum bicolor
cacttggcagtggcacacaggaaactcaaaccgaagccgcacgctgtttccttcgttttccggatccaggccacgcccgccaattagcctccgggcccgcgcccccaccacaccgaccgcggctgctgcgtgccgcgtgggcgtgtccgctttcacgaccacgacgagctcgccgccgcggcgtgacccagcgtagtacggctctcatccgcccacccagaccgctcgctatttcctttcccccctactcctcctcttccttcccccgtcgcggaggaagacaaagacacgcgtggagaagcaaaggctcggggctagatttgggaggttcaggaggactcactcaggagggaagctttttccggtcggccggcgacatggcggaggagaagagcgctctgcagtcggcgagggagtgggtcgtggagcacaagctccgggccgtcgggacgctgtggctcagcgggatcgtcggctccatcgcctacaactggtccaggccgggcatgaagaccagcgtcaagctcatccacgccaggctgcatgctcaggctctcacactggctgccttggctgggtctgggctggtggagtactacgatcaccaacaagggtcaggatccaaagtccaccaatacgcaaagcagttcctatcatctgatgctgatagcagtagcagcccacaaaaagagtagcagccttacgaagtaccatctgtggagtgggtcagtgggtgttattctctgatcaaataattttgcctatggcattctgtggcaacttaggcggagcttcgcctgattttctatgtaatgtaagctgctgaaacctgaattaccgtgtatgaagatggtaccatgcatatgttttcctgaatgtcttgaaatgaaataaatggttttttttttatcggctgctaggtatgcatcatgagccgtcacgccgatttaggccttctttacttccccaaaaaaattgtaaaatattcaagattttttgtcacaatgaatcttgc

SEQ ID NO: 1756 - DNA, 799 bp, Pennisetum glaucum
cgcgcgccggcacgtcgggaagagctgcatggtcctgccgtccggcgttttcccctcttcttccccaccggtcgcactccaccagagccaagccagtcgcactcgggagcagggagggagagagggagggagctcggctcgggactcggaagctttcgtttttcttccggcgagatggcggaggagaagagcgcgttgcagtcggccagggagtgggtcgtcgaccacaagctccgggccgtcgggacgctgtggctcagcgggatcgccgcctccatcgcctacaactggtccaggcccggcatgaagaccagcgtcaagatcatccacgccaggctacacgctcaggctttgacactggctgccttggctgggtctgcactggtggagtactatgatcatcagcaaggatcaggatcaaaggttcaccaatatgcgaagcagttcatatcatctgacgggggctcacagaacaagtagggcaacacggttgggttgggttgggttggggttaggcgtgggtgacgggagtagcagcggcgagagagacatggaacgggtcgggtgttatatgttatattccgatcaaataatttgcctgtgacattctgtgggaacttcgggaaactccccctgctgatcgagggggctgcccacgttttctgtgtaggctactttgaaccagcatttcaggtgtcgtgatacgctgaattgctgctgatggcagatggcccccctgaatgtattgaatggaaaaggctttcctcaagctgctggtatgcatacaagtcgtcagacg

SEQ ID NO: 1757 - DNA, 697 bp, Avena sativa
cagcgcaagagcccgagacccttttcccctcttcttctccccccctcccactcccgtcaagaacacacacacacgcgacgaagcagattggagccggaactcgacctgataatcgaagccttcctttcattcatctggaaatggcggaggagaagggcacgctgcagtcgatgagggagtgggtcgtggagcacaagctccgggccgtcggtacgctgtggctcacggggatcgcgggatcgatcgcgtacaactggtccaggcccggcatgaagaccagcgtcaagctcatccacgccaggcttcatgctcaggcccttaccctggcagccttgggtggttccgcactggtggaatactatgatcaccagtcaggttcaggatcaaaagttcacagctacgcgaagcagttccttccagctgatagcaaccccaaaaaggagtagaggatacaccgtgtagagaaggcagcaaattacaggcagccaccagctgatatggaatttgttgatgttatttacctgagcaaacagtctggcattttgcgtgccgttatcgaaactctgtaggctgcctatttcaatgtataagctactgaaccaccattcagatgtccccatatgcagatgcgtggtaaccggaaacatgtaattttcctgaaccgcacatgaatgtgatgaatgaaatgttaccctct

SEQ ID NO: 1758 - DNA, 671 bp, Avena sativa
acagcgcaagagcccgagacccttttcccctcttcttctcccccccccccactcccgtcaagaacacacacacacgcgacgaagcagattggagccggaactcgacctgataatcgaagccttcctttcattcatctggaaatggcggaggagaagggcacgctgcagtcgatgagggagtgggtcgtggagcacaagctccgggccgtcggtacgctgtggctcacggggatcgcgggatcgatcgcgtacaactggtccaggcccggcatgaagaccagcgtcaagctcatccacgccaggcttcatgctcaggcccttaccctggcagccttgggtggttccgcactggtggaatactatgatcaccagtcaggttcaggatcaaaagttcacagctacgcgaagcagttccttccagctgacagcaaccccaaaaaggagtaggatacaccgtgtagcaaattacaggcagccacccagctgatatggaatatgttgatgctattacctgaagaaacaatctggcattttgctctgtaggctgcctatttccaatgtataagctactgaaccaccattcagatgtcgccatgtgcagatgcgtggtaaccggaaacatgtaattttcctgaaccgcacatgaatgtgatggatgaaatgttaccctc

SEQ ID NO: 1759 - DNA, 670 bp, Avena sativa
tcttcttctcccccctccccactcccgtcaagaacacacacacacacgcgacgaagcagattggaaccggaactcgacctgataatcgaagccttcctttcattcatctggaaatggcggaggagaagggcacgctgcagtcgatgagggagtgggtcgtggagcacaagctccgggccgtcggtacgctgtggctcacggggatcgcgggatcgatcgcgtacaactggtccaggcccggcatgaagaccagcgtcaagctcatccacgccaggcttcatgctcaggcccttaccctggcagccttgggtggttccgcactggtggaatactatgatcaccagtcaggttcaggatcaaaagttcacagctacgcgaagcagttccttccagctgatagcaaccccaaaaaggagtagaggatacaccgtgtagagaaggcagcaaattacaggcagccaccagctgatatggaatttgttgatgttatttacctgagcaaacagtctggcattttgcgtgccgttatcgaaactctgtaggctgcctatttccaatgtataagctactgaaccaccattcagatgtccccatatgcagatgcgtggtaaccggaaacatgtaattttcctgaaccgcacatgaatgtgatgaatgaaatgttaccctc

SEQ ID NO: 1760 - DNA, 597 bp, Avena sativa
cgaagcagattggaaccggaactcgacctgataatcgaagcttttctttctttcactcatctcgaaatggcggaggagaagggcacgctgcaggcgatgagggagtgggtcgtggagcacaagctccgggccgtcgggacgctgtggctcacggggatcgcgggatcgatcgcgtacaactggtccaggcccggcatgaagaccagcgtcaagctcatccacgccaggcttcatgcgcaggcccttaccctggcagccttgggtggttcagcactggtggagtactatgatcaccagtcaggttcaggatcaaaagttcacagctacgcgaagcagttccttccagctgacagcaaccccaaaaaggagtaggatacaccatgtagcaaattacaggcagccacccagctgatatggaatatgttgatgctattacctgaagaaacaatctggcattttgctctgtaggctgcctatttccaatgtataagctactgaaccaccattcagatgtcgccatgtgcagatgcgtggtaaccggaaacatgtaattttcctgaaccgcacatgaatgtgatggatgaaatgttaccctct

SEQ ID NO: 1761 - DNA, 712 bp, Brachypodium distachyon
gggagacaccgtacacagttttcctttagccgtcgtccgccagagcccaaagccgctttcccctcctcttcttcttctcccccgttaaaaccgccagcacagcggcaggcagatcggaaaccggaactcgatccgcgaggagcgtgaaaaatggcggaggagaagggcgcgctgcagtcgatgaggcagtgggtggtggagcacaagctccgggccgtcgggtcgctgtggctggcggggatcgcggggtcgatcgcctacaactggtccaggcccgggatgaagaccagcgtgaagctcatccacgccaggcttcatgctcaggcccttaccctggctgctttaggtgggtctgcactggtggagtactacgatcatcagtcagggtcaggatcaagagttcaccaatatgcgaagcagttcctcccacctgacagcaaccccaaaaaagactaggatctactgtgtagaagaggcagcaaattacagccaccggctgatatggaatgcattgatgttatttcctgagcaaacaatctgtcagtctgtgtgccgttattggaattcctcgtgctgcctattttctgtgtaagctactgaaccagcattccggtgccgcgatatgcagatatgcatggtaatggaacaatgtattttcctgaaccaaacatgaatgctgaaatggatgaaaaaattccctctttctaccgat

SEQ ID NO: 1762 - DNA, 1341 bp, Brachypodium distachyon
aagcaaatttctgcatttttcaaactctgaagaagaaggggaaaaaaaagaccaatggcacgtatctctctgtctgtgaaaccacgtatctctctgtctgtgaaaccatgggagacaccgtacacagttttcctttagccgtcgtccgccagagcccaaagccgctttcccctcctcttcttcttctcccccgttaaaaccgccagcacagcggcaggcagatcggaaaccggaactcgatccgcgaggagcgtgaaaaatggcggaggagaagggcgcgctgcagtcgatgaggcagtgggtggtggagcacaagctccgggccgtcgggtcgctgtggctggcggggatcgcggggtcgatcgcctacaactggtccaggcccgggatgaagaccagcgtgaagctcatccacgccaggcttcatgctcaggcccttaccctggctgctttaggtgggtctgcactggtggagtactacgatcatcagtcagggtcaggatcaagagttcaccaatatgcgaagcagttcctcccacctgacagcaaccccaaaaaagactaggatctactgtgtagaagaggcagcaaattacagccaccggctgatatggaatgcattgatgttatttcctgagcaaacaatctgtcagtctgtgtgccgttattggaattcctcgtgctgcctattttctgtgtaagctactgaaccagcattccggtgccgcgatatgcagatatgcatggtaatggaacaatgtattttcctgaaccaaacatgaatgctgaaatggatgaaaaaattccctctttctaccgatgaagtaaactagtaccaagcaaatcccatgccacatgctcctaagctggtgtgcatgcagaagcttctcttcagtaacaataaaaattccattgcctgacatcggatgtagtaatcccttggaattcacagcaccacatgatgagattcctttctctgtttggaatatgatactgtgcagtgctagtacatatacatatataggagtcattaattagagcacatgctaatatgctttcgaggtgactggtgaaacatcagcgttgcttccaatgttgggtctgctggtgtgttagttttatggtttcctactaggcgattggtttgtagcttccttgttggttagcgtcgtgtagttgaaaccaaacccagcttaattagctgcatggtccgtgtcatgcccatgaatcttgagtgtgctgaaagataacagaacacaactaaccattcgccaaccagtttcccggtttatgccgctaatggcaagcttgaattaggtggctttgcatggtgccacatat

SEQ ID NO: 1763 - DNA, 695 bp, Oryza sativa
atcgattgcttcttcctcgttcacagcaggcacaaacagatcgggcaccggagaggttgggaggagagcttgggttggcctgacgaaatggcggaggagaagagcacgatgcagtcgatgagggagtgggtcgtcgaccacaagctccgggccgtcgggacgctgtggctgactggggtggcgagctcgatcgcgtacaactggtcgaggcccggcatgaagaccagcgtcaagatcatccacgccaggttgcatgctcaggccctcacactggctgcattggctggctctgcactggtggagtactacgaccatcggtcaggttcaggatcaagagttcatcagtatgcgaagcagttcatcacacctgagagcaacccacaaaaagaatagaggacgttgtgtacttaatcaacgccagatgtatcgatatgatttcctacgcacaaattctgtggcgtctgaatctcctacgtactgtctgttttcccttctctgcctgctttctgtataagctaagctgctgaactaacattcagggtttcagacgctgcgatatcgatgatgaatgataatgaactggcatcagctgtgtaatgtaatacatttgttgtttcttgtcaagacgaatcaaatgttctgattttctatatgtgtgtaactattgaggcttttttttaaatcactattgaggc

SEQ ID NO: 1764 - DNA, 750 bp, Oryza sativa
gcgagccgcgtgtgcgctcgaaaccatctccgccaccgccaccgcgacagaggcacgggtcgccacgtacgttcgcagctcgcgctgccggattcctgccgcgtcatcgtgcagcggctgccacctgagcagtgccaccaccacggccgtttcccaggcacaaacagatcgggcaccggagaggttgggaggagagcttgggttggcctgacgaaatggcggaggagaagagcacgatgcagtcgatgagggagtgggtcgtcgaccacaagctccgggccgtcgggacgctgtggctgactggggtggcgagctcgatcgcgtacaactggtcgaggcccggcatgaagaccagcgtcaagatcatccacgccaggttgcatgctcaggccctcacactggctgcattggctggctctgcactggtggagtactacgaccatcggtcaggttcaggatcaagagttcatcagtatgcgaagcagttcatcacacctgagagcaacccacaaaaagaatagaggacgttgtgtacttaatcaacgccagatgtatcgatatgatttcctacgcacaaattctgtggcgtctgaatctcctacgtactgtctgttttcccttctctgcctgctttctgtataagctaagctgctgaactaacattcagggtttcagacgctgcgatatcgatgatgaatgataatgaactggcatcagctgtgtaatgtaatacatttgttgtttcttgtc

SEQ ID NO: 1765 - DNA, 628 bp, Festuca arundinacea
  misc_feature (87)..(87): n is a, c, g, or t
  misc_feature (128)..(128): n is a, c, g, or t
  misc_feature (147)..(147): n is a, c, g, or t
  misc_feature (182)..(182): n is a, c, g, or t
  misc_feature (253)..(253): n is a, c, g, or t
  misc_feature (292)..(292): n is a, c, g, or t
  misc_feature (298)..(298): n is a, c, g, or t
  misc_feature (313)..(313): n is a, c, g, or t
  misc_feature (575)..(575): n is a, c, g, or t
ggcacgaggcccaaacccttttcccctctccttctccaactcccgtcgcggaatcacgcgcagattggaacaggagctcgatccganagaagctttcttttctcgcggaatggcggaggagaagggcncgctgcagtcggcgaggangtggatcgtggagcacaagctccgggccgtcgggncgctgtggctctcggggatcgcgggatcgatcgcgtacaactggtccaggcccggcatgaagaccagcgtnaagctcatccacgccaggcttcatgctcaggcccttacnctggcngccttgggtggttcngcactggtggagtactatgatcaccagtcaggttcagggtcaagagttcacaactatgcaaagcagttccttcctccagctgacaccaaccccaaaaaggagtaggatctactgtgtagaagaggcaccaaattacagccaccagatatggaacatcttggatgttattttctgaacaaagaatctggcactctgtgtgcatttattgagattctgcaggctggctattttctgtataagctactgaaccagcattcagatnccgcgttacgctgatgcatggtaatgaaaatatgtagtactatcctcaaaaac

SEQ ID NO: 1766 - DNA, 641 bp, Secale cereale
agcatacgcgcagacagattgattgggaccggagaactcgatctggtagcagaagctctcgtttcctttcggcggaagtaatggcggaggagaaggggacgctgcaggcgatgaggggctgggtcgtggaccacaagctgcgggccgtagggacgctgtggctcacggggatcgcgggatccatcgcctacaactggtccaggcccggcatgaagaccagcgtcaagctcatccacgccaggcttcatgctcaggccctcaccctggctgcattgggttgttccgcactcgtggagtactatgatcaccagtcaggttcaggatcaaaggttcacgactatgcaaagcagttccttccatcggacagaaacaccaaaaaggactctgtgtagaagaggcagcatattataggcttccattagctgatatggaatttgtggatgttattttctgagaacaatcttggcatgtgatgtgccgttatcctagttctgcagactccctatttcaatctggcatgtgatgtgccgttatcttagttctgcaggctccctattttctgtataagctcctgaaccagcatctagatgcagccgtatgcaaatccgtggtgatggaaatatgtactttcctgaaccgcg

SEQ ID NO: 1767 - DNA, 625 bp, Secale cereale
agcatactcgcagacagattgattgggaccggagaactcgatctggtagcagaagctctcgtttcctttcggcggaagtaatggcggaggagaaggggacgctgcaggctatgaggggctgggtcgtggaccacaagctgcgggccgtagggacgctgtggctcacggggatcgcgggatccatcgcctacaactggtccaggcccggcatgaagaccagcgtcaagctcatccacgccaggcttcatgctcaggccctcaccctggctgcattgggttgttccgcactcgtggagtactatgatcaccagtcaggttcaggatcaaaagttcacgactatgcaaagcagttccttccatcagaccgaaacgccaaaaaggactccgtgtagaagaggcagcaaattataggcttccattagctgatatgggatttgttgatgttattttctgagcaaacaatctggcatgtgatgtgccgttatcttagttctgcagactccctgttttcggtataagctcctgaaccagcatcaagatgcagccgtatgcaaagccgtggtgatggaaatatgtactttcctgaaccgcgtatgaatgtaatgaatgaaatgtttctctcttg

SEQ ID NO: 1768 - DNA, 756 bp, Secale cereale
gactccagccacagcggaccgcggtatcgcgccggcaacggactcatttccccccaccaacaccgcccaacagagccccaaacccttttcccctctacttctacccccccgccccccacccccagccccccgtcgcagaagcatacgcgcagacagattgattgggaccggagaactcgatctggtagcagaagctctcgtttcctttcggcggaagtaatggcggaggagaaggggacgctgcaggcgatgaggggctgggtcgtggaccacaagctgcgggccgtagggacgctgtggctcacggggatcgcgggatccatcgcctacaactggtccaggcccggcatgaagaccagcgtcaagctcatccacgccaggcttcatgctcaggccctcaccctggctgcattgggttgttccgcactcgtggagtactatgatcaccagtcaggttcaggatcaaaagttcacgactatgcaaagcagttccttccatcagaccgaaacgccaaaaaggactccgtgtagaagaggcagcaaattataggcttccattagctgatatggaatttgttgatgttattttctgggcaaacaatctggcatgtgatgtgccgttatcttagttctgcagactccctgttttctgtataagctcctgaaccagcatctagatgcagccgtatgcaaagccgtggtgatggaaatatgtactttcctgaaccgcgtatgaatgtaatgaatgaaatgttt

SEQ ID NO: 1769 - DNA, 843 bp, Secale cereale
acggactcatttcccccaccaacaccgcccaacagagacccaaaccttttcccctctacttctacccctccccccacccagccccccgtcgcagaagcacacgcgcagacagattgattgggaccggagaactcgatctgatagcagaagctctcgtttcccttcggcggaagtaatggcggaggagaaggggacgctgcaggcgatgaggggttgggtcgtggaccacaagctgcgggccgtagggacgctgtggctcacggggatcgcgggatccatcgcctacaactggtccaggcccggcatgaagaccagcgtcaagctcatccacgccaggcttcatgctcaggccctcaccctggctgcattgggttgttccgcactcgtggagtactatgatcaccagtcaggttcaggatcaaaagttcacgactatgcaaagcagttccttccatcagaccgaaacgccaaaaaggactccgtgtagaagaggcagcaaattataggcttccattagctgatatggaatctgttgatgttattttctgagcaaacaatctggcatgtgatgtgccgttatcttagttctgcaggctccctatttcaatctggcatgtgatgtgccgttatcttagttctgcagactccctgttttctgtataagctcctgaaccaacatctagatgcagccgtatgcaaatccgtggtaatggaaatatgtactttcctgagccgtgcatgaatgtaatgaatgaaatgtttctctcttgctactgatgaagtataccaacagacgacttggtgtgcagaagcttagggctgctacaatgacagaaaccttag

SEQ ID NO: 1770 - DNA, 627 bp, Triticum aestivum
cagaagcacacgcgcagacagattggaaccggagagctcgatctgatagcacaagctttcgaatccctttcggcggaaggaatggcggaggagaaggggacgctgcaggcgatgagggggtgggtcgtggaccacaagctgcgggccgtagggacgctgtggctcacggggatcgcgggatccatcgcctacaactggtccaggcccggcatgaagaccagcgtcaagctcatccacgccaggcttcacgctcaggccctcactctggctgccttgggttgttctgcgcttgtggagtactatgatcaccagtcaggttcaggatcaaaggttcacgactatgcaaagcagttccttccatcggacagaaacgccaaaaaggactccgtgtagaagaggcagcaagttataatataggcttccattagctgatatggaatttgttgatgttattttctgagcaaacaatctggcatttcacatgccgttatccaagttctgcaggcttcctgttctctgtataagctaccgaaccagcatttagatgcagccgtatgcaaatccgtggggatggaaatatgtgctttcctgaaccgtgcatgaatgtaatgaatgaaatgtttctct

SEQ ID NO: 1771 - DNA, 742 bp, Triticum aestivum
tcttcttctactactactccccccaccccacccagcccaccgtcgcagaagcacacgcgcagacagattggaaccggagagctcgatctgatagcacaagctttcgaatccctttcggcggaaggaatggcggaggagaaggggacgctgcaggcgatgagggggtgggtcgtggaccacaagctgcgggccgtagggacgctgtggctcacggggatcgcgggatccatcgcctacaactggtccaggcccgggatgaagaccagcgtcaagctcatccacgccaggcttcacgctcaggccctcactctggctgccttgggttgttctgcgcttgtggagtactatgatcaccagtcaggttcaggatcaaaggttcacgactatgcaaagcagttccttccatcggacagaaacgccaaaaaggactccgtgtagaagaggcagcaagttataatataggcttccattagctgatatggaatttgttgatgttattttctgagcaaacaatctggcatttcacatgccgttatccaagttctgcaggcttcctgttctctgtataagctaccgaaccagcatttagatgcagccgtatgcaaatccgtggggatggaaatatgtgctttcctgaaccgtgcatgaatgtaatgaatgaaatgtttctctcttacagtactactgatgaagtaaaccgacaaggtgagttcgtgcgcagaagcttctgctcaaggcaaaa

SEQ ID NO: 1772 - DNA, 692 bp, Triticum aestivum
aagcacacgcgcacacagattggaaccggagaactccgtctgatagcagaagctttcgtttcctttcggcggaagtaatggcggaggagaaggggacgctgcaggcgatgagggggtgggtcgtggaccacaagctgcgggccgtagggacgctgtggctcacggggatcgcgggatccatcgcctacaactggtccaggcccgggatgaagaccagcgtcaagctcatccacgccaggcttcacgctcaggccctcaccctggctgccttgggttgttccgcactggtagagtactatgatcaccagtcaggttcagggtcaaaagttcacgactatgcaaagcagttccttccgtcggacagaaacgccaaaaaggactctgtgtagaagaggcagcaaattatgatataggcttccattagctgatatggaatttgttgatgttattttctgagcaaaaacaatctggcatttcaaatgccgttatccaagttctgcaggcttcctgttctccgtataagctactgaaccagcatctagatgcagccatatgcaaatccgtggtgatggaaatatgtacttgtgtactttcctgaaccgtgcatgaatgtaatgaatgaaatgtttctctatgaagtaaaccaaccagacgagttggtatgcagaagcttctgctcatggcaaaaaaaa

SEQ ID NO: 1773 - DNA, 848 bp, Triticum aestivum
ttttcccctcttcttctactactactccccccaccccacccagcccaccgtcgcagaagcacacgcgcagacagattggaaccggagagctcgatctgatagcagaagctttcgaatcccttttggcggaaggaatggcggaggagaaggggacgctgcaggcgatgaggggctgggtcgtggaccacaagctgcgggccgtagggacgctgtggctcacggggatcgcgggatccatcgcctacaactggtccaggcccggcatgaagaccagcgtcaagctcatccacgccaggcttcatgctcaggccctcaccctggctgccttgggttgttctgcgctggtggagtactatgatcaccagtcaggctcagggtcaaaagttcacgactatgcgaagcagttccttccgtcggacagaaacgccaaaaaggactctgtgtagaagaggcagcaaattatgatataggcttccattagctgatatggaattcgttgatgttactttctgagcaaaaacaatctggcatttcaaatgccgttatccaagttctgcaggcttcctgttctctgtataagctactgaaccagcatctagatgcagccgtatgcaaatccgtggtgatggaaatatgtacttatgtactttcctgaaccgtgcatgaatgtaatgaatgaaatgtttctctatgaagtaaaccaatcagacgagtatgcagaagcttctgctcatggcaaaaaaaagcttatggagtgtcttatttctaagacgcgacaataagcatgatgcgtgtagtgttggcttttcttatgtactttcctgagtaaacgacgtttgagggcgttt

SEQ ID NO: 1774 - DNA, 888 bp, Triticum aestivum
ctccccccaccccacccagcccaccgtcgcagaagcacacgcgcagacagattggaaccggagaactcgatctgatagcagaagctttcgtttcctttcggcggaaggaatggcggaggagaaggggacgctgcaggcgatgagggggtgggtcgtggaccacaagctgcgggccgtagggacgctgtggctcacggggatcgcgggatccatcgcctacaactggtccaggcccggcatgaagaccagcgtcaagctcatccacgccaggcttcacgctcaggccctcaccctggctgccttgggttgttccgcactggtggagtactatgatcaccagtcaggttcagggtcaaaagttcacgactatgcaaagcagttccttccgtcggacagaaacgccaaaaaggactctgtgtagaagaggcagcaaattatgatataggcttccattagctgatatggaattcgttgatgttattttctgagcaaaaacaatctggcatttcaaatgccgttatccaagttctgcaggcttcctgttctccgtataagctactgaaccagcatctagatgcagccgtatgcaaatccgtggtgatggaaatatgtacttatgtactttcctgaaccgtgcatgaatgtaatgaatgaaatgtttctctatgaagtaaaccaaccagacgagttggtatgcagaagcttctgctcatggcaaaaaaaagcttatggagtgtcttatttctaagacgcgacaataagcatgatgcgtgtagtgttggcttttcttatgtactttcctgagtaaacgacgtttgagggcgttttgatggaaagcagctggtcatactctgaagtctacttgtttaaatactcttttaaaacccc

SEQ ID NO: 1775 - DNA, 665 bp, Hordeum vulgare
taccaacaccgcgcaacagagcaccaaacccttttcccctctacttctacccctcctcctcccctctccccacccaggcccctgtcgcagaagcacacgcgcagacagattggaaccggagaggagagctcgatctgatagcagaagctttcggcggaatggcggaggagaaggggacgctgcaggcgatgaggggctgggtcgtggaccataagctccgggccgtagggacgctgtggctcacggggatcgcgggatcgattgcgtacaactggtccaggcccggcatgaagaccagcgtcaagctcatccacgccaggcttcatgctcaggcccttacgctggctgccttgggttgttccgcgctggtggagtactatgatcaccagtcaggttcatggtcaaaagttcatgactatgcaaagcagttccttccatcggagagaaacgccaaaaaggactctgtgtagaagaggcagcaaattataatataggcttccattagctgatatggaatttgttgatgttattttctgagcaaacaatctggcatttcacatgccgttatccaagttctgcaggcttcctgttctctgtataagctactgaaccagcattttgatgcagccgtatgcaaatctgtggtagtggaaaaaaaaaaaaaa

SEQ ID NO: 1776 - DNA, 823 bp, Hordeum vulgare
caacagagcaccaaacccttttcccctctacttctacccctcctcctcccctctccccacccaggcccctgtcgcagaagcacacgcgcagacagattggaaccggaggactcgatctgatagcacaagctttcgtttcttttctcggcggaatggcggaggagaaggggacgctgcaggcgatgcggggctgggtcgtggaccacaagctgcgggccgtagggacgctgtggctcacggggatcgcgggatccattgcgtacaactggtccaggcccggcatgaagaccagcgtcaagctcatccacgccaggcttcatgctcaagcccttaccctggctgccctgggttgttccgcgctggtggagtactatgatcaccagtcaggttcagggtcaaaagttcatgactatgcaaagcagttccttccatcggagagaaacgccaaaaaggactctgtgtagaagaggcagcaaattataggcttccattagctgatatggaatttgttgatgttattttctgagcaaacaatctggcatttcacatgcctatccaagttctgcaggcttcctgttctctgtataagctactgaaccagcattttgatgcagccgtatgcaaatctgtgctcgtggaaatatgtattttcctgaaccacccatgaatgtagtgttgaaatgtttccctcctgcgactgatgaagtaaactaccaagaaagtttcatattatgtgctcctctgctcaagagaaaaaactttatggagtgtttatttctaaaacgtgacggtaaacatgatgcgtgttgtgcttatctctttt

SEQ ID NO: 1777 - DNA, 933 bp, Hordeum vulgare
cggcacgaggacggcatccagccccgctcccggttccgccacgacgacgcccaaaaccaggagccacgttggtggcggcgcagcctccgcctccaccggccatcgcggaccgcggtatcgtgccggcagtagactcgtttccccccaccaacagagccccaaacccttttcccctctacttctactcctccccctcccatcccccgtcgcagaagcacacgcgcagacagattggaaccggaggactcgatctgatagcacaagctttcgtttcttttctcggcggaatggcggaggagaaggggacgctgcaggcgatgcggggctgggtcgtggaccacaagctgcgggccgtagggacgctgtggctcacggggatcgcgggatccattgcgtacaactggtccaggcccggcatgaagaccagcgtcaagctcatccacgccaggcttcatgctcaagcccttaccctggctgccctgggttgttccgcgctggtggagtactatgatcaccagtcaggttcagggtcaaaagttcatgactatgcaaagcagttccttccatcggagagaaacgccaaaaaggactctgtgtagaagaggcagcaaattataggcttccattagctgatatggaatttgttgatgttattttctgagcaaacaatctggcatttcacatgcctatccaagttctgcaggcttcctgttctctgtataagctactgaaccagcattttgatgcagccgtatgcaaatctgtgctcgtggaaatatgtattttcctgaaccacccatgaatgtagtgttgaaatgtttccctcctgcgactgatgaagtaaactaccaagaaagtttcatattatgtgctcctgagttggtgtgcagaagcttctgctcaagacaaaaaacttatggagtgtgtatttct

SEQ ID NO: 1778 - DNA, 689 bp, Saccharum officinarum
cgactccgaagagcgacgcaggaggcggcggttgaggagaagatccatccaagtcgacaaagatggcttccgcgtacgcctcgtggtccaagaggtggatccgccccgaggtgtacccgctgttcgtgccgatggcggcggcgctgggcatctgctcgtaccagctggtgcgcaacatcacgggcaacccggaggtgcgggtgaccaaggagaagcgggcggcgggcgtgctggacaaccacgacgagggggagaggtacgccatgcacggcctccgcaagttcgtccgcgggaagaagcccgagatcatggcctccatcaactccttcttcgccgaccctcccaaggacgactaggcggctgatccgaggcccacccatcgagggacgggcgggcagggttttatttctcttgcatggggatctatcattcgttaccgggcggcggcggccttgattccctagccgtcggggcatttttgtttggcttctgaattcccccggccgtataaatgaaagaacatgcttttgttgggggcttggcttgggctgcgaaccaccccaaaaaaaaaaaaaagacctaccccaacccggtagggggtcttaatatattgaggggtggggggctgcgtaaaagggacataggtattctctttgcttgtgtttgaagaggattatattatttttacc

SEQ ID NO: 1779 - DNA, 590 bp, Sorghum bicolor
cttccactctgactgacgactctgaaccgcgacgcgagacgagagagaggcgcatacaggcgcaggcggcggctgaggatcgtcggagaagacccatcgaagacgacgaagatggcctccgcgtacgcgtcgtggtccaagaggtggatccgccccgaggtgtacccgctgttcgtgccgatggcggcggcgctgggaatctgctcgtaccagctggtgcgcaacatcacgggcaacccggaggtgcgggtgaccaaggagaagcgggcggcgggcgtgctggacaaccacgacgaaggggagaagtacgccatgcacggcctccgcaagttcgtccgcgggaagaagcccgagatcatggcatccatcaactccttcttcgccgacccgcccaaggacggctagctaggcggatccatccatcggcatgcacatccagattttcggatttttatatattttctcatgagatttatcattcattaccaccggcgacggcggcggcggccttgaatccctagtcgtcggtagatttttgttctgtattctaatttcgatccctatatatataattaaatggaagaacattc

SEQ ID NO: 1780 - DNA, 932 bp, Sorghum bicolor
gtccagccccgccacccaaaacgactcgactcgcctcgcctccgactcttttctttctttcgagttggagttggagcccacctaccgagagagttcacacgaagcaggcacggctcccgccgtctccgcctatataagacgcaacggagcccagcccccgccgtccttccactctgactgacgactctgaaccgcgacgcgagacgagagagaggcgcatacaggcgcaggcggcggctgaggatcgtcggagaagacccatcgaagacgacgaagatggcctccgcgtacgcgtcgtggtccaagaggtggatccgccccgaggtgtacccgctgttcgtgccgatggcggcggcgctgggaatctgctcgtaccagctggtgcgcaacatcacgggcaacccggaggtgcgggtgaccaaggagaagcgggcggcgggcgtgctggacaaccacgacgaaggggagaagtacgccatgcacggcctccgcaagttcgtccgcgggaagaagcccgagatcatggcctccatcaactccttcttcgccgacccgcccaaggacggctagctaggcggatccatccatcggcatgcacatccagattttcggatttttatatattttctcatgagatttatcattcattaccaccggcgacggcggcggcggccttgaatccctagtcgtcggtagatttttgttctgtattctaatttcgatccctatatatataattaaatggaagaacattcatttgtgtgtttgttgtgtgctcttggtggctgcggctgcaaaaacaaattaagagactgcaggctgaggcctaggtccgatgattttcatcacaatatactttcccaaccacaataactttggtattgttgtgcctagcaatgttttttcttataataataataaattagcggcga

SEQ ID NO: 1781 - DNA, 1881 bp, Sorghum bicolor
ctcttctccctcggcttcgagggggagggttatttttatttatttctttctttccttttttttcttttctattttctttcttttttttttctttttgggtttttttccttcgtcctcccgttggggttttgcgccccgacgaaccctaataatcgccggggaccgaccggcggccgatcgccgcgcctcgcccgcccgccagcccgccggcatgcacccgcagcggatgaagcaggccgcggcgcagcagcagctgatgcagcaggccctgctcctgcagcagcagcaggcgcagcagccgcccttgttcccggggcaccaccacccgcaccccggcctcctcgccgcgccacagatggagccaatagttagtggaaacctgcctcctgggtttgattcgagtacatgccgcagcgtgtatgttggcaatatcagtcttcaagtgacggacacagtactgcaggaagtcttccaaagtattggtccagtagaagggtgcaaactcatcaggaaagaaaagtcatcctttggtttcattgactactatgaccgcagatatgctgcactagcaattttatctctcaatggcagaccactgtatggtcagccaataaaagttaattgggcatatacaagtactcagagggaggatacatcaggtcattttaatatttttgttggggatctttgcccagaagtcactgatgctactttgtttgcatttttctctggatactctacctgctcagatgctagggttatgtgggaccagaaaacaggacgatccagagggtttggttttgtttctttcaggaaccagcaggatgctcaaagtgcgataaatgacttgaatgggaagtggcttggcaaccgtcaaattcgttgcaattgggcaacgaaaggtgccaatgctggtgaagagaaacagattgtggactccaaggttgacctgacaaatggcacatcagaatctggaaaagagaatccaaatgaagatggtcctgaaagtaaccctcagtttactactgtctatgttggcaatcttcctcacgaggctaccaacaatgatgtgcacctgtttttccattcacttggggctggctcaattgaggaagtccgtgtaactcgtgataaaggctttggttttgtaaggtacagcacccatgaggaggctgcgcaggcaattcagatggctaatggccaacttattggcgggaggcagataaagtgttcctggggaagcaaaccgactccaccagggacagcatcctcgcctctgcctcctccagcaccggcactgttctccactggagtgtcgccgacagacttcctggcataccagcgcatggccctgaacaagatggccacgaacccatccctaatgggtcagcacgccttgaatcaggtcgcactggggatgggtggccgagccagccagtccatctatgatggcggcttccagggcatcagtactgccgccgccacaacctccgcccagcaacaacagcagcagcagcagcagctcatgtactactagagtactactactccatgaggcaccagctacctatctcttaaagaggaaggcgaggatgaatggatgatgccccttgctacacccttatacatatagtagatgatgtactaccaggaccttttttataatcttttaagacccatctaagtaacatgtcctctctatgctagctatatatatctatatacaccctataacgtatgtatttctggatacatgaacaccccaaggttcttagtataatcttctgtgtttgaccatcttttattgtgccgtatggatttttattgccgattactgtatatatacgttactagacttgatggcaagcgtcatgttctcgt

SEQ ID NO: 1782 - DNA, 2056 bp, Sorghum bicolor
ctctggggtcagagggtacggttagagatatcgacaatctcagggactgaaacgaaaactcctcacgcccatggaaatatcccgccgcggccccggctccaccccctgcgctgcgctctgcttcttcttctcttctcttctccctcggcttcgagggggagggttatttttatttatttctttctttccttttttttcttttctattttctttcttttttttttctttttgggtttttttccttcgtcctcccgttggggttttgcgccccgacgaaccctaataatcgccggggaccgaccggcggccgatcgccgcgcctcgcccgcccgccagcccgccggcatgcacccgcagcggatgaagcaggccgcggcgcagcagcagctgatgcagcaggccctgctcctgcagcagcagcaggcgcagcagccgcccttgttcccggggcaccaccacccgcaccccggcctcctcgccgcgccacagatggagccaatagttagtggaaacctgcctcctgggtttgattcgagtacatgccgcagcgtgtatgttggcaatatcagtcttcaagtgacggacacagtactgcaggaagtcttccaaagtattggtccagtagaagggtgcaaactcatcaggaaagaaaagtcatcctttggtttcattgactactatgaccgcagatatgctgcactagcaattttatctctcaatggcagaccactgtatggtcagccaataaaagttaattgggcatatacaagtactcagagggaggatacatcaggtcattttaatatttttgttggggatctttgcccagaagtcactgatgctactttgtttgcatttttctctggatactctacctgctcagatgctagggttatgtgggaccagaaaacaggacgatccagagggtttggttttgtttctttcaggaaccagcaggatgctcaaagtgcgataaatgacttgaatgggaagtggcttggcaaccgtcaaattcgttgcaattgggcaacgaaaggtgccaatgctggtgaagagaaacagattgtggactccaaggttgacctgacaaatggcacatcagaatctggaaaagagaatccaaatgaagatggtcctgaaagtaaccctcagtttactactgtctatgttggcaatcttcctcacgaggctaccaacaatgatgtgcacctgtttttccattcacttggggctggctcaattgaggaagtccgtgtaactcgtgataaaggctttggttttgtaaggtacagcacccatgaggaggctgcgcaggcaattcagatggctaatggccaacttattggcgggaggcagataaagtgttcctggggaagcaaaccgactccaccagggacagcatcctcgcctctgcctcctccagcaccggcactgttctccactggagtgtcgccgacagacttcctggcataccagcgcatggccctgaacaagatggccacgaacccatccctaatgggtcagcacgccttgaatcaggtcgcactggggatgggtggccgagccagccagtccatctatgatggcggcttccagggcatcagtactgccgccgccacaacctccgcccagcaacaacagcagcagcagcagcagctcatgtactactagagtactactactccatgaggcaccagctacctatctcttaaagaggaaggcgaggatgaatggatgatgccccttgctacacccttatacatatagtagatgatgtactaccaggaccttttttataatcttttaagacccatctaagtaacatgtcctctctatgctagctatatatatctatatacaccctataacgtatgtatttctggatacatgaacaccccaaggttcttagtataatcttctgtgtttgaccatcttttattgtgccgtatggatttttattgccgattactgtatatatacgttactagacttgatggcaagcgtcatgttctcgtaactactcactctgttcaaactataaggctctcattttcta

SEQ ID NO: 1783 - DNA, 1905 bp, Triticum aestivum
gcacggaggcggcttcgagtttttttcttcccttttttccatttcgatattccttcttcgtcgagtttgggttggattaatccccgacccaaaccctaataatcgatctccctgacccgggactacgggccggggatcgatcgccatgcagcagaggatgaagcaggcggcggcggtagcggcgcagcagcagcagcagatgatgcagcaggcgctgctcatgcaccaccaccagcagcagcagcaggcggcggccgcggtgccgcccatgttcccgccgcaccacgcgcacccgggtctccttgccgcgccgcatatagagcccatcgttagtgggaacctgcctcctgggtttgattcaagcacatgccgcagtgtgtatgttggcaacatccatcttcaagtcacagattcactactgcatgaagttttccagagtattggtccagttgaagggtgtaagctcatcaggaaagaaaagtcatcttttggttttgttgactattatgaccgtagatatgctgcacttgctattgtgtcactcaacggtagacaactgtttggccagccaataaaagtcaattgggcatacgcaagtacccagagagaggatacatcaggtcattttaacatcttcgtcggggatctttgcccggaggttacggatgctgctttgtttgcttttttctcggcatattctacctgttcagatgctagagttatgtgggatcagcagactggacgatccagagggtttggtttcgtttcttttaggaatcagcaggatgcacaaactgccataaatgaattgaatggaaagtggcttggcaaccgccaaattcgttgcaattgggcaacgaagggcgctaatgctggtgaagagaagcaaagtacagactccaagggtgtggtggagttgataaacggctcatcagagcctggcaaggagaatgcaaatgaagatggtcctgaaaataacccacagtatacaactgtttatgttggcaatcttccccatgatatcaacagcaatgatgtgcatcgatttttccatttactcggggctgggtcaattgaggaggtccgtgtaacacgcgataaaggatttggctttgtgagatatagtacccatgaagaagctgcacaagcaatacagacgggtaatggccaacttattggcgggaggcagatcaagtgctcttggggaagcaaaccaactccaccagggacagcatctgcgcctctgcctcctccggcattagcgccatacacccctggcgtgtcagcagttgacctcatctcctacgagcgatcccttgctctgagcaagatggctgccaacccggccctgatgggtcagcacgccgccctgaggcaggccgcgatgggtatgggcgccggcgccagccaggccatctttgacgggggcttccagagtgtcaaccctcagcagcagcagcagcagctcatgtactactgagtgtatgaagcaagtatgctggcgacggaggggactacaacaccctccttcctaatatatatacatatatggtagatgaagcctcaccagggccttttcttttgttattactagtccaacatcgcaattagtaatttactatccttcgccgctgttaacgctccgggtcgccggctatatatagcaccaatgtactagaacatatgtatccctgacgtgttaagagttgggcaattcttatttttaataactactcccatcgatccaaaataattgtcgcagttttgaactaaggttagttcaaccttaattcaatactgcaacacttattatggatagagctaaccttaattcaaaactgtgacgcttattttggattgaagggagtagcatatatgaccatgtgttgcaacaggagaaaagaa

SEQ ID NO: 1784 - DNA, 1866 bp, Triticum aestivum
gcacggaggcggcttcgagtttttttcttcccttttctccatttcgatttccttcttcgtcgagtttggattggattaatccccgacccaaaccctaataatcgatctccctgacccgggactacgggccggggatcgatcgccatgcagcagaggatgaagcaggcggcggcggtagcggcgcagcagcagcagcagatgatgcagcaggcgctgctcatgcaccaccaccagcagcagcagcaggcggcggccgcggtgccgcccatgttcccgccgcaccacgcgcacccgggtctccttgccgcgccgcatatagagcccatcgttagtgggaacctgcctcctgggtttgattcaagcacatgccgcagtgtgtatgttggcaacatccatcttcaagtcacagattcactactgcatgaagttttccagagtattggtccagttgaagggtgtaagctcatcaggaaagaaaagtcatcttttggttttgttgactattatgaccgtagatatgctgcacttgctattgtgtcactcaacggtagacaactgtttggccagccaataaaagtcaattgggcatacgcaagtacccagagagaggatacatcaggtcattttaacatcttcgtcggggatctttgcccggaggttacggatgctgctttgtttgcttttttctcggcatattctacctgttcagatgctagagttatgtgggatcagcagactggacgatccagaggttttggtttcgtttcttttaggaatcagcaggatgcacaaactgccataaatgaattgaatggaaagtggcttggcaaccgccaaattcgttgcaattgggcaacgaagggcgctaatgctggtgaagagaagcaaagtacagactccaagggtgtggtggagttgataaacggctcatcagagcctggcaaggagaatgcaaatgaagatggtcctgaaaataacccacagtatacaactgtttatgttggcaatcttccccatgatatcaacagcaatgatgtgcatcgatttttccatttactcggggctgggtcaattgaggaggtccgtgtaacacgcgataaaggatttggctttgtgagatatagtacccatgaagaagctgcacaagcaatacagacgggtaatggccaatttattggcgggaggcagatcaagtgctcttggggaagcaaaccaactccaccagggacagcatctgcgcctctgcctcctccggcattagcgccatacacccctggcgtgtcagcagttgacctcatctcctacgagcgatcccttgctctgagcaagatggctgccaacccggccctgatgggtcaggtcgccgccctgaggcaggccgcgatgggtatgggcaccggcgccagccaggccatctttgacgggagcttccagagtgtcaaccctcagcagcagcagcagcagcaacagcagcagcagctcatgtactactgagtgtatgaagcaagtatgctggcgacggaggggactacaacaccctccttcctaatatatatacatatatggtagatgaagcctcaccagggccttttcttttgttattactagtccaacatcgcaattagtaatttactatccttcgccgctgttaacgctccgggtcgccggctatatatagcaccaatgtactagaacatatgtatccctgacgtgttaagagttgggcaattcttatttttaataactactcccatcgatccaaaataattgtcgcagttttgaactaaggttagtttaaccttaattcaaaactgcaacacttattatggatagaactaaccttaattcaaaactgtgacttatttt

SEQ ID NO: 1785 - DNA, 1652 bp, Hordeum vulgare
tttttttacacttagatttccttcttcatctgggttggattaatccctgaccgaaagcctaataaatcgatccccctgacccgacggcccggggatcgatcgccatgcaacagaggatgaagcaggcggcggcgggagcggcacagcagcagcagcagatgatgcagcaggcgttgcaccagcagcagcagcaggcggccgccgcggtgccccccatgttcccgccgcaccacgcgcacccgggtctcctcgccgcgccgcatatagagcccatcgttagtgggaacctgcctcctgggtttgattcaagcacatgccgcagtgtgtatgttggcaacatccatcttcaagtcacagattcactactgcatgaagttttccagagtattggtccagttgaagggtgtaagctcatcaggaaagaaaagtcatcttttggttttgttgactattatgatcgtagatatgctgcacttgctattgtgtcactcaatggtagacaactgtttggccagccaataaaagtcaactgggcatatgcaagtacccagagagaggatacatcaggtcactttaacatcttcgtcggggatctttgccctgaggttacagatgctgctttgtttgtttttttctcggcatattctacctgttcagatgctagagttatgtgggatcagcagtctggacgatccagagggtttggttttgtttcttttaggaatcagcaggatgcacaaactgccataaatgaattgaatggaaagtggcttggcaaccgccaaattcgttgcaattgggcaacaaagggcgctaatgctggtgaagtgaagcaaagtacagactccaagggtatggtggagttgataagcggctcatcagaggctggcaaggagaatgcaaatgaagatggtcctgaagataacccacaatatacaactgtttatgttggcaatctttcccatgatatcgacagcaatgatgtgcatcgattttttcatttacttggggctgggtcaattgaggaggtccgtgtaacacgtgataaaggatttggctttgtgagatatagtacccatgaagaagctgcacaagcaatacagacgggtaatggccaacttattggtgggaggcagatcaagtgctcttggggaagcaaaccaactccaccagggacagcatctgcacctcttccccctccggcatcagcgccatacacccctggcgtgtcggcagctgacctcatctcctacgagcgatcccttgctctgagcaaaatggctgccaacccggccctgatgggtcagcacgccgccctgaggcaggctgctatgggcgccggcgccagccaggccatctatgacgggggcttccagagtgtcaaccctcagcagcagcagctcatgtactattgagtgacgagactgtatgaagcaagtatgctggcgacgaaggggactacaacaccttcctccttcctaattctgaatttctaatctatacctaatattaaagggaggattgtttctccatgttttttcgtgcatcaggcctttttcatatgttgccttctatttcacgttcgtcaggtcgtccttactacgattcttgttgatggcactaaagaaactaacgatggatagtgtccaaat

SEQ ID NO: 1786 - DNA, 2207 bp, Oryza sativa
aaaatttctatgaatttcgtttcaatcaacgatgtgaattgtaggtaacacagggggtttgatgtaaaaaacgtgttctcgtccatgaaaaatatccccttcttctccggctcgcccacctcctcactccgccatccgcctcacgccgcgcctccgccctcttcctcccccctcggcttcgagggtttttttttttcttcttcttttttctttttttcttcttctccttttttgtttctcgtttcttttttttttcggtttcgggggagttggattcttgattccttcctccccctgaggccaaaccctaataataatctgatccctgacacgagagcggaggcggaggaggaggtgggggatcgatcgatcgcgatcgatcgattgagtgattggttgattgatcgacatgcagcatcagcagcggatgaagcaggcggcggcggcggcgcagcagcagcagatgatgcagcaggcgctgctcatgcagcagcagcaggctgcggcggtggcggcggcggcgcagcagcagcaggcgcccttgttccccccgcaccacccgcacccgggcctcctcgcggcgccgcagatagagcccattgttagtggcaacctgcctcctggatttgattcaagtacatgccggagtgtgtatgttggcaatatccatcttcaagtgacggattcactgctacatgaggtcttccaaagtattggtccagtagaaggatgcaagctcatcaggaaggaaaagtcatcctttggttttgttgactattatgaccgtagatctgctgcaattgcaattgtatcactcaacggtagacaattgtttggccagccaataaaagtcaattgggcatatgcaagtactcaaagagaggatacatcaggccattttaatatttttgttggcgatctttgcccggaagtaacagatgctgctttgtttgcttttttcgctggatttaccagttgctcagatgctagggtaatgtgggatcagaaaactggacgatccagaggttttggttttgtttctttcagaaatcagcaggacgcacaaaatgccataaatgaactgaatgggaagtggctcggcaaccgtcaagttcgttgcaattgggcaacaaagggtgctaatgctggtgaagagaaacaaaatacagactccaagggtatgatagagttgacaaatggttcatcagaaggtggaaaggataatgcaaatgaagatggtcctgaaaacaacccacagtacacgactgtttatgttggcaatcttcctcatgatgtcaacagcaatgatgtgcacagatttttccattcacttggggttggttcaattgaggaggtgcgtgtaacgcgtgataaaggttttggctttgtgcgttacagcacccatgaagaagctgctctagcaattcagactggtaatggacaacttattggcggtaggcagatcaagtgttcctggggaagcaagccaactccaccagggacagcatccgcgcccctaccccctccagcaccagcaccattcaatcctggcatgtcggcgaccgacctcctagcctacgagcgcaccctggcgctgagcaagatggcagcgaacccggccctgatgagtcagcacgccgccctaaagcaggctgccgccatggggatgggcgccggagccagccaggccatctacgacggcggctaccagagtgccaacgccgtcttctactagagtgacctgagtacctgaccccccatgaagcagaccaccaccattgcctgcctgcctctgtatgaccaaggaggatgatgatgacccctccacccccttatacatatagtagatgaagccttacctgaacctctccttttctacctttgttatttgccaatctagtaatcttctcttcgctggatgctggctatatatatatatctagaacatatatataatgtttttctgcatttttagagatatggaaacgacctttggtatttggatggttccctctgttactatcatcgtatcatgtcggtgtcatattgtattgctctatgcgcattttttttttaattttaccttgctctcaattaacgatatctgtatgtataattttcttttcatgccaagaaactgtctactctaccgaaactgtataatacatttccttaaaagagaaaagtgaaatcgagttccagtctct

SEQ ID NO: 1787 - DNA, 2077 bp, Oryza sativa
gccatccgcctcacgccgcgcctccgccctcttcctcccccctcggcttcgagggtttttttttttcttcttcttttttctttttttcttcttctccttttttgtttctcgtttcttttttttttcggtttcgggggagttggattcttgattccttcctccccctgaggccaaaccctaataataatctgatccctgacacgagagcggaggcggaggaggaggtgggggatcgatcgatcgcgatcgatcgattgagtgattggttgattgatcgacatgcagcatcagcagcggatgaagcaggcggcggcggcggcgcagcagcagcagatgatgcagcaggcgctgctcatgcagcagcagcaggctgcggcggtggcggcggcggcgcagcagcagcaggcgcccttgttccccccgcaccacccgcacccgggcctcctcgcggcgccgcagatagagcccattgttagtggcaacctgcctcctggatttgattcaagtacatgccggagtgtgtatgttggcaatatccatcttcaagtgacggattcactgctacatgaggtcttccaaagtattggtccagtagaaggatgcaagctcatcaggaaggaaaagtcatcctttggttttgttgactattatgaccgtagatctgctgcaattgcaattgtatcactcaacggtagacaattgtttggccagccaataaaagtcaattgggcatatgcaagtactcaaagagaggatacatcaggccattttaatatttttgttggcgatctttgcccggaagtaacagatgctgctttgtttgcttttttcgctggatttaccagttgctcagatgctagggtaatgtgggatcagaaaactggacgatccagaggttttggttttgtttctttcagaaatcagcaggacgcacaaaatgccataaatgaactgaatgggaagtggctcggcaaccgtcaagttcgttgcaattgggcaacaaagggtgctaatgctggtgaagagaaacaaaatacagactccaagggtatgatagagttgacaaatggttcatcagaaggtggaaaggataatgcaaatgaagatggtcctgaaaacaacccacagtacacgactgtttatgttggcaatcttcctcatgatgtcaacagcaatgatgtgcacagatttttccattcacttggggttggttcaattgaggaggtgcgtgtaacgcgtgataaaggttttggctttgtgcgttacagcacccatgaagaagctgctctagcaattcagactggtaatggacaacttattggcggtaggcagatcaagtgttcctggggaagcaagccaactccaccagggacagcatccgcgcccctaccccctccagcaccagcaccattcaatcctggcatgtcggcgaccgacctcctagcctacgagcgcaccctggcgctgagcaagatggcagcgaacccggccctgatgagtcagcacgccgccctaaagcaggctgccgccatggggatgggcgccggagccagccaggccatctacgacggcggctaccagagtgccaacgccgtcttctactagagtgacctgagtacctgaccccccatgaagcagaccaccaccattgcctgcctgcctctgtatgaccaaggaggatgatgatgacccctccacccccttatacatatagtagatgaagccttacctgaacctctccttttctacctttgttatttgccaatctagtaatcttctcttcgctggatgctggctatatatatatatctagaacatatatataatgtttttctgcatttttagagatatggaaacgacctttggtatttggatggttccctctgttactatcatcgtatcatgtcggtgtcatattgtattgctctatgcgcattttttttttaattttaccttgctctcaattaacgatatctgtatgtataattttcttttcatgccaagaaactgtctactctaccgaaactgtataatacatttccttaaaagagaaaagtgaaatcgagttccagtctct

SEQ ID NO: 1788 - DNA, 1993 bp, Setaria italica
caacatgtctgccgctgccgcggccgcgtcatacacacacgccattcggagctcgcatccgaacgcgagcaagcagaccaaatcgccctccgtattctatcgcccgcaccgcatctggccgcctcggcacccggcggcggcggcggcgatggggctggagatggaggcgatggcggcgtcgattggcgtctcggtgcccgtgctccgcttcctgctctgcttcgcggccaccatcccgacgggcctcctgtggcgcgcggtgcccggcgccacggggcgacacctctacgcggggctcacgggcgccgcgctctcctacctctccttcggggccacgtccaacctcctcttcgtcgtgcccatggcgctcggctacctcgccatgctcctcttccgccgccacgccgggctcatcaccttcctcggcgccttcggcttcctcatcgcatgtcatgtgtactacatgagtggagatgcatggaaggagggaggcattgatgcaactggtgctttaatggttttgacgctgaaagtcatttcctgcgcaataaactacagtgatggcatcttgaaggaagagggtttgcgtgatgctcagaaaaagtaccgattgactaagcttccttctctaattgaatattttggttactgcctctgctgtgggagccactttgctggaccggtgtacgagatgaaagattatcttgattggactgaaaggaaaggaatatgggctagcccaactccttcacccttgttacctactttgcgtgctctagttcaggctggtatatgcatggggttatatttatacctgtcacctaaatttccactctcacggtttagtgagcccctttattatgaatggggtttctggcaccggctcttctatcagtacatgtcaggctttactgctcgttggaaatattactttatatggtcaatttcagaagctgcaattattatatctggtctgggctttactggttggtcagagtcttctcccccaaaagccaaatgggatcgtgcaaagaatgttgatgtattaggtgttgaattagctggaagtgcagttcaattgccccttgtgtggaatattcaagtgagcacatggctacgatactatgtctatgagaggctgattcagaaaggaaagaaacctggtttccttcagttgttgggtacacagacagtcagcgccgtctggcatggactgtatcctgggtatatcatattctttgttcaatcggcattgatgataaatggttcacgagttatatacagatggcaacaaacagtgaacaattcagttttccgcggtatcctggcttttctgaattttgcatatacattgctggtgcttaactactcgtgcattgggttccaggtactgagcttcaaggaaacgttggcatcctaccagagcgtgtattatgttggcacaattgttcccattgtatgtgtcctgctgggcaatgttatcaaaccagcaaggaagccgaaggctcagaaggccgagtgaggaatatatactcgggtgatcgttacacagaagaaagatgggagagagcttcaacgacgataacacagctagttttcagattatgtattctccttttgaaccatatcaaagttagcacaaggatagtgtggtgcccccagttctcatatttcggaactccatcgcaattgaccgtcattaaaacgtgtcactcccgtcgggtttttcttccacataatgacttcatgttgcaaagcatttttggcttgtcgagccttctactcttttgttctcatctgcctgttgatgaatgtctttgggacgcctttccacctggagcctgatggaggtgtgaatgcgcttgttgctcgcacctcacatcccatcgtgttagttgttagtttgttacctactgagctcctagaactgagcatccgtgttttgactcggcctttttttttctctccactgctcactttgaatgcagttttg

SEQ ID NO: 1789 - DNA, 1657 bp, Pennisetum glaucum
ccaaatcgccctccgtattctatcgcccgcaccgcatctggccgcctcggcacccggcggcggcgacgatggggctggagatggaggcgatggcggcgtcgattggcgtgtcggtgcccgtgctccgcttcctgctctgcttcgcggccaccatcccgacgggcctcctgtggcgcgcggtgcccggcgccacggggcggcacctctacgcggggctcacgggcgccgcgctctcctacctctccttcggggccacgtccaacctcctcttcgtcgtgcccatggcgctcggctacctcgccatgctcctcttccgccgccacgccgggctcatcaccttcctcggcgccttcggcttcctcatcgcatgtcatgtgtactacatgagtggagatgcttggaaggagggaggcattgatgcaactggtgctttaatggttttgacgctgaaagtcatttcctgcgcaataaactacagtgatggcatattgaaggaagagggtttgcgtgacgctcagaaaaagtaccgattgactaagcttccttctctaattgaatattttggttactgcctctgctgtgggagccactttgctggaccggtgtacgagatgaaagattatcttgattggactgaaaggaaaggaatatgggctagcgcaactccttcacccctgttacctactttgcgtgctctagttcaggctggtatatgcatggggttatatttgtacctgtcacctaaatttccactctcacggtttagtgagcccctttattatgaatggggtttctggcaccggctcttctatcagtacatgtcaggctttactgctcgttggaaatattactttatatggtcaatttcagaagctgcaattattatatctggtctgggctttactggttggtcagagtcttctcccccaaaagccaaatgggatcgtgcaaagaatgttgatgtattaggtgttgaattaactggaagtgcagttcaattgccccttgtgtggaatattcaagtgagcacatggctacgatactatgtctatgagaggctgattcagaaaggaaagaaacctggtttccttcagttgttgggtacacagacagtcagtgccgtctggcatggattgtatcctgggtatatcatattctttgttcaatcggcattgatgataaatggctcacgagttatatacagatggcaacaagcagtgaacaattcagtcttccgcagtatcctggcttttctgaattttgcgtatacattgctggtgcttaactactcgtgcattggattccaggtactgagcttcaaggaaacgttggcatcctaccagagcgtgtactatgttggcacaattgttcccattgcatgcttgctgctgggcaatgttatcaagccagcaaggaagcccaagactcagaaggctcagaaggccgagtgaataaaatatacccaggtgatcgttacacagaagaaagatggggagagcttcaacgacgataacacagctagttttcagattatttattctccttttgaaccgcatcaaagttagcacaaaggatagtttggtgaccccagcctctcatatttcggaactccattgcaattgaccaatcactaaaacgtcactcccgttgggttttt

SEQ ID NO: 1790 - DNA, 1695 bp, Brachypodium distachyon
aggaaaaaacaagaggcaccccatcgctcgggcgtcggggagggggacaaccaaatcttctctgttctgtatcgcccgcatctgttcgtctctcccggcggcggcggtggcggtggcggtggcgacgatggggctcgagatggagccgatggcggcggcgataggcgtgtcggtgcccgttctccggttcctcctctgcttcgcggccaccatcccgacgggtctcctctggcgggcggtgccaggagccacggggcggcacctctacgcggggctcagcggcgccgcgctctcctacctgtccttcggggccacctccaacctcctcttcgtcgtgcccatggcgctcggctacctcgctatgctcctctgccgtcgccacgccggcctcgtcaccttcctcggcgccttgggcttcctcatcgcatgccacgtgtattatatgagtggggatgcgtggaaggagggaggaatcgatgcaactggtgctttaatggttttaacattgaaagtcatttcatgcgcaataaactacagtgatggtcttttgaaggaagagggcctgcgtgatgctcagaaaaagtatcgcttggctaagcttccttctctagttgaatattttggttactgcctctgctgtggcagccactttgctggaccagtatatgagatgaaagattatcttgactggaccgaaaggaaaggaatatgggccggctcaactccttctccattgttacctactctgcgtgctctagttcaggcaggaatatgcatgagtttatatttgtatctgtcacctcggtttccactttctcgatttagtgagcccctatattatgagtggggtttctggcaccggctcttctttcagtacatgtcaggttttactgctcgttggaaatactactttatatggtcagtttcagaagcttcagttattatatccggtctgggcttcaccggttggtctgattcttctcccccaaaagccaaatgggagcgtgctataaatgttgatattctaggtgttgaattagctggaagtgcagttcaattgccacttaagtggaatattcaagtgagcacatggctgcgatactatgtgtacgagaggttaatccagaaaggaaagaagcctggtttccttcagttgcttggtacacagactgtcagtgctatctggcatggactgtatccaggatatatgatattctttgttcagtcggcattgatgataaatggttcccgagttatatacagatggcagcaagctgtgagcaactcagtactccacactatcctgactttactaaattttgcatacacgatgatggtgctcaactactcatgcattggcttccaggtactgagcttccaggaaacgttagcatcctacaagagcgtatattatgtcggtacaattgttcccattctatgtgtcctgctgggctatgttatcaagccagccaggcctgtgaagccgaaggctcggaaggctgaatgaggaacagagggaacacttgtcattaaataggggaaggatcaatgatgattatgaccagctagttttcagtttacttccatctttgtggaatgaaatgacatttagcaaaggataatttggtggctccatccaactcatacactttggagtcattgaccaatcattaaaacgtgtcattttcgttgggt

SEQ ID NO: 1791 - DNA, 1815 bp, Brachypodium distachyon
gcggctgccgagctcgcttcaggaaaaaacaagaggcaccccatcgctcgggcgtcggggagggggacaaccaaatcttctctgttctgtatcgcccgcatctgttcgtctctcccggcggcggcggtggcggtggcggtggcgacgatggggctcgagatggagccgatggcggcggcgataggcgtgtcggtgcccgttctccggttcctcctctgcttcgcggccaccatcccgacgggtctcctctggcgggcggtgccaggagccacggggcggcacctctacgcggggctcagcggcgccgcgctctcctacctgtccttcggggccacctccaacctcctcttcgtcgtgcccatggcgctcggctacctcgctatgctcctctgccgtcgccacgccggcctcgtcaccttcctcggcgccttgggcttcctcatcgcatgccacgtgtattatatgagtggggatgcgtggaaggagggaggaatcgatgcaactggtgctttaatggttttaacattgaaagtcatttcatgcgcaataaactacagtgatggtcttttgaaggaagagggcctgcgtgatgctcagaaaaagtatcgcttggctaagcttccttctctagttgaatattttggttactgcctctgctgtggcagccactttgctggaccagtatatgagatgaaagattatcttgactggaccgaaaggaaaggaatatgggccggctcaactccttctccattgttacctactctgcgtgctctagttcaggcaggaatatgcatgagtttatatttgtatctgtcacctcggtttccactttctcgatttagtgagcccctatattatgagtggggtttctggcaccggctcttctttcagtacatgtcaggttttactgctcgttggaaatactactttatatggtcagtttcagaagcttcagttattatatccggtctgggcttcaccggttggtctgattcttctcccccaaaagccaaatgggagcgtgctataaatgttgatattctaggtgttgaattagctggaagtgcagttcaattgccacttaagtggaatattcaagtgagcacatggctgcgatactatgtgtacgagaggttaatccagaaaggaaagaagcctggtttccttcagttgcttggtacacagactgtcagtgctatctggcatggactgtatccaggatatatgatattctttgttcagtcggcattgatgataaatggttcccgagttatatacagatggcagcaagctgtgagcaactcagtactccacactatcctgactttactaaattttgcatacacgatgatggtgctcaactactcatgcattggcttccaggtactgagcttccaggaaacgttagcatcctacaagagcgtatattatgtcggtacaattgttcccattctatgtgtcctgctgggctatgttatcaagccagccaggcctgtgaagccgaaggctcggaaggctgaatgaggaacagagggaacacttgtcattaaataggggaaggatcaatgatgattatgaccagctagttttcagtttacttccatctttgtggaatgaaatgacatttagcaaaggataatttggtggctccatccaactcatacactttggagtcattgaccaatcattaaaacgtgtcattttcgttgggttcatcttacttttgtattaccactatatgcaacacatgatttttctgcccaagcagattattatttatttttatttgcaaagacgaagccttttgttatc

SEQ ID NO: 1792 - DNA, 1706 bp, Panicum virgatum
acacgccctccggagctcctcgcatccggacgcgagcaagcggaccaaatcgtcctctgctttctaccgcccgcaccgcatctggccgcctcgacgctcggcggcggcggcggcggcggcgatggggctggagatggaggagatggcggcgtcgattggcgtgtcggtgcccgtgctccgcttcctgctctgcttcgcggccaccatcccgacgggcctcctgtggcgcgcggtgcccggcgccacggggcggcacctctacgcggggctcacgggcgccgcgctctcctgcctctccttcggggccacgtccaacctcctcttcgtcgcgcccatggcgctcggctacctcgccatgctcctcttccgccgccacgccgggctcatcaccttcctcggcgccttcggcttcctcatcgcatgtcatgcgtactacatgagcggagatgcatggaaggaaggaggcattgatgcaactggtgctttaatggttttgacgctgaaagtcatttcatgcgcaataaactacagtgatggcatcttgaaggaagagggcttacgcgaggctcagaaaaagtaccgattgactaagcttccttctctaattgaatattttggttactgcctctgctgtgggagtcactttgctggaccggtgtatgagatgaaagattatcttgattggactgaaaggaaaggaatatgggctagctcaactccttcaccattgttacctactttgcgtgctattgttcaggctggtatatgcatggggttatatttgtacctctcgcctaaattcccactctcgtggtttagtgagcccctttattatgaatggggtttctggcaccggctcttctatcagtacatgtcaggctttactgctcgttggaaatattactttatatggtcaatttcagaagccgcaattattatatccggtctgggatttactggttggtcagagtcttctcccccaaaagccaagtgggatcgtgcaaaaaatgttgatgtattaggtgtcgaattagctggaagtgcagttcaattgccccttatgtggaatattcaagtgagcacatggttacgatactacgtctatgaaaggctaattcagaaaggaaagaaacctggttttcttcagttgttgggtacacagacagtcagtgccatctggcatggactgtatcctgggtacataatattctttgtccaatcagcattgatgataaatggttcacgagttatatatagatggcagcaagcagtgagcaattcagtcctccgcagtatcctggcttttctaaattttgcatatacattgttggtgcttaactactcgtgcattgggttccaggtactgagcttcaaggaaaccttggcatcttaccagagtgtatattatgttggcacgatttttcccattgtatgcctcctgctgggcaatgttatcaagccagcaaggaagccgaaggctcagaaggccgagtgaggaacatatactcgagtgatcgttacacagaaagatggagaagcttcaacgacgataacgacagcctagttttcagtttatttattctctcttttttgaaccgtaaaaatttagcacaaggatagtgtggtgaccgcagctggcatatatttcggaactccatcgcagttgaccaatcattaaaacgtggcacccccgtttggtttttttt

SEQ ID NO: 1793 - DNA, 1858 bp, Secale cereale
tcctgcacatcgcccgcatactgttcgtccccctctgcgcgcgtgcgtggcgacgatggggctcgagatggagccgatggcggcggcgatcggcgtctcggtgcccgtgctccgcttcctgctctgcttcgcggccaccatacccacgggcctcctctggcgcgccgtgccgagcgccgcggggcggcacctctacgcggggctcagcggcgccgcgctctcctacctctccttcggggccacctccaacctcctcttcgtcgggcccatggcgctcggttacctcgccatgctcctctgccgtcgccgagctggcctcgtcaccttcctcggcgcgttcggcttcctcattgcatgtcatgtctactacatgagtggggacgcatggaaggaggggggcatcgacgcaactggtgctttaatggttctaacgttgaaagtcatttcatgctcaatgaactacagtgatggtctcttgaacgaagaagagggtctacgtgatgctcagaagaagtatcgcttggctaagttgccttctctaatagaatattttggttactgcctctgctgtggcagccactttgctggaccagtatatgagatgaaagattatcttgaatggactgaaaggaaaggaatatgggccggctcaactccttcaccattattacctactttgcgtgctttagttcaggctggaatatgcatggggttatatttgtatctgtcacctatgtttccgctttcacgatttagtgaacctctatattatgaatggggtttctggcaccggctcttctttcaatacatgtcaggatttactgctcgttggaaatactactttatatggtcgatttcagaagctgcaattattatatctggcctgggtttcacgggttggtctgattcttctcccccaaaagccaaatgggaccgtgcaataaatgtcgatattttgggtgtcgaactagccggaagtgcagctcaattgccgcttaagtggaatattcaagtgagcacatggttacgatactatgtgtatgagaggttaattcagaaagggaagaagcctggtttccttcagttgttgggtacacagacagtcagtgctatctggcatggactgtatccaggatatatgatattctttgttcagtcggcattgatgataaatggttcaaaagttatatacagatggcaacaagctgtgggcaactcaggcctacgcactatcctgtctttagtaaattgtgggtacacaatgatggtgcttaactactcatgcattggcttccaggtactgagcttccaggagaccttggcatcctacaagagcgtgtattatgtcggcacaattgttcctattctgtgtgtcttgctgggctatgttatcaagcctgcgagacctgtgaagccgaaggctcgcaaggcagaatgaggaacagagcaaattggtctttacatagatgagttacgaagcttcaatgatgattatgacaagatagttttcagtttacttccatctttgtgaaacaataccagatttagcaaaaaagggtaatgtggtggctctaactcacaccttggagctccattgtaattgagcaatcattaaaaacctgttatttcgtgggattgatcgcccgtttgttttgtcacatgcaacacatgatttttggccctaagctgttattgtttatttatcatgtggttagttaaaaaaaaaaaaaaaaacaaaaaaaaaaaacaaaaaaaaaaacaaaaaaaaaacaaaaaaaacaaaaaaaacaaaaaacaaaaaacaaaacaaacaacacagacacatacacacacagacacatacccagataacgacatt

SEQ ID NO: 1794 - DNA, 1777 bp, Panicum virgatum
accatatacacacgccaccattcggagctcgcatccgaacgcgagcaagcggaccaaatcgtcctctgttttctatcgcccgcaccgcatctggccgcctcgacgctcggcggcggcggcggcggcgacgatggggccggagatggaggcgatggcggcgtcgattggcgtgtcggtgcccgtgctccgcttcctgctctgcttcgcggccaccatcccgacgggcctcctgtggcgcgcggtgcccggcgccacggggcggcacctctacgcggggctcaccggcgccgcgctctcctacctctccttcggggccacgtctaacctcctcttcgtcgcgcccatggcgctcggctacctcgccatgctcctctgccgccgccgcgccgggctcatcaccttcctcggcgccttcggcttcctcatcgcatgtcatgtgtactacatgagcggagatgcatggaaggaaggaggcattgacgcaactggtgctttaatggttttgacgctgaaagtcatttcgtgcgcaataaactacagtgatggcatcttgaaggaagagggtttacgtgagtctcagaaaaagtaccgattgactaagcttccttctcttattgaatattttggttactgcctctgctgggggagtcactttgctggaccggtgtatgagatgaaagattatcttgattggactgaaaggaaaggaatatgggctagctcaactccttcaccattgttacctactttgcgtgctatagttcaggctggtatatgcatggggttatatttatacctgtcgcctaaatttccactctcgcggtttagtgagcccctttattatgaatggggtttctggcaccggctcttctaccagtacatgtcaggctttaccgctcgttggaaatattattttatatggtcaatttcagaagctgcaattattatatctggtctgggatttactggttggtcagcgtcttctcccccaaaagccaagtgggatcgttcaaaaaatgttgatgtattaggtgtcgaactagctggaagtgcagttcagttgccccttgtgtggaatattcaagtgagcacatggctacgatactacgtctatgaaaggctaattcagaaaggaaagaaacctggtttccttcagttgttgggtacacagacagtcagtgccatctggcatggactgtaccctgggtatatcatattctttgtccaatcagcattgatgataaatggttcacgagttatatacagatggcagcaagcagtgagcaattcagtcctccgcagtatcctggcttttctaaattttgcttatacattgttggtgcttaactactcgtgcattgggttccaggtactgagcttcaaggaaaccttggcatcctaccagagtgtatattatgttggcacgattgttcccattgtatgcctcctgctgggcaacgttatcaagccagcaaggaagccgaaggctcagaaggccgagtgagtaacatatactggagtgatcgttacacagaaagatggagaagcttcaacgacgataacgacagcctagttttcagtttatttattctctctttttgaacctaccaaatttagcacaaggatagtgtggtgaccgcagctcgcatatatttcagaactccatcgcaattgaccaaccattaaaacgtgacactcccgtttcgtttttcttcaacttaatgactacatgttgtaaagcattttggctcgacgaaccttctaatcttttgttccc

SEQ ID NO: 1795 - DNA, 1660 bp, Triticum aestivum
cgcccgcatctgttcgcccccctctgcggcggcggtggcggtggcgacgatggggctcgagatggagccgatggcggcggcgatcggcgtctcggtgcccgtgctccgcttcctgctctgcttcgcggccaccatacccacgggcctcctctggcgcgccgtgccgagcgccacggggcggcacctctacgcggggctcagcggcgccgcgctctcctacctgtccttcggggccacctccaacctcctcttcgtcgggcccatggcgctcggttacctcgccatgctcctctgccgtcgccgagctggcctcgtcaccttcctcggcgcattcggcttcctcatcgcatgtcatgtctactacatgagtggggacgcgtggaaggagggaggcatcgacgcaactggtgctttgatggttttaacgttgaaagtcatttcatgctcaatgaactacagtgatggtctcttgaaggaagaagagggtctacgtgatgctcagaagaagtatcgcttggctaagttgccttctctagtcgaatattttggttactgcctctgctgtggcagccactttgctggaccagtatatgagatgaaagattatcttgaatggactgaaaggaaaggaatatgggccagctcaactccttcaccattattacctactctgcgtgctctagttcaggctggaatatgcatggggttatatttgtatctgtcacctatgtttccgctttcacgatttagtgaacctctatattatgaatggggtttctggcaccggctcttctttcaatacatgtcaggatttactgctcgttggaaatactactttatatggtcaatctcagaagctgcaattattatatctggcctgggtttcactggttggtctgattcttctcccccaaaagccaaatgggatcgtgctataaatgttgatattctgggcgtcgagctagctggaagtgcagctcaattgccacttaagtggaatattcaagtgagcacatggctaagatactatgtgtatgagaggttaattcagaaagggaagaagcctggtttccttcagttgttgggtacacagacagtcagtgctatctggcatggactgtatccaggatatatgtttttctttgttcagtcggcgttgatgataaatggttcaaaagttatatacagatggcaacaagctgtgagcaattcaggcctccgcactatcctgtctttactaaattgtgcatacaccatgatggtgcttaactactcatgcattggcttccaggtactgagcttccaggagaccttagcatcctacaagagcgtgtattatgtcggcacaatcgttcctattctatgcgtcttgctgggctatgtcatcaagcccgcgagacctgtgaagccgaaggctcgcaaggcagagtgaggaacagagcgaattgatctttacatagatgagttacgaagcttcaatgatgattatgtcaagatagttttcagtttacttccatctttgtgaaacaatatcaaatttagccaaaaggataatgtggtggctccattgtaattgaccaatcattagaaacctgttgtttcgtcgggctgatcacccatttgttttaccacacatgcaacacatgatttttggccctaa

SEQ ID NO: 1796 - DNA, 1825 bp, Triticum aestivum
cacacacacacatatacacgcggctcgcgagctcgcttcagaaaaaaccaaatcctctattcctgcatcgcccgcatctgttcgtccccctctgcggcggcggtggcggtggcgacgatggggctcgagatggagccgatggcggcggcgatcggcgtctcggtgcccgtgctccgcttcctgctctgcttcgcggccaccatacccacgggcctcctctggcgcgccgtgccgagcgccacggggcggcacctctacgcggggctcagcggcgccgcgctctcctacctgtccttcggggccacctccaacctcctcttcgtcgggcccatggcgctcggttacctcgccatgctcctctgccgtcgccgagctggcctcgtcaccttcctcggcgcattcggcttcctcatcgcatgtcatgtctactacatgagtggggacgcgtggaaggagggaggcatcgacgcaactggtgctttgatggttttaacgttgaaagtcatttcatgctcaatgaactacagtgatggtctcttgaaggaagaagagggtctacgtgatgctcagaagaagtatcgcttggctaagttgccttctctagtcgaatattttggttactgcctctgctgtggcagccactttgctggaccagtatatgagatgaaagattatcttgaatggactgaaaggaaaggaatatgggccagctcaactccttcaccattattacctactctgcgtgctctagttcaggctggaatatgcatggggttatatttgtatctgtcacctatgtttccgctttcacgatttagtgaacctctatattatgaatggggtttctggcaccggctcttctttcaatacatgtcaggatttactgctcgttggaaatactactttatatggtcagtctcagaagctgcaattattatatctggcctgggtttcactggttggtctgattcttctcccccaaaagccaaatgggatcgtgctataaatgttgatattctgggcgtcgagctagctggaagtgcagctcaattgccacttaagtggaatattcaagtgagcacatggctaagatactatgtgtatgagaggttaattcagaaagggaagaagcctggtttccttcagttgttgggtacacagacagtcagtgctatctggcatggactgtatccaggatatatgtttttctttgttcagtcggcgttgatgataaatggttcaaaagttatatacagatggcaacaagctgtgagcaattcaggcctccgcactatcctgtctttactaaattgtgcatacaccatgatggtgcttaactactcatgcattggcttccaggtactgagcttccaggagaccttagcatcctacaagagcgtgtattatgtcggcacaatcgttcctattctatgcgtcttgctgggctatgtcatcaagcccgcgagacctgtgaagccgaaggctcgcaaggcagaatgaggaacagagcgaattgatctttacatagatgagttacgaagcttcaatgatgattatgtcaagatagttttcagtttacttccatctttgtgaaacaatatcaaatttagcaaaaaggataatgtggtggctccattgtaattgaccaatcattaaaaacctgttgtttcgtcgggctgatcacccatttgttttaccacacatgcaacacatgatttttggccctaagctgtatgttattcatttaccttttctgcttggctctattcaaactgatgtatattttcgcaccttcccattggctctgtatggaggtgtgaacgct

SEQ ID NO: 1797 - DNA, 263 bp, Triticum aestivum
tctctatgcgaagcagtggtatcaacgcagagtgaggaacagagcgaattgatctttacatagatgagttacgaagcttcaatgatgattatgtcaagatagttttcagtttacttccatctttgtgaaacaatatcaaatttagccaaaaggataatgtggtggctccattgtaattgaccaatcattagaaacctgttgtttcgtcgggctgatcacccatttgttttaccacacatgcaacacatgatttttggccctaa

SEQ ID NO: 1798 - DNA, 1612 bp, Saccharum officinarum
atggggctggagatggaggcgatggcggcatcgatcggcgtgtcggtgcccgtgctccggttcctgctctgcttcgcggccaccatcccgacgggcctcctgtggcgcgcggtgcccggcgccacggggcgccacctctacgcggggctcacgggtgccgcgctctcctacatctccttcggggccacgtccaacctcctcttcgtcgtgcccatgacgctcggttacctcgccatgctcctgttccgccgccacgccgggctcatcaccttcctcggcgccttcggcttcctcatcgcatgtcatgtgtactacatgagcggggatgcatggaaggagggaggcattgatgcaactggcgctttaatggttttaacattgaaagtcatttcatgcgcaataaactacagtgatggtatcttgatggaagagggtttacgtgatgctcagaaaaaataccgattgactaagcttccttctctaattgaatattttgggtactgtctctgttgtgggagccattttgctggaccggtatatgagatgaaagattatcttgaatggactgaaaggaaaggaatatgggctagcccaactccttcgccattgttacctactttgcgtgctctagttcaggctggtatatgcatggggttatatttatacctgtcacctaaatttccactctcacggtttagtgagcccctatattatgaatggggtttctggcaccgactcttctatcagtacatgtcaggctttactgctcgttggaaatattactttatatggtcaatttcagaagcctcaattatcatatctggtctgggctttactgggtggtcggaatcttctcccccaaaagccaaatgggatcgtgcaaaaaatgttgatgtattaggtgttgaattagctggaagtgcagttcaattgccccttgtgtggaatattcaagtgagcacgtggctacgatactatgtctatgagaggctaattcagaaaggaaagaaaccaggtttccttcagttgttgggtacacagacagtcagtgccatctggcatggactgtatcctggatatatcatattctttgttcagtcagcattgatgataaatggttcacgagtcatatacagatggcagcaagcagtgagcagttcattcctccgcggtatcctggcttttctaaattttgcttatacattgctggtgcttaactactcctgcatcgggttccaggtactgagcttcgaagaaaccttggcgtcctacaagagcgtatattatgttggcacgattgttcccattgtgtgtatcctgctgggcaatgttatcaaaccagcaaggaaggcgaaggctcggaagactgagtgaggaaatacacactcaagtgaccattacatagaagaaagatgaagcttcaacgaagatacgacattctagttttcagtttatttattctgtgtctttgtaccgtatcaaatttagcataaggataatgtggtaaccccagttctcctacctcggaacttgattgcgattgaccaatcattaaaacgtggcataaccactgggttttccttctacttaatgactaatacgtgtgtgcgaa

SEQ ID NO: 1799 - DNA, 1752 bp, Sorghum bicolor
aaccgtcttcaacatgtctgccgctgccgcatccatatagacacacgccgctcggaacggaatcggagctcgcatccgaccgcgagcaagcggaccaaatcctcctccttattctatcgcgcgcccgcatctggccgcctcgaccatcggcggcggcggcggcgacgatggggctggagatggaggcgatggcggcgtcgatcggcgtgtcggtgcccgtgctccggttcctgctctgcttcgcggccaccatcccgacgggcctcctgtggcgcgcggtgcccggcgccacggggcgtcacctctacgcggggctcacgggtgccacgctctcctacctctccttcgggccctcgtccaacctcctcttcgtcgtgcccatgacgctcggttaccttgccatgctcttgtcccgtcgccacgccgggctcatcaccttcctcggcgccttcggcttcctcatcgcatgtcatgtgtactacatgagcggggatgcatggaaggagggaggcattgatgcaactggcgctttaatggttttaacgctgaaagtcatttcatgcgcaataaactacagtgatggtatcttgaaggaagagggtttacgcgatgctcagaaaaaataccgactgactaagcttccttctctaattgaatattttgggtactgtctctgttgtgggagccattttgctggaccggtatatgagatgaaagattatcttgattggactgagaggaaaggaatatgggctagcccaactccttcgccattgttacctactttgcgtgctctagttcaggctggtgtatgcatggggttatatttatacctgtcacctaaatttccactctcacggtttagtgagcccttatattatgaatggggtttctggcaccgactcttctatcagtacatgtcaggcttcactgctcgttggaaatattactttatatggtcaatttcagaagcctcaattatcatatctggtctgggctttactggttggtcagaatcttctcccccgaaagccaaatgggatcgtgcgaaaaatgttgatgtattaggtgttgaattagctggaagtgcagttcaaattccccttgtgtggaatattcaagtgagcacatggttacgatactatgtctatgagaggctaattcagaaaggaaagaaaccaggtttccttcagttgttgggtacacagacagtcagcgccatctggcatggactgtatcctggatatatcatattctttgttcagtcagcattgatgataaatggttcacgagttatatacagatggcagcaagcagtgagcagttcattcctccgcggtatcctggcttttctaaattttgcttatacattgctggtgcttaactactcctgcatcgggttcctggtactgagcttcaaagaaaccttggcgtcctaccagagcgtatattatgttggcacaattgttcccattgtgtttctcctgctgggcaatgttatcaagccagcaaggaaggcgaaggctcggaagaccgagtgaggaaaatacacactcaagtgaccattacatagaagaaagatggagaagcttcaacgaagattacgacattctagttttcagtttatttattctgtccgtatcaaatcaaatttagtataaggattaatgtggtgaccccagttctcctttcacggaactcgattgcgattgactcatcattaaaacgtggcataaccactgggttttcctt

SEQ ID NO: 1800 - DNA, 2185 bp, Sorghum bicolor
gttggaccatgcttttaagtcaaggattgatctagggaaaacttgagtgttcttttcccctctatttctacaaaatttgattaaccaaaaatagaagggagttttctacaaaaccgtcttcaacatgtctgccgctgccgcatccatatagacacacgccgctcggaacggaatcggagctcgcatccgaccgcgagcaagcggaccaaatcctcctccttattctatcgcgcgcccgcatctggccgcctcgaccatcggcggcggcggcggcgacgatggggctggagatggaggcgatggcggcgtcgatcggcgtgtcggtgcccgtgctccggttcctgctctgcttcgcggccaccatcccgacgggcctcctgtggcgcgcggtgcccggcgccacggggcgtcacctctacgcggggctcacgggtgccacgctctcctacctctccttcgggccctcgtccaacctcctcttcgtcgtgcccatgacgctcggttaccttgccatgctcttgtcccgtcgccacgccgggctcatcaccttcctcggcgccttcggcttcctcatcgcatgtcatgtgtactacatgagcggggatgcatggaaggagggaggcattgatgcaactggcgctttaatggttttaacgctgaaagtcatttcatgcgcaataaactacagtgatggtatcttgaaggaagagggtttacgcgatgctcagaaaaaataccgactgactaagcttccttctctaattgaatattttgggtactgtctctgttgtgggagccattttgctggaccggtatatgagatgaaagattatcttgattggactgagaggaaaggaatatgggctagcccaactccttcgccattgttacctactttgcgtgctctagttcaggctggtgtatgcatggggttatatttatacctgtcacctaaatttccactctcacggtttagtgagcccttatattatgaatggggtttctggcaccgactcttctatcagtacatgtcaggcttcactgctcgttggaaatattactttatatggtcaatttcagaagcctcaattatcatatctggtctgggctttactggttggtcagaatcttctcccccgaaagccaaatgggatcgtgcgaaaaatgttgatgtattaggtgttgaattagctggaagtgcagttcaaattccccttgtgtggaatattcaagtgagcacatggttacgatactatgtctatgagaggctaattcagaaaggaaagaaaccaggtttccttcagttgttgggtacacagacagtcagcgccatctggcatggactgtatcctggatatatcatattctttgttcagtcagcattgatgataaatggttcacgagttatatacagatggcagcaagcagtgagcagttcattcctccgcggtatcctggcttttctaaattttgcttatacattgctggtgcttaactactcctgcatcgggttcctggtactgagcttcaaagaaaccttggcgtcctaccagagcgtatattatgttggcacaattgttcccattgtgtttctcctgctgggcaatgttatcaagccagcaaggaaggcgaaggctcggaagaccgagtgaggaaaatacacactcaagtgaccattacatagaagaaagatggagaagcttcaacgaagattacgacattctagttttcagtttatttattctgtccgtatcaaaccaaatttagtataaggattaatgtggtgaccccagttctcctttcacggaactcgattgcgattgactcatcattaaaacgtggcataaccactgggttttccttctacttaatgactacttatacgtgtgtgcgaatgattttgtgtgttcccatctgcatgctgaatgtcggtctagacgtcttcccacctggagcttttttttgactggcaagatctgctcaccgtaagtgatatccatgaacaaatggatgcagacgtcaggagtgaggatacaaaaacatcgaattgctcaggcacatcgcacatgctgtgatttttcctctccaaattgaccatgctgaaagtcattttctgctgggaatctcagtttccactccacgattcacgcgctttgggaatattcatcatgccaacttcttttgc

SEQ ID NO: 1801 - DNA, 1770 bp, Hordeum vulgare
caaatcctctattcctgcatcgcccgcatctgttcgcccccctctgcggcggcggtggcggtggcggtggcgacgatggggctcgagatggagccgatggcggcggcgatcggcgtctcggtgcccgtgctccgcttcctgctctgcttcgcggccaccatacccacgggcctcctctggcgcgccgtgccgagcgccacggggcggcacctctacgcggggctcagcggcgccgggctctcctacctgtccttcggggccacctccaacctcctcttcgtcgggcccatggcgctcggttacctcgccatgctcctctgccgtcgccgagctggcctcgtcaccttcctcggcgcattcggcttcctcatcgcatgtcacgtctactacatgagtggggacgcgtggaaggagggaggcatcgatgcaaccggtgctttaatggttttaacgttgaaagtcatttcatgctcaatgaactacagtgatggtctcttgaaggaagaagagggtctacgtgatgctcagaagaagtatcgcttgactacgatgccttctctagtcgaatatttcggttactgcctctgctgtggcagccactttgctggaccagtatatgagatgaaagattatcttgaatggactgaaaggaaaggaatatgggccagctcaactccttcaccattattacctactctgcgcgctctagttcaggctggaatatgcatggggttatatttgtatctgtcacctatgtttccgctttcacgatttagtgaacctctatattatgagtggggtttctggcaccggctcttctttcagtacatgtcaggatttactgctcgttggaaatactactttatatggtcagtttcagaagctgcaattattatatctggcctgggtttcaccggttggtctgattcttctcccccaaaagccaaatgggaccgtgctataaatgttgatattctgggcgtcgaactagctggaagtgcagctcaattgccacttaagtggaatattcaagtgagcacatggctaagatactatgtatatgagaggctaattcagaaagggaagaagcctggtttccttcagttgttgggtacacagacagtcagtgctatctggcatggactgtacccaggatatatgatattctttgttcagtcggcattgatgataaatggttcaaaagttatatacagatggcaacaagctgtgagcaattcaggcctccgcactatcctgtctttactaaattgtgcatacaccatgatggtgcttaactactcatgcattggcttccaggtactgagcttccaggagaccttggcatcctacaagagcgtatattatgttggcacaattgttcctattctatgtgtcttgctaggctatgttatcaagcccgcgagacctgtgaagccaaaggctcgcaaggcagaatgaggaacagagtggattgatgtttacatagatgagttacgaagcttcaatgatgattatgacaagatagttttctgtttacttcatgtttgtgaaacaatatcaaatttagcaaaaaggatggctctaactcacaccttggagctccattgtaatcgacgaatcattaaaaatctgtcatttcgttgggttgatcacccttttgttgtaccacatgcaacgcatggtttttggccctaaagatgatgtttgttatttattcatgtgaagtttaagcctttttctgccttggtctattcaaactgaagtattttc

SEQ ID NO: 1802 - DNA, 1734 bp, Zea mays
cacacccacacacacacgccgctcggaatcggagcttgcatccgaccgcgagcaagcggaccaaatcctcctccatattctatcgcgtgcacgcatctggccgcctcgaccctcggcggcggcggcggcgacggcgacgacgacgatggggctggagatggaggcgatggcggggtcgatcggcgtgtcggtgcccgtgctccggttcctgctctgtttcgcggccaccatcccgacgggcctcctgtggcgcgcggtgcccggcgccatggggcgccacctctacgcggggctcactggtgccacgctctcctacctctccttcggggccacctccaacctcctcttcgtcgtgcccatgacgctcggttaccttgccatgctcctgttccgccgccacgccgggctcatcaccttcctcggcgccttcggcttcctcatcgcatgtcatgtgtactacatgagcggggatgcgtggaaggagggaggcattgatgcaactggagctttaatggttttaacgctgaaagtcatttcgtgctcaataaactacagtgatggtatcttgaaggaagagggtttacgcgatgctcagaaaaaaaaccgattgactaagcttccttctctaattgaatattttgggtattgtctctgttgtgggagccactttgctggaccggtatatgagatgaaagattatcttgaatggactgaaaggaaaggaatatgggctagcccaactccttcgccattgttacctactttgcgtgctctagttcaggctggtatatgcatggggttatatttatacctgtcacctaaatttccactctcacggtttagtgagcccctatattatgaatggggtttttggcaccgactcttctatcagtacatgtcaggctttaccgctcgttggaaatattactttatatggtcaatttcagaagcctcaattatcatatctggtctaggctttactggttggtcggaatcttctcccccaaaagccaaatgggatcgtgcaaaaaatgttgatgtattaggtgttgaattagctggaagttcagttcaattgccccttgtgtggaatattcaagtgagcacatggctacgatactatgtctatgagaggttaattcagaaaggaaagaaaccaggtttccttcaattgttgggtacacagacagtcagtgccatctggcatggactatatcctggatatatcatattctttgttcaatcagcattgatgataaatggttcacgagttatatacagatggcagcaagcagcgagcagttcattactaagcggtatcctggcctttctaaattttgcttatacattgctggtgcttaactactcctgcatcgggttccaggtactgagcttcaaagaaaccttggcatcctaccggagcgtatattatgttggcacaattgttcccattgtgtgtcttctgctgggcaatgttatcaagccagcaaggaaggcgaaggctcggaagaccgagtgaggaaatactcactcaagtgacctttacatagaagaaagatggtgaagcttcaacgaagataaggacattctagttttcaatttatttattctgtctttttgtacggtatcaaatttagcataaggataatgtggtgaccccggttctcctacctcggaactcgattgcgattgatcaatcattaaaacgtgacataaccactggattttccttta

SEQ ID NO: 1803 - DNA, 1462 bp, Hordeum vulgare
gataccttcccagggcttccacgccatcacacacagcacatatacacgcgcggctcgcgagctcgcttcatcatcagaaaaaaccaaatcctctattcctgcatcgcccgcatctgttcgcccccctctgcggcggcggtggcggtggcggtggcgacgatggggctcgagatggagccgatggcggcggcgatcggcgtctcggtgcccgtgctccgcttcctgctctgcttcgcggccaccatacccacgggcctcctctggcgcgccgtgccgagcgccacggggcggcacctctacgcggggctcagcggcgccgggctctcctacctgtccttcggggccacctccaacctcctcttcgtcgggcccatggcgctcggttacctcgccatgctcctctgccgtcgccgagctggcctcgtcaccttcctcggcgcattcggcttcctcatcgcatgtcacgtctactacatgagtggggacgcgtggaaggagggaggcatcgatgcaaccggtgctttaatggttttaacgttgaaagtcatttcatgctcaatgaactacagtgatggtctcttgaaggaagaagagggtctacgtgatgctcagaagaagtatcgcttgactacgatgccttctctagtcgaatatttcggttactgcctctgctgtggcagccactttgctggaccagtatatgagatgaaagattatcttgaatggactgaaaggaaaggaatatgggccagctcaactccttcaccattattacctactctgcgcgctctagttcaggctggaatatgcatggggttatatttgtatctgtcacctatgtttccgctttcacgatttagtgaacctctatattatgagtggggtttctggcaccggctcttctttcagtacatgtcaggatttactgctcgttggaaatactactttatatggtcagtttcagaagctgcaattattatatctggcctgggtttcaccggttggtctgattcttctcccccaaaagccaaatgggaccgtgctataaatgttgatattctgggcgtcgaactagctggaagtgcagctcaattgccacttaagtggaatattcaagtgagcacatggctaagatactatgtatatgagaggctaattcagaaagggaagaagcctggtttccttcagttgttgggtacacagacagtcagtgctatctggcatggactgtacccaggatatatgatattctttgttcagtcggcattgatgataaatggttcaaaagttatatacagatggcaacaagctgtgagcaattcaggcctccgcactatcctgtctttactaaattgtgcatacaccatgatggtgcttaactactcatgcattggcttccaggttagcttccaggagaccttggcatcctacaagagcgtatattatgttggcacaattgttc

SEQ ID NO: 1804 - DNA, 2694 bp, Setaria italica
gcccgctgatggtggcgaggatgatgcggtggccgcggccgccggcggcgcgcaagttccgggtgcggctggtggtgcggcgggcggaggggttgccgctgcctgcgcctgcggtggagccggcctcgccggagcgggaggcggcgggcgccgcgccgccgagggccgtcgcggcggaggtgaggtggaaggggcccagggcgtcggcgctgggctcgctgcggcgcgccgcggtcaggcgcaaccgcacgcgggaggaggcggaggcggcgtgggaggaggagttcgagagcgtcgtcacgctcgcggccgcgtcgcagcgggagggcgccgcgttccagccctgggagctcgccttctgcgtcttcagcgacatcaacataggggcaaagaataaaccatcaattctgggaactgcttctctcaacctagcagactatgcatcagcagctgaggaggtgattgagataattctcccattgtctgtacctggtggtgaacctgaatcagccccatcccttcacctcactctaagtatggtggaactaagagctgttcaagaaacgtccgatgcatcacaacgacctgctgcaacctttccattgtccccatcatctggtgattctcttcctggaggaaaagatgaggtttcagttatcaaagcagggctgaggaaagtaaaaattctcacagatctggtggcgacacgaaggtccaagaagacttgccaagatgatgaaggcggcgaagataagttctgtgttaacagtgatggtgctgaatatccatgtgatactgagtctctcgatgacgatctggatgacagagtacaggaagatgaaattggggattcaactatcaggaagtccttcagttatggatcgctgcagtctgtcaactatgtcggtggcctagtttatgcccatgcaaagattgatggggagcatgaggactggatatattatagtcaccgaaaatctgatgtcggttatcatgtagagaaaatgttgccatcgaccactgaggagactgtgttgccaactgctaaacggagtatacttccttggaggaagaggaaattgagtttaagatcactgaaggctaaaggtgaacctctgttgaagaaggcatatggggaagagggaggtgatgatattgactatgatcgacgcctgctaacctcttctgatcaatctgtttcagagggatcaagagctgaagatggatcagcaaatggtatggtgtcagaatttggtgatgataattttattgtggggaattgggagttcaaggagataatcagccgtgatggccatatgaaactttcgtcccaggtgttctttgcatcaatagaccagagaagtgagcgagcagctggggagagtgcatgtacagcacttgtggctgttattgcagactggttccaggcaaatcggaatatgatgcctattcagtcacagtttgacagccttatccgtgaaggatcactagagtggagaaacctttgtgagaacgagacatatagagagcgctttcctgataagcactttgatcttgaaactgtccttcatgccaagattcgcccactgacagtctccccaagcaaatcttttattggattcttccagcctgaaggcgatgaggacatgggcggttttgactttcttaatggcgccatgtcatttgacagcatctgggatgagattacccaggcggcagagttctcatctagtgacaaccctaacctatacatagtgagttggaatgaccacttttttctcctcaaggttgagcatgatgcatattacattatcgatacccttggagagaggctccatgaagggtgcagccaggcatacattttgaagtttgacaacactaccacgattcacaaggtacaggctgaaaagaaaccttctagccccgactcaagcggaccatcaaaggattcttcaggtcctgagagctcttcaactgaccaggacagtgagaatgatattggagaggacatccttgtgtccaagggcaaagaatcatgcaaagaatacatcaagagtttcttggcagccataccaatccgggaactacaggtagacatcaagaaaggactgatggcatcaaccccgttgcaccatcgcctccaaattgagttccactacacccaatcttccccaaaagagattgcatccgcccctcagcttcttgccaccgatgccccttttgagttctcatggcctgaggcaacaccaacgatggaagttgcgctaacacctgtagtctccgttgtatagcttgttgccatgggtggctgagacacgacaacagtctgccctgatgttcaacatcaagagcctctttttccttgagccgtggtatgacgcagaacctagatgaagacttagtcccttttctgtttgtactaatttatctagtatgaactgacccaggcatagccgcataggagcattccgcctgaattttgtatagaggtgtatgctcctatcttccctcatctgctgctttgtaatcttttggagccttgtatgactaatcaatgagaaatgtcccccctgttataatgaactacgggcctgtttatctgtagatgtaatatgttaatatcttccaacaagcatcaagctggaattctgaatctgctagttggaagcagcatatgtccacacattttgagtg

SEQ ID NO: 1805 - DNA, 1017 bp, Zea mays
agccaaccggcccaaccccgtctaggtttaggcacccgaccgccgcagcgtccccgccgccacgaccacgagcgaaaggaggtcgccggaagagggggcgcggagatgagcgggagcgcgttcaacgcgttcaagtcgcgggtgccggtggcgtggagtccccggctgtacatcacgctggtgcggggcctccccgggacgcggcgcctccaccgccgcacgctcgaggccatgcgcctccgccgctgccaccgcaccgtcgagcaccgcaccacgccgtcgctcctcgggatgctcacccaggtgaagcgcctcgtcgccgtggagaccgaggagatgtacaacgcgcggaagcaggccgaggcggagaggcgcgcgcccagacccccgctcgtcgtctcccaccagccacagccgccggctccgaagccggcagccgccgccgcggtgggtgccgctaccactgcgcagtagcctccgggcatcagaagcctttcatcacagttcagcggcataataattgatttgcctgtgtttgggtctgctggttttcagacgatcgctttgggtcttcttgctcaacgagatctagcaacggatttgatcgatcttctcaagatcgttgtgtggtgcaacctgcattgaccctgtattttagattgttttatatgaactaggcgcacggttttccaatgcttttgtctagaatcaagtccaatgatttggtttaaattactaaattctctgtaaatgctcttcaagatgtgtaggcggttaaggcttcttgcgtaattgaaccagaggattgctagcgtctaaagttgctcggttgtgattgttggttcttagcgaaaggatttataacgttgattgggttctgggagtgagaacgtactgtgatcttgactacttcggtctccccaccgaatctccgaagaaaaagggtaccgatcaggggctcagggctgagcttggacggaccgggccatgcacggccaagttgattgaaaaaaaaaa

SEQ ID NO: 1806 - DNA, 825 bp, Saccharum officinarum
ctaggtttacgcttcccggccgccgcagcctccacgccacgagcgaaagcagatcaccggaagagggggcgcggagatgagcgggagcgcgttcaatgcgttcaagtcgcgtgtgccggtggcgtggagtccccggctgtacatcacgctggtgcggggcctcccggggacacggcgcctccaccgccgcacgctcgaggccatgcgcctccgccgctgccaccgcaccgtcgagcaccgcaccacgccgtcactcctcgggatgctcacccaggtgaagcgcctcgtcgccgtcgagaccgaggagatgtacaacgcgcggaagcaggccgaggcggagagacgcgcgctcagacccccgctcgtcgtctcccaccgcccgccgccgccgactccgaagccggcagcagccgccgcggagggtgccgctgccacttcccagtagcctctgggcatcagaagcctttcatcacagttcagcagcataataattaaccggcctgtgtttgggtctgctgctctccagacgatcgcattggatcttcttgctcaacatctagcaaccgatatgatctcaagatcattctatggtccgacttgcattggccctgtattttatattattatatggactgagtgcatggttttctaaagcctttgtctaaaaataaagtttaatgattttggtttcaatttccttaaatttccagaaaaaatgctttttttaaaagtgtgaaaacttttttttggttatttgaaaacacaaaggttgcttccggcgctaaaatttttgtttctccggatatcaattatctatgaattggc

SEQ ID NO: 1807 - DNA, 932 bp, Zea mays
agttaaagtaacatcaataatcaagcacttgttaaaaaaaacatcaatgatgaagcaaacaggtcacagctgaatgccaaaattgtggacatatcccaccaaacaggccgatagccctctatctcggcagcctccttggcccatgtgatgatcgccttcaaggttcaagctggtggacctcagagtcaaccggcccaaccctctcagtctcgggtcgccagtcctcgcctaggtttaggcttccagcggccgcagcctccacaccaagagcggaaggagatcgccggaagaggggggaggcgcggagatgagcgggagcgcgttcaacgcgttcaagtcgcgtgtgccggtggcgtggagtccccggctgtacatcacgctggtgcggggcctaccgggcacgcgccgcctccaccgccgcacgctcgaggccatgcgcctccgccgctgccaccgcaccgtcgagcaccgcaccacgccgtcgctgctcgggatgctcacccaggtgaagcgcctcgtcgccgtcgagaccgaggagatgtacaacgcgcgcaagcaggccgaggcggagaggcgcgcgcccagacccccgctcgtcgtctcccaccaccagccaccgccgccggctctgaagccggcagccgccgccgcggagggtgctgctgccactgcgccatagcctctggtaagctcctcgcgttccgatcgtcctggtgtggtctggttttccattttgcttatttgccctcgaagcgtttgatgcaacgcctcgagtcggtgcgcgctaaggggctgtcaatatagcaaattcagatgctcaagctaacacaaaatggcttagttttgtttataatgaagaagcaatctaagagttagcggctgcgtttaatttgttctgcatttttgtattgagtgctttatatcagacattc

SEQ ID NO: 1808 - DNA, 987 bp, Setaria italica
gagccaacaccggcccaaccatctcattcccccccaaagcctccggcaatcgtcgccgcctagggtttaggcttccggccgccgcagcctccacgcagcgagcgaaagggggatcgccggaagggagccgcggagatgagcgggagcgcgttcaacgcgttcaagtcgcgggtgccggtggcgtggagcccgcggctgtacatcacgctggtgcgggggctccccgggacgcggcgcctccaccgccgcacgcttgaggccatgcgcctccgccgctgccaccgcaccgtcgagcaccgcaccacgccgtcgctcctcgggatgctcacgcaggtcaagcgcctcgtcgtcgtcgagacggaggagatgtacaacgcgcggaggcaggcggaggaggagcggcgcgcgcccaggccgccgcttgtcatctcccaccacccgccggctccgactccgaagccggcagcagccgcggctgagggtgccgctgccactgcgcagtagcctctgggcatcagaagcctttcatgacagtccagcaacataataatttatgtgccttttatcaacagatgctttcattggatcctcctgctcaacaagctctagcaacccatgctatatgcaacacacactgcagcatgctactgttttcattggtcctgtattttagattgttatgggctgatgccattgtctttctatacttgtggtcaatcaagctcagtgcaattactaaaattcctgaaaatgctctttaagatgtgtcatattggttccatgcctaattcagcctaagggatgtcagcctttaaatttacggtatcgtgattgttccaacttccaaccttagcaaagggggttgctagcttcagttataattgccaaatttgcttcagttctgaagtaaaactgtcttgtatactctggtgattttggtgctgtgccttctaactctgattttgcgctgaaaatgattattagtcg

SEQ ID NO: 1809 - DNA, 487 bp, Setaria italica
tctcattccccccccaaagcctccggcaatcgtcgccgcctagggtttaggcttccggccgccgcagcctccacgcagcgagcgaaagggggatcgcccgaagggagccgcggagatgagcgggagcgcgttcaacgcgttcaagtcgcgggtgccggtggcgtggagcccgcggctgtacatcacgctggtgcgggggctccccgggacgcggcgcctccaccgccgcacgcttgaggccatgcgcctccgccgctgccaccgcaccgtcgagcaccgcaccacgccgtcgctcctcgggatgctcacgcaggtcaagcgcctcgtcgtcgtcgagacggaggagatgtacaacgcgcggaggcaggcggaggaggagcggcgcgcgcccaggccgccgcttgtcatctcccaccacccgccggctccgactccgaagccggcagcagccgcggctgagggtgccgctgccactgcgcagtagcct

SEQ ID NO: 1810 - DNA, 470 bp, Pennisetum glaucum
cggaaggcccaaccccctcatttccccaaagcctccggcaatcgtcgccgcctagggtttagccttccggccgccgcagcctccacacagacagaacgcggaagggggatcgccggaaaggaatccgcggagatgagcggcagcgcgttcaacgcgttcaagtcgcgggtgccggtggcgtggagcccgcggctgtacatcactctggtgcgggggctccccgggacgcggcgcctccaccgccgcacgctcgaggccatgcgcctccgccgctgccaccgcaccgtcgagcaccgcaccacgccgtcgctcctcgggatgctcacgcaggtcaagcgcctcgtcgtcgtcgagacggaggagatgtacaacgcgcggaggcaggctgaggaggagcggcgcgcgcccaggccgccgctcgtcatctcgcaccacccgccggctccgaccccgaagccggcggcagcagc

SEQ ID NO: 1811 - DNA, 797 bp, Panicum virgatum
aggcattcgccggaacggagcgcggagatgagcgggacagcgttcaacgcgttcaagtcgcgggtgccggtggcgtggagcccgcggctgtacatcacgctggtgcgggggctccccgggacgcggcgcctccaccgccgcacgctcgaggccatgcgactccgccgctgccaccgcaccgtcgagcaccgtaccacgccgtcgcttctcggaatgctcacccaggtaaagcgcctcgtcgtcgtcgagaccgaggagatgtataacgcgcggaggcaggcagaggaggagcgacgcgcgcccaggccgccgcttctcatctcccaccaccagccagcgccaactgcgaacccgggagcagccacggcagagggttctgctgccacttcgccgtagcctctgggcatgagaagcctttcatgacagttcaacgtcataataattaatttgccttttgactctagaagatatcattggatcctcgtgctcaacaagctccagcaacccatactctatgaaaaattgcagtatggtccaaactactgttttccttggccctgtatttagatttgtttatggacaggtattggtgtttcagtgcctgtggtcaatcttgctcggtgtaatttcaattacaaaaatttctaaaaatgctctttaagatgtcatattggttttttccctaatttaacgtaaggatgtatctcagattttaaatttattgtattctgattgttccaacattagcaaaagcgttgctgtgcttttggttgattgccagaattgcttcagttctg

SEQ ID NO: 1812 - DNA, 777 bp, Triticum aestivum
cccaactccccccactccggcagaaggcaacagagggttagggttccggccgccggagcaaatcacacggaggagcagagccagcagtcgagagagaagcgagatgagcgggagcgcgttcaacgccttcaagtcgcgggtgccggtggcgtggagcccgaagctgtacatcacgctggtgcgcgggctgccggggacgcgcaagctccaccgccgcaccctggaggccatgcgcctccgccgctgccaccgcaccgtcgagcaccgcaccacgccctccctcctcggcatgctcacccaggtcaagcgcctcgtcgtcgtcgagaccgaggagatgtacaacgcgcggaagcaggccgacgagcagcgccgcgcgctcaggcccccgctcgtcgtctcgcacgccccgccgcccaagccggccgccgccgcgccggagggcgccgggcagtagtcgcctccggttagttcccaccccccggtgatgcttcggtttgttttgctttcgcctgcccgcctgcccgcgcgtcaggtgttcgacgcaatgccttggcagggttggcgtcctcctttataatagaaatgctttagcgatctttggcaacttgaattgatgggaataagtgaagaatttcctgtgatcgttcaattttactactgattgttatattgaaatgtaaggcccaagtcatatcagttgatgttgcgtgatgctttgaatgctgaatatagatatgcctgcaatacacgttggaaggactctctaaatgtggttcc

SEQ ID NO: 1813 - DNA, 737 bp, Triticum aestivum
cagcccaactgcctcccactccggcaaaagggtacagacagaggcttagggttccggccgccggagtaaatcccaccacacgcacacggaggagcagagccagagccagagagatgagcgggagcgcgttcaacgccttcaagtcgcgggtgccggtggcgtggagcccgaagctgtacatcacgctggtgcgcgggctgccggggacgcgcaagctccaccgccgcaccctggaggccatgcgcctccgccgctgccaccgcaccgtcgagcaccgcaccacgccctccctcctcggcatgctcacccaggtcaagcgcctcgtcgtcgtcgagaccgaggagatgtacaacgcgcggaagcaggccgacgagcagcgccgcgcgctcaggcccccgctcgtcgtctcgcacgccccgccgcccaagccggccgccgccgcgccggagggcgccgggcagtagtcgcctccggttagttcccaccccccggtgatgcttcggtttgttttgctttcgcctgcccgcctgcccgcgcgtcaggtgttcgacgcaatgccttggcagggttggcgtcctcctttataatagaaatgctttagcgatctttggcaacttgaattgatgggaataagtgaagaatttcctgtgatcgttcaattttactactgattgttatattgaaatgtaaggcccaagtcatatcagttgatgttgcgtgatgctttgaatgctgaa

SEQ ID NO: 1814 - DNA, 679 bp, Secale cereale
agagcagagggttagggttccggccgccggcgcagatcccaccacacgcgcacggcggagcagagccgccggaggggagatgagcgggagcgcgttcaacgccttcaagtcgcgggtgccggtggcgtggagcccgaagctgtacatcacgctggtgcgcgggctgccggggacgcgcaagctccaccgccgcaccctggaggccatgcgcctccgccgctgccaccgcaccgtcgagcaccgcaccacgccctccctcctcgggatgctcacccaggtcaagcgcctcgtcgtcgtcgagaccgaggagatgtacaacgcgcggaagcaggccgacgagcagcgccgcgcgctcaggcccccgctcgtcgtctcgcacgccccgcagcccaagccggccgccgcgccggagggcgcgggccagtagtcgcctctgggcatcatagtcatcacaagctctggtcgtgttgatcaactgagccatcgtttcatttggtggaggccacctctttgtgtgttcttgctccaaagattgtgacttctcagttcttgtgatctgtttatttttcgataagtggagcagccttgatcggagcagaaaattgttacagcttaggtccatatgtaatgctgttgatttgttggttccctcctcacgaaagagattactagcttggat

SEQ ID NO: 1815 - DNA, 996 bp, Hordeum vulgare
aactcctctcactccagcaaaaggcagcagaggtctagggttccggccgccggagcagatcccaccgcacggaggagcagagccactgggagagaagggggatgagcgggagcgcgttcaccgccttcaagtcgaaggtgccggtggcgtggagcccgcggctgtacatcacgctggtgcgcgggctccccgggacgcgcaagctccaccgccgcaccctggaggccatgcgcctccgccgctgccaccgcaccgtcgagcaccgcaccacgccctccctcctcgggatgctcacccaggtcaagcgcctcgtcgtcgtcgagacccaggagatgtacaacgcgcggaagcaggccgacgagcagcgccgcgcgctcaggcccccgctcgtcgtctcccacgccccgccgcccaagccggccgccgccgcgccggagggcgccgggccgtagtggcctccggttagttccgcccccgcggtgatgcttcgatttgatttgcttttgcctgcctgcctgcccgcctgcgcgtcaggtgttcgacgcaatgcctcggaagggtcggcaccctccctttttaatagaaatgctgtagaagtctgtgacatgtcgacttgatgggaataagtgaagaatttcctggtgatcgttcagttttactactaccgattgtttgatgttttattgaaattgtaaggcataagtcaaatcagttgatgttgcgtgctctgaatatttaagataggtatgcctgcaatacacgttggaatgactccagaaatgtgatttccctgaacaattatatgacaagctgttgtaactgctgcagctatctctagttttaaggtccagttcgataaaagtttaagcagattccaattagccagtgtcggtatgttgcataatgctttggatgttgaatacaagtatgcctgcaatacatgccggaagaactgtccaaatgtgatattcacgaacggtgataaaaaaaaaaaaa

SEQ ID NO: 1816 - DNA, 1053 bp, Hordeum vulgare
cggcttcttaaagcccatctaatagtaacagccatttctctcgatagatcgccgagctggagcagcccaactcctctcactccagcaaaaaggcagcagaggtctagggttccggccgccggagcagatcccaccgcacggaggagcagagccactgggagagaagggggatgagcgggagcgcgttcaccgccttcaagtcgaaggtgccggtggcgtggagcccgcggctgtacatcacgctggtgcgcgggctccccgggacgcgcaagctccaccgccgcaccctggaggccatgcgcctccgccgctgccaccgcaccgtcgagcaccgcaccacgccctccctcctcgggatgctcacccaggtcaagcgcctcgtcgtcgtcgagacccaggagatgtacaacgcgcggaagcaggccgacgagcagcgccgcgcgctcaggcccccgctcgtcgtctcccacgccccgccgcccaagccggccgccgccgcgccggagggcgccgggcagtagtggcctccggttagttccgcccccgcggtgatgcttcgatttgatttgcttttgcctgcctgcctgcccgcctgcgcgtcaggtgttcgacgcaatgcctcggaagggtcggcaccctccctttttaatagaaatgctgtagaagtctgtgacatgtcgacttgatgggaataagtgaagaatttcctggtgatcgttcagttttactactaccgattgtttgatgttttattgaaattgtaaggcataagtcaaatcagttgatgttgcgtgctctgaatatttgagataggtatgcctgcaatacacgttggaataactccagaaatgtgatttccctgaacaattatgtgacaagctgttgtaactgatgcagctatctctagttttaaggtccagttcgataaaagtttaagcagattccaattagccagtgtcggtatgttgcataatgctttggatgttgaatacaagtatgcctgcaatacatgccggaagaactgtccaaatgtgatattcacgaacggtgata

SEQ ID NO: 1817 - DNA, 989 bp, Hordeum vulgare
cggcttcttaaagcccatctaatagtaacagccatttctctcgatagatcgccgagctggagcagcccaactcctctcactccagcaaaaaggcagcagaggtctagggttccggccgccggagcagatcccaccgcacggaggagcagagccactgggagagaagggggatgagcgggagcgcgttcaccgccttcaagtcgaaggtgccggtggcgtggagcccgcggctgtacatcacgctggtgcgcgggctccccgggacgcgcaagctccaccgccgcaccctcgaggccatgcgcctccgccgctgccaccgcaccgtcgagcaccgcaccacgccctccctcctcgggatgctcacccaggtcaagcgcctcgtcgtcgtcgagacacaggagatgtacaacgcgcgtaagcaggccgacgagcagcgccgcgcgctcaggcccccgctcgtcgtctcccacgccccgccgtccaagccggccgccgccgcgccggagggcgccgggcagtagtggcctccgggcatcagagtcatcacaagctctggtcgagttgatcagctgagccgtagttccattttgctgggaaccgcctcttggcttcagatttctagtgccttttgtgtcatgttgctccaaagattgtggcttgttctcagttcttgtgatatgtttattttccgattagggcagcatccttaattggagcagaaaattgttacagctaggtctatatggtatgttgtttatttgttggttcccgcctcaccaaagggattactagcttggattttatttttgccttaattgccagagtcgcaataactgtctgacttgttataatatgaaaacaatttggtaaaatagttgtgcgattggcagccagtgtcgatggtagacagactgggcggtgaaagtaaccagcagggagtcaggacattatcttgctgaaagccaaggaaacagaattttcgtttggac

SEQ ID NO: 1818 - DNA, 336 bp, Setaria italica
atgagcgggagcgcgttcaacgcgttgaaatcgcgggtgccggtggcgtggagcccgcggctgtacatcactctggtgcgggggctccccgggactcggcgcctccaccgccgcacgctcgaggccatgcgcctccgccgctgccaccgcaccgtcgagcaccgtaccacgccgtcgctcctcagaatgctcacccaggtcaagcgcctcgtcgtcgtcgagaccgaggagatgtataacgcgcggaggcaggcggaggaggagcgacgcgcgcccaggccgccgcttgtcatctcctgcggcggagggtgccgctgccactgcgcagtagcctct

SEQ ID NO: 1819 - DNA, 814 bp, Brachypodium distachyon
ctcccactccggcaataggtaccagagagtttagggttccggccgccggagcaaccaaagagcagaaagagagatagtctgcgagagagagggagcgaggagatgagcgggagcgccttcaacgcgttcaagtcccgggtgccggtggagtggagccctcggctgtacatcacgctggtgcgcggcctccccgggacgcggaagctccaccgccgcaccctcgaggccatgcgcctccgccgctgccaccgcaccgtcgagcaccgcaccacgccctccctcctcggcatgctcacgcaggtcaagcgcctcgtcgtcgtcgagaccgaggagatgtacaacgcgcggaggcaggccgacgagctgcggcgcgcgcccaggccgccgctcgtcgtctcccacaacccgccgcccaaggtggcggcttccccggaggctgcctcttaggcgaggtagtagtagcctctggttagtttctcgagtccctgttgttctcgtatttgcttgcctgcctgcctgcctgcttgcggggtgtttgatgtagtgcctcggaagggtcggcactatctttcttatctgagttgggtattttcctccgaaaaatacattgaagatgttgggttagtggttatgacattgacttgatagaaataagtgaggagtttactgtgatcatacagttttactactgattaatttacagtttattatagaagacctatgtcaaatcatttgatgttgcatatagctatgtgtgctgaatatagatatggctgcaatacgcaatagaagatctcctgaaatgtaattgcat

SEQ ID NO: 1820 - DNA, 1210 bp, Brachypodium distachyon
tcccactccggcaataggtaccagagagtttagggttccggccgccggagcaaccaaagagcagaaagagagatagtctgcgagagagagggagcgaggagatgagcgggagcgccttcaacgcgttcaagtcccgggtgccggtggagtggagccctcggctgtacatcacgctggtgcgcggcctccccgggacgcggaagctccaccgccgcaccctcgaggccatgcgcctccgccgctgccaccgcaccgtcgagcaccgcaccacgccctccctcctcggcatgctcacgcaggtcaagcgcctcgtcgtcgtcgagaccgaggagatgtacaacgcgcggaggcaggccgacgagctgcggcgcgcgcccaggccgccgctcgtcgtctcccacaacccgccgcccaaggtggcggcttccccggaggctgcctcttaggcgaggtagtagtagcctctggttagtttctcgagtccctgttgttctcgtatttgcttgcctgcctgcctgcctgcttgcggggtgtttgatgtagtgcctcggaagggtcggcactatctttcttatctgagttgggtattttcctccgaaaaatacattgaagatgttgggttagtggttatgacattgacttgatagaaataagtgaggagtttactgtgatcatacagttttactactgattaatttacagtttattatagaagacctatgtcaaatcatttgatgttgcatatagctatgtgtgctgaatatagatatggctgcaatacgcaatagaagatctcctgaaatgtaattgcatgaataatgaggtgacaaggtgttgtaactattacagccatcttgattgcgggttccagtttgctacagcctacaagtataaaaatatttcagttaggtaactgtgaatattgtgatatggcgatacacacttcgccatggttggtatccactattgcctgaggaaagaaggaatgcgtaggggaaagaagaacaagggcaatcttatccaaatggaaagtactactccctctgtcaggaaatagaattatatcttatacgaaatggcatagaattggtagattatatcttatacgaaatggcatagaattgattacattcaacctgagtcatgctagaggttacatttctgaaagtactggaattattttatatccatactgaagttcattttgact

SEQ ID NO: 1821 - DNA, 1062 bp, Saccharum officinarum
cgccacatgccccagctccacccagattctgacagcgccttaccaacttgctcgcccccgcagcgacagcgcgcacttggattcggcgaccgccggagcgcagagcaggcaagcgccgatctagagacgatggccgctgcgggctcctcgccgtcctcctcctcgagtaagcggttggaagggaaggtggccctcgtcaccggtggcgccaccggcatcggcgaagccatcgttcgcctcttcatggagcacggcgccaaggtctgcatcgcggacatccaggacgaggccgggcagcagctgcgcgacgccctgggaggcgacggggagggcgtcatgttcgtccactgcgacgtgacgtcggaggaggacgtgagccgcgccgtggacgcggcggcggagcggttcggtgcgctggacgtgatggtgaacaacgccggcgtgacgggcaccaaggtgacggacatccgtgccgtggacttcgccgaggcgcgcagggtgctcgacgtcaacgtgcacggcgtgttcctggggatgaagcacgcggcgcgcgtcatgatcccgcagaagcggggctccatcgtgtcgctggccagcgtggccagcgccatcggcgggatgggcccgcacgcgtacacggcgtccaagcacgccgtggtcgggctcaccaagagcgtcgccgcggagctcggccgccacggggtgcgcgtcaactgcgtgtccccctacgccgtgcccacggcgctgtccatgccgcacctgccccagggagcgcgcgccgacgacgcgctcagggacttcctggccttcgttggcggcgaggccaacctcaagggcgtcgacgccatgcccaaggacgtcgcccaggcggtgctatacctggccagcgacgaggcgaggtacgtcagcgcgctcaacctcatggtggacggcggcttcacagccgtcaaccataacctcaggccgttcgatgattagctcagcttgttagcagcattattatcactcttgttctggtgctactctgagacgtggcatgtagtcacaactcacgagtgtctg

SEQ ID NO: 1822 - DNA, 2374 bp, Setaria italica
accacagcaggctctcgcctcgcctacccacccatcttccccgctatcgccacgacgacgcgcaccggattcggcgacgccggaggcaggctccgatctcgagacgatgtccgccgcgagctcctcgccgtcctcctcatcctccgcgaagcggctggaagggaaggtcgccctcgtcaccggtggtgccaccggcatcggtgaagccatcgttcgcctcttcagagagcatggcgcgaagatctgcatcgcggacatccaggacgaagccggccagcagctgcgcgacgccctcggagaccaggacgtcatgttcgtccactgcgacgtcacggtcgaggacgaagtcagcgccgccgtcgacgcggtggcccagcggttcggctcgctggacgtcatggtgaacaacgccgggatcacgggaagcaaggtcactgacatccgcaacgtggacttcgccgaggtgcggaaggtgttcgacatcaacgtgcacggcgtgttcctcgggatgaagcacgcggcgcgcgtcatgatcccccagaagcggggctccatcgtgtcgctggcgagcgtggccagcgtcatcggcgggatgggcccgcacgcgtacacggcgtccaagcacgccgtcgccggcctcaccaagagcgtcgccggcgagctcgggcgccacggggtgcgcgtgaactgcgtctcgccgtacgccgtgcccacggcgctgtccatgccgcacctgccgcagggcgcgcgcgccgacgacgcgttgaaggacttcctggccttcgtcggcggcgaggccaacctcaagggcgtcgacctgatgcccagggacgtcgccgaggcggtgctctacctggcaagcgacgaggcgaggtacgtcagcgcgctcaacctcacggtggacggtggcttcacagccgtgaaccataacctgaaaccgttcgaggattagttcaaagctgttcgcagcattatgccagctctgctctgcgagtattggcactgctgttccgagatgtggcatgtgctatatttgtagcaagattaagcgtccgcaagactaatgagcccggtacatgaatgtagggcaactgattggaccttcgaaataaacagtgccgaattcgtgtgtatgatcaatgagaatgtgcaagaattaatttccagcagcgtgtgatcagataaactttctcgcgatgagacttaatgaaatataagaactgctcttccaatacttgggcacatcgtgttagtacatcatcatacttgcaacacacaatatagatgccaatactaacattgacataacatatatgctacccgtgctcttttaattgagctagagcaattttcctgtacagcgtttctgtagtgaactatatcatgacctttcaaaatcaagaatctaatcatcagctgaaaattgatgtgaagttacagaatcagcattatcaggtgagggattgcttgagtcagctgcatccttgctatcttcagtagagtcagaccctgagatggcgccacaaggttcaacatatgcttcagccaaggacctttcggctaattcagctacactgtcatgttgagcatgcagagcatctcttttcacgatgttaagtagaataccgttagcagtgctttcaggttgcagcaaatctccttcagaaacagcgatgcttgtgggagtagaagcttgactacctctggtgttgacagtgttgtatgactcggtctcagaaatttctgtgcctggtgtagtaactctagaactattgtttgggcatgggtcgtttggaaaggtagattccgacaaaatgcctgtagtctcaccctctagagtacagggcttaatgaaatcagtgtcagtctcaagattttggataaaactgatgaacttgtcagcagatgctgtcctcatcagaggcccaccacttctggtccagcaattaaggtcaatggtttctgattcactctcacttccgtcatgagaattgcgccgaacgtggtgagaagtatttggtgtgccaacaacaagaacagtaccctgttgcgtggatgaagtagcaactgcagaaatttcttcagagagagattctgaagggggtgtgccaacaacaagaacagtaccctgttgcgtggatgaagtagcaactgcagaaatttcttcagagagagattctgaagaattctctcgactgatgcggttccatgatggtaccctccttggtgttttgagtcgaacatagttagaatgtccctgggaagccgctgtcctttcaatgcttctttttagcctccgtttgtggtttaaaactgctatcgattcatccaatgcaagttcaatggcacagtttgctctgattgcagagagctt

SEQ ID NO: 1823 - DNA, 1116 bp, Panicum virgatum
  misc_feature (390)..(390): n is a, c, g, or t
  misc_feature (451)..(451): n is a, c, g, or t
  misc_feature (510)..(510): n is a, c, g, or t
  misc_feature (520)..(520): n is a, c, g, or t
  misc_feature (531)..(531): n is a, c, g, or t
  misc_feature (537)..(537): n is a, c, g, or t
  misc_feature (540)..(540): n is a, c, g, or t
  misc_feature (552)..(552): n is a, c, g, or t
  misc_feature (561)..(561): n is a, c, g, or t
  misc_feature (606)..(606): n is a, c, g, or t
  misc_feature (609)..(609): n is a, c, g, or t
  misc_feature (726)..(726): n is a, c, g, or t
  misc_feature (772)..(772): n is a, c, g, or t
atcactctgacttccactccccatcttttttgctctcgccaccacgacgcgcacccgcaccggattcggcgacgccggcggcaggctccgatctagagacaatgtcagccgcgggctcctcgccgtccgccgcctcctccagcaagcggttggaagggaaggccgccctcgtcaccggcggtgccaccggtatcggtgaagccatcgttcgtctcttcagagagcatggcgccaaggtctgcatcgcggacatccaggacgacgccggccagcggctgcgcgacgccctcggagaccaggacgtcatgttcgtccattgcgacgtcacggtcgaggaggacgtgagcgccaccgtcgacgcggcggccaagcggttcggcgcgctggacntcatggtgaacaacgccggcatcacgggcacaaggtcacgacatccgcaacgtggacttcnccgaggtgcgcaaggtgttcgacatcaacgtgcacggcgtgttcctcgggatgaagcangcggcgcgcntcatgatcccncagaancgnggctccatcgtntcgctggcnagcgtggccagcgtcatcggcgggatgggcccgcacgcgtacacnggntccaagcacgccgtggttgggctcaccaagagcgtcgccggggagctcgggcgccatggggtgcgcgtcaactgcgtgtcgccctacgccgtgcccacggcgctgtccatgccgcanctgccccagggcgcgcgcgccgacgacgcgctcaaggacttctggncttcgtcggcggcgaggccaacctcaagggtgtcgacgtgatgcccagggatgtgcgccgaggcggtgctctacctggcaagcgacgaggcgaggtacgtcagcgcgctcaacctcatggtggacggcggcttcacagccgtgaaccataacctgaaagcgttcgaggattagctcaagctgttggcagcatttgccagctctggtagtgttgtccctgctgttctgctgcaattcagagatgtggcatgtgctaatatatgtagcagattcgactgtgctgtattcatgtgtctgcaagactaatgtgccagtatatgaatgtctcgcaactgattggatatt

SEQ ID NO: 1824 - DNA, 1098 bp, Cenchrus ciliaris
ctacgacgcgcatccgcaccggattcggcgacgccggaggcaggctccgatctcgagacgatgtccggtgcgagctcctcgccgtccgcctcctcctccgcgcagcggttggagggaaaagtcgccctcgtcaccggtggtgccaccggtataggtgaagccatcgttcgcctcttcagagagcatggcgcgaaggtctgcatcgcggacatccaggacgaggccggccagaagctccgcgacgccctcggggaccaggacgtcatgttcgtccactgcgacgtcacggtcgaggacgaagtcagcgccgccgtcgacgcggtggcccagcggttcggcgggctggacgtcatggtgaacaacgccgggatcacgggcaacaaggtcacggacatccgcaacgtggactccgccgaggttcgcaaggtgttcgacatcaacgtgcacggcgtgttcctggggatgaagcacgcggcgcgcgtcatgatcccccagaagcggggctccatcgtgtcgctggcgagcgtgtccagcgtcctcggcgggatgggcccgcacgggtacactgcgtccaagcacgccgtcgttgggctcaccaagagcgtcgccgccgagctcgggcgccacggcgtgcgcgtcaactgcgtgtcgccgtacgccgtgcccacggcgctgtccatgccgcacctgccaaagggcgagcgcgccgacgacgcgctcaaggacttcctggcctttgtcggcggtgaggccaacctcaagggcgtcgacgcgatgcccaaggacgtcgccgaggcggtgctctacctggcaagcgacgaggcgaggtacgtcagcgcgctcaacctcacggtggacggcggtttcacagccgtgaaccgtaacctgaaaccgttcgaggattagttcattatgccagctcagcgtgacactgctgttccgagatgtgccatatttgtagcaagattcgaagtgtcagcaagactattgtgccaggacatgaatgtagcgcaactgatggacattcgaaataaacaatgccgatttcgcgtgtatgatcaatgagaatatgcgagaagaatgatttccacttttcca

SEQ ID NO: 1825 - DNA, 1240 bp, Setaria italica
cgagacgcaccggatttcggcgacgatgcggtgtgtgcggccttggctgtacacacgagacgctagccatgcgccgtcgcggtcgtcaactgtccggttccgcgcaattggtgcagctagcgtggacggccgtgacttgcttttacatgagccgtgcgagatgagacacaaggagaggaggagatttttctgacgctcccgtctcgccgcgcaccgatcgaattcgcgacgccggaggcagaggatccaatccagagagaccatgtccgccgctgcctcctcgccatcctcctcctccatgacgaagcggttggaagggaaggtcgccctcgtcaccggcggtgccagcggtatcggtgaaaccatcgttcgcctcttcaaaaaccatggcgcgaaggtctgcatcgcggacatccaggacgaggccggccagaagctacgcgacgccctcggaggtggcgacgacgtcatgttcgtccactgcgacgtcacggtcgaggaggacgtgagtgccgccgtcgacgcggtggcccagaggttcggcgcgctggacgtcatggtgaacaacgccggcatcacggggagcaaggtcactgacatccgcaacgtggacttcgccgaggtgcgcaaggtgttcgacatcaacgtgcacggcgtgttcatgggcatgaagcacgcggcgcgcgtcatgatcccccggaagcggggctccatcgtgtccctggcgagtgtggccagcgtcatcggcgggatgggcccgcacgcgtacacggcgtccaagcacgccgtcgccggcctcaccaagagcgtcgccggcgagctcgggcgccacggggtgcgcgtgaactgcgtctcgccgtacgccgtgcccacggcgctgtccatgccgcacctgccaaagggcgcgcgcgccgacgacgcggtcaaggacttcctggccttcgccggcggcgccgccaatctgaagggcgtcgacctgatgcccgaggacgtcgccgaggcggtgctctacctggccagcgacgaggcgaaatacgtcagcgcgctcaacctcgtggtggatggtggcttcacatccgtgaaccatgatatgaagcagttcgaggattaactcaagctgttagcaacattaatcactatgccaattctgggagcattgtcactataaatttttatgatcttctctataattttgatcaaatataaaataatttaattctataagaaagaaagttggaat

SEQ ID NO: 1826 - DNA, 1094 bp, Setaria italica
cgcaattggtgcagctagcgtggacggccgtgacttgcttttacatgagccgtgcgagatgagacacaaggagaggaggagatttttctgacgctcccgtctcgccgcgcaccgatcgaattcgcgacgccggaggcagaggatccaatccagagagaccatgtccgccgctgcctcctcgccatcctcctcctccatgacgaagcggttggaagggaaggtcgccctcgtcaccggcggtgccagcggtatcggtgaaaccatcgttcgcctcttcaaaaaccatggcgcgaaggtctgcatcgcggacatccaggacgaggccggccagaagctacgcgacgccctcggaggtggcgacgacgtcatgttcgtccactgcgacgtcacggtcgaggaggacgtgagtgccgccgtcgacgcggtggcccagaggttcggcgcgctggacgtcatggtgaacaacgccggcatcacggggagcaaggtcactgacatccgcaacgtggacttcgccgaggtgcgcaaggtgttcgacatcaacgtgcacggcgtgttcatgggcatgaagcacgcggcgcgcgtcatgatcccccggaagcggggctccatcgtgtccctggcgagtgtggccagcgtcatcggcgggatgggcccgcacgcgtacacggcgtccaagcacgccgtcgccggcctcaccaagagcgtcgccggcgagctcgggcgccacggggtgcgcgtgaactgcgtctcgccgtacgccgtgcccacggcgctgtccatgccgcacctgccaaagggcgcgcgcgccgacgacgcggtcaaggacttcctggccttcgccggcggcgccgccaatctgaagggcgtcgacctgatgcccgaggacgtcgccgaggcggtgctctacctggccagcgacgaggcgaaatacgtcagcgcgctcaacctcgtggtggatggtggcttcacatccgtgaaccatgatatgaagcagttcgaggattaactcaagctgttagcaacattaatcactatgccaattctgggagcaaggtcactgacatccgcaacgtggacttcgccgaggtgcg

SEQ ID NO: 1827 - DNA, 4110 bp, Setaria italica
gctcttgcgatttcttgatccgccatcctgcgctgctcaattccgattctttttgttcggatttgagtagctgcggggcttcggcgatcacttgattggtttccccgattccttttccttgtttatcccccacttgtgcgaattggggattctcaaccgtttggtctctgggatattattgatctggaataaaaccagttcggggttctggtttcctgcttgccgagctcatcgagatcactagctccacctgccaatggacgaatccggggaagcaagcgtcggcgccttcaggatcgggccgtcgacgctgctcggccgcggggtcgcgctccgcgtgctcctcttcagctcgctgtggcgcctgcgggcgcgcgcgtacgccgccatctcgcgcgtgcgcaccacgacggtgccggcagtggcgtcctggctgcacctcaggaacacccacggcgtcctcctgatggtcgtcctcttcgcgctcttcctgaggaagctctccggcgcgcggtcgcgggcggcgctggcgcgccggcgtagcctgtgcgagaaggccatgcgtcatgccggcacgtacgaggagtgggtgcgcgccgccaaggtgctcgacaagatgtctgagcaggtacatgaggcggatttctacgacgaggagctcatcaggagtaggcttgaggagctccgcaggcggagggaggataggtcgctccgggatgtggtgttctgtatgcgtggtgatctcgtgaggaacttggggaacatgtgcaatcctgagcttcacaaaggcaggcttgaggttcctaagcttataaaggaatacattgatgaggtttctactcaattgaaaatggtgtgtgaatctgacgctgacgagttgctgttggaagagaagcttgcctttgttcaggagaccaggcattcctttgggaggacagcactactcttaagtgggggtgcctcactggggtctttccatgtaggtgtagtgaaaacattggttgagcataagcttttgcctcggattatagcaggatcaagcgttggctccattatatgttcaatcgttgctacccgaacttggcctgagattgagagctacttcatagattcattacagaccttgcagttctttgataggataggtggaatttttgcagtgatgaagcgtgtcaccacttatggtgcactacatgacattagtcagatgcaaaggcttctgagggatctcacaagtaacttaacatttcaagaggcttatgacatgactggccgtgtccttgggatcactgtttgctctcctagaaaaaatgagccaccccgctgcctcaactatctgacagcacctcatgttgttatctggagtgctgtaaccgcctcttgtgcatttcccgggctcttcgaagctcaggaactgatggcaaaggatagattcggcaacatagttcccttccatgcacccttttccacagatcctgaacaaggtcctggggcctcaaagcgccggtggagagatgggagcttggagatggatttgcccatgatgagactcaaggaattgtttaatgtaaatcatttcatcgtgagccaaactaaccctcacatttccccactcctccgaatgaaagagcttgtcagagcctatggaggccgctttgctggaaagcttgctcgtcttgctgagatggaagttaagtatcgatgcaaccaaattctagagcttggtcttccaatgggaggacttgcaaagttgtttgctcaggactgggagggtgatgtcaccatggttatgccagcaacagtagctcagtatttgaagattatacagaatccaacatatgcggaacttcagatggctgccaaccaaggccgcaggtgcacatgggagaagctctctgcaatcagagcaaactgtgccattgaacttgcattggatgaatcgatagcagttttaaaccacaaacggaggctaaaaagaagcattgaaaggacagcggcttcccagggacattctaactatgttcgactcaaaacaccaaggagggtaccatcatggaaccgcatcagtcgagagaattcttcagaatctctctctgaagaaatttctgcagttgctacttcatccacgcaacagggtactgttcttgttgttggcacacccccttcagaatctctctctgaagaaatttctgcagttgctacttcatccacgcaacagggtactgttcttgttgttggcacaccaaatacttctcaccacgttcggcgcaattctcatgacggaagtgagagtgaatcagaaaccattgaccttaattgctggaccagaagtggtgggcctctgatgaggacagcatctgctgacaagttcatcagttttatccaaaatcttgagactgacactgatttcattaagccctgtactctagagggtgagactacaggcattttgtcggaatctacctttccaaacgacccatgcccaaacaatagttctagagttactacaccaggcacagaaatttctgagaccgagtcatacaacactgtcaacaccagaggtagtcaagcttctactcccacaagcatcgctgtttctgaaggagatttgctgcaacctgaaagcactgctaacggtattctacttaacatcgtgaaaagagatgctctgcatgctcaacatgacagtgtagctgaattagccgaaaggtccttggctgaagcatatgttgaaccttgtggcgccatctcagggtctgactctactgaagatagcaaggatgcagctgactcaagcaatccctcacctgataatgctgattctgtaacttcacatcaattttcagctgatgattagattcttgattttgaaaggtcatgatatagttcactacagaaacgctgtacaggaaaattgctctagctcaattaaaagagcacgggtagcatatatgttatgtcaatgttagtattggcatctatattgtgtgttgcaagtatgatgatgtactaacacgatgtgcccaagtattggaagagcagttcttatatttcattaagtctcatcgcgagaaagtttatctgatcacacgctgctggaaattaattcttgcacattctcattgatcatacacacgaattcggcactgtttatttcgaaggtccaatcagttgccctacattcatgtaccgggctcattagtcttgcggacgcttaatcttgctacaaatatagcacatgccacatctcggaacagcagtgccaatactcgcagagcagagctggcataatgctgcgaacagctttgaactaatcctcgaacggtttcaggttatggttcacggctgtgaagccaccgtccaccgtgaggttgagcgcgctgacgtacctcgcctcgtcgcttgccaggtagagcaccgcctcggcgacgtccctgggcatcaggtcgacgcccttgaggttggcctcgccgccgacgaaggccaggaagtccttcaacgcgtcgtcggcgcgcgcgccctgcggcaggtgcggcatggacagcgccgtgggcacggcgtacggcgagacgcagttcacgcgcaccccgtggcgcccgagctcgccggcgacgctcttggtgaggccggcgacggcgtgcttggacgccgtgtacgcgtgcgggcccatcccgccgatgacgctggccacgctcgccagcgacacgatggagccccgcttctgggggatcatgacgcgcgccgcgtgcttcatcccgaggaacacgccgtgcacgttgatgtcgaacaccttccgcacctcggcgaagtccacgttgcggatgtcagtgaccttgcttcccgtgatcccggcgttgttcaccatgacgtccagcgagccgaaccgctgggccaccgcgtcgacggcggcgctgacttcgtcctcgaccgtgacgtcgcagtggacgaacatgacgtcctggtctccgagggcgtcgcgcagctgctggccggcttcgtcctggatgtccgcgatgcagatcttcgcgccatgctctctgaagaggcgaacgatggcttcaccgatgccggtggcaccaccggtgacgagggcgaccttcccttccagcc

SEQ ID NO: 1828 - DNA, 1101 bp, Brachypodium distachyon
gcagcgcacaccccactctgctcctgcacgaagcaccgcaaggtccgcaagccccggagccggcgacgaagccggaggagctccaagctctctgagaagagacgatgtctgcagccgccgccgtctcctcctcgtcctcgccgcgaaggttggaaggaaaggtcgcgcttgttaccggtggagcttcaggtatcggcgaagccattgttcgcctcttcagacagcacggcgcgaaggtctgtatcgcagacgtccaggacgaggccggccagcaggtccgcgactccctcggagacgatgccggcacggatgtcctgttcgtccactgcgatgtcacggtggaggaagacgtgagccgagccgtggacgccgcggccgagaagttcggcaccctggacatcatggtcaacaatgccggcatcaccggcgacaaggtcacggacatccggaacctcgacttcgccgaggtcaggaaggtgttcgacattaacgtgcacggcatgctgctggggatgaagcacgcggcgcgcgtcatgatcccgggcaagaaggggtccatcgtctcgctggcgagcgtcgccagcgtcatgggagggatggggcctcacgcgtacacggcgtcgaagcacgccgtggttggcctcaccaagagcgtggccctggagctgggcaagcacggcataagggtgaactgcgtgtccccctacgccgtgccgaccgcgctctccatgccgcatctgccccagggggagcacaagggtgatgccgtgagagatttcctggcctttgttggaggtgaagccaacttgaaaggcgtggatctgctgcccaaggatgttgctcaggcagtgctttacttggctagcgatgaagcgaggtatatcagtgcgctcaacctcgtggtggacggtggatttacgtctgtgaatccaaatctgaaagcatttgaggactagtgcaggtttttagctaccttctgatttcatggaccttgatcaattgcctgtattaattaagtatgtcaataaggtggataaccatatgtaaaattggataatgattatgtatcagtgtttaagggcagttttgattcttacatca

SEQ ID NO: 1829 - DNA, 1328 bp, Brachypodium distachyon
accgatacgtaataaactggaacgacgagacctttctcgccactccacacatcgcatcgcaccggccagagcgcggcggaatcaagcagagacacgtggaaatttccttgcaaagtcaaccagatcaggagacacagtggtagcagcgcacaccccactctgctcctgcacgaagcaccgcaaggtccgcaagccccggagccggcgacgaagccggaggagctccaagctctctgagaagagacgatgtctgcagccgccgccgtctcctcctcgtcctcgccgcgaaggttggaaggaaaggtcgcgcttgttaccggtggagcttcaggtatcggcgaagccattgttcgcctcttcagacagcacggcgcgaaggtctgtatcgcagacgtccaggacgaggccggccagcaggtccgcgactccctcggagacgatgccggcacggatgtcctgttcgtccactgcgatgtcacggtggaggaagacgtgagccgagccgtggacgccgcggccgagaagttcggcaccctggacatcatggtcaacaatgccggcatcaccggcgacaaggtcacggacatccggaacctcgacttcgccgaggtcaggaaggtgttcgacattaacgtgcacggcatgctgctggggatgaagcacgcggcgcgcgtcatgatcccgggcaagaaggggtccatcgtctcgctggcgagcgtcgccagcgtcatgggagggatggggcctcacgcgtacacggcgtcgaagcacgccgtggttggcctcaccaagagcgtggccctggagctgggcaagcacggcataagggtgaactgcgtgtccccctacgccgtgccgaccgcgctctccatgccgcatctgccccagggggagcacaagggtgatgccgtgagagatttcctggcctttgttggaggtgaagccaacttgaaaggcgtggatctgctgcccaaggatgttgctcaggcagtgctttacttggctagcgatgaagcgaggtatatcagtgcgctcaacctcgtggtggacggtggatttacgtctgtgaatccaaatctgaaagcatttgaggactagtgcaggtttttagctaccttctgatttcatggaccttgatcaattgcctgtattaattaagtatgtcaataaggtggataaccatatgtaaaattggataatgattatgtatcagtgtttaagggcagttttgattcttacatcagtactattcttataatcttgtgagataatatgggcttgtttaacattcaattgaagtttcatcaagacttatgtgccagttctgg

SEQ ID NO: 1830 - DNA, 1399 bp, Zea mays
accgctaatgtaccttgtggtttattttattaattagtcaatgggtcttaacccaattattcaacacacgaaacgccaaatgcccggtgcgctgtcgtttactggcccacgtgcgccagctcctccacccagattttgacaacgccttcccaacttgctcgctcccgcaacgacagcgcgcacttggattcggcgaccaccggagcgcggaggaggcacaggcgccgatctaaagacgatggccgccgcgggctcctcgccgtccttctcctcctcgagtaagcgggcgatgaattgaaggatccacccaggccaagcactggtgctctgtgcttatcttttagcgagcgaagtggtcatttccccctctcttctttatgggaggaaaataggaaatggtgtgccaagtgtatcctcaaccattctactgttccaaacgtgcagtatacatcggcatacagtcgatccagttgcaacaccatagctggaagggaaggtggccctcgtcactggtggcgccaccggcatcggtgaggccatcgttcgcctcttcatggagcacggcgccaaggtctgcatcgcggacatccaggatgaggctgggcagcagctgcgcgacgccctgggaggtgacgcgcagggcgccatgttcgtccactgcgacgtgacgtcggaggaggacgtgagccgcgccgtggacgctgcggcggagcggttcggcgcgctggacgtgatggtgaacaacgccggcgtgacgggcaccaaggtgacggacatccgcaacgtggacttcgcggaggcgcgcagggtgctcgacgtcaacgtgcacggcgtgttcctggggatgaagcacgcggcgcgcgctatgatcccgcggaagcggggctccatcgtgtcgctggccagcgtggccagcgccatcggcgggacgggcccgcacgtctacacggcgtccaagcacgccgtggtcgggctcaccaagagcgtcgccgcggagctcggccgccacggggtgcgcgtcaactgcgtgtccccctatgccgtgcccacggcgctgtcgatgccgcacctgccccagggcgcgcgcgcagatgacgcgctcaaggacttcctggcctttgtcggcggcgaggccaacctcaagggcgtcgacgccatgcccgaggacgtcgcccaggcggtgctctacctggccagcgacgaggcgaggtacgtcagcgcggtcaacctcatggtggacggaggcttcacagccgtaaacaataacctcagggcgtttgaggattagttgaggcatttatgccagctctgggattgggagggagtattaccgctatttcttctgctgttgtgacaagtgtgtgcaagactaataaaccgcagcatgttcatgtagcca

SEQ ID NO: 1831 - DNA, 1547 bp, Zea mays
cacgaaacgccaaatgcccggtgcgctgtcgtttactggcccacgtgcgccagctcctccacccagattttgacaacgccttcccaacttgctcgctcccgcaacgacagcgcgcacttggattcggcgaccaccggagcgcggaggaggcacaggcgccgatctaaagacgatggccgccgcgggctcctcgccgtccttctcctcctcgagtaagcgggcgatgaattgaaggatccacccaggccaagcactggtgctctgtgcttatcttttagcgagcgaagtggtcatttccccctctcttctttatgggaggaaaataggaaatggtgtgccaagtgtatcctcaaccattctactgttccaaacgtgcagtatacatcggcatacagtcgatccagttgcaacaccatagtacggtgctgctccatctccatccagtagctgtgcctgtgtttttgtccttcagatttgatcttgcgtttcttgccccaaacacaggctggaagggaaggtggccctcgtcactggtggcgccaccggcatcggtgaggccatcgttcgcctcttcatggagcacggcgccaaggtctgcatcgcggacatccaggatgaggctgggcagcagctgcgcgacgccctgggaggtgacgcgcagggcgccatgttcgtccactgcgacgtgacgtcggaggaggacgtgagccgcgccgtggacgctgcggcggagcggttcggcgcgctggacgtgatggtgaacaacgccggcgtgacgggcaccaaggtgacggacatccgcaacgtggacttcgcggaggcgcgcagggtgctcgacgtcaacgtgcacggcgtgttcctggggatgaagcacgcggcgcgcgctatgatcccgcggaagcggggctccatcgtgtcgctggccagcgtggccagcgccatcggcgggacgggcccgcacgtctacacggcgtccaagcacgccgtggtcgggctcaccaagagcgtcgccgcggagctcggccgccacggggtgcgcgtcaactgcgtgtccccctatgccgtgcccacggcgctgtcgatgccgcacctgccccagggcgcgcgcgcagatgacgcgctcaaggacttcctggcctttgtcggcggcgaggccaacctcaagggcgtcgacgccatgcccgaggacgtcgcccaggcggtgctctacctggccagcgacgaggcgaggtacgtcagcgcggtcaacctcatggtggacggaggcttcacagccgtaaacaataacctcagggcgtttgaggattagttgaggcatttatgccagctctgggattgggagggagtattaccgctatttcttctgctgttgtgacaagtgtgtgcaagactaataaaccgcagcatgttcatgtagccaacagatgattgaacattccaagtatcattgctgaattcacgcatatagttgctcttcaaatagatcaagtacaatttcgtcctacagcgttgctgctgtggctatataatgaccttccaaaatcaag

SEQ ID NO: 1832 - DNA, 3779 bp, Triticum aestivum
gccaaggtgctcgacagaatgtccgaccaggtcaatgagtcggatttctacgacgttgagctcatcgggagcaggctcgacgagctccggcggcggagggaggagggatcgctccgggacgtggtcttctgcatgcgcggcgatctcgtcaggaacttggggaacatgtgtaatcctgagctgcacaaaggcaggttggaggtgcctaggctaataaaagatttcattgacgaggtttcgactcaactgaaaatggtgtgtgaatctgatacagatgaattacttttggaagagaagcttgcctttgttcaggaaaccagacatgcctttggaaggactgcgctactcttaagtgggggtgcttcactggggtcattccatgtaggtgtagtgaaaactttggttgagcataagcttcttcctcggatagtggcaggatcgagtgtgggttccattatatgctcaattgtcgctacccggacatggcctgagattgagagcttcttcatagactcactacagatcttaaagttctttgataggataggtggagtttttgctgttacaaaacgggttatgacttatggtgcacttcatgacattagccagatgcaaaggcttttgagggatctcacaagtaacttaacatttcaagaggcttacgacataactggccgtgttcttggggtcactgtttgctctcctagaaagaatgagccacctcgctgcctcaactacctgacatcaccacatgttgtcatttggagtgctgtaactgcctcttgtgcattcccgggcctctttgaagctcaggagctgatggcaaaggatagatttggccacatagttcccttccatgctccctttgccacagatccagaacaaggtcctggagcatccaaacgccggtggagggacggaagtctggagatggatttgccaatgatgcaactgaaggagttgttcaatgtaaatcatttcattgtgagccaaactaatcctcacatctctccactcctccgaatgaaggagatcgtcagagcctatggaggccgctttgccggaaagcttgctcgtcttgctgagatggaggtgaagtatcgatgtaatcaagttctggaaattggcctcccactgggaggacttgcaaagttgtttgctcaggattgggaaggtgatgtcaccatggttatgccagcaacagtagctcagtacttgaagattatacaaaacccgacatatccagagctccaaatggctgccaaccagggtcgcaggtgcacatgggagaagatctctgcgatcagagcaaactgtgcaattgaacttgcattggatgaatccatagcagccctcaaccacaaacgaaggctaagaagaagcattgaaagggcagcagcttcttcccagggatataccgacaatgttcgagtcaaaacaccaaggagggtaccatcatggagctgcataagtcgagagaattcatcaggatctctctcagaagatcacttcgcggccgccatttcatccaatcaccaaggtactattcgagttgatggtgcaccaagcacgtctcatcatgttcgtcataggtcacatgacggaagtgagagcgaatcagagaccatcgacctaaattcatggaccaggagtggcgggcccctgatgaggacttcatcagctgaccagttcatcaactttatccagaatctcgagattgagtccgagtttgatggggttcatacaatagagggtggcaatgcaggtattttcacaggacccacatttcctagagatccatatccaaccaacatttccagagctactacaccagacggcccagatagatgcacagaggtttctgaaacagagtcatgcaacagtactagcaacgtaagcatcgctgtgtctgaaggagatctgctgcaacctgggaggactaccaacgggattctacttaattttgtcagaagagaagatctgattgctcggcataacggcgatgctgacgtggccgagagctccttacctcaagcatatgtggacagaacacattcagaatcgggtgacgccatctcagctgcttctgacagctctgaagataacaaagatgtggctgactcggacaatccctcggtttctcatacagattttgtaactccgcctcaaccctctgttgacgataacgaagatgctaagctagattttaaataattcttaatggtttggtgcagcaacaatgatgtacgtatatgataattgcagtgtctatttagagagcactgctgacagcagcatatctgttgtgtgaagtagatgattggtactgatgatacattgatagaagcctttcttggcgtcgacataaatggaattcagtgtttgttgtaccacaggctctacctggtcaagattcttctgaactaaacacacattataacaactctggaaatccatttctgtacacatattcagttatcatatacacgcacaaaaattctgagaaaatcatatatgaactgatagggcttctgactcaaattttgaagctcaatggtttctatcccgcagatatactggcacagaagtctttatgaaactcttaactgaatgttacacaaggtcctaacacacccaacaggttcaacagagtaatatcaataataatcaacactgtccttaagcactaatatagaataattatccaattttacacatgatcacccaccttattgacatgctaacacaggcaaatcagaaatggtactcaaatgctttcagataccaagtaacaaatgcagctaaagacttcaactagtcctcaaacgccttcaggttgccattcacggaggtgaatccgccgtcgaccacgaggttgagcgcgctgatgtacctcgcctcgtcgctcgccaggtagagcaccgcctcggcgacatccttcggcagcagatcaacacctttcaggtttgcctcactgccaacaaaggccaggaagtccctcactgcatcacccttctgctctccttggggtaaatgcggcatggagagcgctgtgggcacggcgtagggggacacgcagttcacccgtatgccatgcctccccagctccaatgccacactcttggtgagacccaccaccgcgtgcttcgacgcggtgtatgcgtgaggccccatccctccaatgacactggcaacactcgccaacgacacaatggatcccttcttgttcgggatcatgacacgcgccgcgtgcttcatgccgagaagcatgccgtgcacgttgatgtcgaacaccttcttgacatcagcaaagtcgaggttccggatatcggtaaccttgtcgcctgtaatgccggcattgttgaccatgatgtcgagggtgccaaacttcccagccgccgcatcgacggcccggcttatgtcctcctccacggtgacgtcgcagtgcacgaacaggacatcggggtcgcctccgagggagtcgcggagctgctgcccggcttcatcctggatgtccgctatgccaaccttggcgccgtgctgtctgaagaggcggacgatggcttcgccgataccggaggcgccgccggtaaccagcgcaacctttccttccaaccgcggcgctggagtggaggacgaggaggagctgccgccggcggcggccgacatcgtctcgggagtggagctccggcttcgtcgccggcccgggcgtcgtggggagagaggcagacgcagaggcagagcgtgagagcttccactgaataatgctcttgctggtc

SEQ ID NO: 1833 - DNA, 1315 bp, Triticum aestivum
gcggggaccagcaagagcattattcagtggaagctctcacgctctgcttctgcctccccacgacgccccgccccgcccgtcccgtcccggcaacgaagccggagctccactcccgagacgatgtcggccgccgccggcggcagctcctcctcctccacatcagcgccgcggttggaagggaaggttgcgctggttaccggcggcgcctccggtatcggcgaagccatcgtccgcctcttcagacagcacggcgccaaggtttgcatagcagatgtccaggatgaagccggtcagcagctccgcgactccctcggaggcgaccccgatgtcctgttcgtgcactgcgacgtcacagtggaggaagacataagccgggccgtcgatgcaacagccgagaagtttggcaccctcgacatcatggtcaacaatgccggcattacgggcgacaaggtcaccgatatccggaacctcgactttgctgatgtcaagaaggtgttcgacatcaacgtgcacggcatgctgctgggcatgaagcacgcggcgcgcgtcatgatcccgagcaagaaggggtctattgtctcgttggcgagcgttgccagtgtcatcggagggatggggcctcacgcatacaccgcgtcgaagcacgcagtggtgggtctcaccaagagtgtggcattggagctggggaggcatggcatacgggtgaactgcgtgtcgccgtacgccgtgcccacagcgctctccatgccgcatttgccccagggggagcaaaagggtgatgcagtgagagacttcctggcctttgttggcagtgaggcaaacctgaaaggtgttgatctgctgccgaaggatgtcgccgaggcggtgctctacctggcaagcgacgaagcgaggtacatcagcgcgctcaacctcgtggtcgacggtggatttacatctgtgaatggcaacctgaaggcgtttgaggactagttgaagtctttagctgcatttgttacttggtatctgaaagcatttgagtaccatttctgatttgcctgtgttagcatgtcaataaggtgggtgatcatgtgtaaaattggataattgttctatattagtgcttaaggacagtgctgattattattgatattactctgttgaacctgttgggtgtgttaggaccttgtgtaacattcagttaagagtttcataaagacttctgtggcagtatatctgcgaaatagtagaaatcagtgagcttcaacatttgagttggaaaccctattagttcataattcatatatgattttcttagaaaaaaaaaaaaaaacga

SEQ ID NO: 1834 - DNA, 1283 bp, Triticum aestivum
accagcaagagcattactcagtggaagctctcacgctctgcttctgcctccccacgacgccccgccccgcccgtcccgtcccggcaacgaagccggagctccactcccgagacgatgtcggccgccgccggcggcagctcctcctcctccacatcagcgccgcggttggaagggaaggttgcgctggttaccggcggcgcctccggtatcggcgaagccatcgtccgcctcttcagacagcacggcgccaaggtttgcatagcagatgtccaggatgaagccggtcagcagctccgcgactccctcggaggcgaccccgatgtcctgttcgtccactgcgacgtcacagtcgaggaagacataagccgggccgtcgatgcaacagccgagaagtttggcaccctcgacatcatggtcaacaatgccggcattacgggcgacaaggtcaccgatatccggaacctcgactttgctgatgtcaagaaggtgttcgacatcaacgtgcacggcatgctgctgggcatgaagcacgcggcgcgcgtcatgatcccgagcaagaaggggtctattgtctcgttggcgagcgttgccagtgtcatcggagggatggggcctcacgcatacaccgcgtcgaagcacgcagtggtgggtctcaccaagagtgtggcattggagctggggaggcatggcatacgggtgaactgcgtgtcgccgtacgccgtgcccacagcgctctccatgccgcatttgccccagggggagcaaaagggtgatgcagtgagagacttcctggcctttgttggcagtgaggcaaacctgaaaggtgttgatctgctgccgaaggatgtcgccgaggcggtgctctacctggcaagcgacgaagcgaggtacatcagcgcgctcaacctcgtggtcgacggtggatttacatctgtgaatggcaacctgaaggcgtttgaggactagttgaagtctttagctgcatttgttacttggtatctgaaagcatttgagtaccatttctgatttgcctgtgttagcatgtcaataaggtgggtgatcatgtgtaaaattggataattgttctatattagtgcttaaggacagtgctgattattattgatattactctgttgaacctgtgagatgtgacaggaccttgtgtaacattcagttaagagtttcataaagacttctgtggcagtatatctgcgaaatagaaaccagttaacttcgaaaatttgagttggaagccctgttagttcatatatgattttctcaga

SEQ ID NO: 1835 - DNA, 1070 bp, Pseudoroegneria spicata
  misc_feature (4)..(6): n is a, c, g, or t
  misc_feature (8)..(8): n is a, c, g, or t
attnnntntaagctctcactctctgccccacgacgcaccgcccgctcgagccggcgacgaagccggagctccacccccgagacgatgtcgttcgccgccggcagctcctcctcctcttcagcgccgcggttggaaggaaaggttgcgctggttaccggtggcgcttcgggtatcggcgaagccatcgtccgcctcttcagacagcacggcgccaaggtttgcatagcagatgtccaggatgaaaccggtcagcagctctgcgactcccttggaggcaaccctgatgtcctgttcgtccactgcgatgtcacagtcgaggaagacataagccgagccgtcgatgcaacagccgagaagtttggcaccctcgacatcatggtcaacaatgctggcattacgggcgacaaggttactgatatccggaacctcgactttgctgatgtcaagaaggtgttcgacatcaacgtgcacggcatgctgctcgggatgaagcacgcggcgcgcgtcatgatcccgagcaagaaggggtccatcgtgtcgctggcgagcgttgccagtgtcatcggagggatggggcctcacgcatacaccgcgtcgaagcacgcggtggtgggcctcaccaagagcgtggcgctggagctggggaggcacggcatacgggtgaactgcgtgtcgccatacgccgtgcccacggcactctccatgccgcatttgccccagggggagcacaagggtgatgcagtgagggacttcctggcctttgttggcagtgaggcaaacctgaaaggtgttgatctgctgccaaaggatgtcgccgaggcggtgctctacctggcaagcgacgaagcgaggtacatcagcgcgctcaacctcgtggtcgacggtggatttacatctgtgaatcgcaacctgaaagcgttcgaggactagttgaagtttttagctgcagttgttactttgtatttgaaagcatttgagtaccatttctgatttgcctgtgttagcatgtcaataaggtgggtgatcatgtgtaaaataggataattatcatatattagtgcttaaagaca

SEQ ID NO: 1836 - DNA, 965 bp, Zea mays
acactattccacagaccccattggtcatctccaaaaccccaaaccctcgttcaacatagccattatccgaagttccgaacccacgccaagccccagggtccgaccgcagaaccgacccaaaatgtcgcccgcctcttccatgctcaccgccgtgtcgctctcctccccgctcccagccccgcgcctccgcgccgccgccgccgcctcctccttcgctccgccgcgccgcgcggcagtcgcactcgtcgtgcgcgcggcgtccgcatcttccaagtcccctgccacggcggaggcggccccgaagaagaagagggcgaccggcatcacccagccgaagtccgtgtcgccggcgctgcaggcaatcgtgggcgacccggttattccccgcaccgaggtcctcaagcgcctctgggcctatatcaaggagcataacctccaggatccctctgataaaaaggtggtggtttgtgatgagaagctgaaggtcctgttcgcggggcgggagcgagtgggattccttgagatcgccaagcttctcaaccctcacttcgtgaagtgatgaggaggagccaggccacttccaggaatcgagttagcttatatggttggttggttacttgtggctggcctagagggtgcgcgtgcgttgggttttggtagcctgagttggctcgctcgactttgtagaatgctgttgttagcttttattagtagccttcagctcgtagcctggtatgcagttagcgtgtgtggtgttctgctatggtttaagtttaaccactgtccatagtcagtcaatgttagcttccttgtccttgcaatggatgttgctgtgtgaattatggtccaacatggattggttgctctgctatggtttagtcactgcccagtcagtctatatatattttttgatggtaacagtcagtctatatatcagcagagtgatcgctgttggctgagcttaa

SEQ ID NO: 1837 - DNA, 1499 bp, Zea mays
tagtatatatatcatcaaataccatgcgtgagttatgcacgcagtagggcgtcttgtcttaactcttaagccagctccgatgacaagctgcttcaacagcggcgccggctggccggagcccgtggtgcgcgtccaggccgtgtcggacacctgcggcgacacgatcccggagcggtacgtgaagcctctgccggagcggccccggctctcgccagcctccgatgtcggcggcggccggaacatcccagtcatagacctgtcaatgccagacgtggacgcgacatcccgtgctgtggcagcggcgtgccgggagtggggctttttccaggcagtgaaccacggcgttcgcccggagctgctgcgcggcgcgcgcgcggcgtggcgtggcttcttcaagcagcccgcggaggtgcgcgagcgctacgcgaactcgccgtcgacgtacgagggctacggcagccgcctcggcaccgctaagggaggccccctggattggggcgactactacttcctccacctcctgccgtcgtccctcaagaaccacgaaaagtggccttccctcccttactctctacggggcacgacggaggagtatggagaggaagtgttgcatctgtgccggagggtgatgcggctgctttccagcgggctgggactggaagccggaagactgcaggcggcgttcggcggagagggtggcgaaggggcgtgcttgcggatcaacttctacccgcggtgcccgcagccagaactcacgctgggcgtagcggggcactccgaccccggcggcatgaccatgctgctggtcgacgaccacgtgaagggcctgcaggtaaggggacccgacggacagtggatcatcgtcgaccccgtccccgacgccttcattgtcaacatcggtgaccagatccaggtgctgagcaacgcggcatacaagagcgtggagcaccgagtgacggtgagcgccacggaggaccggctgtctatggctttcttctacaacccgcgaagcgacctgcccatcgcgccgatggcggagctggtggggccaggccggccggcgctgtacccggagatgaccttcgatgagtaccgcgtcttcattcggcaacgcggtttggccggcaaggcgcaacttgagtccatgcagaaagccgccgccaccgccgccgacggcggccgccgccagctcgtccaccagctagcagctactgaacatatcatctccagggccagctggtctgttagcgatgcataatcatcattgtcattggatggatcggtgaacaataatttgatgtttaatttctatagaaatgctggtggtgtacattcatcccatgtaactgagcagtaataatgtgcgtgtgtagatacatatgcatatatacaagtgtgtggaagtggaactcctatttgtgttgtgtgttacttgagttcacaagagaagtcatgcaaaccaggataatgatccaaatcaatactactaatgatctatt

SEQ ID NO: 1838 - DNA, 1960 bp, Zea mays
ggttttcaaaaactttattctcaaacagggccttactaagttaaaaaaaaggtggaagtcgtatccacaattcaatcaaacatgttctgaaagtagaccgtgtcatgtaaacacgcactaagttaaaaaaaaaagtggaagccgtgtccatgtattgtttcacagagatatactgagacgaaatccccagatgagactgaaaaatgatcgaccacgtcacctcgaaccttccacgcacacgctagcagtagcagccagcggctctccggcccccaacaaccgcgcgagcgcgacgacctactcctctctccgtgctgccattacatatagcgcagctgcaggctgcagctccgaccaagcaaaccttcatctatcgagtcgcccgtcaccacagctgatattgaggcgacgcgccggccgtccagatcaaccaaaaaagaaaaaaagaaaaaacagtagccatgtcgcggctcctcctcctcggggccgccgtgctgctgctcgcgtcggccgccacggcgcaggactgcctgtccgcgacgttcagcggcgggcggaccttcgggcggtgcaacaacctgccgtcgctgagcgccagcctgcactggacgtaccacccggagaacggcaccgcggacgtggcgttccgcgcgccgtcggacgccagcggctgggtcgcctggggcatcaaccccgaccgcggcggcagcatgggcggcagcagcgtcttcgtggcctcgccctcgcaggacggcagcggcgcggtgtccatcctcatgacccacctggagagcacgtcgcccagcctaaccaacaacacgctcaagttcaaggtgcccgtcggccccgccgccgagtactccaacggcgcctacaccatattcgccacggtggagcttcccggcaactccacgcagcagttcacggtgtggcaggccggcgcgaccagcaacggtgccatctcccctcacccgacggcgccggccaacttggccagcacccagaggctggacttcctctccgggtccagcaccgccgcctcaaactccaggcttcaccgccgtaacatccacggcatgctgaacgcgatcgcctggggcgtcctgatccccgtcggcgccatcatcgcgcggtacctgcgcgtgttcgagtccgcggacccggcgtggttctacctgcacatcgcgtgccagtgctccggctacatcctgggcgtggccggctggggcctggggctgaagctcggcagcgagtcggccggcgtcacctaccagccgcaccgcagcatcggcatcgccatcttctgcctggccacgctgcaggtgttcgcgctgctgctccggcccgacaagaagaacaggtacaggctgtactggaacatctaccaccactccgtcggctactccgtcatcgtcctcggtgccgtcaacatcttcaaggggctcgacatcctcaagccggacagcggctacaagaccgcctacattgtcgtcctggccacgctcggcggcgtcgcgctctgcctcgaggccatcacgtggcccatcgccatccggaagcgcaggcgtaacgccgccgacaaggcgtccaacggcaacggctggcagcagggtgcgtagggggccaggtcgatcgccgggctttgtgcgcgtgtgtggttgtgctatagttttgatgcgagagagaggtctgatatcgatgtgctgatgccgttgttcagagagagagatcgttgctgatgtgtttctttcctgttactactgcctctgtagtctgtactcctacctagaagagtagctcctttgattttttttcttctgttttgttgttgaattttattagggttctatagtgccatttgtacacattttttcccttcttattgatgtacgtacgactgctttgattactgtatggtttcagtcagatgacacggctttccttactgctcaagttaaaa

SEQ ID NO: 1839 - DNA, 1826 bp, Zea mays
ccacctagagacccttttcacaatatcaagagaagacgaccgtgtcatgtaaacacgcacagagccccgccccaaccaacacacacaccaaaaaaagaagcagcagccgcatcattgtgttgtttcacatagatatatcatgcataagatactatcggagacgaaatccccagatgacactgcaaaatgatcgaccatgtcaacctcgaacgttccaggcacacgctatcgaccagcggctctccggtccccaacaaccgcgcgacgacctcctcctctccccgtgctgccattacatatagcgtagctggactttccctccctcaccagctgcagctccgaccaagcctgtttgctgccttcgtccatcaagtatccatggcgcggctcctcctcctcctcctcggggcctccgtgctgctgctcgcgtccgccgtcacggcgcaggactgcctgtccgcgacgttcagcggcgggcggacgttcggcaagtgcaacagcctgccgtcgctcagcgccagcctgcactggacgtaccacccggagaacggcacggccgacgtggcgttccgcgcgccgtcggaccccagcggctgggtcgcctggggcatcaaccccgacagcggcggcagcatggaagggagcagcgtcttcgtcgcctcgcaggacggcagcggcgccgtgtccatcctcatgaccaacctggagagcaccagccccagcctcaccaacaccaccgccctcaagttcaaggtgcccgccggccccgccgccgagtactccgaccgcgcgtacaccatctacgccacggtggagcttccccggaactccacgcagcagttcacggtgtggcaggccggcccagcgaccagcaacggtggcatctcccctcacccgacggcgccggccaacttggccagcacccagcggctggacttcctctccggctccagcaccgccgcgtcaaactccaagcttcaccgccgtaacatccacgggatgctgaacgcgattgcgtggggcgtcctgatccccacgggcgccatcatcgcgcgctacctgcgcgtgttcgagtccgcggacccggcatggttctacctccacatcgcctgccagtgctccggctacgtcctcggcgtggccggctggggcctggggctgaagctgggcagcgagtccgccggcgtcacctaccagccccaccgcagcatcggcatcgccatcttctgcctggccaccctccaggtgctggcgctgctgctcaggcccgacaagaagaacaagtacaggctctactggaacatctaccaccactccgtcggctacgccgtcatcgtcctcagcgccgtcaacatcttcaaggggctccacatcctcgagccggccagcggctacaagaccgcctacattgtcatcctggccacgctcgccggcatcgcgctctgcctcgaggccatcacgtggcccatcgccatccggaagcgcaggcggaacgccgacaaggcgtccggcggcaacggctggcagcagggtgcgtagtagggaccagatcgcccggcttgtgcttagttttgaatgcgagagagggatgtgatatcgatgtgctcatgtcgttgttcagagggatcgttgctgcttgtgctttctttctcttcctgttattactgcctctctagtctgtacttgtttatttattttatttatgtttcttctgttttgtttatttattttattattagggttccatattgccatttgtacacagtttttctctcttcttattattgactacgattactctgattagtgtatatattgtttccatc

SEQ ID NO: 1840 - DNA, 1448 bp, Saccharum officinarum
ggcgcacccacacgccaccgctcggtctcttgcttcctcccggcaccgccccgccacaagccatccgccatcatgtgggtgacgcaggtgtgggacgacgaggccgcgggcaagggcggcggcgcggcggtgacccccgcgccggccgcggccatgctgggctcgctggcggggtggctgtcccgcaccgtacagccgcagccgcccccgccacgggtgtgcggcaccgaggggggaccgcccgtgacggcgcccaggctcaggctccgcgacggccgccacctcgcctactgcgagagcggcgtgcctcgggaccaggccaggttcaaggtcgtcttctcccacgggttcaccggctcccgcgaggacagcgtccgcgcctcccaggaagtggcggaggagctgggcgtgtacatggtgggcttcgaccgcgctggctacgggcagagcgaccccaacccgaaccggtccgtcaagagcgcggcgctggacgtggaggagctcgcggacgcgctggggctcggccccaagttctacgtcatcggcatctccctcggctgccatgccgtctggggcgccctcaagtacatacccgacaggatcgccggcgcagcgatgatggcgccggtggtgaactactggtggccgggattcccagcggagctggcggcggaggtgtacgcgaagcaggaggtgggggaccagtgggcgctgcgggtgtcgcaccacgcgccgggcatcctccactggtggatggagcagagctggctgcccacgtcgacggtggtggccggcacgacgccgctgcccaacgcgcgcgacgccgagatccggcgcaacatgcaggcggacggcacgttccagcagaagcgggagcaggcgacgcagcaggggatccacgagtcctactaccgcgacatgacggtcatgttcggcaagtgggagttcgaccccatggcgctgccggagccgccgtgccccgtgcacctgtggcagggcgacgaggacggcctcgtccccgtcgtgctgcagaggtacctcgccggcaagctcgcctgggtcaactaccacgagctccccggcaccggacacttcctgtcggcggtgcctgggctcggagacaccgtcctcaggacccttttcggtcagaagcagtaacggcaaacagttcatcacgacgtatggacggtgctaagcttaaagtatactagtagtgtcagtcgtggcgcattagttcatttgttattgtaaggccgatgttgtcgctgattaacgatgataatggtgatgtagatgcaggatctttaaagtcaaatactatcagatatcagatatgtacatatagtcatacggtgatgtgatactgtttgcttgacttttcgaccctacttttttagcgaaggaacagtgtttttctcttacagcaaatcagccaacagtacttttta

SEQ ID NO: 1841 - DNA, 1400 bp, Panicum virgatum
ccggccatcaccagcagccagcaagcaaagctaaagggcaagcaagcatgtgggtgacctcgatgccgcaggtgtgggacgaggagggcgtccccaagcggggcgccgccgacgcggtgaccccggcgccggccgcggccatgctgagctccctcgcgggctggctctcccgcaccgtccagccgcagccgccgccgcccagggtgtgcggcaccgacggcggccctcccgtgacggcgcccaggctccgcctccgcgacggccgccacctcgcctactgcgagaccggcgtgcccaaggacaaggcgcgcttcaaggtcgtcttctcgcacggcttcaccggatcacgcgaggacaccgtcagaccctcgcaggaagtggccgaagagctgggcgtgtacatggtgggctttgatcgcgccgggtacgggcagagcgaccccaaccccaaccgctccgtgaagagcgcggcgctggacgtggaggagctcgccgacgcgctggggctcggccccaagttctacctgatcggcatctccctcggctgccatgccgtctggggcgccctcaagtacatccccgacaggatcgctggggcggcgatgatggctccggtggtgaactactggtggccggggttcccggcggacctggcggcggaggtgtacgcgaagcaggaggtgggcgaccagtgggcgctgcgcgtgtcgcaccacgccccgggcatcctccactggtggatggagcagagctggctgcccacttcgacggtggtggccggcacgaccccgctccccaacaagcgcgacgcggagatccggagcaatatgaaggcggacgggacgttccagcaaaggatggagcaggcgacgcagcagggcatccacgagtcctactaccgggacatgatggtcatgttcggcaagtgggagttcgaccccatgagcctgccccagccgccgtgccccgtgcacctgtggcagggcgacgaggacggcctcgtccccgtggtgttgcagcgctacctggccggccgcctcacctggatcaactaccatgagctccccggcaccggccacttcctgtcgtcggtgcccggactgggagacaccgtcctcaggaccctcttcgcctgatgatgagcagcagtttgagaagaacacttgggaagcatggacgggtgctaaccccttatttaaacgtacacatactccagtatagtactagctccgtggtgcattagtttcatttgttgtaaggccggttcgttagttgtcgctgtttattatagcgatggtaatgatcatgacgatgatatatatagatgatgcaaggtcccagtgcctgcaaagtactatttcttcgttcggaattctcatatttaaaggaacaatatcaga

SEQ ID NO: 1842 - DNA, 1500 bp, Panicum virgatum
ccacgcgtccgcaaggctagctgccttccgccaccagcccagcagccagcaagcaaaaggcaaggcaaagcatgtgggtgacgtcgatgccgcaggtgtgggacgaggagggcggcgccgacgcggtgaccccggcgccggccgcggccatgctgagctccctctcgggctggctctcccgcaccgtccagccgcagccgccggcgcccagggtgtgcggcaccgagggcggcccgcccgtgacggcgaccaggctccgcctccgcgacggccgccacctggcctactgcgagaccggcgtgcccaaggacaaggcgcgcttcagggtcgtcttctcacacggcttcaccggatcacgcgaggacaccgtcagaccctcacaggaagtggccgaagagctgggcgtgtacatggtgggctttgatcgcgccgggtacgggcagagcgaccccaaccccaagcgctccgtgaagagcgcggcgctggacgtggaggagctcgccgacgcgctggggctcggccccaagttctacctgatcggcatctcgctcggctgccatgccgtctggggcgccctcaagtacatccccgacaggatcgctggcgccgcgatgatggctccggtggtgaactactggtggccggggttcccggcggacctggccgcggaggtgtacgccaagcaggaggtgggcgaccagtgggcgctgcgcgtgtcgcaccacgccccgggcatcctccactggtggatggagcagagctggctgcccacgtcgacggtggttgccggcacgaccccgctccccaacaagctcgacgcggagatgcggagcaagatgatggcggacgggacgttccagcagaggaaggagcaggcgacgcagcagggcatccatgagtcctactaccgggacatgatggtcatgttcggcaagtgggagttcgacccgatgagcctgccccagccggcgtgccccgtgcacctgtggcagggcgacgaggacgggctcgtccccgtcgtgttgcagcggtacctggccagccgcctcagctgggtcaactaccatgagctccccggcaccgggcacttcctgtcgtcggtgcccggactgggcgacaccgtcctcaggacccttttcggctgatgcagatgcagcagcagcagcagtttcggaagaacacatggcaagtatggacgggtgctaattattattaaacctatactactccagtatagtagcgccgtggtgcattagtttcatttgttgtaaggccagttcgttggttgtcgctgattattacagcgacggtaatgatcatgaagatgatatatatagatgatgcaaggtcgcaccgccttcaaagtactatttgttcgttcagaattctcatgtttaaagggaagaagatatcagacactagtatagatatgttttgaaaggaggaaaaccggaattttgtccatcgttatttatctatctagattattgataccacaat

SEQ ID NO: 1843 - DNA, 1576 bp, Oryza sativa
atcggccgggtcacccaccaacacacgcaacggcgtaatcacacgcttataagtagcggtggttgacgcctgcgctcggtagcgggtgagcaagcaagccgatcggcagccacaccgcatatcatacactcatacacatttcgctcgaccgatccgcgcgcgcacggagaagatgtgggtgacgtcgatgccgcaggtgtgggacgaggagggggtggcgaagggcagcgtggtgacgccggcgccggcgacggcgctgctggggtcgctcgcgggatggatgtcccgcgccgtcgagccgccggcgccgaggccgtgcggcacggagggtggcccgccggtgaccgcgacgaggctgaggctgcgcgacggccgccacctcgcctactgcgagagcggcgtccccaaggaggaggcccgcttcaaggtcgtcttctcccacggcttcaccggctcccgcgaggacagcgtccgcgcctcccaggaggtggctgaggagttgggcgtgtacatggtaggctttgatcgcgctggatatggtgagagtgatccaaaccccaatcggtctgtgaagagcgctgccctcgatgttgaggagcttgcggacgctctaggattaggccccaagttctatgtgatcggtatctccctcggctgccatgctgtttggggcgccctcaagtacatcccagaaaggattgctggagcggccatgatggcaccggtggtgaactactggtggccggggttccctaccgatctggctgccgaggtgtacaacaagcaggaagtgggtgaccagtgggcgctgcgtgtttcacaccatgcacccagcatcctccactggtggatggagcagagctggcttcccacctccaccgtcgtggctggcaccactcccctccccaacaagcgtgatgccgagatccgcaaaaatatgaaggcggatggctcgttccagaagaaaatggacttggcgacacaacaaggcattcatgagtcgtactaccgtgacatgatggtgatgttcggcaagtgggagtttgacccgatgagcttgccgaagccgccatgccctgtgcatatctggcagggcgacgaggacgggcttgtgccggtggtgttgcagagatacctcgttagccggctcagctgggcgaactaccatgagctccccggaaccgggcacttcctgtctgcggttcccgggcttggagacaccgttcttaggaccattttcggttgagtatatgtagcagtcagaagaagcaacagttcagaatgctgatactaagttatagtgtcccacccggtacattacttcgtttaaatggtaaggctgttcgttactcgctgattagcgatgatgatgatatagatgaaagggcagtgtaaaatgagctgctctgttttttttttgtttttttggtgtaaaatggcgtggcccagatgctacccaaaaatgttctttgaccttggaaagaaagtgatagtattatacaatgtggactcttttgtttcgtactcctacatgttactacatctctacttacggtttcagcctgctccagtggcc

SEQ ID NO: 1844 - DNA, 1429 bp, Secale cereale
cgactacgaacctaccgcccgaccaaccctcgaccccgaccccacaagcaatcccaccaccacgcaacaaggacaaaccaagccgagccagcatgtgggtgacgtcgatgccgcaggtgtgggacgaggaggcgaggagccgcaagggcgacggcattatgtcgccggcgccggccgccgccatgctggggtcgctggcgggctggctgtcgcgcgccgccgacccgccggcgcccaagctctgcggctcgccgggcggcccgcccgtgaccgcgccccgggtcgccctgcgcgacgggcggcacctcgcctactgcgagagcggcgtccccaaggagcaggcacggttcaaggtcgtcttctcccacggcttcaccggctcccgcgaggacagcgtccgcgccgcccaggaagtggctgaagagctaggcgtgtacatggtgggttttgaccgtgccggatacggcgagagcgacccgaaccctaaccgatctgttaaaagcgcggcgcttgatgtcgaggagcttgctgacgcacttggattgggtcctaaattctatgttattggcatctcccttggctgccatgctgtctggggcgccctcaagtacatccctgaaaggattgctggagctgcaatgatggcgccggtggtgaactactggtggccgggcttccccgcggatctcaccgcggaggtgtacagcaagcaggaggtgggcgaccagtgggctctgcgcgtgtcacattacgcacctggcatcctccactggtggatggaccagagctggctgcccacctccaccgtcgtggccggtaccaccccgctccccaacaagcgcgacgccgagatccgtgccaagctcaaggccgatggcacattccagcagaagatggaactggcaacgcagcaaggcatccatgagtcgtactaccgcgacatgatggtgatgttcggcaagtgggatttcgacccgatgagcctgccgaaaccgccttgccccgtgcacatctggcagggcgacgaggacggtctggtgcccgtggtgctgcagaggcacatcgccagccggctcagctgggtgaactaccatgagctccccgaaaccgggcacttcctgtcgccggtccccgggctaggtgacaccgttcttcggaccctttttggcaatgctaagcaatgatcagcaacagcaacagcagctctgaacatactagttgctgaagtatagcgttcttccggtgcattgttttattctaaggtggtcaggttgtcgctgattagcgatgatgttataggtgaaatggtggtgtaacatcaagtgttttttgtggtggaaatcgcgcggccaggatgtgggcgcaaaatatgtaattgaacctttgaaacgagaaagtagtcgaactattataccatgatgatcttacc

SEQ ID NO: 1845 - DNA, 1611 bp, Triticum aestivum
accgctaccttagctccctttgcttccgtgcttataagtagcgcgacgcccgcgccgagttagccagcgaccgagcatcacctcacgtcctcacctcgcctcgcccacaagcaatcccaccaccaccactttcgccgcccgcccgcgcacgcaacaaggacaaaccaagccgagctcgatcgcggcctccaacgccagcaagccaacatgtgggtgacgtcgatgccgcaggtgtgggacgaggaggcgaggagccgcaagggcgacgacatgatgtcgccggcgccggcggccgccatgctggggtcgctggccggctggctgtcccgcgccgccgacccgccggcgcccaagctctgcggctcgccgggcggcccgcccgtgaccgcgccccgggtcgccctgcgcgacgggaggcacctggcctactgcgagagcggcgtccccaaggagcaggctcgcttcagggtcgtcttctcccacggcttcaccggctcccgcgaggacagcgtccgcgccacccaggaagtggccgaagagctaggcgtgtacatggtgggtttcgaccgtgccggatatggcgagagcgaccctaaccctaaccgatctgtgaaaagcgctgcgctcgatgtcgaggagctcgctgacgcgcttggattgggccctaaattctacgtgatcggcatatcccttggctgccatgctgtctggggcgccctcaagtacatccctgaaaggattgctggagctgcaatgatggctccggtggtgaactactggtggccgggcttccctgcggatctcgccgcggaggtgtacaacaagcaggaggtcggcgaccagtgggcgctgcgcgtgtcacattacgcccctggcatcctccactggtggatggaccagagctggctgcccacctccaccgtcgtggccggcaccacgccgctccccaacaagcgcgacgccgagatccgcgccaagctcaaggccgacggcacgttccagcagaagatggaactggcgacacagcagggcatccacgagtcgtactaccgcgacatgatggtgatgttcggcaagtgggagttcgacccgatgagcctgccgaagccgccttgccccgtccacatctggcagggcgacgaggacggtctggtgcccgtggtgctgcagaggcacatcgccagccggctcagctgggtgaactaccatgagctccccgcgaccgggcatttcctgtcgccggtccctgggctaggtgacaccgttcttcagacccttttcggcaatgctaagcaatgatcaggaacagcaatagtagctctgaacatactacgttgctgaagtatagggttcttccgatgcattgttttattctaaggtggtcaggtaatcgctgctgattagcgacgatgttataggtgaaatggtggtgtaacatcaagtgttttttgtggcggaaattgcgcggccaggatgtgcgcgcaaaatatgtaattgaaccttgggaacgagaaagtagtggaactactataccatgatgatcttaccttttactccgttacttatttcttggatatatcttgccttcctgtttctggtccaaaaaaaaaa

SEQ ID NO: 1846 - DNA, 1485 bp, Secale cereale
gactctcaccccgcccacaagcaatcccaccaccacgcaacaaggacaaaccaagccgagccagcatgtgggtgacgtcgatgccgcaggtgtgggacgaggaggcgaggagccgcaaggtcgacggcattatgtcgccggcgccggccgccgccatgctggggtcgctggcgggctggctgtcgcgcgccgccgacccgccggcgcccaagctctgcggctcgccgggcgggcccccggtgaccgcgccccgggtcgccctgcgcgacgggcggcacctcgcctactgcgagagcggcgtccccaaggagctggcccgcttcaaggtcgtcttctcccacggcttcaccggctcccgcgaggacagcgtccgcgccacccaggaagtggctgaagagctaggcgtgtacatggtgggttttgaccgtgccggatatggcgagagtgacccgaaccctaaccgatctgtgaaaagcgctgcgctcgatgtcgaggagctcgccgatgcactaggattgggccctaaattctacgtgatcggcatctccctcgggtgtcatgctgtctggggcgccctcaagtacatccctgaaaggattgctggagcggcaatgatggcgccggtggtgaactactggtggccgggcttccccgcggatctcaccgcggaggtgtacagcaagcaggaggtgggcgaccagtgggctctgcgcgtgtcacattacgcccctggcatcctccactggtggatggaccagagctggctgcccacctccaccgtcgtggccggcaccacgccgctccccaacaagcgcgacgccgagatccgcgccaagctcaaggccgacggcacattccagcagaagatggaactggcaacgcagcaaggcatccatgagtcgtactaccgcgacatgatggtgatgttcggcaagtgggatttcgacccgatgagcctgccgaaaccgccttgccctgtgcacatctggcagggcgacgaggacggtctggtgcccgtggtgctgcagaggcacatcgccagccggctcagctgggtgaactaccatgagctccccgaaaccgggcacttcctgtcgccggtccccgggctaggtgacaccgttcttcggaccctttttggcaatgctaagcaatgatcagcaacagcaacagcagctctgaacatactagttgctgaagtatagcgttcttccggtgcattgttttattctaaggtggtcaggttgtcgctgattagcgacgatgttataggtgaaatggtggtgtaacatcaagtgttttttgtggtggaaatcgcgcggccaggatgtgggcgcaaaatatgtaattgaacctttgaaacgagaaagtagtggaaccattataccatgatgatcttaccttttacttggtaccttatttcttggatatatcttgccttactgttgaattgtatcaagattttggaactggtcaaattacgca

SEQ ID NO: 1847 - DNA, 1445 bp, Triticum aestivum
ccgccacctcgcctcgcctcgcccacaagcaatcccaccacaccggctccatttttcaacttcgccgcccgcccacgcaacaagaagaaaccaaggcagccagcatgtgggtgacgtcgatgccgcaggtgtgggacgaggaggcgaggagccgcaagggcgacggcgacatgatgtcccccgcgccggcggccgccatgctggggtcgctggccggctggctgtcccgcgccgccgacccgccggcgcccaagctctgcggctcgccgggcgggcccccggtgaccgcgccccgggtcaccctgcgcgacgggcggcacctggcctactgcgagagcggcgttcccaaggagcaggcccgcttcagggtcgtcttctcccacggcttcaccggttcccgcgaggacagcgtccgcgccacccaggaagtggctgaagagctaggcgtgtacatggtgggtttcgaccgtgccggatatggcgagagtgacccgaaccctaaccgatctgtgaaaagcgcagcgctcgacgtcgaggagcttgctgacgcactaggattaggccctaaattctacgtgatcggcatctcccttggctgccatgctgtctggggcgccctcaagtacatccctgaaaggattgctggagctgcaatgatggctccggtggtgaactactggtggccgggcttccctgcggatctcgccgcggaggtgtacaaaaagcaggaggtgggcgaccagtgggcgctgcgtgtgtcacattacgcccctggcatcctccactggtggatggatcagagctggctgcccacctccaccgtcgtggccggcaccacgccgctccccaataagcgcgacgccgagatccgcgccaagctcaaggccgatggcacattccagcagaagatggaactggcaacacagcagggcatccacgagtcgtactaccgcgacatgatggtgatgttcggcaagtgggagttcgacccgatgagcctgccgaagccgccttgccccgtgcacatctggcagggcgacgaggacggcctggtgcccgtggtgctgcagaggcacatcgtcagccggctcagctgggtgaactaccatgagctccccgcgaccgggcatttcctgtcgccggtccccgggctaggtgacaccgttctccagacccttttcggcaatgctaagcaatgatcagcagcaacaacagcaacagcagctctgaacatactacgttgctgaagtatagcgttcttcgggtgcattgttttattctaaggtggtcaggttatcgctgattagcgacgatgttataggtgaaatggtggtgtaacatcaagtgttttttgtggtggaaatcgcgcggccaggatgtgcgcgcaaaatatgtaattgaaccttggaagttagaaacgagaaagtagtggaactactatacca

SEQ ID NO: 1848 - DNA, 1631 bp, Triticum aestivum
attcggcacgagcatcgacgccggagtccaatccgcgttcgtgcgatgcgtccacgccacggcagtcggtaggtgaagaacgctgcctccctcccggtcactcacccaccaactctccggccggtcagccaggccaccccttcgcctccctccgtgctcattataagtagcgtcacgcccgcgccgagttagccagcgaccgagaaccaccgccgccacctcgcctcgcctgcacgcaatcccaccgcaaccggtttcatctccaccgccggcgcacgcaacaacaaggacaaacgcctccagcgatgtgggtgacgtcgatgccgcaggtgtgggacgaggaggcgaggagccgcaagggcgacggcgacatgatgtcccccgcgccggcggccgccatgctggggtcgctggccggctggctgtcccgcgccgccgacccgccggcgcccaagctctgcggctcgccgggcggcccgcccgtgaccgcgccccgcgtcgccctgcgcgacggccggcgcctcgcctactgcgagagcggcgctcccaaggagcgggcccggttcagggtcgtcttctcccacggcttcaccggctcccgcgaggacagcgtccgcgccacccaggaagtggctgaagagctcggcgtgtacatggtgggtttcgaccgtgcgggttacggcgagagcgacccgaaccctaaccgatctgtgaaaagcgccgcactcgacgtcgaggagctcgctgacgcactaggattgggccctaaattctatgtgatcggcatctccctcgggtgtcatgctgtctggggcgccctcaagtacatccctgaaaggattgctggagctgcaatgatggctccggtggtgaactactggtggccgggcttccctgcggatctcgccgcggaggtgtacaacaagcaggaggtgggcgaccagtgggcgctgcgcgtgtcacattacgcccctggcatcctccactggtggatggaccagagctggctgcccacctccaccgtcgtggccggcaccaccccgctccccaacaagcgtgacgccgagatccgcgccaagctcaaggccgacggcacgttccagcagaagatggaactggcaacacagcaaggcatccatgagtcgtactaccgcgacatgatggtgatgttcggcaagtgggagttcgacccgatgagcctgccgaagccggcttgccctgtccacatctggcagggcgacgaggacggcctggtgcccgtggtgctgcagaggcacatcgccagccggctcagctgggtgaactaccatgagctccccgcaaccgggcatttcctgtcgccggtccccgggctaggtgacaccgttcttcagacccttttcggcaatgctaagcaatgatcagcaacagcaatagcagctctgaacatactacgttgctgaagtatagcgttcttccggtgcattgttttattctaaggtggtcaggtaatcgctgctgattagcgacgatgttataggtgaaatggtggtgtagcatcaagtgttttttgtggtggaaatcgcgcggccaggatgtgcgcgcaaaatatgtaattgaaccttggaagttagaaacgagaaagtagtgga

SEQ ID NO: 1849 - DNA, 1412 bp, Brachypodium distachyon
ttccgtttcgacgatcgaccatgtgggtgacctcgatgccgcaggtgtgggacgaagaggcccggagccggggcggcggaagcggcatggcggcgtcgccggcggccgcgctgctgggctggctgtcccgggcggccgacccgccggcgcccaagccctgcggctcccccggcgggccacccgttacggcgcccagagtcacgctcaaggacgggagacgcctggcctactgcgagagcggcgtgcccaaggagcaggcccggttcaaggtcgtcttctcccacggattcaccggctcccgcgaggacagcgtccgggccacccaggaagtggctgaagagctaggtgtgtacatggtgggttttgatcgtgccggttatggcgagagcgacccgaaccccaaccgatctgtcaagagcgccgcgctcgatgtcgaggagcttgcggacgcactagggttgggatctaaattctacgtgatcggcatttccctcggatgccatgccgtctggggcgccctcaagtacatccctgataggattgctggagctgcaatgatggcaccggtggtgaactactggtggcctgggttcccagccgatctcgctgcggaggtgtacaacaagcaggaggtgggcgaccaatgggcgctgcgtgtgtcgcaccacgcccccggcatcctccactggtggatggagcagagctggctcccaacttccaccgtcattgccggcaccaccccgctcccaaacaagcgtgacgccgagatccgcagcaacatgaaagctgacggcaccttccagaagaagatggagctggcgacgcagcaaggcatccacgagtcgtactaccgcgacatgatggtaatgtttggcaagtgggagttcgatccgatgagcctgccgaagccgccatgcccagtccacatctggcagggcgacgaggacgggctggtgccggtggtgctgcagagacacctcgccagccagctcagctgggtgaactaccatgagctcccaggagtcgggcacttcatgtcgcctgttcccgggctaggagacaccgttcttaggacccttttcggctgagggtccagcatagccgcagtgatcagcagcagcagctcagaacatatgatgctgaagcatagtaggtgttcttccagtacattgatttattctatggcggttgggtaaatctctgatttagagatcggtgttatagatgaaatggtggtgtaagatgaactgttttttcgtcgcgaaaatcacgtggcctggatgcccgcgtacgcaaatatgtgcttacttctacctgttaatacatgggaagccagctcttgctggatctttaaaaaaaaatattctcaacatgggatgcgggcccatgttgtcggcgcaacccagcccatt

SEQ ID NO: 1850 - DNA, 1687 bp, Setaria italica
caacctccgaccccgacacggcgcgcctcctatccggctatatataacctccacacggcgagaggcccgccagagaccaccaccaccgctacggtctcttccttttgcttgctcgcttccgccaccgcccatcagccaggccgccactgctcagaactcacagcccaagcaactcggcaagcaatcatgtgggtgacttcgatgccgcaggtgtgggacgaggagggggcggccaagggcgccgccgacgcggtcacgcccgcgcccgccgccgccatgctgggctccctcgccgcctggctctcccgcaccatccagccgcagccgccggcgccacgggtgtgcggcaccgagggagggccgcccgtgacggcgcccagggtcaggctccgcgacggccgctactgcgagaccggcgtgcccaaggaacaggcgcgattcaaggtcgtcttctcacacggattcaccggatcccgcgaggacagcgtccgaccttcccaggaagtggccgaagagctgggcgtgtacatggtgggcttcgatcgcgccgggtacgggcagagcgaccccaaccccaaccgctccgtcaagagcgcggcgctggacgttgaggagctcgcggacgctctgggactcggccccaagttttacgtgatcggcatctccctcggatgccatgccgtctggggcgccctcaagtacatccccgactaagcaaagcaagaacaacagttatgtgcatccaatccaacaagccggttggttgtgcggttgtgcctaacagaacaccctgtgcgtgcaggatcgctggtgcggccatgatggcgccagtggtgaactactggtggccgggtttccccgctgacctggtcgcggaggtgtacgcgaagcaggaggtgggcgaccagtgggcgcttcgcgtgtcgcaccacgccccgggcatcctccactggtggatggagcagagctggctgcccacgtcgacggtggtggccggcacgacgccgctccccaacaagcgcgacgccgagatccgcagcaagatgaaggaggacggcacgttccagcagaagatggagcaggcgacgcagcagggcatccacgagtcctactaccgcgacatgatggtcatgttcggcaagtgggagttcgaccccatgagcctgccggagccgccgtgccccgtgcacctgtggcagggcgacgaggacggcctcgtccccgtggtgttgcagcggtacctggccagccgactcagctggctcaactaccatgagctccccggcaccggacacttcctgtcgccggtgcccgggctgggagacaccgtcctgaggacacttttcggttgatgagcaggtcgtgcaggagccagaagcagcaacagtttcagaacgtaaggacgggtgctaaacctaaagtatagagttgtggtgcattagtttcatttgttgtaaggctgttggttagttgtcgctgattagcgatgataaaatgatcatgatgataatatagatgcaaggtcgcagtgcctgcaagtatatgctcagagttctgccagctgtgtacctgtgatatgcacgcacaacgatcaggcggcaaaattagtgattgttggtaatcaatccgctggacgcgttctatgttcaggttggatctccggtgatcgaagatgaatagatgggcg

SEQ ID NO: 1851 - DNA, 1301 bp, Avena sativa
gggcgccgccggcatggtgacgccggcgccggcgacggcgctgctggggtcgctggccggctggctgtcccgcgtcgcagacccgccggcggccaaggtgtgcggcgcgccgggcggcccgccggtgacggcgcccagggtgacgctccgcgacgggcggcacctggcctactgcgagagcggcgtgcccaaggagcaggcccggttcaaggtcgtcttctcccacggcttcaccggctcccgcgaggacagcgtccgcgcatcccaggaagtggctgaagagctaggcgtgtacatggtgggtttcgaccgtgccggttacggtgagagcgacccaaaccccaaccgatccgtgaagagcgccgccctcgacgtggaggagcttgcggatgcactgggattgggccctaaattctatgtgatcggcatctcccttggctgccatgccgtctggggcgccctcaagtacatccccgataggattgctggagccgcaatgatggcgccggtggtgaaccactggtggccgggcttccctgctgatcttgccgcggaggtgtacaacaggcaggaggtgggcgatcagtgggcgctgcgcgtgtcgcaccacgcccctggcatcctccactggtggatggaccagacctggcttcccacctccaccgtcgtggccggcaccaccccgctccccaacaaacgcgactccgagatccgaaccaagctcaaggcagacggcacgttccagcagaagatggaactggcgacgcagcaaggcatccacgagtcgtactaccgcgacatgatggtgatgttcggcaagtgggagttcgacccgatgagcctgccgaagccgacctgccccgtccacatctggcagggcgacgaagacgggctggtgccggtagtgctgcagagacacatcgccagccggctcagctgggtgaactaccacgagctctcagaaaccgggcacttcctgtcgccagtccctgggttaggagacaccgttcttaggaccctcttcagctaggctggcttggcaacgtcgtagcagtgatcacaactcagaagcagaagcagcagctccggccatacggtgctcaagtatagcgttcttccggtacattggtttgttctaaggtggtcagtcaggtagtcgctgattagcgacgatgttatagatgaaaggggtggtgtaagatgatctgttttttgtggtggatgttgccccgcgaggctaggttgtctccgcaaaattctgctcaaaccttggaaacaggaaaatggaactattataccat

SEQ ID NO: 1852 - DNA, 1382 bp, Setaria italica
ccgactcgggcgccccgccgccgccgcctccgccgcgccgcaatggagctgctggccaaggcgcccgtgctgggctgcgcggggaagaggcagctcggggcccccgtgggctccgtcgtgggcgcgctggggaggtggatcagcggggccgtgccgccaccgccgccgcccagggtgtgcgggacgccgggggggccgccggtgacggcgcccagggtgcgcctcagggacggccgccacctggcgtacgcggagtccggggcgcgcaaggaggacgcgcggttcaaggtcgtcatctcccacgggttcaccggctcccggctcgacaccatccgcgctgcgccggaagtggccgaagagctgggcgtgtacatggtgggcttcgatcgcgccgggtacgggcagagcgaccccaaccccaaccgctccgtcaagagcgcggcgctggacgttgaggagctcgcggacgctctgggactcggccccaagttttacgtgatcggcatctccctcggatgccatgccgtctggggcgccctcaagtacatccccgacaggatcgctggtgcggccatgatggcgccagtggtgaactactggtggccgggtttccccgctgacctggtcgcggaggtgtacgcgaagcaggaggtgggcgaccagtgggcgcttcgcgtgtcgcaccacgccccgggcatcctccactggtggatggagcagagctggctgcccacgtcgacggtggtggccggcacgacgccgctccccaacaagcgcgacgccgagatccgcagcaagatgaaggaggacggcacgttccagcagaagatggagcaggcgacgcagcagggcatccacgagtcctactaccgcgacatgatggtcatgttcggcaagtgggagttcgaccccatgagcctgccggagccgccgtgccccgtgcacctgtggcagggcgacgaggacggcctcgtccccgtggtgttgcagcggtacctggccagccgactcagctggctcaactaccatgagctccccggcaccggacacttcctgtcgccggtgcccgggctgggagacaccgtcctgaggacacttttcggttgatgagcaggtcgtgcaggagccagaagcagcaacagtttcagaacgtaaggacgggtgctaaacctaaagtatagagttgtggtgcattagtttcatttgttgtaaggctgttggttagttgtcgctgattagcgatgataaaatgatcatgatgataatatagatgcaaggtcgcagtgcctgcaagtatatgctcagagttctgccagctgtgtacctgtgatatgcacgcacaacgatcaggcggcaaaattagtgattgttggtaatcaatc

SEQ ID NO: 1853 - DNA, 1490 bp, Avena sativa
cgaccgggcacgcaccacctcgcctcgctcgcaagcaaccgtcgatccactttcagcgcacgcgatcgatcaccaaacagccaacggcagcgagctcgcgagcatgtgggtgacgtcgatgccgcaggcgtgggacgaggaggcgaggagcggggaagggcgctgccgcgggcgccgccggcatggtgacgccggctccggcgacggcgctgctggggtcgctggccggctggctgtcccgcgtcgcagacccgccggcggccaaggtgtgcggcgcgccgggcggcccgccggtgacggcgcccagggtgacgctccgcgacgggcggcacctggcctactgcgagagcggcgtgcccaaggagcaggcccggttcaaggtcgtcttctcccacggcttcaccggctcccgcgaggacagcgtccgcgcatcccaggaagtggctgaagagctaggcgtgtacatggtgggtttcgaccgtgccggttacggtgagagcgacccaaaccccaaccgatccgtgaagagcgccgccctcgacgtggaggagcttgcggatgcactgggattgggccctaaattctatgtgatcggcatctcccttggctgccatgccgtctggggcgccctcaagtacatccccgataggattgctggagccgcaatgatggcgccggtggtgaaccactggtggccgggcttccctgctgatcttgccgcggaggtgtacaacaggcaggaggtgggcgatcagtgggcgctgcgcgtgtcgcaccacgcccctggcatcctccactggtggatggaccagacctggcttcccacctccaccgtcgtggccggcaccaccccgctccccaacaaacgcgactccgagatccgaaccaagctcaaggcagacggcacgttccagcagaagatggaactggcgacgcagcaaggcatccacgagtcgtactaccgcgacatgatggtgatgttcggcaagtgggagttcgacccgatgagcctgccgaagccgacctgccccgtccacatctggcagggcgacgaagacgggctggtgccggtagtgctgcagagacacatcgccagccggctcagctgggtgaactaccacgagctctcagaaaccgggcacttcctgtcgccagtccctgggttaggagacaccgttcttaggaccctcttcagctaggctggcttggcaacgtcgtagcagtgatcacaactcagaagcagaagcagcagctccggccatacggtgctcaagtatagcgttcttccggtacattggtttgttctaaggtggtcagtcaggtagtcgctgattagcgacgatgttatagatgaaaggggtggtgtaagatgatctgttttttgtggtggatgttgccccgcgaggctaggttgtctccgcaaaattctgctcaaaccttggaaacaggaaaatggaactattataccatgatcgttagtatagtaagta

SEQ ID NO: 1854 - DNA, 1211 bp, Sorghum bicolor
gcggagtgcttcaccatgtgagctcataccgcacgatccacgactccgcctccgtcgtcgctcgttccccaggccgcgcgcgcaggtggtggcggccgttgttcctctaacgccgttgcaggcaccagatcggcgcagagttagggttcaccggagcggcgcggcgctcccgacctctcgtcatcagatcggcgcgtcactggaccggctgccgtcctcgcccggggcacagcacacgcgaagcccgggtaagccgcaacagtcggcgatgtcgccgccgccgtcgcccctcgtggtgctcccgctcctcctcctcctcgccgctgtatcccactttgcggccaatgtggcaggtgccggcgcccctcccccggtgccgacgccgtggccggagcagttccatgccgtagttttcacaaacctcaccgagagcggcggccggctgcagctgatcgacctctactacgactggcccaggggccgcaacctcaacctcatccgggaccagctctccggcgacccgctctacgacgttgagtggaccaacggcacctcctacttcttcgactccgggtcctgccgcaccgtgcgtgtccccgtggggctcctgccgcccgactggctcgccgccggcgccgtctacctcggccgcgagcacgtcgacggcttcgactgccacctctggaccaaggtcgacttcatatggtactacgaggaagtcgccaccggccgccccgtccgatggaatttcttcaatgggatgcagcagcatgtgatgagttttgaggtgggaggagtgctggaagactccaagtggcaggcacccgcttactgcttcaatggcggcaatgccgacaccgccaatgtggctgcggatggagttgatagtgatgctggtagatccagtagagttgatgttgatgtgatgaacagcctgatcaggttcgccggggctccagctgtagctgcatcatttgaccagtgagatttttttttttgatgattggctgatgagagactttgccaacggtggtccacgtcctgttgattatgttatgttctgttaatcgcattgtgctttgtataaccctggctgatttgtggtaacagtcactctacatttcctggacctggaaatttgacaagtcgtagctgctaggagtactattttcttggggaatgcaaggttcataatcgatactgattccctg

SEQ ID NO: 1855 - DNA, 1215 bp, Sorghum bicolor
agagcggagtgcttcaccatgtgagctcataccgcacgatccacgactccgcctccgtcgtcgctcgttccccaggccgcgcgcgcaggtggtggcggccgttgttcctctaacgccgttgcaggcaccagatcggcgcagagttagggttcaccggagcggcgcggcgctcccgacctctcgtcatcagatcggcgcgtcactggaccggctgccgtcctcgcccggggcacagcacacgcgaagcccgggtaagccgcaacagtcggcgatgtcgccgccgccgtcgcccctcgtggtgctcccgctcctcctcctcctcgccgctgtatcccactttgcggccaatgtggcaggtgccggcgcccctcccccggtgccgacgccgtggccggagcagttccatgccgtagttttcacaaacctcaccgagagcggcggccggctgcagctgatcgacctctactacgactggcccaggggccgcaacctcaacctcatccgggaccagctctccggcgacccgctctacgacgttgagtggaccaacggcacctcctacttcttcgactccgggtcctgccgcaccgtgcgtgtccccgtggggctcctgccgcccgactggctcgccgccggcgccgtctacctcggccgcgagcacgtcgacggcttcgactgccacctctggaccaaggtcgacttcatatggtactacgaggaagtcgccaccggccgccccgtccgatggaatttcttcaatgggatgcagcagcatgtgatgagttttgaggtgggaggagtgctggaagactccaagtggcaggcacccgcttactgcttcaatggcggcaatgccgacaccgccaatgtggctgcggatggagttgatagtgatgctggtagatccagtagagttgatgttgatgtgatgaacagcctgatcaggttcgccggggctccagctgtagctgcatcatttgaccagtgagatttttttttttgatgattggctgatgagagactttgccaacggtggtccacgtcctgttgattatgttatgttctgttaatcgcattgtgctttgtataaccctggctgatttgtggtaacagtcactctacatttcctggacctggaaatttgacaagtcgtagctgctaggagtactattttcttggggaatgcaaggttcataatcgatactgattccctga

SEQ ID NO: 1856 - DNA, 1073 bp, Zea mays
gataatttggatgtctgcttccaaccctgtctagctccctcggtccagcttcgactggctcgcagtggcaactggcaggtaggcacacgcgaagcgataaggtcggttaagccgtaacagtcgttgatgtcgccgccgccgtcgtccctcgtggtgctcccgctcctcctccccctcctcctcgccgctgtatcccacgctacggctaatgcggccggtgccggcgcccctcccccagtgccgacgccgtggccggagcagttccacgcggtggtcttcaccaatctcaccgagagcggcggccggctgcagctgatcgacctgtactacgactggcccaggggccgcaacctcaacctcatccgggaccagctctccagcgacccgctctacgacgtcgagtggaccaacggcacctcctacttcttcgactccgggtcctgccgcaccatgcgtttccccgtggggatcctgccgcctgactggctcgccgccggcgccgtctatctcggccgcgagcacgtcgacggcttcgactgccacctgtggaccaaggtcgacttcgtctggtactacgaggaagtcgccaccggccgccccgtccgctggaatttcttcaatgggatgcagcagcatgtgatgagctttgaggtgggaggagtgctggaagactccaagtggcaggcgccccctcgctgcttcagtggcggcaatgccgacaccgccaacgcggctgcggatggagttcatggcgaggaagccggtagtgttgatgtgatggacagcatgatcaggttcgccgtggctccggctgcagcagtagctgcatcatttgaccagtgagatttttgttttcctgatgtttggctgatgagagagtctctgccaacggtgatccacgcgtcctggtgattctgctacgctctgttgatcacattgtgctttgtataaccctggctgatttgtggtaacaccgacagtcactgtacatttcctggtactgatccactgaacttaactatcctgctgtcatggaacatgaggggcacaaatagacttgcgtttttggttgc

SEQ ID NO: 1857 - DNA, 1002 bp, Panicum virgatum
  misc_feature (32)..(32): n is a, c, g, or t
  misc_feature (46)..(46): n is a, c, g, or t
  misc_feature (66)..(66): n is a, c, g, or t
  misc_feature (68)..(68): n is a, c, g, or t
  misc_feature (99)..(99): n is a, c, g, or t
  misc_feature (112)..(112): n is a, c, g, or t
  misc_feature (201)..(201): n is a, c, g, or t
  misc_feature (234)..(234): n is a, c, g, or t
  misc_feature (283)..(283): n is a, c, g, or t
gcattcgccaagcgataagctcggagtaagcngcaacagccgccgntgtcgccgccgccgtcgccncncatgcttctcccgctcctcctcctcctcgcngccggatccttcnctgcggccaatgccaagcccggcgcccccgccccggtgccgacgccgtggccggagcagttccacgcggtggtcttcaccaacctcacngagagcggcggccggctgcagctgatcgacctntactacgactggcccaagggccgcaacctcaacctcatccaaaaccagntctccggcgacccgacctacgacgtcgagtggaccaacggcacctcctactacttcgactcgggctcctgccgcaccatgcggttccccgtggggctcctgccgccggactggctcgccgacggcgccgtgtacctcggccgcgagcacgtcgacggcttcgactgccacctgtggacaaaggtcgatttcatctggtactacgaggaagtcgccaccggccgccccgtccgctggaatttcttcaatgggatgcagcagcatgtgatgagctttgaggtgggaggagtgctggaggactccatgtggcaggcaccggcttactgcttcaatgccgacacagcgaatttggctgcagatggagttgatgtgatgaatagcctgatgaggttcgcgggggctccagctgcagctatagctgcatcatttgaccagtgagagatttttttagggttggctgatgagaggctttcccaacggcgatatgctgatccattctgctccttagtcacactgttcttcttgaaccctgttgttatgtgtagtaacagccattccgcgtcatgggaatttgatgagttgtggccactattctcttgttcggggatgcaagatctatgatcagtactaaattgtatacagattggaaataattgcactatgtgctctgaatttgactatgcattattgaacactcctatgttgcttgtaccacgactg

SEQ ID NO: 1858 - DNA, 2106 bp, Saccharum officinarum
cacggtcacggctcacacgctcccgtcgcctgcgtcgcctctgatcgaattagtcggaccgggtcgtgtgggctcctcgtgcccgatcttgtcttctcttgtcttggttcccagccaggaatagagaacagcgcaacgagatccctggtcgcgcgcgcgagagagggagggcggcgaccgggcgtggccgcgaggggaaatgggatcggagggacgggcctggaacggcgccgccggcagcggccatggcggcggcgtagaggcgaaagcgatcaccgcggctgtgtcggccgcggaggttcccaggttggcggtctccgtcgacatctcgctgccgctcccggagatgtcgcctgacatcatatttctctgcaaggaattggtcagtgggtggtgtaagattgacagctcgcgcttctccatcgagaccgtgtctggaggcatcaccaatctattgctcaaggtttctgtcaaagaagacaacggcaatgagtcttctgttactgttcggttgtatggaccaaatacggacttggtgattgatcggaaaagggaattgcaggcgataccatatctctcagctgcagggttcggggctcggctacttggaatatttgagaatggagtagttcagtcattcatctatgctcgaacactgtcacctgcagacatgagagatcctaaaatagcagctgaaattgccaaggagctacgcaaattccatcaagtagacataccagggtctaaaaaaccgcaattgtggaatgatatattcaagtttttgaagaaagctgcagcattgaagtttgaggataacgagcagcagaagacatatgaaaagatctcatttagagaaatacaagatgaagttcaagaacttaaggatctcttggacattctgaatgcgcctgtggtttatgcacacaatgatttgctttcaggaaatctgatgctcaatgatttggaagggaagctatattttattgattttgagtatgggtcatacagctaccgtggctatgacattgcaaatcatttcaatgagtatgcaggatttgattgtgactataatttgtacccagataaagatgcccagtatcacttcttcaggaattatctacgccctgatagacctagtgaggcgcaggcacaagatatggaagtgctttatgtggaaacaaacactttcagactagcatcgcacatttactgggcattatgggcccttattcaggcaaaggtatccccaattgactttgactatcttggatacttcttcttacggtatggtgagtacaagaaacagagggagtcctgcttctccttggcacaaagcttcctctccgagctaagaaatggctagagcctgagaatctgttcacgagtttatactgttgtaagcatatactcggggcgggtacgcgttgtgatcatcggctgctactcagaaactctattatagtggtggtagcagcccctcattgttgtatctgatgttaggttcgtcattgcctgataggaaagtcgcatgatccgtcctcgggaacacagggtggcaagatctgttatatttgtaataaacacaatcctggcgggttctgccctgtgcaatttgttgtgcacataagcattccgtgttttgatacattcttgtgaggaactgcataagttttttttgttttcgattaaataatatgttgtttttctgatgaggagcagggtgggcgatcggctgccggcattatccgtggaggactcggcgaaactgcgatggtccttcgacttcgtcggcttcaaccactacctcatcctacgagtccggtcgtcgtcggagaagaaggattccggacagagactgggggactactacgttgatgcgaccagagtagaatccctgagggtgtgttcacttcgtgaaaagtagctgaaaagttactgtagcatctttcgttgttatttggcaaaatttgtccaatcatggactaactaggctcaaaagattcgtcctgacatttacagacaaactatgcaattaattttttttacctacatttaatgctccatgcatgcgtcgaaaaaaaaaaaaaaaaaaactcgagactagtt

SEQ ID NO: 1859 - DNA, 1868 bp, Zea mays
actgtcttgcctgttgcctctgcggctttgcctgcgctcacggacggtcactggctcacgctcccctcgcctgcgtcgcctcgcctagacaagagacaagacgcctagtcgcctccgatcgaaatcgaatcgagtcgggtgggctcgggcccggtcttgttgtcttgtctcccagctaggaatagcgcaacgagatccctcgcgcgcgcggaccccggagaggccgagggagggtgacagggcgtgtcctcgaccgcgaggggaatgggatcggagggacgggcctggaacggcgcgggcatggccgccggcagcggctatggcggcggggtagaggcgaaagcgaccaccacggctgtgtcggccgcggcccccgcggaggttcccacgtcggcggcctccgtcgacatctcgctgccgctcctgaagatgtcgcctcgcatcatagctctctgcaaggaattggtcgaagggtggtcgtcgattgacagctcgctcttctccatcgagaccgtgtccgggggcatcacgaatctattgctgaaggtttctgtcaaagaagacaacggcaatgagtcttctgttactgttcggttgtatggaccaaatacggacttggtgattgataggaaaagggaattgcaggcgataccatatctctcagctgcagggttcggggctcggctacttggaatatttgagaatggagtagttcagtcattcatctatgctcgaacactgtcaccagcagacatgaaagaacctaaaatagcagctgaaattgccaaggagctacgcaaattccatcaagtagacataccagggtctaaagaaccacaattgtggaatgatatattcaagtttttgaagaaagctgcagcattgaagtttgaggataacatgaagcagaagagatatgaaaagatctcatttagagaaatacaagatgaagttcaagaacttaaggatctcttggacattctgcgcgcgcctgtggtttatgcacacaatgacttgctttcaggaaatctgatgctcaatgatttggaagggaagctatattttattgattttgagtatgggtcatacagctaccgtggctatgacattgcaaatcatttcaatgagtatgcaggatttgattgtgactataatttgtacccagataaagatgcccagtatcacttcttcaggaattatctacacactgatagacctagtgaggtggatgcacaagatatggaagtactttatgtggaaacaaacactttcagactagcatcgcacatttactgggcattatgggcccttattcaggcaaaggtatccccaattgactttgactatcttggatacttcttcttgcggtatggtgagtacaagaaacaaagggagtcctgcttctccttggcacaaagctttctctccgagctaaaaaatggctagagcctgagaatctgttcacgagtttatactggtgtacgcatgctcggagcgggtacgcgttgtgatcatcgactgctacccagaaactctattatagcggttgtagcagcccctcattgttgtatctgatgttaggttcatcattgtctaaggactagtttggatactctagtatcgagctcaattcatgtgtatgagatggattcgggtgtaacttaaactaatttacacactaatccaactcaacacatgtggattggggtcaatactaaattacccaaacaaagcctaacagggaagtcaccagtggcaaattatgtacttatatttataataataaacacaatcctgatgggttgtgccctgttgaatttgttcttcgattaattctgccctgtgcaatctgttctgcacttccgagt

SEQ ID NO: 1860 - DNA, 1647 bp, Panicum virgatum
cttccctcgcctgagtcgccccgcctccgatcgaatcgaaccgggtgggcttgcttcgtctcgtttcgtctcgtctcggctctcagcctctcaggaaaccgcaacgagattcctcgcgcgcgcggctcagcagatcgcgcgagcgcgagagggaggagcatgggatcggagggacggggctggaacggcgctggcgacggcgccaggggcggggaggagaaaccgaccaccaccgcggcggtggccgcaggggcgccggcggacgtgcccacgtcggcggcctccgtcgacatctcgctgccgctcccggagatgacgcctcacatcataggtctctgcaagggatcggtcaaagggtggtcatcgctggacagctcgtgcttctccatcgagacggtgtctggcggcatcacgaatctattgctgaaggtatctgtaaaagaagatactggaaatgagttttctgttactgttcgtttgtatgggccaaatacagacttggtgattgatcggaaaagggaattgcaggcgataccatatctctcagctgcagggtttggggctcgtctacttggaatttttgagaatggagtagttcagtcattcatccatgctcgaacactgtcacctgcagacatgagagaacctagaatagcagctgagattgccaaggagctccacagattccatcaagtagacattccagggtctaaagaaccacaactgtggaatgatatattcaagtttttgaaaaaagcttcagcactgaagtttgaggataatgagaagcggaagagatatgaaacaatctcatttagagaaatacaagatgaagttaaagaacttaaggatctttccgaccttctgcgtgcacctgtggtttttgcacacaatgacttgctttcaggaaatttgatgctcaatgattcggaagggaagctatattttattgattttgagtatgggtcatacagctaccgcggttatgacattgcaaatcatttcaacgagtacgcaggatttgattgtgactataacatgtacccagataaagatgctcagtatcactttttcaggaattatatgcaacctgacagacccagtgaggtgcaggcacaagatctggaagcactttatgtggaaacaaacactttcaggttagcatcgcacatttactgggcattatgggccctcatacaggcaaaggtatccccaatcgattttgactatcttgggtacttcttccaacggtatggtgagtacaagaaacagagggagtcctgcttctccttggcacaaagcttcctctctgagctgagaaatggctagagcctgagaatctgttcacaagtcaatattgtggtctgtttacggtgggtatgcgttgtaattttcggcttctgctcggaaactttattatggtgctggcagaagcctctcgttgttgtatctgatgttagattcgtcatggcctgataggaaagccgcacgataggtcctcgggaaagcacatgtacttctattatttgtgattgtaataaacactatcctgatgggttctgctccgtgcaatttgttgcgcatgaaagctttccatgtaataccttgatacattctggctttaaaacataggcactgttccttttc

SEQ ID NO: 1861 - DNA, 2083 bp, Setaria italica
atgagaggcaaaccgcccggtgcggcacccgcgcgtgcacagcgtgccaagtgccaaccgccaccaacccaaaaaaacagatccggacaacgaacgggcgggcagaagcggaaccggatgccgggcccgcacaacgacgtcactccagatcccgcaaaggccaaaatctccgccgtccaacgcccccgtcgccctccggtgggccccgcgacggcgcaggcccgcgcgcagtgggacagccgcgcacgccacgcggttggtcaggaggacgggccgacgggaagcacaagcgaccgcgcgaagccgacgtggcccgggcccgccacgcggcgcgacgcgagtgggcgctatatagtgcgccctgttctcggccgctccgtcaccgccccggccagaagcttcttgaccttcctcccccccctggccttttctctctatcgcgcgggagtggagggagtgggggaaacgagccgcgagtgcgcgaggagcatgggatcggagggacggggctggaacggcgcggccgccggcagcggcgacggcgtcggaggcagggaggagaagccgaccaccaccgccgcggtggccgcgggggcgccggcggacgtgcccacgtctgcggcctccgtcgacataaccctgccgctcccggagatgacgcctcgcatcataggcctctgcaaggagttggtcaaagggtggtcatcgctggacagctcctgcttctccatcgagacggtgtctggcggcatcacgaatctattgctgaaggtgtctgtcaaagaagacactgacaatgagttttctgtgactgttcggttgtatggaccaaatacagacttggtgatcgatcggaaaagggaattgcaggcgataccatatctctcagctgcagggtttggggctcggctacttggaatttttgagaatggagtagttcagtcattcatcaatgctcgaacactctcacctgcagacatgagagaacctagaatagcagctgaaattgccaaggagctccacagattccatcaagtagacattccagggcctaaagaaccgcaactgtgggatgacatattcaagtttttgaaaaaagcttcagcattgaagtttaaggataacgagaagcagaagagatatgagacaatctcatttacagaaatacaagatgaagttcaagaacttaaggatctctcggatcttctgcatgcgcctctggtttttgcacacaatgatttgctttcaggaaatctgatgctcaatgattcggaagggaagctatattttattgattttgagtatgggtcatacagctaccgcggttatgacattgcaaatcatttcaacgaatatgcaggatttgattgtgactacaacatgtacccagataaagatgtccagtatcacttcttcaggaattatctgcaacctgataaacctagtgaggtgcgggcacaagatctggaagcactttatgtcgaaacaaacactttcagattagcatcgcacatttactgggcattatgggcccttattcaggcaaatgtatccccgattgatttcgactatcttgggtacttcttcctaaggtacggtgagtacaagaaacagagggagtcctgcatttccttggcacaaggcttcctctctgagctgagaaatggctagaacctgataatctgttgacgagtcaagaatgtgatccgctcccctcatggcgggtaggcttcggctgctgctcagaaactctattatggtggtggtagcagcctctcgttgttgtatctgatgttagaaattcgtcatggcctgttaggaagccacacgatgggtcctcgggaaaacacctgtatacttctatttgtaataaacacagtcctgatgggttctgctccgtgcaatttgttgtgcataaaagctatccatgtttaagctttttgatacattctggcagaaaaagtatagtttaagattagcaaaactgcaaaagtaaggctttctagaaattcccttcccctgaccttggagttttcaatatttggtgctgcatttttgaataaataaaattttggttgatagc

SEQ ID NO: 1862 - DNA, 1580 bp, Setaria italica
tgggatcggagggacggggctggaacggcgcggccgccggcagcggcgacggcgtcggaggcagggaggagaagccgaccaccaccgccgcggtggccgcgggggcgccggcggacgtgcccacgtctgcggcctccgtcgacataaccctgccgctcccggagatgacgcctcgcatcataggcctctgcaaggagttggtcaaagggtggtcatcgctggacagctcctgcttctccatcgagacggtgtctggcggcatcacgaatctattgctgaaggtgtctgtcaaagaagacactgacaatgagttttctgtgactgttcggttgtatggaccaaatacagacttggtgatcgatcggaaaagggaattgcaggcgataccatatctctcagctgcagggtttggggctcggctacttggaatttttgagaatggagtagttcagtcattcatcaatgctcgaacactctcacctgcagacatgagagaacctagaatagcagctgaaattgccaaggagctccacagattccatcaagtagacattccagggcctaaagaaccgcaactgtgggatgacatattcaagtttttgaaaaaagcttcagcattgaagtttaaggataacgagaagcagaagagatatgagacaatctcatttacagaaatacaagatgaagttcaagaacttaaggatctctcggatcttctgcatgcgcctctggtttttgcacacaatgatttgctttcaggaaatctgatgctcaatgattcggaagggaagctatattttattgattttgagtatgggtcatacagctaccgcggttatgacattgcaaatcatttcaacgaatatgcaggatttgattgtgactacaacatgtacccagataaagatgtccagtatcacttcttcaggaattatctgcaacctgataaacctagtgaggtgcgggcacaagatctggaagcactttatgtcgaaacaaacactttcagattagcatcgcacatttactgggcattatgggcccttattcaggcaaatgtatccccgattgatttcgactatcttgggtacttcttcctaaggtacggtgagtacaagaaacagagggagtcctgcatttccttggcacaaggcttcctctctgagctgagaaatggctagaacctgataatctgttgacgagtcaagaatgtgatccgctcccctcatggcgggtaggcttcggctgctgctcagaaactctattatggtggtggtagcagcctctcgttgttgtatctgatgttagaaattcgtcatggcctgttaggaagccacacgatgggtcctcgggaaaacacctgtatacttctatttgtaataaacacagtcctgatgggttctgctccgtgcaatttgttgtgcataaaagctatccatgtttaagctttttgatacattctggcagaaaaagtatagtttaagattagcaaaactgcaaaagtaaggctttctagaaattcccttcccctgaccttggagttttcaatatttggtgctgcatttttgaataaataaaat

SEQ ID NO: 1863 - DNA, 2042 bp, Setaria italica
atcaacactgcctccgttcgcctctgaactcgcagacgttcccatcttctccgggcgctcacgagcacttccattcttttcctcttggcataggcctttcgtgaagtcttttgtgtggagctagcctgtgatcgtgtgaggcgaaagctttgtgtgtttgtggtttgagtattgggcagtcgccatggccggcggcgtggtggtgaacaccggagggggcaaggactaccccggcaagctcaccatgttcgtgctcttcgcctgcatcgtcgccgccaccggcggcctcatcttcggatatgacatcggcatctctggtggcgtgacgtcgatgaacccgttcctgatgaagttcttcccgtcggtgtaccgcaaggagcaggaggcggagcggaaccagaccaaccagtactgcaagttcgacagccagctgctgaccatgttcacctcctcgctctacctcgccgcgttggtggcctccttcttcgccgccacggtgacgcgagtggccgggcgcaagtggtccatgttcggcggcggcgtcacgttcctcatcggcgcggccctcaacggcgccgccaaggacgtcgtcatgctcatcctcggccgcgtcctcctcggcatcggcgtcggcttcgccaaccaggccgtgccggtgtacctgtcggagatggcccccgcgcgcctccgtgggatgctcaacatcgggttccagctcatgatcaccatcggcatcctgtgcgccaacctcatcaactacggcaccgccaagatcaagggcggctgggggtggcgcgtgagcctggccctggcggcggtgccggcggccatcatcgccatcggcgcgctgttcttgcccgacacccccaactccctcatcgaccgcggctacaccgacgccgccaagcggatgctcaagcgcgtgcgcggcacggaggacgtggaggaggagtacaacgacctcgtcgccgccagcgaggagtccaagctcgtggcgcacccgtggcggaatatcctgcagccgcgctaccggccgcagctcgtcatggccatcgccatccccatgttccagcagctcaccggcatcaacgtcatcatgttctacgcaccggtgctcttcaagacgctgggcttcgcagacgacgcctccctcatgtccgccgtcatcacggggctcgtcaacgtcttcgccaccttcgtctccatcgtcaccgtggaccgcctcggccgccgcaagctgttcctgcagggcgggacccagatgctcgcctgccagatcgtcgtcggtagcctgatcggcgccaagttcgggttctccggcgtggcggagatccccaaggcgtacgccgccatcgtggtgctcttcatctgcgcctacgtggccgggttcgcctggtcatggggacccctcgggtggctggtgcccagcgagatcttcccgctggagatccggtcggcggggcagagcatcaacgtgtccgtcaacatgctctgcaccttcatcatcgcgcaggcgttcctccccatgctttgccgcttcaagttcatcctcttcttcttcttcggcgcctgggtggtggtcatgaccatcttcgtcgcgctcttcctgccggagaccaagaacgtgcccatcgaggaaatggtgctcgtgtggaagaaccactggtactggggccgcttcatccgcgacgaggacgtgcacgtcggcgccgacctcgagatgcgcggcggtgccaacggcaacggcaagctcgccggcatgcagtagcccgtgacgcctgggacgtcgctcgctgctgacggtgtcggccgggcaataatttactcatacggctttattcttcgggtttagcgggaaatttaaaatggtttaaggattcaccgtattataatcatcgcagtaggtaggatgactggatgatgacgaacagtcaactggtcttcgtcccctgtcttcttttttctttgtggggtatggattggatcaaatcgaagtatatgaatgcaagttgcaaattaaaactctgcctttctccgtgcgc

SEQ ID NO: 1864 - DNA, 2043 bp, Panicum virgatum
catcgttcgcctctgaacttcctctcccctgaactcgtcgacgttccatctctgggcgctcacgaacacttcccgttcctcatcggttcgattcgattagtcgtaggcctttcgagtggagccagcctgtgatcttcttggttcttgagaggcgaaagctctgtgccttttctggttgagaggtgagctgtcgcaatggccggcggcgtggtggtgaacaccggagggggcaaggactaccccggcaagctcaccatgttcgtgctcttcgcctgcatcgtcgccgccaccggcggcctcatcttcggctatgacatcggcatctccggtggcgtgacgtcgatgaacccgttcctgatgaagttcttcccgtcggtgtaccgcaaggagcaggaggcggagcgcaaccagagcaaccagtactgcaagttcgacagccagctgctgaccatgttcacctcctcgctctacctcgcggcgctcgtggcctccttcttcgccgccacggtgacgcgcgtggccggtcgcaagtggtccatgttcggcggcggcgtcacgttcctgttcggcgccgcgctcaacggcgccgccaagaacgtggtgatgctcatcctcggccgcgtcctgctcggcatcggcgtcggcttcgccaaccagtccgtgccggtgtacctgtcggagatggcccccgcgcgcctccgcgggatgctcaacatcgggttccagctcatgatcaccatcggcatcctgtgcgccaacctcatcaactacggcaccgccaagatcaagggcggctggggctggcgcgtgagcctcgcgctcgccgccgtgccggcggccatcatcgccgtgggcgcgctgttcctgcccgacacccccaactccctcatcgaccgcggccacaccggcgccgccaagcggatgctgaagcgcgtgcgcggcacggaggacgtggaggaggagtacaacgacctggtggccgccagcgaggagtccaagctcgtggcgcacccgtggcgcaacatcctgcagccgcgctaccggccgcagctggtcatggccatcgccatccccatgttccagcagctcaccggcatcaacgtcatcatgttctacgcgccggtgctcttcaagacgctgggcttcgccgacgacgcctcgctcatgtccgccgtcatcacgggcctcgtcaacgtcttcgccaccttcgtctccatcgtcaccgtggaccgcctcggccgccgcaagctgttcctgcagggcggcacccagatgctcgcctgccagatcgtcgtcggcagcctgatcggcgccaagttcgggttctccggcgtggccgagatccccaaggcgtacgccgccatcgtggtgctcttcatctgcgcgtacgtggccgggttcgcctggtcgtgggggcccctcgggtggctggtgcccagcgagatcttcccgctggagatccggtcggcggggcagagcatcaacgtgtcggtgaacatgctctgcaccttcatcatcgcgcaggcgttcctccccatgctgtgccgcttcaagttcatcctcttcttcttcttcggcgcctgggtggtggtgatgaccatcttcgtggcgctgttcctgccggagaccaagaacgtacccatcgaggagatggtgctcgtgtggaagtctcactggtactggggccgcttcatccgcgacgaggacgtgcacgtcggcgccgacctcgagatgcacggcgccaacggcaacggcaagctcggcggcgcgcagtagcccggacgtcgctcgctgctgacggtgtcgggcaataatctactcatacagaactactccgggtttagcgggaaatttcaaaagtttaaggattcatcactgtattataaatcgtcgcattaggtagggtgactggatgttgaccgttggtcaacaagtcttcgtttcctgtcttcttttttctttgtctcaagatactcgatgtggggggtatggtgtggatcaaatcagatttgaatatgaatgcaagttgcaaatttaaaactc

SEQ ID NO: 1865 - DNA, 2057 bp, Zea mays
agcactcgcccattcatccgttcgcctctgtgcctctctgagctcgcactcgctcgtgaacgctccccgacctccgtgttgtccagctcactttagcagttcagcctaggactctctgcgagtagcatagcagcagcttcttgcgaagcagaggcagagccttgtgttgcgttgcgtcttccttcctgcttgagcttattagttggctcgcgatggccggcggcgtggtggtgagctccggtgggggcaaggactaccccggcaagctcaccatgttcgtgctcttcgcctgcatcgtcgccgccaccggcggcctcatctttggatacgacatcggcatctctggtggcgtgacgtcgatgaacccgttcctgatgaagttcttcccgtcggtgtaccgcaaggagcaggaggcggagcggaaccagagcaaccagtactgcaagttcgacagccagctgctcaccatgttcacctcctcgctctacctggcggcgctcgtggcctccttcttcgccgccaccgtcacccgcgtggccggccgcaagtggtccatgttcggcggcggcgtcacgttcctggtcggcgccgcgctcaacggcgccgccaaggacgtgggcatgctcatcctcggccgcgtcctcctcggcgtcggcgtcggcttcgccaaccagtccgtgcccgtctacctctcggagatggcgccggcgcgcctccgcgggatgctcaacatcggcttccagctcatggtcaccatcggcatcctctgcgccaacctcatcaactacggcaccgccaagatcaggggcggctggggctggcgcgtcagcctcgcgctcgcggccgtgccggcggccatcatcgccgtgggcgcgctcttcctgcccgacacacccaactccctcatcgaccgcggctacaccgacgccgccaagcggatgctcaagcgcgtgcggggcaccgacgacgtggaggaggagtacagcgacctggtggccgccagcgacgagtccaagctggtggcgcacccctggcgcaacatcctgctgccgcgctaccgcccgcagctcgtcatggccatcgccatccccatgttccagcagctcacgggcatcaacgtcatcatgttctacgccccggtcctcttcaagacgctgggcttcgcggacgacgcctccctcatgtccgccgtcatcacgggcctcgtcaacgtcttcgccaccttcgtgtccatcgtcaccgtcgaccgcctcggccgccgcaagctgttcctgcagggcggcacccagatgctcgcgtgccagatcgtcgtgggcagcctcatcggcgccaagttcggcttctccggcgtcgcggagatccccaaggcgtacgccgccatcgtcgtgctcttcatctgcgcctacgtggccggcttcgcctggtcctggggccccctcggctggctggtgcccagcgagatcttcccgctggagatccgctcggcggggcagagcatcaacgtgtccgtcaacatgctctgcaccttcatcatcgcgcaggccttcctccccatgctctgccgcttcaagttcatcctcttcttcttcttcggcgcctgggtcgtcgtcatgaccatcttcgtcgcgctcttcctgccggagaccaagaacgtgcccatcgaggagatggtgctcgtgtggaaggcgcactggtactggggccgcttcatccgcgacgaggacgtgcacgtcggcgccgacctcgagatgccctccgccaacgccaagctcggcggcatgcagtagccatggccgtccctcgctgctcatgttgttgggcaataatctacccatacagtattattcttggggctttaccgggaaatttgaaactcatcatcaatgtgtattataatcgtctcattaggtaggatgactggatgatgacaaatagtcaactagtcttggtcccctgtctttttttttattttgtgcgggatactgaatgtggagtataattatgtttgcaacagatcaaaccaaatatgaatatcaattgcaagttgcactgcaaaa

SEQ ID NO: 1866 - DNA, 2110 bp, Oryza sativa
ggcatattttgcggtccaccccttgggattttgagcttttacagaatagtccggacccctcccccgcctatatatttcccgccgctccgcctctccaaactcaccatccattcgcttctgtgtctctagatacactcgtctctgatctcttctcgtcagagagggtttcttctttgagctcgtgatctcttcgagatttgtagtagtactacgtcgacggttaggtggtcgtcgcagcaatggccggcggcgtggtggtgaacaacggaggggggaaggactaccccgggaagctcaccatgttcgtcctcttcgcctgcatcgtcgcagccaccggcggcctcatcttcggatatgacatcggcatctccgggggtgtgacgtcgatgaacccgttcctgatcaagttcttcccgtcggtgtaccggaaggagcaggcggcggagaagaaccagagcaaccagtactgcaagttcgacagcccgctgctgaccatgttcacctcgtcgctctacctcgccgcgctcgtcgcctccttcttcgcgtccaccgtcacccgcgtcgcggggcgcaagtggtccatgttcggcggcggcgtcaccttcctcgtcggcgccgcgctcaacggcgccgccaagaacgtgctcatgctcatcctcggccgcgtcctcctcggtgtcggcgtcggcttcgccaaccagtctgtgccgctgtacctgtcggagatggcgccggcgaggctgcgcgggatgctcaacatcgggttccagctgatgatcaccattggcatcctgtgcgccaacctgatcaactacgggactgccaagatcaagggcgggtgggggtggcgcgtgagcctggcgctggcggcggtgccggcggcgatcatcgccgtgggcgcgctcttcctccctgacacgcccaactccctcatcgaccgcggccacaccgacgccgccaagcgcatgctccggcgcgtgcgcggcaccgacgacatcgaggaggagtacaacgacctggtggccgccagcgaggagtccaagctcgtggcgcacccgtggcggaacatcctccagcgccggtacaggccgcagctgaccatggccatcgccatcccgctgttccagcagctgacggggatcaacgtcatcatgttctacgcgccggtgctgttcaagacgctgggattcgccgacgacgcgtccctcatgtccgccgtgatcaccggcctcgtgaacgtcttcgccaccttcgtgtccatcgtgaccgtcgaccgcctcggccgccggaagctgttcctccagggcgggacgcagatgctggcgtgccagatcgtcgtcggaagcctcatcggcgccaagttcgggttctccggcgtggccgacatccccaaggcgtacgcggcgttcgtggtgctcttcatctgcgcctacgtcgccgggttcgcgtggtcgtgggggcccctgggctggctcgtccccagcgagatcttcccgctggagatcaggtcggcggggcagagcatcaacgtgtcggtgaacatgctcttcaccttcatcatcgcgcaggcgttcctccccatgctctgccgcttcaagttcatcctcttcttcttcttcggcgcgtgggtggtgatcatgacgctgttcgtcgccttcttcctgccggagaccaagaacgtgcccatcgaggagatggtgctcgtctggaagtcgcactggtactggggcaggttcatccgcgacgaggacgtgcacgtcggcgccgacgtcgagatgcccgccgccggcaaccgcaacggcaaggtcgacccggccaagctcgccaactgatgacctcagcgcgtcggtcgctgacatcgttcgcaaataagctaccattaaaaaaaatcttatatttcttttttctcatttttctgtattataccccaattgtcttagtactaggacgacgacgaaaaagcagtcactagtctctctttcgttttcttttcatttttaaagttccggtttaattatctgtgccggatactctacttggggattgttttggatcaagtatgaatataaatgcaagtttcaagaacgttgctctatgagttcgtgccggc

SEQ ID NO: 1867 - DNA, 1997 bp, Oryza sativa
accatccattcgcttctgtgtctctagatacactcgtctctgatctcttctcgtcagagagggtttcttctttgagctcgtgatctcttcgagatttgtagtagtactacgtcgacggttaggtggtcgtcgcagcaatggccggcggcgtggtggtgaacaacggaggggggaaggactaccccgggaagctcaccatgttcgtcctcttcgcctgcatcgtcgcagccaccggcggcctcatcttcggatatgacatcggcatctccgggggtgtgacgtcgatgaacccgttcctgatcaagttcttcccgtcggtgtaccggaaggagcaggcggcggagaagaaccagagcaaccagtactgcaagttcgacagcccgctgctgaccatgttcacctcgtcgctctacctcgccgcgctcgtcgcctccttcttcgcgtccaccgtcacccgcgtcgcggggcgcaagtggtccatgttcggcggcggcgtcaccttcctcgtcggcgccgcgctcaacggcgccgccaagaacgtgctcatgctcatcctcggccgcgtcctcctcggtgtcggcgtcggcttcgccaaccagtctgtgccgctgtacctgtcggagatggcgccggcgaggctgcgcgggatgctcaacatcgggttccagctgatgatcaccattggcatcctgtgcgccaacctgatcaactacgggactgccaagatcaagggcgggtgggggtggcgcgtgagcctggcgctggcggcggtgccggcggcgatcatcgccgtgggcgcgctcttcctccctgacacgcccaactccctcatcgaccgcggccacaccgacgccgccaagcgcatgctccggcgcgtgcgcggcaccgacgacatcgaggaggagtacaacgacctggtggccgccagcgaggagtccaagctcgtggcgcacccgtggcggaacatcctccagcgccggtacaggccgcagctgaccatggccatcgccatcccgctgttccagcagctgacggggatcaacgtcatcatgttctacgcgccggtgctgttcaagacgctgggattcgccgacgacgcgtccctcatgtccgccgtgatcaccggcctcgtgaacgtcttcgccaccttcgtgtccatcgtgaccgtcgaccgcctcggccgccggaagctgttcctccagggcgggacgcagatgctggcgtgccagatcgtcgtcggaagcctcatcggcgccaagttcgggttctccggcgtggccgacatccccaaggcgtacgcggcgttcgtggtgctcttcatctgcgcctacgtcgccgggttcgcgtggtcgtgggggcccctgggctggctcgtccccagcgagatcttcccgctggagatcaggtcggcggggcagagcatcaacgtgtcggtgaacatgctcttcaccttcatcatcgcgcaggcgttcctccccatgctctgccgcttcaagttcatcctcttcttcttcttcggcgcgtgggtggtgatcatgacgctgttcgtcgccttcttcctgccggagaccaagaacgtgcccatcgaggagatggtgctcgtctggaagtcgcactggtactggggcaggttcatccgcgacgaggacgtgcacgtcggcgccgacgtcgagatgcccgccgccggcaaccgcaacggcaaggtcgacccggccaagctcgccaactgatgacctcagcgcgtcggtcgctgacatcgttcgcaaataagctaccattaaaaaaaatcttatatttcttttttctcatttttctgtattataccccaattgtcttagtactaggacgacgacgaaaaagcagtcactagtctctctttcgttttcttttcatttttaaagttccggtttaattatctgtgccggatactctacttggggattgttttggatcaagtatgaatataaatgcaagtttcaagaacgttgctctatgag

SEQ ID NO: 1868 - DNA, 2003 bp, Triticum aestivum
tgacttgtgcgccacagagaactcttcttggagagcctgtgaatctcgagaggcattgggtccgtcctgagttgttgttagtgtcgccttggtctttcgtttttggctttcgtgccgatccactccggtgctgttcggcggcggtcacgatggccggcggcgcggttgtgaacaccggaggggggaaggactaccccggcaagctcaccatgttcgtgctcttcgcctgcatcgtcgccgccaccggcggcctcatcttcggatacgacataggcatctccggtggcgtgacctccatgaaccccttcctgatgaagttcttccccggcgtgtaccacaaggagcaggaggcggagtggaaccagagcaaccagtactgcaagttcgacagccagctgctcaccatgttcacctcctcgctctacctcgccgcgctcgtcgcttccttcttcgccgccaccgtcacccgcgtcgccggccgcaagtggtccatgttcgccggcggggtcaccttcctcgtcggcgccgcgctcaacggcgcagccaagaacgtcctcatgctcatcctcgggcgcgtcctgctcggcattggggtcggcttcgccaaccagtcggtgccggtgtacctgtcggagatggcgccggcgaggctgcgggggatgctcaacatcgggttccagctgatggtcacgatcggcatcctgtgcgcgaacctgatcaactacgggacggccaagatcaagggcgggtggggctggcgcgtgagcctcgcgctggccgcggtgccggccggaatcatcgccatcggcgcgctcttcctccccgacacccccaactccctcatcgaccgcggctacaccgaggacgccaagaagatgctccggcgcgtgcgcggcacggacgatgtggaggaggagtacagcgacctggtggccgccagcgaggagtccaagctcgtgagccacccgtggcgcaacatcctccagcgccgctaccggccgcagctcaccttcgccatcgcgatccccttcttccagcagctcaccggcatcaacgtcatcatgttctacgcgcccgtgctcttcaagacgctggggttcgccgacgacgcgtccctcatgtccgccgtcatcaccggcctcgtcaacgtcttcgccaccttcgtgtccatcgtgaccgtggaccggctgggccggcgcaagctcttcctgcagggcggcacccagatgctggcctgccagatcgtggtgggcagcctgatcggcgccaagttcgggttcaccggcgtggccgacatccccaaggggtacgcggcgttcgtggtgttcttcatctgcgcgtacgtggccgggttcgcgtggtcctggggcccgctggggtggctcgtccccagcgagatcttcccgctggagatcaggtcggcggggcagagcatcacggtgtcgatgaacatgctgtgcaccttcatcatcgcgcaggcgttcctccccatgctctgccgcttcaagttcatgctcttcttcttcttcggcgcgtgggtggtcgtcatgaccctcttcgtcgccttcttcctgccggagaccaagaacgtgcccatcgaggagatggtgctcgtgtggaaggcgcactggtactggggccgcttcatccgcgacgaggacgtgcacgtcggcggcgcagacgtcgagatgcgctccaacggcaaggtccaggctgccaagctcccgtgacgtcgaaacgtcgtcgctggccaataagctgttaccatccgaggccgatcgaggactttttgagtcctcgtctgatttttcatttgtcttcttctgtattataattgccatactacctaggatgatgacgaacaatcagtgcgtcactaatcattcccagtttccttttctttttatgaagtttgggctcctttgtgcccggatatatactctggtgccgtggtggctttggatcaaaaatgaatatagatgctggttgaatcaaaaaaaaaa

SEQ ID NO: 1869 - DNA, 2050 bp, Triticum aestivum
ctccgcctccatttcatcctccctctctctcatcgtctccatctgcttctctttctgcgacctgacttgtgcgccacagagagctcttcttggagagcctgtgaatctcgagaggcattgggtccgtcctgagttgttgttagtgtcgccttggtctttcgtttttggctttcgtgccgatccactccggtgctgttcggcggcggtcacgatggccggcggcgcggttgtaaacaccggaggggggaaggactaccccggcaagctcaccatgttcgtgctcttcgcctgcatcgtcgccgccaccggcggcctcatcttcggatatgacataggcatctccggtggcgtgacgtccatgaaccccttcctgatgaagttcttccccggcgtgtaccacaaggagcaggaggcggagtggaaccagagcaaccagtactgcaagttcgacagccagctgctcaccatgttcacctcctcgctctacctcgccgcgctcgtcgcttccttcttcgccgccaccgtcacccgcgtcgccggccgcaagtggtccatgttcgccggcggggtcaccttcctcgtcggcgccgcgctcaacggcgcagccaagaacgtcctcatgctcatcctcgggcgcgtcctgctcggcattggggtcggcttcgccaaccagtcggtgccggtgtacctgtcggagatggcgccggcgaggctgcgggggatgctcaacatcgggttccagctgatggtcacgatcggcatcctgtgcgcgaacctgatcaactacgggacggccaagatcaagggcgggtggggctggcgcgtgagcctcgcgctggccgcggtgccggccggaatcatcgccatcggcgcgctcttcctccccgacacccccaactccctcatcgaccgcggctacaccgaggacgccaagaagatgctccggcgcgtgcgcggcacggacgatgtggaggaggagtacagcgacctggtggccgccagcgaggagtccaagctcgtgagccacccgtggcgcaacatcctccagcgccgctaccggccgcagctcaccttcgccatcgcgatccccttcttccagcagctcaccggcatcaacgtcatcatgttctacgcgcccgtgctcttcaagacgctggggttcgccgacgacgcgtccctcatgtccgccgtcatcaccggcctcgtcaacgtcttcgccaccttcgtgtccatcgtgaccgtggaccggctgggccggcgcaagctgttcctgcagggcggcacccagatgctggcctgccagatcgtggtgggcagcctgattggcgccaagttcgggttcaccggcgtggccgacatccccaaggggtacgcggcgttcgtggtgttcttcatctgcgcgtacgtggccgggttcgcgtggtcctggggcccgctggggtggctcgtccccagcgagatcttcccgctggagatcaggtcggcggggcagagcatcacggtgtcgatgaacatgctgtgcaccttcatcatcgcgcaggcgttcctccccatgctctgccgcttcaagttcatgctcttcttcttcttcggcgcgtgggtggtcgtcatgaccctcttcgtcgccttcttcctgccggagaccaagaacgtgcccatcgaggagatggtgctcgtgtggaaggcgcactggtactggggccgcttcatccgcgacgaggacgtgcacgtcggcggcgcagacgtcgagatgcgctccaacggcaaggtccaggctgccaagctcccgtgacgtcgaaacgtcgtcgctggccaataagctgttaccatccgaggccgatcgaggactttttgagtcctcgtctgatttttcatttgtcttctgtattataattgccatactacctaggatgatgacgaacaatcagtgcgtcactaatcattcccagtttccttttctttttattaagtttgggctcctttgtgcccggatatatactctggtgccgtggtggctttggatcaaaaatgaatatagatgctggttgga

SEQ ID NO: 1870 - DNA, 2090 bp, Hordeum vulgare
atcctccctctctcatcttcctcctccacgttctctcgtcgtgcctccacctgcttctctttctgcagcctaaacctgtgcgccacacacaactcttcttcaagagcctgtgaatctctagaggcattgagtccgtcttgagttgttgttagtgtcgccttggtcttctgtttttcgctttcgtgccgatccactccggtgctgttgggcggcggtcacgatggccggcggcgcggttgtgaacaccggaggggggaaggactaccccggcaagctcaccatgttcgtgctcttcgcctgcatcgtcgccgccaccggcggcctcatcttcggatatgacataggcatctccggtggcgtgacctcgatgaaccccttcctgatgaagttctttccgggcgtgtaccacaaggagcaggaggcagagcggaaccagagcaaccagtactgcaagttcgacagccagctgctcaccatgttcacctcctcgctctacctcgccgcgctcgtcgcttccttcttcgccgccaccgtcagccgcgtcgccggccgcaagtggtccatgttcgccggcggggtcaccttcctcgtcggcgccgcgctcaacggcgccgccaagaacgtcctcatgctcatcctcggacgcgtcctgctcggcatcggggtcggcttcgccaaccagtcggtgccggtgtacctgtcggagatggcgccggcgaggctgagggggatgctcaacattgggttccagctgatggtcacgatcggcatcctgtgcgcgaacctgatcaactacgggacgtccaagatcaagggcgggtggggctggcgcgtgagcctcgccctggccgcggtaccggccggaatcatcgccatcggcgcgctcttcctccccgacacccccaactccctcatcgaccgcggctacaccgacgatgccaagaagatgctccggcgcgtgcgcggcacggacgacgtcgaggaggagtacagcgacctggtggccgccagcgatgagtccaagctcgtgagccacccgtggcgcaacatcctccagcgccgctaccggccgcagctcaccttcgcgatcgccatccccttcttccagcagctcaccggcatcaacgtcatcatgttctacgcgcccgtgctcttcaagacgctcgggttcgccgacgacgcgtccctcatgtccgccgtcatcaccggcctcgtcaacgtcttcgccaccttcgtgtccatcgtgaccgtggaccgcctgggccgccgcaagctcttcctgcagggcggcacccagatgctggcctgccagatcgtggtcggcagcctgatcggcgccaagttcgggttcaccggcgtggcggacatccccagggggtacgcggcgttcgtggtgttcttcatctgcgcgtacgtggccgggttcgcatggtcctggggcccgctcgggtggctcgtccccagcgagatcttcccgctggagatcaggtcggcggggcagagcatcacggtgtcgatgaacatgctgtgcaccttcatcatcgcgcaggcgttcctccccatgctctgccgcttcaagttcatgctcttcttcttcttcggggcgtgggtgatcgtcatgaccctcttcgtcgcattcttcctgccggagaccaagaacgtgcccatcgaggagatggtgctcgtgtggaaggcgcactggtactggggccgcttcatccgcgacgaggacgtgcacgtcggcgccgacgtcgagatgcgctccaacggcaacggcaagatccaggctgccaagctcccgtgacgtggaaacatcgtcgctggacaataagctgttaccatccgaggccgaggacttttttagtcctgacttgatttttcatttgtcatcttctgtattataattgtcatacgtaggatgatgacgaacaatcagtgcgtcactaattattccacatttccttttctttttatactagtattaagtttgggctccttttgtgcccggatatatactctggtgccgtggtggctttgggccaaagatgaatatagatgctggtcgaatgaaattccttgtctgtgtccgc

SEQ ID NO: 1871 - DNA, 2022 bp, Secale cereale
ctctcgtctccatctgcttctctttctgcgacctgacttgtgtgcgccacagagaactcttcttggagagcctgtgaatctcgagaggcattgagtccgtcttgagttgttgttagtgtcgccttggtcttctgctttcggctttcgtgccgatccactccggtgctgttcagcggcggtcacgatggccggcggcgcagttgttaacaccggaggggggaaggactaccccggcaagctcaccatgttcgtgctcttcgcctgcatcgtcgccgccaccggcggcctcatcttcggatacgacataggcatctccggtggcgtgacctcgatgaaccccttcttgatgaagttctttcccgggggtgtaccaccaggagcaggaggcggagcggaaccagagcaaccagtactgcaagttcgacagccagctgctcaccatgttcacctcctcgctctacctcgccgcgctcgtcgcttccttcttcgccgccaccgtcacccgcgtcgccggccgcaagtggtccatgttcgccggcggggtcaccttcctcgtcggcgccgcgctcaacggcgccgccaagaacgtcctcatgctcatcctcgggcgcgtcctgctcggcatcggggtcggcttcgccaaccagtcggtgccggtttacctgtcggagatggcgccggcgaggctgagggggatgctcaacatcgggttccagctgatggtcacgatcggcatcctgtgcgcgaacctgatcaactacgggacggccaagatcaagggcgggtggggctggcgcgtgagcctcgcgctggccgcggtgccggccggaatcatcgccatcggcgcgctcttcctccccgacacccccaactccctcatcgaccgcggctacaccgacgacgccaagaagatgctccggcgcgtgcgcggcacggacgacgtcgaggaggagtacagcgacctggtggccgccagcgaggagtccaagctcgtgagccatccgtggcgcaacatcctccagcgccggtaccggccgcagctcaccttcgcgatcgccatccccttcttccagcagctcaccggcatcaacgtcatcatgttctacgcgcccgtgctcttcaagacgctcgggttcgcggacgacgcgtccctcatgtccgccgtcatcaccggcctcgtcaacgtcttcgccaccttcgtgtccatcgtgaccgtggaccggctgggccggcgcaagctcttcctgcagggcggcacccagatgctggcctgccagatcgtggtgggcagcctgatcggcgccaagttcgggttcaccggcgtggccgacatccccaaggggtacgcggcgttcgtggtgctcttcatctgcgcgtacgtggccgggttcgcgtggtcctggggcccgctggggtggctcgtccccagcgagatcttcccgctggagatcaggtcggcggggcagagcatcaccgtgtccatgaacatgctgtgcaccttcatcatcgcgcaggcgtttctccccatgctctgccgcttgaagttcatgctcttcttcttcttcggcgcgtgggtgatcgtcatgaccctcttcgttgccttcttcctgccggagaccaagaacgtgcccatcgaggagatggtgctcgtgtggaaggcgcactggtactggagccgcttcatccgcgacgaggacgtgcacgtcggcggcggcgcagacgtcgagatgagctccaacggcaaggtccaggctgccaagctcccgtgacgccgaagcgtgtcgctggcgctcgccaataagctgttgccatacgaggccgaggaccttttgagtcctggtttgatttttcatttgtctcctgtattataattgccatacctaggatgatgacgaacaatcagtgcgtcactaatcattcccaatttccttttctttttaagtttgggctcctttgtgcccggatatatactctgctgccgtggtggctttggataaaaaatgaatatagatgctggttgaa

SEQ ID NO: 1872 - DNA, 2034 bp, Brachypodium distachyon
gcatcctctcctctcatctccttctgctgctctgaaccgaacacaggcttgctcatcagagtcagagagaacctctttcttggagcttctgaatctcgagagagacatccgctagctagcgtcgcgtaagtactcgcgttgagttgcgtgctagtaggcggcggtcgtgatggccggcggcgcggtggtgaacaccggaggggggaaggactaccccgggaagctcaccatgttcgtgctcttcgcctgcatcgtcgctgccaccggcggcctcatcttcggatatgacatcggcatctctggtggcgtgacgtcgatgaacccgttcctgatgaagttcttcccggcggtgtaccggcaggagcaggaggcggagcggaaccagagcaaccagtactgcaagttcgacagccagctgctcaccatgttcacctcctcgctctacctggcggcgctcgtcgcctccttcttcgccgccaccgtcactcgcgtcgccggccgaaagtggtccatgttcgccggcggcgtcaccttcctcgccggcgccgccctcaacggtgccgccaaggacgtcctcatgctcatcctcggacgcgtcctcctcggcatcggcgtcggcttcgctaaccagtcggtgccggtgtacctgtcggagatggcgccggcgcggctgcgagggatgctcaacatcgggttccagcagatgatcacgatcggcatcctgtgcgcgaacctgatcaactacggcacggccaagatcaagggagggtggggctggcgcgtgagcctggccctggccgcggtgccggccgccatcatcgccgtgggcgcgctcttcctccccgacacgcccaactccctcatcgaccgcggatacaccgacgacgccaagcgcatgctccggcgcgtgcgcggcacggacgacgtggacgaagaataccgcgacctggtggccgcgtccgaggagtccaagctcgtgagccacccgtggcgcaacatcctgcagcgccgctaccgcccgcagctcaccttcgcaatcgccatccctttcttccagcagctgaccggcatcaacgtcatcatgttctacgcgcccgtgctcttcaagacgctgggcttcgccgacgacgcctccctcatgtccgccgtcatcacgggcctcgtcaacgtcttcgccacttccgtgtccatcgtgaccgtggaccggctcgggcgccggaagctgttcctccagggcggggtccagatgctggtttgccagatcgtggtgggcgggctgatcggggcgaaattcgggttcagcggcgtggccgtgatccccaaggagtacgcggcgttcgtggtgctcttcatctgcgcctacgtggccgggttcgcctggtcctggggcccgctcgggtggctcgtccccagcgagatcttcccgctggagatcaggtcggccgggcagagcatcaccgtgtccgtcaacatgttctgcacgttcgtcatcgcgcaggcgttcctccccatgctctgccggttcaagttcatgctcttcttcttcttcggcgcgtgggtggtgctcatgacgctcttcgtggcattcttcctgccggagaccaagaacgtgcccatcgaggagatggtgctcgtctggaaggcgcactggtactggggccgcttcatccgggacgaggacgtgcacgtcggcgccgacgtcgagatgccggcatccggcaagaacaagatccagccaggcaacggcaagctcggcatctagctagcctgtgagtgacgtcgtcggtgaaaatgttcgctaataatcaagctgttgcagtccgatgtcaaggactttgagtcctgaatcctgatttgatttccattttttatgtgttgtaattgtcttagtacctaggacgatgacgaatagtccttaattccgggttcttttgtgccggagattttactctagtgccatggtggcatggatcaaatatggatagaaatgcaagttgaaaggcaatctctgcgcgtggatgaatcatgaattaa

SEQ ID NO: 1873 - DNA, 2226 bp, Brachypodium distachyon
attacagccctcaaatgtatctctgttttctaaggagcgcccccgccttcccactcctataaatcctcgctctcctccgcctccatttcctcccctcccattctcttctgcatcctctcctctcatctccttctgctgctctgaaccgaacacaggcttgctcatcagagtcagagagaacctctttcttggagcttctgaatctcgagagagacatccgctagctagcgtcgcgtaagtactcgcgttgagttgcgtgctagtaggcggcggtcgtgatggccggcggcgcggtggtgaacaccggaggggggaaggactaccccgggaagctcaccatgttcgtgctcttcgcctgcatcgtcgctgccaccggcggcctcatcttcggatatgacatcggcatctctggtggcgtgacgtcgatgaacccgttcctgatgaagttcttcccggcggtgtaccggcaggagcaggaggcggagcggaaccagagcaaccagtactgcaagttcgacagccagctgctcaccatgttcacctcctcgctctacctggcggcgctcgtcgcctccttcttcgccgccaccgtcactcgcgtcgccggccgaaagtggtccatgttcgccggcggcgtcaccttcctcgccggcgccgccctcaacggtgccgccaaggacgtcctcatgctcatcctcggacgcgtcctcctcggcatcggcgtcggcttcgctaaccagtcggtgccggtgtacctgtcggagatggcgccggcgcggctgcgagggatgctcaacatcgggttccagcagatgatcacgatcggcatcctgtgcgcgaacctgatcaactacggcacggccaagatcaagggagggtggggctggcgcgtgagcctggccctggccgcggtgccggccgccatcatcgccgtgggcgcgctcttcctccccgacacgcccaactccctcatcgaccgcggatacaccgacgacgccaagcgcatgctccggcgcgtgcgcggcacggacgacgtggacgaagaataccgcgacctggtggccgcgtccgaggagtccaagctcgtgagccacccgtggcgcaacatcctgcagcgccgctaccgcccgcagctcaccttcgcaatcgccatccctttcttccagcagctgaccggcatcaacgtcatcatgttctacgcgcccgtgctcttcaagacgctgggcttcgccgacgacgcctccctcatgtccgccgtcatcacgggcctcgtcaacgtcttcgccacttccgtgtccatcgtgaccgtggaccggctcgggcgccggaagctgttcctccagggcggggtccagatgctggtttgccagatcgtggtgggcgggctgatcggggcgaaattcgggttcagcggcgtggccgtgatccccaaggagtacgcggcgttcgtggtgctcttcatctgcgcctacgtggccgggttcgcctggtcctggggcccgctcgggtggctcgtccccagcgagatcttcccgctggagatcaggtcggccgggcagagcatcaccgtgtccgtcaacatgttctgcacgttcgtcatcgcgcaggcgttcctccccatgctctgccggttcaagttcatgctcttcttcttcttcggcgcgtgggtggtgctcatgacgctcttcgtggcattcttcctgccggagaccaagaacgtgcccatcgaggagatggtgctcgtctggaaggcgcactggtactggggccgcttcatccgggacgaggacgtgcacgtcggcgccgacgtcgagatgccggcatccggcaagaacaagatccagccaggcaacggcaagctcggcatctagctagcctgtgagtgacgtcgtcggtgaaaatgttcgctaataatcaagctgttgcagtccgatgtcaaggactttgagtcctgaatcctgatttgatttccattttttatgtgttgtaattgtcttagtacctaggacgatgacgaatagtccttaattccgggttcttttgtgccggagattttactctagtgccatggtggcatggatcaaatatggatagaaatgcaagttgaaaggcaatctctgcgcgtggatgaatcatgaattaagatatgaagacatgccatcatgagctatctggcaaccattttttggtttgtagcactaattaatttacgcgtatttacagctc

SEQ ID NO: 1874 - DNA, 1913 bp, Avena sativa
ccttccttcccgaactccctctgcttcccacaccacctgcgcatcatagtatcagagagatcttcttcttctgcctcttgatagcccgccattgctactatccttctgctgatagagtgtcgcgttgagatcttcttccgtcctttcgctagtcggcggtggtcgagatggccggcggcgcggtggtgaacaccggagggggcaaggactaccccggaaagctcaccatgttcgtgctcttcgcctgcatcgtcgcagccaccggcggactcatcttcggatacgacatcggcatctccggtggcgtgacgtcgatgaacccgttcctcatcaagttcttcccgggggtgtaccggcaggagcaggaggcggagcggaaccagagcaaccagtactgcaagttcgacagccagctgctcaccatgttcacctcctcgctctacctcgccgcgctggtcgcgtctttcttcgcggccaccgtcacacgcgtcgccggccgtaagtggtccatgttcgccggcggcgtcactttcctcgccggggccgcgctcaacggcgctgccaagaacgtgctcatgctcatcctcggccgcgtcctcctcggcatcggcgtcggcttcgccaaccagtcggtgccggtgtacctgtcggagatggcgccggcgaggctgcgcgggatgctcaacatcgggttccagatgatgatcaccatcggcatcctgtgcgcgaacctcatcaactacggcacggccaagatcaagggcgggtggggatggcgcgtcagcctcgcgctcgccgcggtgccggctgcgatcatcgccatcggctcgctcttccttccggacacccccaactccctcatcgaccgcggctacaccgtcgaagccaagcgcatgctccggcgcgtgcgcggcactgacgacgtccaggaggagtacaacgacctcgtggccgccagcgacgagtccaagctcgtcagccacccgtggcgcaacatcctccagcgccgctaccgcccccagctcaccttcgccatcgccatccccttcttccagcagctcaccggcatcaacgtcatcatgttctacgcgcccgtcctcttcaagacgctcgggttcgccgacgacgcctccctcatgtccgccgtcatcacgggcctcgtcaacgtctttgccaccttcgtgtccatcctcaccgtggaccgcctcggccgccggaagctcttcctccagggcggcacccagatgctggcgtgccagatcgtcatcggcagcctcatcggcgccaagttcggcttcaccggcgtggccgacatccccaagggctacgctgcgttcgtggtgctcttcatctgcgcgtacgtcgccggcttcgcctggtcgtggggcccgctcgggtggctcgtccccagcgagatcttcccactggagatcaggtcggcggggcagagcatcaccgtgtccgtgaacatgctctgcacattcatcatcgcgcaggcattcctccccatgctttgccgcttcaagttcatgctcttcttcttcttcggcgcgtgggtggtcgtcatgaccttgttcgtggccttcttcctgccggagacaaaaaacgtgcccatcgacgaaatggtgctcgtatggaagtcgcactggtactggagccgcttcatccgcgacgaggacgtgcacgtcggcgcggacgtcgagatgcgctccaacggcaagatccaggccgccaagctcaacatctagcccggaatgtcttcccggagaaataaactgctacaatccgaggtcgtggacttgattccagaaatgatttttcatttttctgtattatatgattgccatacctagccaggacgatgacgaaaagtcagtccgtcgctagcctttttccttctttttctttggttt

SEQ ID NO: 1875 - DNA, 1992 bp, Avena sativa
ccttccttcccgaactccctctgcttcccacaccacctgcgcatcatagtatcagagagatcttcttcttctgcctcttgatagcccgccattgctactatccttctgctgatagagtgtcgcgttgagatcttcttccgtcctttcgctagtcggcggtggtcgagatggccggcggcgcggtggtgaacaccggagggggcaaggactaccccggaaagctcaccatgttcgtgctcttcgcctgcatcgtcgcagccaccggcggactcatcttcggatacgacatcggcatctccggtggcgtgacgtcgatgaacccgttcctcatcaagttcttcccgggggtgtaccggcaggagcaggaggcggagcggaaccagagcaaccagtactgcaagttcgacagccagctgctcaccatgttcacctcctcgctctacctcgccgcgctggtcgcgtctttcttcgcggccaccgtcacacgcgtcgccggccgtaagtggtccatgttcgccggcggcgtcactttcctcgccggggccgcgctcaacggcgctgccaagaacgtgctcatgctcatcctcggccgcgtcctcctcggcatcggcgtcggcttcgccaaccagtcggtgccggtgtacctgtcggagatggcgccggcgaggctgcgcgggatgctcaacatcgggttccagatgatgatcaccatcggcatcctgtgcgcgaacctcatcaactacggcacggccaagatcaagggcgggtggggatggcgcgtcagcctcgcgctcgccgcggtgccggctgcgatcatcgccatcggctcgctcttccttccggacacccccaactccctcatcgaccgcggctacaccgtcgaagccaagcgcatgctccggcgcgtgcgcggcactgacgacgtccaggaggagtacaacgacctcgtggccgccagcgacgagtccaagctcgtcagccacccgtggcgcaacatcctccagcgccgctaccgcccccagctcaccttcgccatcgccatccccttcttccagcagctcaccggcatcaacgtcatcatgttctacgcgcccgtcctcttcaagacgctcgggttcgccgacgacgcctccctcatgtccgccgtcatcacgggcctcgtcaacgtctttgccaccttcgtgtccatcctcaccgtggaccgcctcggccgccggaagctcttcctccagggcggcacccagatgctggcgtgccagatcgtcatcggcagcctcatcggcgccaagttcggcttcaccggcgtggccgacatccccaagggctacgctgcgttcgtggtgctcttcatctgcgcgtacgtcgccggcttcgcctggtcgtggggcccgctcgggtggctcgtccccagcgagatcttcccactggagatcaggtcggcggggcagagcatcaccgtgtccgtgaacatgctctgcacattcatcatcgcgcaggcattcctccccatgctttgccgcttcaagttcatgctcttcttcttcttcggcgcgtgggtggtcgtcatgaccttgttcgtggccttcttcctgccggagacaaaaaacgtgcccatcgacgaaatggtgctcgtatggaagtcgcactggtactggagccgcttcatccgcgacgaggacgtgcacgtcggcgcggacgtcgagatgcgctccaacggcaagatccaggccgccaagctcaacatctagcccggaatgtcttcccggagaaataaactgctacaatccgaggtcgtggacttgattccagaaatgatttttcatttttctgtattatatgattgccatacctagccaggacgatgacgaaaagtcagtccgtcgctagcctttttccttcttctttctttggtttcctttgtgccaaatactacggtgccgttagtggcttgaacagaatacgaattatggaattatggatgcaagttggacc

SEQ ID NO: 1876 - DNA, 1397 bp, Pennisetum glaucum
tggggagtcgccatggccggcggcgtggtggtgaacaccggagggggcaaggactaccccggcaagctcaccatgttcgtgctattcgcctgcatcgtcgccgccaccggcggcctcatcttcggttacgacatcggcatctccggtggcgtgacgtcgatgaacccgttcctgaagaagttcttcccgtcggtgtaccgcaaggagcaggaggcggagcggaaccagagcaaccagtactgcaagttcgacagccagctgctgaccatgttcacctcctcgctctacctcgccgcgctggtggcctccttcttcgccgccacggtgacgcgcgtggccgggcgcaagtggtccatgttcggcggcggcgtcacgttcctcgtcggcgcggccctcaacggcgccgccaaggacgtggtcatgctcatcctcggccgcgtcctgctcggcatcggcgtcggcttcgccaaccagtccgtgcccgtgtacctgtcggagatggcacccgcgcgcctccgcgggatgctcaacatcggcttccagctcatgatcaccatcggcatcctgtgcgccaacctcatcaactacggcaccgccaagatcaagggcggctgggggtggcgcgtgagccttgccctcgcggcggtgccggcggccatcatcgccatcggcgcgctgttcctgcccgacacccccaactccctcatcgaccgcggctacaccgactccgccaagcggatgctcaagcgcgtgcgcggcacggaggacgtggaggaggagtacaacgacctcgtcgccgccagcgaggagtccaagctcgtggcgcacccgtggcggaacatcctgcagcggcgctacaggccgcagctcgtcatggccatcgccatccccatgttccagcagctcaccggcatcaacgtcatcatgttctacgcgccggtgctcttcaagacgctgggcttcgccgacgacgcctccctcatgtccgccgtcatcacggggctcgtcaacgtcttcgccacgttcgtctccatcgtcaccgtcgaccgcctcggccggcgcaagctgttcctgcagggcggcgctcagatgctggcctgccagatcgtcgtgggcagcttgatcggcgccaagttcgggttcaccggcgtggctgagatccccaaggcgtacgccgccatcgtggtgctcttcatctgcgcctacgtggccgggttcgcctggtcgtgggggcccctcgggtggctggtgccgagcgagatcttcccgctggagatccggtcggcggggcagagcatcaacgtgtccgtcaacatgctgtgcaccttcatcatcgcgcaggcgttcctccccatgctctgccgcgatgatgaaggggcagagcatcaacgtgtccg

SEQ ID NO: 1877 - DNA, 1127 bp, Saccharum officinarum
cgcgcttcctcctcctcctcctcatctcgccgccccgcaagcaatggcggtggcgcggctgcgcgcggcggccgccgcccggctgcagcccgcgctcgccggctgcggcgagaggcggccgctcgggacggcggcggaggtggccaccgcggggccaggggccgcgaggtgggagctcatgggggcgcgggagtactacgactaccggcgggccatctacggcgacatcacgcacaaggccatcctcgtcgacgccgccggcacgctgctcgcccccaccgagcccatggcccaggtgtacagaacgataggctagaagtatggagtggattactcagaggatgagattctgatgcggtatcggcgggcttatgcgcagccatggggtagatcacgtctgaggtatgtcaatgatggaaggcccttttggcaatacatagtgagttcatctactggctgctcagatctacagtattttgaggaactgtatcagtactatacaactgaaaaggcttggcatctctgcgatccagatgctggacgtgtttttgaggcattgaggagggctggtgtcaaaacagctgtcgtgtccaactttgacacccgtcttcggccacttttacaagcccttaaatgtgactgctggtttgatgcagttgctatatctgctgaggttgcagcagaaaagccaaaccctacaatattcttgaaggcctgcgagctgttaggagtgaaacctgaagaagctgtgcatattggtgatgaccgtagaaacgacatatggggagcaagggatgcaggctgcgatgcctggctttggggcagtgatgtttactccttcaaggaggttgcagagaggatcggggtcgaggtatagcaagttgttctcctgagccgcaataagagtacatagtgtcaacgccacttaccaagggcgtcttgtacatatttccaagggaaattacaagagcagtttctccctgtgggcgactgtgccaggcattttgtagcaaatactgatgtttatgtatacatttaaatgttcagttaaccgcctgttagtttcttgtgcgcggctgtgaccttgtggccccgttcgcttgtcttataagctatattttttcagc

SEQ ID NO: 1878 - DNA, 1084 bp, Zea mays
caccactcgccacgccttcgccgcctataaaccgccaccactagccccccctgctccgaggaccacaggagcccacggcacggcgacgccatcgacctcactccatccctccctccctccctccctcactcctcctcttcgccgcctcgcaagcaatggcggtggcgcggctacgcgcggtcgccgccgccgtgctgcagccggcgctcgccgcgggcggccgcggcgagaggcggccgctcgggacggcggcggaggtggccgcgggcgcgggcccgggggctgcgaggtgggagctcttgggcgcgcgggagtactacgactaccgccgcgccatgtacggcgacatcacgcacaaggccatcctcgtcgacgccgccggcacgctgctcgcccccaccgagcccatggcgcaggtgtacaggacgataggccagaagtacggagtgaattactcagaggatgagattctgatgcggtaccggctagcttatgcgcagccatggggtcgatcgcgtctgaggtatgtcgatgacggaaggcccttttggcaacatatagtgagctcatctaccggctgctcagatctacagtatttcgaggaactgtaccagtactacacaactgagaaggcctggcgtctctgcgacccagacgctggacgtgttttcgaggcgctgaggagggctggcgtcaaaacagccatcgtgtccaacttcgacactcgtcttcggccgcttttacaggcgctgaaatgcgacggctggttcgacgcagttgctgtgtctgctgaggttgcagcagaaaagccgaaccccacaatattcttgaaggcctgcgagctgctaggagtgaaacctgaagaagcggtgcacattggtgatgaccgtaggaacgacttatggggagcgagggatgcaggctgcgatgcctggctttggggcagtgacgtttactccttcaaggagatcgcggagaggatcggagttgaggtgtagcaagttgtttctcctcggtcggcgccacttaccccgggcgtcttgtacatattcccaagagaaataacaagagcatcagtttctcc

SEQ ID NO: 1879 - DNA, 1351 bp, Zea mays
gcttccactatctcccatttccctttttttataaccaaaacatgttctccattcgacctgagagaatcggaaggcatccatccaagtaaaccctgctgccgaacgaaggagcagcaaagccaccttccttctccaccacatcacctcacctctctcagtctcacgccgcagtcaccaactcgccacgcacgccttcgccgcctataaccgcaaggccccaagcccacgacgcgccacgccacgccgccagctgtcgctctccctcgcccctccccgctcctctcgccgcctcgcaatcaatggcggtggcgcggctgtgcgcggcggccgccgccgcccggctgcagccggcgctcgccgcgggcgcccgcggcctcgggacggcggcggaggtggccgcgggcgccaggtgggagcccatgggggcgcgggagtactacgactaccgccgggccatgtacggcgacatcacgcacaaggccatcctcgtcgacgccgccggcacgctgctcgccccaaccgagcccatggcgcaggtgtacagaacgataggccagaagtatggggttgattactccgaggatgagattctgatgcggtatcgctgggcgtatgcgcagccttggggtagatcacgtctgaggtatgtcaatgatggaaggcccttctggcaatacatagtgagttcatctactggctgctcaaatctagagtactttgaggagctgtatcaatattacacaactgaaaaggcttggcatctctgcgatccagatgctggacgtgtttttgaggcattgaggaaggctggtgtcaaaacagctgtcgtgtccaattttgacactcgtcttcggccacttttacaggcactgaaatgtgaccgctggtttgatgcagttgctgtatctgctgaggtcgcagcagaaaagccaaaccctacaatattcttgaaggcctgcgagctgttaggagtgaaaccagaagaagtcgtgcatattggtgacgaccgtaggaatgacctatggggagctagggatgcaggctgtgatgcctggctttggggcagtgatgtttactccttcaaggaggttgcggagaggatcggggttgaggtataggaagaagtcgctctcctgagccgcaagaagactcgtccttgtacatagtgttagggcgtcctgtacatagagacaaaatcctgtgtgcgactgtgccaaggccttctgtagcaaatactgatgtacatctttgcgtttgaatgttcgttgcggctgtgacctgcagaatagacctttggagacccctgcagcatctttcacgtttcatatcctgaagcatcatcagcgtcacc

SEQ ID NO: 1880 - DNA, 1291 bp, Setaria italica
gccacgcccacagccccacactcaagccgcgcgcgcgaagctgggggacggcacggggacgccaccgccgcccgcgcccgccaccgggccccgccacccgaggcgcacgctcctctcctcaccaccaccaccgcctcgcgagcaatggcggcggcgctgctgcgctcggcggccgaccggctccggcccgcgctcgctgctggcgcccgcggcgagaggcggctgctcgcgacggccgcggcggaggtgaccgtggacgcgggggcggcggccgccgccgcggtggccgccgcggtcgcgaggtgggagatcatgggcgcaggcgcgcgggagtactacgactaccggcgcgccatctacggcgacatcacgcacaaggccatcctcgtcgacgccgccggcacgctcctcgcccccaccgagcccatggcgcaggtatacagaacgatcggccaaaagtatggggtggactactcagaggatgagatcctgatgaggtaccggcgggcttatgcgcaaccatggggtaaatcgcgcctcaggtatgtcaatgatggaagacccttttggcaatacatagtcagttcctctacaggctgctcagatctgcagtactttgaggaactgtatcagtactatacgactgaaaaggcttggcatctctgtgatccagatgcaggacgcgttttccaggcattgagaagggctggtgtaaaaacagctgttgtgtccaactttgacactcgtcttcggccacttttgcaagccctgaaatgcgatcactggtttgatgcagttgccatatctgctgaggttgcagcagaaaagccaaacccaacaatattcttgaaggcatgtgagctgttgggcgtgaaacctgaagaagctgtgcatattggggatgaccgtaggaacgatttatggggagctagggatgcaggctgtgatgcctggctttggggcagcgatgtttactccttcaaggaggttgcagagaggatcggggttgaggtataacgagttgactgcagagtcatctcacatgagctgcaatgaaaagaatggaaaaaaaaaagatgttgcctgcctccttgtacataatgtcaacccttgttggttgttgccccggcgccttgtacatattttccatttccccagggaataactgagagcagttagtcctgtgacaggcctttcagtatcgaatactactgatatgtacatacacatttgagtgtccaattaacggcctgtttaacactgcttgtgccttgaataatccctgtgatcc

SEQ ID NO: 1881 - DNA, 1489 bp, Oryza sativa
tttttttcccatttggagccccctgtttgtactgaatttgccatttgtagccagtcctctcatcctctcctcctcgaaacggctaagcacaaaaacagaaaaccgaaaccgagggagaaggagcaaccaaccaaaccaacggacgccatcgccaccaccatcctcgccgtcgcctctccaactcaccactcctcctcctcctataaaccaacgaagaacacaaactcaaactcctccttcacacacacgcacgcgacaccggtcaagaagcgcgcgcgcgcgcaccactgcaccgcgcgagcggcaacggcggaggaggagaggctgtgagtggtgggcaatggccgtggcggcgcggctgaggtcggcgggggcaaggctcgtggtcgggccggcggcgatggcggtgggacgtggtggtggtggggaggggaggtggatggggacggccacggcggaggcggccgcggggatcgcgaggtgggagccgatgggggcgcgggagtactacgactaccggagggccatctacggcgacatcacccacaaggccatcctcgtcgacgccgccgggacgctcctcgcccccaccgagcccatggcgcaggtatacagaacaattggcgaaaagtatggagtcaactactcagaggatgagatcttgatgagatacaggagggcttatgcgcagccatggggtagatcgcggctgaggtatgtggatgatggtaggcccttctggcagcatatagttagctcttcaactggatgctcagatttacagtactttgaggaactttatcagtactatacaactgcaaaggcttggcagctctgcgaccctgacgctaaatatgtttttgaagcattgagaaaggctggtgtaaaaacagctgttgtatccaactttgacacacgtcttcggccacttttacaggccctgaattgtgatcactggtttgatgcagttgctgtatctgctgaggttgctgcggaaaagccaaacccaacaatattcttgaaggcttgcgagtttttaggtgtgaagcctgaagaagctgtgcatattggtgatgaccgcaggaatgatctctggggagccagggatgcaggctgtgatgcctggctctggggcagtgatgtttactctttcaaggaggtcgcagaaaggatcggagttaaggtgtaaggagtcgttcgtccgctgggtcacctgaaataagaaggccgggaggtgttgcatttttgtacatagcggcaacccttgttgctccactgatgtacatatttttccagagaataaccgatggcagtgtagtatatatctgtatgactgcatttgcatttgagactttgagcgctcaatttacgttacccctgctggtgtctgaaactctgaatgtctccttgtgttagctgaacctgaaaacgttaacctgaaggcgattagcatcaacatccacattgggtcgccggcccaggtgaccag

SEQ ID NO: 1882 - DNA, 1413 bp, Triticum aestivum
cacggcacggcggagccgccaccacctgagattctggcgcccggacccacctgccaccagagacccgccaccccgccacctcgttgacaatggcggtggcgcggctgcgctcggccgccgcggcccggctccagccggcgctcgcgggccggcggcgcctcgggacggcggccgcggcggaggccccggaggcggtcgtcggggcgggcagcgcgcggtgggagccgatgggcgcgcgggagtactacgactaccggcgcgccatctacggcgacatcacgcataaggccatcctcgtcgacgccgccggcaccctcctcgcccccaccgagcccatggcccaggtgtacagaacagtaggcgaaaagtatggggtgaagtactcggaggatgagatcttgatgaggtaccggcaggcatatgcgcagccatggggcagatcgcggcttaggtatgttgatgatgggaggcccttttggcaacatatagttagttcttctacaggctgctcagatttagagtactttgaggaactttatcattactatacaactgagaaggcctggcagctcattgaccctgacgctaaatatgttttcgaagcattgagaagggctggtgtgagaacagctgttgtatccaactttgacacccgtctccgcccacttttacaggccctgaattgtgatcactggttcgatgcagttgctgtatctgctgaggttgcagcagaaaagccaaacccaacaatattcctgaaggcctgcgagttgttggacgtgaagcctgaagaggctgtgcatattggcgacgaccgtcggaatgatttgtggggagctagggacgcaggctgcgatgcctggctctggggcagtgatgttcactccttcaaggaagtcgctgaaaggatcggagtcagtgttggtatgggcaacaatatgtgattcaccacgcttgcttgtaagcgggctccgctgcgcctggcgggcggtcagttcggatcgctgcccttcccttcttcctgtcgagtatatgctcgccgagccccctgagcttcaataaaaaggctgggaggtggtgcttaggttccctcctctgtacatagtgccgacccttctttgctcaggtgtgtgtgtggctgtccggccgctgtacatattttccagggaagtgagaactgatggcagtgtctctctgtggcaaggccttaatttcctaagtctatattgtagcaacaatgtacgtatgtaattaagcgaactcgatttaccctttggatcgttcctgccgtgtgctctgaaatctgtgtttcacaagaatgaccccaacgtgcccctgcattttgtacattggaatttggtaaagaaagttgagagcattgccttgtggtgctacggattatggtttgtttac

SEQ ID NO: 1883 - DNA, 1424 bp, Triticum aestivum
cacgcacgcacgccacaggagagaccgaccgcgcgcgctcgcacgctccggcacggcacggcggagccgccaccaccacctgagactctggcgccgggacccacctgccacccgagacccgccaccccgccacctcgttgacaatggcggtggcgcggctgcgctcggccgccgcggcccggctccagccggcgctcgcgggccggcggcgcctcgggacagcggccgcggcggaggccccggaggcggtcgtcggggcgggcagcgcgcggtgggagccgatgggcgcgcgggagtactacgactaccggcgggccatctacggcgacatcacgcacaaggccatcctcgtcgacgccgccggcaccctcctcgcccccaccgagcccatggcccaggtgtacagaacagtaggcgaaaagtatggggtgaagtactcggaggatgagatcttgatgaggtaccggcaggcatatgcgcagccatggggcagatcgcggcttaggtatgttgatgatgggaggcccttttggcaacatatagttagttcttctacaggctgctcagatttagagtactttgaggaactttatcattactatacaactgagaaggcctggcagctcattgaccctgacgctaaatatgttttcgaagcattgagaagggctggtgtgagaacagctgttgtatccaactttgacacccgtctccgcccacttttacaggccctgaattgtgatcactggttcgatgcagttgctgtatctgctgaggttgcagcagaaaagccaaacccaacaatattcctgaaggcctgcgagttgttggacgtgaagcctgaagaggctgtgcatattggggacgaccgtcggaatgatttgtggggagctagggacgcaggctgcgatgcctggctctggggcagtgatgttcactccttcaaggaagtcgcagaaaggatcggagtcagtgtgggtatgggcaacaatatgtgattcgccacgcctgcttgtaagcagactctactacgcctctggtggtcatgacggatcgccaccgttcccttcttcctgtcgagtatgctcgccgaggcccctgagcttcaataaaaaggctgggaggtggtgcttagtttccctcctctgtacatagtgccgacccttctttgctcaggtgtgtgtgtggctgtccggccgctgtacatattttccagggaagtgagaactgatggcagtgtctctttgtgtcaggccttaatttccaaagtctatattgtagcaacaatgtacgtatgtaattaagcgaactcgatttaccctttaaatagttcctgccgtgtgctctgaaatctgtgcttcacgagaatgacccctgcattttgtacattggatttggtaaaaatttctgagggtattgcctcc

SEQ ID NO: 1884 - DNA, 1423 bp, Triticum aestivum
gcacgcacgccacaggagagaccgaccgcgcgcgcgcgctcgaacacggcacggcggagccgccaccacctgagattctggcgcccggacccacctgccaccagagacccgccaccccgccacctcgttgacaatggcggtggcgcggctgcgctcggcaaccgcggcggcggcggcccggctccagccggcgctcgcgggccggcggcgcctcgggacggcggccgcggcggaggccccggaggcggtcgtcggggcgggcagcgcgcggtgggagccgatgggggcgcgggagtactacgactaccggcgcgccatctacggcgacatcacgcacaaggccatcctcgtcgacgccgccggcacgctcctcgcccccaccgagcccatggcccaggtgtacagaacagtaggcgaaaagtatggggtgaagtactcggaggatgagatcttgatgaggtaccggcaggcatatgcgcagccatggggcagatcgcggcttaggtatgttgatgatgggaggcccttttggcaacatatagttagttcttctacaggctgctcagatttacagtactttgaggaactttatcattactatacaactgagaaggcctggcggctcattgatcctgatgctaaatatgtttttgaagcattgagaagggctggtgtgagaacagctgttgtatccaactttgacacccgtctccggccactgttacaggccctgaattgcgatcactggttcgatgcagttgctgtatctgctgaggttgcagcagaaaagccaaacccaacaatattcctgaaggcctgcgagttgttggacgtgaagcctgaagaggctgtgcatattggcgacgaccgtcggaatgatttgtggggagctagggacgcaggctgcgatgcctggctctggggcagtgatgttcactccttcaaggaagtcgctgaaaggatcggagtcagtgttggtatgggcaacaatatgtgattcaccacgcttgcttgtaagcggactccgctgcgcctggcgggcggtcatttcggatcgctgccgttcccttcttcctgtcgagtatgctcgccgagccccctgagcttcaataaaaaggctgggaggtggtgcttagtttccctcctctgtacatagtgccgacccttctttgctcaggtgtgtgtgtggctgtccggccgctgtacatattttccagggaagtgagaactgatggcagtgtctctttgtgtcaggccttaatttccaaagtctatattgtagcaacaatgtacgtatgtaattaagcgaactcgatttaccctttaaatagttcctgccgtgtgctttgaaatctgtgcttcacgagaatgacccctgcattttgtacattggatttggtaaaaatttctgagggtattgcct

SEQ ID NO: 1885 - DNA, 1433 bp, Triticum aestivum
ggcgtcacacccacacacacggccacgcacgccacaggagagagaccgaccccgcgcgcgcgcacgctcgaacacggcacggcggagccaccacctgagattctggcgcccggacccacctgccacccgagacctgctaccccgccacctcgttgacaatggcggtggcgcggctgcgctcggccaccgcggcccggctccagccggcgctcgccggccggcggcgcctcgggacggcggccgccgcggaggccccggaggcggtcgtcggggcgggcggcgcgcggtgggagccgatgggcgcgcgggagtactacgactaccggcgggccatctacggcgacatcacgcacaaggccatcctcgtcgacgccgccggcaccctcctcgcccccaccgagcccatggcccaggtgtacagaacagtaggcgaaaagtatggggttaagtactcggaggatgagatcctgatgaggtaccggcaggcatattcgcagccatggggcagatcgcggcttaggtatgttgatgatgggaggcccttttggcaacatatagttagttcttctacaggctgctcagatttacagtactttgaggaactttatcattactatacaactgagaaggcctggcggctcattgaccctgatgctaaatatgtttttgaagcattgagaagggctggtgtgagaacagctgttgtatccaactttgacactcgcctccggccacttttacaggccctgaattgcgatcactggttcgatgcagttgctgtatctgctgaggttgcagcagaaaagccaaacccaacaatattcctgaaggcctgcgagttgttggacgtgaagcctgaagaggctgtgcatattggggacgaccgtcggaatgatttgtggggagctagggacgcaggctgcgatgcctggctctggggcagtgatgttcactccttcaaggaagtcgcagaaaggatcggagttagcgtgggtatgggcaacaatatgtgatgtgattcgccgcggttgcttgtaaggcggactctgctgcgcctggcgggcggtcagtgtggatcgctgcccttcccttcttcctgtcgagtatatgctcgccgtgccccctgagcttcaataaaaaggctgggaggtggtgcttaggttgcctcctctgtacatagtgccggcccttctttgctcaggtgtgtgtgtggctatccggccgctgtacatattttccagggaagtgagaactgatggcagtgtctctttgtggcaaggccttaatttcctaagtctatattctagcaacaatatacgtatgtaattaagtgaactcgatttatcatttggatacttcctgccgcgtgctctgaaatctgtgtttcacgagaatggccccaacgtatccaccgcattttgtacattggattt

SEQ ID NO: 1886 - DNA, 1429 bp, Avena sativa
cacgcacagacatacacgagacggcgcgcgcgcgcacgctggggacggcacggcggagccaccaccgggacccaccaccaccaccaccaccacctgacgcgctccccccctcgccacctcgttgacaatggcggtggcgcggctgcgctcggcctcctcggcggcggcggcgcggctccagccggcgctcgcgggccgcggcgaggaccggcgccggcacctcgggacggccgcggcggcggcggcggtcgcggacgcggtcggggccggggccgccaggtgggagccgatgggggcgcgggagtactacgactaccggagggccatctacggcgacatcacgcacaaggccatcctcgtcgacgccgccggcaccctcctcgcacccaccgagcccatggcccaggtgtacagaacactcggcgagaagtacggggtgaagtactcggaggatgagatcttgatgaggtaccggcaggcgtatgcgcaaccatggggtagatcacggcttaggtatgttgatgatggaagacccttttggcaacacatagttagttcttctacagggtgctcagatttagaatacttcgaggaactttatcattactatacaactgaaaaggcttggcagctcatcgaccctgatgctaaatatgttttcgaggcactgagaagggctggtgtaagaacagctgttgtatccaactttgacacccgtctccggccacttttacaggccctgaattgtgatcactggtttgatgcagttgctgtatctgctgaggttgcagctgaaaagccaaacccaacaatattcctgaaggcctgtgagttgctgggggtgaaacctgaagaggctgtgcatattggtgatgaccgtaggaacgacttatggggtgctagggatgcaggctgtgatgcctggctttggggcagcgatgttcactccttcaaggaggtcgcggaacggatcggagttagcgtgggcatgggcaactgtatgtgattccctatgcttgctcacgctctaccccataaagcctactcgactgtgtgtggcggtcagcgacacttcctcggttgcgcgaaccgctacccttcctttcttcctgacgaatatgctcgcagagcccctgagcttcaataaaaggctgggataaggaggtgttctgccgccttcctttttgtacatagtgcccacccttcttgctcgggtgtctggctgtctgctgtacatatttttccagagaaccgagggccgcgtctcctatgtcagtccttataattttcctacgtagtaagtagtatatgttatagcagaagtgtactcttatgtagttaagcaaactcgatttaccccgtttcgatgtttcgcggtgtgtgttctgaatcttgtgtttcatgcagtgtactgaacccagtgtgtccc

SEQ ID NO: 1887 - DNA, 1656 bp, Avena sativa
cttggccacacacacgcacagacatacacgagacggcgcgcgcgcgcacgctggggacggcacggcggagccagcaccgggacccaccaccaccaccacctgacgctctccccccctcgccacctcgttgacaatggcggtggcgcggctgcgctcggcctcctcggcggcggcggcgcggctccagccggcgctcgcgggccgcggcgaggaccggcgccggcacctcgggacggccgcggcggcggcggtggtcgcggacgcggtcggggccggggccgccaggtgggagccgatgggggcgcgggagtactacgactaccggagggccatctacggcgacatcacgcacaaggccatcctcgtcgacgccgccggcaccctcctcgcacccaccgagcccatggcccaggtgtacagaacactcggcgagaagtacggggtgaagtactcggaggatgagatcttgatgaggtaccggcaggcgtatgcgcaaccatggggtagatcacggcttaggtatgttgatgatggaagacccttttggcaacacatagttagttcttctacagggtgctcagatttagaatacttcgaggaactttatcattactatacaactgaaaaggcttggcagctcatcgaccctgatgctaaatatgttttcgaggcactgagaagggctggtgtaagaacagctgttgtatccaactttgacacccgtctccggccacttttacaggccctgaattgtgatcactggtttgatgcagttgctgtatctgctgaggttgcagctgaaaagccaaacccaacaatattcctgaaggcctgtgagttgctgggggtgaaacctgaagaggctgtgcatattggtgatgaccgtaggaacgacttatggggtgctagggatgcaggctgtgatgcctggctttggggcagcgatgttcactccttcaaggaggtcgcggaacggatcggagttagcgtgggcatgggcaactgtatgtgattccctatgcttgctcacgctctaccccataaagcctactcgactgtgtgtggcggtcagcgacacttcctcggttgcgcgaaccgctacccttcctttcttcctgacgaatatgctcgcagagcccctgagcttcaataaaaggctgggataaggaggtgttctgccgccttcctttttgtacatagtgcccacccttcttgctcgggtgtctggctgtctgctgtacatatttttccagagaaccgagggccgcgtctcctatgtcagtccttataattttcctacgtagtaagtagtatatgttatagcagaagtgtactcttatgtagttaagcaaactcgatttaccccgtttcgatgtttcgcggtgtgtgttctgaatcttgtgtttcatgcagtgtactgaacccagtgtgtccccttgcattttgcgaaaatttggatttggttatttcctctgcatatctttcatttttcttccagttgagctggttgccgcttgcaccgtgtggctgcggcgagtggtgcaggcgctcgcgctcgctaccggccggttacaacagttaccgcaggcagctgttacctcgtcgtcggcgactgctctgtgcctgaggcagttagctgacgggcggcgagcgtgc

SEQ ID NO: 1888 - DNA, 1655 bp, Avena sativa
cttggccacacacacgcacagacatacacgagacggcgcgcgcgcgcacgctggggacggcacggcggagccagcaccgggacccaccaccaccaccacctgacgctctctccccctcgccacctcgttgacaatggcggtggcgcggctgcgctcggcctcctcggcggcggcggcgcggctccagccggcgctcgcgggccgcgccgaggaccggcgccggcacctcggcacggccgcggcggcggcggtggtcgcggacgcggtcggggccggggccggggccgccaggtgggagccgatgggggcgcgggagtactacgactaccggagggccatctacggcgacatcacgcacaaggccatcctcgtcgacgccgccggcaccctcctcgcccccaccgagcccatggcccaggtgtacagaacactcggcgagaagtacggggtgaagtactcggaggatgagatcttgatgaggtaccggcaggcgtatgcgcaaccatggggcagatcacggcttaggtatgttgatgatggaagacccttttggcaacacatagttagttcttctacagggtgctcagatttggaatacttcgaggaactttatcattactatacaactgaaaaggcttggcagctcatcgaccctgatgctaaatatgttttcgaggcactgagaagggctggtgtaagaacagctgttgtatccaactttgacacccgtctgcggccacttttacaggccctgaattgtgatcactggtttgatgcagttgctgtgtctgctgaggttgcagctgaaaagccaaacccaacgatattcttgaaggcctgtgagttgctggacgtgaaacctgaagaggctgtgcatatcggtgatgaccgtaggaacgacttatggggagctagggacgcaggctgtgatgcctggctttggggcagcgatgttcactccttcaaggaggttgcagaaaggatcggagttagcgtgggcatgggcaactgtatgtgattccctacgcttgctcgcgctctaccccataaagacgactcgactgtgcgtggcggtcagcgacacttcctcggttgcgcgaaccgctacccttcctttcttcctgacgaatatgctcgcagagcccctgagcttcaataaaaggctgggataaggaggtgttctgcctccttcctttttgtacatagtgcccacccttcttgctcgggtgtctggctgtctgctgtacatatttttccagagaaccgagggccgcgtctcctatgtcagtccttataattttcctacgtagtaagtagtatatgctatagcagaagtgtactcttatgtagttaaggaaactcgatttaccccgtttggttcgtggtgtgtgttctgaatcttgtgtttcaagcagtgaactgaacccaatgtgccccttgcattatgcgaatttggatttggttatttcctctgcatatctttcatttttcttccagttgagctggttgccgcttgcaccgtgtggctgcggcgagtggtgcaggcgctcgcgctcgctaccggccggttacaacagttaccgcaggcagctgttacctcgtcgtcggcgactgctctgtgcctgaggcagttagctgacgggcggcgagcgtgc

SEQ ID NO: 1889 - DNA, 1409 bp, Brachypodium distachyon
cccaacactcaccccccacccccgaacgcaagcacgcgcgagcgctggggacggccacggcgccaccaccacctgagcccggcaccggggacccaccgtatacctcaccacatcgatgacaatggcggctgcgcggctgcgctcggctaccgcggtggcagcggcggcgcgggtcgtgggctgcggcgaggggacaaggaggatgctcgggacggcggcggcggcggaggtcgcggaggcggggggcgcgaggtgggagccgatgggcgcgcgggagtactacgactaccggagggccatctacggcgacatcacccataaggccatcctcgtcgacgccgccggcaccctcctcgccccgaccgagcccatggcgcaggtgtacagaacactcggcgagaagtatggagttaagtactcggaggaagagatcttgatgaggtatcggcaggcttatgcccaaccatggggtagatcacggcttaggtatgttgatgatggaagacccttttggcaacacatagttagttcttctacaggctgctcggatttacaatactttgaggaactttattgttactatacaactgaaaaggcatggcagctcattgaccctgatgctaaatacgtttttgaagcactgagaagggctggtgtgagaacagctgttgtatccaactttgacacccgtcttcggccacttttacaggccctgaaatgtgatcactggtttgatgctgttgctgtatctgctgaggttgcagcagaaaagccaaatccaacaatattcttgaaggcctgcgagttgttgggcgtgaaacctgaagaggctgtgcatattggcgacgaccgtaggaatgatttatggggagctagggacgcaggctgcgatgcctggctttggggcagtgatgttcactctttcaaggaggtcgcggagaggatcggagttaaggtgggaatgggcaactctatgtgatcctctacgctttactgcatagcggtcagcggcacttcttcggctccgcaaatcgcaacacaccgcttcttccaggcgagcatgctcaccgagccgccggcgatccccccctgaggttcaataaaaaagggctgggaggaggtgtttggcctcccctttgtatatagcgccggccccttcttgcccgggtgttcctgggtcgctggctgtccgctgtacatagtttccagtgaactgatcggtagcgtctcgtcagtgtccttacatagtactactccctttgtattaggcgctcttgtattatgggacggacgagtactatatatactactcctatattgcagtgacaatggatctattcatttaatccagctcagttttccccattgtgtagttcctgctttgtggtgtgacccaaaagaaagaaagg

SEQ ID NO: 1890 - DNA, 1517 bp, Brachypodium distachyon
cccaacactcaccccccacccccgaacgcaagcacgcgcgagcgctggggacggccacggcgccaccaccacctgagcccggcaccggggacccaccgtatacctcaccacatcgatgacaatggcggctgcgcggctgcgctcggctaccgcggtggcagcggcggcgcgggtcgtgggctgcggcgaggggacaaggaggatgctcgggacggcggcggcggcggaggtcgcggaggcggggggcgcgaggtgggagccgatgggcgcgcgggagtactacgactaccggagggccatctacggcgacatcacccataaggccatcctcgtcgacgccgccggcaccctcctcgccccgaccgagcccatggcgcaggtgtacagaacactcggcgagaagtatggagttaagtactcggaggaagagatcttgatgaggtatcggcaggcttatgcccaaccatggggtagatcacggcttaggtatgttgatgatggaagacccttttggcaacacatagttagttcttctacaggctgctcggatttacaatactttgaggaactttattgttactatacaactgaaaaggcatggcagctcattgaccctgatgctaaatacgtttttgaagcactgagaagggctggtgtgagaacagctgttgtatccaactttgacacccgtcttcggccacttttacaggccctgaaatgtgatcactggtttgatgctgttgctgtatctgctgaggttgcagcagaaaagccaaatccaacaatattcttgaaggcctgcgagttgttgggcgtgaaacctgaagaggctgtgcatattggcgacgaccgtaggaatgatttatggggagctagggacgcaggctgcgatgcctggctttggggcagtgatgttcactctttcaaggaggtcgcggagaggatcggagttaaggtgggaatgggcaactctatgtgatcctctacgctttactgcatagcggtcagcggcacttcttcggctccgcaaatcgcaacacaccgcttcttccaggcgagcatgctcaccgagccgccggcgatccccccctgaggttcaataaaaaagggctgggaggaggtgtttggcctcccctttgtatatagcgccggccccttcttgcccgggtgttcctgggtcgctggctgtccgctgtacatagtttccagtgaactgatcggtagcgtctcgtcagtgtccttacatagtactactccctttgtattaggcgctcttgtattatgggacggacgagtactatatatactactcctatattgcagtgacaatggatctattcatttaatccagctcagttttccccattgtgtagttcctgctttgtggtgtgacccaaaagaaagaaaggaaaaaaagagcctgatcggacgtgtcaactgcatttgtttagcttctttctgtacacagtgttttcgaagtggagttgctctttgccgtggcaggttttcaaatgaag

SEQ ID NO: 1891 - DNA, 1359 bp, Triticum aestivum
ggcgtcacacccacacacacggccacgcacgccacaggagagagaccgaccccgcgcgcgcgcacgctcgaacacggcacggcggagccaccacctgagattctggcgcccggacccacctgccacccgagacctgctaccccgccacctcgttgacaatggcggtggcgcggctgcgctcggccaccgcgacggcggcggcggctggggcccggctccagccggcgctcgcgggccggcggcacctcgggacggcggccgcggcggaggccccggaagcggtcgtcggggcgggcggcgcgcggtgggagccgatgggcgcgcgggagtactacgactaccggcgggccatctacggcgacatcacgcacaaggccatcctcgtcgacgccgccggcaccctcctcgcccccaccgagcccatggcccaggtgtacagaacagtaggcgaaaagtatggggttaagtactcggaggatgagatcctgatgaggtaccggcaggcatattcgcagccatggggcagatcgcggcttaggtatgttgatgatgggaggcccttttggcaacatatagttagttcttctacaggctgctcagatttacagtactttgaggaactttatcattactatacaactgagaaggcctggcggctcattgaccctgatgctaaatatgtttttgaagcattgagaagggctggtgtgagaacagctgttgtatccaactttgacacccgcctccggccacttttacaggccctgaattgcgatcactggttcgacgcagttgctgtgtctgctgaggttgcagcagaaaagccaaacccaacaatattcctgaaggcctgcgagttgttggacgtgaagcctgaagaggctgtgcatattggggacgaccgtcggaatgatttgtggggagctagggacgcaggctgcgatgcctggctctggggcagtgatgttcactccttcaaggaagtcgcagaaaggatcggagttagcgtgggtatgggcaacaatatgtgattcgccacggttgcttgtaagcggactctgctgcacctggcgtgcggtcggtgcggatcgccgcccttcccttcttcctgtcgagtatgctcgccgagccccctgagcttcaataaaaaggctgggaggtggtgcttagttcgcctcctctgtacatagtgccgacccttctttgctcaggtgtgtgtgtggctgtccggccgctgtacatattttccagggaagtgagaactgatggcagtgtctctctgtgacaaggccttaatttcctaagtctatattgtagcaacaatgcacgtatgtaattaagcgaactcgatttaccctt

SEQ ID NO: 1892 - DNA, 1067 bp, Setaria italica
cgcggaggtgaccgtggacgcgggggcggcggccgccgccgcggtggccgccgcggtcgcgaggtgggagatcatgggcgcaggcgcgcgggagtactacgactaccggcgcgccatctacggcgacatcacgcacaaggccatcctcgtcgacgccgccggcacgctcctcgcccccaccgagcccatggcgcaggtatacagaacgatcggccaaaagtatggggtggactactcagaggatgagatcctgatgaggtaccggcgggcttatgcgcaaccatggggtaaatcgcgcctcaggtatgtcaatgatggaagacccttttggcaatacatagtcagttcctctacaggctgctcagatctgcagtactttgaggaactgtatcagtactatacgactgaaaaggcttggcatctctgtgatccagatgcaggacgcgttttccaggcattgagaagggctggtgtaaaaacagctgttgtgtccaactttgacactcgtcttcggccacttttgcaagccctgaaatgcgatcactggtttgatgcagttgccatatctgctgaggttgcagcagaaaagccaaacccaacaatattcttgaaggcatgtgagctgttgggcgtgaaacctgaagaagctgtgcatattggggatgaccgtaggaacgatttatggggagctagggatgcaggctgtgatgcctggctttggggcagcgatgtttactccttcaaggaggttgcagagaggatcggggttgaggtataacgagttgactgcagagtcatctcacatgagctgcaatgaaaagaatggaaaaaaaaaagatgttgcctgcctccttgtacataatgtcaacccttgttggttgttgccccggcgccttgtacatattttccatttccccagggaataactgagagcagttagtcctgtgacaggcctttcagtatcgaatactactgatatgtacatacacatttgagtgtccaattaacggcctgtttaacactgcttgtgccttgaataatccctgtgatccaaacgcattgccccc

SEQ ID NO: 1893 - DNA, 1232 bp, Festuca arundinacea
  misc_feature (42)..(42): n is a, c, g, or t
  misc_feature (193)..(194): n is a, c, g, or t
  misc_feature (206)..(206): n is a, c, g, or t
  misc_feature (218)..(218): n is a, c, g, or t
  misc_feature (365)..(365): n is a, c, g, or t
  misc_feature (679)..(679): n is a, c, g, or t
ggcacgccggagccgccacctgagacccaccaccacctgacncgctctccacctcgttgacaatggcggtggcgcggctgcgctcggcctcctcggcggcggcgcggctccagccggcgctcgcgggccgcggcgaggaacggcggcggtacctagggaccgcggctgcggctgcggcggcggaggcggaggnngctgttgccgtnggggccgtcggngcgaggtgggagccgatgggggcgcgggagtactacgactaccggagggccatctacggcgacatcacgcacaaggccatcctcgtcgacgccgccggcaccctcctcgcccccaccgagcccatggcacaggtgtacagaacactnggtgaaaagtatggagtgaagtactcggaggatgagatcttgatgaggtacaggcaggcgtatgcgcaaccatggggtagatcgcggcttaggtatgttgacgatggaagacccttttggcaacatatagttagttcttctacaggctgctcagatttagaatactttgaggaactttatcattactatacaactgaaaaggcctggcagctcatcgaccctgatgctaaatatgttttcgaagcattgagaagggctggtgtaagaacagctgttgtatccaactttgacacccgtctccggccacttttacnggccctgaattgtgatcactggtttgatgcagttgctgtatctgctgaggttgcagcagaaaagccaaacccaacaatattcttgaaggcctgtgagttgttggacgtgaaacctgaagaggcagtgcatattggtgatgaccgtaggaacgatttatggggagctagggacgcaggctgtgatgcctggctttggggcagcgatgttcactccttcaaggaggtcgcagaaagaatcggagttagcgtgggtatgggcaactctatgtgattccctacgcttgctcgcactctacaccataagccgactcaactgtgtgtggcggtcagtgacacttcctcggttgcgcgaaccgctacccttccgttcttcctgacgagtatgctcaccgagcccctgagcttcaataaaaggctgggaggaagaggtgttttacctccttcctgttgtacatagtgccgacccttcttgctctcgggtgcctggctgtctgctgtacatattttcccagagaactgagggcagcttctcttgtgtcaggccttatttttc

SEQ ID NO: 1894 - DNA, 1030 bp, Pennisetum glaucum
cgggggtgaccgcggtggccgcggccgccgcggtcgccaggtgggagctcatgggcgcgggcgcgagggagtactacgactaccgccgcgccatctacggcgacatcacgcacaaggccatcctcgtcgacgccgccggcacgctcctcgccccaaccgagcccatggcgcaggtatacagaacgatcggccaaaagtatggagtggagtactcagagggtgagatcctgacgaggtatcggcgggcttatgcgcaaccctggggtgcttcgcgcctgaggtatgtcgatgatggaaggcccttttggcaatacatagtcagttcctctacaggctgctcagatctgcagtactttgaggaattgtatcagtactatacgactgaaaaggcttggcgtctctgcgatccagatgcagggcgtgttttccaggcattgagaagggctggtgtaaaaacagctgttgtgtccaactttgacactcgccttcggccacttttgcaagccctgaaatgcgatcactggtttgatgcagtcgccatatctgctgaggttgcagcagaaaagccaaacccaacaatattcctgaaggcatgtgagctgttgggcgtgaaacctgaagaagctgtgcatattggcgatgaccggaggaacgatttgtggggggctagggatgcaggctgtgacgcctggctttggggcagcgacgtttactccttcaaggaggttgcggagaggatcggggttgaggtctaacgaacgagttgactgcaaggtcatctcacatgagctgcaataagaaggaaggggaaagaaaagaaaagaaaagaaaagaaaagaaaaggctgtgtggtgtttgccttgtctccttgtacataaatgccaacccccttgtgccccggcgcctttgtacatattttccattttcctcagggagtaactgcgagcagtttgtcctgtgactttcggtatcgaatactactcctactagtgatgtgtgtgtgtatacgcatttcagtgcccaattaacc

SEQ ID NO: 1895 - DNA, 1227 bp, Triticum aestivum
gggacagcggccgcggcggaggccccggaggcggtcgtcggggcgggcagcgcgcggtgggagccgatgggggcgcgggagtactacgactaccggcgcgccatctacggcgacatcacgcacaaggccatcctcgtcgacgccgccggcacgctcctcgcccccaccgagcccatggcccaggtgtacagaacagtaggcgaaaagtatggggtgaagtactcggaggatgagatcttgatgaggtaccggcaggcatatgcgcagccatggggcagatcgcggcttaggtatgttgatgatgggaggcccttttggcaacatatagttagttcttctacaggctgctcagatttacagtactttgaggaactttatcattactatacaactgagaaggcctggcggctcattgatcctgatgctaaatatgtttttgaagcattgagaagggctggtgtgagaacagctgttgtatccaactttgacacccgtctccggccactgttacaggccctgaattgcgatcactggttcgatgcagttgctgtatctgctgaggttgcagcagaaaagccaaacccaacaatattcctgaaggcctgcgagttgttggacgtgaagcctgaagaggctgtgcatattggcgacgaccgtcggaatgatttgtggggagctagggacgcaggctgcgatgcctggctctggggcagtgatgttcactccttcaaggaagtcgctgaaaggatcggagtcagtgttggtatgggcaacaatatgtgattcaccacgcttgcttgtaagcgggctccgctgcgcctggcgggcggtcagttcggatcgctgcccttcccttcttcctgtcgagtatatgctcgccgagccccctgagcttcaataaaaaggctgggaggtggtgcttaggttgcctcctctgtacatagtgccgacccttctttgctcaggtgtgtgtgtggctgtccggccgctgtacatattttccagggaagtgagaactgatggcagtgtctctctgtgacaaggccttaatttcctaagtctatattgtagcaacaatgtacgtatgtaattaagcgaactcgatttaccctttggatcgttcctgccgtgtgctctgaaatctgtgtttcacaagaatgaccccaacgtgcccctgcattttgtacattggatttggtaaagaaagttgagagcattgccttgtgg

SEQ ID NO: 1896 - DNA, 1056 bp, Panicum virgatum
ggcggaggtgaccgcggatgcggcggccaccgtggccgccggggtcgcgaggtgggagcccatgggcgcgcgggagtactacgactaccggcgggccatctacggcgacatcacgcacaaggccatcctcgtcgacgccgccggcacgctcctcgcccccaccgagcccatggcgcaggtatacagaacgatcggccagaagtatggagtggaatactcagaggatgaaatactgatgaggtatcggcgggcttatgcgcaaccatggggtagatcccgcctgaggtatgtcaatgatggaaggcccttttggcaacacatagtcagttcctctacaggctgctcagatctgcagtactttgaggaagtgtatcagtactatacgactgaaaaggcttggcatctctgtgatccagacgcagggcgcgttttccaggcattgagaagggctggtgtaaaaactgctgttgtgtccaactttgacactcgtcttcggccacttttacaggccctgaaatgtgatcaatggtttgatgcagttgctgtatctgctgaggttgcagcagaaaagccaaacccaacaatattcttgaaggcctgcgagctgttgggcgtgaaacctgaagaaactgtgcatattggggatgaccgtaggaacgatgtatggggagctagggatgcaggctgtgatgcctggctttggggcagtgatgtttactccttcaaggaggtcgcagagaggatcggggttgaggtataacgacttgactgcagagtcaactcaacatgagctgcaatacaaagaagaaaataggctgtggtgttgcctccttgtacatagtgtcaattcttgttgccccggcaccttgtacatactttccattttcccagggaataacagagagcagtttgtcctgcgatatgccccttcccgtagcaactgttgaatactgtatatgtgcgtttcactgtccaattgggccgcctgtttaatttgctgttgcttgtgcgtaattctgtgatccaaacgcatttgcaattgacccgaacagtgac

SEQ ID NO: 1897 - DNA, 1680 bp, Zea mays
gtcggcggcgtcaatgccgcgccgcacccgtcctccactgacctcgcgccagctgccctgcagctccccaaaccccccctccgcatccacgagccggcgcatcgttcatgtgagtgtgaccaccggcacgtcccctgctgtattttaaggccacctaccttaaccaccgtgctgcaccacctccactcccccgtcactccggcgagcgagcaggagcagaccgatggcgtctcccgctgccgtcaagaaggtgctggtgccgatcgcggcgggctcggagcccgcggaggcgttcgtccccatcgccgtcctccgccgcgcgggcgccgacgtcaccgtggcggccgccggagccggaaccggcctgcgcgtccacgctatgtacggggtcaccgtcgtcgcggacgccagcgtcgccgactgcgccgacgcctcctacgacctcgtcgtcctccccggcggcgtccccggcgcggacaacctgggcggctgcgcggcgctggagggcatcgtgaggcgccacgcgctcgggggcgggctctgcgccgccatctgcgccgcgccgccgctggcgctggcgcgctggggcctgctcgacggcgtcaaggcaacggctcacccggagttcgtggacaagttcccggcagaggtggccggcgtggacgcgaacgtggtggtcgacggcagggtcgtgacggggcgtggccccgcggcggccatggagttcgctctcgctctcgtggaccagctctacggcaagggcaaggtcgacgagatcgccaaacccatgatggtcaggtacgaaccagggtacgccttcgaggaactgaacccggttcagtggcggtgcagcggcacgcccagggtcctgataccagtggccaacggcagcgaggagatggaggtgctcgtgaccgtcgacgtgctgcgccgggccaaggcggacgtcgtggtcgcgtcggccgaggaggtcgtcgtcgcgcgccacggcaccaggatcgtcgccgacgcgctgctgcaggacgccgccggccagcagttcgacctcatcgtcgtaccgggtggcatgccgggcgtgaagacgacgctggcagacaaggtggagctcatggcgctgctgaaggagcatgcggcggcgggcagggcgtacggcgccattggcgccgccacggcgcaggtgctggagccgcacggcctcatcgggggcagcatgaaggcgacgacgtgcgcgtccagggcggaccggcccagcgagtgcgggagcagggtggtggtggacgggaacctggccacgagcgggagcaccgggacggccatggagttcgcgctggccgtcgtggagaagctgctcggccccgaggcggcgcgggaggtggcggaagccctgctcttcgtctgaccatcactggaccagcgaccacgtacggagtgtagctgttgggccctttcgcgtgtaccgtcgtgtgcaccggatcgtgtttgatccttcctcgcttgataacgtcggacccaaagtaattatcttcgtaataaaaacttctcccatccatcatcgatagaaggatgttactgtccgttcacgttctctgagtcagtaacctccattttcatatccatatactctcatgtatccataccaaccgtccgtcgatgctcctccttcaagcaatagaaataata

SEQ ID NO: 1898 - DNA, 1280 bp, Zea mays
ggtgccggtgccccgtgccccgcaccgggcggcggcggcgaacgacgggagcggagacaaaaatcaaatcaaccaacagcgacgtcagcgggcgccacgggacagcgtgcgtggtgatgacgccacggcgcatgctttcccgtcgtgctgacgtaggacggcggtgcagcagcgcaagtactgtacagcgttgcattgcctgtctgtctccatttcggtcaattgtgaggcaatcagatttctttcgccacctctccactcgactagtactagaccggctggcaccgcttcgtggggggtgacgtggcaccgcgctggcctccctttccgtcccggccacgtgacgcaacctccggccccacgcgtcctcgtcacagcccgcgcctgacgtcaccttcccctcacccggcgggcatatgatggtgtgccgtgcccggctatatatgtgctgcgggcacgcgacgcctttcctcgctccccgcagccggcaggcgaggtcgtccctttcccttccggtccttttggcccgctgtagctaataagtagtgtactccgtaaccagcagcagcatgcaggcggtgggcatccggcgtggtctgaccatcgacccggccggggaggaggaggcccccgcggcgcgcgtgtggcggctggtccgcgagagccccgtggtgatcttcgcccggcgcggctgctgcatggcgcacgtgatgaggcggctgctggcggcggtgggcgcgcacgccaccgtgatcgagctggacgccggcgccgcggaggagcaggagctggcggcggcggtcgagggcggcggcgtcccggcgctcttcgtgggcggcgaccccgtcggtggcctcgagggcctcatggggctccacctcagcggccgcctcgtgccccggctcagggagctcggcgccctctgcgcctagctgagctcctccggtgctccgtccgtctgtctgtcggtccgcgtgccgggcgcccggactcgcgaagattcgcagtcgcatgccatgtgctggctgtacctgtacatactactacgctacgctagctacagggggggaaacggcagtgcaggaggagcagccagcaagcaaagcttctgtttttctttttgtttttgtttttgctaatactgtactccagagattcaaatcgaaaggtgcgtggatgtagtttagctagcataaaactatggcacatgattgaattgcagtgcagtgcagccgtgcgtgtatagtagcgacaaattaaagccgattattattcttata

SEQ ID NO: 1899 - DNA, 976 bp, Zea mays
ccgccaccgccacccgctccgtggagtggcgtacgtggcgccgcgttgaattaatggcgtccctccccatccggttccggcccgggcacgtgacggtgacgcaacctccggccccacgcatcccccgtcaggccgtcaccggcccgcctgacgtcaccttccccgtcaccccacccggcccgccggtatgccgggggggccattaggccatgtggtgtgtctgcctctgcccgtctgccgccccggccgggtatatatatgcggttgcggtcctctcgtctaggcgagctcgtccggtcccgtcgatcttccaggccgccgctctcagctaatcggcacgcaggccggccggcaggtgggtgggtggtgggtggtccaggtcgagagcatgcaggcggtgggcatccggcggcgcgggctgaccatcgacccggcgggggaggaggaggcccccgcggcgcgcgtggggcggctggtccgggagagccccgtggtgatcttcgcgcggcgcggctgctgcatggcgcacgtgatgcggcggctgctggcggccgtgggcgcgcacgccaccgtcatcgagctaggcagcgccgaggaggaggaggaagagctggcggcggccgagggcggcggcgtcccggcgctcttcgtaggcggcgaccccgtcggcggcctcgagggcctcatgcggctccacctcagcggccgcctcgtgccccggctccgggagctcggcgccctctgcgcctgagctgctctctctctccgccgtctgtactgtacatagcacgcgcgcgcgcggcctcttcgatcgatcagggtgctcggcgcaaaacacagccgaccggtggtgtactgtactagtactagtgctgtgcacatgattgccgtgtacatacatcctatccccttcctggaaggcgtaacttgtgcttcggaagacaacatacaaaaacctgaaagatcaacgtcaccg

SEQ ID NO: 1900 - DNA, 631 bp, Pennisetum glaucum
gccggatcttgctgcccaccagtataccaccagtagcgcgctggctctcgatatcgctagctactagctttgattcgctagctcctctgcgcccggccggccggatcttgctgcccccccctgctcggctgcggcggcgacgacgacacgtccgggccggcgatcgagctagctcgaccccgtcttcgctcaagcagcttactagcgtgtctccaagcgggagaaggagagaccatgcaggcggtgggcatccggcggggtctgaccatcgacccggcgggggaggaggagcccccggcggtgcgcgtggggcggctggtccgggagagccccgtggtgatcttcgcccggcgcgggtgctacatggcgcacgtgatgaagagcctcctcgccgccgtgggcgcgcacgccaccgtcatcgagctggacgccggcgcggccgacgagctcgcggcggcggccgaggccgggcgcggcgccgtcccggcgctcttcgtgggcggcgcgcccgtcggcgggctcgagggcctcatggacctccacctcagcggccgcctcgtgccgcgcctcagggaggtcggcgccctcctctgcgcctagccactagctagctaccactagccacacctcg

SEQ ID NO: 1901 - DNA, 1491 bp, Setaria italica
gaaaaaccttcgagctcgaggtcaattatggagtacgaaagaacaatcgcagtagtaccatcgaatttcggtggcggcatcttcgagcggagcttcttcctaacgcacgcacgcagattcttccgacgactggcccaggttgaacgcacgcaccaaaaatatcgccaccccgaaaaaaaagagaaatcattttccttttccttccgatgattttcttcctcgccggagtaggagtagaatatgctcgatcggtgggtgtttaatgtggcgcagcgcttggaatttaatggcccggccacgtgacgcaacctccggccccaccgctcctcgtcacctccccgcctatggccatgtgatgtgccgctgccgctccggctatatatgccacggatgcgcctccccgttcctccccggccgcctagctcttgatctcgctagctttgctttgctcctccgcgcccggccggatcttgctcccctgctcggcggcgacgacgacacgtccaggccggccgccggcgatcgagctcgatcgtctccttcgttctagctacgcggcagcttcatcgatcacgtgttggtcgagagctagcgggcacaccatgcaggcggtgggcatccggagggggctgaccatcgaccctgcgggggaggaggaggcccccgcggcgcgggtggggcgcctggtccgcgagagccccgtggtgatcttcgcgcggcgcgggtgctacatggcgcacgtgatgaagcgcctcctcgccgccgtgggcgcgcacgccaccgtcatcgagctggacgccggcgcggccgacgagctcgcggcggcggccgccgaggccgggcgcggcgccgtcccggcgctgttcgtgggcggcgcccccgtcggcgggctcgaggggctcatggacctacacctcagcggccgtctcgtgccacggctcagggaggtcggcgccctctgcgcctagctagccacctcgccgtccgccgggcgcgcgcggctgggctcgctcatcaatcgccactcctcagtttcacccaaggcgggggcctcgcatggcatcgcgtcgcgtccatgtacatacgcgcggcccctgcgattcggagaagcatcagggtgctggatgcaaagtacaatcgaataataagttttaagcaagtggtagtactactacgccgccggggcgggatgcttgtgagggggaacattgttacagggggttttgcgagaaaacggcaggacctaaatgtgattacttaggagtaacactgcttcttccttcttccttctctccgtctcttttccttcctttcacagcagcaagcaagctagcaagcaagttactacggcagtgatcttgcattgccccttgtccagacttatgtaatgcagccagctccatgtttggaaggctgcatagagagttagctgagcttgattatgaaaaaggcttgtccggcctgcatacctggaaatgcaaattgaaacgc

SEQ ID NO: 1902 - DNA, 936 bp, Setaria italica
cgggcacaccatgcaggcggtgggcatccggagggggctgaccatcgaccctgcgggggaggaggaggcccccgcggcgcgggtggggcgcctggtccgcgagagccccgtggtgatcttcgcgcggcgcgggtgctacatggcgcacgtgatgaagcgcctcctcgccgccgtgggcgcgcacgccaccgtcatcgagctggacgccggcgcggccgacgagctcgcggcggcggccgccgaggccgggcgcggcgccgtcccggcgctgttcgtgggcggcgcccccgtcggcgggctcgaggggctcatggacctacacctcagcggccgtctcgtgccacggctcagggaggtcggcgccctctgcgcctagctagccacctcgccgtccgccgggcgcgcgcggctgggctcgctcatcaatcgccactcctcagtttcacccaaggcgggggcctcgcatggcatcgcgtcgcgtccatgtacatacgcgcggcccctgcgattcggagaagcatcagggtgctggatgcaaagtacaatcgaataataagttttaagcaagtggtagtactactacgccgccggggcgggatgcttgtgagggggaacattgttacagggggttttgcgagaaaacggcaggacctaaatgtgattacttaggagtaacactgcttcttccttcttccttctctccgtctcttttccttcctttcacagcagcaagcaagctagcaagcaagttactacggcagtgatcttgcattgccccttgtccagacttatgtaatgcagccagctccatgtttggaaggctgcatagagagttagctgagcttgattatgaaaaaggcttgtccggcctgcataccttcgagggtccgacgcgtcgcctacctcctcacgtcacacttgagcactccgccgccg

SEQ ID NO: 1903 - DNA, 365 bp, Saccharum officinarum
aggaggagaggtcccggtcaagcatgcaagcggtgggcatccggcgtgggctgaccatcgacccggcgggggaggaggagcccgcggcggcgcgcgtggggcggctggtccgcgagagccccgtggtgatcttcgcccgccccggctgctgcatggcgcacgtgatgaagcggctgctgcaggcggtgggcgcgcacgccaccgtcatcgagctggacgccggcgccgcggaggaggaggagctcgcagcggacgaagctgggggcgacccgacacgcttcgtgggcggcgaccccgtcggcggactccagggcctcatggggccccacctcaacggacgcctcttgcccaggctcaaggagctc

SEQ ID NO: 1904 - DNA, 1962 bp, Zea mays
ttatttgcaaaaaaaccgcaatttggccgccggaaaccattcgctcatcaaggcgaggagatgagatcttgcagcggagagcatatgcctacaaagttctcaccccagctggttccctccaatattcccctccgacgatggaatatccccgcagttccaacccaggcccgccttcttcatcgtcttcagtccttctcccgcttatatacgcaacggcgacctcgccctcttccttgctcgtacaaatcatcacacgcagccacgcaggtagaacacaagcgccgtgcacgcttgcgcaagcccaaggattgccgctctgctctgtctcctccggtggccgcaggggcaatggcgattggcgggaaggaggtcaaggatgacctggaggaggcgccgccgccggtcctggacgaggccatgcggccgcgccgcgtcgcgctcttcgtcgagccgtctccgttcgcatacatctctgggtataagaaccggttccagaacttcatcaaacatttgcgagaaatgggggacgaggtcattgttgtgaccaatcatgagggagttccccaagagttccatggcgccaaggttataggttcatggagcttcccatgccccatgtatggaaaagtacctctttcgctggcactcagtcctaggatcatttcggaggttgcgaagttcaaacctgacattattcatgcgtcttctcctggaattatggtttttggagctctagctattgccaagctactcggtgtgcccctagtcatgtcctatcacacccatgttccagtatacatacctagatatacatttagctggcttgtggagccaatgtggcaagtcataagattccttcatagagctgctgatttaactttagtaccatctgctgctatcagcaaagattttgaaactgcccaggtcatatcagctaatagaatacgcctttggaacaaaggtgttgattctgcaagcttccatcctagattccgcagtcatgagatgcgagtcaggctaagtgacggtgagcctgaaaaaccactggtaattcatgtcggacgttttgggcgtgagaaaagtttggattttttgaagatggtaatggaaaggttgcctggagtaagaattgcatttattggagatggaccatataggggtgaactagagaagatgtttgaaggaatgccagcagtgttcacaggaatgatgcagggtgaagagctctcgcaggcgtacgccagcggcgatgttttcatcatgccatcggagtcagaaacgctcggccaagtggtcctagagtccatgtcgtcgggggtgcccgtcgtcgcggcccgtgcaggcgggatccccgacataatcccggaggaccaggagggcaggacgagcttcctgttcacccctggtgacctggacgactgcctcggcaaggtccagcagctgctgacgaacagggagtttagagaaaacatggggcggacggccagatccgagatggagaagtgcgactggcgggcagcgtccaagacgatccgcaacgagttctacaatgctgctatctggtactggcgaaagaagcatgcggagctggtgaagccgctgcagtggctggcacagatgttcctgccggcgcctgaggtccgcagcatcatgcaatgctgagtgaggatgctgttgcttgcagacatgatccagacaattgatggacggatgggcagatgcatatgcactccttgtaaattgaaattgtatgatgtatagtgctgtgtcgataggtgagatagttccccgtttttgtatggaaactggtattggactgtgattggtgtggcaattccatcgattacatgtgtcttgtgtagcaaaacaaaattggaattgtgctatatcttgctggacattgtaacctgtaaattatgatcatgccattttatttaaccgaagcggcaggagctttggcat

SEQ ID NO: 1905 - DNA, 1997 bp, Setaria italica
ttattgcaaaagaaaattgcaatttggccgccagaaaccactcgctcatcaaggcgaggaggagatgagatcttgcagcagagagcatatgcctcgcaaaggtcccggcccagccggttccctccaatattcccctccgccgatggaatatccccgcaattcctacccagaccccgtcttcttcgtcttcatttactccttctcccgcttatatacgcagcggcgagctcgccttctcccacgctccgacgcaacgtacgcagctgggagcgagagaacacgcgcgacgtgcacgcttgcgcaaactgaaggattgccgctctgttcttggtctctcctcctcgggtggcggcggcgggagcaatggcgattggcgggaaggagatcaaggaggacctggaggaggccccgcctctgctcctcgatgaggccgcgcgcccgcgccgcgtcgcgctcttcgtcgagccgtcgccgttcgcctatatctctgggtataagaaccggttccagaacttcatcaaacacttgcgtgaaatgggggatgaggtcattgttgtgaccaatcatgaaggagttcctgaagaatttcatggcgccaaggttattggctcatggagcttcccatgtcccatgtatggaaaagttccgctttctctggcactcagtcctaggatcatttcagaggttgcaaagttcaaacctgacattattcatgcatcttcacctggaattatggtttttggggctctagctattgccaagctgcttagcgtgcccctagtcatgtcctaccacacacatgtcccagtatacataccgagatatacatttagctggcttgtagagccaatgtggcaagtcataaggttccttcacagagctgctgatttaaccttggtgccatctgctgctatcagcaaggattttgaaaccgcccatgttatatcagctaacagaatacgcctttggaacaaaggtgttgattctgctagtttccatcccaggtttcgcagtcatgagatgcgagttaggctcagtgatggtgaacctgaaaaaccattgataattcacgtcggacgttttgggcgtgagaaaaatttagattttctgaagattgtaatggacaggttgcctggagtcagaattgcatttatcggagatggaccatacaggacggagctagagaagatgtttgagggaatgcccgcagtgttcaccggaatgatgcaaggtgaagagctctctcaggcatacgccagcggcgacgtcttcgtcatgccatcagagtctgaaacgctcggccaggtggtccttgagtccatgtcatccggagtccccgtcgtcgcagcccgcgccggcgggatccccgacattatcccagaggaccaggagggcaagaccagcttcctcttcaccccgggcgacctggacgactgcgtgggcaaggtccagctgctgctgacgaacagggagttcagggacaacatggggcggacggcgagggccgagatggagaagtgcgactggcgggcggcgtcgaagacgatccgcaatgagttctacaacgccgccatctggtactggaggaagaagcgcgcggagctggtgcagccactgcagtggctggcgcagatgttcctgccggcgccggaggtccgcagcatcacgaagtgctgagctgaggcctcctgtcgtgggatgctgtttgcagccatgatccagacaaagtgaaggaaggacaaatgcgtatgcatcccttgtaaatttctgatatatatagtgcagtgtcgataggtgagatagttcctcgtttttgtgtggaaattggttggattgtgaattgttattggtgtggcaaggccatcgattgcatgtatttgtgtagtagcaaaactaaaattggaaatgtgctatcttgatgtacattgtactgcacatgtagatgctgttcagctgttgtgctcggagaggactgattgtgtttcggcacatgtgta

SEQ ID NO: 1906 - DNA, 1966 bp, Oryza sativa
aaaaaaaaaggcatatgccttgcaaagttcccagcttggttcccttccctccaatattctccacccctcccatggaatatcccccacaattccctactccccaactccacactccaatctcttcctcctcttcttcttcttcctcgcctcgcttatatacgcggcgtgtcgagctcctcctcctcctcttccttgctccaccacaacaccgtcgactcgaggcgcacgcaaacgccggtagcgaggagaaggattgcttcttcttttttttttgtgtgtgtgctgtgttcttgggtttcttggcaatggtgattggggccgagatcaaggacgagatggaggaggcgccgccgctgctgctcgacgaggccgcgcgccctcgccgcgtcgcgctcttcgtcgagccgtctccgttcgcttacatctctgggtacaagaaccggtttcagaacttcatcaagcacttgcgcgaaatgggggatgaggtgattgttgtgaccaaccatgagggggttccccaagaattccatggtgccaaggttattggttcatggagctttccctgtccaatgtatggaaaagttcctctctcgctggcactcagtcctaggattatttcggaggttgcaaagttcaagcctgacatcattcatgcatcctcacctggaattatggtttttggggcacttgctattgctaaactgctcggtgtccctctagtgatgtcctatcacacccatgtcccagtatacattccaagatatacatttagctggcttgtagagccaatgtggcaagtcataaggttccttcatagagctgctgatctaacattagtgccatctgttgctatcagcaaagattttgaaactgcccatgttatatcagctaatagaatacgcctttggaacaaaggtgttgattcagccagtttccatcccaagttccgcagtcacgaaatgcgagttagactaagtgacggtgagcctgaaaaaccattgataatccatgtaggacgctttgggcgtgaaaagaacttggattttctgaaaacggtaatggataggctgcctggagtaagaattgcatttattggagatggaccatacaggagtgagctggagaagatgtttgaggggatgcctgccgtgttcactggaatgatgcaaggcgaagagctatcacaggcatatgccagcggtgatgttttcgtgatgccctcggagtccgaaacacttggtcaagtagtcctggagtccatgtcatctggagtcccggtcgttgcagctcgtgctggtggtgttcctgatataattccagaagatcaggaagggaagaccagcttcctgttcaccccaggagacctcgaagactgtcttggcaagattcagctattgctgacggacaaggaattcagagacaacatggggatgacggctagagccgagatggagaagtgcgactggagagcagcttccaagaagatccgcaacgagttctacaatgctgcgatctggtactggaggaagaagcgcgcagaattgatcaaaccgttgcagtggctggcgcagatgttcctaccagcacctgaggtcaacagaatcacacaacactgaagcctcaaggggatgcttctgcagccatgatccggtccttgtaaatttctgatctatagtgcagtgtcaataggtgagatagttcctcttttttttgtatggaattggaattgtgaatggtatggcaaagccatttgttgcctgtattgttgtagtggacaatgtgttgccttgttgggacatgatgtgatgaactgtatttgattataatccacggcatcaacacatcaagatgctattgtgcacgcaatgaaaagtttggtatcaactcttgagatgctgaactttctcagcttatctgctactctgaatgtcagattattttgcctgggaatggaataataggaggg

SEQ ID NO: 1907 - DNA, 1891 bp, Oryza sativa
ttgcaaagttcccagcttggttcccttccctccaatattctccacccctcccatggaatatcccccacaattccctactccccaactccacactccaatctcttcctcctcttcttcttcttcctcgcctcgcttatatacgcggcgtgtcgagctcctcctcctcctcttccttgctccaccacaacaccgtcgactcgaggcgcacgcaaacgccggtagcgaggagaaggattgcttcttcttttttttttgtgtgtgtgctgtgttcttgggtttcttggcaatggtgattggggccgagatcaaggacgagatggaggaggcgccgccgctgctgctcgacgaggccgcgcgccctcgccgcgtcgcgctcttcgtcgagccgtctccgttcgcttacatctctgggtacaagaaccggtttcagaacttcatcaagcacttgcgcgaaatgggggatgaggtgattgttgtgaccaaccatgagggggttccccaagaattccatggtgccaaggttattggttcatggagctttccctgtccaatgtatggaaaagttcctctctcgctggcactcagtcctaggattatttcggaggttgcaaagttcaagcctgacatcattcatgcatcctcacctggaattatggtttttggggcacttgctattgctaaactgctcggtgtccctctagtgatgtcctatcacacccatgtcccagtatacattccaagatatacatttagctggcttgtagagccaatgtggcaagtcataaggttccttcatagagctgctgatctaacattagtgccatctgttgctatcagcaaagattttgaaactgcccatgttatatcagctaatagaatacgcctttggaacaaaggtgttgattcagccagtttccatcccaagttccgcagtcacgaaatgcgagttagactaagtgacggtgagcctgaaaaaccattgataatccatgtaggacgctttgggcgtgaaaagaacttggattttctgaaaacggtaatggataggctgcctggagtaagaattgcatttattggagatggaccatacaggagtgagctggagaagatgtttgaggggatgcctgccgtgttcactggaatgatgcaaggcgaagagctatcacaggcatatgccagcggtgatgttttcgtgatgccctcggagtccgaaacacttggtcaagtagtcctggagtccatgtcatctggagtcccggtcgttgcagctcgtgctggtggtgttcctgatataattccagaagatcaggaagggaagaccagcttcctgttcaccccaggagacctcgaagactgtcttggcaagattcagctattgctgacggacaaggaattcagagacaacatggggatgacggctagagccgagatggagaagtgcgactggagagcagcttccaagaagatccgcaacgagttctacaatgctgcgatctggtactggaggaagaagcgcgcagaattgatcaaaccgttgcagtggctggcgcagatgttcctaccagcacctgaggtcaacagaatcacacaacactgaagcctcaaggggatgcttctgcagccatgatccggtccttgtaaatttctgatctatagtgcagtgtcaataggtgagatagttcctcttttttttgtatggaattggaattgtgaatggtatggcaaagccatttgttgcctgtattgttgtagtggacaatgtgttgccttgttgggacatgatgtgatgaactgtatttgattataatccacggcatcaacacatcaagatgctattgtgcacgcaatgaaaagtttggtatcaactcttgagatgctgaactttctcagc

SEQ ID NO: 1908 - DNA, 1949 bp, Panicum virgatum
ccaatattcccctccgccgatggaatatccccggaattccaacccaaacctatcgtcttcgttttcactccttctgccgcttatatacgcaacggccagctcgccctctcccacagtcccacgcccggacgcatcgttacgcagctgggccgtgcacgcttgcgcaaaccgaaggattcccgctctgttcttggtctcctcaggtgctggcggcgggagcaatggcggttggcgggaaggagatcaaggaggacctggaggaggcgccgccactgctcctggacgaggccgcgcgcccgcgccgcgtggcgctcttcgtcgagccgtcgccgttcgcctatatctctgggtataagaaccggttccagaacttcatcaaacacttgcgtgaaatgggagatgaggtcattgttgtgaccaaccatgaaggggttcccgaagaatttcatggtgccaaggttattggctcatggagcttcccatgtcccatgtatggaaaagttccgctttcgctggcactcagtcctaggatcatttcggaggttgcaaagttcaaacctgacattattcatgcatcttcacctggaattatggtttttggggctcttgctattgctaagcttctcagcgtgcccctagtcatgtcctatcacactcatgtcccagtatacataccgagatatacatttagctggcttgtcgagcccatgtggcaagtcataagattccttcacagagctgctgatttaaccctggtaccatctgctgctatcagcaaggattttgaaactgctcaggttatatcagctaacagaatacgcctttggaacaaaggtgttgattctgcaagcttccatcccagatttcgcagtcacgagatgcggattaggctaagtgatggggagcctgacaaaccactcataattcacgtcggacgttttgggcgtgagaaaaatttggattttgtgaagatggtaatggataggttgcctggaataagaattgcatttatcggagatggaccatacaggacggagctagagaatatgtttgagggaatgccagcagtgttcaccggaatgatgcaaggcgatgagctctctcaggcatacgccagtggtgacgttttcatcatgccatcagagtctgaaacgctcggccaagtggtccttgagtccatgtcatcgggagtccctgtcgtcgcagcctgtgctggtgggatcccagacataatcccggaagatcaggacggcaagaccagcttcctcttcaccccgggcgacctggacgactgcgtgggcaaagtccagctgctgctgacgaacagggagttcagagacaacatggcgcggacggccaggtccgagatggagaaatgcgactggcgggcggcgtcgaagacgatccgcaacgagttctacgatgccgccatctggtactggcggaagaagcgtgcggatatggtgcagccgctgcagtggctggcgcagatgttcctaccggggctggaggtccgccgcatcacacagtgctgatgcctcctctcttgcagccatgatccggacatggatggaaggacagatgcatatgaattccttgtaaatttttgatatttatagtgcagtgccgataggtgagatagtttatcgttttttgtggaaatcggagtagcttggactgtgattgctgtggcatggccatcgattgcacgtgtgttgtgtagtagcaaaaccaaaatcagaaatgtgctatcttgatggacattgtagattgtactgcacatgtatagatcatgatcaccccatcaatgcatgaagatgcttttgtgcggtatagcagctggttgttttttttttttagatgatgattaaaatttcattgtgttttgtcgaatgcattttatttacaagatcaaaagaaaataacatgccatcgatacatgtatgtat

SEQ ID NO: 1909 - DNA, 1675 bp, Triticum aestivum
ggcggcaatggcgatcggcgcggacggcctggaggaggcgccgccgctgctccttgacggcgaggaggccgcctactcgcgcccacgccgcgtcgcgctcttcatcgaaccgtcgccgttcgcctacatctctgggtacaagaaccggttccagaacttcatcaagcacctgcgcgaaatgggcgacgaggtcattgttgtgaccaaccatgagggggttccccaagagttccacggtgccaaggttattggttcatggagctttccatgtccactgtatggaaaggttcctctgtcactggcactcagccctaggatcatctcagaggttgcaaaattcaagcctgacatcattcatgcatcctcacctggaattatggtttttggggcccttgctattgctaagctgctcagcgtccccctagtgatgtcctaccacacccatgtcccagtatacattccaagatatacattcagctggcttgtggaaccgatgtggcaaatcatcaggttccttcatagagctgctgatctaactttggtgccatctgctgctatcagcaaggattttgaaactgcccatgtcatttctgctaacaggatacgcctttggaacaaaggcgtcgattctgccagcttccatcccaggttccgcagccatgagatgcgagtcaggctaagtgatggtgagcccgaaaaaccgttgataattcacgtcggacgctttgggcgcgagaagaatctggatttcctgaaaatggtaatggaccggttgcctggagtaagaattgcattcatcggagatggaccatataggacagagctagagaagatgtttgaggggatgccggcggtgttcaccgggatgatgcaaggggaggagctctcgcaggcatacgcgagcggcgacgtgttcgtgatgccctcggagtcggagacgctcggccaagtagtcctggagtccatgtcgtccggggtgcccgtggtggcggtccgcgccggcgggatccccgacataatcccggaggacgtggaggggaggaccagcttcctcttcgccccgggggacctcgacgactgcgtcggcaagatcaggctgctgctgacggacgacgagttcaggggcgaaatggggaggaccgccagggcggaaatggagaagtgtgactggagggccgcctccaagacgatccgcaacgagttctacagctcggcaatcgactactggcggaagaagcaggcggagatggtccagccgctgcaatggctggcacaaatgttcatgccggcgccgaaccgggtcattggcggcggcatcaagcagtagtggtgcatcttagccatgatctaggcaggtggggggctggaagacggatggacaactccatgcactccttgtaaattcttggtctacaatagttcagtgtctataggtgagaagatagtttctgctcttttctttgtggaattgggatactgtgaatggttgtaatgtaatagtggaaatgtgatgaactttctggtggtgagcatgatccatcagtgcatcatgtggaagcaagcagaatccatatcagccatgaaatgcccacatatgtactccctgcgttcatgcatatagactctgcatgtagtccgtattgaaatatctaaaacatcttataagtatttgtga

SEQ ID NO: 1910 - DNA, 1631 bp, Brachypodium distachyon
ttcttgcgggggtggtggtaatggcgatcggtggcgagatcaaggacgacctggaggaggcgccgccgccgccgctcctcgacgaggcctctctgcgcccgcgccgcgtggcgctcttcgtcgagccctcgccgttcgcctacatctctgggtataagaaccggtttcagaacttcatcaagcacttgcgtgaaatgggcgacgaggtcattgttgtgactaaccatgagggagttccacaagagttccatggtgccaaggttattggttcatggagctttccatgtccattgtatggaaaagttcctctctcgcttgcactcagtcctaggatcatttcagaggttgcaaagttcaagcctgatattattcatgcatcatcacctggaattatggtttttggggctcttgctattgcaaagctgctcagcgtccccctagtgatgtcctaccacacccatgtcccagtatacataccaagatatacgtttagctggcttgtagaaccaatgtggcaaatcatcaggttccttcatagagctgctgatctaactttggtaccgtctgctgctatcagcaaggattttgaaacagcccatgttatttcagctaacagaatacgcctttggaacaaaggtgttgattctgccagcttccatcccagatttcgcagccatgagatgcgagttaggctaagtgacggtgagcctgaaaaaccactgataattcatgttgggcgctttgggcgtgagaaaagcttagattttctgaaaacggtaatggatcagttgcctggtgtaagaattgcatttgttggagatggaccatataggactgagctagagaagatgttcgaggggatgcctgcagtgttcactggaatgatgcaaggagaggagctctctcaggcatacgccagcggtgatattttcgttatgccttcagagtctgaaacactcggccaagtagtcctggagtccatgtcatctggagtccctgtagtcgcagcacgtgccggtgggatccccgacataattccagaagaggaggagggcaagaccagcttcctcttcaccccaggaaacctcgacgattgtgtgggcaagatcaagctgctgctgacagacagggagttcagagacagcatggggagaaccgctagagccgagatggagaaatgcgactggaggacggcctcgaggacgatccgcaacgagttctacaacacggcgatcttctactggaggaagaagcgcgcggagcttgtccaacctttgcagtggctggcgcaaatgttcctgccggcaactgatcgcacccgcagcatcacccaacattgatgcacagtgatggccagatccacacattccctgtaaattcctgatctatatagtgcagtgtcaataggtgagatagctcttccttctgtgtgggattggaatacagtgattggttgtagttctttttggggtaatattgtaatggtgcaaaaaaaatgtgatggaactttgtgttgaccatgatccatgcatacatcatcaagatgctgttgttggaactttggacgcaagaagaatccatataagcttatgaaatgttaactcttttgtcagatataacattctaaattc

SEQ ID NO: 1911 - DNA, 2228 bp, Brachypodium distachyon
aggctatccatgggtttcttcttctttttgaaggctatatccatcagtattttcttgtgtcgctctcttcactcttgtcactgcattgaaaggcactagcattgaccttgttctcctgctaggctccaaggatttcttctgagaaattttttattcttacaagtgcctatatttagcaactaacttagcatggcaggcaactcagctgcacacttgcacatcactagagattggattgggtgcgaaagatttgggtttcaataattgcaaaagaaaaaaaatgcaatttgggaaagagagtgagagacatgagatgagaggggaggagatcttggaggcaaaagcatatgctttgcaaagttccctccaatatccccttctcctccaatggaatatcccccaaattcttccaactcccagctccaatcccgcatctctcttcgctcttatatatatacgcagcacgaactcgccgtctttcttgctcgctcccacacgctgcgccaacccagcgcgtacacgcaaacaatttgtagctggtagcaacacacaataggtatagcgccggcaagagattcttctccggttcttgctggtttcttgcgggggtggtggtaatggcgatcggtggcgagatcaaggacgacctggaggaggcgccgccgccgccgctcctcgacgaggcctctctgcgcccgcgccgcgtggcgctcttcgtcgagccctcgccgttcgcctacatctctgggtataagaaccggtttcagaacttcatcaagcacttgcgtgaaatgggcgacgaggtcattgttgtgactaaccatgagggagttccacaagagttccatggtgccaaggttattggttcatggagctttccatgtccattgtatggaaaagttcctctctcgcttgcactcagtcctaggatcatttcagaggttgcaaagttcaagcctgatattattcatgcatcatcacctggaattatggtttttggggctcttgctattgcaaagctgctcagcgtccccctagtgatgtcctaccacacccatgtcccagtatacataccaagatatacgtttagctggcttgtagaaccaatgtggcaaatcatcaggttccttcatagagctgctgatctaactttggtaccgtctgctgctatcagcaaggattttgaaacagcccatgttatttcagctaacagaatacgcctttggaacaaaggtgttgattctgccagcttccatcccagatttcgcagccatgagatgcgagttaggctaagtgacggtgagcctgaaaaaccactgataattcatgttgggcgctttgggcgtgagaaaagcttagattttctgaaaacggtaatggatcagttgcctggtgtaagaattgcatttgttggagatggaccatataggactgagctagagaagatgttcgaggggatgcctgcagtgttcactggaatgatgcaaggagaggagctctctcaggcatacgccagcggtgatattttcgttatgccttcagagtctgaaacactcggccaagtagtcctggagtccatgtcatctggagtccctgtagtcgcagcacgtgccggtgggatccccgacataattccagaagaggaggagggcaagaccagcttcctcttcaccccaggaaacctcgacgattgtgtgggcaagatcaagctgctgctgacagacagggagttcagagacagcatggggagaaccgctagagccgagatggagaaatgcgactggaggacggcctcgaggacgatccgcaacgagttctacaacacggcgatcttctactggaggaagaagcgcgcggagcttgtccaacctttgcagtggctggcgcaaatgttcctgccggcaactgatcgcacccgcagcatcacccaacattgatgcacagtgatggccagatccacacattccctgtaaattcctgatctatatagtgcagtgtcaataggtgagatagctcttccttctgtgtgggattggaatacagtgattggttgtagttctttttggggtaatattgtaatggtgcaaaaaaaatgtgatggaactttgtgttgaccatgatccatgcatacatcatcaagatgctgttgttggaactttggacgcaagaagaatccatataagcttatgaaatgttaactcttttgtcagatataacattctaaattc

SEQ ID NO: 1912 - DNA, 1658 bp, Triticum aestivum
ggcggcaatggcgatcggcaccgacgacctggaggaggcgccgccgctcctgctcctcgacgacgacgaggccgcctacccgcgcccccgccgcgtcgcgctcttcgtcgagccgtcgccattcgcctacatctctgggtacaagaatcggttccagaacttcatcaagcatctgcgcgaaatgggcgacgaggtcattgttgtgaccaaccatgagggggttccacaggagttccacggtgctaaggttattggttcatggagctttccatgtccactctatggaaaggttcctctctcactggcactcagccctaggatcatctcagaggttgcaaagttcaagcctgacatcattcatgcgtcctcacctggaatcatggtttttggagcccttgcgattgctaaactgctcagtgtccccctggtgatgtcctaccacacccatgtcccagtatacattccaagatatacatttagctggctcgtcgaaccaatgtggcaagtcatccggttcctccacagagctgctgacctaactttggtaccatctgttgctatcatcaaggattttgaaactgcccatgtcatttcagctaaccggatacgcctttggaacaaaggcgtcgattctgccagcttccatcccaggttccgcagccatgagatgcgcgtgaggctaagtgacagtgagccagataaaccattgataattcacgtcgggcgctttgggcgcgagaagaatttggactttctgaaaatggtaatggatcggttgcctggagtaagaattgcattcgtcggagatggaccgtataggactgagttggagaagatgttcgagggaatgccggcggtgttcaccgggatgatgcaaggggaggagctctcgcaggtgtacgcgagcggcgacgtcttcgtgatgccctcggagtcggagacgctcggccaagtagtcctggagtccatgtcgtccggggtgcccgtggtggcggtccgcgccggcgggatccccgacataatcccgggggacgcggaggggaggaccagcttcctcttcgccccgggggacctcgacgactgtgtcggcaagattaggttactactgacggacgacgagttcaggggcgacatggggaggaccgccagggcggagatggagaagtgtgattggagggccgcctccaagacgatccgcaacgagttctacagctcggcaatcgactactggcggaagaagcaggcggacattgttcagccgctgcaatggctggcgcaaatgttcatgccggcgccgaaccgggtcatcggcggcggcatcaagcagtagtggtgcatcttagccatgatctaggcagggcgggggctggaagatgggtggataattccatgcattccttgtaaattcttggtatatagtgcagtgtcaataggtgagagatagtttctgttttttatctgtgtgaaattgggatactatgattggttgtactgtaatagtggaaatgtgctgaactttctggtggtgcacaagatccatcagtttgtggaagcaagcagaatccacatcagccatgtaatgcccacatatgtactccctccattcactattgtaagatgttttagcttttttcatactcgaatgtatatagacacat

SEQ ID NO: 1913 - DNA, 1684 bp, Hordeum vulgare
ccaacacacacgcaacaactgcagcttggtgtgttgtgacttgtgagggtggcggcaatggcgatcggcgtggacgacctggaggcggcgccgccgccgctcctcgacgacgaggccgcctacccgcgcccgcgccgcgtcgcgctcttcgtcgagccctcgccgttcgcctacatctctgggtacaagaaccggtttcagaacttcatcaagcacctgcgcgagatgggcgacgaggtcattgttgtgaccaaccatgagggggttccccaggagttccacggtgccaaggtcattggttcatggagctttccatgtccactgtatggaaaggttcctctgtcgctggcactcagccctaggatcatctcagaggttgcaaggttcaaacctgacatcatccatgcatcctcacctggaatcatggtttttggggcgcttgccattgctaaactgctcagtgtccccctggtgatgtcctaccacacccatgtgccactatacattccaagatatacgtttagctggctcgtcgagccgatgtggcaagtcatccggttcctccacagagccgctgatctaactttggtgccgtccgctgctatcagcaaagatttcgaaactgcccatgttatttcagctaaccggatacgcctctggaacaaaggcgtcgattccgccagcttcaaccccaggttccgcagccatgagatgcgcgtgaggctaagtgatggtgagccggaaaaaccgttgataattcacgtcggacgctttgggcgcgagaagaatctggacttcctgaaaatggtgatggatcggttgcccggagtaagaattgcattcatcggagatgggccatataggacagagctagagaagatgttcgaggggatgccggcggtgtttaccgggatgatgcaaggggaggagctctcgcaggcgtatgcaagcggcgacgtcttcgtgatgccctctgagtcagaaacacttggccaagtagtcctcgagtccatgtcgtcgggtgtccctgtggtggccgttcgtgccggcggtatccccgacattatcccagaggacgtagagggaaggacgagcttcctcttcgctccgggggacctcgacgactgtgttggcaagattaggctgctgttgacggacgacgagtttaggggcgacatggggagggccgccagggctgagatggagaagtgcgactggagggcagcatccaagatgatccgcaacgagttctacagctcggcaatcgactactggcggaagcaacaggcggagattgttcagccactgcaatggctggcgcaaatgttcatgccggcgccgaaccaggtcatcggcggcatcaagcaatagtggtggatcttagccatgatctagggaggtgggggactggaagatggatggacaattccatggattacttgtaaattcttggtatatagttcaatgtcaataggtgagagatagtttctgtttttctattgtggaattgggatacagttattgcttgtattgtaatagtggaaatgtgagcatgatccatcacagcatcaatgtactgttgcagaagcaagcagaatccatattagcgatgaaatgcccagatatgtaagtaaacagtggaaatactccctccgtatcaaaataattgtcacagatttagtac

SEQ ID NO: 1914 - DNA, 1666 bp, Setaria italica
gcaatggcgattggcgggaaggagatcaaggaggacctggaggaggccccgcctctgctcctcgatgaggccgcgcgcccgcgccgcgtcgcgctcttcgtcgagccgtcgccgttcgcaagcgttaaggatagcagattagtatgtgtagcttattttggttttcttgtgggttgtgtaggtcattgttgtgaccaatcatgaaggagttcctgaagaatttcatggcgccaaggttattggctcatggagcttcccatgtcccatgtatggaaaagttccgctttctctggcactcagtcctaggatcatttcagaggttgcaaagttcaaaccttattcatgcatcttcacctggaattatggtttttggggctctagctattgccaagctgcttagcgtgcctaccacacacatgtcccagtatacataccgagatatacatttagctggcttgtagagccaatgtggcaagtcataaggttccttcacagagctgctgatttaaccttggtgccatctgctgctatcagcaaggattttgaaaccgcccatgttatatcagctaacagaatacgcctttggaacaaaggtgttgattctgctagtttccatcccaggtttcgcagtcatgagatgcgagttaggctcagtgatggtgaacctgaaaaaccattgataattcacgtcggacgttttgggcgtgagaaaaatttagattttctgaagattgtaatggacaggttgcctggagtcagaattgcatttatcggagatggaccatacaggacggagctagagaagatgtttgagggaatgcccgcagtgttcaccggaatgatgcaaggtgaagagctctctcaggcatacgccagcggcgacgtcttcgtcatgccatcagagtctgaaacgctcggccaggtggtccttgagtccatgtcatccggagtccccgtcgtcgcagcccgcgccggcgggatccccgacattatcccagaggaccaggagggcaagaccagcttcctcttcaccccgggcgacctggacgactgcgtgggcaaggtccagctgctgctgacgaacagggagttcagggacaacatggggcggacggcgagggccgagatggagaagtgcgactggcgggcggcgtcgaagacgatccgcaatgagttctacaacgccgccatctggtactggaggaagaagcgcgcggagctggtgcagccactgcagtggctggcgcagatgttcctgccggcgccggaggtccgcagcatcacgaagtgctgagctgaggcctcctgtcgtgggatgctgtttgcagccatgatccagacaaagtgaaggaaggacaaatgcgtatgcatcccttgtaaatttctgatatatatagtgcagtgtcgataggtgagatagttcctcgtttttgtgtggaaattggttggattgtgaattgttattggtgtggcaaggccatcgattgcatgtatttgtgtagtagcaaaactaaaattggaaatgtgctatcttgatgtacattgtactgcacatgtagatgctgttcagctgttgtgctcggagaggactgattgtgtttcggcacatgtgtattctgtcgaattcattccatttacaagatgaaagcacagcaacaaattaaca

SEQ ID NO: 1915 - DNA, 2082 bp, Triticum aestivum
ttagaattcggcacgagccccgccgtctttcttgctcccacacgcagcacccattccaacacacacacgcaacaattgcagcttgtaccagcacacagccaaggcaagattctgctaggtttggttcttggtttcttgcgggggcggcggcaatggcgatcggcaccgacgacctggaggaggcgccgccgctcctgctcctcgacgacgacgaggccgcctacccgcgcccgcgccgcgtcgcgctcttcgtcgagccgtcgccattcgcctacatctctgggtacaagaatcggttccagaacttcatcaagcatctgcgcgaaatgggcgacgaggtcattgttgtgaccaaccatgagggggttccacaggagttccacggtgctaaggttattggttcatggagctttccatgtccactctatggaaaggttcctctctcactggcactcagccctaggatcatctcagaggttgcaaagttcaagcctgacatcattcatgcgtcctcacctggaatcatggtttttggagcccttgcgattgctaaactgctcagtgtccccctggtgatgtcctaccacacccatgtcccagtatacattccaagatatacatttagctggctcgtcgaaccaatgtggcaagtcatccggttcctccacagagctgctgacctaactttggtaccatctgttgctatcatcaaggattttgaaactgcccatgtcatttcagctaaccggatacgcctttggaacaaaggcgtcgattctgccagcttccatcccaggttccgcagccatgagatgcgcgtgaggctaagtgacagtgagccagataaaccattgataattcacgtcgggcgctttgggcgcgagaagaatttggactttctgaaaatggtaatggatcggttgcctggagtaagaattgcattcgtcggagatggaccgtataggactgagttggagaagatgttcgagggaatgccggcggtgttcaccgggatgatgcaaggggaggagctctcgcaggtgtacgcgagcggcgacgtcttcgtgatgccctcggagtcggagacgctcggccaagtagtcctggagtccatgtcgtccggggtgcccgtggtggcggtccgcgccggcgggatccccgacataatcccgggggacgcggaggggaggaccagcttcctcttcgccccgggggacctcgacgactgtgtcggcaagattaggttactactgacggacgacgagttcaggggcgacatggggaggaccgccagggcggagatggagaagcgtgattggagggccgcctccaagacgatccgcaacgagttctacagctcggcaatcgactactggcggaagaagcaggcggacattgttcagccgctgcaatggctggcgcaaatgttcatgccggcgccgaaccgggtcatcggcggcggcatcaagcagtagtggtgcatcttagccatgatctaggcagggcgggggctggaagatgggtggataattccatgcattccttgtaaattcttggtatatagtgcagtgtcaataggtgagagatagtttctgttttttatctgtgtgaaattgggatactatgattggttgtactgtaatagtggaaatgtgctgaactttctggtggtgcacaagatccatcagtttgtggaagcaagcagaatccacatcagccatgtaatgcccacatatgtactccctccattcactattgtaagatgttttagcttttttcatactcgaatgtatatagacacattttagtgtgtttgttcactcattgagtctgtgtagaacatattgaaatatccgaaacatcttatatttgtgaacggagaaagtacttcttatacttccttgcaaggatggtcaagccctctgatgataatgaccatttgacaaaatgcggtttacttggcatagttgttttgttaacaattcagggttcacgtagtctactagttgtaaatttttgttttgcaacaaaatcgacgggggtctagtaatttaggagtatagaatgtctgaccaagcttac

SEQ ID NO: 1916 - DNA, 1779 bp, Hordeum vulgare
ccaacacacacgcaacaactgcagcttggtgtgttgtgacttgtgagggtggcggcaatggcgatcggcgtggacgacctggaggcggcgccgccgccgctcctcgacgacgaggccgcctacccgcgcccgcgccgcgtcgcgctcttcgtcgagccctcgccgttcgcctacatctctgggtacaagaaccggtttcagaacttcatcaagcacctgcgcgagatgggcgacgaggtcattgttgtgaccaaccatgagggggttccccaggagttccacggtgccaaggtcattggttcatggagctttccatgtccactgtatggaaaggttcctctgtcgctggcactcagccctaggatcatctcagaggttgcaaggttcaaacctgacatcatccatgcatcctcacctggaatcatggtttttggggcgcttgccattgctaaactgctcagtgtccccctggtgatgtcctaccacacccatgtgccactatacattccaagatatacgtttagctggctcgtcaaaccgatgtggcaagtcatccggttcctccacagagccgctgatctaactttggtgccgtccgctgctatcagcaaagatttcgaaactgcccatgttatttcagctaaccggatacgcctctggacaaaagcgtcgattccgccagcttcaaccccaggttccgcagccatgagatgcgcgtgaggctaagtgatggtgagccggaaaaaccgttgataattcacgtcggacgctttgggcgcgagaagaatctggacttcctgaaaatggtgatggatcggttgcccggagtaagaattgcattcatcggagatgggccatataggacagagctagagaagatgttcgaggggatgccggcggtgtttaccgggatgatgcaaggggaggagctctcgcaggcgtatgcaagcggcgacgtcttcgtgatgccctctgagtcagaaacacttggccaagtagtcctcgagtccatgtcgtcgggtgtccctgtggtggccgttcgtgccggcggtatccccgacattatcccagaggacgtagagggaaggacgagcttcctcttcgctccgggggacctcgacgactgtgttggcaagattaggctgctgttgacggacgacgagtttaggggcgacatggggagggccgccagggctgagatggagaagtgcgactggagggcagcatccaagatgatccgcaacgagttctacagctcggcaatcgactactggcggaagcaacaggcggagattgttcagccactgcaatggctggcgcaaatgttcatgccggcgccgaaccaggtcatcggcggcatcaagcaatagtggtggatcttagccatgatctagggaggtgggggactggaagatggatggacaattccatggattacttgtaaattcttggtatatagttcaatgtcaataggtgagagatagtttctgtttttctattgtggaattgggatacagttattgcttgtattgtaatagtggaaatgtgagcatgatccatcacagcatcgacgtactgttgcggaagcaagcagaatccatattagcgatgaaatgcccagatatgtaagtaaacagtggaaatactccctccgtatcaaaataattgtcgcagatttagtacaaatttatacttgatcaacgacacttatttcaagacagaggaggtagttgtttgtgtccttgtatgaacctgacactgtcgtcgctatgcaaacct

SEQ ID NO: 1917 - DNA, 1516 bp, Pennisetum glaucum
caaaacttcatcaaacacttgcgtgaaatgggggatgaggtcattgttgtcactaaccatgaaggagttcctgaagaatttcatggcgccaaggttattggctcatggagcttcccttgtcccatgtatggaaaagtcccgctttcgctggcactcagtcctaggatcatttcagaggttgcaaagttcaaacctgacattatacatgcatcttcacctggaattatggtttttggggctctagctattgccaagctgcttagcgtgcccctagtcatgtcctaccatacacatgtcccagtatacataccaagatatacatttagctggcttgtagagccaatgtggcaagtcataaggttccttcatagagctgctgatttaaccttggtgccatctgctgctatcagcaaggattttgaaactgcccaggttatatcagctaacagaatacgcctttggaacaaaggtgttgattctgcaagtttccatcctaggtttcacagtcaggagatgcgagttaggctaagtaatggtgagcctgaaagaccattgataattcacgtcggacgttttgggcgtgagaaaaatttggattttctgaagatggtaatggataggttgcctggagtcagaattgcatttatcggagatggaccatacaggacggagctagagaagatgtttgagggaatgccggcagtgttcaccggaatgatgcaaggtgaagagctctctcaggcatacgccagcggtgacgtcttcatcatgccatcagagtctgaaaccctcggccaggtggtccttgagtccatgtcatcaggagtccccgtcgtcgctgcccgcgctggcgggatccccgacataatcccagaggatcaggagggcaagaccagcttcctcttcaccccgggtgacctggacgactgcgtgggcaaggtccagctgctgctgacgaacagggagttcagggacagcatggggcggacggcaagggccgagatggagaagtgcgattggcgggcggcgtcgaagacgatccgcaacgagttctacaacgccgccatctggtactggaggaagaagcgagcggagctggtgcagccgctgcagtggctggcgcagatgttcctgccggcgccggaggtccgcagcatcacgaagtgctgagctgaggcctcctgttgtgggatgctgttccttgcagccatgatccagacaagtggaggaaggacaagtgtgtatatagtcagtgcagggtcgataggcgagatagtttctggttttgtgttgaaaaatggttggatggtgaattgtgattggcgtggcaaggccatcgattacatgtattcttgtagtagtaaacaaaaattcagaaatgtgttatcttggacattgtactgcacgtgtatagatcatgatcacgctacaatgcgtgaagatgctcagctgttgtgctcacagagaaccggttgtgttgtgaattgtgattggcgtggcaaggccatcgattaca

SEQ ID NO: 1918 - DNA, 1222 bp, Panicum virgatum
gaaacggggacacgccagatggtgcccttgcgcagctgccaccgcttcgcccacctgcgcctcttctccttcctctccatggcggcgccccagcaacccggcaaaactcccctccgccccaacccctcgccttcccccaccggctcggcgcccaagaggtccaggacgatggccacggacgcagcggcggctggtcctccggcctccaagggatgcccagcgatgaaggccgagttcgccaagcacgccgagtacctcaatgccctgaacgataagagagaaaggcttgtgaaagcaagtcgggatatcacaatgaacagcaaaaaggtcatctttcaggtccacagggccagtaaagttaacaaggaagaggttctgtccaaggcagaaaatgatcttgctgcagtggttaaccagtacattggaaagttggtaaaagaattacaaggaactgacttctggaagctcagaagagcctacacctttggtgtacaagaatatgttgaagctgcaacgctgtgtagattttgcaagactggcacactattaagtcttgctgaaatcaatgattctttactagcactaagtgataaatctgttgagcccttacagataaatgtacttgactatcttttaggggttgctgatttgtcaggagagttaatgaggctagcgataggccgtatatctgatggggaagttgaatatgcaaaaaagatctgtgcatttgttcgtgacatttacagggagctgacccttgtggtgcctttaatggatgacaatagcgagatgaaaaagaaaatggaggttatgctgcaaagtgttgtgaaaattgagaatgcttgcttcagtgttcatgtaagaggttcagagtacattcctctacttggatcatctgcagatccagattattccttttttggtgcctcagactttgaccaatgaaggcttcgaagcaagagagcctgagtgttaattgggcaacttccgaagactagttgtgtcaaggctacttttaggctccatcctgtttagtgttggattttattgcaggtttatgtcgcacatcctagagtctttaaattttggctcaacctgaatcatgtcacaagactcgaggctgcgccaacatgaggctattactccggtcaaactactgtcatggtcaccaacgtttgtatttgatcgctattttctataacaaaatatgtttattagatct

SEQ ID NO: 1919 - DNA, 1206 bp, Setaria italica
cgagacaccaaaacggggacaggccagatggtgcccctccgcttcgcccacctgcgcctcttctccttcctctccatggcggcgccccagcaaccaggcaaaaccctcctccgccccaatccctcgccttcacccgccggctcggtgcccaagaggtccaggacgatggccacggacgcggcggcggcggctgatcctccggcttccaaggggtgccccgcgatgaaggccgagttcgcgaagcacgccgagtacctcaatgccctgaatgataagagagaaaggcttgtgaaagctagtcgtgatattacaatgaacagcaaaaaggtcatctttcaggtccacaggatcagtaaagttaacaaggaagaggttctgtgcaaggcagaaaatgatcttgctgcagtggttaaccagtacattggaaagttagtaaaagaattacaaggaactgacttctggaagctgagaagggcctacacctttggtgtacaagaatatgttgaagctgcaacgctgtgtagattttgcaagactggcactctattaactcttgctgaaatcaatgattctttactagcactaagtgataaatctgttgagcccttacagataaatgtgcttgactatcttttaggggttgctgatttgtcaggagagctaatgaggcttgcgataggccgaatatctgatggggaggtggaatatgcaaaaaagatatgtgcatttgtacgtgacatttacagggagctgacccttgtggtgcctctaatggatgacaataatgagatgaagaagaaaatggaggttatgctgcaaagtgttgtgaaaatcgagaatgcttgcttcagtgttcatgtgagaggttcagagtacattcctctacttggatcatctgcagatccagattactccttttttggtgcctccgactttgaccaatgaaggctttgaagcaagagcgcctaactgaatgttaaatgggtaactttggaagaaaatagttgcgtgaaggctacttttaggttccatcctgtttagtgattttatcacctgtttatgttgcacatctcggagtctgtaaatcttctacctggtaatcatgagaatcatgttgcaagactgtcttttgtatttaaattgtgggtgttgacgcagcttccttgtcctgcgcggctgtgccaacatgaggctatttctccggtc

SEQ ID NO: 1920 - DNA, 1276 bp, Cenchrus ciliaris
ccgtaagcgagccaccaaaacggggaccagatggtacccctccgcggctgccaccgcttcgcccacctgcgcctcttctccctcctctccatggcggcgccccagcaacccggcaaacccctcctccgccccaacccctcgccttcccccgccggctcggtgcccaagaggtcaaggacgatggccacggacgcggcggcggctgatcctccggcctccaaggggtgcccagcgatgaaggccgagttcgcgaagcacgccgagtacctcaatgccctgaatgataagagagaaaggcttgtgaaggctagtcgtgatattacaatgaatagcaaaaaggtcatctttcaggtccacaggatcagtaaagttaacaaggaagaggttctgtccaaggcagaaaatgatcttgctgcagtggttaaccaatacattggaaagttggtaaaagaattacaaggaacagacttctggaagctcagaagagcctacacctttggtgtacaagaatatgttgaagctgcaacgctgtgtagattttgcaagactggcactctattaagtctttctgaaatcaatgattctttactagcacttagtgataaatctgttgagcccttacagataaatgcacttgactatcttttaggggttgctgatttgtcaggagagctaatgaggctcgcaataggccggatatctgatggtgaggttgaatatgcaaaaaagatttgtgcatttgtacgtgacatttacagggaactgacccttgtggtgcctctgatggatgacaataatgagatgaagaagaaaatggaggttatgctgcaaagtgttgtgaaaatcgagaatgcttgcttcagtgttcatgtcagaggttcagagtacatacctctacttggatcctctgcagatccagattactcattttttggcgcctccgacttcgaccaatgaaggctttgaagcaagagtgcctaactgaatgttaaatgcgcaactttgtaagagaatagtaggttccatcctgtgtaatgatgttatcgccagtttatgttgcacatctaggagtctgtatatcttggctctgcctagtaaacatgagaatcatatcctgttgcattctaattgtgcgcttgtgctaacatgtggctattactccggtcagactgtcagggtactcagacattttgggtatgcccgtggtcgctaatgtgtcagctattttctacaacgatattatctttatataagattcaaaaagtttatgagatca

SEQ ID NO: 1921 - DNA, 1110 bp, Eragrostis curvula
gggggtttgccggtttcgcccacctggcgcccttctccttccccatggcggcgccccagcaaaccggcaaaaccctccgcccttttacctcgccttcccccgccggttcggcccccaagaggtccaggacgatggccactgatgcggcggcggcggcgacggcaggctcgaagggctgccccgcgatgaaggccgagttcgccaagcacgcagagtacctcaatgccctgaatgacaagagagaaaggcttgtgaaagcaagtcgggatatcacaatgaacagcaaaaaggttatcttccaggtccacagaatcagcaaagccaacaaggaagaagttctttccaaggcagaaaatgatcttgccacagtggttaaccagtacattggaaagttagtaaaagaattacatgggaccgacttctggaagcttagaagagcctacacttttggtgtgcaagaatatgtcgaagctgcaacgttttgcagattttgcaagactggcactctattaagtctcactgagattaatgaatccttactagcactaagtgataaatctgttgatcccttacagataaatgtacttgactacgttttaggggttgctgatctgtcaggagagctaatgagactggcaataggctgtatatctgatggggaagttgaatatgcaaagaacatctgttcatttgtacgcgacatttacagggagctgacccttgtggttcctctaatggatgataatatggagatgaagaagaagatggaggttatgctgcaaagtgtactgaaaattgagaatgcttgcttcagtgttcacgtgagaggatccgagtactttccacttctaagatcatcagccgatccagattattcctttttcggtgcctcagactttgaaccatgatgaagcatgactggcaaactaaaaacggcgacttgtgcttctatccacttccgtaaatcaaaagaaaaaattgggtcaaggctatatttttaggtcccatctttttgtttccgggttgattttactggtggttttacatgcccaccatgtattctggtaatcctagtcggggaaatccatgttcaaggacagcctttttctg

SEQ ID NO: 1922 - DNA, 1587 bp, Triticum aestivum
ggccctcaagagccgcgccgaaaccgtgggacgggccagccagatggtgcccctacgcgtctgccaccgcctcgtccacctgcgcggcctcccctcctcgcttcggcttcctctcccctccaccatggcggcgccccaacccggctgcaaaacccttcgccccaccactacttcttcgccgtctcctgccggcccggccaccaagaggtccaggacaatggccacggacgcggcggcttctccggcctcggcggggtgctccgcgatgaaggccgagttcacgggccacgccgagtacctcaacgcgctgaatgataaaagggaaaggcttgtgaaagcaagtcgggatgtgacaatgaacagcaaaaaggtcatctttcaggtccacaggatcagcaaaaataacaaggaggaagttctttcaaaggcggaaaatgaccttgctgctgtggttaaccagtacattggaaaattagtaaaagaactacaaggaaccgacttctggaagctcagaagagcctatacccctggtgtacaagaatatattgaagctgcaacattttgtagattttgcaagactggcactttattgggtctagctgaaattaatgattctttgcttgctctaagtgataaatccattgagcccttgcagataaatgtgcttgactatcttttaggggttgctgatttgtcaggagagctaatgaggcttgcaattggacgtatatctgatggggaagttgaatatgctaaaaatatatgtgcatttgtacgtgacatttatagggagctgacccttcttgtgccactgatggatgacaataatgagatgaagaagaaaatggaggttatgcttcaaagtgtagtgaaaattgagaatgcttgcttcagtgttcatgtgagaggatctgaatacatccctatgctgggatcatctggcgagtcagactatgccttcttcggtgccgccgactatgaccaatgaagccagaccgcctaacagacatgtttcggggacctatctcaaaaaagaagctttgaacatgactgtattatttattgcttgtgcacatcacaccgtagaacatgtaatatctgtattctgtagcattgcaagactaacctagcattcttcttcttctatgcactggttgtttctgtttccttatcttctgatgctcttttgtcccctccagaaaagtcccttgagggttctgaacatcagctctaatcacctgatatgcgttcagacctcacctaagtagagagaaaataattgtcttgttaatacaatttcaagaaaaatcatcaaatctccaattagtttggattgcttaccacatgtcttaataattatagtgaggtgtactggataatttttctctcaaaatataccatcccctagagaacgccgtaagagatgatatgccgccaccttggaacatttggaagaggtcgtaccctgcccataggaaatgttcagcgctagccgccgatcaaccggcctagttttcagtcggtcactgcacgggcgttgaatacgtgtgcgtgtggccgtcggatctgtcttcccatgtcgttttt

SEQ ID NO: 1923 - DNA, 1140 bp, Triticum aestivum
agatggtgcccctacgcgtctgccaccggctcgtccacctgcgcggcctcccctcctcgcttcggcttcctctcccctccaccatggcggcgccccaacccggctgcaaaacccttcgccccaccactacttcttcgccgtctcctgccggcccggccaccaagaggtccaggacaatggccacggacgcggcgacttctccggcctcggcggggtgctccgcgatgaaggccgagttcacgggccacgctgagtacctcaacgcgctgaatgataaaagggaaaggcttgtgaaagcaagtcgggatgtgacaatgaacagcaaaaaggtcatctttcaggtccacaggatcagcaaaaataacaaggaggaagttctttcaaaggcggaaaatgaccttgctgctgtggttaaccaatacattggaaaattagtaaaagaactacaaggaaccgacttctggaagctcagaagagcctatacccctggtgtacaagaatatattgaagctgcaacattttgtagattttgcaagactggcactttattgggtctagctgaaattaatgattctttgcttgctctaagtgataaatccattgagcccttgcagataaatgtgcttgactatcttttaggggttgctgatttgtcaggagagctaatgaggcttgcaattggacgtatatctgatggggaagttgaatatgctaaaaatatatgtgcatttgtacgtgacatttatagggagctgacccttcttgtgccactgatggatgacaataatgagatgaagaagaaaatggaggttatgcttcaaagtgtagtgaaaattgagaatgcttgcttcagtgttcatgtgagaggatctgaatacatccctatgctgggaacatctggcgagtcagactacgccttcttcggtgccgccgattatgaccaatgaagccagactgcctaacaggcatgtttctgggacctatctcaaaaaagaagctttgaacacgactattatttgttgcttgtgcacatcacaccgtagaacatgtaatcccggccctcagctacctgtattctgtagcattgcaagactaaccttctagcattattcttctatgcactggttgtttctgtttact

SEQ ID NO: 1924 - DNA, 1070 bp, Secale cereale
accgcctcgtccgcctgcgcggcctcccctcctcgcttcggcttcccctcccctccaccatggcggcgccccaacccggctgcaaaacccttcgccccagcaccacttcttcgccgtctcctgccggcccggccaccaagaggtccaggacaatggccacggacgcggcggcttctccggcctcggcggggtgctccgcgatgaaggccgagttcacgggccacgccgagtacctcaacgcgctgaatgataaaagggaaaggcttgtgaaagcaagtcgggatgtcacaatgaacagcaaaaaggtcatctttcaggtccacaggatcagcaaaaataacaaggaggaagttctttcaaaggcggaaaatgaccttgctgctgtggttaaccagtacattggaaagttagtaaaagaactacaaggaaccgacttctggaagctcagaagagcctatacccctggtgtacaagaatatattgaagctgcaacattttgtagattttgcaagactggcactctattgggtctagctgaaattaatgattctttgcttgctctaagtgataaatccattgagcccttgcagataaatgtgctggactatcttttaggggttgctgatttgtcaggagagctaatgaggcttgcaattggacgtatatctgatggggaagttgaatatgctaaaaatatatgtgcatttgttcgtgacatttatagggagctgacccttcttgtgccactgatggatgacaataatgagatgaagaagaaaatggaggttatgcttcaaagtgtagtgaaaattgagaatgcttgcttcagtgttcatgtgagaggatctgaatacatccctatgctgggatcatctggcgagccagactatgccttctttggtgccgccgactatgaccaatgaagccagaccggctaacagacatgtatcagggacctatctaaaaaaagaagccttgaaaatgactgtattatttgttgcttgtgcacatcacaacgttgaacatgtaatcccggccctcagctatctgtattatgtaaaattgcaaga

SEQ ID NO: 1925 - DNA, 1492 bp, Oryza sativa
ggaaacggaagtgccgagacggggcggggcccacaatctgacagatgttgcccctgcgcggctgccaccgccgcctcctctccctgcgcggcgtcaccgccccctcccttcttcctcccatcaccaccacccccaccacgtccatggcggcgccccagtcccactcccaccccgccaaaaccctccgcgcgagccctcctccgccctccaccgccggctcggcgcccaagaggtccaggacgatggccaccgacgcggcggcgacggcgcattcggcctcggcggggtgctccgcgatgaaggccgagttcgccaagcacgccgagtacctcaacaccctgaatgataaaagggaaaggcttgtgaaagcaagtcgggatttgacaatgaacagcaaaaaggccatctttcaggttcacaggataagtaagaataacaaggaagaggttctttcaaaagctgaaaatgatctcactgttgtggttaaccaatacattgggaagttggtaaaagaactgcaagggaccgacttctggaagctcagaagggcctatacctttggtgtacaagaatatgttgaagctgcaacattctgcagattttgcaagactggcactttattaagtcttgctgaaatcaatgattctttgctagagctgggtgacaaatctgttgagcccttacagataaatgtactcgactatgttttaggggttgccgatctgtcaggagagctgatgaggcttgcaattggccgtatatctgatggagaagttgaatatgccaaaaacatttgtgcatttgtacgtgatatatacagggagctgacccttgtggtgcctctgatggatgacaatagtgagatgaagaagaagatggagactatgctgcaaagtgtagtgaaaattgagaatgcttgcttcagtgttcatgtgagaggatcagagtacatccctttgcttggctcatctgctgatccagattactctttttttggtgcctcagactttgaccaatgaagcctttgaagctagatccccaaactgacatgttagacgaactattgctcttagcttccagcttgttcaccgcctgaaatcgttgctggtgtactacagcatggaatgtgttaaatggagcttggaagattgtttttttataaacttaaattaggatttcgttatctccactccaatggtttctattaaccaatatctatgcttttgtctgacgtcttggatatctccatttaagttaatagaaataaaggaaaatctaaataaaaaaaagatcaccaagctagggaattatttccattatagaaaaaatagcgtaaagctaaacccatattattactgatattttatacggtttacttttaatctttacatctcttgttggattggacacttcttgacaataagattttcaacgttcttcgcactgctgtacatacgttggggcaaaatcaactttgctggatacttttgta

SEQ ID NO: 1926 - DNA, 1178 bp, Hordeum vulgare
cctacgcttctgccaccgcctcgtccacctgcgcggcctcccctcctcgcttcggcttcccctcccctccaccatggcggcgccccaacccggctgcaaaacctttcgccccggaaccacttctttgccgtctcctgccggcccggctcccaagaggtccaggacaatggccacggacgcggcggcttctccggcctcagcggggtgctccgcgatgaaggccgagttcaccggacacgccgagtacctcaacgcgctgaatgataaaagggaaaggcttgtgaaagcaagtcgggatgtgacaatgaacagcaaaaaagtcatcttccaggtccacaggatcagcaaaaataacaaggaggaagttctttcaaaggcggaaaatgatcttgctgctgtggttaaccagtacattggaaaattagttaaagaactacaaggaaccgacttctggaagctcagaagagcctatactcctggtgtacaagaatatattgaagctgcaacattttgtagattttgcaagactggcactttattgggtctagctgaaattaatgattctttgcttgctctaagtgataaatctattgagcccttgcagataaatgtgcttgactatcttttaggggttgctgatttgtcaggagagctcatgaggcttgcaatcggacgtatatctgatggggaagttgaatatgctaaaaatatatgtacatttgtacgtgacatttatagggagctgacccttctggtgccactgatggatgacaataatgagatgaagaaaaaaatggaggttatgcttcaaagtgtagtgaaaattgagaatgcttgcttcagtgttcacgtgagaggatctgaatacatccctatgttgggatcatctggcgagtcagactatgccttctttggtgcggccgactatgatcaatgaagccagaccgcctaacagacatgttacgggaacttatctcaagaaagaagctttgaatggcactgtattatactccatccgttccaaaataagtgtcttaactttatattagttttaataaaaaatgtattaagctgaagacatttattttggaatgtagggagtatgttgctggtgtacgtcacaccgtagaacatgtaatcccctcagctattgtagtattgcaagactaaccttctgg

SEQ ID NO: 1927 - DNA, 1269 bp, Zea mays
ctagctcagcacttgccaagaagcagcccctcgtagacgtcgctgtcgtcgcatcgtataagtaggagcgcgcgtgcctcttcccggttcaacctggttcaaacacctcgcttcactagaggaataatctagcagcttctgttgcctccaaattgtccggagaaaggagttgaagcagtgtgagagggccctgagacgatggcgaacctgttcctcaagcaggcaaagcagtacgtggcgacgcggccggtctacccgccggagctcttcgacttcatcgcctccaagacccctcgccgcgacatggcctgggatgtcggcaccggcaacggccaggccgcagcgtcgctggcgaagctgtacaagcacgtggtgggcacggacacgagcgcgcagcagctcgcctacgcgacgcgcctcagcaacacccgctacgtgcacaccccagcggacctgcccctggaggggatccacgccaccgtggccccgccggcctccgtcgacctcgtcaccgtcgcgcaggccttccactggctcgacctcccgcgcttctacgcgcaggcccgctccgtgctgcgccccggccacggcgtgctcgccgcctggtgctacaccgagccacgcgtcaacgccgccgtcgacgccgtgttctggcgcctgtaccacgggtcccagggattctgggcgcccaaccgccggatggtcgacgacgagtaccggagcgccgacttcccgttcgacccggtcgagggggagaagcacacgggcccgttccagttctccacgcaccgccggatggacctcgatgactacctcatgtatatcacgtcctggtccgcctaccagactgccaaggataacggcgtcgagctgctcgatgcgcccaccgtccaggagttcgcggcggcgtggggcggcgatgccaaggaggtgaagaccgtcacgtaccccatcttcctcaggattggcaaggtcaggtcggagtgagctgcacggaaaaatgaaactcgacaaactatggatacactacggacgctccgacgattgatgatcgatcatctaggaatcgatgcttataacctttttgaataatgttttattcgattgcaaatgtttgttcgatctgcacaattgtatttcaaattctaatgcatgcactattctgttcgactttttttttctttgtgtcttcttagatagtgtaaatttcaatatctgtactgtgatgacaaaatatccacaataacccacgtggctgaaatctttggt

SEQ ID NO: 1928 - DNA, 1206 bp, Setaria italica
atgtacccggccggcgccagaaagagcctcccgtccggttcaagtcaagcacgctccctctcttgctcgcacctgccgagaagcagcccccggtcgacgtcgctgtcggcgcggcactacaaaccaagacgagaacccagcagcttcagttggctccaagctagatacagattgcgagagagaaatcatcagcaggccgagagactagcagccatggcgaacctgttcctgaagcaggcgaagcagtacgtggcgacgcggccgtcctacccgccggagctcttcgacttcatcgcctccaagacgccccgccgcgacctcgcctgggacgtcggcaccggcaacggacaggccgcagcatcgctcgcgaagctgtacaaggccgtggtgggcacggacacgagcgcgcagcagctcgctttcgcggcgcccctccccaacgtgcgctacgtccacaccgcgccggacctgccgctcgacgggatccacgccgccgtcgcggggccgggcaccgccgacctcatcaccgtcgcgcaggccttccactggctcgacctcccgcgcttctacgcgcaggcccgctccgtgctgcgcccggagcagggcgtcctcgccgcctggtgctacacggagccacgcgtcagcgccgccgtcgacgccgtgttctggcgcctctaccgcggctcgcagccgtactgggcgcccaaccgccggatggtcgacgacgagtaccgcggcgccgacttccccttcgaccccgtcgacggcgaggcccacacggggcccttcgagttctccacggagcgggccatggacctggatggctacctcacctacatcacgtcctggtcggcgtaccagacggccaaggagaagggcgtcgagctgctcgacgaggcgacggtgcaggagttcgcggcggcgtggggcggcgatgggaaggaggtgaaggcggtgacgtacccaatcttcctcaggattggcaaggtgagggccgaatgatgcacgaaacaagttgacgacgggtgcgagacgacagacgactactcggaatatatttgtgctgataacctttctgtagaaggatttgttttgtattgactgtactacaattttttttggttcggaatgtattaaaataataaaaatgcagtcagtgttgaataaattgtaatgcagttttgaattcatttttttttgaaatcg

SEQ ID NO: 1929 - DNA, 1034 bp, Setaria italica
gcaacccggtcaaagaccaagacgagaacccagcagcttcagttggctccaagctagatacagattgcgagagagaaatcatcagcaggccgagagactagcagccatggcgaacctgttcctgaagcaggcgaagcagtacgtggcgacgcggccgtcctacccgccggagctcttcgatttcatcgcctccaagacgccccgccgcgacctcgcctgggacgtcggcaccggcaacggacaggccgcagcatcgctcgcgaagctgtacaaggccgtggtgggcacggacacgagcgcgcagcagctcgccttcgcggcgcccctccccaacgtgcgctacgtccacaccgcgccggacctgccgctcgacgggatccacgccgccgtcgcggggccgggcaccgccgacctcatcaccgtcgcgcaggccttccactggctcgacctcccgcgcttctacgcgcaggcccgctccgtgctgcgcccggcgcagggcgtcctcgccgcctggtgctacacggagccacgcgtcagcgccgccgtcgacgccgtgttctggcgcctctaccgcggctcgcagccgtactgggcgcccaaccgccggatggtcgacgacgagtaccgcggcgccgacttccccttcgaccccgtcgacggcgaggcccacacggggcccttcgagttctccacggagcgggccatggacctgaatggctacctcacctacatcacgtcctggtcggcgtaccagacggccaaggagaagggcgtcgagctgctcgacgaggcgacggtgcaggagttcgcggcggcgtggggcggcgatgggaaggaggtgaaggcggtgacgtacccaatcttcctcaggatcggcaaggtgagggccgaatgatgcacgaaacaagttgacgacgggtgcgagacgacagacgactactcggaatatatttgtgctgataacctttctgtagaaggatttgttttgtattgactgtactacaatttttttttggttcggaatgtattaaaat

SEQ ID NO: 1930 - DNA, 918 bp, Pennisetum glaucum
agcttgatacagattgcgagagagaagtcgtccgcaggccgagagactagcagccatggcgaacctgttcctcaagcaggcgaagcagtacgtggcgacgcggccgtcctacccgccggagctcttcgatttcatcgcctccaagacgccccgccgcgatctcgcctgggacgtcggcaccggcaacggccaggccgcagcatcgctggcgaagctgtacaaggccgtggtgggcacggacacgagctcgcagcagctcgcctacgcggcgcccctccccaacgtgcgctacgtcctcaccccgccggacctgccgctcgatgggatccacgccgccgtcgcggggccgggcaccgccgacctcgtcaccgtcgcgcaggccttccactggttcgacctcccgcgcttctacaagcaggtccgctccgtgctgagcccggcgcagggcgtcctcgccgcctggtgctacacggagccccgcgtcagcgccgccgtcgacgccgtgttctggcgcctctactgcggttcgcagccgtactgggcgcccaaccgccggatggtcgacgacgagtaccgcagcgccgacttccccttcgaccccgtcgacggtgaggtgcacacggggcccttcgagttctccacggagcgggccatggacctggatgactacctcacctacatcacgtcctggtcggcgtaccagacggccaaggagaagggcgtcgagctgctcgacgaggcgacggtgcgtgacttcgcggcagcgtggggcggcgatgggaaggaggtgaaggcagtgacgtacccaatcttcctcaggattggcaaggtgagggtggaagaatgagatgcacgaaagcggcgcatacaatttctttttgttcagaatgtttttcaaaaataatgataacgcagtca

SEQ ID NO: 1931 - DNA, 1222 bp, Triticum aestivum
aagcatccatctcctcggttcagcccacaggcaacgaacgcacacgagcgtgcgcacgagcgagcgagagagataaagatggcgaacctgttcctgaagcaggcgaagcactacgcggcggcgcggccggactacccggcggagctcttccagttcatcgcgtccaagacggcgcgccacgacctcgcgtgggacgtcggcaccggcagcggccaggccgcagtctcgctggcgaagctgtacaagaacgtggtgggcacggacacgagcgcgcagcagctggcctacgcgccggcgctccccaacgtgcgctacgcccacaccccggcggacctgccgctcgagggcatccacgcggccgtcgcgccgccgggctccgtcgacgtggtcaccgtggcgcaggccttccactggctcgacctgccgcgcttctacgcgcaggcccgctccctcctgcgcgcgcacggcgtcctcgccgcatggtgctacacggagccccgcgtgggcgccgccgtcgacgccgtcttctggcgcctctacgacggctcgcagccccactgggcgcccaaccggaagatggtcgacgacgagtaccgcagcgccgacttccccttcgaccccgtcgacggcgagacccacacgggccccttcgagttctccaccgaccgccgcatggacctcgacgactacttcacctacatcaagtcctggtccgcgtaccagaccgccaaggacaatggcgtcgagctgctcgacgacgccacggtccaggacttcgccgacgcgtggggcggcgaccgcgaggaggtcaagacggtgaggtaccccatcttcctcaggatcggcaaggtgaggccttgagaatcaacgaatgcagcatgatgcaagtggccttgagaaaagggacgctttcatgtctgcacgtgacgatcgaagtgaccatggtgcaaaatgccgagcagcgtacgtgtgccgccgctggaccattttatttgcattccacgctctttttacaggacgaagtgatttttggcatcctgctactactatcccgttcctattcctattccaaattcagcgtgtaacaaataatggtatatattcctagtatccatcccattttctagacaaataattgtaagttgtggatgttacctttgtctatcgtatagtatatgaatattatttttgcggtgttgctgaatctgagtcagctgtgttg

SEQ ID NO: 1932 - DNA, 1129 bp, Triticum aestivum
aagcatccatctcctcggttcagcccacaggcaacgaacacacacgagcgcacgcacgagcgagcgagagagataaagatggcgaacctgttcctgaagcaggcgaagcactacgcggcggcgcggccggactacccggcggagctcttccagttcatcgcgtccaagacggcgcgccacgacctcgcgtgggacgtcggcaccggcagcggccaggccgcagtctcgctggcgaagctgtacaagaacgtggtgggcacggacacgagcgcgcagcagctggcctacgcgccggccctccccaacgtgcgctacgcccacaccccggcggacctgccgctcgacggcatccacgcggccgtcgcgccgccgggctcggttgacgtggtcaccgtggcgcaggccttccactggctcgacctgccgcgcttctacgcgcaggcccgctccctcctgcgcgcgcacggcgtcctcgccgcatggtgctacacggagccccgcgtgggcgccgcggtcgacgccgtcttctggcgcctctacgacggctcgcagccgcactgggcgcccaaccggaagatggtcgacgacgagtaccgcagcgccgacttccccttcgaccccgtcgacggcgagacccacacgggccccttcgagttctccaccgaccgccgcatggacctcgacgactacttcacctacatcaagtcctggtccgcgtaccagaccgccaaggacaatggcgtcgagctgctcgacgacgccacggtccaggacttcgccgacgcgtggggcggcgaccgcgaggaggtcaagacggtgaggtaccccatcttcctcaggatcggcaaggtgaggccttaagaatcagatgcagcatgatgcaatgcaagtggccttgagaaagggacgctttcatgtctgcacgtgacgatcgaagtgacgatggtgcaaaatgccgagcagcgtacgtgtgccgccgctggaccattttatttgcattcccctcctattcctattccaaattcagcgtgtaacaaatggtattcctagtatccatcccattttagacaaataattgtaagttgtggatgttacctttgtctatcatatatgaatgttatttttgcgg

SEQ ID NO: 1933 - DNA, 1270 bp, Hordeum vulgare
atcgcatacactagaatccatctcctggcttcaatcaacccacagggctaagcactacgcgtcgagagggagatggcgaatctgttcctgaagcaggcgaagcactatgcggcggcgcggccggactacccggccgagctcttccagttcatcgcctccaagacggcgcgccatgacctcgcgtgggacgtcggcaccggcagcggccaggccgcagtctcgctggcgaagctgtacaagaaggtggtgggcacggacacgagcgcgcagcagctggcctacgcgccggccctccccaacgtgcggtacgcccacacaccggcggacctgccgctcgagggcatccacgcggccgtcgcgccgccgggctccgtcgacgtggtcaccgtggcgcaggcattccactggctcgacctgccgcgcttctacgcgcagacgcgctccctcctgcgcgcgcacggcgtactggccgcatggtgctacacggagccccgcgtgggcgcggccgtcgacgccgtcttctggcgcctctacaacggctcgcagccgcactgggcgcccaaccggaagatggtcgacgacgagtaccgcagcgccgacttccccttcgaccccgtcgacggggaggatcacacgggccccttcgagttctccacggagcgcagcatggaccttgacgactacttcacctacatcaagtcttggtccgcgtaccagaccgccaaggacaatggcgtcgagctgctcgacgaggacaccgtgcgggcgttcgctgacgcgtggggcgacgaccgtggggaggtcaagacggtgaggtaccccatcttcctcaggatcggcaaggtgaggccggaatcaacggatgcggcatgatgatgcgagtggccttgaggaaaggatgctgtcgagtctgctcgcaccaatacgccgcactgaggatgctgctgggatatgaataagatgtttttgggtccctcatggtcccattccatattcagttttatgaaatatggtattgttaatagaatttccagtctcattccgctacttggcggagccagctcaaatttatagcctgggcaagatatacatgatgccaagttaattagattttgcccaaaaaactatgaagtaaaccatgtttcactactagagctccattcacatgccccatgggagcccgggcagcagacccggcccgccgggtgctgtcttcagcagttctaaattggattatcatccgacttgtaatataatttcaagtatgcac

SEQ ID NO: 1934 - DNA, 1298 bp, Hordeum vulgare
atcatagcatacactagaatccatctcctggcttcaatcaacccacagggctaagcactacgcgtcgagagggagatggcgaatctgttcctgaagcaggcgaagcactatgcggcggcgcggccggactacccggccgagctcttccagttcatcgcctccaagacggcgcgccatgacctcgcgtgggacgtcggcaccggcagcggccaggccgcagtctcgctggcgaagctgtacaagaaggtggtgggcacggacacgagcgcgcagcagctggcctacgcgccggccctccccaacgtgcggtacgcccacacaccggcggacctgccgctcgagggcatccacgcggccgtcgcgccgccgggctccgtcgacgtggtcaccgtggcgcaggcattccactggctcgacctgccgcgcttctacgcgcagacgcgctccctcctgcgcgcgcacggcgtactggccgcatggtgctacacggagccccgcgtgggcgcggccgtcgacgccgtcttctggcgcctctacaacggctcgcagccgcactgggcgcccaaccggaagatggtcgacgacgagtaccgcagcgccgacttccccttcgaccccgtcgacggggaggatcacacgggccccttcgagttctccacggagcgcagcatggaccttgacgactacttcacctacatcaagtcttggtccgcgtaccagaccgccaaggacaatggcgtcgagctgctcgacgaggacaccgtgcgggcgttcgctgacgcgtggggcgacgaccgtggggaggtcaagacggtgaggtaccccatcttcctcaggatcggcaaggtgaggccggaatcaacggatgcggcatgatgatgcgagtggccttgaggaaaggatgctgtcgagtctgctcgcaccaatacgccgcactgaggatgctgctgggatatgaataagatgtttttgggtccctcatggtcccattccatattcagttttatgaaatatggtattgttaatagaatttccagtctcattcctggatactccagtggcggagccagctcaaatttatagcctgggcaagatatacatgatgccaagttaattagattttgcccaaaaaactatgaagtaaaccatgtttcactactagagctccattcacatgccccatgggagcccgggcagcagccccggctgtcttcagcagttctaaattggattatcattcgacttgtaatataatgttacctttgactatcatatgaacattatgcaaacgagtcttc

SEQ ID NO: 1935 - DNA, 1048 bp, Avena sativa
agagagatggcgaatctgttcctgaaccaggcgaagcagtacgcggcgacgcggccggtctacccgctggagctcttcgagttcatcgcctccaagacgccccgccatgacctcgcatgggacgtcggcaccggcagcggccaggccgcagcctcgctagcgacgctgtacaaggacgtggtgggcacggacacgagcgcgcagcagctcgcctacgcgccgcgcctccccaacacgcgctacgtccacaccccgccggacctccccctcgagggcatccacgaggccgtcgcccggccaggcaccgtcgacgtcgccaccgtcgcgcaggccttccactggctcgacctgccacgcttctacgcgcaggcgcgctccgtcctgcgcgcgccgccgcacgggcacggcgtcctcgccgcctggtgctacaccgagccccgcgtcggagccgccgtcgacgaggtcttctggcgcctctaccacggctcgcagccgcactgggcgcccaaccgcaggctcgtcgacgacgagtaccgcagcgtcgacttccctttcgaccccgtcgacggggagacgcacacggggccattcgagttcgccaccgagcgacgcatggacctccacgactacctcagctacatcacctcatggtccgcgtaccagacggccaaggagaagggcgtcgagatgctcgacgaggccaccgtcaaggagttcgctgaggcctggggcggccaacgcgaggaggtcaagacggtcaggtacccaatcttccttaggatcggcaaggtcaggccacaatcagatgatgcatgatcgcgacaaagccagagcgatgcttccgagtttatttggacgtaaccgtcgatggtgcaactgcaagacgtacgtacgcctggaagaccattttactgcttgcattattcccccttttttttggaaagagcaaattaacaataaactttgtcaaaccgtgccccgcacgggctaggctagctagtatgaagaatgtctgattattgaaaaagcataataaatttaagattct

SEQ ID NO: 1936 - DNA, 1089 bp, Avena sativa
tcaaagacaatccaccaatataattcagacgcgctagctagctagagagagatggcgaatctgttcctgaaccaggcgaagcagtacgcggcgacgcggccggtctacccgctggagctcttcgagttcatcgcctccaagacgccccgccatgacctcgcatgggacgtcggcaccggcagcggccaggccgcagcctcgctagcgacgctgtacaaggacgtggtgggcacggacacgagcgcgcagcagctcgcctacgcgccgcgcctccccaacacgcgctacgtccacaccccgccggacctccccctcgagggcatccacgaggccgtcgcccggccaggcaccgtcgacgtcgccaccgtcgcgcaggccttccactggctcgacctgccacgcttctacgcgcaggcgcgctccgtcctgcgcgcgccgccgcacgggcacggcgtcctcgccgcctggtgctacaccgagccccgcgtcggagccgccgtcgacgaggtcttctggcgcctctaccacggctcgcagccgcactgggcgcccaaccgcaggctcgtcgacgacgagtaccgcagcgtcgacttccctttcgaccccgtcgacggggagacgcacacggggccattcgagttcgccaccgagcgacgcatggacctccacgactacctcagctacatcacctcatggtccgcgtaccagacggccaaggagaagggcgtcgagatgctcgacgaggccaccgtcaaggagttcgctgaggcctggggcggccaacgcgaggaggtcaagacggtcaggtacccaatcttccttaggatcggcaaggtcaggccacaatcagatgatgcatgatcgcgacaaagccagagcgatgcttccgagtttatttggacgtaaccgtcgatggtgcaactgcaagacgtacgtacgcctggaagaccatctgcttgcattattcccccttttttttggaaagagcaaattaacaataaactttgtcaaaccgtgccccgcacgggctaggctagctagtatgaagaatgtctgattattgaaaaagcataataaatttaagattct

SEQ ID NO: 1937 - DNA, 1113 bp, Brachypodium distachyon
ggtgaaagacgcaggcaaccaatttcacacgcacgagtgattgagcgagcaagatggcgaatctgttcctgaagcaggcgaagcagtacgcggcgacacggccggcctacccgccggagctcttcgagttcatcgcgtccaagacggcccgccatgacctggcatgggacgtcggcacaggcagcggccaggccatagcgccgctagcgaagctgtacaaggaagtggttggcacagacacgagcgcgcagcagctctcctacgcgcctcccctccccaacgtccgctacgtgcacaccccagcagaccttccgctggcgggcatccacgcggccgtggcgccgccttcctccgtggacgtcatcaccgtggcgcaggctttccactggctcgacctgccgcgcttctacgcggatgcccgctccgtcctgcgcgcgccgcacggcgtcctggccgcctggtgctacaccgagccccgcgtggacgccggcggcgccgtggacgccgccttctggcgcctctacgaggcctcgcagccgcactgggcgcccaaccgcaagatggtcgacgacgagtaccggagcgtggaattccccttcgaccccgtggacggggaggcgcacacgggccccttcgagttctccacggagcggcgcatggacctggatgactacctcacgtacatcagctcctggtccgcgtaccagacggccaaggacaagggcgtcgagctgctcgacgaggccacggttcgggagttcgctgcggcgtggggcggcgaccgcggggtggtcaagacggtcaggtaccccgtcttccttaggatcggcaaggtcaggccagaatcagatgtatgatgatcagcgagtgaagaaaggggtgtttgttggaccattctatttggatttccacgctcttttttaggaagagtcaataaataaatgaaccataaaccaatttctcatgtaacttttgtagtgttgtaatcaataatttaccaactgttcaggctcaatcatagtttaggctgaaatttattatgaaccattttcgaatcaggtagtaagaggtttttctgatctgggcattctctgttacaattgcgaattcctt

SEQ ID NO: 1938 - DNA, 1157 bp, Brachypodium distachyon
ctcgttccagcaatccaccccggtgaaagacgcaggcaaccaatttcacacgcacgagtgattgagcgagcaagatggcgaatctgttcctgaagcaggcgaagcagtacgcggcgacacggccggcctacccgccggagctcttcgagttcatcgcgtccaagacggcccgccatgacctggcatgggacgtcggcacaggcagcggccaggccatagcgccgctagcgaagctgtacaaggaagtggttggcacagacacgagcgcgcagcagctctcctacgcgcctcccctccccaacgtccgctacgtgcacaccccagcagaccttccgctggcgggcatccacgcggccgtggcgccgccttcctccgtggacgtcatcaccgtggcgcaggctttccactggctcgacctgccgcgcttctacgcggatgcccgctccgtcctgcgcgcgccgcacggcgtcctggccgcctggtgctacaccgagccccgcgtggacgccggcggcgccgtggacgccgccttctggcgcctctacgaggcctcgcagccgcactgggcgcccaaccgcaagatggtcgacgacgagtaccggagcgtggaattccccttcgaccccgtggacggggaggcgcacacgggccccttcgagttctccacggagcggcgcatggacctggatgactacctcacgtacatcagctcctggtccgcgtaccagacggccaaggacaagggcgtcgagctgctcgacgaggccacggttcgggagttcgctgcggcgtggggcggcgaccgcggggtggtcaagacggtcaggtaccccgtcttccttaggatcggcaaggtcaggccagaatcagatgtatgatgatcagcgagtgaagaaaggggtgtttgttggaccattctatttggatttccacgctcttttttaggaagagtcaataaataaatgaaccataaaccaatttctcatgtaacttttgtagtgttgtaatcaataatttaccaactgttcaggctcaatcatagtttaggctgaaatttattatgaaccattttcgaatcaggtagtaagaggtttttctgatctgggcattctctgttacaattgcgaattccttacaaaagatatgaattaacagta

SEQ ID NO: 1939 - DNA, 2917 bp, Zea mays
atctcttctcttcccgccaccgccgccgccgcctccatctcccgccattttactctccccttccccatccccatccccatccccatcccacccttcccatatcccaccaccacctcctctctcactacctatctgccatcccgagtgattgtctgtgcgaccaagacatggcttctgacggcggcggcagctcccctcctcccgcatcgtcgccctatggtcggccgtcaagcccactcgcggttactaactcctccccatctcagcccacacgccgctccggcggtcgccgtcgccgtggttccgctagtccttatgcttcgtccccttctctcggggggttcgagacgccgccgcaccctggccgccgcacgccgtccggagctggggctggcgcccctcggcagccgcgtcagaactcgactggccggttcccgccgacgccctccactccaatgtccaccgatgacgtccctccatcctccgaagctggggacgacgagaccgacggcggcggcggcgtcgacgccaccccggtcttcgtctggggcaccaacataagcgtgcaggacgtcaacgccgccattctccggttcttgcgccacttccgggacccgcgcgacgctggccgcgtcgacccggtcatggacgagggcaagtacatgcgcgccatccaccgcatcctcgagctcgagggcggggagtcgctcgacgtcgatgcgcacgacgtgtttgaccacgacccagacctctacagcaagatggttcgctatccgctcgaggtgctcgccatcttcgacatcgtgctcatggacctcgtcgcgcgcatcgagccgctcttcgagaagcacatccagaccaggatctacaacctcaagtcgtccatttgcttgaggaatctcaacccatctgatattgagaagatggtatccatcaagggtatgataattagatgcagctcggtcataccggagctcaaggaggctgtgttccgctgcctggtttgtggtttctactcagagcccgtcatggttgatagaggaagagtaactgaaccacacatttgtcagaaagaacaatgtaaagccacaaattctatgaccctagtgcacaacagatgcagattttcagacaagcagatcataaagttgcaggaaacaccagacgagataccagaaggtggcactccacatacagttagtgtcttgatgcatgataagcttgttgatgctggaaagcctggagatagggttgagataactggaatatacagagctatgagtattcgaattggaccaactcaaaggacagtgaagtctatattcaagacatatattgattgccttcacataaagaagacagacaagtctaggcttcatgtggaggacaccatggatattgataattctaacgctagcaaatctactgaagaggattttcttagtgataaggttgagaaactaaaagagctttcgaagttgcctgatatctatgaaagattgactagatcattagctccaaacatatgggagttggatgatgtcaaaagaggtctcctttgccagcttttcggcggcaatcccttgaagcttccttctggagctagtttccggggtgacatcaatattttacttgtgggggaccctggaacaagtaaatcccagcttctccagtacatgcataaactgtctcctcgtggtatctatacgagtggtagaggaagttctgctgttggtcttactgcttatgttaccaaagaccctgagactggcgaaactgttctagaaagtggagcacttgttttgagtgacaaaggtgtttgttgcatagatgagtttgataagatgtctgataatgcccgaagcatgttacacgaggtgatggaacagcagacagtatccattgcgaaggctggaataattgcatctttaaacgctaggacatctgtcctggcatgtgccaatcctactgaatcacgttacaatccaaggctctctgtaattgacaacatccacttagcgccaacgctactttcaagattcgacctgatttatcttatcttggacaaggcggatgagcaaactgataggcgcctggcaaagcatattgtttcgttgcattttgagaatccaaatttagaggagctcgaggtcttggacttgcagacactagtttcctacataagctatgcaaggaagtatattcagccacagttatctgatgaagctgcagaagagttaactcgtggctatgtcgagatgagaaaaagagggaatagccctgggagcagaaagaaggtcataacagcaaccgctagacaaatagagagtttgatccgtctcagcgaagcattagcccgaatgcggttctctgaagtggtcgaggtgcgggatgttgtggaggcattcaggcttcttgaagtcgccatgcagcagtctgcgacggatcatgcaactggtacgattgatatggatctgatcatgacggggatatccgcaagcgaaaggcagaggcgggagaacctcgttgccgcaacccgtaacctgattgcggagaaaatgcagcttggaggcccctcgatgcgcatgattgagttgctggaggaactgaggaagcagagctcaatggaaattcatatgcacgaactccgcggtgctcttggcaccctgatgactgaaggcgcggtggttatccatggagacaacgtgaggagagtttgatgtcttgacggccatctgcggtgatgcttctataaggctccaacccgccacttccttgaacagacaaggttccgaagataactgtagcacttagccctaacttgtggtccgaggtctaaactggtccagatttgtagcagtattgctagttgtagatttttttttaaaaaattgttatcagaattttgttctcttgc

SEQ ID NO: 1940 - DNA, 2919 bp, Zea mays
ccatctcccatcacctcattccctgtctgccatcccgagcgattgtctctgtgactaggccatggcttctaacagcggcggcaactccccaccctccgtaccgtcgtcggatggtcgaccgtcgagcccgctcccggtcacccactcctccccatctcagcccacccgccgctccggtgggcgccgccgccgcggctccgccagcccttatgcttcgtccccatccctctgggggttcgagacgccgccacaccctggccgccgcacgccgtctggtgccggggctggcgccgcccggcagcagcgtcagaatttgtctggccggttcccgccgacgccctccaccccaatgtctacagatgacgtcccgccgtcctccgaagccggggacgacgagacagatggcggcgacggcggggtcgacgccaccccggtcttcgtctggggcaccaacatcagcgtgcaggacgtcaatgccgccatcctccggttcctgcgccacttccgggacccgcgtgacgccggccgcgtcgacccggtcatggacgagggcaagtacatgcgctccatccaccgcatcttggagctcgagggcggggagtcactcgacgtcgacgcgcacgacgtgtttgaccatgactcagacctctacagcaagatggtccgctacccgcttgaggtgctagccatcttcgacattgtgctcatggacctcgtcgcgcgcatcgagccgctcttcgagaagcacatccagaccagggtctacaacctcaagtcgtccatttgcttgaggaatctcaacccatctgatattgagaagatggtatccatcaagggtatgataattagatgcagctcagtcattccggagctcaaggaggctgttttccgctgcttggtttgtggtttctactcagagcccgtcatggttgatagagggagagtaactgagccacacatctgtcagaaagagcaatgtaaagccacaaattctatgaccctagtgcacaaccgatgcagattttcagacaagcagatcataaagttgcaggaaacaccagatgagatacctgaaggtggcactccacatacagttagtgtcttgatgcatgataagcttgttgatgctggaaagcctggagatagagttgtgataactggtatatacagggctatgagtattagagttggaccaactcaaaggactgtgaagtctatattcaagacatatatcgattgccttcacataaagaagacagacaagtctaggcttcatgtggaggataccaaggatattgataattctaatgctagcaaatgtactgaagaggattttcttagtgataaggttgagaaactaaaagagctttcaaagttgcctgatatctatgacagattgactagatcattagctccaaacatatgggagttggatgatgttaaaagaggcctcctttgccagctttttggcggcaatcccttaaagcttccttctggagctagcttccggggtgacatcaatattttacttgtgggtgatcctggaacgagtaaatcccagcttctccagtacatgcataaactgtctcctcgtggtatctacacaagtggcagaggaagttctgctgttggtcttactgcatatgtcaccaaagatcctgagactggtgaaactgttctagaaagtggagcactagttttgagtgacaaaggtgtttgttgcatagatgagttcgataagatgtctgataatgcacgaagcatgttacacgaggtgatggaacagcagaccgtatccattgcgaaggctggaataattgcatctttaaatgctagaacatctgtcctggcatgtgccaatcctaccgaatcacgttacaacccaaggctttctgtaattgacaacattcacttagccccaactctactttcaagattcgacctaatttatcttatcttggacaaggcggatgagcaaactgataggcgcctggcaaagcatattgtttcgttgcattttgagaatccaaatttagaggagctcgaggtgttggatctgcagacactagtttcctacataagctatgcaaggaagtatattcagccacagttaactgatgaagctgcagaggagttaactcgtggctatgttgagatgaggaaaagagggaatagccctgggagcagaaagaaggtcataactgcaactgctagacaaatagagagtttgattcgtctaggtgaagcattagcccggatgcggttctctgaagtggtcgaggtgcgagatgttgtggaggccttcaggcttcttgaagttgccatgcagcagtctgcaacggatcatgcaactgggacgattgatatggatctaatcatgacggggatatctgcaagtgaaaggcagagacggaacgaccttgttgctgcaacccgtaaccttatcgtggagaaaatgcagctcggagggccttcaatgcatatgattgagttgctggaagaactcaggaagcagagctcaatggaaatccatctgcacgaactccgcggtgctcttggcactctgatgactgaaggtgcggttgttatccatggagaaaacgtgaagagagtttgatgttaactgccatctgcggtgatgcttctgtaagctcagtctgccgtttccttcaacagtcaaggttgcgaagatctgaacaactgtagggttttagctgccagagtgctaactaatgtggtctgagatttgttccagattgtgtaactccctaacagcggtgttgctagctgtagatttttttaatgaaatatcaaaaaattagttcacgaattgtaaatggtaattatgattggaattaaaaaaattatttaacattatgtgttacccatcacgtgaatcaaatagcaccttatattcta

SEQ ID NO: 1941 - DNA, 2978 bp, Setaria italica
ccctcccctaccccccatccccgtctcccaccacctcctcggctccttgtcgtcctctctcttcccgccggtgcgtccgtctctgcgcgcaagccatggcgtctaacggcggcggcagctccccaccttccgcgtcgtcgccggatgctcgcccgtcgagcccgttcccggtcaccaattcctcccctacccagtccacgcgccggtctggcgggcggcgccgccgcgggtccgccagcccctatccctcgtccccctccctcgggggatttgagacgccgccgcaccccggccgccgcactccgtccggcgccggggccggcgccgcccggcagcagcgccagaactggactggccggttcccgccgacgccctccacccccatgtctaccgacgacatcccgccgtcctccgacgctggggacgacgagaccgacggcgccggcgccggcgtcgacgccaccccggtgttcgtctggggtaccaacatcagcgtgcaggacgtcaacgccgccatcctccggttcctgcgccacttcagggacccgcgcgacgccggccgtgtcgacccggtaatggacgagggcaagtacatgcgcgccatccaccgcatcctcgagctcgagggcggggagtcgctcgacgttgacgcgcacgatgtcttcgaccatgacccggacctgtacagcaagatggtgcgctacccgctcgaggtgctcgccattttcgacatcgtgctcatggacctcgtagcacgcatcgagccactcttcgagaagcacatccagaccaggatctacaacctcaagtcgtccatttgcttgaggaatctcaacccatctgacattgagaagatggtgtcgataaagggcatgataattagatgcagctcggtcataccagagctcagggaggctgtgtttcgctgcctagtttgtggtttctactcagagcccatcatggttgatagagggagagtaactgaaccacacatttgtcagaaagaacaatgtaaagccacaaattctatgaccctggtgcataaccgatgcagatttgcagacaagcagatcataaagttgcaggaaacaccagatgagatagcagaaggtggtactccacatacagttagtgtcctgatgcatgataaacttgttgatgctggaaagcctggagatagggttgagatcactggaatatatagggctatgagtattagagttggacctgctcaaaggacagtgaagtctatattcaagacgtacattgattgccttcacgtaaagaagaccgacaagtctaggcttcacgtggacactatggatattgacaattccaacgctaacaattctactgaagaggactttcttagtgataaggttgagaaactaaaagagctttcgaagttgcctgatatctatgacagattgactagatcattggcgccaaacatatgggagttggatgatgttaaaagaggcctcctttgccagctttttggtggcaatcccttgaagcttccttctggagctagtttccgaggtgacatcaatattttacttgtgggtgatcctggaacaagtaaatcccagcttctccagtacatgcataaactgtctcctcgtggtatctatacaagtggtagaggaagttctgctgttggtcttactgcttatgttgccaaagatcctgagactggtgaaactgttcttgagagtggagcacttgttttaagtgacaaaggtgtttgctgtatagatgagttcgataagatgtctgataatgcccgaagcatgttacatgaggtgatggaacagcagacagtatccattgcaaaggctggaataatcgcatctttaaatgctagaacatctgtgctggcatgtgcgaatcctacagaatcacgttacaatccgagactttccgtaatcgacaacatccaccttgccccaacacttctttcaaggtttgatctgatttatcttatcttggacaaggcagatgagcaaactgataggcgcctggcaaagcatattgtttcattgcatttcgagaacccaaatttagaggagctcgaggtcttggacttgcccacattagttgcctacataagctatgcaaggaagtatattcagccacagttatctgatgaagctgcagaagagttgactcgtggctatgttgagatgaggaaaagagggaatagccctgggagcagaaagaaggtcataactgcaacagctagacaaatcgagagcttgattcgtctcagtgaagcattggcccgaatgcggttctctgaagtggtcgaagtgcgagatgttgtggaggctttcaggcttcttgaagttgccatgcagcagtctgcaacagatcatgcaacagggacgattgacatggatctaatcatgacgggaatatctgcaagcgaaaggcagagacgggagaacctcgttgcagcaacccgtaatcttatcatggagaaaatgcagcttggaggcccctcaatgcgtatgacagagctgctggaagaaatgaggaagcagagctcaatggaaattcagctgcacgatcttcgcggtgctcttggcaccctgatgactgaaggtgctgttgttatccatggagacaatgtgaagagggtttgatgccgatacgcaccatctgccgcattgatgtggactggtctacaattcatccacggattgccaagaattgatgaaatgtagagctgagccatgcagaatgctaactttggtctgaagtctaaactggtcctgattgtgctactcccctagataagatagcgtagttttgtggtagttgtagtttctttttttagtattaatattaaaacataatattcttgcgttgcctgagtttactgaatcaatgtaacttgtatcatttacgtaatctggctcagggtcctactgaaccatatgtccgtatgtagtgtgtacgggtcattggtgatg

SEQ ID NO: 1942 - DNA, 2878 bp, Oryza sativa
tgctctctctgctcgcgcggaagccatggcgtctcgcggcggtggcggcggcggcgacggcaattcccctcctccctccgtgtcgtcgccggatgtgcgaccgtcgagccctctcccggcgaccaactcctccccgcctcagtcggggcggcgcggcggggggcggcgccggcgtggttccgccagcccgtacccgtcgtccccgtccctcggcgggttcgagacgccgccgcacccgggccgccgcacgccctccggcggcgcggcggcgcggcagcagcggcagaactggacgggggggcggttcccgccgaccccgtccacccccatgtccaccgacgacgtcccgctctcctcggaggccggggacgaggacacccccgagaccgacggcggcggcggcggcggcgcgggcgccgacgccacgccggtgttcgtctggggcaccaacatcagcgtgcaggacgtcaacgccgccatcctccggttcctccgccacttccgcgacccgcgcgacgccggccgcgtcgacccggtcatggacgagggcaagtacatgcgcgccatccaccgcatcctcgagctcgagggcggggagtcgctcgacgtcaacgcccacgacgtgttcgaccacgacccggacctctacggcaagatggtcaggtacccgctcgaggtgctcgccatctttgacatcgtgctcatggacctcgtcgcgcgcatcgagcccctcttcgagaagcacatccagaccaggatctacaacctcaagtcctcggtttgcttgaggaatctcaacccttctgatatcgagaagatggtgtccatcaagggtatgataattcggtgcagctcggtgattccagagctcaaggaggctgtgttccgctgcttggtttgcgggttctactctgagcctgtaatggttgatcgagggagggttactgagccgcacatctgtcagaaagaacaatgtaaagctacaaactctatgactcttgtgcataaccgatgcaggtttgcagataagcagatcataaagttgcaggaaacaccagatgagataccagaaggtggcactccacatactgttagtgtcttgatgcacgataagcttgtagatgctggaaagcctggagacagggttgagataactgggatatacagagccatgagtattagagttggcccaactcagaggacagtgaagtcgattttcaagacgtacattgattgccttcacataaagaagacagacaagtctagacttcatgttgaggactccatggaaactgataaccccaatgctaacaagacaactgaagatgattttctcagagataaggttgagaaattaaaagagttgtcaaagttgccagatatatatgacagattaactaggtcattggctccaaacatatgggagctggacgacgttaaaaggggcctcctttgccagctttttggtggaaatgctttgaggcttccttctggagctagtttccgaggcgacatcaatattttgcttgttggtgatcctggaacaagtaaatcccagcttctccaatacatgcacaaactgtctcctcgtggcatttatacaagtggcagaggaagttcagctgttggccttactgcatacgttaccaaggatcctgaaactggtgaaactgttcttgagagtggagcgcttgttttgagtgacaaaggtgtttgttgtattgatgaatttgataagatgtctgataatgctcgaagcatgttacatgaggtgatggaacaacagactgtctccattgccaaggctggaataattgcatctttaaatgccagaacatcagttctagcatgtgcaaatcctactgaatcacgttataatccaaggctctctgtgattgacaatatccatcttcctccaacactgctttctaggtttgacctcatttatctgatattggacaaggcagatgagcaaactgatagacgcctggctaagcatattgtttcgttgcattttgagaatccaaacatagaggagctcgaggtcttggatttgccaacacttgtagcctacataagttatgcaaggaagcatatacaaccacagttatctgatgaagctgcagaagaattgactcgcggctatgttgagatgaggaaaagaggaaacagccctggtagcagaaagaaggtcataactgcgacagctcgacaaattgagagcttgattcggctcagtgaagcactggcccgaatgcgattctctgaaatggttgaagtacaagatgttgtagaggccttcaggcttctcgaagttgccatgcagcaatcggcaactgatcatgccactggtacaatcgatatggatcttatcatgactggaatatctgcgagcgaaaggcagaggcgggacaatctcgttgcagcaacccgcaaccttgtgatggagaaaatgcagcttggagggccctcagtgcgaatgattgagttgctggaagaaattaggaagcagagctctatggaagttcatctgcatgatcttcgcggtgctcttggcactctgatgacagagggtgccgtagtcatccatggagacagcgtcaagagggtctgatgccttattatttgcgatctctctagctaatgttctgatccgttgttagtgctctcaattggagactgcttacacatcggacttattgtctaactgtataatttttagataatgtttcttgttacggttgcttacatgaaaacaagcaagtgttaatcagagttgtaatgtaatgcatcagtttccttttagtcaactatatgtaggcatgatgattcatatttgtatttgttctacacattcagtttccaaatagttctacca

SEQ ID NO: 1943 - DNA, 2979 bp, Brachypodium distachyon
atggcgaccaatcgcggcggcggcaacagcagccctcccaacaactccgtgtcgtcgcccgatgtccggccatcgagcccgctcccagccaccaactcatcccctccccagtccacgcggcgcgccgtcgggcgccgccgccggggctctgccagcccgtacccttcatccccctctctcggggggttcgagacgccgccgccacccggccgctccacgccgtccggcgctgggcccacccggcagcgccagaactggaccggacggttcccgccaacgccgtccactccaatgtccacggacgacgtcccgatgtcctccgaagccggggatgaggacaccccggagaccgacggcggtggcgccggcgtcgacgccaccccggtcttcgtctggggtactaacatcagcgtgcaggacgttaacgccgccatcctgcggtttctgcgccacttccgggacccccgcgacgccggccgcgtcgacccggtcatggatgagggcaagtacatgcgcgccatccaccgcatcctcgagctcgaaggtggggagtcgcttgacgtggacgcacacgacgtgttcgaccacgaccctgacctatacggcaagatggtccggtacccgctcgaggtgcttgctatctttgacatcgtgctcatggatctcgtggcgcggattgagccactgttcgagaagcatattcagactagaatctacaacctcaagtcgtcgatttgcttgaggaatcttaacccatcagatattgagaagatggtgtcgatcaagggtatgataattcggtgcagctcagtcataccggagctgaaggaagctgtgttccgctgtcttgtttgtggcttctactcagagcctgtcatggttgatagagggagagtaactgagccgcaaagatgtcagaaagagcaatgtaaagcaacaaattctatgacgctagtgcataatcgttgcagattttcagacaagcagatcataaagttgcaggaaacaccagatgagataccagaaggtggtactcctcatacagttagtgtattgatgcatgataagcttgttgatgctggaaagcctggagacagggttgagatcactgggatatacagggccatgagtatcagaattggaccaagtcaaaggacagtgaagtcaatatttaagacatatattgattgccttcacataaagaagacagacaagtctaggcttcatattgaagatggtatggatactgatagcaccaatgctagcaagacttctgaagatgactttgtcagagataagattgagaaattaaaagagctttcaaagttgcctgacatctatgacagattgactagatcactggctccaaacatatgggaactggacgatgttaagagaggactcctttgccaactttttggtgggaatgctttgaggcttccatctggagcaaatttcagaggtgacatcaacattttgcttgttggtgatcctgggacgagtaaatcccagcttctccagtacatgcataaactttctcctcgtggtatttacacgagtggaagaggcagttcggcagttggtcttactgcttatgttgcgaaggatcctgaaactggtgaaactgttctcgagagtggtgcacttgttttgagtgacaaaggtgtttgctgtatcgatgagtttgataagatgtctgataatgcccgaagcatgcttcatgaggtgatggagcagcagactgtatccattgcaaaggctggaataattgcgtctttaaatgctagaacatctgttctagcatgtgcaaatccgtctgaatcacgttataatccaaggctttctgtcatagacaatatccaccttcctccaacactgctgtcaagatttgacctgatttatcttatcttggacaaggcagacgagcaaactgatagacgcttggctaagcatattgtttcattgcattttgagaatccagatgtagaggagcaccaggtcttggatttgcccacgttagttgcatacataagctacgcaaggaagtatattgagccacagttatctgatgaagcagcagaagaattgacccgtggctatgttgagatgaggaaaagagggaacagccctgggagccgaaagaaggtaatcactgcaacagctaggcaaattgagagcttgattcgtctcagtgaagcactggctcgaatgcggttctcagaagtggtaggagtgcgagatgttacagaggcctttaggcttcttgaagtcgcgatgcagcaatctgctactgatcatgcaacagggacgattgatatggatctaatcatgacgggaatatctgcaagtgaaaggcagaggcgtgacaatcttgttgcagctatccgaaaccttgtcatggagaaaatgcagcttggagggccctcaatgcgtatgattgagttgctggaagaattaaggcaacagagctccatggaagttcatctgcacgatgttcgtggtgctcttggcactctgatgagtgagggaaccgtagttatgcatggagatagtttcaagaggacctgatatgttatcatgtaggatccatggcatcaagcggtggatatcaccagttcgatcaaccatgtccttgagctgatctttctacctctgcaagaatggtgaagatctgatatactggagtgctaacctgtttggtcatttgatggccctgattgggtaacttcctagatagaggtgtatcatgtgctgtagaattcttaaacgtgcctcttgctattgttatttctacgtcaacaccattttaatccgagggacagttttgttaatctggctaacagctgcagtaaccatgacgcatcaatcttttttcttggttgtgcgctaacggctcacgtgcatgcatccggctcgagtccccaggaatagaaaaggcgatcatgttttgatttgctgttgtaaacttggagtggttgg

SEQ ID NO: 1944 - DNA, 3211 bp, Brachypodium distachyon
cccagttcccctgacccctgcctctcatctctccccaccccttccctggactctctctctctcgtctttccctctccgtgcgtgagctatggcgaccaatcgcggcggcggcaacagcagccctcccaacaactccgtgtcgtcgcccgatgtccggccatcgagcccgctcccagccaccaactcatcccctccccagtccacgcggcgcgccgtcgggcgccgccgccggggctctgccagcccgtacccttcatccccctctctcggggggttcgagacgccgccgccacccggccgctccacgccgtccggcgctgggcccacccggcagcgccagaactggaccggacggttcccgccaacgccgtccactccaatgtccacggacgacgtcccgatgtcctccgaagccggggatgaggacaccccggagaccgacggcggtggcgccggcgtcgacgccaccccggtcttcgtctggggtactaacatcagcgtgcaggacgttaacgccgccatcctgcggtttctgcgccacttccgggacccccgcgacgccggccgcgtcgacccggtcatggatgagggcaagtacatgcgcgccatccaccgcatcctcgagctcgaaggtggggagtcgcttgacgtggacgcacacgacgtgttcgaccacgaccctgacctatacggcaagatggtccggtacccgctcgaggtgcttgctatctttgacatcgtgctcatggatctcgtggcgcggattgagccactgttcgagaagcatattcagactagaatctacaacctcaagtcgtcgatttgcttgaggaatcttaacccatcagatattgagaagatggtgtcgatcaagggtatgataattcggtgcagctcagtcataccggagctgaaggaagctgtgttccgctgtcttgtttgtggcttctactcagagcctgtcatggttgatagagggagagtaactgagccgcaaagatgtcagaaagagcaatgtaaagcaacaaattctatgacgctagtgcataatcgttgcagattttcagacaagcagatcataaagttgcaggaaacaccagatgagataccagaaggtggtactcctcatacagttagtgtattgatgcatgataagcttgttgatgctggaaagcctggagacagggttgagatcactgggatatacagggccatgagtatcagaattggaccaagtcaaaggacagtgaagtcaatatttaagacatatattgattgccttcacataaagaagacagacaagtctaggcttcatattgaagatggtatggatactgatagcaccaatgctagcaagacttctgaagatgactttgtcagagataagattgagaaattaaaagagctttcaaagttgcctgacatctatgacagattgactagatcactggctccaaacatatgggaactggacgatgttaagagaggactcctttgccaactttttggtgggaatgctttgaggcttccatctggagcaaatttcagaggtgacatcaacattttgcttgttggtgatcctgggacgagtaaatcccagcttctccagtacatgcataaactttctcctcgtggtatttacacgagtggaagaggcagttcggcagttggtcttactgcttatgttgcgaaggatcctgaaactggtgaaactgttctcgagagtggtgcacttgttttgagtgacaaaggtgtttgctgtatcgatgagtttgataagatgtctgataatgcccgaagcatgcttcatgaggtgatggagcagcagactgtatccattgcaaaggctggaataattgcgtctttaaatgctagaacatctgttctagcatgtgcaaatccgtctgaatcacgttataatccaaggctttctgtcatagacaatatccaccttcctccaacactgctgtcaagatttgacctgatttatcttatcttggacaaggcagacgagcaaactgatagacgcttggctaagcatattgtttcattgcattttgagaatccagatgtagaggagcaccaggtcttggatttgcccacgttagttgcatacataagctacgcaaggaagtatattgagccacagttatctgatgaagcagcagaagaattgacccgtggctatgttgagatgaggaaaagagggaacagccctgggagccgaaagaaggtaatcactgcaacagctaggcaaattgagagcttgattcgtctcagtgaagcactggctcgaatgcggttctcagaagtggtaggagtgcgagatgttacagaggcctttaggcttcttgaagtcgcgatgcagcaatctgctactgatcatgcaacagggacgattgatatggatctaatcatgacgggaatatctgcaagtgaaaggcagaggcgtgacaatcttgttgcagctatccgaaaccttgtcatggagaaaatgcagcttggagggccctcaatgcgtatgattgagttgctggaagaattaaggcaacagagctccatggaagttcatctgcacgatgttcgtggtgctcttggcactctgatgagtgagggaaccgtagttatgcatggagatagtttcaagaggacctgatatgttatcatgtaggatccatggcatcaagcggtggatatcaccagttcgatcaaccatgtccttgagctgatctttctacctctgcaagaatggtgaagatctgatatactggagtgctaacctgtttggtcatttgatggccctgattgggtaacttcctagatagaggtgtatcatgtgctgtagaattcttaaacgtgcctcttgctattgttatttctacgtcaacaccattttaatccgagggacagttttgttaatctggctaacagctgcagtaaccatgacgcatcaatcttttttcttggttgtgcgctaacggctcacgtgcatgcatccggctcgagtccccaggaatagaaaaggcgatcatgttttgatttgctgttgtaaacttggagtggttggctcgtggaagttggagcatttgtactttagatgggtgagctgttgtttcaggtaggctagatcaagggtggcatcattaaatccatcctgaagctagactgatgtgtgatactacccgctaaatccatcctgatgtttgcatga

SEQ ID NO: 1945 - DNA, 2885 bp, Triticum aestivum
gctccctctctggcctctctctgcgcgcaagccatggcgtccaacggcgtcggaaacagcaactctccctactctgcgtcgtcgccggatgtccgcccgtcgagcccgctcccggccaccaactcatcccctccccagtccgctcgccgcgccggcggccgcctccgccgcggccccacctcgtctccctccctcggcgggttcgagactccgccgccaccgggccgccgcactccgtccggtgctggcgcagcccggcagcgccaaaactggaccggacggtttccgccaactccgtccactcccatgtccaccgacgacgtcccgctgtcctccgaagccggggaggaggacacgcccgagaccgacggcggcggcgtcggcgccgatgcaccccggtcttcgtctggggcaccaatatcagcgtgcaggacgtgaacgctgccattctgcggtttctgcgccacttccgggacccccgcgacgccggccgcgtcgaccctgtcatggacgagggcaagtacatgcgcgccatccaccgcatcctcgagcttgagggtggcgagtcgctcgatgtggacgcacacgacgtcttcgaccacgatcccgacctatacggcaagatggtacgctacccgctcgaagtgcttgccatcttcgacatcgtccttatggacctggtggcgcgtatggagccgctgtttgagaagcacattcagaccaggatctacaacctcaagtcatccatttgcttgaggaatctgaatccgtcagatattgagaagatggtgtcaatcaagggtatgataattcgatgcagctcagtcataccagagctcaaggaggctgtgttccgctgccttgtttgcggcttctactcagaacctgtcatggttgacagagggagagtaactgagccacacatatgtcagaaagaacaatgtaaagcctcaaattctatgactctagtgcataaccgatgcagatttgcggacaagcaaatcataaagttgcaggaaacaccagatgagataccagaaggtggcactcctcatacagtcagtgttttgatgcatgataagcttgttgatgctggaaagcctggagatagggttgagatcactgggatatatagggccatgagtatcaggatcgggccaagtcagaggacagtgaagtcaatattcaagacatacattgattgccttcacataaagaagacagacaagtccaggcttcatattgaggactctatggatactgataacaccaatgctagcaagtcttctgaagatggccatgtcacagataagatagataaattaaaagagctttcaaagttgcctgacatctatgatagattgactagatcactggctccaaacatatgggaactggatgatgttaagaggggcctgctttgccagctttttggtggcaatgctttgaggcttccttctggagctaacttcagaggtgacatcaatattttgcttgttggtgatcctggaacgagcaaatcccagcttctccagtacatgcataaactgtctcctcgtggtatttacacaagtggaagaggcagttcagcagttggccttactgcttatgttgctaaggaccctgaaactggtgaaactgttcttgaaagtggagcacttgttttgagtgacaaaggtgtttgctgtattgatgagtttgataagatgtctgataatgcccgaagcatgctgcatgaggtgatggagcagcagactgtatccattgcaaaggctggaattattgcatctttgaatgctaggacatctgtcctagcatgtgccaatccatctgaatcacgttacaatccaaggctttctgtgatcgacaatatccaccttcctccaacactgctgtcaaggtttgacctgatttatctgatcttggacaaggcagacgaacaaactgatagacgcctggctaagcatattgtttcattgcatttcgagaatccagaagtagttgagcaccaggtcttggatttgcccacgttagttgcgtacatcagctatgcaaggaagtacattcagccaaagttatctgatgaagctgcagaagaattgacccgtggctacgttgcaatgaggcaaagggggaacaatcctggtagcagaaagaaggtcatcacagcaacagctaggcaaattgagagcttgattcgtcttagtgaagcactggcgcgaatgcgtttttcggaagtggttggagtgcgagatgtaacagaagcctttaggcttcttgaagtcgccatgcagcaatctgcaaccgatcatgcaacagggacgattgatatggatctaatcatgactggggtatccgcaagtgaaaggcagagacgtgacaatcttgttgcggctatccgagaccttgtcatggagaaaatgcagcttggagggccctcgatgcgtatggctgagttgctggaagaagtgaggaaacagagctccatggaagttcatcagcatgatctccgtgttgctcttggcacactgcagagtgagggctccgtatttgtccacggagacagtttcaagaggacctgatggcaacgacgttgtagccagcatcaactgaacctaccatgctcccctctccaagaatgttgaagatctgatgtctttgtagagctgggtgctaacctgtttggtcttttcatggcctgtgccgtagatttcttaatgttgctcttgggattgttatgtttacatgaaggcatatttttatttgtgtttgccagcaatggatcaattatgctgctaccattgagtctgtggtgcataaatccatttttcttcttgtctggtgggaacctgctcatttgcaagcatacagcacgagtagcccac

SEQ ID NO: 1946 - DNA, 2761 bp, Oryza sativa
tgctctctctgctcgcgcggaagccatggcgtctcgcggcggtggcggcggcggcgacggcaattcccctcctccctccgtgtcgtcgccggatgtgcgaccgtcgagccctctcccggcgaccaactcctccccgcctcagtcggggcggcgcggcggggggcggcgccggcgtggttccgccagcccgtacccgtcgtccccgtccctcggcgggttcgagacgccgccgcacccgggccgccgcacgccctccggcggcgcggcggcgcggcagcagcggcagaactggacgggggggcggttcccgccgaccccgtccacccccatgtccaccgacgacgtcccgctctcctcggaggccggggacgaggacacccccgagaccgacggcggcggcggcggcggcgcgggcgccgacgccacgccggtgttcgtctggggcaccaacatcagcgtgcaggacgtcaacgccgccatcctccggttcctccgccacttccgcgacccgcgcgacgccggccgcgtcgacccggtcatggacgagggcaagtacatgcgcgccatccaccgcatcctcgagctcgagggcggggagtcgctcgacgtcaacgcccacgacgtgttcgaccacgacccggacctctacggcaagatggtcaggtacccgctcgaggtgctcgccatctttgacatcgtgctcatggacctcgtcgcgcgcatcgagcccctcttcgagaagcacatccagaccaggatctacaacctcaagtcctcggtttgcttgaggaatctcaacccttctgatatcgagaagatggtgtccatcaagggtatgataattcggtgcagctcggtgattccagagctcaaggaggctgtgttccgctgcttggtttgcgggttctactctgagcctgtaatggttgatcgagggagggttactgagccgcacatctgtcagaaagaacaatgtaaagctacaaactctatgactcttgtgcataaccgatgcaggtttgcagataagcagatcataaagttgcaggaaacaccagatgagataccagaaggtggcactccacatactgttagtgtcttgatgcacgataagcttgtagatgctggaaagcctggagacagggttgagataactgggatatacagagccatgagtattagagttggcccaactcagaggacagtgaagtcgattttcaagacgtacattgattgccttcacataaagaagacagacaagtctagacttcatgttgaggactccatggaaactgataaccccaatgctaacaagacaactgaagatgattttctcagagataaggttgagaaattaaaagagttgtcaaagttgccagatatatatgacagattaactaggtcattggctccaaacatatgggagctggacgacgttaaaaggggcctcctttgccagctttttggtggaaatgctttgaggcttccttctggagctagtttccgaggcgacatcaatattttgcttgttggtgatcctggaacaagtaaatcccagcttctccaatacatgcacaaactgtctcctcgtggcatttatacaagtggcagaggaagttcagctgttggccttactgcatacgttaccaaggatcctgaaactggtgaaactgttcttgagagtggagcgcttgttttgagtgacaaaggtgtttgttgtattgatgaatttgataagatgtctgataatgctcgaagcatgttacatgaggtgatggaacaacagactgtctccattgccaaggctggaataattgcatctttaaatgccagaacatcagttctagcatgtgcaaatcctactgaatcacgttataatccaaggctctctgtgattgacaatatccatcttcctccaacactgctttctaggtttgacctcatttatctgatattggacaaggcagatgagcaaactgatagacgcctggctaagcatattgtttcgttgcattttgagaatccaaacatagaggagctcgaggtcttggatttgccaacacttgtagcctacataagttatgcaaggaagcatatacaaccacagttatctgatgaagctgcagaagaattgactcgcggctatgttgagatgaggaaaagaggaaacagccctggtagcagaaagaaggtcataactgcgacagctcgacaaattgagagcttgattcggctcagtgaagcactggcccgaatgcgattctctgaaatggttgaagtacaagatgttgtagaggccttcaggcttctcgaagttgccatgcagcaatcggcaactgatcatgccactggtacaatcgatatggatcttatcatgactggaatatctgcgagcgaaaggcagaggcgggacaatctcgttgcagcaacccgcaaccttgtgatggagaaaatgcagcttggagggccctcagtgcgaatgattgagttgctggaagaaattaggaagcagagctctatggaagttcatctgcatgatcttcgcggtgctcttggcactctgatgacagagggtgccgtagtcatccatggagacagcgtcaagaggaaaacaccttcttttgctgctaatcacgttttagttcgaattaatgccatccactcgatcgcgggattaagatccatccggccgttcatgtggctgctcatcctgagccataggatcggcgaaagcatattggatggtccagattttttttga

SEQ ID NO: 1947 - DNA, 2611 bp, Hordeum vulgare
ttcctctcttcccgccgccgcctcccgccatttaccccagccccgtgcccctcccctccacctcccgctcatctccaccccaaccctcgtctctctccctctccctctccctctctcgcctctctctgcgcgcaagccatggcgtctaacggcggcggcaacagcaactcaccctactcgccggatgtccgcccgtcgagcccgctcccggccaccaactcatcccctccccagtccgctcgccgcgccggcgggcgcctccgccgcggccccacctcgtctccctccctcggcgggttcgagacgccgccgccaccgggccgccgtattccgtccggtgctggtgccggccggcaacgccaaaactggactggacggtttccgccaactccgtccactcccatgtccaccgacgacgtcccgccgtcctccgaagctggggaggaggacacgcccgagaccgacggcggcggcgtcggcgccgatgccaccccggtattcgtctggggcaccaatatcagtgttcaggacgtgaacgctgccattctgcgttttctgcgccacttccgggacccccgcgacgccggccgggtcgacccagtcatggacgagggcaagtacatgcgcgccatccaccgcatccttgagctcgagggcggcgagtcgctcgacgttgacgcacacgacgtgttcgaccacgatcccgacctatacggcaagatggtacgctacccgctggaagtgcttgccatcttcgacatcgtccttatggacctggtggcgcgtatggagccgctgtttgagaagcacatacagaccaggatctacaacctcaagtcatccatttgcttgaggaatctgaatccgtcagatattgagaagatggtgtcaatcaagggtatgataattcgaggcagctccgtcataccagagctcaaggaggctgtcttccgctgccttgtttgcggcttttactcagaacctgtcatggttgacagagggagagtaactgagccacacatatgtcagaaagaacaatgtaaagcctcaaactctatgactctagtgcataaccgatgcagatttgcggacaagcagatcataaagttgcaggaaacaccagatgagataccggaaggtggcactcctcatacagtcagtgttttgatgcatgataagcttgttgatgctggaaagcctggagatagggttgagataactgggatatacagggccatgagtatcagaatcggaccaagtcagaggactgtgaagtcaatattcaagacatacattgattgccttcacataaagaagacagacaagtccagacttcatattgaggactctatggatactgataacaccaatgctagcaagtcttctgaagacagccatgtcacagataagatagataaattaaaagagctttcaaagttgcctgacatctatgatagattgactagatcactggctccaaacatatgggaactggatgatgttaagaggggcctgctttgccagctttttggtggcaatgctttgaggcttccttctggagctaacttcagaggtgacatcaatattttgcttgttggtgatcctggaacaagcaaatcccagcttctccaatacatgcataaactatctcctcgtggtatttacacaagtggaagaggcagttcagcagttggccttactgcttatgttgcgaaggaccctgaaactggtgaaactgttcttgagagtggagcacttgttttgagtgacaaaggtgtttgctgtattgatgagtttgataagatgtctgataatgcccgaagcatgctgcatgaggtgatggagcagcagactgtatccattgcaaaggctggaattattgcatctttgaatgctagaacatctgtcctagcatgtgcaaatccatctgaatcgcgttacaatccaagactttctgtgattgacaatatccaccttcctccaacactgctgtcaaggtttgacctgatttatctgatattggacaaggcagacgaacaaactgatagacgccttgctaagcatattgtctcattgcatttcgagaatccagaagtagtggagcaccaggtcttggatttgcccacgttagttgcgtacatcagctatgcaagaaagtttattcagccaaagttatctgatgaagctgcagaagaattgacccgtggctatgttgagatgaggaaaagagggaacaatcctgggagcagaaagaaggtcatcacagcaacagctaggcaaattgagagcttgatccgtcttagtgaagcactggcacgaatgcgtttttcagaagtggttggagtgcgagatgtagcagaagcctttaggcttcttgaagttgccatgcagcaatctgcaactgatcatgcaacagggacgattgatatggatctaatcatgactggggtatctgcaagtgaaaggcaaagacgtgacaaccttgtctcagctatccgagaccttgtcatggagaaaatgcagcttggagggccctcgatgcgtatggctgagttgctggaagaagtgaggaagcagagctccatggaagttcatcagcatgatctccgtg

SEQ ID NO: 1948 - DNA, 2733 bp, Secale cereale
tgtccgcccgtcgagcccgctcccggccaccaactcatcccctccccagtctgctcgccgcgccggcgggcgcctccgccgcggccccatctcgtctccctccctcggcgggttcgagacgccgccgccaccgggccgccgcaccccgtccggtgctggcgccgcccggcagcgccaaaactggaccggacggtttccgccaactccgtccactcccatgtccaccgacgacgtcccgctgtcctctgaagccggggaggacacgcccgagaccgacggcggcggcgtcggcgccgatgccaccccagtcttcgtctggggcaccaatatcagcgtgcaggacgtcaacgctgccattctgcggtttctgcgccacttccgggacccgcgcgatgccggccgcgtcgaccctgtcatggacgagggcaagtatatgcgcgccatccaccgcatcctcgagctcgagggtggcgagtcgctcgacgtggacgcacacgacgtcttcgaccacgatcctgacctatactgcaagatggtacgctacccgctcgaagtgcttgccatcttcgacattgtccttatggacctggtggcgcgtatggagccgctgtttgagaagcacattcagaccaggatctacaacctcaagtcgtccatttgcttgaggaatctgaatccgtcagatattgagaagatggtgtcaatcaagggtatgataattcgatgcagctcggtcataccagagctcaaggaggctgtgttccgctgccttgtttgtggcttctactcagagcctgtcatggttgacagagggagagtaactgagccacacatatgtcagaaagaacaatgtaaagcctcaaactctatgactctagtgcataaccgatgcagatttgcggacaagcagatcataaagttgcaggaaacaccagatgagataccagaaggtggcactcctcatacagtcagtgttttgatgcatgataagcttgttgatgctggaaagcctggagatagggttgagatcactgggatatacagggccatgagtatcagaatcgggccaagtcagaggacagtgaagtcaatattcaagacatacattgattgccttcacataaaaaagacagacaagtccaggcttcatattgaggactctatggatactaataacaccaatgatgctagcaagccttctgaagatggccttgtcacagataagatcgataaattgaaagagctttcaaagttgcctgacatctatgataggttgactagatcactggctccaaacatatgggaactggatgatgttaagaggggcctactttgccagctttttggtggcaatgctttgaggcttccttctggagctaacttcagaggtgacatcaatattttgcttgttggtgatcctggaacgagcaaatcccagcttctccagtacatgcataaactgtctcctcgtggtatttacacaagtggaagaggcagttcagcagttggccttactgcttatgttgcgaaggatcctgaaactggtgaaactgttcttgagagtggagcacttgttttgagtgacaaaggtgtttgctgtattgatgagtttgataagatgtctgacaatgcccgaagcatgctgcatgaggtgatggagcagcagactgtatccattgcaaaggctggaattattgcatctttaaatgctagaacatctgtcctagcatgtgcaaatccatctgaatcacgttacaatccaaggctttctgtgattgacaatatccaccttcctccaacactgttgtcaaggtttgacctgatttatctgatcttggacaaggcagatgaacaaactgatagacgcctggctaagcatattgtttcattgcatttcgagaatccagaagtagttgagcaccaggtcttggatttgcccacgttagttgcgtacataagctatgcaaggaagtacattcagccaaagttatctgatgaagctgcagaagaattgacccgtggctacgttatgatgaggcaaagagggaacaatcctgggagcagaaagaaggtcatcacagcaacagctaggcaaattgaaagcttgattcgtcttagtgaagcactggcgcgaatgcgtttttcggaagtggttggagtgagagatgtaacagaagcctttaggcttcttgaagtcgccatgcagcaatctgcaactgatcatgcaacagggacgattgatatggatctaatcatgactggcgtatccgcaagtgaaaggcagagacgtgacaatcttgttgcggcgatccgagaccttgtcatggagaaaatgcagcttggagggccctttatgcgtatggctgagttgctggaggaagtgaggaaacagagctccatggaagttcatcagcatgatctccgtgttgctcttggcacactgcagagtgagggctccgtatttgtccatggagacagtttcaagaggacctgatgtgttgctcaacctaccctgcccccctctcttcaagaatgttgaagatctgatgtctttgtagagctgggtgctaacctgtttggtcttttcctggccctgactcctagatggaggtctatcctgtgctgtagattttttaatgttgctcttgggattgttatgtttacatgaaggcatatttttatttgtgtttgccagcaatggatcaatgatgatgctaccattgaatccgtggt

SEQ ID NO: 1949 - DNA, 3234 bp, Triticum aestivum
gctccctctctggcctctctctgcgcgcaagccatggcgtccaacggcgtcggaaacagcaactctccctactctgcgtcgtcgccggatgtccgcccgtcgagcccgctcccggccaccaactcatcccctccccagtccgctcgccgcgccggcggccgcctccgccgcggccccacctcgtccccctccctcggcgggttcgagactccgccgccaccgggccgccgcactccgtccggtgctggcgcagcccggcagcgccaaaactggaccggacggtttccgccaactccgtccactcccatgtccaccgacgacgtcccgctgtcctccgaagccggggaggaggacacgcccgagaccgacggcggcggcgtcggcgccgatgcaccccggtcttcgtctggggcaccaatatcagcgtgcaggacgtgaacgctgccattctgcggtttctgcgccacttccgggacccccgcgacgccggccgcgtcgaccctgtcatggacgagggcaagtacatgcgcgccatccaccgcatcctcgagctcgagggtggcgagtcgctcgatgtggacgcacacgacgtcttcgaccacgatcccgacctatacggcaagatggtacgctacccgctcgaagtgcttgccatcttcgacatcgtccttatggacctggtggcgcgtatggagccgctgtttgagaagcacattcagaccaggatctacaacctcaagtcatccatttgcttgaggaatctgaatccgtcagatattgagaagatggtgtcaatcaagggtatgataattcgatgcagctcagtcataccagagctcaaggaggctgtgttccgctgccttgtttgcggcttctactcagaacctgtcatggttgacagagggagagtaactgagccacacatatgtcagaaagaacaatgtaaagcctcaaactctatgactctagtgcataaccgatgcagatttgcggacaagcaaatcataaagttgcaggaaacaccagatgagataccagaaggtggcactcctcatacagtcagtgttttgatgcatgataagcttgttgatgctggaaagcctggagatagggttgagatcactgggatatatagggccatgagtatcaggatcgggccaagtcagaggacagtgaagtcaatattcaagacatacattgattgccttcacataaagaagacagacaagtccaggcttcatattgaggactctatggatactgataacaccaatgctagcaagtcttctgaagatggccatgtcacagataagatagataaattaaaagagctttcaaagttgcctgacatctatgatagattgactagatcactggctccaaacatatgggaactggatgatgttaagaggggcctgctttgccagctttttggtggcaatgctttgaggcttccttctggagctaacttcagaggtgacatcaatattttgcttgttggtgatcctggaacgagcaaatcccagcttctccagtacatgcataaactgtctcctcgtggtatttacacaagtggaagaggcagttcagcagttggccttactgcttatgttgctaaggaccctgaaactggtgaaactgttcttgagagtggagcacttgttttgagtgacaaaggtgtttgctgtattgatgagtttgataagatgtctgataatgcccgaagcatgctgcatgaggtgatggagcagcagactgtatccattgcaaaggctggaattattgcatctttgaatgctaggacatctgtcctagcctgtgcaaatccatctgaatcacgttacaatccaaggctttctgtgatcgacaatatccaccttcctccaacactgctgtcaaggtttgacctgatttatctgatcttggacaaggcagacgaacaaactgatagacgcctggctaagcatattgtttcattgcatttcgagaatccagaagtagttgagcaccaggtcttggatttgcccacgttagttgcgtacatcagctatgcaaggaagtacattcagccaaagttatctgatgaagctgcagaagaattgacccgtggctacgttgcaatgaggcaaagggggaacaatcctggtagcagaaagaaggtcatcacagcaacagctaggcaaattgagagcttgattcgtcttagtgaagcactggcgcgaatgcgtttttcggaagtggttggagtgcgagatgtaacagaagcctttaggcttcttgaagtcgccatgcagcaatctgcaaccgatcatgcaacagggacgattgatatggatctaatcatgactggggtatccgcaagtgaaaggcagagacgtgacaatcttgttgcggctatccgagaccttgtcatggagaaaatgcagcttggagggccctcgatgcgtatggctgagttgctggaagaagtgaggaaacagagctccatggaagttcatcagcatgatctccgtgttgctcttggcacactgcagagtgagggctccgtatttgtccacggagacagtttcaagaggacctgatggcaacgacgttgtagccagcatcaactgaacctaccatgctcccctctccaagaatgttgaagatctgatgtctttgtagagctgggtgctaacctgtttggtcttttcatggcctgtgccgtagatttcttaatgttgctcttgggattgttatgtttacatgaaggcatatttttatttgtgtttgccagcaatggatcaattatgctgctaccattgagtctgtggtgcataaatccatttttcttcttgtctggtgggatcctgctcatttgcaagcatacagcacgagtagcccacaaacagaagtctttttgccctgccgcacggtgctaccaaaacaaagtcgacctgtcagagcttggagtggtcggtcaagtaacaaggagccagtgttgtttcaaggctgagataattaaacccatcctgttatctgacaaaacaaaggctgagatatttggaccctcttgtacatgttttccttccaaagtagcgtcggagaagtagtgcaagtactcttatatgcaaatagagtaaggatcaagagagttgctcagatcaaggagtaatactttctttgcggaaaactggtgaaaggtgaccaaaccaggaaaccgtgatacgttgagcgttagtatctgttgacaag

SEQ ID NO: 1950 - DNA, 1212 bp, Saccharum officinarum
ccgcaaacaagctcttggcaacccacgacgacacaaagcatccatcgtagccagccagccgcccagcccccgaaaaccagccagctaaacccatggccgggatcgtggtggtgttcgacttcgacaagacgatcgtcgacgtggacagcgacaactgggtcgtcgacaacctcggcttcaccgagctgttcgagcgcctcctccccacgatgccctggaacaccctcatggacaccatgatgggggagctgcacgcggccggcaagaccctgggcgacgtcgccgaggtgctgagggcggcgcccatcgacccgcgcgtgcccgccgccatcaaggccgcctacgcgctgggctgcgacctgcgcgtcctcagcgacgccaacgccttcttcatcgagaccatcctggagcaccacggcatccggggctgcttctcccagatcaacaccaaccccagccacgtcgacgccgacggccgcctccgcatcgggccctaccacgccgccccgcacggctgcggcgtcggcacctgcccgcccaacatgtgcaagggccaggtgctggaccgcatcctccgcgaggcgtcggcctccgggaccgggttgaggaagcgcgtcatctacctgggcgacggccgcggcgactactgcccgtcgctgcgcctggcgcgggaggacttcatgatgccgcgcaggggttaccccgtgtgggacctcatctgcgaggaccccgcgcggctgcaggcggaggtgcacccgtgggccgacggcgccgagctggaggagacgctgctgcgcctcgtcgggagggcgctcgtggaggaggccgcgctgctgccgccgctcgactgcaagctcgagtccaccatgcccgttgccgcgcaggacgccggcatgcccatcatgccgctcggcgtcaagaactgatacagtctgtctctggttgagaattgaggagattattgccggttcgggttcgtcgcgagatcgagctcgaccaagtgctggcgaggcacggcgtacgatggattagtagcgtctattaactgtattattgactaattttgtgtgcgtgcgcgtggtgtatccctccggatcgagcctgtcgctgctgaattggctatggctcgttgtatcttgcctaccaacaaaagattaaattaatggatgaaatccattgcgacaagcaaaaaaaaaaaaaaaaaactcgaga

SEQ ID NO: 1951 - DNA, 1138 bp, Setaria italica
ccacaacctacgacaaagcaaactacttgcctcgcctcgaaacccagcagcaggcaatggccgggatcatcgtggtgttcgacttcgacaagaccatcatcgacgtcgacagcgacaactgggtcgtcgacagcctcggcttcacggaggagttcgagcgcctcctccccaccatgccgtggaacgacctcatggacgccatgatggggaagatccacgctgcggggaggaccctggacgacgtcgcggcggcgctgcgcgcggtgcccatcgacccgcgcgtccccgccgcgatccgtgcggcgtgcgcgctcgggtgcgacctgcgcgtcctcagcgacgccaacgccttcttcatcgacacagtcctcgaccaccacggcctccggggctgcttcaccgaggtcaacaccaacccgagccgcgtcgacgccgacggccgcctccgcatcgggccataccacgccgccccgcacggctgcggcgtcggcacctgcccgcccaacatgtgcaagggccaggtgctcgaccgcatcctccgcgaggcggcggcgggtggggggaggaagcgcgtcatctacctcggcgacggccgcggcgactactgcccgtcgctgcggctggcgcgggaggacttcgtgatgccgcgcagggggttccccgtgtgggacctcatctgcgaggaccccgcgcgggtgcaggccgaggtgcacccctgggccgacggcgccgagatggaggccacgctgctggggctcgtcaggagggtgctcgtcgaggacgccgcggcgctgctgccgctcgactgcaagctcgagtccagcattcccgtcaccgccgcgcaggacggcatgcccatcatgccgctcggcgtcaagaattgatcgagcactcgagaatggtcggaagagattgcacggacgattatcagtagtgtttaacaggagtattgactaatttttgtgtgcggcgtggcgtgttgtatccctggtgatcgagcctgccactgctgaattggctgcggctcattgtatcttacctaccgacaaaagataaaattaattaatggatgaaatccatgacgacaaaaagcgaaatttcactacgatttttagccacaattagccatacgaaattc

SEQ ID NO: 1952 - DNA, 1259 bp, Zea mays
attgttaggcatctctgtaatattccctcagcatcttttccccgacgccgcccggtaccgtatatatataggccgcggctccctgcttcccttggatccaccgcaaacaaggtcctgacaacccacgccacgacgacacaacaaagcacaagcaccgcagctaaacccatggccggggtcgttgtggtgttcgacttcgacaagacgatcatcgacgtcgacagcgacaactgggtcgtggacagcctcggcttcaccgagccgttcgagcgcctcctgcccaccatgccctggaacacgctcatggacaccatgatgggggagctgcacgcgcacggcaggaccctggacgacgtcgccgaggcgctccgtgcggcgcccgtcgtcgcgggcgtccccgccgccatcaaggccgcctacgcgctcggctgcgacctgcgcgtcctcagcgacgccaacgccttcttcatcgacaccgtcctggcgcaccacggcctgctgggctgcttctcccagatcaacaccaaccccagccaccccgacgccgacgccgacggccgcctccgcatcgggccctaccacgacctgcacgggtgcggcgtcggcacctgcccgcccaacatgtgcaagggccaggtgctggaccgcatcctccgcgaggcgtcgtcgtcggccgccggcaggaagcgcgtcgtgtacctgggcgacggccgcggcgactactgcccggcgctgcggctggcaagggaggacttcgtcatgccgcgcaggggcttccccgtgtgggacctcatctgcgaggaccccgcgcggctgcaggcggaggtgcacccctgggccgacggcgccgagctggaggagacgctgctgcgcctcgtcgggagggcgcgcgtggaggaggccgcactgctgccgccgctcgactgcaagctcgagtccatgcccgttgccgcgcaggagggcatgggacccatcatgccgctcggcgtcaagcactgacgatacacgcagcagtgcagtctctggtttgctggttaatgctggtttggttcgggttggacgaacgattagtaagtagctcgaataattagtataactgtatcggctaattttatgtgtttgtgtgtgtgctgtgtggtgtatgcctccgcatcgagctgcctgtcactgctgaattggctctgcctcgctgtgtatcttattcttacctacagaaagagtaccacgagcaaatactcatgcgcgtgcttcgcagcgta

SEQ ID NO: 1953 - DNA, 1388 bp, Zea mays
cccgccggcccgaccgcgaaccaaaccagaagctgggcgccacgcgtggtttggcgaatctactccaccgagagaaggcgagaacccaacagcaccgaggctggctcgctacgctattcttagagcatctctgtaatattccctcggcatcttccccttcccgccccgacgcccggtatataaaggccgcctccaccgcggctccctagccatcgatccagtgcaaacaagctcgctcgcaagcgcaacccacccacgtctacggtctaccacacgaagcatcgtagccagccagccagctaaacccacaccacacatggccgggatcgtggtggtgttcgacttcgacaagacgatcatcgacgtggacagcgacaactgggtggtggacagcctcggcctcaccgacctgttcgagcgcctcctccccaccacgccctggaacacgctcatggacacgatgatgggggagctgcacgcgcggggcaggacgctggccgaggtgaccgaggcgctcagggcggcgcccatcgacccgcgcgtgcccgccgccgtcagggccgcgcacgcgctcggctgcgacctgcgcgtgctcagcgacgccaacgccttcttcatccacaccgtcctggaccaccacggcctgctcgcctgcttctcccaggtcaacaccaaccccagccgcgtcgacgcccacggccgactccgcatcgggccctgccacgacccgcgcgcggcgccgcacggctgcggcgtcggcacctgcccgcccaacatgtgcaagggcctcgtgctggaccgcatcctccgcgaggccgaggccgaggccgagaccgcatcctccgcgaagccgcgcgtcatctacctgggcgacggccgcggcgactactgcccggcgctgcggctggcgcgcacagacttcgtgatgccccgcaggggttaccccgtctgggacctcatctgcgaggaccccgcgcgcctgcaggcggaggtgcacccctggaccgacggcgccgagctggaggagacgctgctgcgcctcgtgcggagggcggtcgtggaggacgccgcgctgccgccgccgccgccgccgccgctcgactgcaagctcgagtccatgcccgtcgccgcgcaggacggtatgcccatcgtgccgctgggcgtcaagaactgatactgtctctggttcagaattgaggtcgccggttagagctccaacaaattccgggcgaggcacggcgtaccgttagtagcgtttcactaattttgtgcgtctgtggtgtatccgtcctgatcgagtctgttgctgctgaattggttacgactcgttgtatcttactaaaaaaggtaaagttaataatggattagacatggtactatttgtttct

SEQ ID NO: 1954 - DNA, 1207 bp, Panicum virgatum
ccacgcgtccggcaagcgtcgtagccaccgagccagccagccagccgcccctcgcctcgccccgagaaaaccagcgagcctaaacctctcgcaatgcccgccggtaatggcatcgtggtggtgttcgacttcgacaagaccatcatcgacgtcgacagcgacaactgggtggtggacagcctgggcctcacggaggagttcgaacgcctgctccccaccatgccgtggaacaccctcatggacaccatgatgggggagctccacgcgcgcgggaggaccctgggcgacttcgccgcggcgctgctcgcggcgcccatcgacccgcgcgtgccggccgccatccgcgcggccgccgcgctcgggtgcgacctgcgcgtcctcagcgacgccaacgccttcttcatcgagaccgtgctggagcaccacggcctccgcggctgcttcaccgaggtcaacaccaacccgagccgcgtcgacgccggcggccgcctccgcatcgagccctaccacgacttcctccgcggggcgccgcacgggtgcggcgtcggcacctgcccgcccaacatgtgcaagggccaggtgctggaccgcatcctccgcgaggccgccgccgggggcaggaagccgcgcgtcatctacctgggcgacggccgcggcgactactgcccggcgctgcggctggcgcgggaggacttcgtgatgccgcgccgcgggtaccccgtgtgggacctcatctgcgaggaccccgcgcgtgtgcaggccgaggtgcacccctgggccgacggcgccgagatggaggccacgctgctggcgctcgtcaggagggcgctcgtcgaggacgccgccgccgccgcgctgctgccgctcgactgcaagctcgagtccagcatacccgccgccgcgcaggacggcggcatgcccatcatgccgctcggcgtcaagaactgactcgaccattccagaccggccggaagagattgccggttcgggttcgttcgtggcgatcgcgagctcgatcgaacaactgcgaggcacggccgattaattactagtgtctagctggagtacttattgactataatttttgtgcgtggcgtggcgtggcgtatccctgatcgagcctgtcaccgctgaattggcggcggctcactgtatctttcctaccaacaaagataaaattaatggatggaattccacgacgacaagc

SEQ ID NO: 1955 - DNA, 1827 bp, Pennisetum glaucum
cattcaaggatccccaaatctttttagactccattgttatcctccgtgttcatgaaattgtccttggcgccaaccctaacgctgttagtggagccatagtaggtgtgcttcttggatgagcccttgcactggcctactggatacttgcgtgcattgatctccatcttccgcagggcagccttgccaaggtcgaccccgcacatgtccgacaggcggaccaggtagaggagcacgtccgcaagctcctcacccaagtgctccttctcaggctcatcccagcctggcagccccttgggcacctctcctttccattggaatatctcagagagctcccccacctctccaaccagggcgaggagcaggttcctaggagagtggaactgctcccagtccctctccctggcgaagtccgccatccgctcccgcagcgcctccaggctcaccgcagccgccgtcgccatcgccatccccatctcgccgccaccacgagcaccgccgccgacgccgcccttgccctccccctccaccctcgcctcctccacacaacctacgaccaaagcaaacaccaagcaaagcctcgtactcgtacgtacccagcgcctcgcctcgaaacccagcagcctagcagcaatggctgccgccgggatcatcgtggtgttcgacttcgacaagaccatcatcgacgtcgacagcgacaactgggtcgtcgacagcctcggcttcacggaggagttcgagcgcctcctccccaccatgccgtggaacgacctcatggacgccatgatggggcagatccacgcgcacggcaagaccctggacggcgacgtcgccgcggcgctgcgcgcggtgcccatcgacccgcgcgtgccccacgccatccgcgcggcgcgcgcgctcgggtgcgacctccgcgtcctcagcgacgccaacgccttcttcatcgacaccgtcctcgaccaccacggcctccggggatgcttcaccgaggtcaacaccaacccgagccttgccgacgccgacggccgcctccgcatcggcccctaccacgccgccccgcacggctgcggcgtcggcacctgcccgcccaacatgtgcaagggcctggtgctcgaccgcatcctccgcgaggcggcggcggcgccgggtgggaggaagcgcgtcatctacctcggcgacggccgcggcgactactgcccgtcgctgcggctggggcgggaggacttcgtgatgccgcggagggggttccccgtgtgggacctcatctgcgaggaccccgcgcgggtgcaggccgaggtgcacccctgggccgacggcgccgagatggaggccacgctgctggggctcgtcaggagggtgcttgtcgaggacgccgcggcggcgctgctgccgctcgactgcaagctcgagtcgtccatgcccgccgccgccacgcaggacggcatgcccatcatgccgctcggcgtcaagaattgagatcgagcaaaagtgttcgagaccggaagagattgcacggacgattatttatcagtatagtgtttaactgggagtattattgactagattttgcgtgcgggcgtggcgtggtgtatccctggtgatcgatccagagcctgccactgctgaattggctacggctcattgtatcttacctctaccgacaaaagatgaagttaatcttcaatggatgaaatccatgaagacaagcgaagatttaatacaatttgtagccgcaattagcgatacgaaatcgttctgaatttatttgcgatcaagcaggggatcgcatcgcacatgtctgccttacagtacattttctttttgaacggg

SEQ ID NO: 1956 - DNA, 886 bp, Zea mays
gcactccaatcccaacacagcaaccagcgcaaatcagcacgatgcgtcgcgagggccgccagcacgggtgggtgtttaccgtcgaccccagcctggtcgacgcggagggcaagtgccggtcccgcgcggtgcaggtggagggcgcggcggcggccaacggcggcttcgtcagggcgtcgaggaagcccaccaaccactccaagcccgccgtcggccgcgcgtacaagtccctgatcggcaagggagaggccgggtcgggcaagcagggcaggcacaagttcaagcacgacgaggtcaagatgtactccctctacctcgagggcgcccacgacgcctacgcggatgcgatgctggagttcgactcgtagtcctgctgatgacattgggtgtgtgaatgatgaggtgctggagttcgacatgcgccattgccaggaggtgtagagattcgatgtacgcttctgtgtctgaatccaaatgtgttttgtgatgtgagcagtgaataaacagactggttgtgacgagaatgtcgtgatccggaatgtatctcgaaccggaattcgatcaatcttcatatccaaagttcaaatctgtagagttggaattttatttagccgtgtgagtttccgtttttcggtcctggttattttcaaatgtaatactagcttagtagctttcgtgcagttaaaagacttactttctggcacaaagcgtattgtcattgtcaaacagtatatggcattggatatttaaattctctttaggaccttcgagtttaagaccacgtatcctcagctaagtacaaaggaccatctaatcaacaaaaatacatacacaactctaaggaccatttcaccatcaatcaacaaatacaaaaaacaaacaaaaa

SEQ ID NO: 1957 - DNA, 2026 bp, Zea mays
tccaaacgaagcattaggggatgaaatttagaggacgttgttggagacagcctcactcctcaccaccacaagtgaagtcaccgacgcacgcacggctgcagcgcgctcctactctcccgcgatcgccaccggggaaggggcaatagaataaagtgagggcagccaatgcaggccgccgtcaacaccaccactgtcggcgctcacccgcacccaacaaagtcctcgttcctccgtccgtcccctccttgccgcgtctacttccacgcttctccacgcccgaaccttagggcgatcgccatggccagcaagtcgcagctgcaggaccaactgatcatcactcgccccgacgactggcacctccatcttcgcgaaggcggtgtcctcgaggctgtagtgccacacagcgcgaggcattttgggagggccatcatcatgcccaacctgaagccgccggtgaccacaacggcacgggccgtggagtacagggaggagataatgagggcgctgccgccagggagtagcttcgagccgctcatgacactatacctcacagacaacacaagcccagaggagatcaagctcgcaagaaagagtggtataatttttgctgtgaagttgtatcctgctggagcaactaccaattcccaagatggtgtcactgatatatttgggaagtgcttgccggtcctcgaggagatggtcaggcaggaaatgccgttgcttgttcatggagaagtcacagatccacatgttgacacatttgaccgcgagaaggttttcattgacaaaatattagcaccacttgtacaaaaacttccgcagctgaaaattgtcatggaacatatcacaactatggatgcagtgaacttcatagaatcatgtgaagaaggtcatgttgctgcaacagtgactccccagcatctcctcctcaataggaatgctttatttcagggtggcttgcagccacacaattattgcttgccagtactgaaaagagagactcatagacaagctattgtgtctgctgtaacaaatgggagtagacggtacttccttggtactgacagcgctccccatgataaacggaacaaagagtgttcctgtggatgtgctggaatatatagcgctcctgttgccttgtctctttatgtgaaggtatttgaagaggctggtgcccttgataaactagaagcatttacaagcttcaatggccctgatttttatggcctcccaaggaacacttcaaagattatcttgagaaagaatgcctggaaagttcctgctacttataaacacagttcaggggagattgtgcctatgtttaatggcagcacccttgaatggcttccatctgatcagcctaaagagtaaacagtatacattattggacccagcacttgggggaatcaatagtgcaattctggaagtagctaaaaggccatattgtatgtttatcaaggctagtctactgatctagacaccatagcatctgtggtttctaaggtgacaaggcgaccaggcaagagctgggtgtgtctggacgcctagatggcacaaggtgctacttttccccaaggcgagctgggtatgcttggacacctagcctctgaaacatgctaccacatccataataatgtaatgaataaatatcagcatttcagttacatagccgtataaccttctagtccggacataatatttctatgtttttgttactctgtgtctgaataaatagatttctactttaaaattgtctttaaataaatcaatctctaggaggctaaacggtccatcagcctatctatttttcttgaagtctcctcgtgtttactgcacctcccatctcctaatctaatattgagtttctgcagttagatgtgtgtagtatatgctataattagtgtgcaattggaacgtttttcaatcaatgtgcactctagtcaatgaaggttagtatgattttttctctatcatactaatctcttctaaacttattagaaatctactctctccgtccaaaaataaa

SEQ ID NO: 1958 - DNA, 1678 bp, Setaria italica
aatcctacccagtcgccgccggcggcggcggcctgtgcgccgcgaaccgagctgaggacaaccattccgccgccaccggcctccgcgcgaatcaaccgaggataaccacgccgcctccgccggcttccaaccagaaattcgatccttctgtgatttgtgaacacagttttgggaagccaatgcaggccgcctccaccaccaccaccgtccgcacgcacacgcacacgaatcctctgtcggcctccttcctccagctgcctcctcctcgccgcgtcagcttccacgcttctccgcgcctgagcctgagggcgactgccatggcagccacgtcgcagcagcaggaggagcagctgatcatcacgcgccccgacgactggcacctccacgtccgtgaaggcagcgtcctcgaggctgtgctgccacacagcgcgaggcattttgggagggccatcatcatgcccaacttgaagcctccggtgaccacgacggcgcgcgcgctggagtacagggaggagatcatgaaggcgctgccacccgggagtagctttgagccactcatgaccctttacctcacggacaacactagcccagaggagatcaaactcggaagaaagagtggtgtagtctttgctgtgaagctgtatcctgccggagcaactaccaattcccaagatggtgtcactgatattgggaaatgcatgcctgtcttcgaggagatggtcagacaggaaatgcccttgcttgttcatggagaagtcacggatccgcatgttgacacatttgaccgtgagaaggttttcattgatagaatattggcaccacttgtacaaaaacttccacagctgaaaatagtcatggaacatatcacaactatggatgcagtgaacttcatagaatcatgtgaagaaggtcatgttgctgcgacagtgactccccagcatctcctcctcaacaggaacgctttatttcagggtggcttgcagccacacaattactgcttgccagtactgaaaagagagactcatagacaagctattctatctgctgtaacaagtgggagtaaacggtactttcttggcactgacagtgctccccatgataaacggaacaaagaacgttactgtggatgtgcaggaatatacagtgctcctgttgccttgtccctttacgcgaaggtatttgaagaggctggtgccctagataagttagaagcatttacgagcttcaatggccctgatttttatggcctcccaaggaacacttcaaagattgtcctgaaaaagagtgcctggaaggttcctgcaacctatacatacagttcaggggagattgtgcccatgtttaccggctgcacccttaaatggcttccatctgatcagaccgaagaataaacaatattgtttacttgggaaaatcaattccatttgtttccccctttctgttagaatcagcatagcaaactacgttgaattcttcaaggctagtttagcgagaataacatattgaaagcaacggcgaaatgtttgcttgttgagctgttatattatatccttttgggattgcagacttcgtaaggaatcggtactcgtagcctaagagggggagagggtgaattaggcaacttacttgatctatagctttcattactttacatcaaaacataaactagatcatgcta

SEQ ID NO: 1959 - DNA, 4914 bp, Oryza sativa
gtgggggctgcgctaaaaaaaaaaagaaaaaaagaaactggagccgccgagagagccgcgtccggttgtcacctgagcagttgcggctcagaaaccgaactccacctcccagtttcccacgggaccgtctcccacaatacgggcacacacccgcgcgcttctacgggagggaatcggcataaagcgaggtcaatcatcatcccaatcatcaatgcagaccgccgcgacctccaccttcttcgcgaacccgcatgtgaagcatttgcccggacctttcctccggccgtcgcctcattacggggccctagtccaccttccctccttccggaacaagacaccgatctcgatcgccatggccgcgtcgccgtcgccgccgccgctgcaggagctcaccatcacgcggcccgacgactggcacctccacctccgggaaggcgatgtcctcgcggccgtgctcccccacagcgcgatgcattttgggagggccatcgtgatgcccaacctgaagccaccggtgaccacgacagcacgagctttggagtacagggaggagatcctcagggcgctgccgcctgggagcaactttgtgccgctcatgacgctctacctcacggacaatactagcccagaggagatcaagctcgcaaaaaagagtggcgtggtttttgctgtgaagttgtacccttctggagcaactaccaactcccaagatggtgtcactgatatatttgggaagtgcttgcctgtgcttgaggaaatggctaggcaggagatgcctttgcttgttcatggagaagtcacagatcagcatgttgatacctttgatcgtgagaaggttttcattgagaaaatattggcaccacttgtacaaagactgccacagctgaaaattgttatggaacatatcaccactatggatgcggttaacttcgtagaatcatgcaaagaaggtcatgttgctgcaacggtgactccccaacatcttcttctcaacaggaatgcgttatttcagggtggcttgcagccacacaactattgcttaccagtactgaaaagagaaactcatagacaagcaattgtgtctgcggtaacaagtgggagtaaacaatactttcttggtactgacagtgctcctcatgataaacggagaaaagaatgctcctgtggttgtgcaggaatatatagcgctcctgtggctctttctctttatgcgaaagtattcgaacaggccggtgctcttgataagctagaagcatttacaagcttcaatggcccagatttttatggccttccaaggaacacttcaaagattgtccttagaaagagcgcctggaaagtacctgatacatactcatatagttcaggagagatcgtgcctatgtttactggcaacaccctcgaatggcttccatccgatcaacttgaagagtaaacagaataaatttatgcttggggtcgggggagaacattcctggagttatattatcatgccttcccctgtccccaactctgtaagaatcaatttcaaacttttccagtcatcactcatcagcctccccttttggaattctcgaagcaatattgctgagaagaacttattgaaagcaagtaagcaatgaagaaactgcttgtcatgctgttgtatacatttgatcgagtgctagaagggcacagtgtaaacttatattggtgattcagacatcacagaaccgataatgatgaataaatatcaatcttgcagttaacccttatatcattgcaaatgaattttactgatactttatcacaaaattttctgttacatctcatggcatttagtagtgttcaatgttgattgccatgtttttgggacatggatggccggatggattatgagtgcttctcaactctccatctgtcagacaatcaccttgtgttccgccatctatcatcaacatccaaatcgtcgtcaccgaactcatcgtgcagcgaacgtagcaaggctctccgctcagcgccacccacgatgcctcgctcctccatctccctcaccaccctttcggcgtcgtccctcctccccgatctccacagctcctccaccaccgccctcctcgtgacgtcgtcgaccacccttcccgcccgagccatgtcccacatcacacgctccgcctccccagcctcccctgccatggccagcgcactgacgaacgtgttgcacgccggctccgtaggggccagccccttggccagcatttcatcgaacacctcacgggcgttcctcgtccggccctgctcgctcagcccgtgcaccaggtagctgtacgtgagggcgtccggttcgcaaccgtagacgggccgcatctggtggaacacgcgcagcgcgtcgttgaggtgcagcgactgcgcgtagcccttgacgagcacgttgagcgcgcgcgtgtccggcgggacaccctcctccagcatctgccggaacagagcggagacggtgtccatgtacatgtagtgcaccatggtgtcgccgccgccgcgggacaagagcgcggtgaagagcgcgtggtaggtgtcggcggaggggcgcgcggcggggtcggcggaggcgcgcatgagggtgtagacgtggaacgccttgccgatcttgcggaactggcagtagaagtagagcgcggtgcggaggaagggcccgggggacgggagagaggggaggagggagaaggcgagggcgcaggtgcggtcgaaatcggcgtagagatcggcggcggcgaggcgcttgatcgcgacgaggaaggggcccgggtcagggcggaaggtggcgagacgaagggagtgggtgaggaccggaaggagtaggcgggcgtcggagacggaggagagggagtaggagaggagaggcggggtgagacgggacgggagggtggcgatggccgcggagacggcttcaggggagggcggcgcagggttcggggagcggcggctgcggcggaagcggtgcggcgtgcggcgggaggaggtggagaaggggaggcggccggtgagcaacgcgtcggccggggtggcgcccaagaggaggcggcgcaggagcgtggtcatcgcggcggcggcggcgggcgcatttcggcgccggtgcccttcgccttctcaaaatctgatggaaatccgcgcgcgaatcttgaagcaaatctgacggttcgtgcctcctgagtctattgccaccaacgaaccgaacccggttaagctcaaagccgacgcccgccgggcagaggcaaaggggagaacgagcaggcgacgacggcgcccagccccatcggttcctggtaaggatggccgccgccgtctcgttggcgagccctttccggcgagtccttcacgtccctttcgcacgccgcgctatccccacatcgtaccacttcttccctagcggacggtgtcacgcggctctctccttcgccgcggcagcagcaggagattcggcggttaaggcgagcttggataggaatgcagccgaggaactcaggagcatcctggatatggcacaaagggcttcccaacggagagatgttttccacaccaattttcttactccacctatagtgaaggagtgcatgctggcaattgagaagttagcagacatcaaagcggtagcacaggggggctacccacaggctgagcgatgccgagtttcagttggacatccggactgtatgacaagcaacccagatgtagttgctgctttgagcatctcagggaatttcagattggaaccctgttctcatggtgactttcttggtgctattcttgggacaggaataacaagggataaagttggagatatacttttgcagggagagagaggtgctcaggtccttgttgatcctgaacttgttgactatctgacttccacacttgaaaaggtggggaaagttggagtttcatgcacacagattcctttgcttgctctagaatatgaaccaccaaggaccaagtcatttaaaactgtagaatcatcactcagggttgatgccctgggtagtgcaggatttaaaatctcacgtacaaagcttgctagcttgatcagtgctggggatgtccgtgtgaattggtcaccagtttcgaaaaatggagtgactctcaaggctggggatgttgtttctgtcagtgggatggggagattaaagattggggaaattgtgactacgaggaaaggaaagtacgcagttgagctgattcgatatttgtaggtttgcaagggataaatggatctctcaagattactgactcaaatgaacggactcaaatccttttttaactgcaacttccgtgagggcttgttctgctctgagaccaaaaaacaaggtttgtgttttaaaaccagaaggagtttcgcaaattcattacctaactttgcctactgcataacgtagcctattctatattcatatgatcaagtgctaccatggccaaccatgaaacatgtgacttcgattatgacaagatggaggcaagctgtttattgggaaaactgatgacgactagtcatatattcagcgcccttttaatgctaaaaagcttgacaaatgacaacggctattctttgtatcacaaaactatcacaattcacaagattcagtttttcaagttgcaaattggtgcaggagtcttgttctcttatagattgtagttgcatatgatttggacatcactggacttttggaataggagtaagaaaaagatcgatggtgacaatggtcatgaaggcttaactgccaaaaagttataacaatagcatcttacagaatacttatacaattgaaatggtatcacaccaaaatccaagggctatagtttcattttattacgatccgaattattacatctgatgcaatcatgctggatatgggggctaaggatgccatttgagtctttgaatgtgttgtc

SEQ ID NO: 1960 - DNA, 2324 bp, Oryza sativa
gtgggggctgcgctaaaaaaaaaaagaaaaaaagaaactggagccgccgagagagccgcgtccggttgtcacctgagcagttgcggctcagaaaccgaactccacctcccagtttcccacgggaccgtctcccacaatacgggcacacacccgcgcgcttctacgggagggaatcggcataaagcgaggtcaatcatcatcccaatcatcaatgcagaccgccgcgacctccaccttcttcgcgaacccgcatgtgaagcatttgcccggacctttcctccggccgtcgcctcattacggggccctagtccaccttccctccttccggaacaagacaccgatctcgatcgccatggccgcgtcgccgtcgccgccgccgctgcaggagctcaccatcacgcggcccgacgactggcacctccacctccgggaaggcgatgtcctcgcggccgtgctcccccacagcgcgatgcattttgggagggccatcgtgatgcccaacctgaagccaccggtgaccacgacagcacgagctttggagtacagggaggagatcctcagggcgctgccgcctgggagcaactttgtgccgctcatgacgctctacctcacggacaatactagcccagaggagatcaagctcgcaaaaaagagtggcgtggtttttgctgtgaagttgtacccttctggagcaactaccaactcccaagatggtgtcactgatatatttgggaagtgcttgcctgtgcttgaggaaatggctaggcaggagatgcctttgcttgttcatggagaagtcacagatcagcatgttgatacctttgatcgtgagaaggttttcattgagaaaatattggcaccacttgtacaaagactgccacagctgaaaattgttatggaacatatcaccactatggatgcggttaacttcgtagaatcatgcaaagaaggtcatgttgctgcaacggtgactccccaacatcttcttctcaacaggaatgcgttatttcagggtggcttgcagccacacaactattgcttaccagtactgaaaagagaaactcatagacaagcaattgtgtctgcggtaacaagtgggagtaaacaatactttcttggtactgacagtgctcctcatgataaacggagaaaagaatgctcctgtggttgtgcaggaatatatagcgctcctgtggctctttctctttatgcgaaagtattcgaacaggccggtgctcttgataagctagaagcatttacaagcttcaatggcccagatttttatggccttccaaggaacacttcaaagattgtccttagaaagagcgcctggaaagtacctgatacatactcatatagttcaggagagatcgtgcctatgtttactggcaacaccctcgaatggcttccatccgatcaacttgaagagtaaacagaataaatttatgcttggggtcgggggagaacattcctggagttatattatcatgccttcccctgtccccaactctgtaagaatcaatttcaaacttttccagtcatcactcatcagcctccccttttggaattctcgaagcaatattgctgagaagaacttattgaaagcaagtaagcaatgaagaaactgcttgtcatgctgttgtatacatttgatcgagtgctagaagggcacagtgtaaacttatattggtgattcagacatcacagaaccgataatgatgaataaatatcaatcttgcagttaacccttatatcattgcaaatgaattttactgatactttatcacaaaattttctgttacatctcatggcatttagtagtgttcaatgttgattgccatgtttttgggacatggatggccggatggattatgagtgcttctcaactctccatctgtcagacaatcaccttgtgttccgccatctatcatcaacatccaaatcgtcgtcaccgaactcatcgtgcagcgaacgtagcaaggctctccgctcagcgccacccacgatgcctcgctcctccatctccctcaccaccctttcggcgtcgtccctcctccccgatctccacagctcctccaccaccgccctcctcgtgacgtcgtcgaccacccttcccgcccgagccatgtcccacatcacacgctccgcctccccagcctcccctgccatggccagcgcactgacgaacgtgttgcacgccggctccgtaggggccagccccttggccagcatttcatcgaacacctcacgggcgttcctcgtccggccctgctcgctcagcccgtgcaccaggtagctgtacgtgagggcgtccggttcgcaac

SEQ ID NO: 1961 - DNA, 1487 bp, Secale cereale
cccgaggccccttcgctgcttacgccggactcgccgccggaggaggagggccaagacaaacaaaaccgaagccgaataaagacggcaagtcaatgcaggccgcgatcaccaccaccgcgtccgcgaacccgcatctgaagcctctggtctccttgctgcgtccgtcgcccccgcaccgggtccgagtccaccctcctcgccaccgcctgaacacgagggccagcgccatggcctcctcggcgccgcaggagcttactatcacgcgccccgacgactggcacctccacctccgtgacggcgacgtgatggccgcggtgctcccccacagcgcgaggcactttcagagagccatcgtgatgcccaacctgaagcctcccgttacaacaacggcacgtgcgatcgcgtacagagatgagatcctgaaggcgctgcctcccgggagcagcttcgtgccgctcatgacgctctacctcacagacaggactagcccggaggaaattaagatcgcaagaaagagtggtgtggtttttgctgtcaagttgtatcctgctggagcaactaccaactcccaagacggcgtaactgatatcttggggaaatgcttgcctgtccttgaagagatggtcaagcaggagatgcctttacttgttcatggagaagtcacagatcctcatgtcgacacctttgaccgtgagaaggttttcatcgagaaaatattagcaccacttgtacaaaaacttccacagctgaaaatcgttatggaacatatcactacgatggatgcagtgaacttcgtagaatcatgcaaagaaggtcatgttgctgcaacagtgactccacagcatctacttctaaacaggaatgcgttgtttcagggtggtttacagcctcacaattattgcttgccagtgctgaagagagaaacccacaggcaagctattgtttctgctgtaacaagtgggagcagacaatactttcttggcactgacagtgctccccatgataagcggatgaaggagtgttcctgtggatgtgcaggaatatatagcgctcctgttgctctttctctttatgcgaaggtatttgaagaggctggtgctcttgataaactggaggcgttcacaagcttcaatgggccagatttttatggactcccaaggaacacatcaaagattgttctgagaaggagcccctggaaagtgcctgcgacttatacgtacggctcaggtgtaattgtgcctatgtccaccggcaacactctggaatggcttccgtccgatcagcctgaagaataagcaaattacagacggtccatttgggggagaaacaataagtggagccttgccatctcccccctttctgtagaatgagcctgacaaacatggttttagtcttaaacttaccccgtgtgggattcctaaaagcatctttgtaagagcaacttattcgaagcaagagcgaaaaagtctttgtctgaataaaagaaa

SEQ ID NO: 1962 - DNA, 1863 bp, Hordeum vulgare
agccagcagcctcccctcggcctcgtcgccgcacgctgctgtacagcggcggcgctcccggcttcccccatcttgtaggcgccgccgacgccgaccgccgtctcgcgccgcccaccgtccctcgtatcgtgccgcaaccgccgcggcgacgcccgccggtatctcgcctcgccctgagctgctctctcccgccgctcgtcatccgccgccgccgggatccagtgcgtcgtccgtgctgcctgcgtgacctactgccaatcttcaaggctacaggcctctcgccgctccacgccggactcgccaccggaggaggaccaagataaacaaccaaaaccgaatccgaataaagccgccaagtcaatgcaggccgcgatcaccgccaccgtctccgcgaacccgcatctgaagcctctggtctccttgctgcggccgtcgcctgcgcaccgggtccgaacccaccttcctcgccaccgccccaacacgagggcgagcgccatggccacctccacgccgcaggagcttaccatcacgcgccccgacgactggcacctccacctccgcgacggcgacgtgctggccgcggtgctcccccacagcgcgaggcattttgagagagccatcgtgatgcccaacctgaagccaccggttacaacaacggcacgtgcgatcgcgtacagagatgagatcctgaaggcgctgcctccggggagcagctttgtgccgctcatgacgctataccttacggacagcactagcccggaagaaattaagatcgcaagaaagagtggtgtggtttttgctgtcaagttgtatcctgctggagcaactactaactcccaagacggcgtaactgatattttgggaaaatgcttgcctgtccttgaagagatggtcaagcaggagatgcctttacttgttcatggagaagtcacagatcctcatgttgacacctttgaccgcgagaaggtcttcattgagagaatattagcaccacttgtacaaaaacttccacagctgaaaatcgttatggaacatatcactactatggatgcagtgaacttcgtagagtcatgcaaagaaggtcatgttgctgcaacagtgactccacagcatctccttctaaacaggaatgcgttgtttcagggtggtttacagcctcacaattattgcttgccagttctcaagagagaaactcacaggcaagctattgtttctgctgtaacgagtgggagcagacaatactttctcggtaccgacagtgctccccatgataaacggatgaaggagtgctcctgtggatgtgctggaatatatagtgctcctgtcgctctttctctttacgcgaaggtatttgaacaggctggtgcacttgataagctggaggcatttacaagcttcaacgggcctgacttttatggtctcccaaggaacacatcaaagattgttctcagaaggagcccctggaaagtgcctgcgacttatgcgtacggttcaggggtgattgtgcccatgtccaccggcaacactctcgaatggcttccgtccgatcagcctgaagaataaggaaaataaagactatccatttgggggagaaacaataagtggagccgttccatcttttcccctttctgtagaatgagcctgacaaacatggttttggtcttaaaactccttgtgtgggactcttagaccctgttcggtaatcctccagctcccggaatccgcggagctggaaaactgcagctccaccagctccgggagcagagttggggagcggcaggataccgaatagggtcttaatagcaactttgtaagataaacttatttgaagcaatggcaaataagaggttatgtttctctgaa

SEQ ID NO: 1963 - DNA, 1570 bp, Brachypodium distachyon
ctctagtcctctttctcaacagcttcctgcttcccggtgctccacgcccgagctcgccaccggaggcggaggcagaggaaagtaaataaaaaccgaattcgaataaagcggagtcaatgcaggctgcgatcaccgacagcatctccgcgcactcgcgtccgaatccttcggtctgcttcctgcggctgtcacatccacacagggtccggatccaccctacttcccaccgccggaacacgagggcgagagccatggccgcttcggtgccgtcgccacagcagcttaccatcacacgccccgacgactggcacctccacctccgcgacggcgacgtcctcgccgctgtgctcccacacagtgcgaggcattttgagagggccatcgtgatgcccaacctgaagccaccggttacaacgacggcacgtgcggtagaatacagggaagagatcctcagggcactgcctcctgggagcagctttgtgcctctcatgacgctctacctcactgacaacaccagcccggaagaaatcaagctcgcaagaaagagtggtgtggtttttgctgtcaagttgtatcctgctggagcaactaccaactcccaagacggtgtaactgatataatggggaaatgcttgcctgtccttgaggagatgatcagacaggaaatgcccttgcttgttcatggagaagtcactgatcctcatgttgacacctttgaccgtgagaaggtttttattgagacaatattagcaccacttgtacaaaagcttccagagctgaaaattgttatggaacatatcactacgatggatgcggtgaacttcgtagaatcatgcaaagaaggacatgttgctgcaacagtgactccgcagcatctccttctcaacaggaatgccttgtttcagggtggtttacagcctcacaattattgcttgccagtactgaaaagagaaactcacagacaagctatcgtttctgcggtaaccagtgggagcaggcagtactttttgggtactgatagtgctccccatgataaacggatgaaggagtgttcctgtggatgtgcaggaatatatagcgctcctgttgctctttctctttatgcgaaggcatttgaacaggctggtactcttgataagcttgaggcctttacaagcttcaacgggccagatttttatggtcttccaaggaacacttcgaagattgttctgagaaggagcgcttggaaagtgcctacaacttatacatacggttcaggggtgattgtacctatgtctaccgggaacactctagaatggcttccatccgatcattctgaagaataagcaaaatactaaatcagcgacacttattctgaatcggagggagtacatcatttcatgattcatttggggtgaacaagtggagcagtttcatttcccccctttatgtagaatcagaatgccaaacatggtctttgtcataaacttgtcccccgtgggattctcgaaagcaagattgtaagagtaacctaatcaaaacaacagcgagaggttttctctgaataaaagaaaagagggtcatcttgagt

SEQ ID NO: 1964 - DNA, 1714 bp, Brachypodium distachyon
agttactctgtcctgatctcctcctctagtcctctttctcaacagcttcctgcttcccggtgctccacgcccgagctcgccaccggaggcggaggcagaggaaagtaaataaaaaccgaattcgaataaagcggagtcaatgcaggctgcgatcaccgacagcatctccgcgcactcgcgtccgaatccttcggtctgcttcctgcggctgtcacatccacacagggtccggatccaccctacttcccaccgccggaacacgagggcgagagccatggccgcttcggtgccgtcgccacagcagcttaccatcacacgccccgacgactggcacctccacctccgcgacggcgacgtcctcgccgctgtgctcccacacagtgcgaggcattttgagagggccatcgtgatgcccaacctgaagccaccggttacaacgacggcacgtgcggtagaatacagggaagagatcctcagggcactgcctcctgggagcagctttgtgcctctcatgacgctctacctcactgacaacaccagcccggaagaaatcaagctcgcaagaaagagtggtgtggtttttgctgtcaagttgtatcctgctggagcaactaccaactcccaagacggtgtaactgatataatggggaaatgcttgcctgtccttgaggagatgatcagacaggaaatgcccttgcttgttcatggagaagtcactgatcctcatgttgacacctttgaccgtgagaaggtttttattgagacaatattagcaccacttgtacaaaagcttccagagctgaaaattgttatggaacatatcactacgatggatgcggtgaacttcgtagaatcatgcaaagaaggacatgttgctgcaacagtgactccgcagcatctccttctcaacaggaatgccttgtttcagggtggtttacagcctcacaattattgcttgccagtactgaaaagagaaactcacagacaagctatcgtttctgcggtaaccagtgggagcaggcagtactttttgggtactgatagtgctccccatgataaacggatgaaggagtgttcctgtggatgtgcaggaatatatagcgctcctgttgctctttctctttatgcgaaggcatttgaacaggctggtactcttgataagcttgaggcctttacaagcttcaacgggccagatttttatggtcttccaaggaacacttcgaagattgttctgagaaggagcgcttggaaagtgcctacaacttatacatacggttcaggggtgattgtacctatgtctaccgggaacactctagaatggcttccatccgatcattctgaagaataagcaaaatactaaatcagcgacacttattctgaatcggagggagtacatcatttcatgattcatttggggtgaacaagtggagcagtttcatttcccccctttatgtagaatcagaatgccaaacatggtctttgtcataaacttgtcccccgtgggattctcgaaagcaagattgtaagagtaacctaatcaaaacaacagcgagaggttttctctgaataaaagaaaagagggtcatcttgagtaatatgcatttcgttgcatatacattaaacaaatgctggcacgattcctgattatataattagacaggaaattgctatattttcggtaatgcgagggtatgcatcaatgcatgatttgggg

SEQ ID NO: 1965 - DNA, 1677 bp, Triticum aestivum
acgcccaggccccttgctgctccacgccggactcgccaccggaggaggagggccaagataaacaaaaccgaatccgaataaagccggcaagtcaatgcagttcgcgatcaccaccgccgtctccgcgaacccgcatctgaagcctctggtctccttcccgcggccgtcgcccccgcaccgggtccgagtccaccctccttgccaccgcctgaacacgagggcgagcgtcatggcctcctcgtcgccgctggagctcaccatcacgcgccccgacgactggcacctccacctccgtgacggcgacgtgatggccacggtgctcccccacagcgctaggcactttgagagagccatcgtgatgcccaacctgaagccaccggttacgacaacggcacgtgcgatcgcgtacagagatgagatcatgaaggcgctgcctcccgggagcagcttcgtgccgctcatgacgctctacctcacggacagcactagcccggaagaaattaagatcgcaagaaagagcggtgcggtttttgctgtcaagttgtatcctgctggagcaactactaactcccaagatggcgtaactgatattttggggaaatgcttgcctgtccttgaagagatggtcaagcaggaaatgcctttacttgttcatggagaagtcacagatcctcatgtcgatacctttgaccgtgagaaggtcttcattgagaaaatattagcaccactcgtacaaaaacttccacagctgaaaatcattatggaacatatcactacgatggatgcagtgaacttcgtagaatcatgcaaagaaggtcatgttgctgcaacagtgactccacagcatctccttctaaacaggaatgcgttgtttcagggtggtttacagcctcacaattattgcttgccagtgctgaagagagaaacccacaggcaagctattgtttctgctgtaacaagtgggagcagacaatactttcttggcactgacagtgctccccatgataaacggatgaaggagtgttcctgtggatgtgcaggaatatatagtgctcctgttgctctttctctttatgcgaaggtatttgaagaggccggtgctcttgataagctagaggcgtttacaagcttcaatgggccagatttttatggtctcccaaggaacacatcaaagactgttctgagaaggagcccctggaaagtgcctgcaacttatgcgtacggttcaggggtgattgtgcctatgtccaccggcaacactctggaatggcttccgtccgatcagcctgaagaataagcaaattacagacggtccatttgggggagaaacaataagtggagccgttccatctccccctttaagtagaatgagcctgacaaacatggttttggttgtaaacttaccccgtgtgggattcctaaaagcaactttgtaagagcaacttattcgaagcaagagcgaaaaagtcttcgtctgaataaaagaaaacaggttattgttgagttatctgcatttcagtggattgcactaaaacctcgtcagaagatgaaagggtacaagctatatgcaggtaagtgatactatttgcctgcgagtcttggttgagtcgattggcacggcaggtgaagcggcagccacagccatggcgtcaagccgtacgtagagcaccatcgccc

SEQ ID NO: 1966 - DNA, 1940 bp, Setaria italica
tctcgtcttttccatctctctgatctgccccctctctctcccctctcctttcccgatacgaatttccgaagcctcccccatcccattccgcgtctcagatccgcaagcgggaagcaatggaggggaggtggtcggcgctatggcggccctgcgtctagggatgacgccatttcgcgagcggcaggctctgtggttgccccgtgcccggcgacaatgtgggttcgcaagttgccggcagcggcggtggacaggcccccggtggagccgcactccctgaagaaggtaagcgcctccggtcactgaagcactccctggatctgttcgcctctgcccacgctcacctcttcatggcatatgcccaaagggcagcaagatgattcttaccgggtgcaaggttagggtagagtacggcgccagaacaggggcattctaggccgcctccaccaccaccaccgtccgcacgcacacgcacacgaatcctccgtcggcctccttcctccggctgcctcctcctcgccgcgtcagcttccgcgcttctccgcacctgagcctgagggcgactgccatggcagccacgtcgcagcagcaggaggagcagctgatcatcacgcgccccgacgactggcacctccacgtccgtgaaggcagcgtcctcgaggctgtgctgccacacagcgcgaggcattttgggagggccatcatcatgcccaacttgaagcctccggtgaccacgacggcgcgcgcgctggagtacagggaggagatcatgaaggcgctgccacccgggagtagctttgagccactcatgaccctttacctcacggacaacactagcccagaggagatcaaactcggaagaaagagtggtgtagtctttgctgtgaagctgtatcctgccggagcaactaccaattcccaagatggtgtcactgatattgggaaatgcatgcctgtcttcgaggagatggtcagacaggaaatgcccttgcttgttcatggagaagtcacggatccgcatgttgacacatttgaccgtgagaaggttttcattgatagaatattggcaccacttgtacaaaaacttccacagctgaaaatagtcatggaacatatcacaactatggatgcagtgaacttcatagaatcatgtgaagaaggtcatgttgctgcgacagtgactccccagcatctcctcctcaacaggaacgctttatttcagggtggcttgcagccacacaattactgcttgccagtactgaaaagagagactcatagacaagctattctatctgctgtaacaagtgggagtagacggtactttcttggcactgacagtgctccccatgataaacggaacaaagaacgttactgtggatgtgcaggaatatacagtgctcctgttgccttgtccctttacgcgaaggtatttgaagaggctggtgccctagataagttagaagcatttacgagcttcaatggccctgatttttatggcctcccaaggaacacttcaaagattgtcctgaaaaagagtgcctggaaggttcctgcaacctatacatacagttcaggggagattgtgcccatgtttaccggctgcacccttgaatggcttccatctgatcagaccgaagaataaacaatattgtttacttggggaaatcaattccatttgtttcccctttctgttagaatcagcatagcaaactacgtggaattcttcaaggctagattagcgagaataacatattgaaagcaacagcgaaatgtctgcttgttgagctgttatattatatccttttgggattgcagactttgtaaggaatcggtactcgtagtctaagagggggagagggtgaattaggtaacttacttatctatagctttcattactttacatcaaaacataaactagatcatactatctagatgtgcaatct

SEQ ID NO: 1967 - DNA, 1792 bp, Setaria italica
tttcgcgagcggcaggctctgtggttgccccgtgcccggcgacaatgtgggttcgcaagttgccggcagcggcggtggacaggcccccggtggagccgcactccctgaagaaggtaagcgcctccggtcactgaagcactccctggatctgttcgcctctgcccacgctcacctcttcatggcatatgcccaaagggcagcaagatgattcttaccgggtgcaaggttagggtagagtacggcgccagagcaggggcattctaggccgcctccaccaccaccaccgtccgcacgcacacgcacacgaatcctccgtcggcctccttcctccggctgcctcctcctcgccgcgtcagcttccacgcttctccgcgcctgagcctgagggcgactgccatggcagccacgtcgcagcagcaggaggagcagctgatcatcacgcgccccgacgactggcacctccacgtccgtgaaggcagcgtcctcgaggctgtgctgccacacagcgcgaggcattttgggagggccatcatcatgcccaacttgaagcctccggtgaccacgacggcgcgcgcgctggagtacagggaggagatcatgaaggcgctgccacccgggagtagctttgagccactcatgaccctttacctcacggacaacactagcccagaggagatcaaactcggaagaaagagtggtgtagtctttgctgtgaagctgtatcctgccggagcaactaccaattcccaagatggtgtcactgatattgggaaatgcatgcctgtcttcgaggagatggtcagacaggaaatgcccttgcttgttcatggagaagtcacggatccgcatgttgacacatttgaccgtgagaaggttttcattgatagaatattggcaccacttgtacaaaaacttccacagctgaaaatagtcatggaacatatcacaactatggatgcagtgaacttcatagaatcatgtgaagaaggtcatgttgctgcgacagtgactccccagcatctcctcctcaacaggaacgctttatttcagggtggcttgcagccacacaattactgcttgccagtactgaaaagagagactcatagacaagctattctatctgctgtaacaagtgggagtaaacggtactttcttggcactgacagtgctccccatgataaacggaacaaagaacgttactgtggatgtgcaggaatatacagtgctcctgttgccttgtccctttacgcgaaggtatttgaagaggctggtgccctagataagttagaagcatttacgagcttcaatggccctgatttttatggcctcccaaggaacacttcaaagattgtcctgaaaaagagtgcctggaaggttcctgcaacctatacatacagttcaggggagattgtgcccatgtttaccggctgcacccttaaatggcttccatctgatcagaccgaagaataaacaatattgtttacttggggaaatcaattccatttgtttccccctttctgttagaatcagcatagcaaactacgttgaattcttcaaggctagtttagcgagaataacatattgaaagcaacggcgaaatgtctgcttgttgagctgttatattatatccttttgggattgcagactttgtaaggaatcggtactcgtagtctaagagggggagagggtgaattaggtaacttacttatctatagctttcattactttacatcaaaacataaactagatatgctatctagatgtgcaatctatggttgatctagtgtgaaac

SEQ ID NO: 1968 - DNA, 2473 bp, Zea mays
aaggaaagaggccatggccaggaggtgctgcggtctgtcgacgcctgtaaacagctagctagaccgcgcgctatggccttgagagcggtcgtgtgtgcacagacgggcatgattttgtgaggggtgttataccagcgagcataataaagagggtcactgactggaaggagattaggagaaggactgcattgcagctctggtgaagtgcgagcaagatcttggagaggttgtggcatgtgggactgagggctgtaaacaaggcctccctccctggcagtgagaaatgttaaaggacggtagcaaggagaaatgttaaggcggagatgggtaagaagggaaattggttcactgcgctcaagaaggccttcacctcaagccccaaggagaagccaacaaatgtgcatcagctggtagcgcagtacccgtctactcacgcgcacggctgggagaagaagcgatggggaggcttcgggcggtcgcggccgcacgcggagccggcgtccccggcggcgggcgcgctgatcaacatcccgctgtaccgcgagccgagcagcatcgagaagatcctcggcgacgcggagatggaccagcagcgccagtactacgccgccaccagggcgcagtaccagatcacgcccgcgaggcccaccaccgccgtcgccggtagtgctgcttctgctgctgccgtgccgctgccgcagccggtggtgggagtgggaacagcacgtgagcgcgagcgcaggagagaagacaagccggccgccgtggtgctcccgctgccgccgccgtcccctcccccgctgatcaggaggttcgaccatgacagggagcagcagaagaagctgcagctgcagccgcagagctgcagggccgagacggagtggcggcggcagcagcagcagccgaggcggcaccgcgcggcgaggcagagcgccgcgccgccggaccgcgcgcgcgccgcggccgtggcgatccaggccgcattccggggctacatggcaagcgcggcggaactaccggtcgctgcgcgggctgatccggctgcagggcgtgatgcggggcgccagcgtgcggcggcagacggcgcaggcgatgcggtgcatgcagacgctggtccgcgtgcaggcgcaagtgcgcgccagccgcgtggaggccatggagcggcgcaaccggcagcaccacggcgccatgctcagggacggcggcaggtggcgcgccagctctcaggacggcggattttgggacgccagccggctgacgcgggaggaggcagacgcgcggacgaagcggaaggtggaggccgtgatcaaacgcgagagagccctcgcctacgcctactcccatcagctgctgaaggcgacaccgatggcggcccacgcgatcctggcggacctgcagtcggggcggagcccctggtggtggacgcccatcgagcgccgccacgagccgggggcctaccgccctgcggatcccgccattagaaagcccctgccggcgctcgccatcgcccaccgcgacatgacgacgacgcctgtggcgatgacggcggcgacgacaccggcccggtcggtggtctcggcctactctaagacaagggccacgaggcctgtgatcagggtgggagccccgccgccttcgaaccatagccacgtggggagcatccgcgacgacgagagcctgacgagctgcccggcattcggcggcgtgcccaactacatgacgcctacgatgtcggcgtccgccaaggcacgggcacgggcgcacctgcaggagcagcagaagaacaaggcggcccaggagaagcccaggttctcgttcgggctgggccagagcatcgggagctgggccaagagcccgttctggaaggccgctgtgccgtcgtcgagggtggccacgccggcggcgtcgatggccggcgggcgacaccgatcgacgcggtcgatcagcgggcttagcacggactccaccgtgtccatgccagccaggctcggcacgaggtcctttaagtagatacacatgtcggactcatcgttgcttacattgcattgcattcttcttatatctcttctcgacgcatttgtgcttggaagtggtacacatgtgattgatggtgtggcttgttgtgggataccatcgtgtttgctgatttattattgtgccttactagctccctggttgctagctcctttgttcacagccttccgtgggtttttgagaggggccagagttgtagcatgtaaaatctgtgactccatcgaacaaccgtacatgcgttaagttcgtgctttttgccaattaccatggcatgtgatgcatatccatttaagttgaacgtgacactgaggtgaaaaaaggagtagaaacattcatgttgttgggagggacgatataggtttaatttgtactttattgaaatgctaaaagcatgacggcctctagttaggtttaagtgattaatgataacacaaaaaaa

SEQ ID NO: 1969 - DNA, 2313 bp, Setaria italica
aaaaaggcgatggcgaggtgcggtccgccgatgcctgcatgagctgaaacagccgaaggctagagcgagaatgggtgcaggaatgtcgtgagcttgtgaagatttcaggtagcattagggaattatattgctgggaggggtgcgctgcaactccgttgcagactggcagtgtgagttcgatcgtggagaggctctgcaattgtaaactcaaggcatcttgaagggagaaatgttaaagggctttaacaaggagaaatgttaacgagatgggcaagaaaggaagctggtttaccgcactcaagaaggcctttacccccagccccaaggagaagccaacaaacgtgcatcagctggtagcgcagtacccgccggcgcacgggcacgcgagggagaagaagcgatggggcagcttcgggcggccgcggccgcacgcggagccggcgtcgccggcagcgggcgcgctgatcaacatcccgctgtaccgcgagccgagcagcatcgaaaagatcctcggcgacgcggagatggaccagcagcgccagtactatgccgccaccagggcgcagtaccagatcacgccggccaggcccaccacaaccgccgtcgccgctagcgccgccgcgccgctgccacagccggtggcagcagcgcgtgagcgggagcgcgagcgcggcagagaggacaagccggccgccgtggtgctcccgctgcccccgccgtccccgccgccgctgatcaggcgattcgaccatgaccgggagcagcagcagaagctccagcagctgcagcagcagagccgtgccgagacggagtggcgccagccgcagccgcggcggcaccgcgcggcgaggcagcgcgccgcgccgccggaccgcgcgcgcgccgcggccgtggcgatccaggccgcgttccggggctacatggcgcggcggaactaccggtcgctgcgcgggctaatccggctgcagggcgtgatgcggggcgccagcgtgcggcggcagacggcgcaggcgatgcggtgcatgcagacgctggtgcgcgtgcaggcgcaggtgcgcgccagccgcgtcgacgccatggagcggcgcaaccggcagcaccacggcgccatgctccgggacggcggcaggtggcgtgccggctcgcaggacggcggcatctgggacgacagccggctgacgcgggaggaggcggacgcgcggacgaagcggaaggtggaggccgtgatcaagcgcgagagggccctcgcctacgcctactcgcatcagctgctgaaggcgactccgatggcggcccacgcgatcctggcggacctgcagtcgggccggagcccctggtggtggacgcccatcgagcgccgccacgaaccggagggggcctactaccgccccgtggatcccgtcagcaagccccggccggctctctccatcgcccaccgcgagatgacgacgccgacgatgccgatgacggcggcgacgacgccggcgcggtcggtggtctcggcctactccaagccgaggtccgcgaggccctccaagggggcgggagcggccccgccgccgttgagccacgcggggagcatgagcatccgcgacgacgagagcctgacgagctgcccggcgttcggcgtcggcggcgtgcccaactacatgacgccgacgctgtcggcctccgctaaggcgcgggcgcgggcgcagctgctgctgcagcagcagcagcagaaggcggcccaggagaagcccaggttctcgttcgggctgggccagagcatcgggagctgggccaagagcccgttctggaaggcgccgtcgtcgtcgcgggtgggcacgccggcggcgtcggtggccggcggcgggcggcaccggcggtcgatcagcgggctcagcgtggactccaccgtgtccatgccggccgggctcggcaggagacccatcaagtagatacgtgtcgtgtcgactcgcgccgtgggttgcatccttcttcctctccatctttgaacttgggatttgtacgtgattggtggtgtgatttggtgtgggtttcaaatgcgtttggcgatttcgctgtgctttgctacgacctctggttgctggctcctttgtctcgagccctttcggtttttgaggggacagtgagctgtggtgtgtaaactcggcgactccatcgaacaagcgttccatgcgtcaagtacattcatatacactagtccatcaacccgtgcgggagcacgggctaatgtttttttagaaactattgtatttaaaaattatttagaaattaaacccctagctaataatcaaaattgattaccta

SEQ ID NO: 1970 - DNA, 2110 bp, Panicum virgatum
gtgaagatttcagggagcattagggaattatactgttgggagggctgcgttgcaactctgttgaagtgcaagttagaccgtggagaagctctacaacacaagtcttgcctggaagggagaaattttgaaggtttttagcaaggagaaatgttaaggagatgggcaagaaaggaaactggtttactgcactcaagaaggccttcacctccagccccaaggagaagccatcaaatgtgcatcagctggtagcgcagtacccgccgccgcacgggcacgcgagggagaagaagcgatggggcggattcgggcggtcgcggccctacgcggagccggcgtcgccggcggcgggcgcgctgatcaacatcccgctgtaccgcgagccgagcagcatcgagaagatcctcggcgacgaggagatggatcagcagcgccagtactacgccgccaccagggcgcagtaccagatcacggccgccagacccgccgccgtcgccgttagcgctgcttcagctgccgcgccgctgccacagccggtggcaacggcgcgtgagcgcgagcgcgagcgccgcagagacgacaagccggccgccgtggtgctcccgctgcccccgccgtccccgccgccgctgatcaggaggttcgaccacgacagagagcagcagcagaagctgcagcagctccaacagcacagcagggccgagacggagtggcgccatcagcagccgccgaggcggcaccgcgcggcgaggcagcgcgccgcgccgccggaccgcgcgcgcgccgcggccgtggcgatccagtccgcgttccggggctacatggcgcggcggaactaccagtcgctgcgcgggctgatccggctgcagggcgtgatgaggggcgccagcgtgcggcggcagacggcgcatgcgatgcggtgcgtgcagacgctggtgcgcgtgcaggcgcaggtgcgcgccagccgcgtcgaggccatggagcggcgcaaccggcagcaccacggcgccatgctcagggacggcggcaggtggcgcgccggctcgcaggacggcggcatctgggacgacagccggctgacgccggaggaggcggacgcgcggacgaagcggaaggtggaggccgtgatcaagcgcgagagagccctcgcctacgcctactcgcatcagctgctgaaggcgacgccgatggcggcccacgcgatcctggcggacctgcagtcgggccggagcccctggtggtggacgcccatcgagcgccgccacgagccggaggcggcctaccgccccgtcgatcccgccagcaagccccggccggctctcgccaccgcccaccgcgggatgatgacgccgacggcgatgacgacggcggcggcgacgccggcccggtcggtggtctcggcctactccaactccaagccgcggtccacgaggcccgcgcccgccaagggggcggggagcgtgagcatccgcgacgacgagagcctgacgagctgcccggcgttcggcggcgtgcccaactacatgacgccgacgctgtcggcctccgccaaggcgcgggcgcgggcgcagctcctgctccagcagcagcagcagcagcagcagaaggcggcccaggagaagcccaggttctcgttcgggctgggccagggcatcgggagctgggccaagagcccgttctggaaggcgccgtcgtcgcgggtcggcacgccggcggcgtcggtggccggcgggcgccaccggccgacgcggtcgatcagcgggctcagcgtcgactccaccgtgtccatgccggccgggatcggcaggaggcccttcaagtagatacatgtccaagtccaaccgtgggttgcattcttcttcttcttcttcctccagcttctctcggacttggatttgtaacgtgattggtggtgtgctttggtgtgggtttccaacacgtttggtggtggttcgttgtgctttacgagcaggctgctctggtcgctggctcctttgtctcgagcccctcgtgtgtgtttgaggggccagtgagctgttgtggcatgtaaaaactcggagactccaccgaacaatcgttccgtgcgtcaagttcgttcgtgcattgctttgtc

SEQ ID NO: 1971 - DNA, 2060 bp, Panicum virgatum
gtgaagatttcagggagcattagggaattatattgttgggagggctgcgttgcaactctgttgaagtgcaagttagactgtggacaagttctgcaacacaaggactttggaagggagaaatgttaaaggtttttagcaaggagaaatgttaaggagatgggcaagaaaggaagctggtttactgcactcaagaaggccttcacctccagccccaaggagaagccaacaaatgtgcatcagctggtagcgcagtacccgccgccgcacgggcacgcgagggagaagaagcgatggggcggcttcgggcggtcgcggccctacgcagagccggcgtcgccggcggcgggcgcgctgatcaacatcccgctgtaccgcgagccgagcagcatcgagaagatcctcggcgacgaggagatggatcagcagcgccagtactacgccgccaccagggcgcagtaccagatcacgcccgccagacccaccgccgccgccgtcgccgttagcgctgcttcagctgccgcgccgctgccacagccggtggcaacagcgcgtgagcgcgtgcgcgagcgcagcagagacgacaagccggccgccgtggtgctcccgctgcccccgccatccccgccgccgctgatcaggaggttcgaccatgacagagagcagcagcagaagctgcagcagctccagcagcacagcagggccgagacggagtggcgccagcagccgccgaggcggcaccgcgcggcgaggcagcgcaccgcgccgccggaccgcgcgcgcgccgcggccgtggcgatccagtccgcgttccggggctacatggcgcggcggaactaccagtcgctgcgcgggctgatcccggctgcagggcgtgatgcggggcgccagcgtgcggcggcagacggcgcacgcgatgcggtgcatgcagacgctggtccgcgtgcaggcgcaggtgcgcgccagccgcgtcgaggccatggagcggcgcaaccggcagcaccacggcgccatgctcagggacggcggcaggtggcgcgccggctcacaggacggcggcatctgggacgacagccggctgacgcggcaggaggcggacgcgcggacgaagcggaaggtggaggccgtgatcaagcgcgagagagccctcgcctacgcctactcgcatcagctgctgaaggcgacgccgatggcggcccacgcgatcctggcggacctgcagtcgggccgggagcccctggtggtggacgcccatcgagcgccgccacgagccggaggcggcctaccgctccgtcgaggtcgccagcaaaccccgcccggctctaaccaccgcccaccgcgagatgatgacgccgatggcgatgacggcggcggcgacaccggcccggtcggcggtctcggcctactccaagccacggtccacgaggcccgcgcccgccaagggggcggggagcatgagcatccgcgacgacgagagcctgacgagctgcccggcgttcggcggcgtgcccaactacatgacgccgacgctgtcggcctccgccaaggcgcgggcgcgggcgcagcttctcctccagcagcggcagcagcagcagaaggcggcccaggagaagcccaggttctcgttcggactgggccagagcatcgggagctgggccaagagcccgttctggaaggcgccgtcgtcgagggtgggcacgccggcggcgtcggtggccggcgggcgccaccggccgacgcggtcgatcagcggcctgagcgtcgactccaccgtgtccatgccggccgggatcggcaggaggcccttcaagtagatacgtgtccaaccgtgggttgcattcttcttcctcctcctccagcttctctcggacttgggatttgtacgtgattggtggtgtggtttggtgtgggtttccaatgcgtttggtggctcgctggctcctttgtctcgagcccttcatgtgttttgagggccagtgactgtggcaactggcatgtaaaaactcggcgactccaccgaacaatcgttccatgcgtcgagttcgttcgtgcgttgctttgtc

SEQ ID NO: 1972 - DNA, 2327 bp, Setaria italica
cgggcctctcgcggcctgcagagagttcggaggaaaaaggcgatggcgaggtgcggtccgccgatgcctgcatgagctgaaacagccgaaggctagagcgagaatgggtgcaggaatgtcgtgagcttgtgaagatttcaggtagcattagggaattatattgctgggaggggtgcgctgcaactccgttgcagacagttcgatcgtggagaggctctgcaattgtaaactcaaggcatcttgaagggagaaatgttaaagggctttaacaaggagaaatgttaacgagatgggcaagaaaggaagctggtttaccgcactcaagaaggcctttacccccagccccaaggagaagccaacaaacgtgcatcagctggtagcgcagtacccgccggcgcacgggcacgcgagggagaagaagcgatggggcagcttcgggcggccgcggccgcacgcggagccggcgtcgccggcagcgggcgcgctgatcaacatcccgctgtaccgcgagccgagcagcatcgaaaagatcctcggcgacgcggagatggaccagcagcgccagtactatgccgccacaccagatcacgccggccaggcccaccacaaccgccgtcgccgctcgctgccacagccggtggcagcagcgcgtgagcgggagcgcgagcgcggcagagaggacaagccggccgccgtggtgctcccgctgcccccgccgtccccgccgccgctgatcaggcgattcgaccatgaccgggagcagcagcagaagctccagcagctgcagcagcagagccgtgccgagacggagtggcgccagccgcagccgcggcggcaccgcgcggcgaggcagcgcgccgcgccgccggaccgcgcgcgcgccgcggccgatccaggccgcgttccggggctacatggcaagcgcggcggaactaccggtcgctgcgcgggctaatccggctgcagggcgtgatgcggggcgccagcgtgcggcggcagacggcgcaggcgatgcggtgcatgcagacgctggtgcgcgtgcaggcgcaggtgcgcgccagccgcgtcgacgccatggagcggcgcaaccggcagcaccacggcgccatgctccgggacggcggcaggtggcgtgccggctcgcaggacggcggcatctgggacgacagccggctgacgcgggaggaggcggacgcgcggacgaagcggaaggtggaggccgtgatcaagcgcgagagggccctcgcctacgcctactcgcatcagctgctgaaggcgactccgatggcggcccacgcgatcctggcggacctgcagtcgggccggagcccctggtggtggacgcccatcgagcgccgccacgaaccggagggggcctactaccgccccgtggatcccgtcagcaagccccggccggctctctccatcgcccaccgcgagatgacgacgccgacgatggacggcggcgacgacgccggcgcggtcggtggtctcggcctactccaagccgaggtccgcgaggccctccaagggggcgggagcggccccgccgccgttgagccacgcggggagcatgagcatccgcgacgacgagagcctgacgagctgcccggcgttcggcgtcggcggcgtgcccaactacatgacgccgacgctgtcggcctccgctaaggcgcgggcgcgggcgcagctgctgctgcagcagcagcagcagaaggcggcccaggagaagcccaggttctcgttcgggctgggccagagcatcgggagctgggccaagagcccgttctggaaggcgccgtcgtcgtcgcgggtgggcacgccggcggcgtcggtggccggcggcgggcggcaccggcggtcgatcagcgggctcagcgtggactccaccgtgtccatgccggccgggctcggcaggagacccatcaagtagatacgtgtcgtgtcgactcgcgccgtgggttgcatccttcttcctctccatctttgaacttgggatttgtacgtgattggtggtgtgatttggtgtgggtttcaaatgcgtttggcgatttcgctgtgctttgctacgacctctggttgctggctcctttgtctcgagccctttcggtttttgaggggacagtgagctgtggtgtgtaaactcggcgactccatcgaacaagcgttccatgcgtcaagtacattcatgtacactagtccatcaacctgtgctcccgcacgggctaatatttttagaaactattgtatttgaaaattatttagaaattaaactcctaactaataatcaaaattgattacctactactctcttattttttgaatac

SEQ ID NO: 1973 - DNA, 1811 bp, Saccharum officinarum
gagccggcgtcgccggcggcgggcgcgctgatcaacatcccgctgtaccgcgagccgagcagcatcgagaagatcctcggcgacgcggagatggaccagcagcgccagtactacgccgccaccagggcgcagtaccagatcacgccggcgaggcccaccaccgccgtcgccgcttctgctgccgcgacactgccacagccggtggtgggaacagcacgtgagcgggagcgcgaacgcagcagagaagacaagctggcctccgtggtgctcccgctgccgccgccgtcccctcccccgctgatcaggaggttcgaccatgacagggagcagcagcagaaactgcagcagctgcagctgcagctgcagctgcagagcagggccgagacggagtggcggcagcagcagcagcagccgaggcggcaccgcgcggcgaggcagcgcgccgcgccgccggaccgcgcgcgcgccgcggccgtggcgatccagtccgcgttccggggctacatggcgcggcggaactaccggtcgctgcgcgggctgatccggctgcagggcgtgatgcgcggcgccagcgtgcggcggcagacggcgcaggcgatgcggtgcatgcagacgctggtccgcgtgcaggcgcaggtgcgcgccagccgcgtggaggccatggagcggcgcaaccggcagcaccacagcgccatgctcagggacggcggcaggtggcgcgccggctcacaggacggcggcatttgggacgacagccggctgacgcgggaggaggcggacgcgcggacgaagcggaaggtggaggccgtgatcaagcgcgagagggccctcgcctacgcctactcccatcagctgctgaaggcgacaccgatggcggcccacgcgatcctggcggacctgcagtcgggccggagcccctggtggtggacgcccatcgagcgccgccacgagccgggggactaccgccccgtggagcccgccagcagcaagccccgtccggcgttcaccatcgcccgccgcgagacgacgacgacgacgccaatggcgatgacggcggcgacgacgccggcccggtcggtggtctcggcctactccaagacaaggtccacgaggcccgtgaccaaggtgggagccccggcgccgccgttgagccacgccgggagcatccgcgacgacgagagcctgacgagctgcccggcgttcggcggcgtgcccaactacatgacgcccacgctgtcggcgtccgccaaggcgcgggcgcgggcgcacctgcagcagcagcagcagaaggcggcccaggagaagcccaggttctcgttcgggctgggccagagcatcgggagctgggccaagagcccgttctggaaggccggcgccggcgggctgccgtcgtcgagggtggccacgccggcggcgtccgtggctggcgggcggcaccggtcgacgcggtcgatcagcgggctcagcgtggactccaccgtgtccatgccagccgggctcggcaggaggcccttcaagtagatacacacacatgtcggactcaccgttgcttgcattctccttcttccatctcctttcgacgcatttgtgcttggaatttgtacgtacctgattgatggtgtggcttgttgtgggttactattgcgtttgctgattcgctgtgctttactagaggctagaactccctggttgctggctcctttgtccccagccttcctttggtttggtttttgaggggccagtgagctgtagcgtgtaaactcggcgactccatcgaacaaccgtacatgcgttcagtaagttcatgcttt

SEQ ID NO: 1974 - DNA, 1894 bp, Zea mays
tgcttgcttccattcccagccacccacttcccaccggctcaaacattcccacgtaacgtaatctctggccgcaataaataccttccccgtaattatctccgacgagggggcgccgagccgagctgagttgagcacgacgaaccccggacacccccctccccacgcccggccatggaggactggctcttctactccctcaccactctcctctgcctcctctgctcgctcattctgcgggcgcgcacaccaggcaagaaggcccggaatgccgactcctcctccccgctccctcccctgcccccgggcccgacgccgctgccggtgctgggcccgctgctcttcctcgcgcgccgcgacttcgacatcgagcccgtcctccgccgcatcgcgcgggaccacggcaaggtcttcacgttcgcgccgctggggcgggcgcgcccgggcatcttcgtggccgaccgcggcgcggcgcaccgcgcgctcgtgcagcgcggcgccgcgttcgcctcccgcccgccctccacggcctccagcgccgtgctcaccagcggcggccgcaacgtcagctcctccccctacggcgccacgtggcgggcgctgcgccggaacctcgcctccggggtgctcaacccggcgcggctccgggccttctcccccgcgcgccggtgggtgctcggcgtcctcgcccgccgcgtccgcgccgacggccgccacggggaggctcccgtcgccgtcatggagccgttccagtacgccatgttctgcctcctcgtccacatgtgcttcggtggcgaccgcctcggggacgacgcgcgcgtccgggacatcgaggccacgcagcgggagctcctcggcagcttcctcagcttccaggtcttctccttcctcccgtgggtgaccaagctcgtgttccgccgacgctgggagaagctcgtctcgctgcggcgtcggcaggaggagctcttcgtcccgctgatacaggccaggcgggaggccggcggcgacggggacagctacgtcgactccctggtgaagctgaccattcccgaggacggcgggaggccgctgacggacggcgagatcgtgagcctctgctccgagttcctcagcgccggcaccgacacgacggccaccgcgctgcagtggatcctggcgaacctggtgaagaacccggcgatgcaggacaggctccgggacgaggtgtccagcgccggcgccggcgccgacggcgaggtgctggaggaggagctgcaggcgatgccgtacctcaaggccgtggtgctggaggcgctccggcgccacccgccgggccactacgtgctcccgcacgccgtgcacgaggacacgacgctggacgggtaccgcgtgcccgccggcgcgcccgtcaacttcgcggtgggggacatcgggatggacgaggaggtgtggagggcccccgcggagttccggccggagcggttcctgcccggcggcgagggggacgacgtggacctcaccggcagcaaggagatcaagatgatgccgttcggcgccgggcgccgggtctgccccggcatggcgctggcgctgctgcacctcgagtacttcgtggccaacctcgtgagggagttcgactggcgccaggccgacggcgaggaggtggacctcaccgagaagctcgagttcaccgtcgtcatgaagcggccgctcagggccagggccgtgccgctgcggccgccgccgcccgccgtcgcagctgcttgatcgagcgaggcttgccttctgagtagtggcatcgtggctgcttctcgttgttctgttactatatttatataaccaaatattaggtataatgataggaaagtattcggactgtacattatgctgcgaccaataacaatgcatacgttgtgct

SEQ ID NO: 1975 - DNA, 2094 bp, Setaria italica
cttcaacactcatcaccggccactggaaaatatcctccctcaacagttgctcccagccacccactccccaccggcaccggagctccaaacattcccagccagcttccttccggccgccgagcacgagcacctcgccacctccccacgctcggccatggaggactggctcttctactccctcaccacgctcctctgcctcctctgctccctcctcctgcgcgccggccgcgcccgcagcctgggcggcagcaaggcccacgccgccgccgactcgctccctcccctcccgccagggccagcgccgctgccggtgttgggcccgctgctcttcctcgcccgccgcgacttcgacgtcgagccggcgctccgccgcatcgcgcgggaccatggcccggtcttcaccttcgcgccgctcggcaggtcccgccccaccatcttcgtcgccggccgcgcagccgcgcaccgcgccctcgtccagcgcggcgcggccttcgcgtcccgcccgcccaccacgggcgccggcgtcgtgctcaccagtggcgggcgcaacgtcagctccgccccctacggcgccacgtggcgcgcgctgcgacggaacctcgcgtccggggtgctcaacccggcgcggctccggggcgccttctcgcccgcgcggcggtgggtgctcgacgtcctcgtctcccgcgtccgctccgacggccgcggcggggagtccccggtccccgtgatggagccgttccagtacgccatgttctgcctcctcgtgtacatgtgcttcggcggcgaccgcgtggtggacgacgacgacgcgcgcgtgcgggacatcgaggccacgcagcgggagctcctcgccaacttcctcagcttccaggtcttctccttcctcccgtccgtcaccaagctcgtgttccggcgccggtgggagaagctcgtctcgctgcggcggcggcaggaggagctcttcctcccgctgatagaagccaggagggacgccggcgccgacggggactgctacgtggactccctgctaaagctcaccatccccgaggacggcgggagggcgctaaccaacggcgagatcgtgagcctctgctccgagttcctcagcgccggcaccgacaccacggccaccgcgctgcagtgggtcctggcgaacctcgtcaagaacccggagatgcagggcaggctgcgggacgaggtggccggcgtcgtcggcgccgccgccggcgaggtgcgggaggaggacctgcaggcgatgccgtacctgaaggccgtcgtgctggaggcgctccggcgccacccgccgggccacttcctgctcccgcacgccgtgcacgaggacaccacgctggacgggtaccgcgtgcccgccggcgcgccggtcaacttcgccgtgggcgacatcgggctcgacggggaggtctgggacgcgccgtcagagttccggccggagcggttcctccccggcggggaaggggaggacgtcgacctgacgggcagcaaggagatcaagatgatgccgttcggcgccggccggagggtctgccccggcatggcgctcgcgctgatgcacctcgagtacttcgtggccaacctcgtgagggagttcgagtggcgcgaggctgacggcgaggaggtggacctcgccgagaagctcgagttcaccgtcgtcatgaagcggccgctcaaggccagagccgtgccgctgcggtcgccgccgcccacagtcgcagctgcttgatcgagtgttctctctagatagcatggcaatgaattggcaacagaaagagtgttcttctggttgctctagctgtgcataccatgggattatagaaccaaagatacatgatgttaaacagatttctcttgttcttttgggaacttagtttgaagcagtaaggtaatgctgcactaatgtgcttgtataatgtgtgtacaataaggcagcagttagtaaatatttactttactgaactccaaatgaaaagtgtatagaaaacttgtatacgtttccagagcacttggaagcgttcagcattcagcaagcacatcgagccattcctctatgcattggcttgacagttttccagaggc

SEQ ID NO: 1976 - DNA, 1584 bp, Setaria italica
ccaccactggccatggaggactggctcttctactctctcaccatgctgctctgcctcctctgctcgctcctgctgcgtgcccgtgcccgcagtccaagcaagatcaatgccaccgacgaatccctccctcctctcccacccggtccggcgccactgccggtggtgggcccgctcctcttcctagcccgccgtgacttcgacatggagcccatgctccgtcgcatcacgcgggagtacggtccggtcttcaccttcgcgccactcgggaaggcgcgtcccaccatcttcgtggcagcccgtggggctgtgcatcgtgcgcttgtgcagcgcggagtgatgttcgcctcccgcccgcctgtgacagcctcgggcatcgtgctcactagtgggggccgcaacatcagctcctccccctacggcaccacgtggcgtacgctgcggcggaaccttgcagcgggtgtgctcaacccggcacgactccgggcattctcccccgcacggcggtgggtgcttgacatccttgtctcccgtgtccgcacggacggagggaacggggaacgccctgtcaccgtgatggagccgttccagtacgccatgttttgcctcctggtgtacatgtgctttggcgaccacctcgaggacgcgcgcgtgcgagacatcgaggccacacagcgggagctgctcagcaacttcctcagcttccaagtcttctcctttgtgccggcggtcaccaagatcgtgttccgacggcgatgggagaagctcatcttgctgcggcggcggcaggaagagctttttgtaccgctgattcaagcaaggagggaggctggtgcagacggagactgctacgtggattccatggtgaagctgatcatccccgaggacagcggcagaacgctcacggacgacgagatcgtgagcctctgctccgagttccttagcgctggcaccgacaccacggccaccacactgcagtggatcctagcgaacttggtcaagaaccaagcaatgcaggataggctgcgggacgaggtggctagctccgtcggtgccaatggcaaggtgcgagaggacaacctgcaagcgatgccgtacctcaaggctgtggtgttggaggggctccgacgccatccaccgggccactacgtgctcccacacgccgtgcacgaggacacgacgttggacgggtaccgtgtgcccgctggcacacctgtgaactttgcggtgggcgacatcggcctagacgaggaggtgtgggatgcaccctcggagtttcggccggagcggttcctacccggcggggaaggggaggaagtggacctaacggggagcaaggagatcaagatgataccattcggtgccgggcggagggtctgccctggcatggcgctggcgctactacacctcgagtacttcgtagccaaccttgtgagggagttcaagtggctcgaggccgatggcgaagacgtggacctcactgagaagctcgagttcactgtggtcatgaagcggccgctcaaggccagggccgtgccgttgcgatcaccgtctgttgttgcagctgcttgatagatcaagcttact

SEQ ID NO: 1977 - DNA, 1832 bp, Setaria italica
gccaccactggccatggaggactggctcttctactctctcaccatgctgctctgcctcctctgctcgctcctgctgcgtgcccgtgcccgcagtccaagcaagatcaatgccaccgacgaatccctccctcctctcccacccggtccggcgccactgccggtggtgggcccgctcctcttcctagcccgccgtgacttcgacatggagcccatgctccgtcgcatcacgcgggagtacggtccggtcttcaccttcgcgccactcgggaaggcgcgtcccaccatcttcgtggcagcccgtggggctgtgcatcgtgcgcttgtgcagcgcggagtgatgttcgcctcccgcccgcctgtgacagcctcgggcatcgtgctcactagtgggggccgcaacatcagctcctccccctacggcaccacgtggcgtacgctgcggcggaaccttgcagcgggtgtgctcaacccggcacgactccgggcattctcccccgcacggcggtgggtgcttgacatccttgtctcccgtgtccgcacggacggagggaacggggaacgccctgtcaccgtgatggagccgttccagtacgccatgttttgcctcctggtgtacatgtgctttggcgaccacctcgaggacgcgcgcgtgcgagacatcgaggccacacagcgggagctgctcagcaacttcctcagcttccaagtcttctcctttgtgccggcggtcaccaagatcgtgttccgacggcgatgggagaagctcatcttgctgcggcggcggcaggaagagctttttgtaccgctgattcaagcaaggagggaggctggtgcagacggagactgctacgtggattccatggtgaagctgatcatccccgaggacagcggcagaacgctcacggacgacgagatcgtgagcctctgctccgagttccttagcgctggcaccgacaccacggccaccacactgcagtggatcctagcgaacttggtcaagaaccaagcaatgcaggataggctgcgggacgaggtggctagctccgtcggtgccaatggcaaggtgcgagaggacaacctgcaagcgatgccgtacctcaaggctgtggtgttggaggggctccgacgccatccaccgggccactacgtgctcccacacgccgtgcacgaggacacgacgttggacgggtaccgtgtgcccgctggcacacctgtgaactttgcggtgggcgacatcggcctagacgaggaggtgtgggatgcaccctcggagtttcggccggagcggttcctacccggcggggaaggggaggaagtggacctaacggggagcaaggagatcaagatgataccattcggtgccgggcggagggtctgccctggcatggcgctggcgctactacacctcgagtacttcgtagccaaccttgtgagggagttcaagtggctcgaggccgatggcgaagacgtggacctcactgagaagctcgagttcactgtggtcatgaagcggccgctcaaggccagggccgtgccgttgcgatcaccgtctgttgttgcagctgcttgatagatcaagcttactcttctctctagcatgggaatggattgggaagagtgcgcatctccttaccattacatatacccaacgattatggtaatcaaattaagtttctcttgttcttttgggtgtgtactagcagtcatagcaaccttaagctcaattagtttgtacaataaggcagcaactagtaaatatttagtacactagtacgaagcattatttatagagggcattcagctatgttaaatggaatgcagcagcaacatca

SEQ ID NO: 1978 - DNA, 2000 bp, Hordeum vulgare
cattagtcttgctattaagcatcatctctaaacttcgcaaccctgaataaaagagtgaattagctagcagattatagtttgcgttcatgccgtcaatgcccgccaccggccgctacaatatcccgcagattatattccccgtgcatgctgcgtgtctcggtccatgcctccaacttcccaccggtccccaaacattcccgatctttttcttgcagtacaaatgaagcatctccaccggaatctcagcgaccagtctgtcccgccgccgccgccgccgccgccatggaggactggctcttctactcgctcaccaccatgctctgcctcctcagctcgctgctgctgcgggcccgggcccgcagcccgtcccattccgcgacgctgacgcctcagacgccgccgctgcctccaggtccggtgccgctgccggttctcggcccgctgctccacctggcccgtcgcgatttcgacctcgagcccgtgctgcgggtcctcgcgcgagcctacggcccggtctactccttcgcgccactggggctggcgcggccaatgatattcgtcgcggcacgaggcccggcccaccgcgcactcgtccagcagggcgccgccttcgcctcccgcccgcgcgccactgctcccgccgccgccgtgctcaccagcggcggccgcaacgtcagctccgctccgtatgggcccacctggcgcgcgctccgccgcaccctcgcctccggcgtgctcaacccggcccgcctccgcgccttcgcccccgcccggcgctgggtgctcgacgtcctcgtgtcccgcatccgctccggtggccgcggcggcggcggcgtcgtcgccgtcatggagcccttccagtacgccatgttctgtctcctggtgtacatgtgcttcggcggcgaccgcctcggcgacgcgcgcgtgagggacatcgaggcgctgcagcgtgacctcctcggcaacttcctcagcttccaggtcttctccttcctcccgccgctcaccaagctcgtcttccgccgccggtggagcaagctcgtctcgctgcgccggcgtcaggaggagctcttcgtcccgctcatccgcgccaggagggaggcgggcgctggcggcgactgctacgtggattccctggtgaggcttgccatcccggaggatggagggagggggctcacggacggcgagatcgtgagcctctgctccgagttcctgagcgccggtaccgacaccacggccacggcgctgcagtggatactcgcgaacctggtcaagaacccggctatgcaggacaggctaagggacgaggtttccgccgccgtcgacggcgagctgcgggaggaagacctgcaggggatgccgtacctcaaggccgtggtgctggaggggctgaggcggcacccgccggggcactacgtgctaccgcacgccgcggcggaggagacgacgctggacgggtaccgcgtcccggcgggcacgccggtaaacttcgcggtaggcgacatcgggctggacgaggagatctggacggcgccgtcggagtaccggccggagcggttcctgccgggcggcgagggggaggacgtggacctcaccggcagcaaggagatcaagatgatgccgttcggcgccggcaggagggtctgccccgccatggcgcttgcgctgctgcacctcgagtacttcgtggccaacctggtcagggaattcgagtggcgggaggaggctggcgaggaggtggacctcaccgagaagctcgagttcaccgttgtcatgaggcggccgctcaaggccagggctgtgccgctgaggcaaggaaggcccatcgccgccacgggctcgggttgatcgacgggggccaaccatattctcctttcccaaatgtttagttggtaattagattaagcttgtcttcttcttttctgaatttgcttttgctaatgaaatgtactatgtggttttctaatctaaaagacagattaaaaagaaactaatgaacg

SEQ ID NO: 1979 - DNA, 1506 bp, Setaria italica
gccgctgccggtgttgggcccgctgctcttcctcgcccgccgcgacttcgacgtcgagccggcgctccgccgcatcgcgcgggaccatggcccggtcttcaccttcgcgccgctcggcaggtcccgccccaccatcttcgtcgccggccgcgcagccgcgcaccgcgccctcgtccagcgcggcgcggccttcgcgtcccgcccgcccaccacgggcgccggcgtcgtgctcaccagtggcgggcgcaacgtcagctccgccccctacggcgccacgtggcgcgcgctgcgacggaacctcgcgtccggggtgctcaacccggcgcggctccggggcgccttctcgcccgcgcggcggtgggtgctcgacgtcctcgtctcccgcgtccgctccgacggccgcggcggggagtccccggtccccgtgatggagccgttccagtacgccatgttctgcctcctcgtgtacatgtgcttcggcggcgaccgcgtggtggacgacgacgacgcgcgcgtgcgggacatcgaggccacgcagcgggagctcctcgccaacttcctcagcttccaggtcttctccttcctcccgtccgtcaccaagctcgtgttccggcgccggtgggagaagctcgtctcgctgcggcggcggcaggaggagctcttcctcccgctgatagaagccaggagggacgccggcgccgacggggactgctacgtggactccctgctaaagctcaccatccccgaggacggcgggagggcgctaaccaacggcgagatcgtgagcctctgctccgagttcctcagcgccggcaccgacaccacggccaccgcgctgcagtgggtcctggcgaacctcgtcaagaacccggagatgcagggcaggctgcgggacgaggtggccggcgtcgtcggcgccgccgccggcgaggtgcgggaggaggacctgcaggcgatgccgtacctgaaggccgtcgtgctggaggcgctccggcgccacccgccgggccacttcctgctcccgcacgccgtgcacgaggacaccacgctggacgggtaccgcgtgcccgccggcgcgccggtcaacttcgccgtgggcgacatcgggctcgacggggaggtctgggacgcgccgtcagagttccggccggagcggttcctccccggcggggaaggggaggacgtcgacctgacgggcagcaaggagatcaagatgatgccgttcggcgccggccggagggtctgccccggcatggcgctcgcgctgatgcacctcgagtacttcgtggccaacctcgtgagggagttcgagtggcgcgaggctgacggcgaggaggtggacctcgccgagaagctcgagttcaccgtcgtcatgaagcggccgctcaaggccagagccgtgccgctgcggtcgccgccgcccacagtcgcagctgcttgatcgagtgttctctctagatagcatggcaatgaattggcaacagaaagagtgttcttctggttgct

SEQ ID NO: 1980 - DNA, 1304 bp, Zea mays
ggaaactgcaaaatttagggtttctttgcatctctcccgtcggctcctcccctcccaagtctcacctcacctctcctcctcgcgaagtatcggcggcggcgagcgcggcaggctagagcctcgttgctgaggaggggagatggcgggtatgggcgatatgccgatgaggccggcgcggccgggcccgccgatgcagcaccgtggtccgcccccgatggcgcgcctccgccccgaaccaatcgaccgcgagaagacctgtcctctgctgctcagggttttcacaagggttgctggtcaccaccaaaatgaagagtttgcagtgagagggaaggaaccaaaggatgaagttcagatttacacatggaaggatgcgaccctccgcgagctcactgatcttgtgaaagaggttgctcttccagcaagaaaaaggaatgcaaggctttcttttgcatttgtatacccagacaagaatggtcgttttgttgtcagacaggtgggttcgaccttcgcttacggtcatggaagaggcgacgatgccaaaactcttgcagagctcggattccagatcggtgattacttgagcgttgcaatcatgtagacggtgcccgcaccggatgtaattgctgtgatgtcaaaagggctctggttgcaacagtaaggcatgattctctgttagcactaggaactgcaaccagaattgtctgtaataccggtagtatcaaatttacctagacacttcgaacgagcaaggcgtctgtaataccggtacttacctgtggtgcctggagcttccaaatctggatagcgtgggtttttcattgagaatgttaagttggctcgggttcctatgaagtcaaacacaggaaagtttgcatcttggagccagaccagagtttgcatcttggagccagaccagttgggcaaattttgtttcgccatttctaaaatcttgtagccaggctagatttgagataacagtttagataatagttactctaaaattgaactgatggtcgaatttgcaccggagattggtctctttatgaacagtaaaagaacagtacaattataatgcatctgatagaatgcaaaagaaataaatgcatgacttgcaaccatttttcagaggcaaggtaccaacagttttaacgcgattttctcagttacgtaaccatgacatttttttctcatcacgcaaactatcccttccgttccaaattttaatacttttctagatacattccgtttgatacagtatatatctaaatacatagcaaaagcggttgaaattaaaaaaaacaaaa

SEQ ID NO: 1981 - DNA, 983 bp, Pennisetum glaucum
cggggtgttcgacggccacggctgctcgcatgtgagtgcccgccctgccccgcaccgcacgccgtcgggtcttcccagaatcccagttcccaccccccacccacctctcccgcgacgaatcggcggcggcgagttcccctgcgatcctcggcgttgaggacctgtgatggcgggcatgggcgacatgccgatgaggccggcgcggccgggcccgccgatgcagcaccgggggcctccgccgatggcgcgactccgccctgagcccatcgatcgggagaagacctgtcctctcctgctcagggtttttacgagggttgctggtcatcaccaaaatgaagagtttgccgtcagagggaaagaaccaaaagatgaagttcagatttatacatggaaggatgccacgctccgtgagctcactgatctcgtgaaagaggttgctcttccagcaaggaaaagaaacgctaggctttcttttgcatttgtgtacccagacaagaatggccgttttgttgtaagacaggtgggttcaacgtttgcatatggtcatggaagaggggatgatgccaaaactcttgcagagcttggtttccagattggtgattacctgagcgtcgcgatcatgtaagcaatgcccatgcccatgcccatgctgaaatcaacgaccgcattggatgtaactgctgtgatgtcaaaagccctgggtggcaaagggtgaatctctgttaggactagggaatcagaccaaaattctctgtattacttgtattgtcaaggcatttcgaaccctcgatgggcctggtgtggttgcttgttaatatggtacttatctccggtgccgggagttgtcaagtctcagcatcgtgtgttttccattgtaattgcgttttccattggttccatgctgagtttgtccggctgatctaacaagctagcacgtactactagccagttgccacaatctggtaacagttgcaatgcattcc

SEQ ID NO: 1982 - DNA, 984 bp, Saccharum officinarum
cggaggaaacgcaaaatttagggtttgttcgcttctcttccaggcacacccacgccgtcggctcctcccctccccacctccacctctccccgcgaagaatcggcggcggcgcgagctccttcccttgtcgaagtccacccggctgtagagcagagcctcgttgctgaggaggggagatggcgggcatgggcgatatgccgatgaggccggcgcggccgggcccgccgatgcagcaccgcgggccgccgccgatggcgcgcctccgccccgaaccaatcgaccgcgagaagacctgtcctctgctgctcagggttttcacaagggttgctggtcaccatcaaaatgaagagtttgctgtgagagggaaggaaccaaaggatgaagttcagatttacacatggaaggatgccactctccgcgagctcactgatcttgtgaaagaggttgctcttccagcaaggaaaaggaatgcaaggctttcttttgcatttgtatacccagacaagaatggtcgttttgttgtcagacaggtgggttcgacctttgcatatggtcatggaagaggtgatgatgccaaaactcttgcagagctcgggttccagattggtgattacttgagcgttgcaatcatgtagacagtgcccacaatgaatttcagcgactgcaccggatgtaactgctgtgatgtcaaaaggctttagttgcaacaatcaaggcatgaatctctgttagcactaggaagtggaaccaaaattttctgtaatactggtagtatcaaatttacctagacatttcgaacgagcaaggagtctggtatggttgcttgtataatatctgtggtgcctgaagtttccaatctggacaacgcgcgttttcaattgagaatgttaagttgggctgactgatattccaagtcagcatgtacaccgacacaatccggtgagatgatcataacagttgcaacgtggtcttacgtctcttgca

SEQ ID NO: 1983 - DNA, 1070 bp, Setaria italica
gttagggtttattgcctcgcttcgagacacatccactcccgcacgccgttccccacccacctctcccgcgacgaatcggcggcggcggcggcgagttcccctgcgagccttggtgttgaggacgtgtgatggcgggcatgggcgacatgcccatgaggccggcgcggccgggcccgccgctgcagcaccgggggcctccgccgatggcgcgcctccgccctgaacccatcgaccgcgagaagacctgtcctctcctgctcagggtctttacgagggttgctggccatcaccaaaatgaagagtttgctgtcagagggaaagaaccaaaagatgaagttcaaatttatacatggaaggatgccacgctccgtgagctcactgatctcgtgaaagaggttgctcttccagcaaggaaaagaaacgctaggctttcttttgcatttgtgtacccagacaagaatggtcgttttgttgtaagacaggtgggttcaacattcgcatatggtcatggaagaggggatgatgccaaaactcttgcagagcttggtttccagattggtgattacttgagcgttgcgataatgtaaaccatgcccatgctgaacttgacgaatgccagtgctgaaatcaacgactgcactggacgtaactgctgtgatgtcaaaagccctgggtggcaaggggtgaatctctgttagcactagggaatcggaccaaaattctctgtaatacttgtactgtcaaggcattttgaaccctcaaggcgtctggtgtgattgcttgttaatatggtacttatctgtggtgcctggagtttacaaatatgaacatcgtacgtttttttttccaattgtaatgtgcctatggttccatgctgagtagggctgactgatattccaaagccaacaagtacttgccccgatctggtaacagttgcaatgcagtctcaatgtgctgtggccggtttatagctttagacagaattaagaagctattctcaggttagaaattgtgttggaacctccattgtagaattatgtagtagatagtcaaaactaagtacaagaaaa

SEQ ID NO: 1984 - DNA, 920 bp, Setaria italica
cgcgacgaatcggcggcggcggcggcgagttcccctgcgagccttggtgttgaggacgtgcgatggcgggcatgggcgacatgcccatgaggccggcgcggccgggcccgccgctgcagcaccgggggcctccgccgatggcgcgcctccgccctgaacccatcgaccgcgagaagacctgtcctctcctgctcagggtctttacgagggttgctggccatcaccaaaatgaagagtttgctgtcagagggaaagaaccaaaagatgaagttcaaatttatacatggaaggatgccacgctccgtgagctcactgatctcgtgaaagaggttgctcttccagcaaggaaaagaaacgctaggctttcttttgcatttgtgtacccagacaagaatggtcgttttgttgtaagacaggtgggttcaacattcgcatatggtcatggaagaggggatgatgccaaaactcttgcagagcttggtttccagattggtgattacttgagcgttgcgataatgtaaaccatgcccatgctgaacttgacgaatgccagtgctgaaatcaacgactgcactggacgtaactgctgtgatgtcaaaagccctgggtggcaaggggtgaatctctgttagcactagggaatcggaccaaaattctctgtaatacttgtactgtcaaggcattttgaaccctcaaggcgtctggtgtgattgcttgttaatatggtacttatctgtggtgcctggagtttacaaatatgaacatcgtacgtttttttttccaattgtaatgtgcctatggttccatgctgagtagggctgactgatattccaaagccaacaagtacttgccccgatctggtaacagttgcaatgcagtctcaatgtgctgtggccggttaatagcttcttaattctgtc

SEQ ID NO: 1985 - DNA, 798 bp, Panicum virgatum
cctcagacctcacctctccccgcgacgaatcggcggcggcggcggcggcggcggcagcgagcactagagacccggctagagacccgggatggccggcatgggcgagatgccgatgaggccggcgcggccgggcccgccgatgcagcaccgggggccgccgccgatggcgcgcctccgccccgaaccgatagaccgcgagaagacctgtcctctcttgctcagggtcttcacaagggttgctggccatcaccaaaatgaagagtttgcggtgagagggaaggagccaaaagatgaagttcagatttacacatggaaggatgccacgctccgtgagctcacagaccttgtaaaagaggttgctcttccagcaaggaaaagaaatgctaggctttcttttgcttttgtgtacccagacaagaatggccgttttgttgtcagacaggtgggttcgacctttgcatatggtcatggaagaggggatgatgccaaaactctggcagagctcgggttccagattggtgattacttgagcgttgcaatcatgtagacgatgcccatgctgaactcgatcactgcaccggactggatgtaactgttgtgacgtcaaaagccccaggggggcaagggatgaatctgtgttagcattagggaattggaaccaaaattgtctgtaatactggtacgatcaaagttcactaaacattctgaacgctcaaggtgtctggtgtgattgcttgttaatatggtatggtatctgtggtgcctggagttttcaaatctgaacatcgtgcgttttcc

SEQ ID NO: 1986 - DNA, 1197 bp, Zea mays
aaacgaggtcttcattgatctcaagggaggaaactgcaaaatttagggtttgtttggccctattcgcacacacccacgccgtcggatcctcctgccctccccacgtccacctctctccgccgaagaatcggcggcggcggcggcggcggcgagcgccttcccttgtcaaaatccacccggcggcagagcagagcctcgttgctgaggaggggagatggcaggcatgaccgatatgccgatgaggccggcgcggccgggcccgccgatgcagcaccggggccctccgccgatggcgcgcctccgccccgaaccaatcgaccgcgagaagacctgccctctgctgctcagggttttcacaagggttgctggtcaccaccaaaatgaagagttttctgtgagagggaaagaaccaaaggatgaagttcagatttacacatggaaggatgccactctccgtgagcttactgatcttgtgaaagaggttgctcttccagcaaggaaaaggaacgcgaggctttcttttgcatttgtatacccagacaagaatggtcgttttgttgtcagacaggtgggttcgaccttcgcttatggccatggaagaggtgatgatgccaaaactcttgcagagcttgggttccagattggcgattatctgagcgtcgcgatcatgtaactgcagattggcgattacctgagcgtcgcgatcatgtaagccggtgcccgcaatgagttccggtgactgcaccggatagaactgatgtgatgtaaaaaatgcattggttgcgacgagcaagggaggagtatctgttagcgctaggaagtggaaccaaaactgtctgtaatgccggtactaccaaagttgcctagacactttgaacgatcaaagcgtatggtatggtttcttgttggtatggtgcttgtctgcggtgcctgaaatttccaatccattgagctgcacgtcaatggctccatgttaagatgggctgaacggtattccaaggggtgggcaagatacccattatctgaaccattatccaaacctgaactacctgaacctgtacccgacctacccgaacctgaattaaccaaacactagtttggatcctaggtctcaaaacccaaaattatattgggtaccgggtaacatgtctcgtgcctgaattacccgaaattatatattatttatccagttcccaa

SEQ ID NO: 1987 - DNA, 765 bp, Cynodon dactylon
gggggcaccacctctacggcgaacaatcggcggcggcggcggccttaccttgtcgaggccaacgccgcggcggggcagatccttgttgctgttgaggaggagtagcgatggcaggcatgggtgacatgccgatgaggccgcggcccggtccaccgatgcagcaccgggggcctccgccgatggctcgccaccgcccggaacccatcgaccgtgagaagacttgtcctctcctgctgagggttttcaccagggttgctggtcatcatgacaaggaagaatttgctgtgagagggaaggagccaaaagatgaagttcagatttacacgtggaaggatgctacgctccgcgaactcactgatcttgtaaaagaggttgctcttccagctaggaaaaggaatgccaggctatcttttgcttttgtatacccagataagaatggtcgttttgttgtcagaccggtgggtacaacatttgcatatggtggaagaggagatgataccaaaacacttgcagagcttgggttccagattggtgattacttgagtgttgcaattctgtgaatgatgcccctttgtgctcgatgactgcactgaaagcaaatctttgtaattgccaaggaatgcatctctcgttagtaattagggaactgaaaccaaaactgtctgtaatactgtattgttggaatcttttggcattatgaacgagtcaagtgtctggtttgattgcttgccaatatagctacttatctattgtcatttagtactg

SEQ ID NO: 1988 - DNA, 1207 bp, Oryza sativa
ggcccttactctcttactagtggtgctaaattatttgccattagacccacgtatcatagacaatgaataactaataattaattgctacatcttaaaagtggcatggagttaaatgtcccttttttagaggtggactgaattgtaaaattgtattttcatttgaacccagggtgcaatctacaaaaagtttactagggttttctttgcttctctcgcatccccttctgaagtgatcggcggcggcggcggcggagcagggcagggggaggtctcgttgcgatggcgggaaggggcgagatgccgatgaggcctgtgcggccagggccgccgatgcagtaccgggggcctcctcccatggctcgcgcgcgcgtcgaacccgtcgatcgcgagaagacgtgccctctcctgctccgggttttcacaaaggttggtggccatcaccaaaatgaagagtttgccgtgagaggaaaggagccgaaagatgaagtgcagatatacacgtggaaggatgccacactccgagagctcactgatcttgtgaaagaggttgctcttgcagcaagaaaaagaaatgcaaggctttcttttgctttcgtgtaccctgataagcatggtcgtttcgttgtcaaagaggtgggttcaaccttctcttatggccatggaaggggagatgatgctaaaactcttgcagagctaggattccagataggggattacttgagtgttgcaatctattgagtgacactgcttcacgaaatagtgtgtttctccctgcctaccatgctgaatccagctttcctgtggcggtacccagctttcctgtggtggtgaatatctctgtagtactagagacgtgataccagaactgtttgttatggtagtaaccttggaattcactcagtatttcgagtgtgttgaacacttaaaacgtttgatgtgattgcgtgttatatacctgttcgtggtttccttggaactgtgagatctgaacatcacgcgttttccattgattctctgcgccgagtaggattaaatgtgttctgtgctaaataactgggtgaaggaacataatgttcttatgatcatctcctacttctcacatttcagtgtttcaatttccaactgagttggcaggatactgtgtagttctgtggtgagcccccaaagtatctgaatgcatgcacataaactgagtcacggctatcac

SEQ ID NO: 1989 - DNA, 948 bp, Oryza sativa
gaattgtaaaattgtattttcatttgaacccagggtgcaatctacaaaaagtttactagggttttctttgcttctctcgcatccccttctgaagtgatcggcggcggcggcggcggagcagggcagggggaggtctcgttgcgatggcgggaaggggcgagatgccgatgaggcctgtgcggccagggccgccgatgcagtaccgggggcctcctcccatggctcgcgcgcgcgtcgaacccgtcgatcgcgagaagacgtgccctctcctgctccgggttttcacaaaggttggtggccatcaccaaaatgaagagtttgccgtgagaggaaaggagccgaaagatgaagtgcagatatacacgtggaaggatgccacactccgagagctcactgatcttgtgaaagaggttgctcttgcagcaagaaaaagaaatgcaaggctttcttttgctttcgtgtaccctgataagcatggtcgtttcgttgtcaaagaggtgggttcaaccttctcttatggccatggaaggggagatgatgctaaaactcttgcagagctaggattccagataggggattacttgagtgttgcaatctattgagtgacactgcttcacgaaatagtgtgtttctccctgcctaccatgctgaatccagctttcctgtggcggtacccagctttcctgtggtggtgaatatctctgtagtactagagacgtgataccagaactgtttgttatggtagtaaccttggaattcactcagtatttcgagtgtgttgaacacttaaaacgtttgatgtgattgcgtgttatatacctgttcgtggtttccttggaactgtgagatctgaacatcacgcgttttccattgattctctgcgccgagtaggattaaatgtgttctgtgctaaataactgggtgaaggaacataatgttcttatgatc

SEQ ID NO: 1990 - DNA, 1054 bp, Hordeum vulgare
gcaaaccgcaaaagcttagggtttcttccagagacatccacacgcttcggactcccccccttcatccgcaccccacccccaccccgtgaagaatccggcggcggacggcggacggcgagcgacagcggacggcgagcgacagcggagcagggtttgggattctagccttctcgaggagggagatggcaggcatgggcgagatgccgatgcggccgcggccgggcccgccgatgcaccgcggcccgccccccatggcgcgcccccgccccgagcccatcgaccgcgagaagacctgccctctcctgctccgggttttcaccaaggttggtggccatcacctgaatgaagaattttctgagagagggaaggagccgaaagatgaagttcagatttacacgtggaaggacgccacactccgggagcttactgatcttgtcaaagaggttgctcttccagcaaggaaaagaaacgctaggttatcttttgcttttgtatacccggataagaatggtcgttttgttgtcaaacaggtgggctcaaccttttcttatagtcatggaagaggggatgatgccaaatctcttggggatcttggcttccagataggtgattacttgagcgtgtcgatcatgtgagctgtgccatctggcaaaacagtgtgcctgctgcacaccaagcataatagttttcctgctgcgctattatcttagctgtgcgtgcgagggatgaatctctccttagtggtagggaactggaaccagaactgtctgtaatagtggtgacttttcgaactagtatttgagacttgacacttgagacatctgatgtgattgcttgctatgtacctgttctttgtggttttcactctgaacgagagtactcattgaaccttatgtttccagcagaacatatgtaaacacttttgagactttatttaccgaatagatgacgataaatcaaagctgtacaaccgttaccggtaacatctgatgcaactaaacaagataccttgtgacctcagataatgagcattgcaatctaatttcgtagtttt

SEQ ID NO: 1991 - DNA, 2496 bp, Hordeum vulgare
gcaaaccgcaaaagcttagggtttcttccagagacatccacacgcttcggactcccccccttcatccgcaccccacccccaccccgtgaagaatccggcggcggacggcggacggcgagcgacagcggacggcgagcgacagcggagcagggtttgggattctagccttctcgaggagggagatggcaggcatgggcgagatgccgatgcggccgcggccgggcccgccgatgcaccgcggcccgccccccatggcgcgcccccgccccgagcccatcgaccgcgagaagacctgccctctcctgctccgggttttcaccaaggttggtggccatcacctgaatgaagaattttctgagagagggaaggagccgaaagatgaagttcagatttacacgtggaaggacgccacactccgggagcttactgatcttgtcaaagaggttgctcttccagcaaggaaaagaaacgctaggttatcttttgcttttgtatacccggataagaatggtcgttttgttgtcaaacaggtgggctcaaccttttcttatagtcatggaagaggggatgatgccaaatctcttggggatcttggcttccagataggtgattacttgagcgtgtcgatcatgtgagctgtgccatctggcaaaacagtgtgcctgctgcacaccaagcataatagttttcctgctgcgctattatcttagctgtgcgtgcgagggatgaatctctccttagtggtagggaactggaaccagaactgtctgtaatagtggtgacttttcgaactagtatttgagacttgacacttgagacatctgatgtgattgcttgctatgtacctgttctttgtggttttcactctgaacgagagtactcattgaaccttatgtttccagcagaacatatgtaaacacttttgagactttatttaccgaatagatgacgataaatcaaagttgtacaatctttaccggtaacatctaatgcaactaaacaaaataacttgtgatctcagataatgagcattgcaatcgtagttttctgtaaactcctgtttctgcctagaaaaaaaagaacttacatctcggcattgaaagcaagttcccaaacattcttgtgaatgactctaatataaactcgtgctgctgcgcgcaagctgttcgacaaaatagaggcatggtttcctctttgagattcctgttgatgtcgaacaaggctgggccgtcagcctagcttacacacacatccatgcttagcaccataactgcacgggcagaatcttgcaacgacaggggtacttccctcccgtaagataaaagaaagccatggatgaggacttgcacactacaaagaactgtgtactgcattgtttctggcaatgcctctccatttcgtggcaaatgtgcctgacagccattactttaaactcaccaagtcaccatggctcatatggaccttttgccaaggcgattacagcgatcctctgctgttcaaagccttcatagtagcccactgtttgttttcaattacttcatttcatctgaaagatggatagtgcagccattgagaagaaatggcccaagcaaaaaccattctacggacggttggatatagattgatttgatctgccgtctgcgttcttacaacatctaacattcctcaatgatccatttcttgtcaggcagtcatcacatctaacagcttggaagtccagcttctgcatccatcctggtctctattcaaggctggagcagcagggacaatgctaactcttagaccgtttccctaatcttggcagccgcacgcctcatctgtttagcaacaaaatcagcttctttcgtttttccatcttcatccagcgcatgatgaagcgcgaccaaactgcgaggttcaacggcagcagaactgcttccgctctcgatgagttcgtagaaaagccggaacgcgtctgaggctctaccagttgtgcaaaggccatccagaaccgtactggatattgacacacccaaatcatgatgcttctgcaagctaaacaaggtaagctcggctgcctctatgaacttcttttcctcgcagaggtccccgattagtttttccatcttgatgtaatagccttggtcatatagggatgtgatgactttgtaggcacggtcatttaggctgcttttgaacaatgcgtcaatcgtattggtcgaaagatccaaattctggcggatcttcctctctagcattatctcaatcaaatctgcagcttcttttgcacaaccttcttttttcaaaagtcctaaaagaacagagtggaacgtgcttgtgctaggccggaggccactgttcagcatcctgtgaaggacctcccatgcaatcttcatccttcctttctgcgaaaacccctctacgatggcaatgtagcattcatcatcgggcacaagatccctcttcaacatcgagagcaccagctggtacccttcttcaaaatgctcctcgtgccga

SEQ ID NO: 1992 - DNA, 730 bp, Brachypodium distachyon
ctcttcttctcccccttcctaccctcgaagaatcatccatcgagcggcggccggcggcgagcggcagcagagcagagcagggggggaaaatctcgctttccgaggagagagatggcaggcatgggcgagatgcacatgaggccgcggccaggcccgcccatgcagcaccgtggcccgcccccgatggcgcgcgcccgccccgagcccatcgaccgcgagaagacctgccctcttttgctccgggtcttcacaaaggttggtgctcatcacctaaacgaagattttgctacaagagggaaggagccaaaagatgaagttcagatttacacatggaaggatgccacgctccgcgagctcactgatcttgtgaaagaggttgctctgccagcaaggaaaagaaatgcgaggctgtcttttgcttttgtgtacccagataaaaatggccggtttgttgttaaacaggtgggttcaaccttctcttatggtcatggaagaggggatgatgccaaatctcttgcagatctgggcttccagataggggattacttgagtgtttcgatccagtgagctcactttcatgcggaatagtgtgtatcaccgtagtttgtcatgctgtgataatgtaatatcttaatctgtgtgttcaaaggttctccttggtagtagggaattgcaaccagaactgcctgtaatactgtcaactttggaattaaattggcattttgaactc

SEQ ID NO: 1993 - DNA, 1371 bp, Brachypodium distachyon
ccctcctaactcctaaactgccgagcccatcccgtagcttcccccatacgtcccaaaatcccaagacttcttccagagacatccacgccgccggctactcttcttctcccccttcctaccctcgaagaatcatccatcgagcggcggccggcggcgagcggcagcagagcagagcagggggggaaaatctcgctttccgaggagagagatggcaggcatgggcgagatgcacatgaggccgcggccaggcccgcccatgcagcaccgtggcccgcccccgatggcgcgcgcccgccccgagcccatcgaccgcgagaagacctgccctcttttgctccgggtcttcacaaaggttggtgctcatcacctaaacgaagattttgctacaagagggaaggagccaaaagatgaagttcagatttacacatggaaggatgccacgctccgcgagctcactgatcttgtgaaagaggttgctctgccagcaaggaaaagaaatgcgaggctgtcttttgcttttgtgtacccagataaaaatggccggtttgttgttaaacaggtgggttcaaccttctcttatggtcatggaagaggggatgatgccaaatctcttgcagatctgggcttccagataggggattacttgagtgtttcgatccagtgagctcactttcatgcggaatagtgtgtatcaccgtagtttgtcatgctgtgataatgtaatatcttaatctgtgtgttcaaaggttctccttggtagtagggaattgcaaccagaactgcctgtaatactgtcaactttggaattaaattggcattttgaactccattaagtgtcattgcttgttatatgcatataggcttgttggagctgcgaaatcttaactatgttttttagcaagaatgcaggtaataagaaatattgaacataggcaggaatttgagacggaatttagccaagtatgagtagggttcgaaatgaactgtccttgttttgatggtccattacaatgacgtatctgattgaacacgaaatataaattcacttgcctatgatggccaaaatttggtacaaccagtagtggtccatgtaacacgatcagggcagtgatatttcagattcgatgtattgctgatacttgtgagcaatcttcatcagtaacgcctaacaccaaatttaccaaacaaactggatttgagcagctgagcgtgcaatctattcttgaaacgggatcacaataatcttgagtttcttgcataatggatcttcagagcaagaatacgaaggctgtttggcgatggaataactttcactccaggtttagcgctctttacttgtgtgagcagaattccgtaatgactgattcacta

SEQ ID NO: 1994 - DNA, 896 bp, Triticum aestivum
ccacaccccccaccaccccgtgaagaatccggcggcggacggcgggcggcgagcggcgagcggcagcggagcagagtcagtcagagcagggcggcggattctagctttccgaggagggagatggcaggcatgggcgagatgtcgatgaggccgcggccgggcccgccgatgcaccgcggcccgcctcccatggcgcgcccccgccccgaacccatcgaccgcgagaagacctgccctctcctgctccgggttttcaccaaggttggtggccatcacctaaatgaagagttttctgagagagggaaggagccaaaagatgaagttcagatttacacgtggaaggatgccacactccgggagctcactgatcttgtcaaagaggttgctcttccagcaaggaaaagaaacgctaggttatcttttgcttttgtatacccggataagaatggtcgttttgttgtcaaacaggtgggttcgaccttttcttatggtcatggaagaggggatgatgccaaatctcttggggatcttggcttccagataggtgattacttgagcgtgtcgatcatgtgagccgtgccatcttgcaaaatagtgtctgctgcacaccaagcagaatagtttttctgctgtgctattatcttgagctgtgcgtgcgtgggatgaagctctccttagtggtcgcctggtagggaactggaaccagaactgtctgtaatagtggcgacattcgaactagtatctgagacttgacacttgagacatttgatgtgattgattgctatgtacctgttctttgtggctgtcactctgaacgagagtactctttgaacctaatgtttccagaacatatgtaaacataagtgcggcgcagcacttttgagactgaatttacc

SEQ ID NO: 1995 - DNA, 1185 bp, Triticum aestivum
tccacgctgcggactcttccccccaaccttcatccacacccaccaccaccccgtgaagaatccggcggcggacggcggacggcgagcggcgagcggcagcggagcagagtcagtcagagcagggcggcggattctagctttccgaggagggagatggcaggcatgggcgagatgtcgatgaggccgcggccgggcccgccgatgcaccgcggcccgcctcccatggcgcgcccccgccccgaacccatcgaccgcgagaagacctgccctctcctgctccgggttttcaccaaggttggtggccatcacctaaatgaagaattttctgagagagggaaggagccaaaagatgaagttcagatttacacgtggaaggatgccacactccgggagctcactgatcttgtcaaagaggttgctcttccagcaaggaaaagaaacgctaggttatcttttgcttttgtatacccggataagaatggtcgttttgttgtcaaacaggtgggttcgaccttttcttatggtcatggaagaggggatgatgccaaatctcttggggatcttggcttccagataggtgattacttgagcgtgtcgatcatgtgagccgtgccatcttgcaaaatagtgtgcctgctgcacaccaagcagaatagttttcctgctgtgctattatcttgagctgtgcgtgcgagggatgaagctctccttagtggtcgcctggtagggaactggaaccagaactgtctgtaatagtggcgactttcgaactagtatttgagacttgacacttgagacatctgatgtgattgcttgctatgtacctgttctttgtggttgtcactctgaacgagagtactctttgaacctaatgtttccagcagaacatatgtaaacataggtgcggcgcagcacttttgagactgaatttaccaaataaatgatgagatatttagctaaatcaaagttgtacaatcgataccagtaacatctgatgcaactaaacatgataacttgttatatcagataatgagcattgcaatctaatttcctaggattatgtgaactcccatttctgcctagaaaaaagaacttatatcttggcactgaaaacaagttcccgggcattcttgctaatgatctaatataaactggtgttttgcaacaaagaaaaaaggacctggt

SEQ ID NO: 1996 - DNA, 1029 bp, Triticum aestivum
ccacacccaccaccaccccgtgaagaatccggcggcggacggcggacggagagcggcggcggagcagagtcagtcagagcagggcaggggattctaggttttcgaggagggagatggcgggcatgggcgagatgtcgatgaggccgcggccgggcccgccgatgcaccgcggcccgcctcccatggcgcgcccccgccccgaacccatcgaccgcgagaagacctgccctctcctgctgcgggttttcaccaaggttggtggccatcacctaaatgaagaattttccgagagagggaaggagccaaaagatgaagttcagatttacacgtggaaggatgccacactccgggagctcactgatcttgtcaaagaggttgctcttccagcaaggaaaagaaacgctaggttatcttttgcttttgtatacccggataagaatggtcgttttgttgtcaaacaggtgggttcgaccttttcttatggtcatggaagaggggatgatgccaaatctcttggggatcttggcttccagataggtgattacttgagcgtgtcgatcatgtgagccgtgccatcttgcaaaatagtgtgcctgctgcacaccaagcagaatagttttcctgctgtgctattatcttgagctgtgcgggcgagggatgaagctctccttagtggtcgcctggtagggaactggaaccagaactgtctgtaatagtggcaactttcgaactagtatttgagacttgacgcttgagacatctgatgtgattgcttcctgtgtacctgttctttgtggttgtcgctctgaacgagagtactctttgaactaatgtttccagcagaacatatgtaaacataggtgtggcgcagcacttttgagactgaatttaccgaataaatgatgagatatttagctaaaaaaaaaaaaaaaaagggcggcgctctaaagtttccccgaggggcccagcttacgcttacccgctttctggtacaaagtggcccctttaggggttggattatagcctaga

SEQ ID NO: 1997 - DNA, 913 bp, Avena sativa
ccacaccgcccctccccgcgaagaatccgaccgccgacggcgagccgcagcaaagaagagtccgtcagagccgagccggggggattctagcttccagaggagagagagagatggcgggcatgggggagatgccgatgaggccgcggccaggcccgccgatgcagcaccgcgggccgcctcccatggcgcgcgcccgccccgagcccatcgaccgcgagaagacctgccctctcctgctccgggttttcacaaaggttggtggacatcacctaaacgaagatttttctgaaagagggaaggagcctaaagacgaagttcagatttacacttggaaggatgccacactccgcgagctcactgatcttgtcaaggaggttgctctgccagcaaggagaagaaatgccaggctatcttttgcttttgtatacccggataagaatggtcgctttgttgtcaaacaggtgggttcaaccttttcttatggtggaagaggggatgatgccaaatctcttggggatctgggcttccagataggtgattacttgagcgtttcaatccagtgagtggcaccgtcgtgcagagtagtttttcctgctgtgttatctgaaagctgtgtgtgcgagggatgaaacccttagtagtactagggatttggaaccataacttgtctgtaatagtggcaactctcgggttaatgtttcgaacagtcaaggcagtacaatgtgattgcttattgtgtacctgttatttgtcggtcacttttaaacgagagtactctttgaactatgtttccagcagaacattggtcgaaagagtatttatgagatgcaggatataaaccgtcttggagtggagtgggtgttgcttcctgtaaaacttttgttccaccttctataaatctatggtatgcggt

SEQ ID NO: 1998 - DNA, 980 bp, Avena sativa
attttgggatggtgtgaaagcaactaaatggtcggaaagaagggatgctgtggcagagctgactaagccacaccgcccctccccgcgaagaatccgaccgccgacggcgagccgcagcaaagaagagtccgtcagagccgagccggggggattctagcttccagaggagagagagagatggcgggcatgggggagatgccgatgaggccgcggccaggcccgccgatgcagcaccgcgggccgcctcccatggcgcgcgcccgccccgagcccatcgaccgcgagaagacctgccctctcctgctccgggttttcacaaaggttggtggacatcacctaaacgaagatttttctgaaagagggaaggagcctaaagacgaagttcagatttacacttggaaggatgccacactccgcgagctcactgatcttgtcaaggaggttgctcttccagcaaggagaagaaatgccaggctatcttttgcttttgtatacccggataagaatggtcgctttgttgtcaaacaggtgggttcaaccttttcttatggtggaagaggggatgatgccaaatctcttggggatctgggcttccagataggtgattacttgagcgtttcaatccagtgagtggcaccgtcgtgcagagtagtttttcctgctgtgttatctgaaagctgtgtgtgcgagggatgaaaccctcagtagtactagggatttggaaccataacttgtctgtaatagtggcaactctcgggttaatgtttcgaacagtcaaggcagtacaatgtgattgcttattgtgtacctgttatttgtcggtcacttttaaacgagggtactctttgaactatgtttccagcagaaaattggtcgaaagagtatttatgagatgcaggatataaaccgtcttggagtggagtgggtgttgcttcctgtaaaacttttgttccaccttctataaatctatggtatgcggt

SEQ ID NO: 1999 - DNA, 851 bp, Secale cereale
aaaagtttagggtttcttccagaggcatccacgctgcggactcttccccccacctccatccacacccaccaccccgtgaagactccggcggcggacggcggacggcgagcggcggcggagcagagcatctaggtttccgaggagggagatggccggcatgggcgatatgcagatgaggccgcggccgatgcaccgcggcccgcctcccatggcgcggccccgccccgaacccatcgaccgcgagaagacctgccctctcctgctccgggttttcaccaaggttggtggccatcacctaaacgaagagttttctgagagagggaaggagccaaaagatgaagttcagatttacacgtggaaggatgccacactacgggagctcactgatcttgtcaaagaggttgctcttccagcaaggaagagaaatgctaggttatcttttgcttttgtatacccggataagaatggtcgttttgttgtcaaacaggtgggttcgaccttttcttatggtcatggaagaggggatgacgccaaatctctcggggatcttggcttccagataggtgattacttgagcgtgtcgatcatgtgaggttgcaaaatagtgcacaccaagcagaatagtttctcctgctgtgctattatcttgagctgtgcgtgtgagaccctccttggtagtagggtgctggaaccagaagtgtctgtaattgtggaactagtatttgagaatttacacttgagacatgtgatgtgtttgcttgctatgtacctgttgtttgtgcttgtcactttgaacgagactagtctttcaacctaatgtttccagcaaaacatgcttttatattattagt

SEQ ID NO: 2000 - DNA, 881 bp, Secale cereale
gactaaccacaaaagtttagggtttcttccagactccagagacatccacgccgcggactcgttccccccacctccatccacacccaccaccccgtgaagactccggcggcggacggcggacggcgagcggcggcggagcagggtcagtcagaacatctaggtttccgaggagggagatggcaggcatgggcgatatgcagatgaggccgcggccgatgcaccgcggcccgcctcccatggcgcgcccccgccccgaacccatcgaccgcgagaagacctgccccctcctgctccgggttttcaccaaggttggtggccatcacctaaatgaagaattttctgagagagggaaggagccaaaagatgaagttcagatttacacatggaaggatgccacactccgggagctcactgatcttgtcaaagaggttgctcttccagcaaggaaaagaaacgctaggttatcttttgcttttgtatacccggataagaatggtcgttttgttgtcaaacaggtgggttcgaccttttcttatggtcatggaagaggggatgacgccaaatctctcggggatcttggcttccagataggtgattacttgagcgtgtcgatcatgtgaggttgcaaaatagtgcacaccaagcagaatagtttctcctgctgtgctattatcttgagctgtgcgtgtgagaccctccttggtagtagggtgctggaaccagaagtgtctgtaattgtggaactagtatttgagaatttacacttgagacatgtgatgtgtttgcttgctatgtacctgttgtttgtgcttgtcactttgaacgagactagtctttcaacctaatgtttccagcaaaacatgcttttatattattatggg

SEQ ID NO: 2001 - DNA, 621 bp, Secale cereale
aaaccacaaaagtttagggtttcttccaggctccagagacatccacgctgcggactcttccccccacctctccctcatccacacccaccaccccgtgaagactccggcggcggacggcggacggcgagcggcggcggagcagggtttctaggtttccgaggagggagatggcagggatgggcgatatgcagatgaggccgcggccgatgcaccgcggcccgcctcccatggcgcggccccgccccgaacccatcgaccgcgagaagacctgccctctcctgctccgggttttcaccaaggttggtggccatcacctaaacgaagagttttctgagagagggaaggagccaaaagatgaagttcagatttacacgtggaaggatgccacactacgggagctcactgatcttgtcaaagaggttgctcttccagcaaggaagagaaatgctaggttatcttttgcttttgtatacccggataagaatggtcgttttgttgtcaaacaggtgggttcgaccttttcttatggtcatggaagaggggatgacgccaaatctctcggggatcttggcttccagataggtgattacttgagcgtgtcgatcatgtgaggttgcaaaa

SEQ ID NO: 2002 - DNA, 849 bp, Secale cereale
ggtagcaaacctacaaagtttagggtttcttccaggctcgagagacatccacgctgcggactcttcccccacctctccctcatccacacccgaccaccccgcgaagaatccggcggcggacggcgagcggcggcggagcaggtttccgaggagggagatggccggcatgggcgatatgcagatgaggccgcggccgatgcaccgcggcccgcctcccatggcgcgcccccgccccgaacccatcgaccgcgagaagacctgccccctcctgctccgggttttcaccaaggttggtggccatcacctaaatgaagaattttctgagagagggaaggagccaaaagatgaagttcagatttacacatggaaggatgccacactccgggagctcactgatcttgtcaaagaggttgctcttccagcaaggaaaagaaacgctaggttatcttttgcttttgtatacccggataagaatggtcgttttgttgtcaaacaggtgggttcgaccttttcttatggtcatggaagaggggatgacgccaaatctctcggggatcttggcttccagataggtgattacttgagcgtgtcgatcatgtgaggttgcaaaatagtgcacaccaagcagaatagtttctcctgctgtgcttcacatgataagatcttgagctgtgcgtgtgagaccctccttggtagtagggtgctggaaccagaagtgtctgtaattgtggaactagtatttgagaatttacacttgagacatgtgatgtgtttgcttgctatgtacctgttgtttgtgcttgtcactttgaacgagactagtctttcaacctaatgtttccagcaaaa

SEQ ID NO: 2003 - DNA, 1852 bp, Panicum virgatum
cctccagctccacctcgtctcccaccaccgccgcgcgtgagccctagcccgatctcaccggcgctgcgccccagatcccgccgcccgcgccgccccgggacgcgccccgccggattcgccgctcctcgcgctgcagcaggcccggaccggaccaggcaaagaaggctaatctggaggcatagcgtaattcaccttggttggaggttgctgtgtggcatgtagtgttgcagtattggtggaggctgtcatcacaaggcatatgttgttgtgatttgccgatggcaaggagatgaaacaggtgtggcagcggagcagcaaggacatgacagccatgccccctctgcgccaccgaggcgctgctaagaagcccatgtggatcatcgtgctattgtcgttggtttgcgttgcgcttatgggggcctatgtctacccaccacggcgctactcagcatgctacttctttgcttcaagtgtctgtactccattcaaggattggctacctaatgttgctcgggagaaaactgatgaagagattatttcggcagtggttattagggacctcctttcgatgcccatgcctgtgtccaaacatcctaagattgcctttatgttcctgacaccaggatcattgccttttgagaaattgtgggagaaatttttacagggtcatgatgggcgatattctatctatatccacgcgtctcgtgagaaaccagtacattccagctccctatttgttggtcgtgaaattcacagtgaaaaggtagtatgggggaggatttcgatggttgatgcagagaagaggctgttagcaaatgcattggaagatgttgataatcagttttttgtcttgctttctgacagctgtgttccactgcatacattcgattacatatataattatctgatgggaacaaatgtcagcttcattgattgcttcctagatcctggcccgcatggaactgggaaggtattccatggaaatgcttcctgaaatagaacagagggacttcaggaagggtgcccagtggtttgctataacacgaaggcatgctttgctgattctggcagacaacctttactacaataagttcaagctatattgcaagccagcagagggacgcaactgtatcgctgatgagcattatttgccaaccctcttcaacatggtagatcctggtggaattgctaattggtcagtgactcatgttgattggtcagagggaaaatggcatccaaggtcatatagagctgcagatgttacctatgaacttttaaagaacataacgtctgtcaatgaaaatttccacattacaagtgatgataagaaagttgtgacggtgaccccatgtatgtggaatggaacaaaaagaccgtgctacctttttgctagaaagttttacccagaagctcagaacaacctattgaagctattctccagtcatacagccgcttgagttctacatgattttttgcctttggcctaggagattcccctaggattttgttttctgtttcatgtaaattgtgaaattgatacttagcggcttaacagagtcacagatccagggccagagacatcttgtaattctgagttccttggtagggttgaggtgctctttgtttagtattgacactgccctccctgtaattcgtggtgccctctgtatgtttctattagcccttcacctttctccccctccctcatattcttagattcctggcgcccattgcctgagtaacagggttttgttcagttcaaactgttattatacaattaattctttgtagacacgaaatgcttatgaaatgagttacactttatagtttaatcctgttttgttatgagttt

SEQ ID NO: 2004 - DNA, 2069 bp, Zea mays
tatgtttatattcaacatcatctagttgaatatatacataaaaatcaaagagccaaaacgattcacgtagtattacattttcatgcgaatgctaatacgaacgatcatgataaaaagggaaaaaaatctaaagtctaacaatccgataaaaaagaccgtgtgtaagtgtaacccatccgtggggactagccataagctcatacgccttttaacagaatagttaaatccactccgccattaattaacctctctccttcctcgccccttcccctccacgactccactaccaccaccttcaccttgtctcccacaaccgccgcgcgcaagccctagcccgatctcgccggcgacagacaccagatctcgccgcccgttgcgcgccgatacgcgccccgccggattcaccgctcctcgcgctgcagcacgcccgggcctgggttactgcgtgacatgtagtattgtataattggaggttgtcaccatcaccacaaagcatatgttgtgatttgtcgatggcgaggagatgaaacaggtgtaggggcggagcagcaaggacatgacagccatgccgcatccgcgccaccgaggcgctgctaagaagcccatgtggatcatagtgctattgtctttggtttgtgttgcacttatgggggcctatgtctacccaccacggcgctactccgcatgctacttctttgcttcgagtgtctgtactccgttcaaggattggctacctgctgttgctcgtgagcgaactgatgaagagatagtttcatcggtggttattagggatcttctttcaatgcctatggctatgtcaaagaacccaaagattgcctttatgttcttgacaccgggttcattgccttttgagaagttgtgggagaaatttttacagggtcatgatggccgatattctatctatatccatgcatctcgtgaaaaacctgtacattctagctctctttttgttgggcgtgaaattcacagtgaaaaggtagtatgggggaggatttcaatggttgatgcagagaagaggctgttaggaaatgcattggaagatgttgataatcaatttttcgtcttgctttctgacagctgtgttccactacatacatttgattacatatataattatctgatgggaaccaatgtcagtttcattgattgcttcttcgatcctggcccacatggaactggaaggtatacgatggaaatgcttcctgaaatagaacagagggacttcaggaagggtgcccagtggtttgctataacacgaaggcatgctttattgattctggcagacaacctttactacaataagttcaagctgtactgcaagccagcagaaggacgcaactgtattgctgatgagcattatttgccaaccctcttcaatatggttgaccctggtggaatagctaactggtcagtgactcatgttgattggtccgagggaaaatggcatccaaggtcatatagagctgcagatgttacatatcaactcttaaagaacataacgtctgtcaatgagaatgttcacattacaagtgatgataaaaaagttgtgacacagaccccatgtatgtggaatggaacaaaaagaccctgctatctttttgctagaaagttttacccagaatctttgaacaacctgctgaagctattctccagttacacatcggcttgagttctacatgattcttttggcattttgcctaggagattcctctaggatttatctttttgtgcttcatgtaaattgtggaattgatacttagaggcttaacagagttacagatccagggccttgatgtaattctgagtcccttggtagggctgaggtgatgtttgtttattattgacgctgccctccctgtcattcgtggtgctctctgtatgactatgtttcttttagcccttcacttttttctcttctcttttattcttagattcctagctcccatattctgagtaacaggggttttgtcagttcttactgttattataagattatttttttgtagacacgaagatattatgaaatcagttacactaatagtttaacc

SEQ ID NO: 2005 - DNA, 1664 bp, Pennisetum glaucum
ttcgccgctcctctcgccgcggcgcgccctgaccggaccaggcaattcatcctggctggaggttcctgcgtggtatgtagtgttgcagtatcggtggaggctgtcatcactaggcgtatatcgttatgatttggtgatggcaaggagatgaaacaggtgtggcagcggagcagcaaggacatgacagccatgcctcctacgcgccaccgaggcgctgctaagaagcccatgtggatcatcgtgctattgctgttggtttgcgttgcacttatgggggcctacgtctacccaccacggcgctactctgcatgctacttctttgcttcgagtgtctgtactccattcaaggattggctacctaatgttgctcgggagaggactgatgaagagattgtttcatctgtggttactagggacctcctttcaatgcctatgcctgtgtcaaaaaatccaaagattgcctttatgttcctgacaccaggttcattgccttttgagaaattatgggagaaatttttacagggtcatgatgggcgatattccatctatatccacgcatctcgtgagaaacctgtacattcgagctctctgtttgttggccgtgaaattcgcagtgaaaaggtggtatgggggaggatttcaatggttgatgcagagaagaggctattagcaaatgcattggaagatgttgataatcaatttttcgtcttgctttctgacagctgtgttccactacataaatttgattacatgtataattatctgatgggaacaaatgtcagcttcattgattgcttcctagatcctggcccgcatggaactggaaggtattccatggaaatgcttcctgaaatagaacagagggacttcaggaagggtgcccagtggtttgctataacacgaaggcatgctttactgattctggcagacaacctttactacaacaagttcaagctatactgcaagccagcagagggacgcaactgtattgctgatgagcattatttgccaaccctcttcaacatggtggatcctggtgggattgccaactggtcggtgactcatgttgattggtctgagggaaaatggcatccaaggtcatatagagctgcagatgttacctatgaactcttaaagaacataacgtctgtcaatgagagtttccgcattacaagtgatgataagaaagttgcgacggtgaccccatgtgtgtggaatggaacaaaaagaccatgctacctttttgctagaaagttttacccagaaactctgaacaacctattgaagctgttctccagttacacatagcttgagttctaaatgattttttgcctttggcctaggagattcacctaggatttctttccttttttctctctgtttcgtgtaaattgtgaaattgatacttagcggcttaacacagagtcacagatccagggccagagaagtcttgtaattctgagtcccttggtagggctaaggtgctctctgtttagtgacactgccctccctgtaattcgtggtgccctctgtatgtttctgttagcccttcacttcaccttcacctcctctctcatattcttagattcctagctaccatttcctgagtaacagggattttgtcagcatgaactgttattatatgattaattcttttgtagaca

SEQ ID NO: 2006 - DNA, 1943 bp, Setaria italica
cccactgcttaaatccctctccttcctctccccttcgcctccaccacctccagctccacctcgtctcccaccaccgccgcgcgcgagccctagcccgatctcgccggcaccacgcctcagatcccgccgcccgtgccgcccagggacgcgcgccgccggattcgccgctcctcgcgccgcagcgcgccctgaccggaccaggcaaagaaggcaactctggaggcatagcacaattcatcctggctggaggttcctgcgtggcatgcagtattgcagtactggtggaggctgtcatcacaaggcatatattgttgtgatttggcgatggcaaggagatgaaacaggtgtggcagcggagcagcaaggacatgacagccatgccccctccgcgccaccgaggcgctgctaagaagcccatgtggatcatcgtgctattgtcgttggtttgcgttgcacttatgggggcctacgtctacccaccacggcgctactctgcatgctacttctttgcttcaagtgtctgtactccgttcaaggattggctacctaatgttgctcgggagagaactgatgaagagattgtttcatctgtggttaatagggacctcctttcaatgcctatgcctgtgtcaaaaaatccaaagattgcctttatgttcttgacaccaggttcattgccttttgagaaattatgggagaaatttttacagggtcacgatgggcgatattccatctatatccacgcatctcgtgagaaacctgtacattctagctctctgtttgttggccgtgaaattcgcagtgaaaaggtagtatgggggaggatttcaatggttgatgcagagaagaggctattagcaaatgcattggaagatgttgataatcaatttttcatcttgctttctgacagctgtgttccactacatacatttgattacatatataattatctgatgggaaccaatgtcagcttcattgattgtttcctagatcctggcccgcatggaactggaaggtattccacggaaatgcttcctgaaatagaacagagggacttcaggaagggtgcccagtggtttgctataacacgaaggcatgctttactgattctggcagacaacctttactacaataagttcaagctatattgcaagccagcagagggacgcaactgtattgctgatgagcattatttgccaaccctcttcaatatggtggatcctggtggaattgccaactggtcacttactcatgttgattggtctgagggaaaatggcatccaaggtcatatagggctgcagatgttacctatgaactcttaaagaacataacgtctgtcagtgagaatttccacattacaagtgatgataagaaagttgcgactgtggccccatgtatgtggaacggaacaaaaagaccgtgctacctttttgctagaaagttttacccagaaactctgaacaacctattgaagctattctccagttacacatcagcttgagttctacatgattttttgtctttggcctaggagattcacctaggatttctttccttttttctctctctgtttcatgtaaattgtgaaattgatacttagcggcttaacacagagtcacagatccagggccagagacatcttgtaattctgagtcccttggtagggctgaggtgctctttgtttagtattgacactgccctccctgtaattcgtggtgccctctgtatgtttctgttagcccttcacttcacctttcacctcctctctcatattcttagattcctagctaccatttcctgagtaacaggggttttgtcagcacgaactgttattatatgattaattcttttgtagacaccaagtgattatgaaatgagttacactttatagtttaatcctgtcttgttttgagtttccatgacacttttaccattctggcat

SEQ ID NO: 2007 - DNA, 1886 bp, Setaria italica
cacgtcctctccttcctctccccttcgcctccaccacctccagctccacctcgtctcccaccaccgccgcgcgcgagccctagcccgatctcgccggcaccacgcctcagatcccgccgcccgcgccgcccagggacgcgcgccgccggattcgccgctcctcgcgccgcagcgcgccctgaccggaccaggcaaagaaggcaactctggaggcatagcacaattcatcctggctggaggttcctgcgtggcatgcagtattgcagtactggtggaggctgtcatcacaaggcatatattgttgtgatttggcgatggcaaggagatgaaacaggtgtggcagcggagcagcaaggacatgacagccatgccccctccgcgccaccgaggcgctgctaagaagcccatgtggatcatcgtgctattgtcgttggtttgcgttgcacttatgggggcctacgtctacccaccacggcgctactctgcatgctacttctttgcttcaagtgtctgtactccgttcaaggattggctacctaatgttgctcgggagagaactgatgaagagattgtttcatctgtggttaatagggacctcctttcaatgcctatgcctgtgtcaaaaaatccaaagattgcctttatgttcttgacaccaggttcattgccttttgagaaattatgggagaaatttttacagggtcacgatgggcgatattccatctatatccacgcatctcgtgagaaacctgtacattctagctctctgtttgttggccgtgaaattcgcagtgaaaaggtagtatgggggaggatttcaatggttgatgcagagaagaggctattagcaaatgcattggaagatgttgataatcaatttttcatcttgctttctgacagctgtgttccactacatacatttgattacatatataattatctgatgggaaccaatgtcagcttcattgattgtttcctagatcctggcccgcatggaactggaaggtattccacggaaatgcttcctgaaatagaacagagggacttcaggaagggtgcccagtggtttgctataacacgaaggcatgctttactgattctggcagacaacctttactacaataagttcaagctatattgcaagccagcagagggacgcaactgtattgctgatgagcattatttgccaaccctcttcaatatggtggatcctggtggaattgccaactggtcacttactcatgttgattggtctgagggaaaatggcatccaaggtcatatagggctgcagatgttacctatgaactcttaaagaacataacgtctgtcagtgagaatttccacattacaagtgatgataagaaagttgtgacggtggccccatgtatgtggaacggaacaaaaagaccgtgctacctttttgctagaaagttttacccagaaactctgaacaacctattgaagctattctccagttacacatcagcttgagttctacatgattttttgtctttggcctaggagattcacctaggatttctttccttttttctctctctgtttcatgtaaattgtgaaattgatacttagcggcttaacacagagtcacagatccagggccagagacatcttgtaattctgagtcccttggtagggctgaggtgctctttgtttagtattgacactgccctccctgtaattcgtggtgccctctgtatgtttctgttagcccttcacttcacctttcacctcctctctcatattcttagattcctagctaccatttcctgagtaacaggggttttgtcagcacgaactgttattatatgattaattcttttttaaactataaagtgtaactcatttcataatcacttggtgtcta

SEQ ID NO: 2008 - DNA, 1830 bp, Zea mays
tctctccttcctctcacattccactagaacactcccaccaggccaccacctccacctcgtcgtctcccaccaccgccgcgcgcgagccctagcccgatctagccggcggcaggcactagatcccgccgcttgcggcatcccgggacgcgcctcgccgaattcgccgctcctcgcactgcaacacgcccggaccactgttactgcatgccatgtagtattttattattggtggaggttgtcaccacaagacatatgttgtgatttctcgatggcgaggagatgaaacaggtgtgggggcggagcagcaaggacatgacaaccatgccccctccgcgccaccgtggcgctgctaagaagcccatgtggatcatagtgctattgtcgttggtttgtgttgcccttatgggggcctatgtctacccaccacggcactactctgcatgctacttctttgcttcgagtgtctgtaccccgttcaaggattggctacctgctgttgttcgggagcgaactgatgaagagatagtgtcatccgtggttattaggaatctcctttcgatgcctatggctgtgtcgaagaacccaaagattgcctttatgttcttgacaccaggttcattgccttttgagaagttgtgggaggaatttttacagggtcatgatggtcgatattccatctatatccatgcatctcgtgaaatacctgtacattctagctccctctttgttggacgtgaaattcgcagtgaaaaggtagtatgggggaggatttcgatggttgatgcagagaagaggctgttagcaaatgcattggaagatgtcgataatcaattttttgtcttgctttctgacagctgtgttccagtacatacatttgattacatatataattatctgatgggaacaaatgtcagcttcattgattgcttcctggatcctggcccacatggaactggaaggtattccatggaaatgcttcctgaaatagaacagagggacttcaggaagggtgcccagtggtttgctataacacgaaggcatgctttattgattctggctgacaacctttactacaataagttcaagctgtactgcaagccagcagagggacgcaactgtattgctgatgagcattatttgccaaccttcttcaatatggtcgatcctggtggaatagctaactggtcagtgactcatgttgattggtccgagggaaaatggcatccaaggtcatatagagctgcagatgttacctatgaactcttaaagaacataacgtctgtcaatgagaatttccgcattacaagtgatgataagaaagttgtgacacggatcccatgtatgtggaatggaacaaaaagaccatgctacctttttgctagaaagttctacccagaatctctgaacaacttgctgaagctattttccagttacacatcggcttgattcaacattttttttgttcatttggcctaggagattcccctagttttttttttctgcttcatgtaaattgtgaaattgatacttagaggcttaacacagagttacgggtacagggccagtgatgtaattctgtgagtcccttggtagggctgaggtgctgtttgtttagtattgacctgccctccctgtcgttcttggtgccgtctgttaggttcctagcgcccattccctgagtaacagggtttttgtcagttattactgattaattctttgtagacatgaagagattacgaaatcagttacacttcatagtttaacctggacttgtttcgagttctagtggcagttgtactcttctgatgagtacggcatcatgttctcatt

SEQ ID NO: 2009 - DNA, 2100 bp, Oryza sativa
cataaaaatccctgcaataaccacattctcctatgttgttttgtgcacaaacacaatggatcaatattgccatgtgaaagaatatctgggcagtcaataaaaaaaatgtatacactactatagcacatcagatgatctgaccaagaggagaagaagaagagagaggatcccaaccccaccacctctcctcctcctcctctctctctctccgatctgcctcgccgccgccgcggctgctcttctcctctcgcctcgcctcgtgcgcgcggcgagttcgacctcctcctcctcctctccgagcccccgcctcccctggctgcgggcggggggtttcgagggggtggacgcggcctccgtgtcggcttcggctcggatcgaattcaaagaagaggttggaaaccttggtggtgtagttagtgccaccgcccctgtctggagtggcatgtagttttcgcaaggctttgtttatgattttgtcgatggcgaggagatgaaggcatcgcaggtgtggcaacggggcagcaaggacatgacagccatgccccctccgcgccaacgaggcgccgccaagaagcccatgtggataatcgtgctgctgtcgctggtgtgcgtcgcgctcatcggggcctacgcgtaccctccgcgccgctactccgcgtgctacttcttcgcttcgagcgtctgcactcctttcaaggattggctccctactgtgacccgacgggagcgaacagacgaagagatcgtctcgtctgttgttatgagggatctccttgcaatgcccatgcctgtctcgaagaatccaaagattgccttgatgttcttaacaccaggttcattgccctttgagaaactatgggagaaatttctacagggtcatgaggatcgatattccatttatatccatgcatcgcgtgaaagacctgtacattctagttctttgtttgttggccgagagattcatagtgaaaaggttgtatgggggaggatttcaatggttgatgcggagaagaggctgctagcaaatgcattggaagatgttgataatcaatttttcgtcttgctatcggacagctgtgttccactacatacatttgattacatatataattttttgatgggaacaaacgtcagcttcattgattgcttccttgatcctggaccacatggaagcggaaggtattctgtggaaatgctccctgaaatagaacagagggacttcaggaagggtgcccagtggtttgctgtaacacgaaggcatgctttactgattttagcagaccacctttactacaataagttcgagctgtattgcaagccagcagagggacgcaactgtattgctgatgagcattatttgccaaccctcttcaatatggtagatcctggtggaatctctaattggtcagtgacacatgttgattggtctgaaggaaaatggcatccaaggtcgtatagagctattgatgttacctatgcactcttgaagaacataacggctatcaaagagaacttccgtattacaagtgatgataagaaagttgtgacaatgacaccctgtatgtggaacggaacaaagagaccatgctacctttttgctagaaagttttacccagaagctctcaacaacctactgaagcactccagctacacgtccacttgagctctacacgattctttgcttttggcctaggaattccctaggatttatttcttcttctattttatgtaaattgtgaaattgatatttagctgcgtaacacagattcagggccagagacatatcaacgttgctgcggcaatggcgatgtcttgcaaattctgagtccctaggtagggctgaggcgatatttatttagttttgatacagccctcattgtaacatgttgtgcttttttgtatgttgctatgagctgctcttcacgcccacattttctctcttttctttctagtttcctagctcctcccatctgttgaggaataggcgtttttgtcagattggaactgttattatatgatccattctttgtagacatgaagagattattatgacaccagcacaaccttacagttaatctgccctcttgagttttgtttaca

SEQ ID NO: 2010 - DNA, 1997 bp, Oryza sativa
gtatacactactatagcacatcagatgatctgaccaagaggagaagaagaagagagaggatcccaaccccaccacctctcctcctcctcctctctctctctccgatctgcctcgccgccgccgcggctgctcttctcctctcgcctcgcctcgtgcgcgcggcgagttcgacctcctcctcctcctctccgagcccccgcctcccctggctgcgggcggggggtttcgagggggtggacgcggcctccgtgtcggcttcggctcggatcgaattcaaagaagaggttggaaaccttggtggtgtagttagtgccaccgcccctgtctggagtggcatgtagttttcgcaaggctttgtttatgattttgtcgatggcgaggagatgaaggcatcgcaggtgtggcaacggggcagcaaggacatgacagccatgccccctccgcgccaacgaggcgccgccaagaagcccatgtggataatcgtgctgctgtcgctggtgtgcgtcgcgctcatcggggcctacgcgtaccctccgcgccgctactccgcgtgctacttcttcgcttcgagcgtctgcactcctttcaaggattggctccctactgtgacccgacgggagcgaacagacgaagagatcgtctcgtctgttgttatgagggatctccttgcaatgcccatgcctgtctcgaagaatccaaagattgccttgatgttcttaacaccaggttcattgccctttgagaaactatgggagaaatttctacagggtcatgaggatcgatattccatttatatccatgcatcgcgtgaaagacctgtacattctagttctttgtttgttggccgagagattcatagtgaaaaggttgtatgggggaggatttcaatggttgatgcggagaagaggctgctagcaaatgcattggaagatgttgataatcaatttttcgtcttgctatcggacagctgtgttccactacatacatttgattacatatataattttttgatgggaacaaacgtcagcttcattgattgcttccttgatcctggaccacatggaagcggaaggtattctgtggaaatgctccctgaaatagaacagagggacttcaggaagggtgcccagtggtttgctgtaacacgaaggcatgctttactgattttagcagaccacctttactacaataagttcgagctgtattgcaagccagcagagggacgcaactgtattgctgatgagcattatttgccaaccctcttcaatatggtagatcctggtggaatctctaattggtcagtgacacatgttgattggtctgaaggaaaatggcatccaaggtcgtatagagctattgatgttacctatgcactcttgaagaacataacggctatcaaagagaacttccgtattacaagtgatgataagaaagttgtgacaatgacaccctgtatgtggaacggaacaaagagaccatgctacctttttgctagaaagttttacccagaagctctcaacaacctactgaagcactccagctacacgtccacttgagctctacacgattctttgcttttggcctaggaattccctaggatttatttcttcttctattttatgtaaattgtgaaattgatatttagctgcgtaacacagattcagggccagagacatatcaacgttgctgcggcaatggcgatgtcttgcaaattctgagtccctaggtagggctgaggcgatatttatttagttttgatacagccctcattgtaacatgttgtgcttttttgtatgttgctatgagctgctcttcacgcccacattttctctcttttctttctagtttcctagctcctcccatctgttgaggaataggcgtttttgtcagattggaactgttattatatgatccattctttgtagacatgaagagattattatgacaccagcacaaccttacagttaatctgccctcttgagttttgtttacacata

SEQ ID NO: 2011 - DNA, 1610 bp, Brachypodium distachyon
gaattatatgcacaggatatgatgccaatactgtgctcttgatttgatgatggcaaggagatgaaagtgtccaaggtgtggccgcggagcagcaaggacatgacagccatgccacctccgcgccaccgtggcgctgccaagaagccaatgtggataattgtgctgttgtcaatggtctgtgtttcgttgattggggcctatgtgtatcctccacggcgctactccgcgtgctacttcttcgcttcaagtgtttgtactccatttaaggattggctcccagcggtaacccggcgggagaagacagacggagagatcatttcatctgtggttatgagggatctactttcaatgcctatgcctgtgtcaaagaagccaaagatcgcttttatgttcttgacaccaggttcattgccctttgagaaattgtgggagaaatttttacaggaccacgagggacggtattccatttatatccatgcgtcacgtgaaaaacctgtgcattctagttctctgtttgtgaaccgagaaattcacagtgaaagggtagtatgggggagggtttcaatggttgatgcagagaagaggctgttagcaaatgcgttggaagatgttgataatcaatttttcgtcttgctttctgacagctgtgttccactacatagattcgattatatatataattatctgatgggaacaaatgttagcttcattgatagcttcctggatcctggtcctcatggaactggaaggtattccatggaaatgcttcctgaaatagaacaaagggacttcaggaagggtgcccagtggtttgctataaaaagaaggcatgctttactgattctagcagacagcctttactacagaaagttcaagctatattgcaagccagcagagggacggaactgtattgctgatgaacattatcttccaacgctattcaaaatggtagatcctggtggaatctctaattggtcagtgacacatgttgactggtctgagggaaaatggcatcctaggtcatatagagctgcagatattacctatgaactcttaaagaacataacgtctttcgatgagaacttgcacattacgagtgatgatacgaaagctgtgacaatgactccatgtatattgaacggaacaaaaagaccatgcttcctttttgcaagaaaattttacccagaagctctcaacaacctattaaagctattttccagttacacgtctgcttgaactctacactattctttgccattggcctaggattccctaggatttttctgttttatgtaaattgtgaaattgatacttagctgcttaacacagatccggggtcagaaacatgttgttgctgcctcaatagtgatgtcctgtcattcaggttccctaggtagggctgaggtgctatatgtttagtactgacactgccctcattgtaatccgttgtgccttctgtatgtttctcttagtcatttttgtcttcttttttccttattagtttcctagctcccatctctcaaggaacaggggttttgtcaaagttgagctgttattatatgatccgttcttttttggacccagattatgaaatgagcatcaccttatag

SEQ ID NO: 2012 - DNA, 1923 bp, Brachypodium distachyon
ccctctctccccacttccaccgtcaccaccacctcgcatagtcctagtcccaccaccacctccggaggagccactcgccaccgccccgcgtgagccctagctccgatctcgccggcgccgggccccagatcccacctcgcgcctctcacgtacccccgcagcccgcagacgaggcgcgcaccgctcgacgctccgccttccgtgccgtgcgtgaaggtggcagctttgggggtgtagcgctattcaccctttttgataagtgccatgtagttttcgccttctgaattatatgcacaggatatgatgccaatactgtgctcttgatttgatgatggcaaggagatgaaagtgtccaaggtgtggccgcggagcagcaaggacatgacagccatgccacctccgcgccaccgtggcgctgccaagaagccaatgtggataattgtgctgttgtcaatggtctgtgtttcgttgattggggcctatgtgtatcctccacggcgctactccgcgtgctacttcttcgcttcaagtgtttgtactccatttaaggattggctcccagcggtaacccggcgggagaagacagacggagagatcatttcatctgtggttatgagggatctactttcaatgcctatgcctgtgtcaaagaagccaaagatcgcttttatgttcttgacaccaggttcattgccctttgagaaattgtgggagaaatttttacaggaccacgagggacggtattccatttatatccatgcgtcacgtgaaaaacctgtgcattctagttctctgtttgtgaaccgagaaattcacagtgaaagggtagtatgggggagggtttcaatggttgatgcagagaagaggctgttagcaaatgcgttggaagatgttgataatcaatttttcgtcttgctttctgacagctgtgttccactacatagattcgattatatatataattatctgatgggaacaaatgttagcttcattgatagcttcctggatcctggtcctcatggaactggaaggtattccatggaaatgcttcctgaaatagaacaaagggacttcaggaagggtgcccagtggtttgctataaaaagaaggcatgctttactgattctagcagacagcctttactacagaaagttcaagctatattgcaagccagcagagggacggaactgtattgctgatgaacattatcttccaacgctattcaaaatggtagatcctggtggaatctctaattggtcagtgacacatgttgactggtctgagggaaaatggcatcctaggtcatatagagctgcagatattacctatgaactcttaaagaacataacgtctttcgatgagaacttgcacattacgagtgatgatacgaaagctgtgacaatgactccatgtatattgaacggaacaaaaagaccatgcttcctttttgcaagaaaattttacccagaagctctcaacaacctattaaagctattttccagttacacgtctgcttgaactctacactattctttgccattggcctaggattccctaggatttttctgttttatgtaaattgtgaaattgatacttagctgcttaacacagatccggggtcagaaacatgttgttgctgcctcaatagtgatgtcctgtcattcaggttccctaggtagggctgaggtgctatatgtttagtactgacactgccctcattgtaatccgttgtgccttctgtatgtttctcttagtcatttttgtcttcttttttccttattagtttcctagctcccatctctcaaggaacaggggttttgtcaaagttgagctgttattatatgatccgttcttttttggacccagattatgaaatgagcatcaccttatagtttaatcagctcgtcttgagttttgcaggca

SEQ ID NO: 2013 - DNA, 1755 bp, Hordeum vulgare
tcttgcgtcagcgctgtgcttaccttgtgtgttgtaaatgcaggggaaggggtgacgagacagctgcctgtggtgtagcagcggccttcccaccgaaaaataacccgagctttcagatgatccaaagatggtgaggagctgagagtacctagagattggcagtgggggctgtggggcagcaaggacatgactgtcatgccacctgcgcgccatcggcccgcggccaagagacccatgtggataatcgtgctcttgtgcctcgtctgcgtcgtgctgatcggggcgtacgtgtacccgccgcggcactactcgcagtgctacctctccgcttccagcgtttgtacacctttcaaggactggctcccgtccatcggccgccgggagcggaccgatgacgaggtcatctcagccgctgttatcagggatatccttggaatgcccatgtccacgtccaagagtccaaagattgcttttatgttcttgacgcctggctcattgccctttgagaaactgtgggaaaagtttttgcagggtcatgagggaagatactccatctatgtgcacgcgtcgcgtcagaagccggtgcattctagttctctctttgttggcagagatattcatagtgatgcggttgtatggggaaagatttcaatgatagatgcagagaagaggctattagcaaatgcgctggaagacgctgataatcaattttttgtcttgctttctgatagctgtgttcctcttcattcattcgactacgtctttaattacctgatgggaacaaacattagtttcattgattgtttccaggatcctggtccacatggaaatggaaggtattctcttgagatgcttcctgaaatagaggagagagacttcagaaagggtgcccagtggtttgcaatcacgcgaagacatgctttactgattctggcggacaacctttactacaagaagttcaagctatattgcaagccagcagatgggcgcaactgtattgctgacgagcattatttgccaaccctattcaatatggtagatccaggtggaatagctaattggtcggttacacatgtggattggtccgaggggaaatggcatccaaggtcatacgcagctgctgatgttagctatgatctactaaagaatataacagccgttgatgagaccatccatgtaacaagtgatgacaagaaagttgtgacacagaagccatgtttgtggaacggatcaaagagtccatgctatctttttgctaggaaattttaccccgaaacactcgacagcttactgaagatattcaccagttacacgtctgtttgacttcaacatgattctttgcacctcaacacatggttcaagtacatgagcatgtctcttttcttcgtgtaaaaattgtgaagtcaatcgatacttagatctgggcctcgagcaacgggttgctgctgcagcgaccgaggcaaacctgcagtttagtccatgggtggtgaggatgcggcgatattgataacgacgatgatactgcccccgttgtaatctattgtgctttttgtatgtttcctttaagtccttcacctctctctccctctctaatctctgtcctagcctcattagttcctggctcttggagttggagatcatatttttgtcaatatgctgttattatatgatccattcttttgtagacacaaaaaggaaatgattgagaagtaccacatatcttttatggtctcttgttgttatttggttacttac

SEQ ID NO: 2014 - DNA, 1750 bp, Secale cereale
ggggaaggaaggggcgaggagtgagccactcgcctgggatctcatcaggccctggagtggtgcagcagtggcctccgcgtcgaaacagccggagctttttagatgatccaaagatggtgaggagctgagagcaccgagagttcgacagtggggcagcaaggacatgactgtcatgccgcctgcgcgccatcggcccgcggccaagaggcccatgtggataatcgtgcttctgtgcctcgtctgcgtcgtgctgatcggggcgtacgtgtacccgccgcgccactactcgcagtgctacctctccgcttccagcgtctgcacgccgttcaaggattggctcccgtccatcggccgccgggagaaaaccgatgacgagatcatctcagccgctgttatcagggatatcctcggaatgcccatgtccgcgtccaagaatccaaagattgcttttatgttcttgacacctggctcattgcccttcgagaagttgtgggagaagtttttgcagggtcatgagggaaggtactccatctatgtgcacgcgtcgcgtcagaagcctgtgcactctagttctctctttgttggccgagatattcatagtgatgcggttgtatggggaaagatttcaatgatagatgcagagaagcggctattagcaaatgcgctggaagacgcggacaatcaattttttgtcttgctttctgatagctgtgttccgcttcattcatttgactatgtctttaattacctgatgggaacaaacattagtttcattgattgtttccaggatcctggtccacatggaaatggaaggtattcacttgagatgcttcctgaaatagaggagagagacttcagaaagggtgcccagtggtttgcaatcacgcgaagacatgctttactgattctggcggacaacctgtactacaagaagttcaagctatattgcaagccagcagatgggcgcaactgtattgctgacgagcattatttgccaaccctattcaatatggtagatccaggtggaatagctaattggtcggttacacatgtggattggtccgaggggaaatggcatccaaggtcatacggggttgctgatgtcagctatgatctactaaagaatataacagccgttgatgaaaccatccatgtaacaagtgatgacaagaaacttgtgacacagaagccatgtttgtggaacggatcaaagagtccatgctatctttttgctaggaaattctaccccgaaactctcgacagcttactgaagatattcaccagttacacgtctgtttgacttcaacctgattctttgcacctcaacacatggttcaagtacatgagcatgtctcccctcttcatgtaaaaattgtgaagtcaatcgatacttagatctgggcctcgagcgacgggttgctgctgcagcgaccaccgcaaacctgcggttcagtccatgggtggtagggatgcggcgatattgatagcgatggtactactgccctctttgtaatctattgtgctttctgtatgtttccttcaaatccttcacctctatctctctctctctccttctctagtctctttcttagcctcattagttcctggctcttggagttggagatcatatttttgtcaatatgctgttattatatgatccattcttttgtagacacaaagaaatgagtgagaagtaccacatgttctttttaaaaaataaaaaaaaaaaaaaaaacaaaaaaaaaaaaaa

SEQ ID NO: 2015 - DNA, 1865 bp, Hordeum vulgare
gcttaatcccctgatttatatatctctctcctccccccctcgcctcctcctcatctccacgactccacctccacccctgctgcccgcccctcccagccagcccacccgatcccatcgccgcgccgccagccccagatccgccgcccgcccgccgccgagctcgtacacgcggggaaggggtgacgagacagctgcctggcatttcatcaggccctgctgtggtgtagcagcggccttcccaccgaaaaataacccgagctttcagatgatccaaagatggtgaggagctgagagtacctagagattggcagtgggggctgtggggcagcaaggacatgactgtcatgccacctgcgcgccatcggcccgcggccaagagacccatgtggataatcgtgctcttgtgcctcgtctgcgtcgtgctgatcggggcgtacgtgtacccgccgcggcactactcgcagtgctacctctccgcttccagcgtttgtacacctttcaaggactggctcccgtccatcggccgccgggagcggaccgatgacgaggtcatctcagccgctgttatcagggatatccttggaatgcccatgtccacgtccaagagtccaaagattgcttttatgttcttgacgcctggctcattgccctttgagaaactgtgggaaaagtttttgcagggtcatgagggaagatactccatctatgtgcacgcgtcgcgtcagaagccggtgcattctagttctctctttgttggcagagatattcatagtgatgcggttgtatggggaaagatttcaatgatagatgcagagaagaggctattagcaaatgcgctggaagacgctgataatcaattttttgtcttgctttctgatagctgtgttcctcttcattcattcgactacgtctttaattacctgatgggaacaaacattagtttcattgattgtttccaggatcctggtccacatggaaatggaaggtattctcttgagatgcttcctgaaatagaggagagagacttcagaaagggtgcccagtggtttgcaatcacgcgaagacatgctttactgattctggcggacaacctttactacaagaagttcaagctatattgcaagccagcagatgggcgcaactgtattgctgacgagcattatttgccaaccctattcaatatggtagatccaggtggaatagctaattggtcggttacacatgtggattggtccgaggggaaatggcatccaaggtcatacgcagctgctgatgttagctatgatctactaaagaatataacagccgttgatgagaccatccatgtaacaagtgatgacaagaaagttgtgacacagaagccatgtttgtggaacggatcaaagagtccatgctatctttttgctaggaaattttaccccgaaacactcgacagcttactgaagatattcaccagttacacgtctgtttgacttcaacatgattctttgcacctcaacacatggttcaagtacatgagcatgtctcttttcttcgtgtaaaaattgtgaagtcaatcgatacttagatctgggcctcgagcaacgggttgctgctgcagcgaccgaggcaaacctgcagtttagtccatgggtggtgaggatgcggcgatattgataacgacgatgatactgcccccgttgtaatctattgtgctttttgtatgtttcctttaagtccttcacctctctctccctctctaatctctgtcctagcctcattagttcctggctcttggagttggagatcatatttttgtcaatatgctgttattatatgatccattcttttgtagacacaaaaaggaaatgattgagaagtacccc

SEQ ID NO: 2016 - DNA, 1731 bp, Secale cereale
tgggcacgacgctccctcctcccgctccgccttgcgtaaaggtggcagcattggggggataattttgttctcaccctgtttggtacgtggcatatagttttggcgtcctgaagtatatgcagaggatataatccggatatattactcttgattctgcaatggcaaggagatgaaagtatcgcgggtgtggcagcggggcagcaaggacatgacagccatgccacatccgcgccaccgcactgccaagaagcccatgtggataattgtgctactgtcaattgtttgtgtttcgttgatcggggcttatgtctatcctccacggcgctactcgacctgttacttctttgcttcaagtgtttgtactccctttaaggattggctccctgctgtgacccggcgggagccgaccgatcaagaggttttttcgtctgtggttatcagggatttgctttcaatgcctatgcctgtgtccaagaatccaaagattgcatttatgttcttgacacctggttcattgcccttcgagaaattgtgggagaaatttttgcagggccatgagggacgatattccatctatatccatgcatcccgtgaaaagcctgtgcattctagtcctttgtttgtgggccgagaaattcgcagtgaaaaggtagtatggggcagggtttcgatggttgatgcagagaaaaggctgttgggaaatgcattgctagatattgataatcaatttttcgtcttgctttctgacagctgtattccactacatacatttgattacatctataattatctgatgggaacaaatgttagcttcattgacagtttcctggatcctggtcctcatggaagtggaaggtattctatagaaatgtttcctgaaatagagcacagggacttcaggaagggtgcgcagtggtttgctataacaagaaggcatgctatactgattatggcagacagcctctactaccgtaaattcaagctatattgcaagccaacagtgggacggaactgtatcgctgatgagcactatttgccaaccttgttcaaaatagtagatcctggtgggatatctaattattcagtgacacatgttgactggtctgaggggaaatggcatccgaggtcctatagagctgctgatattacctatgaactcttaagaaacataacgtatttcaatgagattgtgcacattgcaagtgatgagactagaactgtgacatcgaccccatgtatattgaacggaagaaagagaccgtgcttcctttttgcaagaaaattttacccagatgctgtcaacaacctactgaagctatttcccagttacacatctgcttgaattctacactattctttgccattggcctaggattcccctaggatttttccttttatgtaaattttgcaattgatacttagtttcttaacagagatccagggccagagacacgtcgttgctacaacaacagcgacgccctgtcattctgggaccctaggtagggctgatgtgatatctatttagtatatggacactgccctcattgtaattcattgtgccttctgcatgtttctgttagctgtccatttcaccttttcctctcattcttgtatttctaactttccctttttaatttcctagctccctctcttgaggaacaggggtttggtcaagttcagctgttactatgcccattctttttggacacagatgatgaaatgagagcagcc

SEQ ID NO: 2017 - DNA, 1675 bp, Triticum aestivum
acaattttgttctcaccctgtttggtacgtggcacgtagttttggcgttctgaagtatatgttggcggagggtataatccggatatattactcttgattctgcaatggcaaggagatgaaagtaccgcgggtgtggcagcggggcagcaaggacatgacagccatgccacatccgcgccaccgcactgccaagaagcccatgtggataattgtgctactgtcaattgtttgtgtttcgttgattggggcttatgtctatcctccacggcgctactcgacctgttacttctttgcttcaagtgtttgtactcccttcaaggattggctccctgctgtgacccggcgggagccgaccgatcaagaggttttttcgtctgtggttatcagggatttgctttcaatgcctatgcccgtctccaagaagccaaagattgcatttatgttcttgacacctggttcattgcccttcgagaaattgtgggagaattttttgcagggccatgagggacgatattccatctatatccatgcatctcgtgaaaagcctgtgcattctagtcctttgtttgtgggccgagaaattcgcagtgaaaaggtagtatggggcagggtttcaatggttgatgcagagaaaaggctgttaggaaatgcattgctagacattgataatcaatttttcgtcttgctttctgacagctgtattccactacatacatttgattacatctataattatctgatgggaacaaatgttagcttcattgacagtttcctggatcctggtcctcatggaagtggaaggtattctatagaaatgtttcctgaaatagagcacagggacttcaggaagggtgcgcagtggtttgctataacaagaaggcatgctatactgattatggcagacaacctctactaccgtaaattcaagctatattgcaagccaacagtgggacggaactgtatcgctgatgagcactatttgccaaccttgttcaaaatagtagatcctggtgggatctctaattattcagtgacacatgttgactggtctgaggggaaatggcatccgaggtcctatagagctgctgatattacctatgaactcttaagaaacataacgtatttcaatgagattgtgcacattgcaagtgatgagactagaactgtgacatcgaccccatgtatattgaacggaagaaagagaccgtgcttcctttttgcaagaaaattttacccagatgctgtcaacaatctactgaagctatttcccagttacacatctgcttgaattctacacgattctttgccattggcctaggattcccctaggattttttcttttatgtaaattttgcaattgatacttagcttcttaacagagatccagggccagagacatgtcgttgctgtagcaactataacgacaccctgtcattctgggaccctaggtagggctgatgttatatctatttagtatatggacactgccctcattgtaatccattgtgccttgtgcatgtttctgttagctgtccatttcaccttttcctctcattcttgtatttctagctttccctttttagtttcctagctcccatctcttgaggaacagggtttttgtcacgttcagcccattctttttggacacatattatgaaatgagagcagccttata

SEQ ID NO: 2018 - DNA, 2083 bp, Oryza sativa
gcaagaggcgactccctcccagcacttaacccaaccaattagtgccacttccagcttaattaatccatttgtttatatctccctcctcctcctcctctctctctctctctctctctctacgactcccacctccacctccgccatcccaatccgatctcccgcgagctccagatccacctcccgggtcgccgccgagctcgccgcggccacctcctcgccggaatcggccgctcgcgagctccagcccggtgcccgttttcgcgccattcgtgcgtgcgagctagcgagctaagctccaagagctgcgcctcctgcgctgcggtgaggtgcggcgctgtgtgagtcctctcgcattgggcttctggttgctcggatagcttgggaaggtgtcaccttgttagttccctcaaatttcattgggccctggtgtagtaacttcacatcataattaccagagtttgattactttgatggtggtaacttctagatgatctgaacatatggagaggagatagaagtgtcttgagtgttgcagtaggacagcaaggacatgactgtcatgccatctctgcgccaccgggctgtcgccaagaagcccaaatggataatcattcttgtgtcactggtttgttttgtattgattggggcatatgttttcccaccacggcggtattcgcaatgctacctcttcggttctggtgcatgcgcaactttcaaggattggctcccatctgtaacccgcagggagcggactgatgaggagatcatttcatctgtagttcttagggatatccttgcaatgcccatgccagtgtcgaaaaatccaaagatcgctcttatgttcctgacacctggtacactgccctttgagaaattatgggaaaagtttttacagggtcaggagggaagatactccatctatgttcatgcatcacgtgaaaagcctgtacatactagttctttgtttgttggtcgtgatattcacagtgacgcggtagtatggggaaagatttcaatggttgatgcagagaagagactattggccaatgcactggcagatgttgataaccagttctttgtgttgctttctgacagctgtgttccactgcatacatttgattatgtctataattatctgatgggaacaaatatcagcttcattgattgtttccgtgatcctggccctcatggaaacgggaggtattctcctgagatgctccctgaaattgaggagaaagacttcaggaagggtgcccagtggtttgcaattacacgaagacatgctctactgattctggcagacagcctttactacaaaaagttcaagttgtactgcaagccagcagacggacgcaactgtattgcagatgagcattacttaccaaccttattcaacatggtagatcctggtggaattgctaattggtcagttacacatgttgattggtctgagggaaaatggcatccgaggtcatatagagctgcagatgtcacctacgatctcttaaagaatataacagctgttgatgaaaatttccatgtaacaagtgatgacaaaaaacttatgacacagaagccatgcttatggaatggatcgaagagaccatgctatctttttgctaggaagttctaccctgaaactcttgacaacctactgaagctattcaccagctatacatctgtttgagctccatcaaattctttgtccttggcatatggtctcaaaatcccatgggcttttttttgctgtttctgtaaattgcaaaatcaatacctagactcttacacatggatctggacctagagactacaagactacacacgcagatcgtcatcgcagcaactgtgacggcttggagttcttagtcactgggaagggctgtggcgaaatttgtagcaatgacactgccctcactgtaatttattgtgctctctgtaatttttccattgatggttcttagtccattgactccattcctgttgaagaacagataattttccattttgtcataccattattatatgatccattttttatatagtcagataacaagagaagtacctcatcctatttttgccatga

SEQ ID NO: 2019 - DNA, 2043 bp, Oryza sativa
aattagtgccacttccagcttaattaatccatttgtttatatctccctcctcctcctcctctctctctctctctctctctctacgactcccacctccacctccgccatcccaatccgatctcccgcgagctccagatccacctcccgggtcgccgccgagctcgccgcggccacctcctcgccggaatcggccgctcgcgagctccagcccggtgcccgttttcgcgccattcgtgcgtgcgagctagcgagctaagctccaagagctgcgcctcctgcgctgcggtgaggtgcggcgctgtgtgagtcctctcgcattgggcttctggttgctcggatagcttgggaaggtgtcaccttgttagttccctcaaatttcattgggccctggtgtagtaacttcacatcataattaccagagtttgattactttgatggtggtaacttctagatgatctgaacatatggagaggagatagaagtgtcttgagtgttgcagtaggacagcaaggacatgactgtcatgccatctctgcgccaccgggctgtcgccaagaagcccaaatggataatcattcttgtgtcactggtttgttttgtattgattggggcatatgttttcccaccacggcggtattcgcaatgctacctcttcggttctggtgcatgcgcaactttcaaggattggctcccatctgtaacccgcagggagcggactgatgaggagatcatttcatctgtagttcttagggatatccttgcaatgcccatgccagtgtcgaaaaatccaaagatcgctcttatgttcctgacacctggtacactgccctttgagaaattatgggaaaagtttttacagggtcaggagggaagatactccatctatgttcatgcatcacgtgaaaagcctgtacatactagttctttgtttgttggtcgtgatattcacagtgacgcggtagtatggggaaagatttcaatggttgatgcagagaagagactattggccaatgcactggcagatgttgataaccagttctttgtgttgctttctgacagctgtgttccactgcatacatttgattatgtctataattatctgatgggaacaaatatcagcttcattgattgtttccgtgatcctggccctcatggaaacgggaggtattctcctgagatgctccctgaaattgaggagaaagacttcaggaagggtgcccagtggtttgcaattacacgaagacatgctctactgattctggcagacagcctttactacaaaaagttcaagttgtactgcaagccagcagacggacgcaactgtattgcagatgagcattacttaccaaccttattcaacatggtagatcctggtggaattgctaattggtcagttacacatgttgattggtctgagggaaaatggcatccgaggtcatatagagctgcagatgtcacctacgatctcttaaagaatataacagctgttgatgaaaatttccatgtaacaagtgatgacaaaaaacttatgacacagaagccatgcttatggaatggatcgaagagaccatgctatctttttgctaggaagttctaccctgaaactcttgacaacctactgaagctattcaccagctatacatctgtttgagctccatcaaattctttgtccttggcatatggtctcaaaatcccatgggcttttttttgctgtttctgtaaattgcaaaatcaatacctagactcttacacatggatctggacctagagactacaagactacacacgcagatcgtcatcgcagcaactgtgacggcttggagttcttagtcactgggaagggctgtggcgaaatttgtagcaatgacactgccctcactgtaatttattgtgctctctgtaatttttccattgatggttcttagtccattgactccattcctgttgaagaacagataattttccattttgtcataccattattatatgatccattttttatatagtcagataacaagagaagtacctcatcctatttttgcc

SEQ ID NO: 2020 - DNA, 1901 bp, Hordeum vulgare
gaccaccatcaccaccaccacctcgtctccctcccctccacccgccaccgtccaccgcctcgcgccagccctagctccgatctcgccgcctccaggcctcagatcccgacctgcgacgagacgcgccccggtctcctggtcctgggcacgacgctccctcctcccgctccgccttgcgtaaaggtggcagcattggggggataattttgttcacaccctgtttggtacgtggcatgtagttttggccttctgaagcacatgtggagggtataatccggatatattactcttgattctgcaatggcaaggagatgaaagtaccgcgggtgtggcagcggggcagcaaggacatgacagccatgccacatccgcgccaccgcactgccaagaagcccatgtggataattgtgctactatcaattgtttgtgtttcgttgatcggggcttatgtctatcctccacggcgctactcgacctgttacttctttgcttcaagtgtttgtactccctttaaggattggctccctgctgtgacccggcgggagccgaccgatcaagagattttttcgtctgtggttattagggatatgctttcaatgcctatgcccatgtccaagaatccaaagattgcatttatgttcttgacacctggttcattgcccttcgagaaattgtgggagaaatttttgcagggccatgagggacgatattccatctatatccatgcatcgcgagaaaagcctgtgcattctagtcctttgtttgtgaaccgagaaattcgcagtgagaaggtagtatggggcagggtttcaatggttgatgcagagaaaaggctgttaggaaatgcattgctagatattgataatcaatttttcgtcttgctttctgacagctgtattccactacatacatttgattacatctataattatctgatgggaacaaatgttagcttcgttgacagtttcctggatcctggtcctcatggaagtggaagatattctatagaaatgtttcctgaaatagagcacagggacttcaggaagggtgcacagtggtttgctataacaagaagacatgccatactgattatggcagacaacctctactaccgtaaatttaagctatattgcaagccaacagtgggacggaattgtatcgctgatgagcactatttgccaaccttgttcaaaatagtagatcctggtgggatcactaattattcagtgacacatgttgactggtctgagggaaaatggcatccgaggtcctatagagctgctgatattacctatgaactcttaagaaacataacgtatttcaatgagattgtgcacattgcaagtgatgagactagaactgtgacatcgaccccatgtatattgaacggaagaaagagaccgtgcttcctttttgccagaaaattttacccagatgctgtcaacaatctactgaagctatttcccagttacacatctgcttgaattctagacaattctttgccattggcctaggattcccctaggattttttcttttatgtaaattttgcaattgatacttagcttcttaacagagatccagggccagagacatgtgtcgttgctataacaatagtgacgccctgtcattctgggaccctaggtaggggctgatgtgatatctatttagtatatggacactgccctcattgtaatccactgtgccttgtgcatgtttctgttagctgtccatttcaccttttctctcattcttgtatttctaattttttttgtttctagtttcctagctcccatcccttgaggaacaggttttttgtcaatttcagctgttactatgcccatcctttttgggtacagattatgaaatgagagcaaccttatagtttaaaaaaaaaaaaaa

SEQ ID NO: 2021 - DNA, 1904 bp, Hordeum vulgare
caccaccatcaccaccaccacctcgtctccctcccctccacccgccaccgtccaccgcctcgcgccagccctagctccgatctcgccgcctccaggcctcagatcccgacctgcgacgagacgcgccccggtctcctggtcctgggcacgacgctccctcctcccgctccgccttgcgtaaaggtggcagcattggggggataattttgttcacaccctgtttggtacgtggcatgtagttttggccttctgaagcacatgtggagggtataatccggatatattactcttgattctgcaatggcaaggagatgaaagtaccgcgggtgtggcagcggggcagcaaggacatgacagccatgccacatccgcgccaccgcactgccaagaagcccatgtggataattgtgctactatcaattgtttgtgtttcgttgatcggggcttatgtctatcctccacggcgctactcgacctgttacttctttgcttcaagtgtttgtactccctttaaggattggctccctgctgtgacccggcgggagccgaccgatcaagagattttttcgtctgtggttattagggatatgctttcaatgcctatgcccatgtccaagaatccaaagattgcatttatgttcttgacacctggttcattgcccttcgagaaattgtgggagaaatttttgcagggccatgagggacgatattccatctatatccatgcatcgcgagaaaagcctgtgcattctagtcctttgtttgtgaaccgagaaattcgcagtgagaaggtagtatggggcagggtttcaatggttgatgcagagaaaaggctgttaggaaatgcattgctagatattgataatcaatttttcgtcttgctttctgacagctgtattccactacatacatttgattacatctataattatctgatgggaacaaatgttagcttcgttgacagtttcctggatcctggtcctcatggaagtggaagatattctatagaaatgtttcctgaaatagagcacagggacttcaggaagggtgcacagtggtttgctataacaagaagacatgccatactgattatggcagacaacctctactaccgtaaatttaagctatattgcaagccaacagtgggacggaattgtatcgctgatgagcactatttgccaaccttgttcaaaatagtagatcctggtgggatcactaattattcagtgacacatgttgactggtctgagggaaaatggcatccgaggtcctatagagctgctgatattacctatgaactcttaagaaacataacgtatttcaatgagattgtgcacattgcaagtgatgagactagaactgtgacatcgaccccatgtatattgaacggaagaaagagaccgtgcttcctttttgccagaaaattttacccagatgctgtcaacaatctactgaagctatttcccagttacacatctgcttgaattctagacaattctttgccattggcctaggatttccctaggattttttcttttatgtaaattttgcaattgatacttagcttcttaacagagatccagggccagagacatgtgtcgttgctataacaatagtgacgccctgtcattctgggaccctaggtaggggctgatgtgatatctatttagtatatggacactgccctcattgtaatccactgtgccttgtgcatgtttctgttagctgtccatttcaccttttctctcattcttgtatttctaattttttttgtttctagtttcctagctcccatcccttgaggaacaggttttttgtcaatttcagctgttactatgcccatcctttttgggtacagattatgaaatgagagcaaccttatagtttagcttgctcagttttgc

SEQ ID NO: 2022 - DNA, 1859 bp, Triticum aestivum
ctcgtctcccctccctcccaccacctccgccaccgcccaccgcccagcgccagccctagctccgatctcgccgccgccgggccccggatcctgccccgcgacgagacgcgccacggcctcctggtcctgggcacgacgctccctcctcccgctccaccttgcgtaaaggtggcagcattggggggataattttgttctcaccctgtgtggtacgtggcatgtagttttggtgttctgaagtatatgcggagggtataatccggatatattactattgattctgcaatggcaaggagatgaaagtatcgcgggtgtggcagcggggcagcaaggacatgacagccatgccacatccgcgccaccgcactgccaagaagcccatgtggataattgtgctactgtcaattgtttgtgtttcgttgatcggggcttatgtctatcctccacggcgctactcgacctgttacttctttgcttcaagtgtttgtactccctttaaggattggctccctgctgtgacccggcgggagctgaccgatcaagaggttttttcgtctgtggtcatcagagatttgcttgcaatgcctatgcccgtgtccaagaagccaaagattgcatttatgttcttgacacctggttcattgcccttcgagaaattgtgggagagatttttgcagggccatgagggacgatattccatctatatccatgcatcgcgtgaaaagcctgtgcattctagtcctttgtttgtgggccgagaaattcgcagtgaaaaggtagtatggggcagggtttcaatggttgatgcagagaaaaggctgttaggaaatgcattgctagacattgataatcaatttttcgtcttgctttctgacagctgtattccactacatacatttgattacatctataattatctgatgggaacaaatgttagcttcattgacagtttcctggatcctggtcctcatggaagtggaaggtattctatagaaatgtttcctgaaatagagcacagggacttcaggaagggtgcgcagtggtttgctataacaagaaggcatgctatactgataatggcagacaacctctactaccgtaaattcaagctatattgcaagccaacagtgggacggaactgtatcgctgatgagcactatttgccaaccttgttcaaaatagtagatcctggtgggatctctaattattcagtgacacatgttgactggtctgaggggaaatggcatccgaggtcctatagagctgctgatattacctatgaactcttaagaaacataacgtatttcaatgagattgtgcacattgcaagtgatgagactagaactgtgacatcgaccccatgtatattgaacggaagaaagagaccgtgcttcctttttgcaagaaaattttacccagatgctgtcaacaatctactgaagctatttcccagttacacatctgcttgaattctacacgattctttgccattggcctaggattcccctaggattttttcttttatgtaaattttgcaattgatacttagcttcttaacagagatccagggccagagacatgtcgttgctgtagcaactataacgacacactgtcattctgggaccctaggtagggctgatgttatatctatttagtatatggacactgccctcattgtaatccattgtgccttgtgcatgtttctgttagctgtccatttcaccttttcctctcattcttgtatttctagctttccctttttagtttcctagctcccatctcttgaggaacagggtttttgtcacgttcagcccattctttttggacacatattatgaaatgagagcagccttatagtc

SEQ ID NO: 2023 - DNA, 1833 bp, Triticum aestivum
tgcaggaattcggcacgaggctcatctccacctccctccacctctgctggctccgcgtgcccatcccatccgatcccatcgccgcgccgccgagctccagatccgcccccgcgcccgccgccgagctccacacgcggggaaggggtgaggagtcagctgcctgccatttcatcaggccctggtgtggtgtagcagcggccttcacgtcgaaacaaccggagcttttagatgatccaaagatggtgaggagctgagagcacctagagttcgacagtgggggctgtggggcagcaaggacatgactgtcatgccgcctgcgcgccatcggcccgcggccaagaggcccatgtggataatcgtgctcctgtgcctcgtctgcgtcgtgctgatcggggcgtacgtgtacccgccgcggcactactcgcagtgctacctctctgcttctagcgtctgcacgccgttcaaggattggctcccgtccatcggccgccgggagaaaaccgatgacgagatcatctcagccgctgttatcagggatattcttgggatgcccatgtccacgtcgaagaatccaaagattgcgtttatgttcttgacacctggctcattgcccttcgagaaattgtgggagaagtttctgcagggtcatgagggaagatactccatctatgtgcacgcgtcgcgtcagaagcctgtgcatactagttctctctttgttggccgagatattcatagtgatgcggttgtatggggaaagatttcaatgatagatgcagagaagaggctattagcaaatgcgctggaagacgcggataatcaattttttgtcttgctttctgatagctgtgttccgcttcattcatttgactacgtctttaattacctgatgggaacaaacatcagtttcattgattgtttccaggatcctggtccacatggaaatggaaggtattctcttgagatgcttcctgaaatagaggagagagacttcagaaagggtgcccagtggttcgcaatcacgcgaagacatgctttattgattctggcggacaacctttactacaagaagttcaagctatattgcaagccagcagatgggcgcaactgtattgctgatgagcattatttgccaaccctattcaatatggtagatccaggtggaatagctaattggtcggttacacatgtggattggtctgaggggaaatggcatccaaggtcatacgcagttgctgatgtcagctatgatctactaaagaatataacagccgttgatgagaccatccatgtaacaagtgatgacaagaaactcgtgacacagaagccatgtttgtggaacggatcaaagagtccatgctatctttttgctaggaaattttaccccgaaactctcgacagcttactgaagatattcaccagctacacgtctgtttgacttcaacctgattctttgcacctcaacacatggttcaagtacatgagcatgtctcctctcttcatgtaaaaattgtgaagtcaatcgatacttagatctgggcctcgagcgacgggttgctgttgcagcgaccaccgcaaacctgcggttcagtccatgggtggtagggatgcggcgatattgatagcgatgatactgccctcagttgtaatctattgtgctttctatatgtttcctttaagtccttcacctctctctccctctttaatctctgtcctagcctcattagttcctggctcttggagttggagatcatatttttgtcaatatgctgttattatatgatccattcttttgtagacacaaagaaatgagtgagaagtaccacatatctttta

SEQ ID NO: 2024 - DNA, 1810 bp, Triticum aestivum
ccacctccacctctgctgcccgcctgccccccgagccacccgatcccatcgacgcgccgccacctccagatccgccgcccgcctcccgccgccgagctcgtaaacgcggggaaggggtgaggagtcagctgcctgacatttcatcaggccctggtgtggtgtggcagtgaccttcacgtcgaaataaccggaccttttagatgatctggagatggtgaggagctgagagcacctagagttcgacagtgggggctgtggggcagcaaggacatgactgtcatgccgcctgcgcgccatcggcccgcggccaagaggcccatgtggataatcgtgctcctgtgcctcgtctgcgtcgtgctgatcggggcgtacgtgtacccgccgcggcactactcgcagtgctacctctctgcttctagcgtctgcacgccgttcaaggattggctcccgtccatcggccgccgggagaaaaccgatgacgagatcatctcagccgctgttatcagggatattcttgggatgcccatgtccacgtcgaagaatccaaagattgcgtttatgttcttgacacctggctcattgcccttcgagaaattgtgggagaagtttctgcagggtcatgagggaagatactccatctatgtgcacgcgtcgcgtcagaagcctgtgcatactagttctctctttgttggccgagatattcatagtgatgcggttgtatggggaaagatttcaatgatagatgcagagaagaggctattagcaaatgcgctggaagacgcggataatcaattttttgtcttgctttctgatagctgtgttccacttcattcatttgactacgtcttcaattacctgatgggaacaaatattagtttcattgattgtttccaagatcctggtccacatggaaatggaaggtattctcttgagatgcttcctgaaatagaggagagagacttcagaaagggtgcccagtggttcgcaatcacgcgaagacatgctttattgattctggcggacaacctttactacaagaagttcaagctatattgcaagccagcagatgggcgcaactgtattgctgatgagcattatttgccaaccctattcaatatggtagatccaggtggaatagctaattggtcggttacacatgtggattggtctgaggggaaatggcatccaaggtcatacgcagttgctgatgtcagctatgatctactaaagaatataacagccgttgatgagaccatccatgtaacaagtgatgacaagaaactcgtgacacagaagccatgtttgtggaacggatcaaagagtccatgctatctttttgctaggaaattttaccccgaaactctcgacagcttactgaagatattcaccagctacacgtctgtttgacttcaacctgattctttgcacctcaacacatggttcaagtacatgagcatgtctcctctcttcatgtaaaaattgtgaagtcaatcgatacttagatctgggcctcgagcgacgggttgctgttgcagcgaccaccgcaaacctgcggttcagtccatgggtggtagggatgcggcgatattgatagcgatgatactgccctcagttgtaatctattgtgctttctgtatgtttcctttaagtccttcgcctctctctccctctccctctttaatctctgtcctagcctcattagttcctggctcttggagttggagatcatatttttgtcaatatgctgttattatatgatccattcttttgtagacacaaagaaatgagtgagaagtaccacatatctttt

SEQ ID NO: 2025 - DNA, 1480 bp, Secale cereale
gtgagccactcgcctgggatctcatcaggccctggagtggtgcagcagtggcctccgcgtcgaaacagccggagctttttagatgatccaaagatggtgaggagctgagagcaccgagagagtgaccagtggggcagcaaggacatgactgtcatgccgcctgcgcgccatcggcccgcggccaagaggcccatgtggataatcgtgctcctgtgcctcgtctgcgtcgtgctgatcggggcgtacgtgtacccgccgcgccactactcgcagtgctacctctccgcctccagcgtctgcacgccgttcaaggactggctcccgtccatcggccgccgggagaaaaccgatgacgaggtcatctcagccgctgttatcagggatatcctcggaatgcccatgtccacgtcgaagagtccaaagattgcttttatgttcttgacacctggctcattgcccttcgagaaattgtgggagaagtttctgcagggtcatgagggaagatactccatctatgtgcacgcgtcgcgtcagaagcctgtgcactctagttctctctttgttggccgagatattcatagtgatgcggttgtatggggaaagatttcaatgatagatgcagagaagaggctattagcaaatgcgctggaagacgcggacaatcaattttttgtcttgctttctgatagctgtgttccgcttcattcatttgactacgtctttaattacctgatgggaacaaacattagtttcattgattgtttccaggatcctggtccacatggaaatggaaggtattcacttgagatgcttcctgaaatagaggagagagacttcagaaagggtgcccagtggtttgcaatcacgcgaagacatgctttactgattctggcggacaacctgtactacaagaagttcaagctatattgcaagccagcagatgggcgcaactgtattgctgacgagcattatttgccaaccctattcaatatggtagatccaggtggaatagctaattggtcggttacacatgtggattggtccgaggggaaatggcatccaaagtcatacggggttgctgatgtcagctatgatctactaaagaatataacagccgttgatgagaccatccatgtaacaagtgatgacaagaaacttgtgacacagaagccatgtttgtggaacggatcaaagagtccatgctatctttttgctaggaaattctaccccgaaactctcgacagcttactgaagatattcaccagttacacgtctgtttgacttcaacctgattctttgcacctcaacacatggttcaagtacatgagcatgtctcccctcttcatgtaaaaattgtgaagtcaatcgatacttagatctgggcctcgagcgacgggttgctgctgcagcgaccaccgcaaacctgcggttcagtccatgggtggtagggatgcggcgatattgatagcgatggtactac

SEQ ID NO: 2026 - DNA, 2023 bp, Zea mays
agcttccacctctgacccaaacccaaccccattcagcagaacatccagttatagcttaattaatccttttctttataccgactccctcgtggcctcgtcgcctcagctccaccaccaccacctccacccgcgcctccaaaatccaaatccgatcgatctccgcggcctccagatcccccggcgggcggagacggcgagctccaggcggccaagaagcccccccctcgcagcgctcctctcctctgcctctccgaatcccttaccagggggaaaaaacattgcctgaaagttcttcaggccctggtgtagcagctgaattacccagtttaatggcgaagaacgagctttagatggtctaaagatggagatgagatagaagcaccacaaagtgtacagtggggtagcaaggatatgactgtcatgatgcctcagcgccaccgggctacagccaagaagcccatgtggataatcgtgctcttgtgcatggtttgcatcgtgctgattggggcttacgtcttcccaccgcggcgcttctctaactgctacctctctgcttcaagtgtatgcgcacctttcaaggattggctcccttctatgggccgtcgggagagaactgacgaggagattatttcatctgtagttattagggatatcctttcaatgcccatgcctatgccaaaaaatccaaagattgcccttatgttcttgacaccaggttcattgccctttgagaaattgtgggagaagtttttacagggacatgagggaagatactccatctatgtgcacgcatcacgtgaaaagcctgttcatactagttctttgtttgctggccgggatattcacagtgatgcggtagtatggggattgatttcaatggttgatgccgagaaaagattgttagcgaatgcactggaagatgttgataatcaagtttttatcttgctttctgacagttgtgttccactgcattcatttgattatgtgtataattacctcatgggaacgaatgttagcttcattgattgtttcaaggatccaggtccacatggcagtggaaggtactctattgagatgtatcctgaaatagacgagagggattttagaaagggtgcccagtggtttgcagttacaaggagacatgctttaatgattctggctgacagcttgtactacaagaagttcaagctatactgcaagccagcagaagggcgcaactgtattgcagatgagcattatttgccaaccctgttcaatatggtagatcctggtgggatctctaattggtctgttacacatgtggattggtctgagggaaaatggcatccaaggtcatatagcgctgatgatgtcacctatgatctcttgaagaacattacagcagttgatgagaacttccatgtaacaagtgatgacaagaaacttgtgatgcagaagccgtgtttgtggaatggatcaaagagaccgtgctatcttttcgctaggaagtttaatcctgaagcacttgacaacctactgaagcaatttaccagttacacatctgtttgagtcctaccggattctttgccttgtgctgtcaaatccgacaagcttttttctcttcctgtttatatgtaaattgtgaagtccgtacttattaggatctgggcctgaagataccggtacaactgcaacagctgtgatggcttggagctgagtcatgggtaaaacggccacagcgatgtttatagaatggcactgccctcatagtaatttatcgtgttcaatgtatgtctccatagtcttccacccaactcccaactcattagttctttattcttggagaacagtttttgtcagagtgttatactgtcatgatatgatccattctttgtagacacagagattacaacagatgtatcacaaatgcagtcttaattttgtcactattaaatcttttatcatgcgttctactgaattaggtgttagcatttcttaaatttcactgtgatcaattttcagcaaagtaagcgtatttgagctg

SEQ ID NO: 2027 - DNA, 1957 bp, Setaria italica
caagagccagccaccttccacctcgaacccaaccaaacccattgagcataacaactagtgccaattctatcttacttaatcctttttctttataccaactccctcgtggcctcggtcgcctccactccgcctccgccggcgcctccaaatccgatcgatctccgcaggctccagatccccggcggccggaggcagcgagctcccggcgcggtggacccccgagcggcgctcgtgtcttcgctctctccaatcaggaaagaaccttctcctgaaaattcatcagcccctgtagtagctgctgaattaccggtgtttgattgggacaaaagagctttagacgatctgaagatggagaggagatagaagtttcacaagcgtatagtggggtggcaaggatatgactgtcatgatgcctcagcgtcatcgggctgcagccaagaagcccatgtggataatcgtgctcttgtctatggtttgtctcgtgttgattggggcttatgtcttcccaccccggcgctactctaagtgctacctctttgcttcaagtgtatgtacaccttctttcaaggattggctcccttcaatgggccgacgggagcggactgatgaggagattatttcatctgtagttattagagatattctttcaatgcccatgcctgtgtcaaaaaatccaaagatcgcccttatgttcctgacacctggttcattgcccttcgagaaattgtgggagaagtttttacagggacatgagggaaggtactccatctatgtgcacgcatcacgtgaaaagcctgttcatactagttctttgtttgctggtcgggatattcacagtgacgcggtagtatggggattgatttcaatggttgatgctgagaagagattactagcgaatgctctggaagatgttgataatcaattttttgtcttgctctctgacagctgtgttccgctgcattcgtttgattatgtgtataattacctgatgggaacgaatgttagcttcgttgattgtttcaaggatccaggtccacatggcagtggaaggtattctattgagatgtttcctgaaatcaacgagagggactttagaaagggtgcccagtggtttgcagttacacggagacacgctttaatgattctggcggacagcctgtactacaaaaagttcaagctatattgcaagccagcagaggggcgcaactgtattgcagatgagcattatttgccaaccctgttcaatatggtagaccctggtggaatctctaattggtcaattacacatgtggattggtctgagggaaaatggcatccaaggtcatatagcgctgcagatgtcacctatgatctcttaaagaatataacggcaattgatgagaacttccatgtaacaagtgatgacaagaaacttgtgatgcagaagccatgtttgtggaatggatcaaagagaccatgttatcttttcgctaggaagttcaatcctgaagcacttgacaacctactgaagctattcaccagttatacatctgtttaagtccaacctaattcattgccttgggcatatggtctgattgaagcctcaagttccacaaggtttttccatgtttatgtaaattgggaggcccatacttcttaacaaggatctgggcccaaagacacagattaccatggcaacaactgtgacggcttggaagctcatagtaatttattgtgttctaagtttcagggaagggccacagcaatgtttatagaatgacactgccctcatagtaatttattgtgttctatgtacgtttctattagttttcccctccctcattcgttcctgtctcttggagaagagatttttgtcatactgtcattatatgatccattctttgtagacacagtgatagctagggaattaccacataactttataattttaaatttgtttttgttaacaaaaggttaa

SEQ ID NO: 2028 - DNA, 1598 bp, Pennisetum glaucum
tgaattactggtgttagatggtgataaaagagctttttagacgatctgaagatggagaggagatagaagtttcacaggtgtacagtgtggtggcaaggatatgactgtcatgatgcctcagcgtcatcgggctgcagccaagaagcccatgtggataatcgtgctcttgtctatggtttgtctcgtgttgattggggcttatgtcttcccaccccggcgctactctaagtgctatctctttgcttcaagtgtatgcacaccttctttcaaggattggctcccttcaatgggccgacgggagcggactgatgaggagattatttcatctgtagttattagagatatcctttcaatgcccatgcctgtgccaaaaaatccaaagatcgcccttatgttcttgacacctggttcattgccctttgagaaattgtgggagaagtttttacagggacatgagggaagatactccatatatgtgcacgcatcacgtgaaaagccagttcatactagtcctttgttttctggtcgggatattcatagcgacgcggtagtatggggactgatttcgatggttgatgctgagaagagattactagcgaatgctctggaagatgttgataatcaattttttgtcttgctctccgacagctgtgttcctctgcattcatttgattatgtgtataattacctgatgggaacgaacgttagcttcattgattgtttcaaggatccaggtccacatggcagtggaaggtattctcctgagatgtttcctgaaatcgtcgagagggactttagaaagggtgcccagtggtttgcaattacacggagacacgctttaatgattctggcggacagcctgtactacaaaaagttcaagctatattgtaagccagcggaggggcgcaactgtattgcagatgagcattatttgccaaccctattcaatatggtagaccccggtggaatctctaattggtcagttacgcatgtggattggtctgagggaaaatggcatccaaggtcgtatagcgctgcagatgtcacctatgatctcttaaagaatataacggcaattgatgagaacatccatgtaacaagtgatgacaacaaacttatgatgcagaagccatgtttgtggaatggatcaaagagaccatgttatcttttcgctaggaagttcaatcccgaagcacttgacaacttactgaagctattcaccagttatacatctgtttaagttcaatctaattcattgccttgggcatatggtctgattgaaacctcaagtttcacaagctttttccatgtttatgtaaattgtgaggtcaagacacagattaccacggcaacaactgtgacggcttgcagttctaagtctcagggaagggccatagcaatgtttatagaatgacactgccctcgtagtaatttattgtgttctgtgtatgtttccattagttttcccctcctccctcatccgttcctgtctcttggagaagagattttttccatactgtcattatatgatccattctttgtagacacagtgatagctagggaattaccacataactttataattttaaacttgtttt

SEQ ID NO: 2029 - DNA, 1984 bp, Brachypodium distachyon
aacaaacccttggtcaaatatcccaagctctctcttcttctacctccgttcctctctctttctctctctctctctcttccgtgaatctatcctgtaagcgccctgcgttacctggccgccgagcgccgccgcctcaacccatccccgaccgccccccgcccccggccggctcgagcgcgtggcgtcgcggttcttcgtcgttcggggcatcgcgttcctggcctgccgtctccacccattccgctgagggccatttggggtctcgaggaaggtggccgttacctgaaatcgcatcaggctttggctggtgtagcggtaagttgcttcagatagaaaaataaccagagatcatagatgatctggagatggcgaggagctgagagtgcctagagagcgtgacaagtgggaggaaggggccagcagcaaggacatgactgtcatgccgcctcagcgcaatcggcccgctgccaagaagcccatgtggataatcgtgctcttgtgcatggtttgtgttatgttgattggggcttatgtgtacccgccgcgcaagtactcgcagtgctacctctctgcatctagtgtctgtacatctttcaaggattggctcccttccataggccgtcgggagaagactgatgaggagattatttcagcggcagttatgaaggatattcttgcaatgccaatgtctgcgtcgaagagtccgaagatcgctcttatgttcttgacacctggttcattgccctttgagaaattgtgggagaagtttttgcagggtcacgaggggcgatactccatctatgtgcacgcgtcgcgtcagaagcctgtgcattctagttctttgtttgttggccgagatattcacagtgacgcggtagtatggggaaagatttctatgattgatgcagagaagagactattagccaatgctctggaagatgctgataaccaattttttgtcttgctttctgatagctgtgttccgctgcattcatttgactatgtctataattacctgatgggaacaaatattagtttcgttgactgcttccaggatcctggtccacatggaaatggaaggtattctctcgagatgcttcctgaaatagaggagagggatttcagaaagggtgcccagtggtttgcaattacacggagacatgctttattgattctggcggacaacctttactacaagaaattcaagctatattgcaagccagcagatggacgcaactgtattgctgatgagcattatttgccaacactattcaatatggtagatcctggtgggatagctaattggtcggttacacatgttgattggtccgaggggaaatggcatccaaggtcatatagagctgaggacgtcacctatgatctcttaaagaatataacagctgttgatgagaactttcatgtaacaagtgatgatcagaaacttgtgacacagaagccatgtttgtggaacggatcaaagagtccatgctacctttttgctagaaaattttatcccgaaactgttgacaatttactgaagatattcaccagttacacatctgtttgagttcaacctgattctttgccctcaacacatggttcaactacatgagcattcttttctctttgtgtaaaaattgtgaagtgaatcaatacttagcttcgtaacacggacctgggcctcgggggacatgttgctgctgcagcgattgcgacgacctgtagttcagtccgtgggtagggctgcggcgacatttatagcaatgacactgcccttgatgtaatctattgtgccttctgtatgtttttctttagttctcccctcactacttagcatcattagttccttgctcttggagaacagatttttgtcaatatgccgagttgttattatatgatcaattcttttgtacacacagagatacagtaaccgagaagtaccccacatatctttataatcttctcattcttgttggatactact

SEQ ID NO: 2030 - DNA, 2157 bp, Brachypodium distachyon
accacttctcctctcgcgtccaaatggaaagcaggaggaaagctccacgttcttccattaacctaaccaagcccccaacacctcacaagccggcaattagtgccacttctttgcttagttaatcggaaaccaacaaacaaacccttggtcaaatatcccaagctctctcttcttctacctccgttcctctctctttctctctctctctctcttccgtgaatctatcctgtaagcgccctgcgttacctggccgccgagcgccgccgcctcaacccatccccgaccgccccccgcccccggccggctcgagcgcgtggcgtcgcggttcttcgtcgttcggggcatcgcgttcctggcctgccgtctccacccattccgctgagggccatttggggtctcgaggaaggtggccgttacctgaaatcgcatcaggctttggctggtgtagcggtaagttgcttcagatagaaaaataaccagagatcatagatgatctggagatggcgaggagctgagagtgcctagagagcgtgacaagtgggaggaaggggccagcagcaaggacatgactgtcatgccgcctcagcgcaatcggcccgctgccaagaagcccatgtggataatcgtgctcttgtgcatggtttgtgttatgttgattggggcttatgtgtacccgccgcgcaagtactcgcagtgctacctctctgcatctagtgtctgtacatctttcaaggattggctcccttccataggccgtcgggagaagactgatgaggagattatttcagcggcagttatgaaggatattcttgcaatgccaatgtctgcgtcgaagagtccgaagatcgctcttatgttcttgacacctggttcattgccctttgagaaattgtgggagaagtttttgcagggtcacgaggggcgatactccatctatgtgcacgcgtcgcgtcagaagcctgtgcattctagttctttgtttgttggccgagatattcacagtgacgcggtagtatggggaaagatttctatgattgatgcagagaagagactattagccaatgctctggaagatgctgataaccaattttttgtcttgctttctgatagctgtgttccgctgcattcatttgactatgtctataattacctgatgggaacaaatattagtttcgttgactgcttccaggatcctggtccacatggaaatggaaggtattctctcgagatgcttcctgaaatagaggagagggatttcagaaagggtgcccagtggtttgcaattacacggagacatgctttattgattctggcggacaacctttactacaagaaattcaagctatattgcaagccagcagatggacgcaactgtattgctgatgagcattatttgccaacactattcaatatggtagatcctggtgggatagctaattggtcggttacacatgttgattggtccgaggggaaatggcatccaaggtcatatagagctgaggacgtcacctatgatctcttaaagaatataacagctgttgatgagaactttcatgtaacaagtgatgatcagaaacttgtgacacagaagccatgtttgtggaacggatcaaagagtccatgctacctttttgctagaaaattttatcccgaaactgttgacaatttactgaagatattcaccagttacacatctgtttgagttcaacctgattctttgccctcaacacatggttcaactacatgagcattcttttctctttgtgtaaaaattgtgaagtgaatcaatacttagcttcgtaacacggacctgggcctcgggggacatgttgctgctgcagcgattgcgacgacctgtagttcagtccgtgggtagggctgcggcgacatttatagcaatgacactgcccttgatgtaatctattgtgccttctgtatgtttttctttagttctcccctcactacttagcatcattagttccttgctcttggagaacagatttttgtcaatatgccgagttgttattatatgatcaattcttttgtacacacagagatacagtaaccgagaagtaccccacatatctttataatcttctcattcttgttggatactactacggtgcatctgttattgtggattcaggcatgttgaat

SEQ ID NO: 2031 - DNA, 2126 bp, Sorghum bicolor
ctctctctctctctctctctctctctcatttcgttcctgctgcctccaattggaaacccatcatcagccatccgcaagaagcaagcagcaataggctattcatgccaatagccaagagccagccaagcttccacctctaacccaacccattccattgagcataatactagtgccagttctagcttaattaatccttttctttatactgcctccctcgtggcctcgtcgcctcagctccacctccatctccacttgcgccctccaaatccgatcgatctccgcagcctccagatccccggcgggcggaggagacagcgagctccagccggtgaaccccacctcgctgcactcctctcctctcactctccaaatcctttaccaggaaagaaaggaaaaaaacgttgcctgccctggtgtagcagctgaattacccagtttgatggtgaagaaagagttttagatggtctaaagatggagatgatgagataaaaagtaccaaaagtgtacagtggatagcaaggatatgactgtcatgattcctcagcgccaccgggctacagccaagaagcccatgtggataatcgtgctcttgtctatggtttgcatcgtgttgattggggcttatgtcttcccaccgcggcgcttctctaagtgctacctctctgcttcaagtgtatgtacgaatttcaaggattggctcccttccatgggccatcgggagcggactgacgaggagattatttcatctgtagttattagggatatcctttcaatgcccatgcctgtgtcaaaaaatccaaagatcgcccttatgttcttgacaccaggttcattgccctttgagaaattgtgggagaagtttttacagggacatgagggaagatactccatctatgtgcacgcatcacgtgaaaagccggttcatactagttctttgtttgctggtcgggatattcacagtgatgcggtagtatggggattgatttcaatggttgatgctgagaagagactattagcgaatgcactggaagatgttgataatcaagtttttatcttgctttctgacagctgtgttccactgcattcatttgattatgtgtataactacctgatgggaacaaatgttagcttcgtggattgtttcaaggatccaggtccacatggcagtggaaggtacgctcctgagatgtatcctgaaatagatgagagggattttagaaagggtgcccagtggtttgcagttacaaggagacatgctttaatgattctggctgacaacctgtactacaagaagttcaagctatactgcaagccagcggaagggcgcaactgtattgcagatgagcattatttgccaaccctgttcaatatggtagatcctggtggaatctctaattggtctgttacaaatgtggattggtctgagggaaaatggcatccaaggtcatatagcgctgatgatgtcacctatgatctcttgaagaatattacggcaattgatgagaacatccatgttacaagtgatgacaagaaacttgtgatgcagaagccatgtttgtggaatggatcaaagagaccgtgctatcttttcgctaggaagtttaatcctgaagcacttgacaacctactgaagctatttaccagttatacatctgtttgagtccaacctgattctttgccttgggctgtcaaatcccacaagcttcttttcctgtttgtatgtaaattgtgaagtccgtacttattaggatctgggcccaaagatactggtacaactgcaacaactgtgatggcttggagctcagtcctcggtaaaacggccacagcaatgtttatagaatgacactgccctcatagtatgtcgtgttcaatgtatgtctccatagtcttccacccaactcccaactcattagttctttgaagaacagtttttttgtcagaatgttatactgtcattatatgatccattctttgtagacacagattacaacagatgtaccacaagcgcatagtcttaatttagtcattattaaatcttttgtcatggattctactgaattaggtgttcgcatttcttcattttcactgtgattaatttttcagcaaagtaaacgtatttgagctgc

SEQ ID NO: 2032 - DNA, 2246 bp, Sorghum bicolor
cgcaaaagcgcacggccatacgtcactttaatccaaattttctcagcccccagccccccacacttgctctctctctctctctctctctctctctctctctctctctctcatttcgttcctgctgcctccaattggaaacccatcatcagccatccgcaagaagcaagcagcaataggctattcatgccaatagccaagagccagccaagcttccacctctaacccaacccattccattgagcataatactagtgccagttctagcttaattaatccttttctttatactgcctccctcgtggcctcgtcgcctcagctccacctccatctccacttgcgccctccaaatccgatcgatctccgcagcctccagatccccggcgggcggaggagacagcgagctccagccggtgaaccccacctcgctgcactcctctcctctcactctccaaatcctttaccaggaaagaaaggaaaaaaacgttgcctgccctggtgtagcagctgaattacccagtttgatggtgaagaaagagttttagatggtctaaagatggagatgatgagataaaaagtaccaaaagtgtacagtggatagcaaggatatgactgtcatgattcctcagcgccaccgggctacagccaagaagcccatgtggataatcgtgctcttgtctatggtttgcatcgtgttgattggggcttatgtcttcccaccgcggcgcttctctaagtgctacctctctgcttcaagtgtatgtacgaatttcaaggattggctcccttccatgggccatcgggagcggactgacgaggagattatttcatctgtagttattagggatatcctttcaatgcccatgcctgtgtcaaaaaatccaaagatcgcccttatgttcttgacaccaggttcattgccctttgagaaattgtgggagaagtttttacagggacatgagggaagatactccatctatgtgcacgcatcacgtgaaaagccggttcatactagttctttgtttgctggtcgggatattcacagtgatgcggtagtatggggattgatttcaatggttgatgctgagaagagactattagcgaatgcactggaagatgttgataatcaagtttttatcttgctttctgacagctgtgttccactgcattcatttgattatgtgtataactacctgatgggaacaaatgttagcttcgtggattgtttcaaggatccaggtccacatggcagtggaaggtacgctcctgagatgtatcctgaaatagatgagagggattttagaaagggtgcccagtggtttgcagttacaaggagacatgctttaatgattctggctgacaacctgtactacaagaagttcaagctatactgcaagccagcggaagggcgcaactgtattgcagatgagcattatttgccaaccctgttcaatatggtagatcctggtggaatctctaattggtctgttacaaatgtggattggtctgagggaaaatggcatccaaggtcatatagcgctgatgatgtcacctatgatctcttgaagaatattacggcaattgatgagaacatccatgttacaagtgatgacaagaaacttgtgatgcagaagccatgtttgtggaatggatcaaagagaccgtgctatcttttcgctaggaagtttaatcctgaagcacttgacaacctactgaagctatttaccagttatacatctgtttgagtccaacctgattctttgccttgggctgtcaaatcccacaagcttcttttcctgtttgtatgtaaattgtgaagtccgtacttattaggatctgggcccaaagatactggtacaactgcaacaactgtgatggcttggagctcagtcctcggtaaaacggccacagcaatgtttatagaatgacactgccctcatagtatgtcgtgttcaatgtatgtctccatagtcttccacccaactcccaactcattagttctttgaagaacagtttttttgtcagaatgttatactgtcattatatgatccattctttgtagacacagattacaacagatgtaccacaagcgcatagtcttaatttagtcattattaaatcttttgtcatggattctactgaattaggtgttcgcatttcttcattttcactgtgattaatttttcagcaaagtaaacgtatttgagctgctgttaatggaattccaaaacataatatttatattttag

SEQ ID NO: 2033 - DNA, 776 bp, Setaria italica
ggagccgacctgatctgagatttctctctcgccgcggcggcatcgaatcgtgccaacactgcaaatcgtgtgcgtgacgctccttccccgcacggccgctttccccttcttcttctccccaaagctccacaccagacactccactctcctccaccagcactcacgcacaaaactcaggccccgctccccgacctccctctcccctctcggtgctagctgttgctcggatcggatcggcagggggcggatcgatggcggactggggccccgtggtggtgggcgtggtgctgttcgtgctgctgtcgccgggcctgctgtgcgagctcccgggcacccaccgccacgtcgacttcggcggcttccacaccaacggcaaggccatcttcgtccacaccctcatcttcttcgcggccttcaccatcctcacgctcgcgctccacgtccacatctacaccggataggtctgtcgagtcggatcggatcggagaagcatgccgtcgctgttgttcgtccccctccttcaacaagtgcgtggtgtactggttgtactgctagctgctgctgcgtgctcgatcgtctatggacaaggtcatctgtaatccgattctgtagtagtctatccgcaggaacaagtgcttgctctttaatccattgaagaagcagttctctacttgttgtggtgtttcctgtcatctgttcattccgatccgtctgtattctcgtcatgtttctcgatgggatgatccaagctgtagctgttgaatgtcgaatccgcg

SEQ ID NO: 2034 - DNA, 782 bp, Setaria italica
ccgaagtcgacggggcggtggagccgacctgatctgagatttctctctcgccgcggcggcatcgaatcgtgccaacactgcaaatcgtgtgcgtgacgctccttccccgcacggccgctttccccttcttcttctccccaaagctccacaccagacactccactctcctccaccagcactcacgcacaaaactcaggccccgctccccgacctccctctcccctctcggtgctagctgttgctcggatcggatcggcagggggcggatcgatggcggactggggccccgtggtggtgggcgtggtgctgttcgtgctgctgtcgccgggcctgctgtgcgagctcccgggcacccaccgccacgtcgacttcggcggcttccacaccaacggcaaggccatcttcgtccacaccctcatcttcttcgcggccttcaccatcctcacgctcgcgctccacgtccacatctacaccggataggtctgtcgagtcggatcggatcggagaagcatgccgtcgctgttgttcgtccccctccttcaacaagtgcgtggtgtactggttgtactgctagctgctgctgcgtgctcgatcgtctatggacaaggtcatctgtaatccgattctgtagtagtctatccgcaggaacaagtgcttgctctttaatccattgaagaagcagttctctacttgttgtggtgtttcctgtcatctgttcattccgatccgtctgtattctcgtcatgtttctcgatgggatgatccaagctgtagctgttgaa

SEQ ID NO: 2035 - DNA, 634 bp, Pennisetum glaucum
acggccgctttccccttcttctgattcctccacctcctacccaaagttccacaccagagcctcggtccataaaccacacacactccactctcctcctccagcactcggacacaacgtactcaggctccgctcgccgagcctccctccctctcagcgctagctgcttctcggatcggatcgatggcggactggggccccgtggtggtgggcgtggtgctgttcgtgctgctgtctccgggcctcctctgcgagctcccgggcacacaccgccacgtcgacttcggcggcttccacaccaacggcaaggccatcttcgtccacaccctcatcttcttcgccgccttcaccatcctcacgctcgcgctccacgtccacatctacaccggataggcggcctgtcgatccagatcggatcggagcatggcgtcgccagctgttgttcgtccccctcctccagcaagtgcgtggtgttagtactgattcagattgtactgctagctgctgcgtgctctcgatcgtgtctatggaataggccatctccatctgtaattcgattctgtagtaggctgtgtctgcaggaacaagtgcttgctctttaatccaattccaatctaagtagctactgaaacaattc

SEQ ID NO: 2036 - DNA, 532 bp, Triticum aestivum
aggcgactgctcccgtgatctgatctgatcggcgatcaactcggcatggcggactggggccccgtggtggtgggcgtggtgctcttcgtgctgctgtcccctggcctgctctgcgagctcccgggcacgcaccgccacgtcgacttcggcggcttccacaccaacggcaaggccatcttcgtgcacaccctcatctttttcgccgccttcaccatcctcacgctcgcgctccacgtccacatctacaccggctagtactagtctatatgtatgtgtggtggtcgatctgggacttgcagaggtcagatcagaatcagatcggatcatgccgtcgttgctgctcttgttcctcttcaactcgatcgattcgacaagtgcttgtactgccttcctcaatcctagctatcactcgtatctatatcatgtaaaggccatatggccgtcggtctgtagctaacgcttgcaggaactagtgcctgcccttttaatcgaatctgttggttggttggttggagcaaaaaaaaaaaaaaaa

SEQ ID NO: 2037 - DNA, 716 bp, Panicum virgatum
ggccccgagttccacttccacccataaaccacacactcccactctccgtctcccccacccaggcagacagactcgcacaagagagtagcagaagagctgaggctcccggcctccaactccaagcaagctactgctagatcgatggcggattggggccccgtggtggtgggcgtggtgctgttcgtgctgctgtcgccgggcctgctgtgcgagctcccgggctcccaccgccacgtcgacttcggcggcttccacaccaacggcaaggccatcttcgtccacaccctcatcttcttcgccgccttcaccatcctcacgctcgcgctccacgtccacatctacaccggctagtctgctctgggcctcctggctcctcgatctggacacggggatccagtccagatcgggacaagccatggcgccgccgctgcttgtctgctcatcctcgactgaacacaagtgaaagtgcgtgtatgctactgctagctatgcaagacatcgtctgtaattcgattctgtaggcggaacacctagctggttgcacttcaatcgatccaatcgaggaactattcaggcaaatctagctaatagttactgcccttttcttttggtgttcatcccgatccgtctggccgctcgtcatcatgtctctcgatttcatcttctttgtttccatgtatgatccatggtattgatttttgaatgtcgaatccgtg

SEQ ID NO: 2038 - DNA, 831 bp, Zea mays
gaggacgggacgtgtgagtgagcatggcccagggcatgcggctcggattgtctgtgtctagttgtctaccagtataccatccgtcggtaggccgtgggcggtgcgcggtgggccaaggcatcgggttcctgacggctgccgtactctactctagtctagtctctcctccgcagatccataaaccactccacactccccctctcctagtctcctctccacactcccgctctcctgctactctgctccgtgatctggtctggtgagatcggggatcggaccgtcgactcggcaaacatggcggactggggccccgtggtggtgggcgtggtgctgttcgtgctgctctcgccgggcctgctctgcgagctgccgggcacccaccgccacgtcgacttcggcggcttccacaccaacggcaaggccatcttcgtccacaccctcgtcttcttcgccgccttcaccatcctcacgctcgcgctccacatccacatctacaccggctagctagctagtgcggagcacatgttgcgtcggtctggactcgcggaggtctcagatcagaaaggaacgccggccggcggcgcgtcctgtgttgctgctcttgttcctctgcagttcgatcgattcgaccaagtgcttgtaactgcctagcttcctcgttgctatgctagttactctctgctatctatcatgtaaaggccgccatggtcgtccatctgtagctgggcttgcagcaacaggaactagtgcgtgccctttaattaatggaatctgttcgttggttgcttaattaattcgcactccgttcgtcccgatttccggtcgctgttt

SEQ ID NO: 2039 - DNA, 911 bp, Oryza sativa
cagcaacaggcaggctggtccacgccgtcggcggcttggcttttaccgatcgctacgctttgcgagcgcatttcgtcgggggcccgcgtgcggcgtcgccttccatccgcatcaaaagcgaaccggtggagccgtgttcctcacctttccccttctctcttcttcttcttcttcccgttgttgtgtttctctccacttcactgtgctgctgttcgtggaggaggaggaggagatggcggactgggcgccggtggtggtgggggtggtgctgttcgtgctgctctcgccggggctgctggtggagctccccggcacgcaccgccacgtcgacttcggcagcttccgcaccaacggcaaggccatcttcgtccacaccctcatcttcttcgccgccttcgccatcctcaccctcgccctccacctccacatctacaccggctagtcacctagtactcttctccaatttccatccatctctctcattccctcctcccttcaatttcacttcgtctctctcctactcctatgcatactaattacttagtaatttctagctagctgctctgtaacaagggaaatatttactgcaactgtactatgctagcccgctactgagtgcaggaaactgtaagtcgattgaagctcttctgttgaatctagctagcaaagaatgtcaatttcttgttgctgcatactgttcctgcctcttcctttgtttgttcttagtttctaggagtactcatcatgtggatcgatcgagtgtcgtcccggcctatgttacatgctcgtttgttagtgtgcgcaggggagccaatgcatttttgtcagcagatcagtatacctactacgtataaaccacggttgcttcaacatattgaagttcattgcagaatttaggtcgccttttctgg

SEQ ID NO: 2040 - DNA, 619 bp, Oryza sativa
gtcgggggcccgcgtgcggcgtcgccttccatccgcatcaaaagcgaaccggtggagccgtgttcctcacctttccccttctctcttcttcttcttcttcccgttgttgtgtttctctccacttcactgtgctgctgttcgtggaggaggaggaggagatggcggactgggcgccggtggtggtgggggtggtgctgttcgtgctgctctcgccggggctgctggtggagctccccggcacgcaccgccacgtcgacttcggcagcttccgcaccaacggcaaggccatcttcgtccacaccctcatcttcttcgccgccttcgccatcctcaccctcgccctccacctccacatctacaccggctagtcacctagtactcttctccaatttccatccatctctctcattccctcctcccttcaatttcacttcgtctctctcctactcctatgcatactaattacttagtaatttctagctagctgctctgtaacaagggaaatatttactgcaactgtactatgctagcccgctactgagtgcaggaaactgtaagtcgattgaagctcttctgttgaatctagctagcaaagaatgtcaatttcttgttgctgcat

SEQ ID NO: 2041 - DNA, 512 bp, Secale cereale
cccgttcttcctcctcctttctccggatccttctcgagttacagtcgtgagatcagatcgacccaagaagaagcagcgagggggaacagctagaggatggcggactgggcgccggtggtggtgggggtggtgctcttcgtgctgctctcgccggggctgctcttcgagatgccggggtcgcaccgccacgtcgacttcggcggcttccacaccaacggcaaggccatcttcgtccacaccctcctcttcttcgccgccttcaccatcctcaccctcgccctccacatccacatctacgccggatagataccccatactccatagattcatagctagctcctgcctgtctgcgtaccgttcccttgctcggttagtcgatcccctccatgtaatttgtgctcgcagatctgtactgcttgctatcagtccaagagtgttgacgtgttgcgctgtctgtctgtttatttatctgataacatctgatgtccttggcatcgtctggggatcgatac

SEQ ID NO: 2042 - DNA, 374 bp, Triticum aestivum
  misc_feature (166)..(166): n is a, c, g, or t
  misc_feature (175)..(175): n is a, c, g, or t
  misc_feature (188)..(188): n is a, c, g, or t
  misc_feature (202)..(202): n is a, c, g, or t
  misc_feature (242)..(242): n is a, c, g, or t
  misc_feature (267)..(267): n is a, c, g, or t
  misc_feature (271)..(271): n is a, c, g, or t
  misc_feature (284)..(284): n is a, c, g, or t
  misc_feature (306)..(306): n is a, c, g, or t
  misc_feature (313)..(313): n is a, c, g, or t
  misc_feature (317)..(317): n is a, c, g, or t
  misc_feature (320)..(320): n is a, c, g, or t
  misc_feature (357)..(357): n is a, c, g, or t
  misc_feature (360)..(360): n is a, c, g, or t
ctcctagtctcctctccacactcccgctctcctgctactctgctccgtgatctggtctggtgagatcggggatcggaccgtcgactcgacaaacatggcggactggggccccgtggtggtgggcgtggtgctgttcgtgctgctctcgccgggcctgctctgcganctgccgggnacccaccgccacntcgacttcggcggnttccacaccaacggtaaggccatcttcgtccagaccctcnatcttcttcgccgccttcaccatcntcangctcgcgctccanattcacatctacagcggctatntagctangtcngancatatgttgcgtccgtctggactcgcggaggtctcanatnagaaaagaacccgg

SEQ ID NO: 2043 - DNA, 744 bp, Secale cereale
tcctactttcccatcctccgccgcttgcctcctcctttctgctatatactagaagaatccactcccccactccactcccgttcttcctcctccttttctcctcatccttctcgagttacagtcgcgagatcagatcgacccaagaagaagaagcggcgaggggggaggatggcggactgggcgccggtggtggtgggggtggtgctcttcgtgctgctctcgccggggctgctcttcgagatgccggggtcgcaccgccacgtcgacttcggcggcctccacaccaacggcaaggccatcttcgtccacaccctcctcttcttcgccgccttcaccatcctcaccctcgcactccacatccacatctacgccggctagatacccgatagcccgcccataccccatagattcatagctagcccatgcctgtctgcgtagtactcttctcttgctcggtcaatcgatcccctccatgtaatctgcttgtaatccgtgctcgccagatctgtaccgcttgctgtcagtccaagagcgttgaggtgctgcgctctgtccgtttatttatctgataacatctcatgtccttgtcatcgtctgaggaatcgttcgatctgctgcagcaagttagattagcgactggcttcaatcagtgggtatgtcattttaattagtcgctgggcatgtcactggagttggtcgccatccactgattgaagccagtcgctaatctaacttgctgcagtc

SEQ ID NO: 2044 - DNA, 516 bp, Festuca arundinacea
ggcacgaggccgcactccactctctttctcagttccttctcgagtaccactagctgcgaggcatcaagatcagatcagttgcgctccctgtaagcagcgcgagctcggagatggctgactggggtccggtggtggtgggggtggtgctcttcatcctgctgtcgccggggctgctgttcgagatcccgggctcgcaccgccacgtcgatttcggcagcttccgcaccaacggcaaggccatcttcgtccacaccctcatcttcttcgccgccttcaccatcctcacgctcgcgctccacatccacatctatgccggataggctactagttactagactatgggtgtatgaactactagctcatgcctgcgcgcatcttgctctcttgttcggttcatggatccccttcatggttctcccatgaatctgtaatccctgcgtcctgtctacttctgttgtcgtcatatgggtgtaccagatccatactactccctaattagttgatgcggattaagtt

SEQ ID NO: 2045 - DNA, 615 bp, Triticum aestivum
atactcctccagaatccactcccccactccactgccgacccttcccgagcgctcctgcgtgttcacaaccaagatccatatctgcggccgtgagatcagatcagatcagatcgaccgaagtccaaggaagaaggagaagcggcggaggatggcggactgggcaccggtggtggtgggggtggtgctgttcgtgctgctctcgccggggctgctgttcgagatgccggggtcgcaccgccacgtcgacttcggcggcctccacaccaacggcaaggccatcttcgtccacaccctcctcttcttcgccgccttcaccatcctcaccctcgccctccacatccacatctacgccggctagactgacaccccataccccatagatgcgccatgtactaccaatactactagctagctcttgcctgtccgcgtgctgttctcttgctcggtaaatcgatcccctccatgtaatcaatctgcttgtaatccaatccctgcctgcaaatctggtgaagaagcgtgttgattgaggtgctgtgctgtgcctgtttatttatctgatccgatctgatgtgatgtgatgagatgtctctgtcaccgtgtgcccctcgatctgtt

SEQ ID NO: 2046 - DNA, 578 bp, Triticum aestivum
tcctactttcccctgctccgccgctcgcggcctcctttctatatactccagaatccactcccccactccactcgccctctctcccccgagtcttcccgagtacttctgtgtgttcatagccgtgagatcagatcagatcgaccaaagaagaagaagaagaagaagaagcgagggagagcaggcggcggaggatggcggactgggcgccggtggtggtgggggtggtgctcttcgtgctgctgtcgccggggctgctgttcgagatgccggggtcgcaccgccacgtcgacttcggcggcctccacaccaacggcaaggccatcttcgtccacaccctgctcttcttcgccgccttcaccatcctcaccctcgccctccacatccacatctacgccggctagatagatcgatacaccatgtactaccagtagcctagctcctgcctgtctgcgtactcttctcttgctcggtcgatcgatcccctccatgtaatccgcttgtaatccgtgcttgccggatctctctgtactgccatcggttgaagaagaagcgtgttgaggtgctgcgctatgcctgtt

SEQ ID NO: 2047 - DNA, 791 bp, Triticum aestivum
atcgaatcgcgccaaccgtccgcgtgacggctgctcctttgttccctcctactttcccctgctccgccgctcgcccccttcctatatactcctccagaatccacctcccccactccactgccgacccttcccgagcgctcctgcgtgttcacaaccaagatccatatctgcggccgtgagatcagatcagatcagatcgaccgaagtccaaggaagaaggagaagcggcggaggatggcggactgggcaccggtggtggtgggggtggtgctcttcgtgctgctctcgccggggctgctgttcgagatgccggggtcgcaccgccacgtcgacttcggcggcctccacaccaacggcaaggccatcttcgtccacaccctcctcttcttcgccgccttcaccatcctcaccctcgccctccacatccacatctacgccggctagatagacaccccataccccatagatgcgccatgtactaccaatactactagctagctcttgcctgtccgcgtgctgttctcttgctcggtaaatcgatcccctccatgtaatcaatctgcttgtaatccaatccctgcctgcaaatctggtgaagaagcgtgttgattgaggtgctgtgctgtgcctgtttatttatctgatccgatctgatgtgatgtgatgagatgtctctgtcaccgtgtgaggatcgatctgttgcaacaggttgattagcgacccacttcaatggtagcttagcttagctcgtcgtcgtcgctgggtaggaggtctacggtgaagtcggagtc

SEQ ID NO: 2048 - DNA, 886 bp, Brachypodium distachyon
gccccgtgcgccgcgctagctgctttctacagtacattgcatcccgcctgatacaaggcatccatccccatccgcgtcgaatcgtgccaagcgtgtgacggctgcttttccccacgctttcccttcctcggccgaaccccggctatataccactcctccactccactccccatccctctcccggccgcaacttcttctcgaccagatcagagcactagatagatctcttgattctccttgcgcctggatcgagtccaagcggaggggagatggctgactggggccctgtggtgatcggggtggtgctgttcatcctgctgtcgccggggctgctgttcgagatcccggggtcgcaccgccacgtcgacttcggcagcttccgcaccaacggcaaggccatcttcatccacaccctcatcttcttcgccgccttcaccatcctcaccctcgcgctccacatccacatctacgccggatagatgcgtacagcacaaaactaccccaaagcctaccgatcctctcctctcttgttctcttctttggtatgaaatcgatccggccggcggccatgaatctgtaatccgagcttgtcgtcttcccccgcctaagtctgttgtcatctggctgtaccgaccagatccgtactagtattagctgaagcggattaagttgctgccttctggttatctgatcggtcttgttgtcaccatgtggatcaatgagattttatttcttctctcttttattttgcaatgagtttgcggcttcagtggctcgcttaaatcagctctgctcaccatctctgctctttgtagtcgctgcacatgatggctgatgtcttatctcattcactttccgtaagaaaaactaaacttcctgtgggatc

SEQ ID NO: 2049 - DNA, 939 bp, Brachypodium distachyon
gccgcgctagctgctttctacagtacattgcatcccgcctgatacaaggcatccatccccatccgcgtcgaatcgtgccaagcgtgtgacggctgcttttccccacgctttcccttcctcggccgaaccccggctatataccactcctccactccactccccatccctctcccggccgcaacttcttctcgaccagatcagagcactagatagatctcttgattctccttgcgcctggatcgagtccaagcggaggggagatggctgactggggccctgtggtgatcggggtggtgctgttcatcctgctgtcgccggggctgctgttcgagatcccggggtcgcaccgccacgtcgacttcggcagcttccgcaccaacggcaaggccatcttcatccacaccctcatcttcttcgccgccttcaccatcctcaccctcgcgctccacatccacatctacgccggatagatgcgtacagcacaaaactaccccaaagcctaccgatcctctcctctcttgttctcttctttggtatgaaatcgatccggccggcggccatgaatctgtaatccgagcttgtcgtcttcccccgcctaagtctgttgtcatctggctgtaccgaccagatccgtactagtattagctgaagcggattaagttgctgccttctggttatctgatcggtcttgttgtcaccatgtggatcaatgagattttatttcttctctcttttattttgcaatgagtttgcggcttcagtggctcgcttaaatcagctctgctcaccatctctgctctttgtagtcgctgcacatgatggctgatgtcttatctcattcactttccgtaagaaaaactaaacttcctgtgggatcgatccttttcagtgctagtctgcgctgtaaactttttgtactccgccttgcattcaagcgtt

SEQ ID NO: 2050 - DNA, 786 bp, Elaeis guineensis
tttacttttccgttccctttcttctctttccttctttccgttctccctctaatctcctccctttctttctccaatatcaccccctttacaattaacctctcctctctcttgttattgggttctcacacggagagagagattagatagatagagagagatggcggactgggcgccggtgttggtgggggtggtgctgttcgtgctgctgtcgccggggttgctgttcgagctcccgggaacacaccgggcggtggacttggggggattccacaccaacgggaaggccgtcgccgtccacactctcatcttcttcgccgtcttcaccatcatcatcctcgccctccacctccacatctacaccgggtgatgatgatctacttaggcttagatacttgctcactactttaatcttagctttccatggccatgtgagcactaccgttgttactgttgttgctgttgttgtgatgaatgaagagaagaacactctaattttatccttgtcctctttcttttgatccatttctaccacaagtgcaagggaggttttttttgtctgtttatgatgttccgccggaacgtggaaacagaggcatgtccttttctttgctggttggatggatctttatttattatatatgccattcatccatcattccacgagtcccaccgcagttgtgatcattactcatggtgggccacccgcttgaccattggtttcatgctagctagcttttgttacatttatattgtaggggatgtggaatgaatgattgtgatttctct

SEQ ID NO: 2051 - DNA, 654 bp, Triticum aestivum
gcaggaattcggcacgagggcgcggcttgcatcccatccgatgcaaggcatggaatcgcgccaaccgtccgcgtgacggctgctcctttgttccctctccactcctctactttcccctgctccgccgctcgcctcctcctttctatatccgctccagaatccactcccgagccttcccgagtagtactcatatgcagccgtgagatcagatcgaccgaccgaagaagaagaaggagaagcgaggggagatcagccagcgggcggaggatggcggactgggcaccggtggtggtgggggtggtgctcttcatcctgctctcgccggggctgctgttggagatgccggggtcgcaccgccacgtcgacttcggcggcctccacaccaacggcaaggccatcttcgtccacaccatcctcttcttcgccgccttcaccgtcctcaccctcgccctccacatccacatctacgccggctagatacccatagcccagagattcatagatgcgccatgtaatctgctactagtactagctagctcttgctcagtcaatcgatcccctccatgtaatccgcttgtaatccctgcttgcttgccagatctctctgtactgccatcggttcaagaagaagcgtattgaactaaaaaaaaaaaa

SEQ ID NO: 2052 - DNA, 564 bp, Hordeum vulgare
ctcgcctcctttctttatagcgcgccaagaatcaatccactcccctccttcctcctccctcccgagccttcccgagcactcctgagatcagatcgaaggaagaagaagaaggagaaggcaagggaggatcagcggatggcggactggggcccggtggtggtgggggtggtgctcttcatcctgctcacgccggggctgctgttcgagatgccggggtcgcaccaccgcgtcgacttcggcggcctccacaccaacggcaaggccatcttcgtccacaccatcctcttcttcgccgccttcaccatcctcaccctcgccctccacatccacatctacgccggctagattcatgtacatactactgtacttcaactagctagctatacttgtgtgcatgtaatgggtccgtgctcgccagatctgtactgctgcttgctatcagttgaagaagcgtattgaagctgctgcgctctgtctgtttgtttatctcactgatgttgtactcctacttgtcgtcggctggggatcgatccatctgttgcaacaagttgatttgcgactggc

SEQ ID NO: 2053 - DNA, 900 bp, Hordeum vulgare
cctactttcccttcccccgtcgctcgcctcctttctttatagcgcgccaagaatcaatccactcccctccttcctcctccctcccgagccttcccgagcactcctgagatcagatcgaaggaagaagaagaaggagaaggcaagggaggatcagcggatggcggactggggcccggtggtggtgggggtggtgctcttcatcctgctcacgccggggctgctgttcgagatgccggggtcgcaccaccgcgtcgacttcggcggcctccacaccaacggcaaggccatcttcgtccacaccatcctcttcttcgccgccttcaccatcctcaccctcgccctccacatccacatctacgccggctagattcatgtacatactactgtacttcaactagctagctatacttgtgtgcatgtaatgggtccgtgctcgccagatctgtactgctgcttgctatcagttgaagaagcgtattgaagctgctgcgctctgtctgtttgtttatctcactgatgttgtactcctacttgtcgtcggctggggatcgatccatctgttgcaacaagttgatttgcgactggcttcagcggtggtagtagtagtagtacagcccatcatcatcgattcgatgtgcgtttcaattagtcgctgggcatgctactggagtctgttatcatccaccttccgattattattttcgactttctgcgcaagggaatatatatataaatatatatccctcagctcatcaaagccactagggcctcttgattcgtgggattttaaagttgcagggatggaaaaaatatagggttgaagcggcatgttgatttgaaccctacagaatcagcaaagagtgcttgatgtcacgtgacaaactaaggaattgtaaaaac

SEQ ID NO: 2054 - DNA, 330 bp, Elaeis guineensis
  misc_feature (155)..(155): n is a, c, g, or t
  misc_feature (317)..(317): n is a, c, g, or t
ccctctaatctcctccctttctttctccatatcaccccctttacaattaacctctcctctctcttgttattgggttctcacacggagagagagattagatagatagagagagatggcggactgggcgccggtgttggtgggggtggtgctgttcntgctgctgtcgccggggttgctgttcgagctcccgggaacacaccgggcggtggacttggggggattccacaccaacgggaaggccgtcgccgtccacactctcatcttcttcgccgtcttcaccatcatcatcctcgccctccacctccacatctacaccnggtgatgatgatc

SEQ ID NO: 2055 - DNA, 1854 bp, Zea mays
gccgaacgacccggcccaagctgccatcgaggagggacgagggagggatccagcgagcggagcggagcggacgccaccctcgcgcgcacacctacgcgcaggcgcatacaccaacgacgccgaccccttccagggagggagggagggaaccacacaaccggacccgacccgacgccccgaggcgaaggcgagggcgagcggtcagccggccggggcggggaccaggggggatcccctcggcggcggcggccatgggcgcggcctccccggcgatgtgggccgggctggtcctggtggtgttattggccgcatcgggcccggcgtcggcggggctgccgaggttcgccgaggcgcccgagtacaggaacggggacgggtgcccggccccggtgacgggcgcgggggtctgcgacccgggcctggtgcacatcgccatgacgctcgacgcgcactacctcaggggctccatggcggccatctactcgctgctcaagcacgcctcctgcccggagtccatcttcttccacttcctcgccgcggagggcggcggcgcgccggccgtcgccgagctccgggccgccgtggccgcctccttcccgtccctgcgcttcgagatctacccgttccgcgccgacgcggtcgccgggctcatctccgcgtccgtgcgcgccgcgctcgaggcgccgctcaactacgcgcgcaaccacctcgccgacctgctcccgcgctgcgtgccgcgcgcgatatacctcgactccgacgtgctcgccgtcgacgacgtgcggcgcctctgggagacgcgcctgcccgccgccgcggtcgtcgccgcgcccgagtactgccacgccaacttctcccgctacttcaccgaggccttctgggacgaccccgtcctcggcgccagggtctttgccggccgccgccgcgcgccctgctacttcaacaccggcgtcatggtcatcgacctccggaggtggcgcgttggcaactaccgccagcgcatcgagcgctggatggagatgcagaaggagaaaagaatctacgagcttggctccttgccccccttcctgctcgtcttcgccggcgagatagaggccgtcgaccaccggtggaaccagcacggcctgggcggcgacaacgtcttcggcagctgccgccctctccataacgggcccgtcagcctgatgcactggtccgggaagggcaagccatgggaccgtctcgacgccggcaagccttgccccctcgaccacacctggaagtcgtacgacctctacattggcgagaatgattcttcaccagcatcagggccgtcccggtcagccttgtcatcgttggtggcatggtagaagttcatatacacaataattctttgatctcgggtgcccgtggttcttggccggtaatggaattgccttgcgatgcattcccactgccggctgccgccacagctgctgccgcaagccagctgccgccttcggctgtacaggacagtgaggggaggggcggtatacagattgcagcaggagcagcagcagcagcaagggggtgaagacagtgaatagcgggggggagcaaattcttgttcgttttgcactatgattgagattgattcattaggctctggtttggaggctgtgactatcatgggatggaaggaattacttggttggtggtgtacaattcttggataggacaaaggtttcggttttttggtgtattagttcagaattgtttcatttacatgtctattcagtacactcgtgtaatacggattaaattgatttgaaacaaattgagtgcatcctggtcgtgtacctgtgctgaaatcctgctctctttgtgactttcgtc

SEQ ID NO: 2056 - DNA, 1833 bp, Zea mays
cgcgtgctttattggtaacgcttcttctccacatctaaatgtccccgacaaaacgacctggccggccgatcgagctgccatcgaggtcgaggaggcgtccagcgaacggagcggacgccaccgggcgcgcacacctacgcgtaggcgcatagaccaacgcgccgaccacttccagggagggaaccacacaaccggacccgacgcccccgaggcgagcgcgagcggtgggccggccggggcggggaccaaggggggtcccctcggcggcggtggccatgggcgcggcctccccggcgatgtgggccgggctggtgctggtggcgttattggccgtatcggggccggcggtggcggcggggctgccgaggttcgccgaggcgcccgagtacaggaacggggaggggtgccctgcccctgtggcgggcgcgggggtctgcgacccgggcctggtgcacatcgccatgacgctcgacgcccactacctcaggggctccatggcagccatctactcgttgctcaagcacgcctcctgcccggagtcgctcttcttccacttcctcgctgcggcggagggcggcggcgcgccggcggcctccgggctccgggccgtcgtggcggcctccttcccgtccctgagcttcgagatctacccgttccgcgccgacgcggtcgccgggctcatctccgcgtccgtgcgcgccgcgctcgaggcgccgctcaactacgcgcggaaccacctcgccggcctgctcccgcgctgcgtgccgcgcgcgatatacctcgactccgacgtgctcgccgtcgacgacgtgcggtggctctgggagacgcggctgcccgccgccgcggtcgtcgccgcgcccgagtactgccacgccaacttctcgcgctacttcaccgacgccttctgggacgaccccgtcctcggcgccagggtcttcgccggccgccgccgcgcgccctgctacttcaacacgggtgtcatggtcatcgacctccggaggtggcgcgtcggcaactaccgccagcgcatcgagcgctggatggagatgcagaaggagaagaggatctacgagcttggctccttgccccccttcctgctcgtcttcgccggcgagatagaggccgtcgaccaccggtggaaccagcacggcttgggcggcgacaacgtgttcggtagctgccgccctctccataacgggcctgtcagcctcatgcactggtccgggaagggcaagccatgggaccgtctcgacgccggcaagccttgcccactggaccacacctggaaggcgtacgacctctacattggcgagaatgattcatcatcttcagggccgtcacggtcagcattgtcatctttggcggcatggtagaagttcagatacgcaacacgatagttctttgatttggggatgccgtggttcttggccggtaatggaattgccttgcgatgcaccagtgccgccacagcggctgctgcaagccagctgccgccctcggctgtacaggacagtgaggtgaggggcggtatacagattgcagcggcagcgaggggacgaagacagtaaaataggggtatggggagccaaattcttgttcattttgcactatgatacatattgattcattaggccctgggttgttggaggttgtgactatcatgagttgggaagaaattacttgattggtggtgtacaattcttggacaggatacaggttccagtttttggtccattagttcaggaattgtttcatttacatgtctattcagtacactcgtataatatggattaagttgatttgaaacgaatcgatgagtgcatcctgacc

SEQ ID NO: 2057 - DNA, 2114 bp, Zea mays
ggtcatcggtcaggatgcactcatcgattcgtttcaaatcaacttaatccatattatacgagtgtactgaatagacatgtaaatgaaacaattcctgaactaatggaccaaaaactggaacctgtatcctgtccaagaattgtacaccaccaatcaagtaatttcttcccaactcatgatagtcacaacctccaacaacccagggcctaatgaatcaatatgtatcatagtgcaaaatgaacaagaatttggctccccatacccctattttactgtcttcgtcccctcgctgccgctgcaatctgtataccgcccctcacctcactgtcctgtacagccgagggcggcagctggcttgcagcagccgctgtggcggcactggtgcatcgcaaggcaattccattaccggccaagaaccacggcatccccaaatcaaagaactatcgtgttgcgtatctgaacttctaccatgccgccaaagatgacaatgctgaccgtgacggccctgaagatgatgaatcattctcgccaatgtagaggtcgtacgccttccaggtgtggtccagtgggcaaggcttgccggcgtcgagacggtcccatggcttgcccttcccggaccagtgcatgaggctgacaggcccgttatggagagggcggcagctaccgaacacgttgtcgccgcccaagccgtgctggttccaccggtggtcgacggcctctatctcgccggcgaagacgagcaggaaggggggcaaggagccaagctcgtagatcctcttctccttctgcatctccatccagcgctcgatgcgctggcggtagttgccgacgcgccacctccggaggtcgatgaccatgacacccgtgttgaagtagcagggcgcgcggcggcggccggcgaagaccctggcgccgaggacggggtcgtcccagaaggcgtcggtgaagtagcgcgagaagttggcgtggcagtactcgggcgcggcgacgaccgcggcggcgggcagccgcgtctcccagagccaccgcacgtcgtcgacggcgagcacgtcggagtcgaggtatatcgcgcgcggcacgcagcgcgggagcaggccggcgaggtggttccgcgcgtagttgagcggcgcctcgagcgcggcgcgcacggacgcggagatgagcccggcgaccgcgtcggcgcggaacgggtagatctcgaagctcagggacgggaaggaggccgccacgacggcccggagcccggaggccgccggcgcgccgccgccctccgccgcagcgaggaagtggaagaagagcgactccgggcaggaggcgtgcttgagcaacgagtagatggctgccatggagcccctgaggtagtgggcgtcgagcgtcatggcgatgtgcaccaggcccgggtcgcagacccccgcgcccgccacaggggcagggcacccctccccgttcctgtactcgggcgcctcggcgaacctcggcagccccgccgccaccgccggccccgatacggccaataacgccaccagcaccagcccggcccacatcgccggggaggccgcgcccatggccaccgccgccgaggggaccccccttggtccccgccccggccggcccaccgctcgcgctcgcctcgggggcgtcgggtccggttgtgtggttccctccctggaagtggtcggcgcgttggtctatgcgcctacgcgtaggtgtgcgcgcccggtggcgtccgctccgttcgctggacgcctcctcgacctcgatggcagctcgatcggccggccaggtcgttttgtcggggacatttagatgtggagaagaagcgttaccaataaagcacgcgtgaaaggttccaacgcgcgcttcgttggcttctgtcatttctttgcttaccgggcttcagcatttcatcgtctgcaggactgcaattgcaattgcaattgcaatgcaaggccgcgggacaggggttaattacggcgtggttaacgagctggggtgtttaattagggctaattcgggcggaattagcagcaggacgccagctcctgttcgacgtccttcccgtgttctgttgttgtcgtcgacgtctgatgctttattatgtgctgtgttagtac

SEQ ID NO: 2058 - DNA, 1781 bp, Setaria italica
ccagccagccatcgatcgatccagccagcgccaccaccccaacgaacgcgtacaccaccaacgacgccgaccacttcccagggagggaaccacacgacccacccgaccccgagacccgaccgcccccgagggcgagggcgagggcgagccggccgcggcgggggatcccctcggcgccggccatgggcgcggccaccccggcgatgtgggccgggctggtgctggcggcgatgttgttattggcccaatcggggccggcggcggcggcggggctgccgaggttcgccgaggcgcccgagtaccggaacggggaggggtgcctggcgcccgtggccggcgcgggggtctgcgacccgggcctcgtccacatcgccatgacgctcgacgcgcactacctccggggctccatggcggccatctactcgctgctcaagcacgcctcctgcccggagtcgctcttcttccacttcctcgccgcggagggcggcggcgcgccgccggtcgccgacctccgggccgccgtcgccgcctcgttcccctcgctgcgcttcgagatctacccgttccgcgccgacgcggtcgccgggctcatctccgcctccgtgcgcgccgcgctcgaggcccctctcaactacgcgcggaaccacctcgccgacctgctcccgcgctgcgtgccgcgcgcgatatacctcgactccgacgtgctcgccgtcgacgacgtgcgcaggctctgggagacgcgcctgcccgccgccgcggtcgtcgccgcgccagagtactgccacgccaacttctcccgttacttcaccgaggccttctggaacgaccccgtcctcggcgcgcgggtcttcgccgggcgccgccgcgcgccctgctacttcaacaccggggtcatggtcatcgacctccggagatggcgcgtcggcaactaccgccagcgcatcgagcgctggatggagatgcagaaagagaagagaatctacgagctcggctccttgcccccgttcttgctcgtcttcgccggcgagattgaggccgtcgaccaccggtggaaccagcacggcttgggcggcgacaacgtgttcggcagctgccgccccctccacaacggtcccgtcagcctgatgcactggtccggaaagggcaagccatgggaccgcctcgacgccggcaagccttgcccgctcgaccacacctggaagtcgtacgacctctacattggcgagaatgattcatcagcatcagggcagtcccggtctgccttgtcatcatcggcggcattgcctgcggcggtgttttcttggtaggagaagctgaagacatacatacacaataattctttggtttggggatgccgtggttcttggctggtaatggaattgccttgcaatgcattgccactgccaccacggctgctgctgctgctgcaaacgagctgccgccttcggctgtacaggacagtgaggggaggggcggtatacacattgcggtggtggcaaggggatgaagacagtgaatagagggagagcaaattcttgttcagttgcactacgattcagattgattcattgggctttgattggtggagactatcaggggttggaaggaattacttgattggtggtgtacaattcttggataggataaaggtttcagttttttttggtctaatagttcagaattgtttcatttacatgtctattcagtacactcttataatatggattaaattgatttgaatcaaattgagtggatcctgttcttgtgcctgtgccggaatc

SEQ ID NO: 2059 - DNA, 1133 bp, Setaria italica
gagccggccgcggcgggggatcccctcggcgccggccatgggcgcggccaccccggcgatgtgggccgggctggtgctggcggcgatgttgttattggcccaatcggggccggcggcggcggcggggctgccgaggttcgccgaggcgcccgagtaccggaacggggaggggtgcctggcgcccgtggccggcgcgggggtctgcgacccgggcctcgtccacatcgccatgacgctcgacgcgcactacctccggggctccatggcggccatctactcgctgctcaagcacgcctcctgcccggagtcgctcttcttccacttcctcgccgcggagggcggcggcgcgccgccggtcgccgacctccgggccgccgtcgccgcctcgttcccctcgctgcgcttcgagatctacccgttccgcgccgacgcggtcgccgggctcatctccgcctccgtgcgcgccgcgctcgaggcccctctcaactacgcgcggaaccacctcgccgacctgctcccgcgctgcgtgccgcgcgcgatatacctcgactccgacgtgctcgccgtcgacgacgtgcgcaggctctgggagacgcgcctgcccgccgccgcggtcgtcgccgcgccagcacgccaacttctcccgttacttcaccgaggcctctggaacgacccgtcctcgcgcgcgggtcttcgcccgggcgccgccgcgcgccctgctacttcaacaccggggtcatggtcatcgacctccggagatggcgcgtcggcaactaccgccagcgcatcgagcgctggatggagatgcagaaagagaagagaatctacgagctcggctccttgcccccgttcttgctcgtcttcgccggcgagattgaggccgtcgaccaccggtggaaccagcacggcttgggcggcgacaacgtgttcggcagctgccgccccctccacaacggtcccgtcagcctgatgcactggtccggaaagggcaagccatgggaccgctcgacgccggcaagccttgcccgctcgaccacacctggaagtcgtacgacctctacattggcgagaatgattcatcagcatcagggcagtcccggtctgccttgtcatcatcggcggcattgcctgcg

SEQ ID NO: 2060 - DNA, 1779 bp, Panicum virgatum
cccccagctagcccaggacatcgatccatccatccagccggggccagggccagcgccaccaccccaacgaacgcgtacaccaccaacgacgccgaccacttctagggaggaggacccgaccgacccgacccccgcgagggcgagggcgagcggcgagccgggggccaaggggggattcccctcgtcgtcgtcggcggcggccatgggcgcggcctccccggcgatgtgggccgggctcgtgctggcggccttgttattggcgcaatcggcggcgggggcgctgccgaggttcgccgaggcgcccgagtaccggaacggggaggggtgcccggcgccggtggcgggcgcgggggtgtgcgacccgggcctggtgcacatcgccatgacgctcgacgcgcactacctccggggctccatggcggccatctactcgctgctcaagcacgcctcctgcccggagtcgctcttcttccacttcctcgccgcggggggcggcggcgcgccgccggtcgccgacctccgggccgccgtcgccgcctccttcccctccctgcgcttcgagatctacccgttccgcgccgacgcggtcgccgggctcatctccgcctccgtgcgcgccgcgctcgaggcgccgctcaactacgcgcggaaccacctcgccgacctgctcccgcgctgcgtgccgcgcgcgatatacctcgactccgacgtgctcgccgtcgacgacgtgcgcaggctctgggagacgcgcctgcccgccgccgcggtcgtcgccgcgccagagtactgccacgccaacttctcccgctacttcaccgaggccttctggaacgaccccgtcctcggcgcgcgggtcttcgccggccgccgccgcgcgccctgctacttcaacaccggggtcatggtcatcgacctccggagatggcgcgtcggcaactaccgccagcgcatcgagcgctggatggagatgcagaaggagaagagaatctacgagcttggctccttgcccccattcttgctcgtattcgccggcgagattgaggccgtcgaccaccgctggaaccagcacggcttgggcggcgacaacgtgttcggcagctgccgacccctccacaacggccccgtgagcctcatgcactggtccgggaagggcaagccatgggaccgcctcgacgccggcaagccttgcccgctcgaccacacctggaagtcgtatgacctgtacattggagagaacgattcatcagcatcatggcagtcccggtcctccttgtcatcatcggcggcattgcctgctggggtgttttcttggtagaagaagctcaagacatacacaataattcattggtttgagggtgccgtggttcttggctggtaatggaattgccttgcaatgcattgccactggccaccaccacggctgctgctgctgcaagcgagctgccgccttcggctgtacaggacagtgaggggaggggcggtatacacattgcggcggcaaggggatgaagacagtgaatagagggagagcaaattcttgttcatttgcactacgattcagattgattcgttaggctgtgattggtggtgactatcaggggtgggaaggaattacttgattggtggtgtacaattcttggataggataaacgtttcagtttttctttggtcagttagttcagaattgtttcatttacatgtctattcagtacacgcgtataatatggattaaattgatttgaatcaaattgagtggatcctgatcttgtgcctgtgccg

SEQ ID NO: 2061 - DNA, 1754 bp, Avena sativa
gaaggaggggcagattggttggaacaaacgccgaccatttcctccgctctctctctctctctctctttctctctctcgaaccaacccagcccgcccgagaagaacccaacccgagcccccggaacgagacagagagagagaagaagagaggacccgagggaagggaggggggagccctagccggagccggtggcggccatgggcggcgccgcaccggggatgtgggccggcctcgtcctggtggcgttcttggccgcatcgggggcgggggcatcggcggggggagcgctgccgaggttcgcggaggcgcccgagtaccggaacggggagggctgcccggcgcccgtcgcgggggccggggtgtgcgacccgggcctggtccacatcgcgatgacgctcgacgcgcactacctcaggggctccatggccgccatctactcgctgctcaagcacgcctcctgcccggagtcgctcttcttccacttcctcgccgccgacgccgccgcgccgggggtcggcgagctcaggagcgcgctcgcagcgtcgttcccctccctgcgcttcgagatctacccgttccgcgccgacgccgtcacgggcctcatctcggcctccgtgcgcgccgcgctcgaggcgccgctcaactacgccaggaactacctcgccgacctgctccccaagtgcgtgcccagggcgatatacctcgactccgacgtgctcgccgtcgacgacgtgcgccgcctctgggagacgcgcctgcccgccgcggccgtcgtcgccgcgccagagtactgccacgccaacttctcccgctacttcaccgacgccttctggtccgacccggagctcggcgcgcgcgtcttcgcgggccgccgccgcgcgccctgctacttcaacaccggggtcatggtcatcgacctccggcgctggcgttcaggcaactaccgtcaccgtatcgagcagtggatggagctgcagaaagagaaaagaatctacgagctggggtctttgcccctttcttgctcgtcttcgccggtgaggtggaggctgtcgaccatcggtggaatcagcacggtttgggcggtgacaacgtgctcggtagctgccgtcccctccacaagggtcctgtcagcctgatgcactggtctggcaagggcaagccatgggatcgcctcgacgccggcaggccttgcccgctcgaccacacctggaagtcatacgacctctatgttgaccaaggtgatgcatcgtcagcatcagcgccgtccctgacctcattgtcatcatcggcattgcccgcggcggtgttctcttggtagaaagatatacatcacacgctaaattcttttcatttggggtgcttgggtttgtcggtggcaacgcaattgccttgcaatgcattgccactgccaccatagctgccaccgttagccggctgccgccttcggctgtacagcaaggggaggggcggtacattgcagcggctgcgaaaggaagaggaacagtgcacagaggaagcaaattcttgttcatccgggatacgattcagattgattcattatgctttggttctgatggggtgttggaattacttgattggtggtgtacaattcttggatagtaggaagataaaggtttcacttttttgtctgttatagttcaggattgtttcatttacatgtctgttcagtaaacccgtataaatattgatttaattgatttcaataaaacagagtggatcctattcttgttgc

SEQ ID NO: 2062 - DNA, 1675 bp, Brachypodium distachyon
agaaagagagattggttgcaaggaaggaacaaacgccgaccacttctcaagggaaaaagggcgaaccaacccaaagcgaacccaaccctcccctcgagcgagcgagaggagaggagagggagggggagcgagggagcccgacccgtgcgcgcgaggagagggcctccggattacctaggagcccgcgccggcggcggcggtccatgggcggcgcctcaccggcgatgcgggccgggtgggtcctggtggcgtttatcctggccgcatctgggccgggggcggcggtcgtggcgctgccgaggttcgcggaggcgccggagtaccggaacggggacgggtgcccggcggccgtggcgggggccggggtctgcgacccgggcctcgtgcacatcgcgatgacgctcgacgcgcactacctcaggggctccatggccgccatctactcgctgctcaagcatgcgtcctgccccgagtcgctcttcttccacttcctcgccgccgcggacggcggcggccccggcgcgggagccccggaggtgggcgagctccggagcgcgctggccgcgtcgttcccctcgctgcggttcgagatctacccgttccgcgccgacgcggtgaccgggctcatctcggcctccgtgcgcgcggcgctcgaggcgccgctcaactacgccaggaaccacctcgccgacctgctccccaggtgcgtgccgcgggcgatttacctcgactcggacgtgctggccgtcgacgacgtgcggcgcctctgggagacccgcctgcccgccgccgccgtcgtcgcggcgcccgagtactgccacgccaacttctcccgctacttcaccgacgccttctggtccgaccccgacctgggtgcgcgcgtcttcgcgggacgccgccgcgcgccctgctacttcaacaccggcgtcatggtcatcgacctcaggcgctggcgttccggcaactaccgccaccgcatcgagcagtggatggagctgcagaaggagaagcgaatctacgagctcggctccttgccccctttcttgcttgtcttcgccggcgaggtggaggccgtcgaccatcggtggaaccagcacggtctgggcggtgacaacgtgctcggcagctgccgccccctccacaagggtcctgtcagcttgatgcactggtcagggaagggcaagccatgggatcgcctggacgccggcaggccttgcccgctcgaccacacctggaagtcatacgacctctacgtcgacgatggcgatgcgtcgtcggcatcagcgccttcccggacctcgttgtcgtcatcggcattgcccgcggcggtgttttcttggtagacagatacggcacatacactattattttttcatttgggtgccttggttcgtgggcggtgatggaattgccttgcaattcattgccactgcagccacagctgccactgcaagccagctgccgccttcggctgtacagcgcggagaggggcggcacattgcagcggcagcaaggagaagaggaacagtgcataggggaagcaaattcttgttcgtttgcgatacaattcagattgattcattatgctttgaccacggggttgccagactatggggtgttggagttacttgattggtggttgtacaattcttggataggataaaagctttcagtt

SEQ ID NO: 2063 - DNA, 1969 bp, Brachypodium distachyon
tccgtcgccgccgagacgagccgggacgggcaacaggaggaagaaagagagattggttgcaaggaaggaacaaacgccgaccacttctcaagggaaaaagggcgaaccaacccaaagcgaacccaaccctcccctcgagcgagcgagaggagaggagagggagggggagcgagggagcccgacccgtgcgcgcgaggagagggcctccggattacctaggagcccgcgccggcggcggcggtccatgggcggcgcctcaccggcgatgcgggccgggtgggtcctggtggcgtttatcctggccgcatctgggccgggggcggcggtcgtggcgctgccgaggttcgcggaggcgccggagtaccggaacggggacgggtgcccggcggccgtggcgggggccggggtctgcgacccgggcctcgtgcacatcgcgatgacgctcgacgcgcactacctcaggggctccatggccgccatctactcgctgctcaagcatgcgtcctgccccgagtcgctcttcttccacttcctcgccgccgcggacggcggcggccccggcgcgggagccccggaggtgggcgagctccggagcgcgctggccgcgtcgttcccctcgctgcggttcgagatctacccgttccgcgccgacgcggtgaccgggctcatctcggcctccgtgcgcgcggcgctcgaggcgccgctcaactacgccaggaaccacctcgccgacctgctccccaggtgcgtgccgcgggcgatttacctcgactcggacgtgctggccgtcgacgacgtgcggcgcctctgggagacccgcctgcccgccgccgccgtcgtcgcggcgcccgagtactgccacgccaacttctcccgctacttcaccgacgccttctggtccgaccccgacctgggtgcgcgcgtcttcgcgggacgccgccgcgcgccctgctacttcaacaccggcgtcatggtcatcgacctcaggcgctggcgttccggcaactaccgccaccgcatcgagcagtggatggagctgcagaaggagaagcgaatctacgagctcggctccttgccccctttcttgcttgtcttcgccggcgaggtggaggccgtcgaccatcggtggaaccagcacggtctgggcggtgacaacgtgctcggcagctgccgccccctccacaagggtcctgtcagcttgatgcactggtcagggaagggcaagccatgggatcgcctggacgccggcaggccttgcccgctcgaccacacctggaagtcatacgacctctacgtcgacgatggcgatgcgtcgtcggcatcagcgccttcccggacctcgttgtcgtcatcggcattgcccgcggcggtgttttcttggtagacagatacggcacatacactattattttttcatttgggtgccttggttcgtgggcggtgatggaattgccttgcaattcattgccactgcagccacagctgccactgcaagccagctgccgccttcggctgtacagcgcggagaggggcggcacattgcagcggcagcaaggagaagaggaacagtgcataggggaagcaaattcttgttcgtttgcgatacaattcagattgattcattatgctttgaccacggggttgccagactatggggtgttggagttacttgattggtggttgtacaattcttggataggataaaagctttcagtttctttttgtgtattagttcagaattgtttcattttacgtgatcattcagtgaacccgtataaatattgattgaattggttgtccttcaataaaacacagtggatcctattcttgttgctgctgtgccaaaactctgttgtatctgtcactcttcattcggaaatgcattcagaatgggctacctctctttgcattttacatctttcagagtggccaaatctacttctatttctagtttgctcgctcagttaat

SEQ ID NO: 2064 - DNA, 1880 bp, Triticum aestivum
tgcccaacccaaccagagagagagagagagagagagaggaagagcgagcccgacccaggcccccctcgttcccaccgggcgagagagaaagagggggagccctagccctagccgccgcggcgggggcgatggccgcggccgcgccggcgatgcgggccgggctggtcttggtggcgttcttgttgttggccgcatcgggggcgggggcgagggcggagggggcgctgccgcggttcgcggaggcccccgagtaccggaacggggaggggtgcccggcggcggtggccggcgcgggggtgtgcgacccggggctcgtccacatcgcgatgacgctcgacgcgcactacctccggggctccatggccgccatctactcgctgctcaagcacgcctcctgcccggagtcgctcttcttccacttcctcgccgccgacggcgccgcgcccggggtggccgagctccggagcgcgctcgcggcctccttcccgtcgctgcggttcgagatctacccgttccgcgccgacgccgtcacggggctcatctccgcctcggtgcgcgccgcgctcgaggcgccgctcaactacgcccggaactacctcgccgacctgctccccaagtgcgtgccgcgggccatttacctcgactcggacgtgctcgccgtcgacgacgtgcggaggctctgggagacgcgcctgcccgccgccgccgtcgtcgccgcgcccgagtactgccacgccaacttctcccgctacttcaccgacgccttctggtccgacccggacctcggcgcgcgcgtcttcgcgggccgccgccgcgcgccctgctacttcaacaccggcgtcatggtcatcgacctccggcgctggcgctcggggaactaccgccaccgtgtcgagcagtggatggagttgcagaaggagaagcgaatctacgagctgggctccttgccccctttcttgctcctcttcgccggcgaggtggaggctgtcgaccatcggtggaaccagcacggcttgggcggcgacaacattcttggtagctgccgcccgctccacaagggccctgtcagcctgatgcactggtcaggcaagggcaagccatgggatcgcctcgacgccggcaggccttgcccgctcgaccatacatggaaatcatacgacctctacattggcgacggtgatgcatcgcaagcatcggcgccgtcctgggcctcattgtcatcatcggcgttgccggcggcggtgttttcttggtagacagatatgggacacacgctataattttttcatttggttgtggtaatgcaattgccttgcgatgcatacccactgccatcacagctgccgtcgcaagccggctgccgccttcggctgtacagcgagaggaggggcggtacattgcggcggctgcgacgggaagaggaagaacagtgcataggggaagcaaattcttgttcattcacgatacaattcggattgattcattatgctgtgattcggaggtggtgactagggggtgttggaattactttattggtggtgtacaattcttggatagaagaaaggtttcactttttttgtctgttagttcaggattgtttcatttacatttacatgtttgttcagtaaaccagtataaatattgattgaattggtttcaataaaacagggtggatcttattcttgcttcagtgctaaactctcttgtatctgtcactcgcttgatgcagaaattccatcgagaatggcttaatctcttgttatttccatatttcgataactacatccatcggattggtcgcagtggtcgctacggaaagaagggtgttgcaatcaactttgtcacgcagcgtgatgtcgagactcttgcgagcatcgaac

SEQ ID NO: 2065 - DNA, 1706 bp, Secale cereale
atccataccgacgagccacgggaggagcgagggattggttggaacagacgccgaccacttcgtccccctcccccctcccaacccaaccacagagagagagagagagagcccgacccaggcccggcgccgaggcccccctcgttccccaccgagcgagagagagggagggcgggagggggaggacccgggagagaaacagggggagccctagccctagccggcggcggcgggggcgatggccgcgccggcgatgtgggccctggcggccttcttggtgctggccgcagtcgggggcggggcggcgggggcgctgccgaggttcgcggaggcccccgagtaccggaacggggagggttgcccggcggcggtggccggcgcgggggtgtgcgacccgggcctcgtccacatcgcgatgacgctcgacgcgcactacctccggggctccatggccgccatctactcgctgctcaagcacgcctcctgcccggagtcgctcttcttccacttcctggcggcggcccctggcgacggcgagctgcgcgccgcgctggcggcctccttcccgtccctgcggttcgagatctacccgttccgcgccgaggccgtggccgggctcatctcggcgtccgtgcgcgccgccctcgaggcgccgctcaactacgcgcggaaccacctggccgacctgctcccgccctgcgtgccccgggccatctacctcgactccgacgtcctggccgccgacgacgtgcgccggctctgggagacgcgcctccccgccgccgccgtcgtcgccgcgcccgagtactgccacgccaacttctcccgctacttcacccccgccttctgggccgacccggcgctcggcgcgcgcgtcttcgcggaccgccgccgcccgccctgctacttcaacacgggcgtcatggtcatcgacctccgccgctggagggccggcaactaccgccgccgcatcgagcgctggatggagatccagaaggagaagcgcatctacgagctgggctcgctgccgccgttcctgctggtcttcgccggcgaggtggaggccgtcgacctccgctggaaccagcacggcctcggcggggacaacgtgcacggcagctgccgcccgctccacgacgggcccgtcagcctgatgcattggtcgggcaagggcaagccgtgggaccgcctggacgccggcaggccctgcccgctcgaccacacctggaagtcctacgacctctacatccccggagacgggagcagcgccgcctcgccggcctccgggccggcattgtccgcctggtagagggagcccgtagctgtactgactagacacagtgattcttttgttggttgggcggttcttggcaatggcagcgcggcggcaccgcgttggtgctgccgctgccgccgccggctgtacagggcggcgaggggggaaggaaggtcgcggcggttgcagcgcgaggaggagggagaagagtggcggatagagaaaagaagagcttgttctttttggtagaaattcagattggttatgtgggggaatttgattcttttgctggaggtggacattctaggggggttaccaattcgctggattggtggcgatgtacaattcgttgatactagtactagggaagactggaattttgttctgttgttattgacgattctttcattcataataagcctatgtgttcttc

SEQ ID NO: 2066 - DNA, 1664 bp, Oryza sativa
cgacctccaagaacccaccccaacccccccgagggtgggaggaggaggagggaatcgaggccggaggcgccggatatggggggcaatccggcgatgcgggccggattggcgttggtggtggtggtggtggcggtggtggtgggggatgtgggcgcggcgttgccgaggttcgcggaggcgccggagtacaggaacggggaggggtgcccggcggcggtggcgggggcgggggtgtgcgacccggggctggtccacatcgcgatgacgctcgacgcgcactacctgagggggtccatggcggccatctactcgctgctcaagcacgcgtcgtgcccggagtcgatattcttccacttcctggcggcggcggacggcggcgaggggtgcgggggtggggtcggggagctgaggaccgccgtggcggcgtcgttcccgtcgcttcggttcgagatctacccgttccgcgctgacgcggtcaccgggctcatctcggcgtccgtgcgcgccgctctcgaggcgccgctcaactacgccaggaactacctcgccgacctgctccccaagtgcgtcccgcgggcgatatacctcgactccgacgtgctcgccgtcgacgacgtgaggcgcctctgggagacgcgcctgcccgccgccgccgtcgtggccgcgcccgagtactgccacgccaacttctcccgctacttcaccgagaccttctggtccgacccgcagctcggcgaccgcgtcttcgccgggcgacgccgcgcgccctgctacttcaacaccggcgtcatggtcatcgacctccggcggtggcgcgtcggcaactaccgtcgccgcatcgaggtgtggatggagctgcagaaggagaagcgaatctacgagctagggtcgctgcccccgttcttgctggtgttcgccggcgaggtggaggccgtcgaccaccgctggaaccagcacggattgggcggcgacaacgtcctcggcagctgccgccctctccacaagggccctgtcagcctcatgcactggtccgggaagggcaagccatgggaccggctcgacgccggcaagccttgcccgctcgaccacacttggaaatcatacgacctctacattgcagagggtgattcatcttcagcatcagcaccgttcgcattgtcatcatcggcattgcctgcggcggcattttcttggtagacagctaatgagtatacacaataattctttcattgaggttgccttgtggagctgtgtgtggtgatggaattgctttgcaattcattgccacagccatcacagctgccaccacaagccagctgccgccttcggctgtacaggacagtgaaggggaggggcggcacactgcggtggcgcacaaagggaagatggagaatagaggaagcaaattcttgttcatttgtggtacaattcagattgattcgttaggcttcggtttggaggtggctgactttggggggatggaattacttgattggtggtgtacaattcttggataggataaaggtttcatttttttgtctattagttcagaatccacatgtttgttcgctgaactcgcataatattgattgaattgatttgaatcaaaatgagttgatcccatccttgtgtctgagctgaaacaatgttgcatctatagctca

SEQ ID NO: 2067 - DNA, 1767 bp, Oryza sativa
ggcggattcgatcgcctccgccctcgccctcgcctcgcctccgcctcgctcgccacccacccccgcacatacaagcgcgacgaggaagaaggggacgccgacctccaagaacccaccccaacccccccgagggtgggaggaggaggagggaatcgaggccggaggcgccggatatggggggcaatccggcgatgcgggccggattggcgttggtggtggtggtggtggcggtggtggtgggggatgtgggcgcggcgttgccgaggttcgcggaggcgccggagtacaggaacggggaggggtgcccggcggcggtggcgggggcgggggtgtgcgacccggggctggtccacatcgcgatgacgctcgacgcgcactacctgagggggtccatggcggccatctactcgctgctcaagcacgcgtcgtgcccggagtcgatattcttccacttcctggcggcggcggacggcggcgaggggtgcgggggtggggtcggggagctgaggaccgccgtggcggcgtcgttcccgtcgcttcggttcgagatctacccgttccgcgctgacgcggtcaccgggctcatctcggcgtccgtgcgcgccgctctcgaggcgccgctcaactacgccaggaactacctcgccgacctgctccccaagtgcgtcccgcgggcgatatacctcgactccgacgtgctcgccgtcgacgacgtgaggcgcctctgggagacgcgcctgcccgccgccgccgtcgtggccgcgcccgagtactgccacgccaacttctcccgctacttcaccgagaccttctggtccgacccgcagctcggcgaccgcgtcttcgccgggcgacgccgcgcgccctgctacttcaacaccggcgtcatggtcatcgacctccggcggtggcgcgtcggcaactaccgtcgccgcatcgaggtgtggatggagctgcagaaggagaagcgaatctacgagctagggtcgctgcccccgttcttgctggtgttcgccggcgaggtggaggccgtcgaccaccgctggaaccagcacggattgggcggcgacaacgtcctcggcagctgccgccctctccacaagggccctgtcagcctcatgcactggtccgggaagggcaagccatgggaccggctcgacgccggcaagccttgcccgctcgaccacacttggaaatcatacgacctctacattgcagagggtgattcatcttcagcatcagcaccgttcgcattgtcatcatcggcattgcctgcggcggcattttcttggtagacagctaatgagtatacacaataattctttcattgaggttgccttgtggagctgtgtgtggtgatggaattgctttgcaattcattgccacagccatcacagctgccaccacaagccagctgccgccttcggctgtacaggacagtgaaggggaggggcggcacactgcggtggcgcacaaagggaagatggagaatagaggaagcaaattcttgttcatttgtggtacaattcagattgattcgttaggcttcggtttggaggtggctgactttggggggatggaattacttgattggtggtgtacaattcttggataggataaaggtttcatttttttgtctattagttcagaatccacatgtttgttcgctgaactcgcataatattgattgaattgatttgaatcaaaatgagttgatcccatccttgtgtctgagctgaaacaatgttgcatctatagctcatcctg

SEQ ID NO: 2068 - DNA, 1601 bp, Triticum aestivum
cgcaccgcaccgcggcgccgatacatacgcccgccctcgccccccgcatcactgctgcaccaccacgcgggacagctcaccacagcctgcgccgcacagagcgagcgagcgccgcaagaatccaagaaccgtcggcggcggcggcgatgagggcggccggggcagccgtggcgctgctcttcttcttcctcctggccgtccccggcgaggcggcggcggcgctgccgaggttcgcggaggcgccgcagtaccggaacggggaggggtgcccggcggcgaccgcggccggcgtgtgcgacccggggctggtgcacatcgccatgaccctcgacgcgcactacctgcggggctccatggcggccatctactcgctgctcaagcacgcctcctgcccggagtcgctcttcttccacttcctggccgcggcgcccggggacggcgagctgcgcgcggcgctggcggcctccttcccgtcactgcggttcgagatctacccgttccgcgccgaggccgtggccgggctcatctcggcctccgtgcgcgccgccctcgaggcgccgctcaactacgcgcggaaccacctcgccgacctgctcccgccctgcgtgccccgggccatctacctcgactccgacgtcctggccgccgacgacgtgcgccggctctgggagacccgcctccccgccgccgccgtcgtcgccgcgcccgagtactgccacgccaacttctcccgctacttcacgcccgccttctggtccgacccggcgctgggcgcgcgcgtcttcgcggaccgccgccgcccgccctgctacttcaacaccggcgtcatggtcatcgacctccgccgctggagggccggcaactaccgccgccggatcgagcgctggatggagatccagaaggagaagcgcatctacgagctgggctcgctgccgccgttcctgctggtcttcgccggcgaggtggaggccgtcgacctccgctggaaccagcacggcctcggcggggacaacgtgcacggcagctgccgcccgctccacgacgggcccgtcagcctgatgcattggtcgggcaagggcaagccgtgggaccgcctggacgccggcaggccctgcccgctcgaccacacctggaagtcctacgacctctacatcgccggggacggaagcagcgccgcctcgccagcctccgggccggcattgtccgcctggtagagggagctcgtagctgcactgactagacacagtgattcttttgttggttgggcggttcttggcaatggcagtgccgctgccgtcggctgtacagggcggcgaggggggaaggaagggagggtcgccggcgattgctgcgcgaggagggagaagagtggtggatagagaaaagaagagcttgttctttttggtagaaaatcagattggttatgtggggggatttggattctttttggtcgaggtggacattctaggggttggttgccaattcgctggattggtggcgatgtacaattcgttgatagtgctaggaaagactgggattttgttctgttgttattgacgattctttcattcataataagcctatgtgttcttgatctgaaa

SEQ ID NO: 2069 - DNA, 2134 bp, Oryza sativa
cgcgtaagcaaagcgaaggcgacgacgcgggacccgcatattctaaaaaaacacggtggttttattggtaaagccacatgtataaatctcccccccgaaaaaacaaacccggcggattcgatcgcctccgccctcgccctcgcctcgcctccgcctcgctcgccacccacccccgcacatacaagcgcgacgaggaagaaggggacgccgacctccaagaacccaccccaacccccccgagggtgggaggaggaggagggaatcgaggccggaggcgccggatatggggggcaatccggcgatgcgggccggattggcgttggtggtggtggtggtggcggtggtggtgggggatgtgggcgcggcgttgccgaggttcgcggaggcgccggactacaggaacggggaggggtgcccggcggcggtggcgggggcgggggtgtgcgacccggggctggtccacatcgcgatgacgctcgacgcgcactacctgagggggtccatggcggccatctactcgctgctcaagcacgcgtcgtgcccggagtcgatattcttccacttcctggcggcggcggacggcggcgaggggtgcgggggtggggtcggggagctgaggaccgccgtggcggcgtcgttcccgtcgcttcggttcgagatctacccgttccgcgctgacgcggtcaccgggctcatctcggcgtccgtgcgcgccgctctcgaggcgccgctcaactacgccaggaactacctcgccgacctgctccccaagtgcgtcccgcgggcgatatacctcgactccgacgtgctcgccgtcgacgacgtgaggcgcctctgggagacgcgcctgcccgccgccgccgtcgtggccgcgcccgagtactgccacgccaacttctcccgctacttcaccgagaccttctggtccgacccgcagctcggcgaccgcgtcttcgccgggcgacgccgcgcgccctgctacttcaacaccggcgtcatggtcatcgacctccggcggtggcgcgtcggcaactaccgtcgccgcatcgaggtgtggatggagctgcagaaggagaagcgaatctacgagctagggtcgctgcccccgttcttgctggtgttcgccggcgaggtggaggccgtcgaccaccgctggaaccagcacggattgggcggcgacaacgtcctcggcagctgccgccctctccacaagggccctgtcagcctcatgcactggtccgggaagggcaagccatgggaccggctcgacgccggcaagccttgcccgctcgaccacacttggaaatcatacgacctctacattgcagagggtgattcatcttcagcatcagcaccgttcgcattgtcatcatcggcattgcctgcggcggcattttcttggtagacagctaatgagtatacacaataattctttcattgaggttgccttgtggagctgtgtgtggtgatggaattgctttgcaattcattgccacagccatcacagctgccaccacaagccagctgccgccttcggctgtacaggacagtgaaggggaggggcggcacactgcggtggcgcacaaagggaagatggagaatagaggaagcaaattcttgttcatttgtggtacaattcagattgattcgttaggcttcggtttggaggtggctgactttggggggatggaattacttgattggtggtgtacaattcttggataggataaaggtttcatttttttgtctattagttcagaatccacatgtttgttcgctgaactcgcataatattgattgaattgatttgaatcaaaatgagttgatcccatccttgtgtctgagctgaaacaatgttgcatctatagctcatcctgaagaccagaatggctcaatgcctcaatctcttgcagtctgtgttttgccagttatgttgatccacaatggttcaatcttttgctgctgctatgtttctttttcttactgttattcatacacaatggtctaatctgcatgatttaccctttctgctgactctgttaatccagaatggcctaatgtactgctgattctgtagtttttgcactgtcagaaattgctgctgctacctgctggtatgctggtatgttttccc

SEQ ID NO: 2070 - DNA, 2311 bp, Sorghum bicolor
cggccaatacatacggcctcccggctcaccgtcaccgaccagtctcccctccccagcagtccccactactgcgactgcgagacagcgcagcacaggctgctgcccgctggccgctcgctgcgagaggaaagagaatccaagaacgcgcaggagccaccccgccctcgtcaccggcgtccatgggcggcgccgcgatgtgggccgctgctttggcggcgacggtggtcttcttggccgtcgaggtttcgggtgccgcgggggcgttgccgaggttcgcggaggcgccggagtaccggaacggggaagggtgcccggctgcggcggcgggggtgtgcgacccgggcttggtgcacatcgccatgacgctggacgcgcactacctgcgtggctccatggcggcggtgtactcgctgctcaagcacgcgtcctgcccggagtccatcttcttccacttcctggccgcggaggcagacggggaggaggacccggagccggagctgctgcggcgcgcggtcgcggcgtcgttcccgtcgctgcggttcgagatctacccgttccgcgccgaggccgtggccgggctcatctcggcgtccgtgcgcgccgcgctcgaggcgccgctcaactacgcgcggaaccacctggccgacctgctcccgcgctgcgtgccgcgggcgatatacctcgactccgacgtgctcgccgccgacgacgtcaggcgcctctgggagacgcgcctccccgccgccgccgtcgtggcggcgcccgagtactgccacgccaacttctcccgctacttcacgcccgcgttctggtctgacccggagctcggcgcccgcgtcttcgcggggcgccgccgcccgccctgctacttcaacaccggcgtcatggtcatcgacctccgccgctggcgcgccgggaactaccgccagcgcatcgagcgctggatggaaatccagaaggtgaagcgcatctacgagctgggctccctgcccccgttcctgctcgtcttcgccggcgaggtggaggccgtcgaccaccgctggaaccagcacggcctcggcggcgacaacgtccacggcagctgccgcccgctccacgccgggcccgtcagcctcatgcactggtcgggcaagggcaagccatgggaccgcctcgacgccggcaggccgtgcccgctcgaccacacctggaagtcgtacgacctctacatccccagcgactcctccggcgccgcctctccggcctccgggccggcattgtccgcatccgtgctctcatggtagagagagagagagagagagagagagagagagagagcttctagttccgtagttgcaacagctcttttgctgattgagaggttcttggcagtggcaatgtgctgcccccattgcattgcattgtcttgctgcggctgttgccgtcgctgctatgatctagctgctgctcgtggtgggctgtacagggcggcgaagggagcggccgtggcgacatggcaggggaaatcaggaatgggttggtagagaaggggagcttttgctctttggggtagaattcagattggttatttggggggattttgattctttttggtccggcaggtgattcttgcattggggttcccaattctctcgattggaggtgtaaagacttggaattttgctctattattgatcattctttcattcatatgtcatgccttcttgacctgaattcttactgtatggtgataatgatttgcttttttacttattagattgatgaactgaactgaactgcgttggaaatgcccttgtttatgatgttaattatctgtcaagtatcagacaggcttatctcccctccaatggttcttgtaatgctcaataattcttgattcaatttggcaaatgaggtgaggactgaggagcatagctggcagtacattgaagattcatggagctgaaatgtagcattggtccgtcggacctgatacatctgtgttgtgttgaatgaaatgttcttggaacctggctgttcatctgcagttggactgtttgtgatgtactgcatcctcctaccagtgatccattgtactacatgcctagtacttcagttctgtatcaattgtacattctacctctgattgaccaggctgaattgtagtagcactgaatttgaatgtctttttgtgaaacatgcctattgcacctgcagtcaattatttccacagatgtaaacactcccctctgatcgggaacagtactatgttacattctctgtatccattcctgttgtatcgatttttagatcagaattcaatactccgcac

SEQ ID NO: 2071 - DNA, 1563 bp, Sorghum bicolor
cagtccccactactgcgactgcgagacagcgcagcacaggctgctgcccgctggccgctcgctgcgagaggaaagagaatccaagaacgcgcaggagccaccccgccctcgtcaccggcgtccatgggcggcgccgcgatgtgggccgctgctttggcggcgacggtggtcttcttggccgtcgaggtttcgggtgccgcgggggcgttgccgaggttcgcggaggcgccggagtaccggaacggggaagggtgcccggctgcggcggcgggggtgtgcgacccgggcttggtgcacatcgccatgacgctggacgcgcactacctgcgtggctccatggcggcggtgtactcgctgctcaagcacgcgtcctgcccggagtccatcttcttccacttcctggccgcggaggcagacggggaggaggacccggagccggagctgctgcggcgcgcggtcgcggcgtcgttcccgtcgctgcggttcgagatctacccgttccgcgccgaggccgtggccgggctcatctcggcgtccgtgcgcgccgcgctcgaggcgccgctcaactacgcgcggaaccacctggccgacctgctcccgcgctgcgtgccgcgggcgatatacctcgactccgacgtgctcgccgccgacgacgtcaggcgcctctgggagacgcgcctccccgccgccgccgtcgtggcggcgcccgagtactgccacgccaacttctcccgctacttcacgcccgcgttctggtctgacccggagctcggcgcccgcgtcttcgcggggcgccgccgcccgccctgctacttcaacaccggcgtcatggtcatcgacctccgccgctggcgcgccgggaactaccgccagcgcatcgagcgctggatggaaatccagaaggtgaagcgcatctacgagctgggctccctgcccccgttcctgctcgtcttcgccggcgaggtggaggccgtcgaccaccgctggaaccagcacggcctcggcggcgacaacgtccacggcagctgccgcccgctccacgccgggcccgtcagcctcatgcactggtcgggcaagggcaagccatgggaccgcctcgacgccggcaggccgtgcccgctcgaccacacctggaagtcgtacgacctctacatccccagcgactcctccggcgccgcctctccggcctccgggccggcattgtccgcatccgtgctctcatggtagagagagagatgcattgcattgtcttgctgcggctgttgccgtcgctgctatgatctagctgctgctcgtggtgggctgtacagggcggcgaagggagcggccgtggcgacatggcaggggaaatcaggaatgggttggtagagaaggggagcttttgctctttggggtagaattcagattggttatttggggggattttgattctttttggtccggcaggtgattcttgcattggggttcccaattctctcgattggaggtgtaaagacttggaattttgctctattattgatcattctttcattcatatgtcatgccttcttgacctgaattctt

SEQ ID NO: 2072 - DNA, 1455 bp, Secale cereale
cgatgagggcggccggggcagccgtggcgctgctattcttgttcgctgcggcggtcgccgtccccggcgaggcggcggcgctgccgaggttcgcggaggcgccgcagtaccggaacggggaggggtgcccggcggcgacggcggccggcgtgtgcgacccggggctggtgcacatcgccatgaccctcgacgcgcactacctgcggggctccatggcggccatctactcgctgctcaagcacgcctcctgcccggagtcgctcttcttccacttcctggccgccgcgccgggcgacggcgagctgcgcgccgcgctggcggcctccttcccgtccctgcggttcgagatctacccgttccgcgccgaggccgtggccgggctcatctcggcgtccgtgcgcgccgccctcgaggcgccgctcaactacgcgcggaaccacctggcggacctgctcccgccctgcgtgccccgggccatctacctcgactccgacgtcctggccgccgacgacgtgcgccggctctgggagacccgcctccccgccgccgccgtcgtcgccgcgcccgagtactgccacgccaacttctcccgttacttcacccccgccttctgggccgacccggcgctcggcgcgcgcgtcttcgcggatcgccgccgcccgccctgctacttcaacaccggcgtcatggtcatcgacctccgccgctggagggccggcaactaccgccgccgcatcgagcgctggatggagatccagaaggagaagcgcatctacgagctgggctcgctgccgccgttcctgctggtcttcgccggcgaggtggaggccgtcgacctccgctggaaccagcacggcctcggcggggacaacgtgcatggcagctgccgcccgctccacgacgggcccgtcagcctgatgcattggtcgggcaagggcaagccgtgggaccgcctggacgccggcaggccctgcccgctcgaccacacctggaagtcctacgacctctacatccccggagacgggagcagcgccgcctcgccggcctccgggccggcattgtccgcctggtagagggagcccgtagctgtactgactagacacagtgattcttttgttggttgggcggttcttggcaatggcagcgcggcggcaccgcgttggtgctgcggctgccgctgccgtcggctgtacagggcggcgaggggggaaggaaggtcgcggcgattgcagcgcgaggaggagggggaagagtggcggatagagaaaagaagagcttgttctttttggtagaaattcagattggttatgtggggggaatttgattctttttgctggaggtggacattctaggggggttaccaattcgctggattggtggcgatgtacaattcgttgatactagtactagggaagactggaattttgttctgttgttattgacgattctttcatt

SEQ ID NO: 2073 - DNA, 1771 bp, Setaria italica
atgcctgtaacagttctaaaaccacagatattgaagtcaagaggtggaccaaacatcctctccacggccatcctaccacatgacactagaataaacgaggatcaaggtactactccaacggtacaaatgcctcctctcaccgaccactcccctccccactactgcgagacagcgcagcacaggctgccgcccgccgcagggagaagagaaaagaatccgagtaggcgcaggagagtcccctcgtcgccggcgtccatgggcggcgccgcgggcgaggcgatgcgggccggtgtcgcggtggcggcggcggtcttcttggctttcgcgttttccggtgcggcggcggcgctgccgaggttcgcggaggcgccggagtaccggaacggggagggttgcccagccgcggcggctggggtgtgcgacccgggtctggtgcatatcgccatgacgctggacgcgcactacctgcgcgggtccatggcggcggtgtactcgctgctcaagcacgcgtcctgcccggagtcgatcttcttccacttcctggccgcggaggccggcgccgcgggcggggagggcccggagccggagccggagctgctgcggcgcgcggtggccgcgtcgttcccgtcgctgcggttcgagatctacccgttccgcgccgaggccgtggcggggctcatctcggcgtccgtgcgcgctgcgctcgaggcgccgctcaactacgcccggaaccacctggcggacctgctcccgcgctgcgtgccacgggcgatatacctcgactccgacgtcctcgccgccgacgacgtgaggcggctctgggagacgcgcctgcctgccgccgccgtggtggcggcgcccgagtactgccacgccaacttctcccgctacttcacgccggccttctggtccgacccggacctcggcgcgcgcgtcttcgccgggcgccgccgcccgccgtgctacttcaacaccggcgtcatggtcatcgacctccgccgctggcgcgccgggaactaccgccaacgcatcgagcggtggatggagatccagaaggagaagcgcatctacgagctgggctccctgcccccgttcttgctcgtcttcgccggcgaggtggaggccgtcgaccaccgctggaaccagcacggcctcggaggcgacaacgtgcacggcagctgccgcccgctccacgacgggcccgtcagcctcatgcactggtcggggaagggcaagccatgggaccgcctcgacgccggcaggccatgcccgctcgaccacacctggaggttatatgacctctacatccccagcgacggcagtggcgctgcctcgccggcgtccgggccggcattgtccgcatccctgttttcatggtagagagagcttgtagttccataggcgcaacaggtacttgctgattgagcggttcttggcgatggcaatgtgcccccatcgcattgcattgtgttgtcttgctggagctgttgctgccgctgctatgagctagctgccgctcatggtgggctgtacagggcggtgaagggagcagcggtagcgacagcaggggaaggagaagagggatcagttcatagagaaggagagctcttgctcttttgggtagaattcagattggttatttgggggattttgattctttttggtctggccggtgatccttggggttcccaattctctcgattggagggtgtacaagtaggaaagacttggaattttgttctattattgatcattctttcattcatatgcc

SEQ ID NO: 2074 - DNA, 1585 bp, Hordeum vulgare
caccgctccgcggcgccgatacatacgccatccctccctccatcaccccgcatcaccatcactgctccaccaccaccacgcgggacaactcaccacagcctgcgccgcacacagagagcgccgcaagaatccaagaagcggccatgagggtggccggggcagccgtggcgctgctcttcttcttcctggccggcgaggcggcggcgctgccgaggttcgcggaggcgccgcagtaccggaacggggaggggtgcccggcgccgtccgcggccgcggccggcgtgtgcgacccggggctggtgcacatcgccatgaccctcgacgcgcactacctgcggggctccatggcggcaatctactcgctgctcaggcacgcctcctgcccggagtcgctcttcttccacttcctcgccgccgcgccgggcgacggcgagctgcgcgccgcgctgggggcctccttcccgtccctccggttcgagatctacccgttccgcgccgaggccgtggccgggctcatctccgcgtccgtgcgcgccgccctcgaggcgccgctcaactacgcgcggaaccacctcgccgacctgctcccgccctgcgtgccccgcgcgatatacctcgactccgacgtcctggctgtcgacgacgtgcgccggctctgggagacccgcctccccgccgccgccgtcgtcgccgcgccagagtactgccacgccaacttctcccgctacttcaccccggccttctggtccgacccggcgctcggcgcgcgggtcttcgccggccgacgccgcccgccctgctacttcaacaccggcgtcatggtcatcgacctccggcgctggagggccggcaactaccgccgccgcatcgagcgctggatggagatccagaaggagcagcgcatctacgagctcggctcgctgccgccgttcctgctcgtcttcgccggcgaggtggaggccgtcgacctccgctggaaccagcacggcctcggcggcgacaacgtgcacggcagctgccgcccgctgcacgacgggcccgtcagcctcatgcattggtcgggcaagggcaagccgtgggaccgcctggacgccggcaggccctgcccgctcgaccacacatggaagtcctacgacctctacgtccccggcgacgggagcagcgccgcctcgccggcctccgggccggcattgtcggcttggtagagggagctcgtagccgtactgagtagatacagtaattcttttgttggttgggcggttcttggcaatggcaccgcgccggcaccgcgttggtgctgccgctgccgctgccgtcggctgtacagggcagcgagggggagggtcgtggccattgcggcgcgaggcggagggagaagattggtggatagagaaaagaagagctcgttctttttggtagaaattcagattggtcatgtggtgggatcttgattctttttgggtggacattttaggggttaccaattagctggattggtggcagtgtacaattcgttgatactagtagaaaagacctggattttgttctgttattgatgacgattctttcattcgtaataatccca

SEQ ID NO: 2075 - DNA, 1661 bp, Hordeum vulgare
accattcccattcccatacgcgcaccgctccgcggcgccgatacatacgccatccctccctccatcaccccgcatcaccatcactgctccaccaccaccacgcgggacaactcaccacagcctgcgccgcacacagagagcgccgcaagaatccaagaagcggccatgagggtggccggggcagccgtggcgctgctcttcttcttcctggccggcgaggcggcggcgctgccgaggttcgcggaggcgccgcagtaccggaacggggaggggtgcccggcgccgtccgcggccgcggccggcgtgtgcgacccggggctggtgcacatcgccatgaccctcgacgcgcactacctgcggggctccatggcggcaatctactcgctgctcaggcacgcctcctgcccggagtcgctcttcttccacttcctcgccgccgcgccgggcgacggcgagctgcgcgccgcgctgggggcctccttcccgtccctccggttcgagatctacccgttccgcgccgaggccgtggccgggctcatctccgcgtccgtgcgcgccgccctcgaggcgccgctcaactacgcgcggaaccacctcgccgacctgctcccgccctgcgtgccccgcgcgatatacctcgactccgacgtcctggctgtcgacgacgtgcgccggctctgggagacccgcctccccgccgccgccgtcgtcgccgcgcccgagtactgccacgccaacttctcccgctacttcaccccggccttctggtccgacccggcgctcggcgcgcgggtcttcgccggccgacgccgcccgccctgctacttcaacaccggcgtcatggtcatcgacctccggcgctggagggccggcaactaccgccgccgcatcgagcgctggatggagatccagaaggagcagcgcatctacgagctcggctcgctgccgccgttcctgctcgtcttcgccggcgaggtggaggccgtcgacctccgctggaaccagcacggcctcggcggcgacaacgtgcacggcagctgccgcccgctgcacgacgggcccgtcagcctcatgcattggtcgggcaagggcaagccgtgggaccgcctggacgccggcaggccctgcccgctcgaccacacatggaagtcctacgacctctacgtccccggcgacgggagcagcgccgcctcgccggcctccgggccggcattgtcggcttggtagagggagctcgtagccgtactgagtagatacagtaattcttttgttggttgggcggttcttggcaatggcaccgcgccggcaccgcgttggtgctgccgctgccgctgccgtcggctgtacagggcagcgagggggagggtcgtggccattgcggcgcgaggcggagggagaagattggtggatagagaaaagaagagctcgttctttttggtagaaattcagattggtcatgtggtgggatcttgattctttttgggtggacattttaggggttaccaattagctggattggtggcagtgtacaattcgttgatactagtagaaaagacctggattttgttctgttattgatgacgattctttcattcgtaataatcccatgtgttcttgatctgaagttctgatctctgcatcattgactcgcgtcaaattca

SEQ ID NO: 2076 - DNA, 1625 bp, Zea mays
ctacccagtccccactactgctactgcgagacagcgcagcacaggctgccgcccgctggccgctgcgagcagagagaatccaagaacgcgcaagagcccccctcgtcaccaccgtccatgggcggcgctgcgggcgaggcgatgtgggccgctgttgtggcggcgacggtggtcttcttggccgtcgaggtttcgggtgccgcgtcggcgttgccacggtttgcggaggcgcctgagtaccggaacggggaagggtgtccggctgcggcggcgggggtgtgcgacccgggcttggtgcacatcgccatgacgctcgacacgcactacctgcggggctccatggcggcggtgtactcgctgctcaagcacgcgtcctgcccggagtccatcttcttccacttcttggccgcggaggccggggcagtggacggggcggacccggagccggagctgctgcggcgcgcggtggcggcgtcgttcccgtcgctgcggttcgagatctacccgttccgcgccgaggccgtggccgggctcatctcggcgtccgtgcgcgccgcgctcgaggcgccgctcaactacgcgcggaaccacctagcggacctgctcccgcgctgcgtgccgcgggcgatatacctcgactccgacgtgctcgccgccgacgacgtgaggcggctctgggagacgcgcctccccgccgccgccgtggtggcggcgcccgagtactgccacgccaacttctcccgctacttcacgccagcgttctggtcagacccggtgctcggggcccgcgtcttcgccgggcgccgccggccgccgtgctacttcaacaccggcgtcatggtcatcgacctccgccgctggcgcgccggcaattaccgccaacgcatcgagcgctggatggaaatccagaagcagaagcgcatctacgagctgggctccctgcccccgttcttgctcgtcttcgccggtgaggtcgaggccgtcgaccaccgatggaaccagcacggcctcggcggcaacaacgtccacggtagctgccgcccgctccacgctgggcccgtcagcctcatgcactggtcgggcaagggcaagccctgggaccgcctcgacgccggcaggccgtgcccgctcgaccacacctggaagtcgtacgacctctacatccccggcgactctggaggcgccgcctcgccggcgtccgggccggcattgtccgcatccgtgttctcttggtagagagatagcttctagttccattgtcttgctgtggctgttgccgccgctgctatgatctagctgccgctcgtggtgggctgtacagggcggcgttgggagcggcggtggcgacatgacaggggaaatcaggaatgagttgatagagaagggggagcctttgccctcgggggtagaattcagataagttattggggagagattttgattctttttggtcgggctggtgattcttgggttcccaattctctcgattggatgttgtaaagacttggaattttgttcaattattgatcattctttcattcatgtgccatgccttcttgacctgaatccttttgctattttttttttacctttattacattagatgaactaacctaactgtactg

SEQ ID NO: 2077 - DNA, 1125 bp, Oryza sativa
gaggaggaggctgcaagaatccaagaaaccgcgatgccggcgcgggccgcggcggcggcggctgcggtggcgctgctgctggccgtctgcgctcaggcggcggcgctgccgaggttcgctgaggcgccggagtacaggaacggggaagggtgtcccgcggcggcgacggcggcggcgggggtgtgtgacgctgggctggtgcacatctcgatgacgctggacgcgcactacctgcgcgggtccatggcggcggtgtactcgctgctcaagcacgcctcctgcccggagtcgctcttcttccacttcttggcggaggaggaggaggttgggggtggtggtgacctgcggcgcgccgtggcggcgtcgttcccgtcgctgcggttcgagatctacgcgttcagggcggaggccgtggcggggctcatctcggcgtccgtgcgcgccgcgctggagtcgccgctcaactacgcgcggaaccacctcgccgacctgctcccgcgctgcgtgccccgcgcgatctacctcgactccgacgtgctcgccgtcgacgacgtgcggcgcctctgggagacgcgcctccccgccgccgccgtcgtcgcggcgcccgagtactgccacgccaacttctcccgctacttcaccccggcgttctggtccgacccaggcctcggccgccgcgtcttcgccggccgccgccgcccgccctgctacttcaacaccggcgtcatggtcatcgacctccgccgctggcgcgccggcaactaccgccaccgcatcgagcggtggatggagatccagaaggagaagcgcatctacgagctgggctcgctgccgcccttcctcctcgtcttcgccggcgaggtcgaggccgtcgaccaccgctggaaccagcacggcctcggcggcgacaacgtgcgcggcagctgccgcccgctccacgacgggccggtcagcctcatgcactggtcaggcaaggggaagccatgggaccgcctcgacgccggcaacccgtgcccgctcgaccacacctggaagtcctacgacctctacgttgccggggacgacggcgccgccgcctcctcgccggcgtccgggccggcgttgtcgtcgacgtcgacgacgtgg

SEQ ID NO: 2078 - DNA, 1512 bp, Brachypodium distachyon
cggcggcgatgatggccggggcagtggcgctgctcttcttggccacggcggcggcggtgctcgtctccggcggtgaggcgggggcggaggcgctgccgaggttcgcggaggcgccggagtaccggaacggggaagggtgccccgcggcggcggcgggggtgtgcgacccgggcttggtccacatcgccatgacgctggacgcgcactacctgcggggctccatggcggccatctactcgctgctcaagcacgcctcctgcccggagtcgctcttcttccacttcatggcggccgcgcccggggacgccgaactgcggcgcgccgtggcggcgtcgttcccatccctgcggttcgagatctacccgttccgcgccgaggccgtggccgggctcatctccgcgtccgtgcgcgccgcgctcgaggcgccgctcaactacgcgcggaaccacctcgccgacctgctcccgccctgcgtgccgcgggcgatctacctcgactccgacgtgctagccgccgacgacgtgcggcgactctgggagacccgcctgccggccgccgccgtcgtcgccgcgcccgagtactgccacgccaacttctcccgctacttcacgccggccttttggtccgaccctgagctcggcgcgcgtgtcttcgctgaccgccgtcgcccgccttgctacttcaacaccggcgtcatggtcatagacctccgccgctggcgagccggcaactaccgccgccgcatcgagcgatggatggagatccagaaggacaagcgcatctatgagctgggctcgctgcccccgttcttgctggtcttcgctggcgaggtggaggctgtcgacctccgctggaaccagcatggcctcggcggcgacaacgtgcacggcagctgccgcccgctccacgacggccccgtcagccttatgcattggtcaggcaagggcaagccctgggaccgcctggacgccggcaggccctgcccgctagaccacacttggaagtcctacgacctctacatcggcggagatggcagcagtgctgccacgccggcctccgggccagcattgtcttcttggtagagggggaaacttgtagctgtagtggcatactgctagatacaacaattcttttgttctttatgcggttctgagcaatgggagcgtggcattgcattggtgctactgctcttgtcgccatgacctagctgcagttccccatcggctgtacagggcagtgaaggaaggggcagctgccattgcagcgccgggagacgagtgaagagtggacagagaaaagaagagcttgttcttttctggtagaattcagattggttatttgggggattttgattcttttgggttggtgttgattggggttcccaattggctccattggtggcagtgtacaattcattgataggaaagacttggaattttgttctgttattgatgattcattcattcatttgacaagtgttctgatctgaaatctaaattatctgagttgctt

SEQ ID NO: 2079 - DNA, 2214 bp, Brachypodium distachyon
acccttccttccttgacccatacgcgcaccgcggacgcggaacggatacatacatacggcctccctcggcttccacggccccctccgcattactgctccaccatcacgagacagcgcagcacaggctgcacaagcgccgcaagaatccaaggaaacacgccgaggggggaaggaggagagaacagagaagccatcggcggcgatgatggccggggcagtggcgctgctcttcttggccacggcggcggcggtgctcgtctccggcggtgaggcgggggcggaggcgctgccgaggttcgcggaggcgccggagtaccggaacggggaagggtgccccgcggcggcggcgggggtgtgcgacccgggcttggtccacatcgccatgacgctggacgcgcactacctgcggggctccatggcggccatctactcgctgctcaagcacgcctcctgcccggagtcgctcttcttccacttcatggcggccgcgcccggggacgccgaactgcggcgcgccgtggcggcgtcgttcccatccctgcggttcgagatctacccgttccgcgccgaggccgtggccgggctcatctccgcgtccgtgcgcgccgcgctcgaggcgccgctcaactacgcgcggaaccacctcgccgacctgctcccgccctgcgtgccgcgggcgatctacctcgactccgacgtgctagccgccgacgacgtgcggcgactctgggagacccgcctgccggccgccgccgtcgtcgccgcgcccgagtactgccacgccaacttctcccgctacttcacgccggccttttggtccgaccctgagctcggcgcgcgtgtcttcgctgaccgccgtcgcccgccttgctacttcaacaccggcgtcatggtcatagacctccgccgctggcgagccggcaactaccgccgccgcatcgagcgatggatggagatccagaaggacaagcgcatctatgagctgggctcgctgcccccgttcttgctggtcttcgctggcgaggtggaggctgtcgacctccgctggaaccagcatggcctcggcggcgacaacgtgcacggcagctgccgcccgctccacgacggccccgtcagccttatgcattggtcaggcaagggcaagccctgggaccgcctggacgccggcaggccctgcccgctagaccacacttggaagtcctacgacctctacatcggcggagatggcagcagtgctgccacgccggcctccgggccagcattgtcttcttggtagagggggaaacttgtagctgtagtggcatactgctagatacaacaattcttttgttctttatgcggttctgagcaatgggagcgtggcattgcattggtgctactgctcttgtcgccatgacctagctgcagttccccatcggctgtacagggcagtgaaggaaggggcagctgccattgcagcgccgggagacgagtgaagagtggacagagaaaagaagagcttgttcttttctggtagaattcagattggttatttgggggattttgattcttttgggttggtgttgattggggttcccaattggctccattggtggcagtgtacaattcattgataggaaagacttggaattttgttctgttattgatgattcattcattcatttgacaagtgttctgatctgaaatctaaattatctgagttgcttcaaattctgttgaactgagtgacatatcctgtatctgcttctgaggtggttctctttgaacttgaagtcttaatttgtttcttgtaatacctgaagctcaatcagacctggcaatctgatgaagaacatagccaaggcattctacatttttgtttgattcaaaacctggggcaactcatgtcatatacattgatgggtatgaagctgaaatgtcgacctaggaattatgatattcctggtgtactgcctttgattgcgaacagttccttgtttgttcattccacttctgtcagaaatcaatactccacacaagaggcttgtgactgggaacttcaaaagtttctcttcaaaattctctgtgcccaataatttcccgcctgcttctgtatccgtgttgtgctatttgaattaacttttgttatccaggatatctccaaattaagtgacagcatcatttaggatgcaattttgcttatgtgatccagtaacttctagttttagtaaggat

SEQ ID NO: 2080 - DNA, 2684 bp, Hordeum vulgare
gcgacggcgatgcgggccctggccctggcggccttcttgttcttggccgcatcgggggtgggggcgctgccgaggttcgcggaggccccggagtaccggaacggggaggggtgccaggcggcggtggcgggggcgggggtgtgcgacccggggctggtccacatcgcgatgacgctcgacgcgcactacctccggggctccatggccgccatctactcgctgctcaagcacgcctcctgcccggagtcgctcttcttccacttcctcgccgcggacggcgccgcgaacggcgccgcgcccggggtcggcgagctccggagcgcgctcgccgcctccttcccctcgctgcgcttcgagatctacccgttccgcgccgacgccgtcacgggcctcatctccgcctcggtgcgcgccgcgctcgaggccccgctcaactacgccaggaactacctcgccgacctgctccccaagtgcgtcccccgggccatatacctcgactcggacgtgctcgccgtcgacgacgtgcgcaggctctgggagacgcgcctgcccgctgccgccgtcgtcgccgcgccagagtactgccacgccaacttctcccgctacttcaccgacgccttctggtccgacccggacctcggcccgcgcgtcttcgccggccgacgccgcgcgccctgctacttcaacaccggcgtcatggtcatcgacctccgccgctggcgctcggggaactaccgacaacgcatcgagcagtggatggagctgcagaaggagaagcgaatctacgagctgggttcgctgccccctttcttgctcctcttcgccggcgaggtggaggccgtcgaccaccgctggaaccagcacggcttgggcggcgacaacgtgctcggcagctgccgcccgctccacaagggccctgtcagcctgatgcactggtcaggcaagggcaagccatgggatcgcctcgacgcaggcaggccttgcccgctcgaccatacttggaaatcatacgacctctacattggcgacggtgatgcctcgcaagcatcggcgccatcctgggcctcattgtcatcatcggcgttgcccgcggcggtgttttcttggtagacagatatgggaggacacacgctataattttttcatttggttgtggtgatgcaatcgcgtttgcgatgcgtcgccgctgccatcacagctgccatcgcaagccggctgccgccttcggctgtacagcgaggggaggggcggtacattgcagcggctgcgacgggaagaggaagaagaacagtgcataggggaagcaaattcttgttcattcacgatacatttcggattgattcattatatgctgtgatccggaggtggtgagtagggggtgttgaaattactttattggtggtgtacaattcttggataggagaaaggtttcacttttttgtctgttagttcaggattgtttcatttacatttacatgtttgttcagtaaaccagtataaatattgattgaattgatttcaataaaacagggtggatcttattcttgctgcagtgatgaactcccctgtatcttgtcattcctttgatgcagaaattccatcgagaatggcttaatttcttgtttatctccatctttggacaatggtcaaatttattgctgctgctagtttgctttgctcagttcaaccagaatggcctaacatattgctggttttatttggcctactgtctccatatgctatgtcctaatttatttcattgctgtatctctgcttgttcatccacaattgcgtgctttgttcatcaagtatggccttatccacgcctgttatgattttgactacttgttcatccagaattgcctgcatgttcatctaagaaggcctaatctaccgatgtttctgttctgcaaacttgctcatccagaattgcctactgcattgctggttattagttccagtatttgtctgtctgttctagtaattgcttacccgtttcggcgacgagagtttacaggaggttgttgctgttttattgggtgtttctgctcagaaattggtgatggcctgtccttgtagttgctccttgacttgaagagataagcgggagcatcagaataccaatctttacagatgtatggcacacctacacagcttgaaagaaagaaagcaaaaggggcaatatcattgttgttggttaagatcaacttttatatcgggaaagcgattagcgcaagccacaggatagggacctcccaacagactcataatgcaggggattaatactggtaatacgccaactgatcccaactagagctccacataaccagcaatgcatgtaacctactctccttttaatcacaaagaggcaggcagcactttaaacttctgttggaatcttgggagggcgtagcaggaatatagcaagctggcttcaacaacagaagcttcttcttctttgcgagggaagttgaattatttgaagcctgataggcatcgattcgcaaaaggctgtgtgctgtggtcgtctgaaattgctttcgcagcagaagcagcaacagcatctcgattattatgctctctttgtggggagatgattggtgaggcagacccgaaatgtagcagcacgagagttattgcccatgatgagcaccatgtgtgttgtgtaatgttttctcagaagc

SEQ ID NO: 2081 - DNA, 1541 bp, Avena sativa
cgactactccctccctctccctccgcattactgctccaccatcgccagacagctcagcgcaggctgcacaccacaaccccccagcgccgcaggaatccaagaataatcgccgagccatcgccggcgccgatgatggccggggcagcagcagccgcagcgctgataatcttcttggccgcgacggccgccgtctccggcgccgagctgccgaggttcgctgaggcgccgcagtaccggaacggggaaggctgcccggccgcggcggcgggcgtgtgcgaccctgggctggtacacatcgccatgaccctggacgcgcactacctgcgtggctccatggcggccatctactccctcctcaagcacgcctcctgcccggagtccctcttcttccacttcctcgccgccgacgcgccccccggggacatcacgggcctgcggcgcgccgtggcggcgtcgttcccgtcgctgcggttcgagatctacccgttccgcgccgaggccgtggcggggctcatctcggcctccgtgcgggccgccctcgacgcgccgctcaactacgcgcggaaccacctcgccgacctgctcccgccctgcgtgccccgggccatctacctcgactccgacgtgctggccgccgacgacgtgcgccgcctctgggagacgcgcctccccgccgccgccgtcgtcgccgcgcccgagtactgccacgccaacttctcccgctacttcacccccgccttctggtccgacccggagctcggcacgcgggtcttcgcgggccgacgccgcccgccctgctacttcaacacgggcgtcatggtcatcgacctccgccgctggcgggcgggcaactaccgccgccgcatcgagcgctggatggagatccagaaggagaagcgcatctacgagctgggctccctgcccccgttcctgctcgtcttcgccggcgaggtggaggccgtcgacctccgctggaaccagcacggcctcggcggcgacaacgtgcacggcagctgccgaccgctccacgacgggcccgtcagcctcatgcattggtcgggcaagggcaagccgtgggacaggctggacgccggcaggccctgcccgctcgaccacacctggaagtcatacgacctctacattcccggagacggcagcggcgccgcctcgccggcctccgggccggcattgtcggcttcttggttgtagaaacagagcgcgtagatgtagcggatggatagatacaataattcttttgttggttggggcggttcttggcaatggcagccgtggcatcgcattggtgctgccgctgccgctcccaccgccgccccaccccatcggctgtacagggtcggtcgcggtgattgcatcgcgacgaggctgggtagagaaaagaagagcttgttcttttcggtagaaattcagattcatttatttatttgggtgggcgttcttggggattcccaattcgctccattcctagcagtgtacaattcgttgatagctgcagagacatgagattttgttctattattatt

SEQ ID NO: 2082 - DNA, 1566 bp, Secale cereale
ggggcgctgccgaggttcgcggaggcccccgagtaccggaacggggagggttgcccggcggcggtggccggcgcgggggtgtgcgacccgggcctcgtccacatcgcgatgacgctcgacgcgcactacctccggggctccatggccgccatctactcgctgctcaagcacgcctcctgcccggagtcgctcttcttccacttcctcgccgcggacggcgccgcgcccggggtggacgagctcaggagcgcgctcgccgcctccttcccctcgctgcggttcgagatctacccgttccgcgccgacgccgtcacggggctcatctccgcctcggtgcgcgccgcgctcgaggcgccgctcaactacgccaggaactacctcgccgacctgctccccaagtgcgtgccgcgggccatatacctcgactcggacgtgctcgccgtcgacgacgtgcgccgcctctgggagacgcgcctgcccgccgccgccgtcgtcgccgcgcccgagtactgccacgccaacttctcccgctacttcaccgacgccttctggtccgacccggacctcggcccgcgcgtcttcgccggccgccgccgcgcgccctgctacttcaacaccggcgtcatggtcatcgacctccgccggtggcgctcggggaactaccgccaccgcatcgagcagtggatggagttgcagaaggagaagcgaatctacgagctggggtccttgccccctttcttgctcctcttcgccggcgaggtggaggctgtcgaccaccggtggaaccagcacggcttgggcggcgacaacgtgctcggcagctgccgcccgctccacaagggccctgtcagcctgatgcactggtcaggcaagggcaagccatgggatcgcctcgacgccggcaggccttgcccgctcgaccacacttggaagtcttatgatctctacattggcgacggtgatgcatcgctagcgtcggcgccgtcctgggcctcattgtcatcatcggcgttgccagcggcggtgttttcttggtagacagatatgtgacacacgctataatttttaaatttggctgtggtgatgcaattgcgtttgcgatgcattgccactgccatcacagctgccatcgcaagccggctgccgccttcggctgtacagcgaggggaggggcggtacattgcagcggctgcgacgggaagaggaagaacagtgcataggggaagcaaattcttggttcattcacgatacaattcggattgattcattatgctgtgattcggaggtggtgactagggggtgttggaattactttattggtggtgtacaattcttggataggagaaaggtttcactttttttgtctgttagttcaggattgtttcatttacatttacatgtttattcagtaaaccagtataaatattgattgaattgatttcaataaaacagggtgcatcttgttcttgctgcagtcctaaactctcttgtatctgtcactcacttggttcagaaattagcatcgagaatggcttacaaaaaaaaaaaactagaagatgccaagcg

SEQ ID NO: 2083 - DNA, 1560 bp, Avena sativa
cgactactccctccctctccctccgcattactgctccaccatcgccagacagctcagcgcaggctgcacaccacaaccccccagcgccgcaggaatccaagaataatcgccgagccatcgccggcgccgatgatggccggggcagcagcagccgcagcgctgataatcttcttggccgcgacggccgccgtctccggcgccgagctgccgaggttcgctgaggcgccgcagtaccggaacggggaaggctgcccggccgcggcggcgggcgtgtgcgaccctgggctggtacacatcgccatgaccctggacgcgcactacctgcgtggctccatggcggccatctactccctcctcaagcacgcctcctgcccggagtccctcttcttccacttcctcgccgccgacgcgccccccggggacatcacgggcctgcggcgcgccgtggcggcgtcgttcccgtcgctgcggttcgagatctacccgttccgcgccgaggccgtggcggggctcatctcggcctccgtgcgggccgccctcgacgcgccgctcaactacgcgcggaaccacctcgccgacctgctcccgccctgcgtgccccgggccatctacctcgactccgacgtgctggccgccgacgacgtgcgccgcctctgggagacgcgcctccccgccgccgccgtcgtcgccgcgcccgagtactgccacgccaacttctcccgctacttcacccccgccttctggtccgacccggagctcggcacgcgggtcttcgcgggccgacgccgcccgccctgctacttcaacacgggcgtcatggtcatcgacctccgccgctggcgggcgggcaactaccgccgccgcatcgagcgctggatggagatccagaaggagaagcgcatctacgagctgggctccctgcccccgttcctgctcgtcttcgccggcgaggtggaggccgtcgacctccgctggaaccagcacggcctcggcggcgacaacgtgcacggcagctgccgaccgctgcacgacgggcccgtcagcctcatgcattggtcgggcaagggcaagccctgggacaggctggacgccggcaggccctgcccgctcgaccacacctggaagtcatacgacctctacattcccggagacggcagcggcgccgcctcgccggcctccgggccggcattgtcggcttcttggttgtagaaacagagcgcgtagatgtagcggatggatagatacaataattcttttgttggttggggcggttcttggcaatggcagccgtggcatcgcattggtgctgccgctgtcgctcccaccgccgccccaccccatcggctgtacagggtcggtcgcggtgattgcatcgcgacgaggctgggtagagaaaagaagagcttgttcttttcggtagaaattcagattcatttatttatttgggtgggcgttcttggggattcccaattcgctccattcctagcagtgtacaattcgttgatagctgcagagacatgagattttgttctattattattttgatgattctttcattct

SEQ ID NO: 2084 - DNA, 1438 bp, Triticum aestivum
cgctgccgcggttcgcggaggcccccgagtaccggaacggggaggggtgcccggcggcggtggccggcgcgggggtgtgcgacccggggctcgtccacatcgcgatgacgctcgacgcgcactacctccggggctccatggccgccatctactcgctgctcaagcacgcctcctgcccggagtcgctcttcttccacttcctcgccgccgacggcgccgcgcccggggtggccgagctccggagcgcgctcgcggcctccttcccgtcgctgcggttcgagatctacccgttccgcgccgacgccgtcacggggctcatctccgcctcggtgcgcgccgcgctcgaggcgccgctcaactacgcccggaactacctcgccgacctgctccccaagtgcgtgccgcgggccatttacctcgactcggacgtgctcgccgtcgacgacgtgcggaggctctgggagacgcgcctgcccgccgccgccgtcgtcgccgcgcccgagtactgccacgccaacttctcccgctacttcaccgacgcattctggtccgacccggacctcggcgcgcgcgtcttcgccggccgccgccgcgcgccctgctacttcaacaccggcgtcatggtcatcgacctccggcgctggcgctcggggaactaccgccaccgcgtcgagcagtggatggagttgcagaaggagaagcgaatctacgagctgggctccttgccccctttcttgctcctcttcgccggcgaggtggaggctgtcgaccatcggtggaaccagcacggcttgggcggcgacaacattcttggtagctgccgcccgctccacaagggccctgtcagcctgatgcactggtcaggcaagggcaagccatgggatcgcctcgacgccggcaggccttgcccgctcgaccatacatggaaatcatacgacctctacattggcgacggtgatgcatcgcaagcatcggcgccgtcctgggcctcattgtcatcatcggcgttgccggcggcggtgttttcttggtagacagatatgggacacacgatataattttttcatttggttgtggtaatgcaattgccttgcgatgcatatccattgccatcacagctgccgtcgcaagccggctgccgccttcggctgtacagcgagaggaggaggggcggtacattgcgacggctgcgacgggaagaggaagaacagtgcataggggaagcaaaattcttgttcattcacgatacaattcggattgattcattatgctgtgattcggaggtggtgactagggggtgttggaattactttattggtggtgtacaattcttggatagaagaaaggtttcactttttttgtctgttagttcaggattgtttcatttacatttacatgtttgttcagtaaaccagtataaatattgattgaattggtt

SEQ ID NO: 2085 - DNA, 2791 bp, Oryza sativa
cggctaattaacgcgtatcccaatcacgcaagggattaaaacccctcgtccgaattgctaacaccacaccgttcgtctccccctcggagaaacgcgcaccgagctcagctgtcatccatccatccatccacgcgacgcgcagacacaaagagaaatacatacgacgcctcaccgaccactcgctgcccaccattactgctgctgctgctgctgctcccaccaccaccaccaccacgggacgaggaggaggaggctgcaagaatccaagaaaccgcgatgccggcgcgggccgcggcggcggcggctgcggtggcgctgctgctggccgtctgcgctcaggcggcggcgctgccgaggttcgctgaggcgccggagtacaggaacggggaagggtgtcccgcggcggcgacggcggcggcgggggtgtgtgacgctgggctggtgcacatctcgatgacgctggacgcgcactacctgcgcgggtccatggcggcggtgtactcgctgctcaagcacgcctcctgcccggagtcgctcttcttccacttcttggcggaggaggaggaggttgggggtggtggtgacctgcggcgcgccgtggcggcgtcgttcccgtcgctgcggttcgagatctacgcgttcagggcggaggccgtggcggggctcatctcggcgtccgtgcgcgccgcgctggagtcgccgctcaactacgcgcggaaccacctcgccgacctgctcccgcgctgcgtgccccgcgcgatctacctcgactccgacgtgctcgccgtcgacgacgtgcggcgcctctgggagacgcgcctccccgccgccgccgtcgtcgcggcgcccgagtactgccacgccaacttctcccgctacttcaccccggcgttctggtccgacccaggcctcggccgccgcgtcttcgccggccgccgccgcccgccctgctacttcaacaccggcgtcatggtcatcgacctccgccgctggcgcgccggcaactaccgccaccgcatcgagcggtggatggagatccagaaggagaagcgcatctacgagctgggctcgctgccgcccttcctcctcgtcttcgccggcgaggtcgaggccgtcgaccaccgctggaaccagcacggcctcggcggcgacaacgtgcgcggcagctgccgcccgctccacgacgggccggtcagcctcatgcactggtcaggcaaggggaagccatgggaccgcctcgacgccggcaacccgtgcccgctcgaccacacctggaagtcctacgacctctacgttgccggggacgacggcgccgccgcctcctcgccggcgtccgggccggcgttgtcgtcgacgtcgacgacgtggcccgcattggtgttctcttggtagaaattgaggatctctagctgtagtgccatactgggacacaataattcttttgttggttgcgcgggttcatggcaattgcaatggtgatcctccatggcattgcattgcattgctgctgctgttgccgccgtgagctaagccacccctcgccatcggctgtacagggcggtgaagggaggccgcggcgattgccgcgcgaggatggggggagaatggatagagagaaaagatgatcttgttcttttcggcggaattcagattggttatttgggggggattttgattcttttgggtggtgattcttggggttcccaattcgctcgattggcggtgtacaattctttggtaggaaagacctggaatttttgttcaattattgattattctttcattcctatgtgatgtgttcatgatctcaaattagtatatgatctgagtctgaattggattgaacctggagcagaaccattttgttctatcagatatgaagttctacattggatctcctattcttgaaatgcccaaagttcaaaccaaacatgccgatcatgtgaagactgaagagcacaaactgaatgcagctggctggcatttctgtcgaattcaaaactgggggcaaacaccaaattgaaatgtgatgaaactggtgattgatggtgctgaaactgtgaggctacaattcctatctttggatgccttctccatcatcaattcaaccttgtcctcatgcactgaattcttctcccggcccctgattgagaacaatccatgtcatactctctgaattcatttcacttgtatcaagtttttggtcagaaatcaatgctccacacaagagacttgtgacaggaggcttcaaagttctcctacaacatctgcccattggtttcccgcctgcttccaaatcatttgaaacaaaaggtacattcagaatttgaggtcagttctaattctgaactagttttccttttaagtattgattaagtcaaaatcattttgttgggttggtagttaggttccttgcaatctaaacaggatgtgcctataataacttacctactacttactactaggccactacacaatcagctctactgatgaagagctgaatagatgatgctagctcatactatagtagaaggcttgaagcaacaaaaatgagaagcctagtttagtgtaaagtagtatatgaccagttatatgccaaagttgatccactttatacaaagacaggatcacaagtcaggtccaggctggaggcaaccaactaatgaacagctagagaattgaaactgcaagccaagtgcactaccactgcagtgcaactgatcattgtctgttttcttttgtcccttgcttcaccttctcactttgcttttcttttctttttttacccccc

SEQ ID NO: 2086 - DNA, 1076 bp, Setaria italica
tcccctcgtcgccggcgtccatgggcggcgccgcgggcgaggcgatgcgggccggtgtcgcggtggcggcggcggtcttcttggctttcgcgttttccggtgcggcggcggcgctgccgaggttcgcggaggcgccggagtaccggaacggggagggttgcccagccgcggcggctggggtgtgcgacccgggtctggtgcatatcgccatgacgctggacgcgcactacctgcgcgggtccatggcggcggtgtactcgctgctcaagcacgcgtcctgcccggagtcgatcttcttccacttcctggccgcggaggccggcgccgcgggcggggagggcccggagccggagccggagctgctgcggcgcgcggtggccgcgtcgttcccgtcgctgcggttcgagatctacccgttccgcgccgaggccgtggcggggctcatctcggcgtccgtgcgcgctgcgctcgaggcgccgctcaactacgcccggaaccacctggcggacctgctcccgcgctgcgtgccacgggcgatatacctcgactccgacgtcctcgccgccgacgacgtgaggcggctctgggagacgcgcctgcctgccgccgccgtggtggcggcgcccgagtactgccacgccaacttctcccgctacttcacgccggccttctggtccgacccggacctcggcgcgcgcgtcttcgccgggcgccgccgcccgccgtgctacttcaacaccggcgtcatggtcatcgacctccgccgctggcgcgccgggaactaccgccaacgcatcgagcggtggatggagatccagaaggagaagcgcatctacgagctgggctccctgcccccgttcttgctcgtcttcgccggcgaggtggaggccgtcgaccaccgctggaaccagcacggcctcggaggcgacaacgtgcacggcagctgccgcccgctccacgacgggcccgtcagcctcatgcactggtcggggaagggcaagccatgggaccgcctcgacgccggcaggccatgcccgctcgaccacacctggaggttatatgacctctacatcccc

SEQ ID NO: 2087 - DNA, 1346 bp, Saccharum officinarum
cccacgcgtccgcccacgcgtccgaaaaaatttggttattcgttcacgtcgcctcgcgctatagcatgttcttctgttcattcacaaaagctactagaggaggaactttcaactgcacacctcgttcgtgtccccctcatgcatgaataaagccagcctgtcgtggcggaggcaagctgttgtggctgcgacacaaacaccgcgccatcacatacacatacctccccctcaccatcctcctccatcctctgtccacaccaaaagcagaaggaagggagagatctggggggtgagagagagcaggagaaggccattggagcttctccgtcctcttctctttctctccgtctctctctggtttgcttgctttgcctctactagactctagtcgtccggtccggtcatggccaccatcctggagaacatccagaaggcgaggttcctgccgaccaggccgctcaaggacgagctgcccaccttccagggcggctttggcggcggtggcaaggaggagagccacctcatgggcctgaggaagcggctgtcctccttctcgggcaagatccagcccatctcctccgcgtcggccgagtgggcgttccggcgctccaagtcggcgccctcgctcggcgccgcgttcgccgcggggggcggctccctgaggcagtggtggcagtggggcgtcggctggctcctgtccaagaagcccggcttcgcgggcgacctcgagatgaacgaggaggaggtcgccgcgctgggccgccagggcaggggcagctgggcccacatcctctacaagatgcgctccggcgtccggcggctcgtcatgtccacgcactcgctccccaccacgcacaagcagtcgtccctgccgtcgtcggcgtcggcggtgcacaacaacgtccagtgcaagccggcggcggcgttcgcctacgcgcagcggcagagcttccaccacaccggccacgccatggcgcactaaggcgcgtcgcgcgcggttgcaggtgccgtttgcagccgatctcctccagattcagaaacggagaacggtgagaggcacgagaagaagaagattcaggttccaggtgcgtgagatcgatggtgaagatgtcaaggtgccgttataagtgaaaactgctcggtgaattgatgatgaatgaaatggaatgtaggttttaccatcctgtgctgtgtagatctagtgcccctgtagaggtgaagaagtgttatatgctcgttctttatattcttttgggttcttttggacgatgtaaatgtacaatgtttggttgattttgtactgtttttgcctccagcagtaaataaaactaatgcaaattgtgctc

SEQ ID NO: 2088 - DNA, 1447 bp, Zea mays
caccgcaccagcagctgccgccacccatcatttttgccaacacggctccagtgtgtctgagctgcctgacttggaggagtcgcaggaaggcaaaaaaaaaaaaggggttttggtaattcatcattcacgtcgcctcgcgttatagcacgttcttgtgttcacaaaaaagctacgaggaactttcaactgcacacctcgttggtgtccccctcatgcatgaataaagccagcctgtccaggcggaggcaagctgctgtggctgcggcacaaacaccgcgccagcacaacgcatacgcatacctcaccttcctttcctcctcccgtcctccatcaaaagaaggcagggaaagatctgatctggggggtgagagagcaggaggagaaagccaagccattgccctcccctcttgaaggcttggagcttggttctacatcctcttctcttcccctccgtctctctctctctctctctatttggtttgcttgcttgcctctactagactctagtcgtcgggtccggccatggccaccatcctggagaacatccagaaggcgaggttcctgccgaccaggccgctcaaggacgagctgcccaccttccagggcggcggcaagagcaaggaggagagccacctcatgggcctgaggaagcggctgtccagcttctccggcaagatccagcccatctcctccgcgtcggccgccgagtgggcgttccgccgctccaagtcggcgccctccctcggcgccgccttcgccgcggggggcggctccctgaggcagtggtggcagtggggcgtcggctggctcctgtccaagaagcccgggttcgcgggcgacctcgagatgaacgaggaggaggtcgccgcgctgggccgccagagcaggggcacctgggcccacatcctgttcaagatgcggtccggcgtccgccgcctcgtcgcgtccgcgcactcgctccccaccacgcacaagcagcagtccctgccgtcgtcgtcggccgcggcggcgcacagcgtccagtgcaagccggcggcgtcgttcgcctacgcgcagcggcagagcttccaccacaccggccacgccatggcgcactaggcagcgtctcgcggttgccggtgccgtctgcggccggtctcctccagatccagggatggagagcgctgagaggcgcgggaagaagaagattcaggttacaggtgcgtgagatcgacggtgaagatgtcgttgaattgatgatgaatgaaatggaatgtaggattaccgttctgtgatctgtgtagatctagtgcccctgtagaggtgaacaagtgttatactacatgcccgttctttctttatattattcttttgggttcgttctttggacgatgtaaatgtaaaatgttttgttgatcttgtactgttaaataaaactgatgcaaattgtgcccctcggttcttgagt

SEQ ID NO: 2089 - DNA, 1389 bp, Setaria italica
gttcgcgtcgcctcgcgctaacatgtttacaaagctaccaccccgaactttcaaccgcacacctcgttcgtgtccccctcatgcatgaataaagccagcctgtccaggcgggggaggcggctgctgtggctgcgagacaaacaccgcgccatcacatacacatacctcgccttcctcctccatcccctgtccacaccaaaaggagaagggaggggaggagatctggagaagagaagaggagaggagttggccattgtcacttgaaggctcgagtttcctctcttttttctttctcttgcttcttgctttgcttggttgaggcgccggccatggccaccatcctggagaacatccagaagacgaggttcctgccgaccaggccgctcaaggacgagctgcccaccttccagggccgcctcggcggcggaggcgggggaggcaaggagagccacctcatgggcctgaggaagcggctgtcctccttctcaggcaagatccagcccatctcctccgcgtcggcggagtgggcgttccggcgctccaagtcggcgccgtcgctcggcgccgcgttcgccgcgggcggcggctccctgcggcagtggtggcagtggggcgtcggctggctcctgaccaagaagcccggcttcgcgggggacctcgagatgaacgaggaggaggtcgccgcgctcggccgccagagccggggcagctggggccacatcctctacagggtgcgcgccggcgtccggcggctcgtcatgtccacgcactccctccccaccacgcagaagcagtcgtcgctgccgtcgtcggcggtgcagcagcacaacgcccagtgcaagccggcggccgcgttggcctacgtgcagaggcagagtttccaccacaacggccacgccatggcgcactaggagagcgtccctcgccggttgcggacgatggccgtcgcaaccgatctccgtgagatccaaatggggatgaagagatgcccgaaaagaagaagattcaggttccaggtgaagatatcgtaatacgattataagtggaaatttagcccggtgaattgaggattgaatgaaacgtagcattaccgttctgttctgtgtagatctagtgcccccctgtcctgtagaggtgaatttgtactctcgttctttatattcttttttgggttggttggtcgatgtaaaaatgtaaaatgtttggttgatcttgtactcctattgattttttgcccccctccctccccccgcggtaaataaaactaatgcaagtcgtgctcctctgttcttgagaggaagaaagatgccttccagagttcctgctcagatctgatacgtcttgtcagtggctggcttgtggctacctaccaaccttgtaacattcttg

SEQ ID NO: 2090 - DNA, 1106 bp, Setaria italica
gtccacaccaaaaggagaagggaggggaggagatctggagaagagaagaggagaggagttggccattgtcacttgaaggctcgagtttcctctcttttttctttctcttgcttcttgctttgcttggttgaggcgccggccatggccaccatcctggagaacatccagaagacgaggttcctgccgaccaggccgctcaaggacgagctgcccaccttccagggccgcctcggcggcggaggcgggggaggcaaggagagccacctcatgggcctgaggaagcggctgtcctccttctcaggcaagatccagcccatctcctccgcgtcggcggagtgggcgttccggcgctccaagtcggcgccgtcgctcggcgccgcgttcgccgcgggcggcggctccctgcggcagtggtggcagtggggcgtcggctggctcctgaccaagaagcccggcttcgcgggggacctcgagatgaacgaggaggaggtcgccgcgctcggccgccagagccggggcagctggggccacatcctctacagggtgcgcgccggcgtccggcggctcgtcatgtccacgcactccctccccaccacgcagaagcagtcgtcgctgccgtcgtcggcggtgcagcagcacaacgcccagtgcaagccggcggccgcgttggcctacgtgcagaggcagagtttccaccacaacggccacgccatggcgcactaggagagcgtccctcgccggttgcggacgatggccgtcgcaaccgatctccgtgagatccaaatggggatgaagagatgcccgaaaagaagaagattcaggttccaggtgaagatatcgtaatacgattataagtggaaatttagcccggtgaattgaggattgaatgaaacgtagcattaccgttctgttctgtgtagatctagtgcccccctgtcctgtagaggtgaatttgtactctcgttctttatattcttttttgggttggttggtcgatgtaaaaatgtaaaatgtttggttgatcttgtactcctattgattttttgcccccctccctccccccgcggtaaataaaactaatgcaagtcgtgctcctctgttcttga

SEQ ID NO: 2091 - DNA, 1122 bp, Panicum virgatum
cgccttcctcctccaccacccctgtccacaccaaaagaagtgggggagagatctggagaagagaagaggaggagaaggccattgacccgtgacggcttgagcttgtctgctcttttccctcttctctctcgcgtgctttctttgcttcgcttggctgaggcgccggccatggccaccatcctggagagcatccagaagacgaggttcctgccgaccaggccgctcaaggacgagctgcccaccttccagggcggcctcggcggcggcaaggagagccacctcatgggcctgaggaagcggctctcctccttctccggcaagatccagcccatctcctccgcgtcggccgagtgggcgttccggcgctccaagtcggcgccgtcgctcggcgccgcgttcgcggccggcggcggctccctgaggcagtggtggaagtggggcgtcggctggctgctctccaagaagcccggcttcgcgggggacctcgagatgaacgaggaggaggtcgccgcgctcggccgccagagccgcggcagctggggccacatcctctacaagatgcgcgccggcgtccggcgcctcgtcatgtcctcgcactcgctccccaccacgcagaagcagtcgctgccgtcggcggcgccgcagcacagcgcccactgcaagccggcggcggccttcgcctacgcgcagaggcagagcttccacctcaacggccacgccatggcgcactaggcagcgtcgccgccggctgcggacggccgtcgccaccggtctccatgagatctaatccaaatggggatgcccaagaagaaggagaggattcagattccaggtgcgtgagaccgatggtgaagatatcgcgatacgaatacaagtgggaacaaaaattagcccggtgagttgaagttgatgaatggttcaagtgaattgtagcgttgccgtcccgttctgtgtagatctagtgcccctgtagaggtgaatttgtatgctcgttctttacattctttttgggttcgctggagattgtaaatgtaaaatgtttggttgatctttgtattgcctttttgccccacgcggtaaataaaactaatgcaaagtcgtgctcctttgtttttgaccttg

SEQ ID NO: 2092 - DNA, 992 bp, Panicum virgatum
aggagaaggccattgccccgtgacggcttgagcttcttctctgctctttttctctcttctctctcgcgtgctttcttgcttcgcttggctgaggcgccggccatggccaccatcctggagagcatccagaagacgaggttcctgccgaccaggccgctcaaggacgagctgcccaccttccagggcggcctcggcggtggcggcggcgggggcggcaaggagagccacctcatgggcctgaggaagcggctctcctccttctccggcaagatccagcccatctcctccgcgtcggccgagtgggcgttccggcgctccaagtcggcgccgtcgctcggcgccgcgttcgcggccggcggcggctccctgcggcagtggtgggcgtggggcgtcggctggctgctctccaagaagcccggcttcgcgggggacctcgagatgaacgagaaggaggtcgccgcgctcggccgccagagccgcggcagctggggccacatcctctacaagatgcgcgccggcgtccggcgcctcgttatgtccacgcactcgctccccaacacgcagaagcagtccctgccgtcggcggcggcgcagcacagcgctcactgcaagccggcggcggcgttcgcctacgcgcagaggcagagcttccacctcaacggccacgccatggcgcactagggagcgtcgccggatgcgcgccgggttccaggtgcgtgagaccgatggtgaagatatcgcgatacgaatataagtgggaaaaaaattagcccggtgattgatgaatggttcaagtgaaatgtagcgttgccgtcccgttctgtgtagatctagtgcccctgtaggggtgaatttgtatgctcgttctttacattctttttgggttcgctggagattgtaaatgtaaaatgtttggttgatcttgtattgccttttttttgccccccgcagtaaataaatctaatgcaaaatcgtgctcctctgttcttgag

SEQ ID NO: 2093 - DNA, 1127 bp, Pennisetum glaucum
gtccacaccaaaaggagaagggaggagaggagatctggagaagagaggaggaagaggtggccagtgctccttgaaggctagagcttcttctcttttccctctcctggttcttgctttgcttggttgaggcgacaggccatggccaccatcctggagaacatccagaagacgaggttcctgccgaaaaggccgctcaaggacgagctgcccaccttccagggcggcctcggcggcggtggtggcggtggcgggggaggtggccttgagagccacctcatgggcatgaggaagcggctgtcctccttctccggcaagatccagcccatctcctccgcgtcggcggagtgggcgttccggcgctccaagtcggcgccgtcactcggcgccgcgttcgccgcgggcggcggctccctgcggcagtggtggcagtggggcgtcggctggctcctggccaagaagcccggcttcgcgggggacctcgagatgaacgaggaggaggtcgccgcgctcggccgccagggacggggcagctggggccacatcctctacaaggtgcgcgccggcgtccggcggctcgtcacgtccacgcactccctccccaccacgcagaagcagtcatcgctgccgtcgtcggcggtgcagcagcgcaacgcccagtgcaagccggcggccgcgttcgcctacgcgcagcggcagagcttccaccacaacggacacgccatggcgcactagggagagcgtccctcgccggttgcggacgatggccgtcgcaaccgcaaccgatctccgtgagatccacactggagatacgcaagaagaaaagattcaggttccaggtgcgtgagaccgacggtgaagatatctgaatacgattataagtggattaaattagctcggtgaattgatgagtgagatgaaacgtagcattaccgttctgttctgtgtagatctagtgcccccctgtcctgtagaggtcaatttgcacgctcgttctttatatatatatatatattttgggttggttggaagatgttgtaaaaatgtaaaatgtttggttgatcttgtattgattttttgcccccccgcggtaaataaaactaatgcaagccgtgctcctctgtcttgat

SEQ ID NO: 2094 - DNA, 1114 bp, Brachypodium distachyon
gaccccgaggccgaaacgtaagttctcggcgtagcaccaccacatatacacacgcgttcttctgcgactcttcttcctctgtctttgccaacccacagaaactagaagaagaggagatctggagaaggccattgcgtttgcacctgagacctgaaacctccttcttctcttctttcctgtttgcttggttggcgtcacgggcggcatggccaccatcctggagaacatccagaaggcgaggttcttgccgaccaggccgctcaaagacgacctgcccaccttccaaggcggcggcagcaaggaggagagccacctcatgggcctgaggaagcggctgtccaccttctcgggcaagatccagcccatctcctccgcctccgccgagtgggccttccggcggtccaggtccgcgccgtcgctcgccgcgttcgccggcgccgcgggcggcccgctcaagcggtggtgggactggggcgtcggctggctgctctccaagaagctcggcttcgccggcgacctcgagatgaacgaggaggaggtggccgccctcggccgccagagcaagggcacctgggcgcacatcctctacaaggtgcgctccggggtccggcggctcgtcgtgtcctcccactcgctgcccaccacacagcacaagcaccactcgctgcccacctcggcggcgcacaaggcgcagtgcaagccgccggcgccgttcgcctacacccagagaagcttccagtacggccaagccatggcgcattgaggccgggcgtgctagggacaagtgggacaagactaagatctggtggtctcgccatgagatccaaatcgatacgaggaggcgctcgagaagaagatgatgattcaggtttggggtgatggcgaagacaattactccgtactattgtttgggaatttagctggggatgaaattgtagtttttaccattctgtttcttgtctactagatctaatgtccatgcgtatagatataccaagtgttttgttcgttctttccattcttttgggttcgtcggacgatgtaaatgttgggatgattccttatgtttttgcctcctgcagtaaataaaagctaatgcagattcatgctcgta

SEQ ID NO: 2095 - DNA, 1387 bp, Brachypodium distachyon
caacacggctccagttcatttcacgtcgcctccctgttaacgacaaagccttttgggttcaggtttcagctgcacacttcgtggccccctatgcctatgcgtgaataaaaaccagcctgttgtccacacacagctgcgaccccgaggccgaaacgtaagttctcggcgtagcaccaccacatatacacacgcgttcttctgcgactcttcttcctctgtctttgccaacccacagaaactagaagaagaggagatctggagaaggccattgcgtttgcacctgagacctgaaacctccttcttctcttctttcctgtttgcttggttggcgtcacgggcggcatggccaccatcctggagaacatccagaaggcgaggttcttgccgaccaggccgctcaaagacgacctgcccaccttccaaggcggcggcagcaaggaggagagccacctcatgggcctgaggaagcggctgtccaccttctcgggcaagatccagcccatctcctccgcctccgccgagtgggccttccggcggtccaggtccgcgccgtcgctcgccgcgttcgccggcgccgcgggcggcccgctcaagcggtggtgggactggggcgtcggctggctgctctccaagaagctcggcttcgccggcgacctcgagatgaacgaggaggaggtggccgccctcggccgccagagcaagggcacctgggcgcacatcctctacaaggtgcgctccggggtccggcggctcgtcgtgtcctcccactcgctgcccaccacacagcacaagcaccactcgctgcccacctcggcggcgcacaaggcgcagtgcaagccgccggcgccgttcgcctacacccagagaagcttccagtacggccaagccatggcgcattgaggccgggcgtgctagggacaagtgggacaagactaagatctggtggtctcgccatgagatccaaatcgatacgaggaggcgctcgagaagaagatgatgattcaggtttggggtgatggcgaagacaattactccgtactattgtttgggaatttagctggggatgaaattgtagtttttaccattctgtttcttgtctactagatctaatgtccatgcgtatagatataccaagtgttttgttcgttctttccattcttttgggttcgtcggacgatgtaaatgttgggatgattccttatgtttttgcctcctgcagtaaataaaagctaatgcagattcatgctcgtatgctctttgtcttgagatgccatcagatctgaactccggtaagtatctttccggttgctaccagctagcatccaccatctgccagcacatgcatttcctaatgtctacagcttcccttcaaaataaatgttcagct

SEQ ID NO: 2096 - DNA, 1440 bp, Setaria italica
gtggctcggagctcagcctgcagcagatcgaggccgagctgcgctagaggagcaaccgagtccgtgtagtacgtccatggcgccctcccggagggtcctcatgctctgcggcgactacatggaggactacgaggccgccgtcccgctctacgcgctcgccgccctcggcgtcgccgtcgaccgcatcgcgcccggcaagcaccctggcgacgcatgcctcaccgccgtccacgagttcctcggcttcgagctctacacggagctcccgggccaccggttcgcggtcaccgcggacttcgcggcggcggcggcgaacccgtcgcgctacgacgcgctcgtcgtcccgggcggccggttcgcggagcacctcagcgcggacgagggcgccgtggcgctcgtcgcggcgttcgcggagatgcggcggcccgtcgtcctgacgtgccacagccagctgctgctcgccgcggcggggggcctggcgggcggggtgcggtgcacggcgttcttcggcgtgcgccccgtcgtcgagctcgccggcgggacgtgggtcgacccggaaccattcagcctttgcgtcgccgatgggcacgtgctctccgccatcgggtggcccgcgcacgccgagatcatcgccaagctcctcgccgccatgggcgcgcgcgccgacgccggccgcggcgggcagcgcgtcctcgtgctctgcgccgactacgtggacgactacgaggcgaacgtgccgttccgggcgctggccggcgtgggctgccgcgtcgagtcggcgtgcccgaccaagcgcaggggcgagccctgcgtcacggccatctacgacgccgtgaaaccgggcgcggtgagcgaggagaggcgggggcacaacttcgcagtgaccgcggactgggcggacgcgagcgccgacggcttcgactgcgtcgtcgtccccggcggccgggcgccggagctgctggtgacccacgagagcgcggtggcgctggtccgggagttcgcagacaaggggaaggtcgtggccagcatcgggcagggccacctgctcctcgccgccgcggggctgctccggggcaggaggtgcgcgagcggggtgcccatgagggtggtctcgaggctggctggggcagaggttgtggagacggaaggggcggtcgccgacgggaagatcgtgacggcggcgggatggccggaccttgcgccgttcgtggctcgcctcgtcgacctcctcggcatcaccgtttcgttctgaagcggcgtcgcatctctgctctgcaaactctcagcgcgcgctgaactgaacactgcggtgttctgaatgtccagttgtttagagattctcttcatgtggtttgagaataaaaccgatgaatcacataaagttttgttgacagaaaaatcgcatctttctgaaagttgaataagaagcaccattacctg

SEQ ID NO: 2097 - DNA, 692 bp, Zea mays
aataatattgtgatccctgaccacggaaccacacccccagagaaaccattctacatattctcatatacactcattagcacatagcgctaggcgccataccaaccatgagcgacctgttatcctacatttccaaggtcatgtgcatcaaggcaagatcggaggcaacacaagccggcgaggacggcggctgcccagcggacgagtgccgcgtctgcctgtccaagattcggctcggcgaggctacccgccgactgccgtgtcgccatgtgttccaccgggactgcgtcgaccggtggctctcgtcctgcaagcgaacctgtccgctgtgccgagtttatgtggccgatgggaacaagcagccggtggcggcaaagcacaccagccgtgaagcacaggcactcgccgacgaccttgttatctggttctccaccgtgcttgttcccggtttctgatgccaaattccttcgtctgttcgttcgtttgaaaaagcttgattggtgtgtattttttttattgcatgcatgatacatgtacgtacctacgttactgttaattgtccttagaacagtttctagaaaatctgtgtgtatgtagcatcttgttgcatgaactgattggaacttctgtgtttgcagctgattactgaaaataagaagttcgagcaaatatatgttatcgaaatttatggtact

SEQ ID NO: 2098 - DNA, 748 bp, Saccharum officinarum
ctcatatactcagcacttagcgctaggcgctataccaaccatgagcgacctgttatcctacatttccaaggttatgtgcatcaaggcaagatcggaggaggcaacacaggccggcgaggacggcggttgcccagcggacgagtgccgcgtctgcctgtccaagattcggctcggcgaggctacccggcgtctgccgtgtcggcatgttttccaccgggactgcgtcgaccgatggctcttgtcctgcaagcggacctgtccgctctgccgagtttatgtggccgatgggaacaagcagccggtggcggccaagcacaccagccgtgaagcacaggcactcgccgacgacctggtgatctggttctccaccgtgcttgtccccggtttctgatgccaaatccctcttttgttcgctcgactcgatcgaaagcttggtgtgtattttttattgcatacatgtacgtacctatgtttatcttaatttagaacagtttttagaaaatgtgtgtatgtagcatcttgttgcatgaactttattggaacttttgtatttggagctgataactgaaaataagaagtccgagcaaatggtgtcgaaatttatggtactataaggtggtgttggtttcacaaattaacgtaaatgtattttttgtaaacaaaaaaaaagggcggccgtctagaggatcaagctacgtcgcgtgatgcacgtatagtctctatgtgcactaaatcctcactgccgcgt

SEQ ID NO: 2099 - DNA, 586 bp, Setaria italica
ccctgaccacggaaccacagccctgcaccccattacatattctcatatactcagcgcctgcacccgcactataccaaccatgagcgacctcatttcctacatctccaagatgttgtgtatcaaggcaaggtccgaggcaacaccggccggcggcgaggacggcggcggttgcgcggcggaagagtgccgcgtctgcctgtcgaggatccgcgtcggcgaggccacccgccggctgccgtgccggcatgttttccaccgggactgcgtcgaccgctggctgctgtcctgcaagcgaacctgcccgctctgccgggtttacgtggccgacgagaacaggcatccggtggcggtgaagcacactggccgtgaagcactcgccgacgacctggtgatctggttctccaccgtgctcgtccccggtttctgatgacaaaatcttcttcattttcgcttgaagctgttttttgtttttggcatatactacagcttacgtgtatgtacttatgttagtctatagaacagttatcaacaaatttgtgtatgcatgcccggatagattctggtttcatttattggtggaattttt

SEQ ID NO: 2100 - DNA, 525 bp, Panicum virgatum
gagcgacctcctctccaacatttccaagatgttgtgcatcaaggcaagatccgaggctacgcaggctggcgaggacgatggctatccggtggacgagtgccgcgtctgcctgtcgaggatccgcgtcggcgaggccacccggggactgccgtgccggcacgttttccaccgggactgcatcgaccgctggttggtgtcctgcaagcggacctgtccgctctgccgggtgttcgtggccgacaagaacaggcatccggtggcggccaagcacaccagccgtgaagcactcaccgacgacctggtgatttggttctccaccgtgctcgtccccggtttctgaggctaagatcgtcttcattttcgattgaagccattattgttttcattttttttgcgagtactattcaacttatatatacctttgttagactatagaacagctttcaaaatatttctgtatgcacgcaggatatagtttctggtttcattttaattgttggaaacaacctttgtactgggtgctgc

SEQ ID NO: 2101 - DNA, 601 bp, Panicum virgatum
gggcactgtaccaaccatgagcgacctcctctcctacatttccaagatgttgtgcatcaaggcaaggtccgaggtgacgcagtccggcgaggacggtggctgtctggtggacgagtgccgcgtctgcttgtccaggatgcgcgttggcgaggccacccggcggctgccgtgccggcaccttttccaccgggactgcgttaatcgctggttggtgtcctgcaagcaaacctgtccgctttgtcgggtttatgtggccgacgagaacaggcatccggtggcggcgaagcacaccggccgtgaagcactcgccgacgacctggtgatctggttctccaccgtgcttgtccccggtttctgaattctgaggctaagatcttcttcattttctattgatgccattctttttttctggcatatactacacaacttttttacgagtactattcaacttatatgtacctatgttagactatagaacagctttcaaaatatttgtgtatgcacgcaggatagtttctggatacatttaatggttggaaataacctttgtactgggtgctgcttgctaaatgagagtgactgaaaataagcagttcgagtc

SEQ ID NO: 2102 - DNA, 1510 bp, Zea mays
gacgaagtaccaggctaccacgcgtccacgcctcaccatcgcagaagcgcagtaggaagccggacaaagctacgcaaggagggagaaagcgtgtaaaccatggcgtcctccgcgttcctcaacgctctcgtcctccgatcgccatcaccgtcgctctcgtcctcgtctaaccgccgcagcaccggcgccttcgcgttcccgaacccaccgcgcttcccatgcctgcgttctgcgcgtcgactcgtccttgcgagggcggcggcagcgccggcgccgggcgatggccccgaggacgagtgggggccggagcccgagggcggttccgctgtcacgggggccgcggtggcggaggcgccggaggcgagagaggtcgcggagctcaaggcgcagctaaaggacgcgctgtacggcacggagcggggcctgcgggcgtccagcgagtcacgagccaaagtgctggagctcatcacgcagctcgagacgcgcaaccccacgccggctcctacggaggcgcttacgctccttaacgggaagtggatcctcgcgtacacatcattttcccaactattcccactattggggtttggtaatctgcctcagctggtgaaggtggaggaaatatcacaaaccattgattctgagaacttcacagtgcaaaactgtatcaagttttcaggacctttggctacaacctcagttgccactaatgcaaaatttgaaattagaagccccaagcgtgtgcagatcaaatttgatgaagggattgttggtacaccacagttgaccgactccattgtgctaccagagaagtttgagttatttggacagaacatcgacctgagtccactgaaaggcatattttcttccatcgaaaatgcagcatcctcggttgcaaagaccatatctgagcagcctccgctcaaaataccgatcaggacaaacaatgctgaatcgtggttgcttacgacataccttgacgaagagctcaggatctccagaggcgatggcagcagcatctttgtgctgttcaaggagggaagtactcttctatactgagatccaaatcccgagtccatgatcgttgaagctgaaccgtgaagtagttatactgcttatgcttttctttcttatagtaatatgctccgtctcaaaataagtcaatttctagaatcacttaaagtcaaattatcttaagtttgaccaattttataggaaaggcaccatcgtctatgtttctatgacaccaaatgagtacattatgaaaaatattttatggtgcattagtgacactaattcagtgccatgctctttttatgaatttggtcaaacttaaaaatagtttgatttaagataactctgagaaattgatttattttgggacagagagaatgtttctgggttgtcttgtaaatacagttcttgtcattagagtatatgatgactaggaccggtttaatccgaattatataaactctctatatatcagcgaaccccttttttatagttaact

SEQ ID NO: 2103 - DNA, 993 bp, Saccharum officinarum
agcatcccagaaacaaaacaaaacaggaagccggacaaagctacggaaggagaaagcttctacagatcccagcaccatggcgggatccgcgttcctcaacgctctcgtcctccgcgcgccatccccatccccgtcgctctcgtgctcgtccaagcgccgcagcgccggcgccttcgcgttcccgaacccaccgcgcttcccatccctgcgttctgtgcgccgcgtcgtccttgcgcgggcagcggcggcggcgccgggcggtgaccccgagcccgaggacgacgagtgggggccggagcctgagggcgggtccgctgccacagggaccgcggtagcggaggctccggaggcgccggaggcgagagaggtcgcggagctcaaggcgcagctgaaggacgcgctgtacggcacggagcggggcctgcgggcgtccagcgagtcgcgggccaaggtgctggagctcatcacgcagctggagacgcgcaaccccacgccggcgccgaccgaggcgcttacgctcctcgacggcaagtggatcctcgcgtacacatcattttcccaactgttcccactgttggggtttggaaatctgcctgagctcgtgaaggtggaggaaatatcacagaccattgattccgagaacttcacagtgcaaaactgtatcaaattttcaggacctttggctacaacctcagttgccaccaatgcaaaatttgaaattagaagccccaagcgcgtacagatcaaatttgatgaaggcattgttggtacatcacagctgaccgactccattgtgctaccagagaagtttgaattgtttggacagaacatcgacctgagtccactgaaaggcatatttacttctatcgaaaatgcagcatcctcggtagcaaagaccatatctgatcagcccccgctgaaaataccgatcaggacaaacaacgccgaatcatggttgcttacgacctaccttgacgaagagctcacgatctc

SEQ ID NO: 2104 - DNA, 1366 bp, Zea mays
cttgtgaaattagccaccagttagctcaagcaaccttttgtcagcctagtcaaatagtttttttttctcgcacggtcgcacggagggagtatcagtctaccacgctaaacaggaagccggagaaagcgtgtacagtaccggaatccagcaccatggcgggatcagcgttgctcaacgctctcgtcctccgcgcgccatccccgtcgctctcgtcctcgtctaaggtccgcagcgccggcgcctttgtgttctcgaacccaccgcgcttcccatccctgcgttctgagcgccgcgtcgcccttccgcgggcggcggcgggcggtgaccccgaggacgagtgggtgccggagcctgagggtgggtccgctgtcactgggaccgcggtggctgaggcgccggaggcgggagaggtcgcagagctcaaggcgcagctaaaggatgcgctgtacggcacagagcggggcctgcgggcgtccagcgagtcgcgggccaaggtgttggagctcatcacgcagctcgagacgcgcaaccccacgccggcgcctaccgaagcgctgacgctcctcaacggcaagtggatcctcgcgtacacatcattttcccaactgttcccactgttggagtttggaaagctgccagcgctggtgaaggtggaggaaatatcacagaccattgattccaagaacttcacagtgcaaaactgtatcaagttttcaggacctttggctacaacctcagtttccaccaatgcaaaatttgaaattagaagccccaagcgcgtgcagatcaaatttgatgaaggcattgttgggacaccacagttgaccgactccgttgtgctaccggagaagtttgaagtatttggacagaacatcgacctgagtccactgaaaggcatattttcttcgatcgaaaatgcagcatcctcggttgcaaagaccatatctggccagcctccactgaaaataccgatcagggcaaacaacgccgaatcgtggttgcttacgacctaccttgacgaagaggtcaggatctccagaggcgaaggcggcggcatctttgtgctgttcaaggagggaagtactcttctaaactgagatcgaaatcctggtcgttgaagatgaaccttggagtagttatactgcttatgctttccttttcttatagtagtatactccgtcccaaagtaagtcagtttctagaatcacataaagccaaactatcttaagtttgatcaattttatagaaaaggtaacgtcatctatgaagatatatttcatgacgtgttactgatactaattgagtgtctaaatactgtccacttatacaaatgttaaatgtcaagtatatccatctaaataccatt

SEQ ID NO: 2105 - DNA, 1481 bp, Setaria italica
gccgcacccgcactcgaagcttctgcctcgacacgtctcctccttcgacgcctctccctctctccctttttctagaattgtatctcgcttgctgaaggtagacgagtagaactttacctgtcagtcacctagcgacagcacaaaacaaagaggaaggaggcagtgaggcaaaagagcccaggaaatcaagaaagctcgtgcaagccatggcgggagttgcgtccctcaacgccctcgctctccgcgcaccttccccatcacccgcggccccgtccccgcgccgcggcaccgtcgccggtgccctcgcgttcccgacaccgccgcgcttcccgttgctgcgtgccgcgcgccgcgtcctggcgcgtgcggtggcggcgggcggggactccgaagacgagtgggggccggagcctgagggtgggtccgcggtcacggggacggcggtggccgaggcgtccgacccggaggcgagcgaggtggcagagctcaaggcgcagctcaaggaggcgctgtacggcacagagcggggtcttcgcgcgtccagcgagacgcgggccgaggtggtcgaactcatcacgcagctcgaggcgcgcaaccccacgccggcgcccaccgaggcgctaacgctcctcaacggcaagtggatcctcgcgtacacatcattttctcaactattccctctgctggggtccggaaggctacctgagcttgtaaaggtggaggagatatcacagactattgattcggagactttcacagtgcaaaactgcatcaagttttcaggaccattggctacaacctcagtttccaccaatgctaaatttgaaattagaagccccaagcgtgtgcagatcaaatttgatgaaggtgttatcggaaccccacaactgaccgactccattgtgctacctgagaagtttgagctctttggacagaacatcgacctgagcccattgaaaggcatattttcttccatcgaaaatgcagcgtcctcggttgcaaataccatctctggtcagccaccactgaagataccgattagaaccaacaatgctgagtcctggctgctcacaacctaccttgacgaagagctcaggatctctaggggcgacggtagcagcatctttgtgctgttcaaggagggaagctcccttctaaactaggatccacatcctgggtataggattcgatgttggagggcgaaccttggaagcattatgctgaccatggttcctttttcttgatttgtgtttatagtatatttgtcggctgtttgctctagaattggtaccttacgggtaaatgtttgtaatcgatgctcttcgtttctataaactgaaatgtacatatacttgcagttgtccagctgcttcaaacactgggtcccaattgcctatagtctgctgcaaagtactcaaaaacttgatttcatgctaaataaagtgccagagaataaactgacatggcaagaaatttatgaa

SEQ ID NO: 2106 - DNA, 1234 bp, Panicum virgatum
cggacgcgtgggcaagtgcacaactagagcccaggaaatcaagaaagctcgtgcaagcagccatggcgggagttgcgtccctcaccctcaccctccgcgcgtcttccccatcacccgcagccccgtacccacgcggcggcagcgacgccgccctcgcgttcccgaccccggcgcgcttccggtcgctgcgcgccgcgcggcgccgcgtcctgacgcgtgcggtggcggcgggtggtggggatcccgaggacgagtgggtgccggagcctgagggcgggtccacggtcacgggggtggccgaggcgcccgcgccggaggcgagcgaggtggcgcggctcaaggcgcggctcaaggaggcgctggacggcgcggaacggggcctgcgcgcgtccagcgagacgcgggcggacgtggtcgagctcatcgcgcagctcgaggcgcgcaaccccacgccggcgcccacggaggcgctcgcgctcctcgacggcaagtggatcctcgcatacacatcattttctcaacttttccctctgctggggtccggaaggctgcctgagcttgtaaaggtggaggagatatcacagactattgattcagagaacttcacagtgcaaaactgcatcaagttttcaggaccattggctacaacctcagtttccaccaatgctaaatttgaagttagaagccccaagcgtgtgcagattaaatttgaagaaggtgttatcggaaccccgcaactgaccgactccattgtgctaccagagaagtttgagctctttggacagaacattgacctgagcccattgaaaggcatattttcttccatcgaaaatgcagcatcctcggttgccaagaccatctctggtcagccaccacttaagataccgattcagaccaacaatgctgagtcctggttgctcacaacctaccttgacgaagagctcaggatatccagaggggacggtggaagcatctttgtgctgttgaaggagggaagcacccttctgaactaggttcaatgttgaagggcgaaccttggcagtattatattgactactgactacgttttctttttcttgataccatgtgtttgtagtagtatattagtggggtgtgtgctgtgtggttttttgaaaatatgattgccaccttatgggtaaatgtctgtaatcgatgcacttagtttcagtacctgaaatttagatatatatacttgcggttgtgctgtttcttc

SEQ ID NO: 2107 - DNA, 680 bp, Saccharum officinarum
agaggaggccccagcctctccacagctctcgagaaacctccaaccagtccagagtccagaggcaccacaccaatggctcccagcaagctcgcggtggtcatcgccttggtagcgtctctcctcctcctcaccaacagcaacaccaaggctgctccgggcggctacccgccggctcctccgctcggccctccgccgcaccagatcgtcgaccccgccaaagactgcgggggcgcgtgcgacgtgcggtgcggcgcgcagtcgcgcaagaaccggtgcacccgggcgtgcctcaagtgctgcagcgtctgccgctgcgtgccggcgggcacggccggcaaccagcagacgtgcggcaagtgctacaccgactggaccacgcacggcaacaggaccaagtgcccgtgactccggcttgggggtggcagcgtcagcgtgttccccggccgaaagcagcctgagtgagttcatgggcgcaccactggcgccacgttttgtatgatccgaccccgtcgtcgtagatgtagggtgtagctatctagctaggtcctggtcgatgtgctatgctgtttttttgttggtagtacgtactcctatctttgtgatgatgatgttgatgggcttgcggtgactctgttcttgtgtaaaaatccgtagcagtaaaatccatctggggtggatca

SEQ ID NO: 2108 - DNA, 681 bp, Setaria italica
ccccgccaggccgccacacaagaaacgacggagcgggaagactctccacagctctcaataaagctcttccagtccagtctccggccggcatcgatggcgcccggcaagctcgcagcggccgtcgccctggtggcaactctcctcctgctcagcaacagcaacatcaaggctgctccgggcggctatccgccggctcctcccgtcggtcctccgccgcaccagatcgtcgaccccgccaaagactgcgggggcgcctgcgacgtgcggtgcggcgcgcactcgcgcaagaaccggtgcacccgggcgtgcctcaagtgctgcagcgtctgtcgctgcgtgccggcgggcacggccggcaaccaggagacctgcggcaagtgctacacggactggaccacgcacggcaacaggacgaaatgcccgtgagcgtctgcgcggtgggtgtggccggtgagagcgtgctccccggccgaaagcaccatgtgtttgtttgtactatgatccatcggcttagttgtagctagctcgtggttgctgtgctctgctgtttctttgttgggttctttctttcgttggtggtctctgcgttcccgtgtaaaaaaagagtgaggcgttttctctagatgtaaaatccctctgggttggattggatcaatgcaacatctttatatttgcacgcta

SEQ ID NO: 2109 - DNA, 696 bp, Panicum virgatum
  misc_feature (44)..(44): n is a, c, g, or t
  misc_feature (164)..(164): n is a, c, g, or t
  misc_feature (255)..(255): n is a, c, g, or t
  misc_feature (407)..(407): n is a, c, g, or t
ggctggaaccgggagctctcaagaaagctctagcccaaggtccngccggcatcgatggcgcccagcaagctcgcagtggccgtcgccctggtggcgactctcctccttctcagcaacagcaacatcaaggctgctcccggcggcggctacccgccggctccccncgtcgggcctccgccgcaccagatcgtcgaccccgccaaagactgcggcggcgcctgcgacgtgcggtgcggcgcgcactcgcgcaagaancggtgcacccgggcgtgcctcacgtgctgcaaagcctgccgctgcgtgccggcgggcacggccggcaaccaggagacctgcggcaagtgctacactgactggaccacgcacggcaacaggaccaagtgcccgtgagcggcggcgccgtgttnggtgttccccggccgagagcagccagagagaggttgccggcgcactaccggcgccgtgtcttgtacttgatccatcggctttagatgtaggatgcgtgctctgttgtttcttctttctgatgttgatgggctggttgtgactgcatccctttgtagtaaaaaagaagaagagtgcgaggcgtctctctagccgtaaaatccatttgggttgtattacctgtctatcttctgttgatcgttgttctgcaaatacctaatcctacaatgcccaagaaagactgtcctcgcg

SEQ ID NO: 2110 - DNA, 844 bp, Panicum virgatum
ccgcaggctggaagtgaaacggcaagcctctccacagctctccagaaagctctagtccaggctccggccggcgtcgatggcgcccagcaagctcgcagtggccgtcgccatggtggcgactctcctcctgctcagcaacagcaacatcaaggctgctcccggcggcggcggctacccgccggcccctcccgtcgggcctccgccgcaccagatcgtcgaccctgccaaagactgcggcggcgcctgcgacgtgcggtgcggcgagcactcgcgcaagaaccggtgcacccgggcgtgcctcacgtgctgccgcacctgccgctgcgtgccggcgggcacggccggcaaccaggagacctgcggcaagtgctacacgggctggaccacgcacggcaacaggaccaaatgcccgtgagaggcggcgcgcggccggcggctggggggggtggccggcggtggcaccgtgttcggtgttccccggccgagagcagccagagagagaggcgggcgcactactggcccgtcttgtactgtgatccatcggctttagatgtaggctgtgtgcgctctgctgtttctttcttgtgttctttctgatgttgcgggctggttgtttcctgtgtaaaaaaaaagagggagatgcatttctctagctgtaaaatccatctgggttggttcaatgcactgtttttatattttgtgtggtagtttaattacctgtcttacatcacttggttattctctgcaagtacctagttctacttctacatgccaaaccgtttttatagattgctctgtactgtgtacattttacattttataatggtaaaatcccagttgtcgt

SEQ ID NO: 2111 - DNA, 1320 bp, Zea mays
atttcctattttcctcacgtattatcctcttgcttgttcgtccggttcttcgccctcgccgcgcgggactaccaatccaaactggcgacgaccctgctgccaccccacagcagatttgaggagcggacgcccgtttaaatggctattggagtcccatccatggagctccaccgctcctcaccgttgctctcgggtggccgaggaggaaatacatgcctacagaagaagcccttctttgtccaagcaaagagactagtggggatggagaaagcaagtacgaggccaggaacacaagagtctggacagacaaagaaaagagcacccctggttcgtggaactgttagcccacctcttccagtaccaggaaacatacctcggcctccttatgtcggcacagaatatgtaccagagatagcaaaagagatacaaatgcatgacaaagagggcattgtccacatgagagctgcttgcgagctcgcggctcgtgttcttgactatgcaggaacgttagtgaaaccctctgtaacaacagacgaaattgataaagcagtgcacaagatgatcatcgatgctggagcctatccatcaccacttggatatggtgggtttccaaaaagtgtatgcacctcagtgaatgagtgcatgtgccatggaattcctgattcacgcgagctacaggatggagacataattaacattgatgtcactgtctacttgaatggttatcatggggatacctcaaaaacatttctttgtggagaagtcgatgaagccagtaaacgacttgtgaaggttactgaagagtgcttgctcaggggcatatcaacatgcaaacatggtaccagctttaagaagattggcagaagaataagtgagcatgctgagaggaacggttttggtgttgtggagtgttttgttgggcatggagtcggcagggtatttcactcagaaccaattatctatcaccagaggaacaacagaccgggccagatgattgaagggcagactttcacaatagagccgatcatatcgatggggagcatcgagtgcgacatgtgggacgacggctggactgccgtgacgacggacggcagcttggcggcgcagttcgagcacaccatactgatcaccaggaccggagccgagatcctcaccaagtgctaggaggaaaggaaatcgcatgtgcccgatagccgacggtaggtaatctgtattcgtgaggtggtgaggatgcttgaggtgacctattttgtctcgcaaaatgggcgtgctacagaatagtgaagaaaagggttgagagattgcaaatggcaggtttgg

SEQ ID NO: 2112 - DNA, 1593 bp, Setaria italica
atgccgccacttgaaacggcggtaacaggctaccgccgtgtcaatcggtggtggaggaagataccgccagatgaaatggcggtagcccgcttaccgccggatgagatggcggtagcgccgcgccttgctgcaggctcgcttccacccatttcgggccgcgtgccacccattttgcaagtcgctggtggttcctgccacccatcatttcgggccctgtgctccctgtcatcggtggtggtggtccttaccctagcggtggtcgcgttgattactccagcagctattgataggcgaaaatccatttccccctcgtattatcctctttctccccttctcaaagttcgtcgcgggctccctccccctcgcccgcgcgactaccaatccgaattggcgaccccgtcgcccgccccactgcagatttggaggagacggccgcccgctctaatggcgattagagtcccgtccatggagctccaccgccccgcaccgttggtctccggtggccgagggaaaacatgccttcagaagaagcctttccttgtccaggcaaagagattagggggtttggagaaagcaagtacgagaggagcacaagagtctggacagccaaagaaaagagcgcccctgattcgtggaactgttagcccaccacttccggttccaggaaacatacctcgacctccttatgttggcacaaaagatgtacctgagatagcaaaagagatacaaatgcacgacaaagagggcatcatccatatgagagctgcttgtgagcttgctgctcgtgttcttgaatatgcaggaacattagtgaaaccctctgtaacaacagacgaaattgataaagcagtgcacaagatgatcattgatgctggagcctatccatcaccacttggatatggtgggtttccaaaaagtgtatgcacgtcagtgaatgaatgcatgtgccatggaatacctgattcgcgcgcactacaggatggagacataattaatatcgatgtcactgtctacttaaatggttatcatggggacacctcaaaaacatttctttgtggagaagttgacgaagccagtaaacgacttgtgaaggttactgaagaatgcctgctcaggggcatatcgacctgcaagcatggtaccagctttaagaagattggcagaagaataagcgagcatgctgagaggcatggacttggtgttgtggaatgttttgttgggcatggagttggcagagtatttcattcagaaccaatcatatatcatcagcgtaacaacaagccaggtcagatggttgaagggcagacattcacgatagagccgatcctatccatggggagcaccgactgcgacatgtgggacgacggctggaccgccgtgacgacggacggcagcttggccgcccagttcgagcacaccatactcatcaccaggaccggcgccgagatcctcacgaaatgctaggggaaaatcttctgcatgcccgttagctgtagccgctgtactgtaatccccttgctaattggcgtaaaatgttaagggaattttaggtaaaaaggacaagttctagcctctaggcttctgggcctcaac

SEQ ID NO: 2113 - DNA, 1183 bp, Setaria italica
tggagctccaccgccccgcaccgttggtctccggtggccgagggaaaacatgccttcagaagaagcctttccttgtccaggcaaagagattagggggtttggagaaagcaagtacgagaggagcacaagagtctggacagccaaagaaaagagcgcccctgattcgtggaactgttagcccaccacttccggttccaggaaacatacctcgacctccttatgttggcacaaaagatgtacctgagatagcaaaagagatacaaatgcacgacaaagagggcatcatccatatgagagctgcttgtgagcttgctgctcgtgttcttgaatatgcaggaacattagtgaaaccctctgtaacaacagacgaaattgataaagcagtgcacaagatgatcattgatgctggagcctatccatcaccacttggatatggtgggtttccaaaaagtgtatgcacgtcagtgaatgaatgcatgtgccatggaatacctgattcgcgcgcactacagtgtttcacaggatggagacataattaatatcgatgtcactgtctacttaaatggttatcatggggacacctcaaaaacatttctttgtggagaagttgacgaagccagtaaacgacttgtgaaggttactgaagaatgcctgctcaggggcatatcgacctgcaagcatggtaccagctttaagaagattggcagaagaataagcgagcatgctgagaggcatggacttggtgttgtggaatgttttgttgggcatggagttggcagagtatttcattcagaaccaatcatatatcatcagcgtaacaacaagccaggtcagatggttgaagggcagacattcacaatagagccgatcctatccatggggagcaccgactgcgacatgtgggacgacggctggaccgccgtgacgacggacggcagcttggccgcccagttcgagcacaccatactcatcaccaggaccggcgccgagatcctcacgaaatgctaggggaaaatcttctgcgtgcccgttagctgtagccgctgtactgtaatccccttgctaattggcgtaaaatgtcgagggaattttaggtaaaaaggacaagttctagcctctaggcttctgggcctcaactttctggtaggcgttcggtttggttctcgctgccccgtgattctcg

SEQ ID NO: 2114 - DNA, 1914 bp, Oryza sativa
gggatgggggaaaaaaatctgcagccttcccgtgttatcctcttcaacctctggccctctcactcctcgcgccgcgcggctgctccggccaccaaagtggcgctccgatggcggtgagagtcccttccatggagctgcaccgccccccgccgtccgtatccggtgtccgaggaaaaagctgccttcaaaagcctttccttgtccaagcaaagagattagagggattggagaaggcaaacccaaggtcacgaggaaagcaaagtttggaacaagtgaagaaaagagcaccactgatccgtgggacagtgagtccacctctaccagtaccaggtcacataactcaacctccttacgttggtaaaaaggatgcttcagagatagcaagtgagatacaaatgcatgacaaagtgagcattattcacatgaaagctgcatgtgagcttgctgctcgtgttcttgaatacgctggaactttagtgaaaccctctgtaacaacagacgaaattgataaagcagtgcacaagatgatcattgatgctggagcctatccatcccctctcggatacggagggtttccaaaaagcgtgtgcacatctgtgaatgaatgcatctgccatggaattcctgattctcgtgaacttcaggatggagacataattaatatcgacgtcactgtctacctgaatggctatcatggggacacctcaaagactttcctatgtggagaagtggatgaagccagtaaacgacttgtgaaggttactgaagagtgcatgctcagggctatatcagcttgcaaacatggtaccagcttgaagaaaattggcagaagaataagcgagcatgctgagaggcacggatttggtgttgtggatcgttttgttgggcatggagttgggagaatatttcattcagaaccaatgatatatcaccagcgtaataatatgccaggtcaaatggttgaaggccagacattcacaatagaaccggccctatccatgggaagcattgattgcgacatgtgggacgacggctggacggccgtcacgacggacggcagcctagccgcgcagttcgagcacacgatactgattaccaagacaggagcagaaatcctcacgaaatgctagtaagatcggtgcccagcattagccactggagtagcagtgatctctgtgtttgtaggacgagtatggtggaaaggatggtcgattgttttgctgtataaagtactccctctgtattttaattttgattttaatgtattatgccgttgactttttaaccaacgtttgaccacttgtcttattcaaaatttgtatgcaaatataaaaatacttatgtcatgcttaaagaacatttgatgataaataaagtcacaataaaataaattataattacataaatttttttgaataagacgaaatgtcaaccgtttgttaaaaagttaacgtcatcatacattaaaatacggagggagtagtaggagtacatgaaactgcaaggataattgtcggcagggaaagaaaatagagctgctgggcgtcttcagatagggggaaaaaagatcagtgcgtttatgcaaatatcggtttactcgtaatacctttcgatccgattcattccagttaatctgacggttgttggtgtcacaatttgggttaagagtattcacatgttctatagtaagtgcacgacatcctgatgtttcttctgatctgacacagctgggtttggtttctgtcgattaattgacacaatactacccctgatcctgactgccgccggcgcctaaccattcacgttcagacttcagaaccgttcctatcggtggggagcaggaagtgatcgaatgcgacatgtgggaattggggtgatggacgggggcagcttggccgctcagctcgagcatat

SEQ ID NO: 2115 - DNA, 1286 bp, Panicum virgatum
  misc_feature (588)..(588): n is a, c, g, or t
  misc_feature (1110)..(1110): n is a, c, g, or t
  misc_feature (1112)..(1112): n is a, c, g, or t
  misc_feature (1126)..(1126): n is a, c, g, or t
  misc_feature (1152)..(1152): n is a, c, g, or t
tcaggctccatccccctcgccgcgcgcgactaccaatccaatttggcgaccccgtcgctcgccccattgcagatttgtgggagaccgccgccggctctaatggcgactagagtcccgtccatggagctccactgccccgcaccgttgctctccggtggccgaggtaatctgttctctccggcggcgtgtcttctttcaactattctagggagaacatgccttaagaagaagcttttccttgtccaagcaaagagattggggggtttggagaaagcaagtacgaggtcaaaagagtctgaacagccaaagaaaagagcagccctgattcgtggaactgttagcccaccacttcctgtaccaggaagcatacctcgacctccttatgttggcacaaaagatgtaccagagatagcaaaagagatacaaatgcacgacaaagagagcatcgtccacatgagagctgcttgcgagcttgctgctcgtgttcttgaatatgcaggaacattagtgaaaccctctgtaacaacagacgaaattgataaagcagtgcacaagatgatcattgatgctggagcctatccatccccncttggatatggtgggtttccaaagagcgtatgcacatcagtgaacgaatgcatgtgccatggaattcctgattcacgcgaactacaggatggagacataattaacatcgatgtcactgtctacttgaatggttatcatggggacacctctaaaacatttctttgtggagaagttgacgaagccaataaacgacttgtgaaggttaccgaagagtgcctgctcagaggcatatcaacatgcaaacatggtaccagctttaagaagattggcagaagaataagcgaacatgctgagaggcatggatttggtgttgtggagtgttttgttgggcacggagttggcagagtatttcattcagaaccaattatatatcaccagcgtaacaacaagccgggtcagatggttgaagggcagacattcccaatagagccgatcctatccatggggagccccgtttgcgacatgtgggacgacggctggaccgccgtgacgacggacggcagcttggctgcccagtttgancncacgattttgatcnccaggaccggcgccgagatcctcacnaaatgttagggggaattcatttgtgatctgtatggatgttggaggtgatagattttcttgctagagggcgtacaaaactttttaaaagttgaaaattgcaatggtgattttagccagagaggacaagttctagc

SEQ ID NO: 2116 - DNA, 1215 bp, Avena sativa
ccacgcccatatctccaggttttgggcgagataaactgctcccatggcggtcagagtcccgtccatggagctaaaccgctcgcctccgctcctctccggtggccgaggcaaaacatgccttaagaagcttttcattgtccaagcaaagagatcagggggattggacaaagcagctactagatcacaaggaacacaaacttctttaaaactcaagaaaagagcacctttgacacgtgggactgttagtccaccgcttccagtaccatggaacataactcgacctccttatgttggttcaaacaaaatgccagagatatcgagtgagatgcagatgcatgacaaggagaccattgtccacatgagagctgcctgtgagcttgctgctcgtgttcttgaaaatgcgggaaagttggtcaaaccctctgtaacaacagacgaaattgataaagcagtgcacaagatgatcattgatgctggagcgtatccatccccacttggatatggtgggtttccgaaaagtgtgtgcacatcagtgaatgagtgcatgtgccatggtattcctgattcacgagaactacaggatggagatataattaacattgatgtcactgtctacttgaatggttttcacggggacacctctaaaacttttttatgtggagaagtggatgaagacagtaaacgtcttgtgaaggttgctgaagagtgcatgcttagaggcatatcagcttgcaaacatggtgtgagctttaagaaaattggcagaagaataagtgagcatgctgagaggcatggatttggtgtcgtggagcaatttgttgggcatggagttggcagagcatttcattcacagccaattatatatcaccagcgtaacaacatgccagggcagatggtggaagggcagacgttcacgatagagccgatcctgacgatgggtaaggacagcatcgagtgcgacatgtgggacgacgggtggactgccctgacgacggacggcagcctggccacgcagttcgagcacaccatactcatcaccaggaccggagctgagatcctcaccaaatgctagccgccggcattattaggtcactcccagtgatgattgtatgaatccatggacagcgtgcgctggtgcgcatgatattttttttatcgaggccgtttcagcgcagaaactgcaagggtcgtgtaggcttcttctgggctttttct

SEQ ID NO: 2117 - DNA, 1378 bp, Triticum aestivum
aaaagaacgaaacaaaatccgttgcgtccgtagtattatccttttgcagtgtctggccgtcgcgctctcgccgtctcgctgccggctgccggctgcccctccccctcgccgcgcccgatttctccgccaactcccatacccaagttctagggaaagatacactgctccgatggcggtcagagttccgtccatggagctgaaccgctccccgccgctcctctccggcggcagaggcaaaacatgccttcagaagcctttcattgtccaagcaaagagatcaggtggattggagaaagcaaatactaggccacgaggaccgcaagcttctgaaaaactcaagaaaagagaacccctgactcgtgggactgttagtgcgcctcttccggtaccaggacacatacctcgacctccttacgttggatcaaacaaaatgcccgagatatcgagtgagagacaaatgcaggacaaagagaccatcgtgcacatgaaagctgcatgtgagcttgctgctcgtgttcttgaaaatgcagggaaattagtcaaaccctctgtaacaacagacgaaattgataaagcagtgcacaagatgatcatcgatgctggagcctatccatccccgcttggatacggtgggtttccaaaaagtgtatgcacatcagtgaacgaatgcatgtgccatggtattcctgattcacgagaactaaaggatggagacataattaacatcgatgtcactgtctacttgaatggttttcatggagatacctctaaaacatttttttgtggagaagttgacgaagctagtaaaagacttgtgaaggttactgaagagtgcatgcttaggggcatatcagcctgcaaacatggtgtgagctttaagaaaatcggcagaagaataagcgagcatgctgagaggcatggatttggtgtcgtggagcaatttgttgggcatggagttggcagagtttttcattcacaaccaattatatatcaccagcgcaacaacatgccggggcagatggtggaagggcagacattcacaatagagccgatcctgaccatgggaagcagcagcatcgagtgcgacatgtgggaggacggctggacggcggtgacgacggacggcagcctggcggcgcagttcgagcacaccatcctcatcaccaggaccggcgcagagatcctcaccaaatgctagcaaagccagcgatgaaggcgtacggatcctgaccgcgtagatcacgtgatttcttcttatgttgtagtataccaaagcatcactgaaacagcaccgatatgatttttggcagcggcaaagagctgccaggcttcttctggcatttagcatccccggtgttttgatgaacggggccgagga

SEQ ID NO: 2118 - DNA, 1267 bp, Triticum aestivum
ctctcgccgtctcgctgccggctgccggctgcccctccccctcgccgcgcacgatttctccgccaacccccatacccaagctctagggaaagatacactgctccgatggcggtcagagttccgtccatggagctgaaccgctccccgccgctcctctccggcggccgaggaaaaacatgccttcagaagcctttcattgtccaagcaaagagatcaggtggattggagaaagcaaatactaggccacgaggaccgcaagcttctgaaaaactcaagaaaagagaaccgctgactcgtggaactgttagcgcgcctcttccggtaccaggacacatacctcgacctccttatgttggatcaaacaaaatgcccgagatatcgagtgagagacaaatgcaggacaaagagaccatcgtgcacatgaaagctgcatgtgcgcttgctgctcgtgttcttgaaaatgcagggaaattagtcaaaccctctgtaacaacagacgaaattgataaagcagtgcacaagatgatcatcgatgctggagcctatccatccccgcttggatacggtgggtttccaaaaagtgtatgcacatcagtgaacgaatgcatgtgccacggtattcctgattcacgagaactaaaggatggagacataattaacattgatgtcactgtctacttgaacggttttcatggggatacctctaaaacgtttttctgtggagaagttgacgaagctgctaaaagacttgtgaaggttactgaagagtgcatgcttaggggaatatcagcctgcaaacatggtgtgagctttaagaaaatcggcagaagaataagcgagcatgctgagaggaatggatttggtgtcgtggagcaatttgttgggcatggagttggcagagtttttcattcacaaccaattatatatcaccagcgcaacaacatgccggggcagatggtagaagggcagacattcacaatagagccgatcctgaccatgggaggcagcagcatcgagtgcgacatgtgggaggacggctggacggcggtgacgacggacggcagcctggcggcgcagttcgagcacaccatcctcatcaccaggaccggcgcagagatcctcaccaaatgctagcaaagccagcgatgaaggcgtacgaatccttacccgcgtagatcacgcgatttcttacccgcgtatacaaagcattattgctgaaacagctgcgtaggtatagccggttatttttggcagcagcagagagctt

SEQ ID NO: 2119 - DNA, 1291 bp, Triticum aestivum
tttgcagtgtctggccgtcgcgctctcgccgtctcgctgccggctgccggctgcccctccccctcgccgcgcccgatttctccgccaactcccatacccaagttctagggaaagatacactgctccgatggcggtcagagttccgtccatggagctgaaccgctccccgccgctcctctccggcggcagaggcaaaacatgccttcagaagcctttcattgtccaagcaaagagatcaggtggattggagaaagcaaatactaggccacaaggaccgcaagcttctgaaaaactcaagaaaagagaacccctgactcgtgggactgttagtgcgcctcttccggtaccaggacacatacctcgacctccttacgttggatcaaacaaaatgcccgagatatcgagtgagagacaaatgcaggacaaagacaccatcgtgcacatgaaagctgcatgtgagcttgctgctcgtgttcttgaaaatgcagggaaattagtcaaaccctctgtaacaacggacgaaattgataaagcagtgcacaagatgatcatcgatgctggagcctatccatccccgcttggatacggtgggtttccaaaaagtgtatgcacatcagtgaacgaatgcatgtgccatggtattcccgattcacgagaactaaaggatggagacataattaacatcgatgtcactgtctacttgaatggttttcatggagatacctctaaaacattcttttgtggagaagttgacgaagctagtaaaagacttgtgaaggttactgaagaatgcatgcttaggggcatagcagcctgcaaacatggtgtgagctttaagaaaattggcagaagaataagcgagcatgctgagaagcatggatttggtgtcgtggagcaatttgttgggcatggagttggcagagtttttcattcacaaccgattatatatcaccagcgcaacaacatgccggggcagatggtggaagggcagacattcacaatagagccgatcctgaccatgggaagcagcagcatcgagtgcgacatgtgggaggacggctggacggccgtgacgacggacggcagcctggcggcgcagttcgagcacaccatcctcatcaccaggaccggcgcagagatcctcaccaagtgctagcatgcaagccagcgatgaaggcatacggatcctgacggcgtagatcacgtgatttcttcttatgttgtagtataccaaagcatcactgaaacagcaccgatatgatttttggcagcggcaaagagctgccaggct

SEQ ID NO: 2120 - DNA, 1482 bp, Oryza sativa
ggaagggggaaaaaaatctgcagccttcccgtgttatcctcttcaacctctggccctctcactcctcgcgccgcgcggctgctccggccaccaaagtggcgctccgatggcggtgagagtcccttccatggagctgcaccgccccccgccgtccgtatccggtgtccgaggaaaaagctgccttcaaaagcctttccttgtccaagcaaagagattagagggattggagaaggcaaacccaaggtcacgaggaaagcaaagtttggaacaagtgaagaaaagagcaccactgatccgtgggacagtgagtccacctctaccagtaccaggtcacataactcaacctccttacgttggtaaaaaggatgcttcagagatagcaagtgagatacaaatgcatgacaaagtgagcattattcacatgaaagctgcatgtgagcttgctgctcgtgttcttgaatacgctggaactttagtgaaaccctctgtaacaacagacgaaattgataaagcagtgcacaagatgatcattgatgctggagcctatccatcccctctcggatacggagggtttccaaaaagcgtgtgcacatctgtgaatgaatgcatctgccatggaattcctgattctcgtgaacttcaggatggagacataattaatatcgacgtcactgtctacctgaatggctatcatggggacacctcaaagactttcctatgtggagaagtggatgaagccagtaaacgacttgtgaaggttactgaagagtgcatgctcagggctatatcagcttgcaaacatggtaccagcttgaagaaaattggcagaagaataagcgagcatgctgagaggcacggatttggtgttgtggatcgttttgttgggcatggagttgggagaatatttcattcagaaccaatgatatatcaccagcgtaataatatgccaggtcaaatggttgaaggccagacattcacaatagaaccggccctatccatgggaagcattgattgcgacatgtgggacgacggctggacggccgtcacgacggacggcagcctagccgcgcagttcgagcacacgatactgattaccaagacaggagcagaaatcctcacgaaatgctagtaagatcggtgcccagcattagccactggagtagcagtgatctctgtgtttgtaggacgagtatggtggaaaggatggtcgattgttttgctgtataaagtactccctctgtattttaattttgattttaatgtattatgccgttgactttttaaccaacgtttgaccacttgtcttattcaaaatttgtatgcaaatataaaaatacttatgtcatgcttaaagaacatttgatgataaataaagtcacaataaaataaattataattacataaatttttttgaataagacgaaatgtcaaccgttgtaaaaagttacgtcatcatacattaaaatcgagggagtgtagagt

SEQ ID NO: 2121 - DNA, 1513 bp, Brachypodium distachyon
gggggaaggaaaataatgaaatcccactgcatccgttatcctgttcccagtgtctggctctcgcggcctcgtcctagctcgcggcgcgcgattgctgcggtgataacgcaatttttgggcgaaataaactgctccctcgatggcagtcggggtcccgtccatggagctgaaccgctccccgccgctcctctccggaggccgagctactttgcaaggtaaaacatgccttcagaagactttccttgtgcaagcaaagagatctgggggattggacaaagcaaatactaggtcacagggaacacgaacttctgaactaaagaaaagagcacccctgactcgtgggactgttagtgcacctcttccagtaccaggccacatacctcgacctccgtatgttgggacaaataatatgccagagatatcaagcgagatacagatgcatgacaaggagaccatcgtccacatgaaagctgcatgtgagcttgctgctcgtgttcttgaaaatgcaggaaagttagtcaaaccctctgtaacaacagacgaaattgataaagcagtgcacaagatgatcattgatgctggagcctacccatccccgcttggatacggtgggtttccaaaaagtgtatgcacatcggtgaacgaatgcatgtgccacggtattcctgattcacgagaattgaagaatggagacataattaacattgatgtcactgtctacttgaatggttatcacggggacacctcaagaacttatttttgtggagaagtcgatgaagccagtaaacgacttgtgaaggttactgaagagtgcatgcttaggggcatatcagcctgcaaacatggtgccagctataagaaaattggccgaagaataagtgaacatgctgagaggcatggatttggtgttgtggagcaatttgttgggcatggagttggccgagtttttcattcacagccaattatatatcaccagcgtaataacatgccagggcagatggttgaagggcagacattcacaatagaacccatcctgtccatgggaagcaacagcatcgagtgcgacatgtgggaagacggctggacggccgtcacgacggacggcagcctggccgcacagttcgagcacacgatactgattaccaggaccggcgcggagatcctcacgaaatgctagcacacatcagtcggtgcacgtcaaaccccccagtggccagttcatctctgtctctcggcctacgtagatttctgtggcggaataataggcgattgttttctgctgtacaaagtatttcctccaactgatttgcaatacggtacagttgaggatttgcaatacggtacaaagggtgaatttaggcaggaacagggagctgatttttttttcctcgaaaaaacagggggctgatttgaagtagtgaaggaacagatctgatgatcttcttttggggcttaatccttttttttggaacgacattgggcttcagctaatcggctgcttctgtgtggcatc

SEQ ID NO: 2122 - DNA, 1240 bp, Avena sativa
ggccgtcattgctccacgcctccacccacgcccatatctccaggttttgggcgagataaactgctcccatggcggtcagagtcccgtccatggagctaaaccgctcgcctccgctcctctccggtggccgaggcaaaacatgccttaagaagcttttcattgtccaagcaaagagatcagggggattggacaaagcagctactagatcacaaggaacacaaacttctttaaaactcaagaaaagagcacctttgacacgtgggactgttagtccaccgcttccagtaccatggaacataactcgacctccttatgttggttcaaacaaaatgccagagatatcgagtgagatgcagatgcatgacaaggagaccattgtccacatgagagctgcctgtgagcttgctgctcgtgttcttgaaaatgcgggaaagttggtcaaaccctctgtaacaacagacgaaattgataaagcagtgcacaagatgatcattgatgctggagcgtatccatccccacttggatatggtgggtttccgaaaagtgtgtgcacatcagtgaatgagtgcatgtgccatggtattcctgattcacgagaactacaggatggagatataattaacattgatgtcactgtctacttgaatggttttcacggggacacctctaaaacttttttatgtggagaagtggatgaagacagtaaacgtcttgtgaaggttgctgaagagtgcatgcttagaggcatatcagcttgcaagcatggtgtgagctttaagaaaattggcagaagaataagtgagcatgctgagaggcatggatttggtgtcgtggagcaatttgttgggcatggagttggcagagcatttcattcacagccaattatatatcaccagcgtaacaacatgccagggcagatggtggaagggcagacgttcacgatagagccgatcctgacgatgggtaaggacagcatcgagtgcgacatgtgggacgacgggtggactgccctgacgacggacggcagcctggccacgcagttcgagcacaccatactcatcaccaggaccggagctgagatcctcaccaaatgctagccgccggcattattaggtcactcccagtgatgattgtatgaatccatggacagcgtgcgctggtgcgcatgatattttttttatcgaggccgtttcagcgcagaaactgcaagggtcgtgtaggcttcttctgggctttttct

SEQ ID NO: 2123 - DNA, 1382 bp, Hordeum vulgare
gtcgcagcgcagtctcgctgccggctgcccctctccctccgccgcgcgtgatttctccgcccactcccatcccataccccggttctagggcgagagacgctgctcccatggcggtcagagtccagtccatggagctgaaccgctccccgacgctcctctccggcggccgaggcaaaacatgcccgttcattgtccaagtaaagagatcagggggattagagaaagcaaatacaaggtcgcaagcttctgaaaaactcaagaaaagagaacccctgacccgtgggattgttagtgcacctcttccggtaccaggtcacatacctcgacctccttatgttggatcaaacaaaatgccagagatatcgagtgagagacaaatgcaggacaaagagagcatcgtgcacatgaaagctgcatgtgagcttgctgctcgtgttcttgaaaatgcagggaaattagtcaaaccttctgtaacaaccgacgaaattgataaagcagtgcacaagatgatcattgatgctggagcctatccatccccgcttggatacggcgggtttccaaaaagtgtatgcacatcagtgaacgaatgcatgtgccatggtattcctgattcacgagaactaaaggatggagacataattaacattgacgtcactgtctacttgaatggttttcatggggatacctctaaaacgtttttctgtggagaagttgacgaagctactaaaagacttgtgaaggttactgaagaatgcatgcttaggggcatatcagcctgcaaacatggtgtgagctttaagaaaattggcagaagaataagcgagcatgctgagaggcatggctttggtgttgtggagcaatttgttgggcatggagttggcagagtattccattcacagccaattatatatcaccagcgcaacaacatgccggggcagatggtagaaggccagacgttcacaatagagccgatcctgaccatgggacgcagcagcatcgagtgcgacatgtgggaggacggctggacggcggtgacgacggacggcagcctggcggcgcagttcgagcacaccatcctcatcaccaggaccggcgcggagatcctcaccaaatgctagcaaagccggcgatgaatgcatacgattcctgagcgccagtgtagatcacgtgatttcctgttatgttgtgtacactgaaacagctgtgtacgtactactagtgtaacttaaggcttgcttggattgtcggacgagtcctaaataccggcgtaattgatacagatgtcgagtcatcgtttttatttcaagcgtaatttacattatagccggtaatatacaggtgtaaattaaatccgaatgcataaatatacaccgattccaagc

SEQ ID NO: 2124 - DNA, 1239 bp, Hordeum vulgare
ctgccggctgcccctctccctccgccgcgcgtgatttctccgcccactcccatcccataccccggttctagggcgagagacgctgctcccatggcggtcagagtccagtccatggagctgaaccgctccccgacgctcctctccggcggccgaggcaaaacatgcccgttcattatacaagcaaagagatcagggggattggagaaagcaaatacaaggtcgcaagcttctgaaaaactcaagaaaagagaacccctgacccgtgggattgttagtgcacctcttccggtaccaggccatatacctcgacctccttatgttggatcaaacaaaatgccagagatatcgagtgagagacaaatgcaggacaaagagagcatcgtgcacatgaaagcttcatgtgagcttgctgctcgtgttcttgaaaatgcagggaaattagtcaaaccttctgtaacaaccgacgaaattgataaagcagtgcacaagatgatcattgatgctggagcctatccatccccgcttggatacggcgggtttccaaaaagtgtatgcacatcagtgaacgaatgcatgtgccatggtattcctgattcacgagaactaaaggatggagacataataaacattgacgtcactgtctacttgaatggttttcatggggatacctctaaaacgtttttctgtggagaagttgacgaagctactaaaagacttgtgaaggttactgaagaatgcatgcttaggggcatatcagcctgcaaacatggtgtgagctttaagaaaattggcagaagaataagcgagcatgctgagaggcatggctttggtgttgtggagcaatttgttgggcatggagttggcagagtattccattcacagccaattatatatcaccagcgcaacaacatgccggggcagatggtagaaggccagacgttcacaatagagccgatcctgaccatgggacgcagcagcatcgagtgcgacatgtgggaggacggctggacggcggtgacgacggacggcagcctggcggcgcagttcgagcacaccatcctcatcaccaggaccggcgcggagatcctcaccaaatgctagcaaagccggcgatgaatgcatacgattcctgagcgccagtgtagatcacgtgatttcctgttatgttgtgtacactgaaacagctgtgtacgtactactagtgtaacttaaggcttgcttggattgtcggatgagtcc

SEQ ID NO: 2125 - DNA, 1456 bp, Brachypodium distachyon
gaaatcccactgcatccgttatcctgttcccagtgtctggctctcgcggcctcgtcctagctcgcggcgcgcgattgctgcggtgataacgcaatttttgggcgaaataaactgctccctcgatggcagtcggggtcccgtccatggagctgaaccgctccccgccgctcctctccggaggccgagctactttgcaaggtaaaacatgccttcagaagactttccttgtgcaagcaaagagatctgggggattggacaaagcaaatactaggtcacagggaacacgaacttctgaactaaagaaaagagcacccctgactcgtgggactgttagtgcacctcttccagtaccaggccacatacctcgacctccgtatgttgggacaaataatatgccagagatatcaagcgagatacagatgcatgacaaggagaccatcgtccacatgaaagctgcatgtgagcttgctgctcgtgttcttgaaaatgcaggaaagttagtcaaaccctctgtaacaacagacgaaattgataaagcagtgcacaagatgatcattgatgctggagcctacccatccccgcttggatacggtgggtttccaaaaagtgtatgcacatcggtgaacgaatgcatgtgccacggtattcctgattcacgagaattgaagaatggagacataattaacattgatgtcactgtctacttgaatggttatcacggggacacctcaagaacttatttttgtggagaagtcgatgaagccagtaaacgacttgtgaaggttactgaagagtgcatgcttaggggcatatcagcctgcaaacatggtgccagctataagaaaattggccgaagaataagtgaacatgctgagaggcatggatttggtgttgtggagcaatttgttgggcatggagttggccgagtttttcattcacagccaattatatatcaccagcgtaataacatgccagggcagatggttgaagggcagacattcacaatagaacccatcctgtccatgggaagcaacagcatcgagtgcgacatgtgggaagacggctggacggccgtcacgacggacggcagcctggccgcacagttcgagcacacgatactgattaccaggaccggcgcggagatcctcacgaaatgctagcacacatcagtcggtgcacgtcaaaccccccagtggccagttcatctctgtctctcggcctacgtagatttctgtggcggaataataggcgattgttttctgctgtacaaagtatttcctccaactgatttgcaatacggtacagttgaggatttgcaatacggtacaaagggtgaatttaggcaggaacagggagctgatttttttttcctcgaaaaaacagggggctgatttgaagtagtgaaggaacagatctgatgatcttcttttggggcttaatccttttttttggaacg

SEQ ID NO: 2126 - DNA, 781 bp, Saccharum officinarum
caactccctccctccttcccgtccgttgctcctgcccgcgcctccggcagtccgtcgataaagctgcggcattgggacggcgttaggcagaaggagcactccccatctcgtgtaggctctccccaccgcactcccacttctgacaccattccgccgccccacctctcctcctctcgccgccgctgaacccacggtgctgcggagatccagccagacctcgatcggcctactccgacaccgctttgggaagataacaaaactgcttgctgtctgctgggaagtggaggaagctcacggttcatatctgtatctgccttgagggaacctgtgggagaaaagggagtggacagggcccaaccacaagcatggacaaaactgccaatgtggtattggatattgagggtctgcctcaaccacctgataaatgctgctctggaagtccaaaaatgattagggccttatcacgtaagggttcaaatcggatggaaaggaggggcggtgatgagcaagagcaagaggattttgcaaaaaaacttatcatcaaagttgtgccatctcaactggagcagcccctgggccagaacaaggctctggttgctccacattgtactccctgcacgcctgttcttattgattctggggaaggaaggagcaaaagatttagccgattcacgtccatcaaccctcggaaaattcttctcttatttgcaacgctgtcgagcgtggggacgacgatactgatctacttcacgctggcgatcaacagcaaagcggaggcgta

SEQ ID NO: 2127 - DNA, 1150 bp, Setaria italica
ccactcttcttcttccacctctcgactcctcccacgctgctccgctcttcctctcaaaagactccaatccgtcgataaaattgcgccattggatcgcggggaggtggattagacccagcactctacccttccccgcccgccctcagcgccggtcacgcctccgccttcctgacccaggcatccttccattccaccacggctctgcctctcctcctacagtcctactacccccgtcgtcgtcctcgcggccccctggacctcgcgcgcagtgaacgtccatccggactcgattggcttcttcttcgctgccttgctggtttgggggaaaaaataagaagactgctgctggctgagaagtgtaggaaaatcacggctcatatctaccttgagggagccggtgggagaaaagggagtggacagggccagatcacaagcatggacaaaactgccagtgtggtattggatattgagggcctgcctcaaccacctgataaatgctgctctggaagtcccaaaatgattagagccctgtcgcgtaagggttcaaatcgcatggagaggaggggtggtgaagagcaagagcaagaggatttggcaaaaaaacttatcatcaaagttgtaccatctcaactggatcagcccctggttcagaacaaggctctggttgctcctcactatactccctgcacacctgttcttatcgattctggtgaaggaaggagcaaaagatttaaccggttcacatcaatcaaccctcggaaaattcttctcttctttgcaacgctgtcgagcatggggacgacgatcctgatatacttcacgctggggatcaacagcaaagcggaggcttagtcgttagcaggcaccatttacttcggcgcggcatcagtacattccaagctttgagtttgctccgttttcggattgtgttttgtttttgggaggaccaccggtccacagcagcaacagctgcagctagatgcagccagtcaggttcctacctgcgagtgagacgacgctgcttgagcggggtgctcgtcctcgttgtataccttcagctcctcgcctcccaaatttccttcatctgtatgtatagagattggttgttgtgacctgtgagtctatggagatagaggagccatcggtgttt

SEQ ID NO: 2128 - DNA, 831 bp, Setaria italica
ctctcgactcctcccacgctgctccgctcttcctctcaaaagactccaatccgtcgataaaattgcgccattggatcgcggggaggtggattagacccagcactctacccttccccgcccgccctcagcgccggtcacgcctccgccttcctgacccaggcatccttccattccaccacggctctgcctctcctcctacagtcctactacccccgtcgtcgtcctcgcggccccctggacctcgcgcgcagtgaacgtccatccggactcgattggcttcttcttcgctgccttgctggtttgggggaaaaaataagaagactgctgctggctgagaagtgtaggaaaatcacggctcatatctaccttgagggagccggtgggagaaaagggagtggacagggccagatcacaagcatggacaaaactgccagtgtggtattggatattgagggcctgcctcaaccacctgataaatgctgctctggaagtcccaaaatgattagagccctgtcgcgtaagggttcaaatcgcatggagaggaggggtggtgaagagcaagagcaagaggatttggcaaaaaaacttatcatcaaagttgtaccatctcaactggatcagcccctggttcagaacaaggctctggttgctcctcactatactccctgcacacctgttcttatcgattctggtgagaaggagcaaaagatttaaccggttcacatcaatcaaccctcggaaaattcttctcttctttgcaacgctgtcgagcatggggacgacgatcctgatatacttcacgctggggatcaacagcaaagcggaggctta

SEQ ID NO: 2129 - DNA, 542 bp, Pennisetum glaucum
gaagactgctgctaggataaaaaaagaagcagagaagtgtaggaacctcacggctcacatctaccttgagggagccggtgggagaaaagggagtggatagggccagatcacaagcatggacaaaactgccagtgtggtattggatattgaaggcctgcctcaaccacctgataaatgctgctctggaagtcccaaaatgactagagccctgtcgcgtaagggttcaaatcgcatggagaggaggggtggtgacgagcaggagcaagaggatttgttaaagaagcttatcatcaaagttgcaccatctcaactggatcagcccctggttcagaacaagtctctggtggctccccactctactccctgcacacctgttcttattgattgtggtgaaggaaggtgcaaaagatttaaccggttcacatctatcaaccctcggaaaattcttctcttatttgcgacgctgtcgagcgtggggacgacgatcctgatatacttcaccctgggaatcaacagcaaagcggaggcttagtcgttagcgc

SEQ ID NO: 2130 - DNA, 1330 bp, Zea mays
gtgagccaaaccaaaccaaaccgcctccagctccagcctcctgtcctgctcccttcctcccctgcctgcctgccgcgcaccactccactcgagtgactcgagtcgtcctcctcccaccacctcccgtccgttgcgttgctcctgcccgcgcctcctccatccaccacaccagtccgtcgttaaagctgcggcatcggcagcacacgccgacgggtacaaggagcactcattgcctccccatctcgtgtaggctctccccctcctccgcgctccgtccgtctctcatcaccgttccgccgccgccccacctctccctcctctcgccgccgcctccgaacccgccacggcgcggcggagatccaaccggacggatctggatcgacctactccgacaccgctttccgaagatagatagatagataacaaggttgtgctgtgcttgctgtctgttgggaagtggaggaagctcaataagttgatatccgcctcgagctcgagggaaccggtgggcagggccccccgatcacgagcatggacagaactgccaataatgcggtattggatatcgagagccttcctcaaccgcctgataaatgctgctctgggagtccgaagatgatcagggccttgtcgcgtaagggttcgaaccggatggagaggaggggcggcggcggcggcgagcaggagcaagaggatttggcgaaaaaacttgtcatcaaagttgtgccgtctcaactggagcagcagcccctgggtcagaacaaggcgctggtcgctccacattgcacacctgttcttgttgattctggggaagggaggagcaaaagattcattagccggttcacgtccatcaaccctcggaagattctcctcttgttcgcaacgctgtcgagcgtggggacaacgatactgatctacttcacgctggcgatcaacagcaaagcggaggcctagtcgcctggagacacccaccaccaccatttgcgtcggcgagcgggcggcggcagtacattccgagcttgagtttttatttttctctatttttgtttgtgaggtagctgccgcggcgagattagatgcagcctgccgctcaggtgtctgtatccattgactgagtgagagactgcttcagtgggtgtcattcttcctcgcgtgtatgtatattggtggaatcgttgatgtgacttttttagtcttcaattatgtgcagcagatcatgtatataacaggagatctgttgaagacagatcggcagagaagttcaattcggattaaaccggctgtttggactcctgcagttttaatgcatagagacaaaaaaaaactataa

SEQ ID NO: 2131 - DNA, 1266 bp, Panicum virgatum
  misc_feature (8)..(8): n is a, c, g, or t
  misc_feature (12)..(12): n is a, c, g, or t
  misc_feature (28)..(28): n is a, c, g, or t
  misc_feature (73)..(73): n is a, c, g, or t
  misc_feature (80)..(80): n is a, c, g, or t
  misc_feature (88)..(88): n is a, c, g, or t
  misc_feature (117)..(117): n is a, c, g, or t
  misc_feature (141)..(141): n is a, c, g, or t
  misc_feature (162)..(162): n is a, c, g, or t
  misc_feature (178)..(178): n is a, c, g, or t
  misc_feature (187)..(187): n is a, c, g, or t
  misc_feature (292)..(292): n is a, c, g, or t
  misc_feature (297)..(297): n is a, c, g, or t
  misc_feature (299)..(299): n is a, c, g, or t
  misc_feature (473)..(473): n is a, c, g, or t
ctaccccngccnctctgtctgcctctgntcgctcctctccgatccgtcgataaaattgcgccattggaccgangggaggnagaacccncgctcagccccttccccacccgccctcgncgccgggcacgcctccaccttccngactcaggcatacaccacagntctgcctcttccagtnttcctactnccctcgtcgtccccctggacttcgcgtgcagcgaacatccatccggactcgggttgacttgttccttcgcgtaagaaaagggctggtggttaacttctgggcctncgttncnggtttggaaaaataagaagactgctgccagccgagaagaggagaaaactcacggttcatatctacttcgagagtttgagggagcccggtgggagaaaagggactggacaggtccagatcacaagcatggacaaaactgccagtgttgtattggatattgagggcctgcctcaancacctgataaatgctgctctggaagtccaaaaatgactagagccctgtcgcgtaagggttcaaatcgcatggagaggaggggtggtaacgagcaggagcaagaggatatggcaaaaaaacttatcatcaaagttgtgccatctcaactggagcagcccctggttcagaacaagcctctggttgctccgcactgtactccctgcacacctattcttatcgattcgggtgaaggaaggaacaaaagatttaaccggttcacagctatcaaccctcggaaaattcttctcttctttgcaacgctgtcgagcttggggacgacgatactgatatacttcacgctggggatcaacagcaaagcggaggcgtagtcgttagcagataccgtttactttggcggcaggagtacattccaagctttgagtttgcttatgttttgtttggggagaggaccacatgttgacagcagcaacgagatgcagatgcattgcttatgttttgtttggggagaggaccacatgttgacagcagcaacgagatgcagatgcaaccagccaggttcttatctatgagtaagagacggtgctcaacccttggggggtgttcgttgtacctccagcagccccttgcctcccaaatttgcttcttcttcttcatctgtatgtatagagattggttttgttgtggcctgtgagtctatggagatagaggagccattggtgtttggtgatccagtgggtgtgctgtgctgcgcgtggttccagtgaccaggggcatggtgattttttttctggtc

SEQ ID NO: 2132 - DNA, 1147 bp, Zea mays
tttggacggctctatctactatctcctcgacacatcctatcaaaagaaaacaccacacataaaaatcccgtccctatccgccacggcacactcatcgccatgcccgccgccatgccctctccgccgggccgcctcctcgcttctatccctctccgctgccacgctccgacccagcagccctccaccaccgccgcccgcggcctcctcctccgcggcgcgtgctccccggttgtcaagcgtgtcccggacggtggcgggtggctcctctggcaccagtccggcccccgcgtggcgctctccacctctatggacggtctccgctggagcgccccagtatcccccgacccactgctaccctcagaggattggtggacgttcgataccgcctgtgttcgcccctccgacgtccttctcgtctccagccccgcggcgtcatcccgccgcttcccgtcctctgccgtatactggctctactacatgggctccaccgacgagcggttcggctccccgtttccggatgcggacgtccccgcgcttcccggcctcgctatcagccaggacggccgccactgggcgcgtatcgagggggaccaccacaccggcgcgctgttcagcgtcgcggaggaaggggagaaatcccgagggtgggaagcgcgctgcattgtcgcacccaaggtggtcatgcacgcagacggggacctgcggatgtactaccactcgttcgacgaaatgtcgcagaggcatgcaatcggtttggctaggtccagggatggtatccgatggaagaagacggggaaggtgcttgagggggggcgtgctggttgctttgacgaatgtggggtgcaacatggacatgtcgtccgtgaccgtgctgcccggcagtatgtcatggtgtttgagggtgttgacgcagatggtagagtgagcattggaatggccgtttcagaggacgggctgaaagagtggaggcggtctagcgagatgccagtgctgtgcccatcttacgatgacgaagggtgggatgccgctggggtcggttcaccatacttggtacaaatggacggggcttatgattggaggctgtattacatgggtgttgggagggacggggaggcttccattgggatggcgtattcagagggtcagg

SEQ ID NO: 2133 - DNA, 1404 bp, Setaria italica
ggaggaggaagttatcgctggtttaactagcgatagcttggatttgcaatttttgtttagccatatatttttgcaaaatactaaaataaaaaaatttccgcgctgtgccatgcgaagggccccacgtcctcctaatccggcacacggcacaactactctcacgatctcaactctcaacccgcctgccatgctccccgccgctctcctcccctcgccggcgggccgcctcctcgcccccgcccctctccgctgccactctcccacccagcaatcctccaccgccgcggcccgcggcctcatcctccgcggcgcgggctcccctgtcgtcaagcgcgtcccggacggcggcgggtggctcctctggcaccagtccggcgcgcgcgtcgcgctcgccacctccccggacgggctccgctggagcgcccccgtgtcccccgacccgctgctaccctccgaggactggtgggcgttcgacaccgccgccgcccgcccctccgacgtcctcctcatctccggccccgccgcgtcctcgcgccgcttcccgtcctccgccgtgtactggctctactacacgggctccaccgacgggcggttcggctccgcgttccccgaagcggacgtccccgcgctgccggggctcgccatcagccaggacggccgcaactgggcgcgcatcgagggggaccaccacaccggcgcgcttctcggcgtcggggaggagggggaggaaccccgtgggtgggaggcgcgctgcattgccgcgcccaaggtggtcatgcacgccgacggggacctgcggatgtactaccattcgttcgacgaaatgtcgcggaggcacgcgataggtctggcgaggtccagggacggcatccggtggacgaagatagggaaggtgcttgagggtggccgtgctggatcctttgatgaatgcggggtgcggcatggacatgtcgtccgtgaccgtgctgccgggcggtatgtgatggtgtatgatggtgttgatgcggatgggaaagtgagcattggaatggctgtgtcggaggacgggcttaaagggtggaggcggtccagtgagatgccagtgctgtgcccatctgaggagggcgaagggtgggatggtgctggggttggttcaccgtacttggtgcaaatggatggggcctatgactggaggctgtattacatgggtgttgggaggaatggcgaggcttcgatcgggatggcgtattcagagggtcaggctcttcagaaattcgagaagtgtgatgctgtcctcatgtaaggtgaggttgagggatgtacatcgggagttgttctggcccttctgggggtgttcacttcacttgcaacaaatttttgttagataaaagacccccaccttggcttatcctttgcattattcac

SEQ ID NO: 2134 - DNA, 1093 bp, Setaria italica
gatctcaactctcaacccgcctgccatgctccccgccgctctcctcccctcgccggcgggcccctctccgctgccactctcccacccagcaatcctccaccgccgcggcccgcggcctcatcctccgcggcgcgggctcccctgtcgtcaagcgcgtcccggacggcggcgggtggctcctctggcaccagtccggcgcgcgcgtcgcgctcgccacctccccggacgggctccgctggagcgcccccgtgtcccccgacccgctgctaccctccgaggactggtgggcgttcgacaccgccgccgcccgcccctccgacgtcctcctcatctccggccccgccgcgtcctcgcgccgcttcccgtcctccgccgtgtactggctctactacacgggctccaccgacgggcggttcggctccgcgttccccgaagcggacgtccccgcgctgccggctcgccatcagccaggacggccgcaactgggcgcgcatcgagggggaccaccacaccggcgcgcttctcggcgtcggggaggagggggaggaaccccgtgggtgggaggcgcgctgcattgccgcgcccaaggtggtcatgcacgccgacggggacctgcggatgtactaccattcgttcgacgaaatgtcgcggaggcacgcgataggtctggcgaggtccagggacggcatccggtggacgaagatagggaaggtgcttgagggtggccgtgctggatcctttgatgaatgcggggtgcggcatggacatgtcgtccgtgaccgtgctgccgggcggtatgtgatggtgtatgatggtgttgatgcggatgggaaagtgagcattggaatggctgtgtcggaggacgggcttaaagggtggaggcggtccagtgaagtgctgtgcccatctgaggagggcgaagggtgggatggtgctggggttggttcaccgtacttggtgcaaatggatggggcctatgactggaggctgtattacatgggtgttgggaggaatggcgaggcttcgatcgggatggcgtattcagagggtcaggctcttcagaaattcgagaagtgtgatgctgtcctcatgt

SEQ ID NO: 2135 - DNA, 1227 bp, Zea mays
aactccaagtcttgcgcggaagcaacggcctgtcatgtacctcgcccgaaatcgccgagagcctcccctcagtttacgccgcacgaaccgacgcactagaccgacccgcgaatcccccgcgcgcgcgccgtgcggtcaccgtccgaggccacggcaccgccggcccccgcccccgccccggccgccaagagcaaaggcaaggccgacgcttcctcctcgtcgtcctcctcctccactccaccgaggtcgcgccgcgcgcttgccgtcgtgatggccgcgtcgctgctcgtgctcgccgtggcgttcttggttggctctggctccggggggatcgatgggggcgcagcggctcccgtcgaggtggagggcaccgaggtggcctacggtagtgtgatcaagctgatgcacgagaagacgaagcaccgtctgcactcgcacgatgtgccctacggctcaggcagcggtcagcagtctgtcaccgggtttcctgaaggcgatgactcaaatagctactggatcataaggcccactccagattcatcgtctaagcaaggtgatgccatcgaaactggtggcatcatcaggttgcaacacatgaggacacggaggtggttgcacagtcacctgcacgcttcaccgttgtctggtaaccttgaggttagctgtttcggcggggatgaattgtcagatagtggtgaccattggaggctagaaattgaaggaagtggaaaagtatggaaaagagatcaaaaggtgcgacttagacatgttgacaccggaggttatctgcatagtcacaacaagaagtacaatcgccttggcggtgggcagcaagaggtctgcggtgtccgagagaagcgagctgagaacatttggttgacagcagagggtgtttatctcccagttaacgggagcaagtgaaaaagcactttctagcatttactatttttaatgttaatcagtataggatcagatattttgccagctttcattcgtccttgtcttaagaaaaacgaacatgggacctgaccccctagtgatatgtttaagttggaatgttggatatcgatgatgtcgacaagaccaggacagcgcatgcttgtaattgatatttataatccatatatgaccgtgtagatacccagaggccagagatgcatgtgatgtgacactttgttaacaactagagatgcggatcatcgtccagatgtgacagacattcgtggc

SEQ ID NO: 2136 - DNA, 1199 bp, Zea mays
aggaccgctgtggaaggtaggaaaagaaacagaaatctagcttaagcatccggctcgcacgcaccgacgcgcgacgcacgagaccgaccaccttcctccgccccaccactccccccgcgcgcgccgtgcgatcaccgccggcccccgccctcaccctggccgccttgaggaaaagcaaggccaacgccttctcctcctcctcctcctctccaccgaggtcgcgccgcgcgattgccgtcacgatggccgcgtcgctgctcgtgctcgccgtggcgttcctggttggcgctggccacggcggcatcgatgggggtgcagcagctcacatggaggtagagggctctgaggtgacctacgggagtgtgattaagctgttgcatgagaagacaaagcaccgtctgcactcacatgatgtgccgtacggctcaggcagcggtcagcagtctgtcaccggctttcctgaaggcgatgactcaaatagctactggatcataaagcctactccagattcatcgtctaagcaaggtgattccattcaaactggtggcatcatcaagttgcaacacatgaagactcggaggtggttgcacagtcacctgcacgcttcaccgttatctggtaaccttgaggttagctgttttggtggggatgaattgtcagatactggtgactattggaggctagaaattgaaggaagtggaaaagtatggaaaagagaccaaaaggtacgacttagacatgttgacactggaggttatctgcatagtcacagcaagaagtacaaccgccttggtggtgggcagcaagaggtctgcggtgtccgagagaagcgagctgagaacatttggttggcagcagagggtgtttatctcccggttaacggaagcaagtgaaaaagcactttcagtatttaccagttttaatgttaattagcataggatcagatattttactcgctttcattcgttcttgtttttcttaagataaatgaacatgggacatgacccctagtgatatgaaattggaatgttgggcatcgaaggtgtcgtacatgcttgtaattggatatttgtgatacatgtgtgaccgtgtagagactcagagatgcaagtgacactttgttcacaagtagagatgctgatcatcttctagatgtgacgcagaaaagacagtcgtggcaaatcttgagttttcgccgc

SEQ ID NO: 2137 - DNA, 1212 bp, Setaria italica
ctcgtctccgcggaagcaacggcccgtccgaactcctccgagtctccccctcagctcgccgcgaactcacgacgcacgcaccgacgcacgagaccgagcagccccaccacgccccgccccgcgcgcgcgccgtgcggtcaccgcccgcggccacggcaccgccggcccccgccccggccgccaagaggaaaggcaaggccgacgcctcctcctcctcgtctccaccgaggtcccgccgcgcgctcgccgtcgcgatggccgcgtccctgctcgcgctcgccgtggctctcctggtcagcgccggattcagcggcgtggacaggggcacagcggcccccgtggagtcagagggcggcgaggtgacgtacgggagcgtgatcaagctgatgcacgagaagacgaagcaccggctgcactcgcacgacgtgccctacggctcgggcagcggccagcagtccgtcacaggattccccgaaggagacgactccaatagctactggatcataaggcctactccagattcatcgtctaagcaaggtgatgccatcgagactggtagcattgtaaagttgcaacacatgaggacacggaggtggctgcatagtcacttgcacgcttcaccgttatctggtaaccttgaggttagctgttatggtggggatgaactatcagacactggtgactactggaggctagaaatagaaggaagcggaaaagtatggaaaagggatcaaaaaataaggcttaggcatgttgatactggaggttatctgcatagtcacaacaagaagtacaatcgccttggtggtgggcagcaagaggtctgcggtgtccgagagaagcgagccgagaacatttggttggcagcagagggtgtttatctcccggttaacggaagcaagtgaaacagcatcttctagtgttttcctgtttcatgagagttagcataggatcaggtgttttccccgttttcatttgttcttgtttgttctttgaaaacacgggacctgacccttgagtgatatgctgaatttagatgatatcgacaaaatgagtacagtacaggcttctaattgatatttacaattcagtatgaccatgtatagatccagacacccagagatgcaaagtgccacattctttcgcaactagggatgtttattttccagatgtgacgcagaaagacagtccttcgaaaatctggaagctttt

SEQ ID NO: 2138 - DNA, 1005 bp, Pennisetum glaucum
tccccctcagctcgccgcgaactcacggcgcacgcaccgacgcacgagaccgatcagccacgcccccccgcgcgcgcgtcgtgcggtcaccgcccgcggccacggcaccgccggcccccgccccggccgccaagcggaaaggcaaggccgacgcctcctcctcctcctcctcccccccgaggtcccgccgcgcgctcgccgtcgcgatggccgcgtccctgctcgcgctcgccgtggctctcctggtcagcgccggattcggaggcgtcgacaggggtgcggcagcccccttggatacagagggcggcgaggtgacctacgggagtgtgatcaagctgatgcacgagaagacgaagcaccggctgcactcgcacgacgtgccctacggatcgggcagcggccagcagtccgtcacgggattccccgaaggggatgactccaatagctactggatcataaggcctactccagattcatcgtctaagcaaggtgatgccatcgagactggtagcattgtaaagttgcaacacatgaagacacggaggtggctgcatagtcacttgcatgcttcaccgttatccggtaaccttgaggttagctgttttggtggggatgaactgtcagacactggtgactactggagactagaaatcgaaggaagcggaaaagtatggaaaagggatcaaaagataaggcttaagcacattgatactggaggttatctgcatagtcacaacaagaagtacaatcgccttggtggtgggcagcaagaggtctgcggtgtcagagagaagcgagctgagaacatttggttggcagcagagggtgtttatctcccggttaaaggaagcaagtgaaacatcattttgtagttttttcctgtttaatgagagttagcataggatcagatgttatttcgttttcatttgttcttgtttgttctctgaaaacatgggacctcaccctccagtgatattttgaatatagatgatgtcgacaaaatga

SEQ ID NO: 2139 - DNA, 1436 bp, Oryza sativa
cccccattctccacgcccacggagactcctcctcctccccccgtccccgactcggcaaaatcccgattcccaacggccgcgacacgcacacgcccaccccacgcccgccgcgcgcgcgagagagatcgagatcgaccgccaccgtgagcgcctcgcgcttccccgcccgcggccacggcaccgccggcctcagccggcgccgcctccgcagcagccaagaggagaggcacagccagctccgcctcctccgcctcttcgacgccttcatcctcctcgccgccgccgccgccgcatccgcgacaggggtcccgtagcgcggccgccgtcgcgatggccgcgtccgttctcgcgctcgccgtcgcgttcctcctcggcgccagcggctacggggtcgacaggggcgccgcggccgcctccccggcggcggagggcgtcgaggtggcttatgggagcaccatcaagctgatgcacgagaagacgaagcaccggctgcactcgcacgatgtgccgtatggctcaggcagcggccagcagtccgtcactggcttccccgaagtcgatgattccaatagctactggatcgtgcggccctctccagattcatcagctaaacagggtgatgccattgaaaccggtagcatcatcaggttgcaacacatgaggacacggaaatggttacatagccacttgcatgcttcaccattatccggtaacctagaggttagctgttttggtggggatggacaatcagatactggagattattggaggctggagattgagggaggtggaaagctatggaaacaggatcagaaagtaagactccgacatgttgatactggaggttatctgcacagtcacaacaagaagtacaacaggcttggtggtgggcagcaagaggtatgtggcgttagagagaagcgagctgaaaatatttggttggcaacagagggcgtctaccttcccgttaacaaaagcaagtaaactcaacattcccatgggtgcgtccaaggttaacatagcaccagaattttactgacattttgttctgctaatgcttttaaatttaaagaagggacctaaaccctgagtcccgagtattttgttggttatagatgacgatgtgcagaaaatgagaaatatacaaacgtttcatgtagccaatttactttctaatattcagaacgacaagctgttgtataatttgtatttgctcttcatgctgacgctagcaagcacacctatcaactatgtttgtttactattaagctaagtgcaattatgttaagcttggtataagtctggaattatacgcaggatgctgacccagggtttgtgacccacaaatataataccacctgcagtgggtaatctggagcttttcttaggctgtgttcttacctttaagttcccaacctatctccctcgttttccgc

SEQ ID NO: 2140 - DNA, 1210 bp, Oryza sativa
acacgcccaccccacgcccgccgcgcgcgcgagagagatcgagatcgaccgccaccgtgagcgcctcgcgcttccccgcccgcggccacggcaccgccggcctcagccggcgccgcctccgcagcagccaagaggagaggcacagccagctccgcctcctccgcctcttcgacgccttcatcctcctcgccgccgccgccgccgcatccgcgacaggggtcccgtagcgcggccgccgtcgcgatggccgcgtccgttctcgcgctcgccgtcgcgttcctcctcggcgccagcggctacggggtcgacaggggcgccgcggccgcctccccggcggcggagggcgtcgaggtggcttatgggagcaccatcaagctgatgcacgagaagacgaagcaccggctgcactcgcacgatgtgccgtatggctcaggcagcggccagcagtccgtcactggcttccccgaagtcgatgattccaatagctactggatcgtgcggccctctccagattcatcagctaaacagggtgatgccattgaaaccggtagcatcatcaggttgcaacacatgaggacacggaaatggttacatagccacttgcatgcttcaccattatccggtaacctagaggttagctgttttggtggggatggacaatcagatactggagattattggaggctggagattgagggaggtggaaagctatggaaacaggatcagaaagtaagactccgacatgttgatactggaggttatctgcacagtcacaacaagaagtacaacaggcttggtggtgggcagcaagaggtatgtggcgttagagagaagcgagctgaaaatatttggttggcaacagagggcgtctaccttcccgttaacaaaagcaagtaaactcaacattcccatgggtgcgtccaaggttaacatagcaccagaattttactgacattttgttctgctaatgcttttaaatttaaagaagggacctaaaccctgagtcccgagtattttgttggttatagatgacgatgtgcagaaaatgagaaatatacaaacgtttcatgtagccaatttactttctaatattcagaacgacaagctgttgtataatttgtatttgctcttcatgctgacgctagcaagcacacctatcaactatgtttgtttactattaagctaagtgcaattatgttaagcttggtat

SEQ ID NO: 2141 - DNA, 803 bp, Panicum virgatum
ccgtggagacggagggcggcgaggtgacctacgggagcgtgatcaagctgatgcacgagaagacgaagcaccggctgcactcgcacgacgtgccctacggctcgggcagcggccagcagtccgtcacgggatttcccgaaggagacgactccaatagctactggatcataaggcctactcctgattcatcgtctaagcaaggtgactccatcgagactggtagcatcataaagctgcaacacatgaggacacgtaggtggctgcatagtcatttgcacgcatcaccgttatccggtaaccttgaggttagctgttttggtggggatgaactgtcagacactggtgactactggaggctagagattgaaggaagtggaaaagtatggaaaagggatcaaaaagtaaggcttaggcacgttgatactggaggttatctgcacagtcataacaagaagtacaatcgccttggtggtgggcagcaagaggtctgcggtgtccgagagaagcgagctgagaacatttggttggcagcagagggtgtttatctcccagttaatggaagcaagtgaaacagcattttctagtgtttttctgtttcatgagcgttggcataggatcagatgtttttcccattttcacttgttcttgtttcttctttgaacctgggacctgaccccttgagtgatatgttgaatatagatggtgtcgacaaaatgagtacagtacaggcctctaattgatatttataattcagtatgtataggcccagtcacccagatatgcaagtgacacattttgttcac

SEQ ID NO: 2142 - DNA, 1188 bp, Triticum aestivum
ggagctcgagaagggcgtggagccggcgggtggaccaagcactcccacgccgagcacacaccgcaacagcacacccaggcacgatagaccatcctgcttcgccgatcgccggcgggaaaggccaaagccccgcgcgcctcgcgcgaacccgacgcggccacggcaccaccggccgccgccgcggccaaggggaaaggctcctcgccgtcaccgcggccgcgatcctatcgcgccaccgccgtcgtcgcgatggccgcgtccgtcctcgcgctcgccgtggcgctcctcctcggggccagctcccgggtcgaccacggcgcggccgccgcccccgtatcggaagaggggctccaggtcacctacgggagcacggtgaagctgatgcacgagaagaccaaggtgaggcttcactcgcacgacgtggcctacggctccggcagcggccagcagtccgtcaccggcttccccgagatcgacgactccaatagctactggatcgtgagacctactcttgattcatcagccaaacaaggtgatgctgttgaaactggtagcatcatcaggttgcaacacatgaggacacggagatggttacatagccacttgcatgcttcaccattatctggtaacctagaggttagctgttttggtggggatggacaatcagataccggtgactattggaggctagaaattgagggaaaggacaaggtatggaagcgagatcagaaggtaagattgcgtcatgttgatacgggaggctatctgcacagtcacaacaagaagtataacaggcttggtggtgggcagcaagaggtctgtggtgttcgagacaagcgagctgagaatatttggtcgacagcggagggcgtttatctcccagtcgatgaaagcaagtgaacatagcatcaggaattttactgacattttccatttttctatctgttcatgcttttaaattaaacaagggacatggtacccagaactagaatgattgttagtgcagtatttttctatttggaaactccgattacaacttagacgtacaccacacacgcgctcacatggtgcatggtacggctctgtcagcatcatcaccctgaactaaattgggccttggaatgcttgaaccccttggacagtaagactttgtgtgactatctacaactctactttattctgggataa

SEQ ID NO: 2143 - DNA, 1135 bp, Triticum aestivum
gcacgcccaggcacgagagaccaccctgcttcgccgatcgccggtgggaaaggccaaagccccgcgcgcctcgcgcgaaccagacgcggccacggcaccaccggccgccgccgcggccaaggggaaaggctcctcgccgtcaccgccgcggaggccctatcgcgccaccgccgtcgtcgcgatggccgcgtccgtcctcgcgctcgccgtggcgctcctcctcggcgccagctcccgggtcgaccacggcgcggccgccgcccccgtgtcggaagaggggctccaggtgacctacgggagcacggtgaagctgatgcacgagaagaccaaggtgaggcttcactcgcacgacgtggcctacggctctggcagcggccagcagtccgtcaccggtttccccgaaatcgacgactccaatagctactggatcgtgagacctactcttgattcatcagccaaacaaggtgatgctgttgaaactggtagcatcatcaggttgcaacatatgaggacacggagatggttacatagccacttgcatgcttcaccattatctggtaacctagaggttagctgttttggtggggatggacaatcagataccggtgactattggaggctagaaattgagggaaaggacaaggtatggaagcgagatcagaaggtaagattgcgtcatgttgatacgggaggctatctgcacagtcacaacaagaagtataacaggcttggtggtgggcagcaagaggtctgtggtgttcgagacaagcgagctgagaatatttggtcgacagcggagggcgtttatctcccagtcgatgaaagcaagtgaacatagcatcaggaattttactgacattttccatttttctatctgttcatgcttttaaattaaacaagggacatggtacccagaactagaatgattgttagtgcagtatatttctatttggaaacggcgattacaacttagacgcacacccccaccacacacgcggcatagtatgactctgtcagcatcatcaccctgaactaaattgggccttggaatgcttgaacccctgggacagtaaagactttgtgtgactatctacaactctactttattctgggataaattgaagaggttgtacaa

SEQ ID NO: 2144 - DNA, 1185 bp, Hordeum vulgare
cccggagctcgcgagatctcgacggccgcaaccacacacaccagcacgcccagacacgagagaccagacccaccccgcttcaccgatcgccggcgggaaagccaaagccccgcgcggctcgcgcgaaccagacgcggccacggcaccaccggccgccgccgcggccaaggggaaaggctcctcgacgtcaccgccgtcgccgccgccgaggtcctatcgcgccaccgccgccgtcgcgatggccgcgtccgtcctcgcgctcgccgtggcgctgctcctcggcgccagctcccgggtcgaccacggtgcggccgccgcccccgtatcggaagaggggctccaggtgacctacgggagcacggtgaagctgatgcacgagaagaccaaggtgaggcttcactcccacgacgtggcctacggctccggcagcggccagcagtccgtcaccggcttccccgagatcgacgactccaatagctactggattgtgagacctactcttgattcatcagccaaacaaggtgaggctattgaaactggtagcatcatcaggttgcaacacatgaggacacggagatggttacatagccacttgcatgcttcaccgttatctggtaacctagaggtgagctgttttggtggtgatggacaatcagataccggtgactattggaggctagaaattgagggaaaggacaaggtatggaagcgagatcagaaggtaagattgcgtcatgttgacacgggaggctatctgcacagccataacaagaagtataacaggcttggtggtgggcagcaagaggtctgtggtgttcgagacaagcgagctgagaatatttggtcgacagcggagggcgtttatctcccagtcgatgaaagaaagtgaacatagcatcaggaattttgttgacattttccatttttttatctgttcgtgcttttaaattaaacaagggatatagtacccagaactagaatgattgttagcgcagtatttttctatttggaaacgacgattacaacttagtcgtacaccatccatcaccacacacgcggctaacatggtgagtgcgactctgtcagcatcatcaccctgaactaacttgggccttggatgcttgaacccctgggacagtaaagactttgtgtgagtatctacaactctactttattcgggggtaa

SEQ ID NO: 2145 - DNA, 1091 bp, Avena sativa
gcaagcgttccccgagctcgtgaaatcccaacggctgcgagcaaacacgagtacgcccgcgcgagactcgccgatcaaggccagaaggctccgcgcgcctcgcgctcaccagacgcggccacggcaccaccaggcgccgccgccgccaaggggaaagcctcctcgccttcatcgtcaccgccaccgccgcctccgaggtcccatcgcaccacggccgtcgtcgcgatggctgcgtccgtcctcgcgctcgccgtggtgcttctaatcggcgccagctcccaggtcgacaacggcgcgtccgccgcccctgtaactgaagaggggcttgaggtgacgtacgggagcacggtgaagctgatgcacgacaagacgaaggtgaggcttcactcgcacgacgtggcctacggctccggcagcggccagcagtccgtaaccggctttccccaaaccgacgactccaatagctactggattgtgagacctactcttgattcatcagctaaacaaggtgatgccattgaaactggtagcatcatcaggttgcaacacatgaggacctggagatggctacatagccacttgcatgcttcaccattatctggtaacctagaggttagctgttttggtggggatgaacaatcagataccggcgactattggaggctagaaattgagggaaaggataagatatggaagcgggatcagaaagtaagactgcgacatgttgacactggaggctatctgcacagtcacaacaagaaatacaacaggcttggtggtgggcagcaagaggtctgtggtgtccgagacaagcgggctgagaatatttggtccacagcagaaggcgtttatctcccagtcagcgggagcaagtaaattaagcatgcattttgtgtgtttccctgttcactggcaagttaacattagcatcagaattttcgctgacattttttatatgttatgttttcaatccaaacaaaggaccttacaccagtgataagttgaatatagaagacgatgcacacaaacagagaaatttacagatgacgcattggcatgctgtactgtgtgatatgtttgattcccaagga

SEQ ID NO: 2146 - DNA, 1168 bp, Secale cereale
caagcacacacagcgcacggccaggcacgagagaccacccagcttcgccgatcgccggcgggaaagcccaaagccccgcgcgcctcgcgcgaaccagacgcggccacggcaccaccggccgccgccgcggccaaggggaaaggctcctcgccgtcgccaccgccgccgcggccctatcgcgccaccgccgtcgtcgcgatggccgcgtccgtcctcgcgctcgccgtggcgctcctcctcggcgccagctcccgggtcgaccacggcgcggccgctgcccccgtatcggaagaggggctccaggtgacctacgggagcacggtgaagctgatgcacgagaagaccaaggtgaggcttcactcgcacgacgtggcctacggctccggcagcggccagcagtctgtcaccggcttccccgagatcgacgactccaatagctactgggttgtgagacctactcttgattcatcagccaaacaaggcgatgctattgaaactggtagcatcatcaggttgcaacatatgaggacacgaagatggttacatagccacttgcatgcttcaccattatctggtaacctagaggttagctgttttggtggggatggacaatcagataccggtgactattggaggctagaaattgagggaaaggacaaggtatggaagcgagatcagaaggttagattgcgtcatgttgatacaggaggctatctgcacagtcacaacaagaagtataacaggcttggtggtgggcagcaagaggtctgtggtgttcgagacaagcgagctgagaatatttggtcgacagcggagggcatttatctcccagtcgatgaaagcaagtgaacatagcatcaggaattttgctgacattttccattttttatctgttcatgcttttaaattaaacaagggacatggtacccagaactagaatgattgttagtgcagtatttttctatttgggaacggcgattacaacttagacgtacaacacccaccaccacatacgccgctcacatggtgcatagtacagtacgactctgtcagcatcatcaccctgaactaaattgggccttggaatgcttgaaccactgggacagtaacgactttgtgtgactatgtacgtacaactctaccttgttcaaggataaatttaagaggt

SEQ ID NO: 2147 - DNA, 1273 bp, Secale cereale
aagcaacgacctcggcaagcaaaacgacccggagcccgcgagatctcgacggccgcaagcacacacagcgcacgcccaggcacgagagaccaccctgcttcgccgttcgccggcgggaaagcccaaagccccgcgcgcctcgcgcgaatcagacgcggccacggcaccgccggccgccgccgcggccaaggggaaaggctcctcgccgtcgccaccgtcgccgaggccctatcgcgccaccgccgtcgtagcgatggccgcgtccgtcctcgcgctcgccgtggcgctcctcctcggcgccagctcccgggtcgaccacggcgcggccgccgcccccgtatcggaagaggggctccaggtgacctacgggagcacggtgaagctgatgcacgagaagaccaaggtgaggcttcactcgcacgacgtggcctacggctccggcagcggccagcagtctgtcaccggcttccccgagatcgacgactccaatagctactgggtcgtgagacctactcttgattcatcggccaagcaaggcgatgctattgaaactggtagcatcatcaggttgcaacatatgaggacacgaagatggttacatagccacttgcatgcttcaccattatctggtaacctagaggttagctgttttggtggggatggacaatcagataccggtgactattggaggctagaaattgagggaaaggacaaggtatggaagcgagatcagaaggtaagattgcgtcatgttgatacgggaggctatctgcacagtcacaacaagaagtataacaggcttggtggtgggcagcaagaggtctgtggtgttcgagacaagcgagctgagaatatttggtcgacagcggagggcatttatctcccagtcgatgaaagcaagtgaacatagcatcaggaattttgctgacattttccctttttaatctgttcatgcttttaaattaaacaaggggcatggtacccagaactagaatgattgttagtgcagtacttttctatttggaaacggcgattacaacttagacgtacaccacccaccaccacatacactgctcacatggtgcatagtacgagtctgtcagcatcatcaccctgaactaaattgggccttggaatgcttgaaccactgggacagtaacgactttgtgtgactatgtacgtacaactctaccttgttcaaggataaatttaagaggttgtacgacaatggtgcttctctagtgtcaataaactggttatgatgcaaaaagtc

SEQ ID NO: 2148 - DNA, 1216 bp, Secale cereale
caagcacacacagcgcacgcccaggcacgagagaccaccctgcttcaccgatcgccggcgggaaagcccaaagccccgcgcgcctcgcgcgaaccagacgcggccacggcaccgccggccgccgccgcggccaaggggaaaggctcctcgccgtcgccaccgtcgccgaggccctatcgcgccaccgccgtcgtcgcgatggccgcgtccgtcctcgcgctcgccgtggcgctcctcctcggcgccagctcccgggtcgaccacggcgcggccgccgcccccgtatcggaagaggggctccaggtgacctacgggagcacggtgaagctgatgcacgagaagaccaaggtgaggcttcactcgcacgacgtggcctacggctccggcagcggccagcagtctgtcaccggcttccccgagatcgacgactccaatagctactgggtcgtgaggcctactcttgattcatcggccaagcagggtgatgctattgaaactggtagcatcatcaggttgcaacatatgaggacacgaagatggttacatagccacttgcatgcttcaccattatctggtaacctagaggttagctgttttggtggggatggacaatcagataccggtgactattggaggctagaaattgagggaaaggacaaggtatggaagcgagatcagaaggtaagattgcgtcatgttgatacgggaggctatctgcacagtcacaacaagaagtataacaggcttggtggtgggcagcaagaggtctgtggtgttcgagacaagcgagctgagaatatttggtcgacagcggagggcatttatctcccagtcgatgaaagcaagtgaacatagcatcaggagtttgctgacattttccatttttcatctgttcatgcttttaaaattaaacaagggacatggtacccagaactagaatgattgttagtgcagtatttttctatttggaaacgccaattacaacttagacgtacaccaccaccacacacgccgcatagtacgactctgccagcatcatcaccctgaactaaattgggccttggaatgcttgaaccactgggacagtaacgactttgtgtgactatctacaactctactttatttaaggataaattaagaggttgtacaacgatgctgcttctctagtgtcaacaaactggttacgatgcaaagagaggagagtgacaccaactga

SEQ ID NO: 2149 - DNA, 913 bp, Brachypodium distachyon
gtcgcacggccgtcgtcgcgatggccgcgtccgtcctcgcgctcgccgtcgcgatcctcctcggcgccagctcccgggtcgacatgggcgacgccgcctcgcccgtagcggaagaggggctcgaggtcacttacgggagcacggtgaagctgatgcacgagaagacgaaggtgaggctgcactcgcatgacgtggcctacggctccggcagcggccagcagtccgtcactggctttccagaaatcgacgactccaatagctactggattgtgaaaccttctctagattcatcggctaaacaaggtgatgccattgaaactggtaccatcgtcagattgcaacacatgaggacacggagatggttacatagtcacttgcatgcttcacccttatctggtaacctagaggtcagctgttttggtggggatggacaatcagatactggcgattattggaggctagaaattgagggaagtggtaaggtatggaagcgggatcaaaaagtacgactccgacatgtggatacaggaggctatctgcatagtcacaacaagaagtacaacaggcttggtggtgggcagcaagaggtctgtggtgttcgagacaagcgagctgagaatatatggtcaacagcggagggcgtttatcttccagttaatgttagcaagtgaaatggggcattgtagtttttcatgtttccctgcgagttaccatagcatcagaaattttgctgacattttcatctgtccatccttataatataaacaaggggcctgacacccggagtgatatgttaaatatagacgattcacacaaaatgtgcatgccgtcctatgtagtgatatgttatatgatattgactctcttcattgcactgaattattcaaccatttttttggaaactgaatatgta

SEQ ID NO: 2150 - DNA, 1185 bp, Brachypodium distachyon
ctcggaaagcaacgtcccccgagctcgacaaatcccaacggccgcaaagcacccgcccgcctccctccttccttccttcgccaatcgctaccctctcgcgcgccacgcgctcacctgacgcggccacggcaccaccgggcgccaccgctgccgccaaggggaaaggctcctcctcgccgtccacaccgccgccgccgccgccgacgcggaggtcccgtcgcacggccgtcgtcgcgatggccgcgtccgtcctcgcgctcgccgtcgcgatcctcctcggcgccagctcccgggtcgacatgggcgacgccgcctcgcccgtagcggaagaggggctcgaggtcacttacgggagcacggtgaagctgatgcacgagaagacgaaggtgaggctgcactcgcatgacgtggcctacggctccggcagcggccagcagtccgtcactggctttccagaaatcgacgactccaatagctactggattgtgaaaccttctctagattcatcggctaaacaaggtgatgccattgaaactggtaccatcgtcagattgcaacacatgaggacacggagatggttacatagtcacttgcatgcttcacccttatctggtaacctagaggtcagctgttttggtggggatggacaatcagatactggcgattattggaggctagaaattgagggaagtggtaaggtatggaagcgggatcaaaaagtacgactccgacatgtggatacaggaggctatctgcatagtcacaacaagaagtacaacaggcttggtggtgggcagcaagaggtctgtggtgttcgagacaagcgagctgagaatatatggtcaacagcggagggcgtttatcttccagttaatgttagcaagtgaaatggggcattgtagtttttcatgtttccctgcgagttaccatagcatcagaaattttgctgacattttcatctgtccatccttataatataaacaaggggcctgacacccggagtgatatgttaaatatagacgattcacacaaaatgtgcatgccgtcctatgtagtgatatgttatatgatattgactctcttcattgcactgaattattcaaccatttttttggaaactgaatatgtacactatgttggtttactctctcttgtgcaaattttggatttttagttggatgttcc

SEQ ID NO: 2151 - DNA, 1134 bp, Avena sativa
gcaagcgttccccgagctcgtgaaatcccaacggctgcgagcaaacacgagtacgcccgcgcgagactcgccgatcaaggccagaaggctccgcgcgcctcgcgctcaccagacgcggccacggcaccaccaggcgccgccgccgccaaggggaaagcctcctcgccttcatcgtcaccgccaccgccgcctccgaggtcccatcgcaccacggccgtcgtcgcgatggctgcgtccgtcctcgcgctcgccgtggtgcttctaatcggcgccagctcccaggtcgacaacggcgcgtccgccgcccctgtaactgaagaggggcttgaggtgacgtacgggagcacggtgaagctgatgcacgacaagacgaaggtgaggcttcactcgcacgacgtggcctacggctccggcagcggccagcagtccgtaaccggctttccccaaaccgacgactccaatagctactggattgtgagacctactcttgattcatcagctaaacaaggtgatgccattgaaactggtagcatcatcaggttgcaacacatgaggacctggagatggctacatagccacttgcatgcttcaccattatctggtaacctagaggttagctgttttggtggggatgaacaatcagataccggcgactattggaggctagaaattgagggaaaggataagatatggaagcgggatcagaaagtaagactgcgacatgttgacactggaggctatctgcacagtcacaacaagaaatacaacaggcttggtggtgggcagcaagaggtctgtggtgtccgagacaagcgggctgagaatatttggtccacagcagaaggcgtttatctcccagtcagcgggagcaagtaaattaagcatgcattttgtgtgtttccctgttcactggcaagttaacattagcatcagaattttcgctgacattttttatatgttatgttttcaatccaaacaaaggaccttacaccagtgataagttgaatatagaagacgatgcacacaaacagagaaatttacagatgacgcattggcatgctgtactgtgtgatatgtttgattcccaaggaactgtctattagtgcaattattatgttacagtacattgtttta

SEQ ID NO: 2152 - DNA, 1701 bp, Hordeum vulgare
ccacaagcaaaaccacagccaaaagacgatcgaggttacacaaccaaggcgctgcacacagtttgtccgagagggacagagtgagatgatgaaggtggaggtggtggagtcggcgctggtggcgccgagcgaggagacgccgcggcgggagctgtggctctccaacctcgacctggccgtgcccaagacgcacacgccgctcgtctactactacccggccccggccccggccacggcggcgccggacgcggaccctgccggcttcttctcgccggagcggctcagggcggcgctggccagggcgctggtgctcttctacccgctggccggccggctcggacgagagggcgagggcgggcggctgcagatcgactgcagcggcgagggcgcgctctttgtcgtggccagggcgccggacgtcgccggggacgagctcttcgggagcggctacgagccctcgccggagatcaggcgcatgttcgtgcccttcgcgccctccggcgacccgccctgcctcatggccatgttccaggtgacgttcctcaagtgcggcggcgtggtgctgggcacgggcatccaccacgtgaccatggacggcatgggcgcgttccacttcatccagacatggacggggctcgcgcggggcctggccctctccgaggcgtgcccgtcgccgccgttccacgaccgcacgctcctccgcgcgcggtcaccgccgcgccccgaattcgaccacccggtgtactcgccggagtacctcaacggcgccccgcggcccttcgtcacccgcgtctactccgtgtccccgaagctcctcgccgacctcaagtcccggtgcgcgcccggcgcgtccacctacggcgccgtgacggcgcacctctggcgctgcatgtgcgtggcgcgcgggctcgcggcgggctccgacacgcgcctccgcgtgccggccaacatccggcaccggctgcggccgccgctcccgcggcagttcttcggcaacgccatcgtgcgcgacctggtgaccgtcaaggtgggcgacgtgctggcgcagccgctggggtacgtggccgacacgatccggaaggcggtggagcacgtcgacgacgcctacacccggtcggtgatggactacctggaggtggagtcggagaagggcagccaggcggcgcgcgggcagctcatgccggagtcggacctgtgggtggtgagctggctggggatgcccatgtacgacgccgacttcggatggggcgcgccgcggttcgtggcgccggcgcagatgttcggcagcggcacggcgtacgtgacgcagcgcggcgccgacagggacgacggcatcgccgtgctgttcgcgctggagccccagtacctgcactgcttccaggacgtcttctacggggagtgaccacatcgccttccctccttcctcgtgtgtccgtcggtgtgtatgactctgtcgattttatagcgtttgctcttcactaccactcttgctgatacttggcacgagatgttcagtttgttgtagtatagtataccaagaactggtttcaaaatttggcattacagtgcatctgccgttcgtcgacgttggaagcgctgacacgacattgtatttccgttcgcttgtactccctccgtccggaattatatgtcgcgtaaataggtaaaagttaatgtatctgaaactaaaatacatcttta

SEQ ID NO: 2153 - DNA, 1543 bp, Secale cereale
agattacacaagcatacgctgcacacaatttcaatttgtttgagagggacagacagctagagcctagaggagaaggagatgatgaaggtggaggtggtggagtcgacgctggtggcgccgagcgaggagacgccgcggcgggcgctgtggctctccaacctcgacctcgccgtgcccaagacgcacacgccgctcgtctactactacccggccccggcgccggactcggactcggccgacttcttctcgccggaccggctcagggcggcgctggccaaggcgctggtgctcttctacccactggccgggcggctcggccgggacgagggcggccggctacagatcgactgcaacggcgagggcgccctcttcgtcgtcgccagggcgccggacatcgccggggaggacctcttcgggagcggctacgagccctcgccggagatcaggcgcatgttcgtgcccttcgcgccctccggcgatccgccctgccacatgtccatgttccaggtgacgttcctcaagtgcggcggcgtggtgctgggaacgggcatccaccacgtgaccatggacggcatgggcgcgttccacttcatccagacatggacggggctcgcgcggggcctcgccctctcggacgcgtgcccgtcgccgccgttccacgaccgaacgctcctccgcgcgcggtcacctccgcaccccgaattcgaccaccccgtgtactcgccggcgtacctcaacggcgcaccgcggcccttcgtcacccgcgtctactccgtgtccccgaagctcctcgccgacctcaagtcccggtgcgcgccaggcgcgtccacctacggtgccgtgacggcgcacctctggcggtgcatgtgcgtggcgcgcgggctcgccccgggctccgacacgcgcctccgcgtgccggccaacatccggcaccgtctgtgcccgcagctgccgcgccagttcttcggcaacgccatcgtgcgtgacctcgtcaccgtcaaggtgggcgacgtcctgtcccagccgctggggtatgtggccgacacgatccggaaggcggtggaccacgtcgacgatgcgtacacccggtcggtgatcgactacctggaggtggagtccgagaagggcagccaggcggcgcgcgggcagctcatgccggagtcggacctgtgggtggtcagctggctcgggatgcccatgtacgacgccgacttcgggtggggcgcgccgcggttcgtggcgccggcgcagatgttcggcagcggcacggcctacgtgacgcagcgcggcgccgacagggacgacggcatcgccgtgctgttcgcgctcgagccccagtacctgcagtgcttccaggacgtcttctacggggagtgaccacatcggcctccgtactcgtgtttatgtcggcgtgtacgagtgtatcgactatctggggtttgttgttcagttttggatttggtagaatgcatgtgtacgttgtacctgtcaattcacatatgtcggccttgctaccgttgattagggaaaataaaccataaaa

SEQ ID NO: 2154 - DNA, 1017 bp, Saccharum officinarum
ggggctccagcccccctaatttcttgatttcaatactaattactgtagcaaaaacttgatttcaccgttaaatcttcgtgcaaatcaacatctctgttgttttagcccccttatcccacatcctacatccgccactgcccgcaagagctgataacccaagcaagcaagcagtaacattagccagctgttaaccacacccaaccaaagcgaacggtagagcgaggatggcgccgtccaagccttcctcatcggcggcggccctgctcctcctggcggtggccatgctggcggcggcgtcggtgacgccagcactggcggacgtgacgcacgccaactgcgccaagaacaagaaggtgacggtgcagaacctgtgcacccacgacgtgacgctgacgctggagccgctggccaacagcccgccgctgttcacgggcgcctacacgctccacccgcacagccacgccgagttcccggtgtgctggtggacggggcgcctgcacgcgggcgccgacgccgccacggtggagttccacgtcggcgtcgacggcgggtccttctacctggcgcccaacgcgcagccggggcagcgcgtgcccgtctccgtcacgccgcacgcggcgtcggcggcctcgccgctgcagggccggtgccccgccgtcgggtgcgccgtcgaggggaagtgctccgtgcaccaggtgccgagcggcgactgccggaacgtccaggagatgaagatcatctactgcaacccgcacgtgtgatgtgatcgatcggtcggtcgatggatggtacggtggtctgatgcacgggccatcatcgtgtcctaccatctccattgttatgcgacttgtgttgcgccgtcatgtcgtcgtcgtcgtcgtcgtgtccaataataaccgcactgtctcgttacattgttattactagcccgttgcgttcttagtagcctctcccttgtattaggagtagtcccgcgcgcgcaaattgttgcttagattgatgtgacccactgcactg

SEQ ID NO: 2155 - DNA, 990 bp, Saccharum officinarum
ttgttctgttaagtacggtccggattgccggatccaccacgcgtccggccagttgttaaccacccacccacccactctagctactctctcgcgtactagaccagtagggaagagcgaggatggcggcgtccaagccctcctcgtcggcggcggccctgctcctcctcctggcggtgaccgtgctcctcgcggcgtcgtcgacgacacccgtgctcgcggacgtgacgcacgccaactgcgccaagaacaagaaggtgacggtgcagaacctgtgcacccacgacgtgacgctgacgctggagccgctggccaacagcccgccgctgttcacgggcgcctacacgctccacccgcacagccacgccgagttcccggtgtgctggtggacggggcgcctgcacgcgggcgccgacgccgccacggtggagtttcacgtcggcgtcgacgggggttccttctacctggcgcccaacgcgcagccggggcagcgcgtgcccgtctccgtcacgccgcacgcggcgtcggcggcctcgccgctgcagggccggtgccccgccgtcgggtgcgccgtcgaggggaagtgctccgtgcaccaggtgccgagcggcgactgccggaacgtccaggagatgaagatcatctactgcaacccgcacgtgtgatgtgatattggtcggtcgatggatggtacggtggtctgatgcacgggccatcatcgtgtcctccatcgtctccattgttatgcgacttgtgttgcgccgtcatgtcgtcgtcgtcgtggtgtccaataataaccgcactgtctcgttacattgttattagtagccgtttgcttgcttttagcctctccgttgtattagaagtagtcgcgcgcgcgcagattgttgctcagatcgatgtgagccactgcactgtacgtacgcgtgagtagtgtcgatgtgtcgtctcgtctcatgtgtttgtaggcactgcctgggcagaggtgcgtgt

SEQ ID NO: 2156 - DNA, 1153 bp, Zea mays
tagcgtagcgtagcgtagcgatggctttagccatgccagcttgcctgtaaatatcagagtatgctcacaggcagcacgggctccatctactgggattctcgttttaaacccctgacccccatgcatctcgcacgggcacgggcacgggcacgggcaccggcacggcacgggccacggttataaataaccacacaccctcaagggctgaaccgaaccaagcagtaacattaatcacccactctactactcgaagttactaccagcagcttgcttcaacagtagaagagagcgagaggatggcgtcaccgaagccctcgtcggcggccctgctcctcctggcggcggcggccgtgctggcgctggcgcgcgcggacctgacgcacgacaactgcgtgaagaacaagaaggtgacggtgcagaacctgtgcagccacgacgtgacgctgacgctggagccgctggccaacagcccgccgctgttcgcgggcacctacacgctgcacccgcgcagccacgccgagttccccgtgtgctggtggacggggcgcctgcgcgcgcccgacgccgcccaggtggagttccacgtcggcgtcgacggcggctccttctacctggcccccaacgcgcagccgggccagcgcgtcccggtctccgtcaccccgcacggctcgccgctgcagggccgctgccccgccgtcggctgcgccatccagggccgctgctccgtgcaccaggtgcccagcggcgactgccgcaacgtccaggagatgaagatcatctactgcaacccgcacgtgtgatgcgatgcggacatggggtcgtcgcgccatctcgcgacctgtgttgtgctttctttcatgtcgccgtcgccgtcgtgtgtccaaccgccattgtcgttaggttgttgttgattagccgtttgcttcgctcagtagcctcgctctccagtgtattatcactcgcatcgcatgcatgtgatgtgagccactgcacgcgtgagtgtcacatgagtcgtcgtcctgtctcgtctcatgtgtttgaaattgtaggcagcagaggatcgagatgcgtgtctgctttgttcgtgttcactgctgtcagtctgtcaccgagttcaataatttagctttgtttcatcgggaaattgaatgga

SEQ ID NO: 2157 - DNA, 2699 bp, Zea mays
cggtgatggtggcgcggatgatgcggtggcctcggccgccgccggcgcggaatatccgcgtccgcctggtggtgcggcgggcggagggcctgcccccgcctcctgcgcccctctcgcctgacgggtcccccggccccgaggccgaggcgaaggcgtttgtggaggtgagctggaagggcccgaagatgtcgccgctctcctcgctgcggcgcgcgcagcggcctcccaggaaccagacgcggaaggaggcgctgccggccgtcgccgcggccgctctcgaggatggcgccgccgccgcccctgctctagcggtgtcggcggtggcctgggacgaggagttcgagagggatgcggcgctcacggcgacgtcgcaccgtgagcccgctgcgttccacccctgggacgtcaccttctccgttgtcagcgaatcaaataaaatatcaaagagcaaacttgttttggggaccgcttcactgaacctagcagattatgcatctgctgctgaagaggaaatcgagataatcctaccattgtctgtgcctagtagtgcaacagacctggtcccatcactccatcttactttaagcctggcggaagtaagaacatctcaacaatcacctggcgcttcacaacgttctgttattgccccattgtcaccttcctctggtgactctcttgcttctggaaaagatgaggtttctgtcattaaggtgggtctgagaaatctgaaaatgctaagagatctagtgtctacacggaggttcaaaaagactaaccaagactttgacggcagtgagaagtattatgtccacagcgatggtgcagaattttcttgtgatactgactctcttgacgatgatctggatgatagagagcatgacgatgagtttgggggttcagccgttaggaagtccttcagctacggctcactgcagactatgaatgttggtgccctactttatgcgcctaggattgatggagacgatgagggttgggtacattacagtcaccgcaactctgatgttggttatcatgttgagcaagtgccaccccccacagctgaggagcatgcttccatccctttgcggcggaagaggagcatacttccagctcggtggagaaaggtaaaattaccaaaggctaaaggggagcctctgttgaagccgtatggagaggagggtggtgatgatattgactacgatcggcggctgttgaccccttctgatggatctgtttcagaggtacatattttattgacatctcaaggatcaaatggttctaacagtatggtgtcggtatttggtgatgacgattttgttgtggggaactgggagtcgaaggaagtatttagccgagatggccacttgaagctttctacacaggtgttctttgcatcgatagaccagagaagcgaacgggctgcaggggagagtgcatgcacagcacttgtggctgttgttgcagactggttccaaacaaaccaggacctgatgccaatcaggtcacagtttgacaacctgatccgagaaggatctctggaatggaggagactctgtgagaacgagacctacagagagcgctttcctgataagcactttgatcttgaaactgtccttcatgcaaagatccgtccactcacagttgctcacagtaagtcattcattgggtttttccatcctcaaggcactgaggatgtaactggattcgacttcctcgacggtgcaatgtcattcgataacatctgggacgagataagccgagcagcggagtgctcctccggaaagcctgccctctacattgtcagttggaacgaccacttctttgtcctcaaggttgacgccaatgctatttacatcattgacacgctcggtgagaggctgtctgaaggctgcaaccaggcatacatcttgaagtttgatgacaccaccaccatccacaaaacacctgctgaaaagaaggaaccaagtcctgatcaccgtggacgccgcaaggattcctcagagacctgctcaaccgagcagggcagcggatcggacactgaagagtgcgagcctgtgttgaagggcaaggatgcatgcaaggagtacatcaagagcttcttggccgccatcccgatccgggagctgcaggctgacatcaagaaaggtctcatggcatcaacgcccctgcaccaccgcctccagatcgagttccactacacggaaccccgccccgccgagatcgcggcgccttctccactgcccccattcgaagcccccttcgagttctgctggcccgagccaccgtcaccgccagctgccactgaatccaccgtgacccatccacctgccatggaggccggcataacccaggctgtcgccgttgtatagccggtcctggctgctgctgcggcctagcctagggcaacggttgcttagtttaacatatagagggcggcgcttcttttagcgagcgaattgtgaggtcgagaccagatcgaagatttggctggcttcggccctggtctgctccttttgctgtctaattaagatgaactgactagtatagcttgactgtcttttggtctcagctttcatcatcttgtaaagaaagaaaggatgattgctcctgcacatctttacctgtgaagcgagttcgctggaattgtaatcctttgctacattatctttatgtgaatcatgacctcgtcttttttggta

SEQ ID NO: 2158 - DNA, 2713 bp, Setaria italica
cggtgatggtggcgaggatgatgcggtggccgcggccgccgccggcgcgggatttccgcgtccggctggtggtgcggcgggcggaggggctgccgccgccgccggcgcccctctcgcccgaggggtcacccgaggcggaggcgaaggtgtttgtggaggtgtgctggaagggcccgaagatgtcgccgctgagctcgctgcggcgcgcccagcggccgcccaggaaccagacgcggaaggaggcgctgccggctgccgggaccgcggccaccccggccgacgtcgaggatggcgccaccgcccctgcgcctaggatggtggcggtggcctgggaggaggagttcgagagggacgcggcgctcacggcgatgtcgcaccgtgaggccaccgcgttccaaccctgggacatctccttctccgtcgtcagcgaatcgaataaaatgtcaaagaacaaacttgttctaggaactgcttcactgaaccttgcagattacgcatctgctgctgaagaggaaattgagataatcctaccattgtcggcgactagtggttcaactgacttgtccccatcacttcatctgactttaagcctggcagaacttaaagtttctccacaatcacctggtgcttcacagcgttctgttgttgttgccccattgtcaccttcctctggtgactctgttccttctggaaaagatgagggttctgtcattaaagtgggcctgagaaatctgaaaatcctaagagatctagtgtcgacacggaggttcaaaaagactaactgtgatggcaccgaggagaagtactatgttcatagtgatggtgcggagttttcttgtgatactgactccctcgatgatgatctggatgacagagagcaggatgatgacttggagggttcaaccgtcaggaaatccttcagctatggctcacttcagactatgaatgttggtgccctgctttatgcacctaggattgatggagatgatgagggttggatacattacagtcaccgaaattctgatgctagttatcatgttgagcaagtgccatcctccactgctgaggagcatgcttccatccctgtacggcgaaagaggagcatacttccagttcgatggagaaagacaaaattgccaaaggccaaaggggagcctctgttgaagccatacggagaagagggtggtgatgatattgactatgatcgtcggctgttgaccccttctgatggatctgtttcagagggatcaaatggctctactaatagtatggtgtcagtatttggtgatgacgattttgttgtggggaactgggagttgaaggaagtatttagtcgtgatggccacttgaagctttctacccaggtcttctttgcatcaattgaccagagaagtgaacgagctgcgggggagagtgcctgcacagcacttgtggctgttattgcagactggttccaagcgaaccaggacctgatgccaatcagatcacagttcgacaacctcatccgagaaggatctctagaatggaggaaactctgcgagaatgagacctacagagagcgctttccagacaagcactttgaccttgaaacagtcctgcatgcaaagatccgcccactcacagttgctcccagcaagtcgttcattgggttcttccatcctgaaggtactgaggatgtaagtggattcgatttccttgatggtgctatgtcatttgataacatctgggatgagataagccgagcagcggagtgctccactggaaaatctaccctatacattgtcagttggaatgaccacttttttgtcctaaaggttgacgccgatgcttattacatcattgatacacttggtgagaggctgtctgaaggttgcaaccaagcatacatcttgaagtttgatgacaacactatgattcataaagtaccggctgaaaagaaggaagctaatcctgattccagtggacgcctcaaggattcctcagagagctcctcctcaactgagcaggacagtggaactgacacagaagagtgtgagctcgtgttgaagggcaaggatgcctgcaaggagtacatcaaaagcttcttggctgccatcccgatacgtgagctgcaggctgacatcaagaagggtctcatggcatcaactccactgcaccaccgcctccagatcgagttccattacacagaatcatgccctgccgaaatcaccatgcctgctcaattccccacttttgagttctgttggcctgagccaccatcaccaacacctgccatggaggccgtggtaacccatccaccacccatggaggttgcagtaacccgtgctgttgccgttgtatagcaggccacagctgctgctgagacctagggcaccagctgcttagtttaacatatagagccgcgcttttcagagcaaattgtgaagtggaccagatcgaagatttggcttcgtttctagtttgctccgtttgctttctaattaagatgaactgactagtatagcttaattgtcttttggcatgcgtgtgtgtgtgtttgttcacttcttccaggcttttgggagctcccatcattttgtaaagagagagagggtgtttgctcctgcacatctttacctgtgaagtgagtttgctggacttgtaatcctacaatattatcattatgttaattatctccctgttctgctctaaacatttgtattctggtcttgtt

SEQ ID NO: 2159 - DNA, 559 bp, Saccharum officinarum
agcctcgcaacacccagccaccaaaccaagcaaagcaacccaccgaagcgtcgcggagaagcagaccgatccatcggaatggcgatggcaccgtgcgcacccgtctccgtctccttccccgcccgccccgcggcggggtccccttcctccgcccggccgcggcgcgccgccggggcagtccgcgccgccgctgagggcggcaggtggtgggcgccgctgctggggtggtcggggaaggctgactacatcgaggccccggcgctccaggcagtggtggtgccgcaggacgacgacgcgggcgcggcggcgcgcaggcagttcgtggggggcttgacggaggagaaggcccgccagctgcgggcgcggatggcgcaaacggagtcgttccacgacgccatgtaccactccgccatcgcctcccgcctcgcccgctccgcctaggcaggaaggccgcccgccgccgccggccccgacatcgccgtagatctagagctccacccgcgcgctcgcgcgcccgtgtgtgtatatactggtttcgcccttcttttcttttaaattc

SEQ ID NO: 2160 - DNA, 743 bp, Saccharum officinarum
acacatctatctaggtatcgcacaacaagcgagcgcaggagagctagctcaggcgcgcgagagatcgatggagaaggaggcggcggcgcaggctcaggcgcaggaggaggagcagtggcagggcgcggtggaggcaactctgccgtcgacgccagcgtccgcggcgtggccgcacatcgccagcttctgcgcgctgcaccggtacctcccgagcatcgacgtgtgcgagctcgcggagggggaggacggccggcccgggtgcgtccgctacgtgtcctcgctcgcgccgggcaccaccgccggggaggtcggcatctgggcgcgggagaagctgctggagatcgacgacgacgcccgacggctcgcgtacgccgtcgtcggcagcagcatggggttcggcagatacgtcgccaccatgagcatcgtcgccgctgaccaggagggggagaacgacgcggggtgcaggctggtctgggcgttcgagtgcgagcccgtgcaggggtggacccgggacgggctcctcggctacctcgacggcggcgtcaaggccatcgccgcgcggatcgaggaagcccatgccgctgacgccgccaatgccggaggagacaacgtggtcgtcgtcgctgcctgacaactccagctccgggccgggaggaatctcaacagccgccagatgcatttctgtattgattattacctcgtcaaattagttaatgcattgttaatctcaaatgattgccact

SEQ ID NO: 2161 - DNA, 2615 bp, Pennisetum glaucum
ccagcttgcagtagggtttggtggtgccccgtctcgcgcagcaggaagggaacggaagggaagggcatacctggtgggttcgccgccggcaaaggacccgacgaagacgtgccgaagggagaccggtgaggagggagtggggggcgagagaaacagagaggagaggagaggtgagcgcgcgacagaggaagaggagcgggaggtggagccgtggaggtgggtgtggagactgactggggaaggctcgagacggagacccggagagggagcgagggagagacgagcggggtgagggaggtgtgatgcgacctctccgaatttataatgttcttttgcccgtctctcgcagcctcctcgctcctaaaattctgttgcgataatagtagtgtatactctcgtatactacgtgtggtgagctgtacttggaattgttctataattcctaagatatgtcgctagcttctattccatgctattattcgcacgctttctctcatcaagattcttttctctgcttctgtctagacacacccaaaagcagcaatcccctttggggtggcgtgatctccactgttccataagtggagtcaccacgaaggctgttcggcacctcgcttgttatataccggcagggctaagcctcgaaggttcttgtaggccttactgccctgttctggttggcatagatgtcgtttcgcagcatcgtccgtgatgtccgcgatggttttggtagcctgtcaaggaggagctttgaggtgaccattgctggcctttctggcctcaccgggcatcacagggggaaatctcagagcaccgtgcatgagctccgggatacagatctcatgatccaggagagccgttgggctaatctccctcctgagctcctccaggatgtgatccggaggctggaggccagtgagagcacctggccaaatcgcaagaatgttgtatcttgcgctgccgtttgccgggcgtggagggagatgtgcagggagattgtgctgagcccggagttctgtgggaagcttaccttcccagtctctttaaaacagcctgggcatcgagatggaatgattcaatgtttcataaagcgagataaatcaaagtcgacatatcatctctacttgtgcctcagcactgctgtacttacggagaacggcaagttcctcttatcagctaaaaggaaccgcaaaacaacatgtacagagtatattatctcgatggatgccgacaacatctcgagatcgagcaacacatatattggaaagcttaggtccaacttcctaggcacaaaatttatgatctatgacacacagcccccttataatggggctgttgtccctcatgctggacgaaccagccggagattcaactccaagaaagtttcccctaaggtgccaactggtagctacaacatagctcaggtgacatacgagctaaatgttctcggcacgaggggccctaggcggatgcactgtgtcatgcactccatacctgcctccgcggttgagcctggcggcatagtccctggacagcctgagcagattctgcctcgtgcattagaggagtcctttcgcagcactacctccttctccaagtcatccatcatggaccggtccatggatttcagcagctcccacgacttcggcagtgtccgtgacttcagcagtgcccgcttttctgacattgctggaggcgccatggttgacggcgaggagggacaaaataaggagaggcctcttgtgcttcgcaacaaggcccccagatggcatgaacagctgcaatgttggtgcctcaacttccgtggccgagtaaccatagcgtccgtgaagaatttccagctgattgccgcatcaagccagcccccagcggcagctggggctccaaccgtgtcgcagcctgctccatcggaccaggacaaggtcatcctgcagtttggcaaggtggcgaaagatatgttcacaatggactaccgctacccgctctcagccttccaggctttcgccatctgcttgagtagcttcgacaccaaattagcctgtgagtagatagacacccaggatttgatcgatgcaagtggagctggaaatgcacaaaagaagaggtgcatctggccctaggattctagatttcgatgcttttgcattttgttgtgctattactctcatggttgtattgtgttctgcttcatgttgtagcctgggaccagacttagcatgcgtgatgcagctgccggcaccatgggttccaatgatgaattgttgtttcaagcttttgcgtggactctgcgacagcttgtaagcacgggaaaaagcgatagcaccgtatcttttctctctctcaaatctgttgtgcacagatgctggcatgattacacagatgtgagcatcacgcttttgcatccagttgtgccgggcttgtctcgctcgatggagccttcctacctcttgtgttttacgctttcaatatggttggtcagtcactcaccagctatcatgtaccatcatggcatgatccgcggatgcaccccctttgttcggcgcgtcgagtgcagtagtagtgcaccccttgataggagaatcattgcacatgtgtgtgcccctttatctcagcac

SEQ ID NO: 2162 - DNA, 2347 bp, Setaria italica
cctcgctcgctctccgggtctccgtctcgagccttcccagtctccagaccctccacacccacctccacctcccgttcctcttcctctgttgcgcgttcacctctcctctctatttctccagccccccgccccctcctcaccggttcacctcccttctctctctcggtctcccttcggcacgtcttcggcgggtcctttgccggcggcgaacccaccaggaacaaatcggcgactgcttctgtctagacacacccaaaggcagcgatcccctttggggtggcgtgatctccactgttccataagtggagtcaccaggaaggctgttgggcaccttccctgttatatatcggcagggctaagcctaaggttcttgtaggcctgactgccctgttctagttggcgtagatgtcgtttcgcagcatcgttcgtgatgttcgggacggttttggtagcctgtcaaggcggagctttgaggtgaccattgctggcctttctggactcaccgggcatcacagggggaaatctcagagcacggtgcatgagctccgtgatacagatctcataatccaggagagccgttgggctaatctccctcctgagctcctccgggatgtgatccggaggctggaggccagcgagagcacctggccaaatcgcaagaatgttgtttcctgcgctgctgtttgtcggacgtggagggagatgtgccgggagattgtgctgagtccggagttctgtgggaagcttaccttcccagtctctttaaagcagcctgggcatcgagatggaatgattcaatgttttataaagcgagataaatcaaagtctacatatcatctctacttgtgcctgagcactgctgtacttacggagaacggcaagttcctcttatcagctaaaaggaaccgcaagacaacatgcacggagtatgttatctcgatggatgccgacaacatctcaaggtcaagcagcacatatattggaaagctgaggtccaacttcctaggcacaaaatttatgatctatgacacacagcccccttataatggggctgttgtccctcacgctgggcgaaccagccggagattcaactccaagaaagtctcccctaaggtgccaactggtagctacaacatagctcaggtgacatacgagctaaatgttctcggtacgaggggccctaggcggatgcactgtgtcatgcactccatacctgcctccgcggttgagcctggcggcatagtccctggacagcctgagcagattctgcctcgagcattagaggagtcctttcgcagcactacctccttctccaagtcatccatcatggaccggtccatggatttcagtagctcccgcgacttcggcagtgtccgtgacttcagcagcgcccgcttttctgacattgccagaggcgccatggttggcgacgaagaggaacaaaataaggagaggcctcttgtgcttcgcaacaaggcccccagatggcatgaacagctgcaatgctggtgcctcaacttccgcggccgagtaaccatcgcgtcggtgaagaatttccagctgattgctacatcaagccagcccccagccactggggctccaaccgtgtcgcagcctgctccatcggaccaggacaaggtcatcctgcagtttggcaaggtggcgaaagatatgttcacggtggactaccgctacccgctttccgccttccaggcttttgcgatctgtttgagtagcttcgacaccaaattagcctgtgagtagatagacacccaggatttgatggaagtggagctggaaatgcacaaaagaagaggtgcatttggccctaggattctagcttttgatgcttttgcattttgttgtattctctcatggttgtattgtgttctgcttcatgttgtagcctggaaccagacttcttagtatgcgtgtttcagctgccggcaccatggttggtgccattcgtctgatgtgcatgagattccacccttaacgtgaaaggttcccttgatgaattattttcaagctttgcgtggattccgcgacaggttgaagcacaaaaaagaagataacaccttatttttcaaatctgttgtgcacagatgcttgcattattatacaatgtgagcatcacgcttgcatcccgttgtgacgggcttgtctcgctcgatggagccttcctacctcttttttaccctttcaatacggttggtcagtcaccagccatcatgtaccatcatggcatgattccgcggatgcaccctttgttcggcgcgtcgagtgcagtggttgtgcccctgataagagaatcattgcacatgtgtgtgcccctttatctcagcac

SEQ ID NO: 2163 - DNA, 1763 bp, Setaria italica
gtggagtcaccaggaaggctgttggacaccttccctgttatatatcggcagggctaagcctaaggttcttgtaggcctgactgccctgttctagttggcgtagatgtcgtttcgcagcatcgttcgtgatgttcgggacggttttggtagcctgtcaaggcggagctttgaggtgaccattgctggcctttctggactcaccgggcatcacagggggaaatctcagagcacggtgcatgagctccgtgatacagatctcataatccaggagagccgttgggctaatctccctcctgagctcctccaggatgtgatccggaggctggaggccagcgagagcacctggccaaatcgcaagaatgttgtttcctgcgctgctgtttgtcggacgtggagggagatgtgccgggagattgtgctgagcccagagttctgtgggaagcttaccttcccagtctctttaaagcagcctgggcatcgagatggaatgattcaatgttttataaagcgagataaatcaaagtctacatatcatctctacttgtgcctgagcactgctgtacttacggagaacggcaagttcctcttatcagctaaaaggaaccgcaagacaacatgcacggagtatgttatctcgatggatgctgacaacatctcaaggtcaagcagcacatatattggaaagctgaggtccaacttcctaggcacaaaatttatgatctatgacacacagcccccttataatggggctgttgtccctcacgctggacgaaccagccggagattcaattccaagaaagtctcccctaaggtgccaactggtagctacaacatagctcaggtgacatacgagctaaatgttctcggcacgaggggccctaggcggatgcactgtgtcatgcactccatacctgcctccgcggttgagcctggcggcatagtccctggacagcctgagcagattctgcctcgagcattagaggagtcctttcgcagcactacctccttctccaagtcatccatcatggaccggtccatggatttcagtagctcccgcgactttggcagtgtccgtgacttcagcagcgcccgcttttctgacattgccagaggcgccatggttggcgacgaagagggacaaaataaggagaggcctcttgtgcttcgcaacaaggcccccagatggcatgaacagctgcaatgctggtgcctcaacttccgcggccgagtaaccatcgcgtcggtgaagaatttccagctgattgctacatcaagccagcccccagccactggggctccaaccgtgtcgcagcctgctccatcggaccaggacaaggtcatcctgcagtttggcaaggtggcgaaagatatgttcacggtggactaccgctacccgctctccgccttccaggcttttgcaatctgtttgagtagcttcgacaccaaattagcctgtgagtagatagacacccaggatttgatggaagtggagctggaaatgcacaaaagaagaggtgcatttggccctaggattctagcttttgatgcttttgcattttgttgtattctctcatggttgtattgtgttctgcttcatgttgtagcctggaaccagacttcttagtatgcgtgttagctgccggcaccatggttggtgccattcgtctgatgtgcatgagattccacccttaacgtgaaaggttccttgctgaattattttcaagctttgcgtggattccgcgacaggttgaagcacaaaaaag

SEQ ID NO: 2164 - DNA, 2470 bp, Oryza sativa
ggagtttgctgtctgacacaatttctaactgagtttgttgtatttttttttttcaagtactatcgacatgtgagctacaaaatcatcctaaagattgaataacatagctagtggtaatgtgaaaaaaatgagataaaaggtggactggtgtctggtggagtactcgagtatcttccccgttccttcccttggcgtaagagaacgagaaatctcccatctctcagtcgtctcccccgcttccttgcgccaagacgagtcgcggctgagcaggagaggggcgccgatctccatccggcgagcagagcaggggaggggatcctggtatagattgttgattgcttgtgcgtgaacacaactaaagcagtaattcttaccgtgtcagcgtgatctgggactgtggccaattgtaccataagtggaaacacagctgcgaagattgtcggtggtcttcgctgataatatattgggcaggctaagtttcaagttcagtttgctgaattcagcgagcctagatgtcgtttcgcagcattgttcgtgatgttagggatagttttggtagcctgtcgaggcgaagctttgaggtcaccctggctggtctatcggggcttaccggccaccatagaggcaagtctcagagtacggttcacgagctctgtgatgcagatctcataatccaggagagtcgttgggctagcctccctcctgagctcctccgcgatgtgatccggaggctggaggctagtgagagcacctggccgtcacgcaaggatgtcgtgtcctgtgctgccgtctgtaaggcatggagggagatgtgtaaagagattgtgctgagcccggagttttgcgggaagcttaccttcccgctctctctaaagcagcctggccctcgagatggaatgattcaatgtttcataaagcgggataaatctaaatcaacttatcatctctacttgtgcctgagtactgctgtacttgcggatagtggcaagttcctcttgtccgctaaaaggcaccgcaaaacaacctgcacagaatatgttatctcaatggatgcagacaacatttcaagatcaagcagcacctatattggaaaactaaggtcaaacttccttggcacaaaatttataatctatgacacacagccctcttataatggggctgtaatccctcctgttggacggagcagccgaagattcaactccaagaaagtgtctcctaagatgccgtctggtagttataacatagctcaggtgacatatgagcttaatgttcttggcaccaggggccctaggcggatgcactgtgtcatgcactccatacctgcctcctcagtcgagcctggtggcattgtccctggccagcccgagcagattgttccccgagctttcgaggagtcatttcgcagcaccacctccttttctaagtcatccatcatggatcggtccatggatttcagtagttcccgtgatttcagcagtgctcgcttttcagacattgctggaggcaccataaatggtgatgaagaggggcaaaataaggagaggccactagtgcttcgcaacaaggcccctaggtggcatgagcagctccaatgctggtgccttaatttccgtgggcgtgtaaccattgcgtcggtaaagaatttccagttgattgctgcaccagcacagcctcccgcaggggctccaactccgtcacaacctgctccaccagagcaggacaagattattctacagtttggtaaggtagcaaaagatatgttcacaatggattaccgctatccgctctcagctttccaggcatttgcaatatgtttaagtagcttcgacacaaaactggcctgcgaatgagggaaacagtgagctctaatggaggcagaactggaaatgcaacagagagcaacttgagaaatgtaatgcccaagggctctagatcatgtttgcattttgttgtgtcgtcttggctgtatttctgcttgtagcctggaactggatttctcagcctgtatgtttcacctggtagcaccatgataggtttcctttgggacagcggttcatgcattgcatttttccatttgtgtggtgtacatgcggttccggatttaagctgaaaggatccgttcatgtctttgttaagctttgcatggatgccgtgttctggtaaagaaaagggaaagattcagtgcttcacttattttgtgcccgggtgggttcaaggctgttcttttacaactatttgtgctgttgtgcatgtgtgcttgcattattctataagatcagaatcatgcttgcatccggttgttctggacttgtctcacatgatggagccttcctagttctttttcagattactcttcctactactttgtactactactgctactaccattttaataaggtttgccacaaccacaatgtatcatcatggcatcatttacaaatgtccccttgcttgccgcgcgaaatacagt

SEQ ID NO: 2165 - DNA, 2188 bp, Oryza sativa
ggagtttgctgtctgacataattcctaactaagtttgttgtatttttttttttcaagtactatcgacatgtgagctacaaaatcatcctaaagattgaataacatagctagtggtaatgtgaaaaaaatgagataaaaggtggactggtgtctggtggagtactcgagtatcttccccgttccttcccttggcgtaagagaacgagaaatctcccatctctcagtcgtctcccccgcttccttgcgccaagacgagtcgcggctgagcaggagaggggcgccgatctccatccggcgagcagagcaggggaggggatcctggtatagattgttgattgcttgtgcgtgaacacaactaaagcagtaattcttaccgtgtcagcgtgatctgggactgtggccaattgtaccataagtggaaacacagctgcgaagattgtcggtggtcttcgctgataatatattgggcaggctaagtttcaagttcagtttgctgaattcagcgagcctagatgtcgtttcgcagcattgttcgtgatgttagggatagttttggtagcctgtcgaggcgaagctttgaggtcaccctggctggtctatcggggcttaccggccaccatagaggcaagtctcagagtacggttcacgagctctgtgatgcagatctcataatccaggagagtcgttgggctagcctccctcctgagctcctccgcgatgtgatccggaggctggaggctagtgagagcacctggccgtcacgcaaggatgtcgtgtcctgtgctgccgtctgtaaggcatggagggagatgtgtaaagagattgtgctgagcccggagttttgcgggaagcttaccttcccgctctctctaaagcagcctggccctcgagatggaatgattcaatgtttcataaagcgggataaatctaaatcaacttatcatctctacttgtgcctgagtactgctgtacttgcggatagtggcaagttcctcttgtccgctaaaaggcaccgcaaaacaacctgcacagaatatgttatctcaatggatgcagacaacatttcaagatcaagcagcacctatattggaaaactaaggtcaaacttccttggcacaaaatttataatctatgacacacagccctcttataatggggctgtaatccctcctgttggacggagcagccgaagattcaactccaagaaagtgtctcctaagatgccgtctggtagttataacatagctcaggtgacatatgagcttaatgttcttggcaccaggggccctaggcggatgcactgtgtcatgcactccatacctgcctcctcagtcgagcctggtggcattgtccctggccagcccgagcagattgttccccgagctttcgaggagtcatttcgcagcaccacctccttttctaagtcatccatcatggatcggtccatggatttcagtagttcccgtgatttcagcagtgctcgcttttcagacattgctggaggcaccataaatggtgatgaagaggggcaaaataaggagaggccactagtgcttcgcaacaaggcccctaggtggcatgagcagctccaatgctggtgccttaatttccgtgggcgtgtaaccattgcgtcggtaaagaatttccagttgattgctgcaccagcacagcctcccgcaggggctccaactccgtcacaacctgctccaccagagcaggacaagattattctacagtttggtaaggtagcaaaagatatgttcacaatggattaccgctatccgctctcagctttccaggcatttgcaatatgtttaagtagcttcgacacaaaactggcctgcgaatgagggaaacagtgagctctaatggaggcagaactggaaatgcaacagagagcaacttgagaaatgtaatgcccaagggctctagatcatgtttgcattttgttgtgtcgtcttggctgtatttctgcttgtagcctggaactggatttctcagcctgtatgtttcacctggtagcaccatgataggtttcctttgggacagcggttcatgcattgcatttttccatttgtgtggtgtacatgcggttccggatttaagctgaaaggatccgttcatgtctttgttaagctttgcatggatgccgtgttctggtaaagaaaagggaaagattcagtgcttc

SEQ ID NO: 2166 - DNA, 2109 bp, Brachypodium distachyon
agcctcatctcgtcatttccccgtctttctcttccgttggtctctcgtctccctcttcacacccgcctcgcctcctcagctcctcttctctctctctctctctctctcccgtcccaccctcttcgcgtggccaagaaaagggaaccagcagacacggaaggcgtgcggagtcggagaaggaagggagctctggatcgacccggcgtttcgattcgcctacccaggtgacggcgcagccgggaggaggcaggctccggatcgggaaggtcgtggcccggcgttcgcgctgatgtacagattgatgattgtttctacgtagacatacttcaaaccagtaatcctcgctctggcgacgtgatctttgataactgttccaataagtggaacatataggaagcttgtcggtggccttagccggtatatacaggcaatttggcagcaggctgagtgtcggagtctcctgcttcgcagctagctagcgcagatgtcgttccgcagcatagttcgtgatgttagggatggtttcggtagcttgtcgagacgaagctttgaggtgaccatctctggcctctctggtctcaccgggcatcacaggggaaagtcccaaagcacggtgcatgagctccgtgacgccgatctcatagtccaggagagccgttgggcttgccttcctcctgaactgctccgcgacgtgatccggaggctggaggccagcgagagcacctggccgtcgcggaagcatgtggtgtcctgtgcagcagtttgtagggcctggagggagatgtgcagggagattgtgattagcccagagttttgtggaaagcttaccttcccagtctctctaaagcagcctggtcctcgagatggaatgattcaatgctttataaagcgagataaatcgaagtctacttaccatctctacttgtgcctaagcactgcggtacttgtggagaatggtaaattcctcttatctgctaaaaggaaccgcaagacaacctgcacagagtatgttatctcaatggatgctgataacatctcaagatcaagcagcacctatattggaaagctgaggtcaaacttcctcggcacaaaatttatagtatatgacacacagccccctcatgatggggctgtagttcctcccgttggacggagtagccggagatttaactccaagaaagtctctccaaaggtgccatctggaagttacaacatagctcaggtcacttacgagttaaatgttcttggcactaggggccctaggaggatgaattgcatcatgcagtccatacctgcctcctctgttgagcctggtggcatagtcccggggcagcctgaacagattttgccccgagctttagaagagtcgtttcgaagcatcacctccttctccaagtcatccattatggaccggtccatggatttcagtagttcccgtgatttcagcagtacccacttttcggacatcgctggaggcacaataaacagtgatgaagaggaacaaaataaggagaggcccctagtgctccgcaacaaggtcccgaggtggcatgagcagttgcaatgctggtgcctcaacttccgtggccgggtaacaattgcctcggtgaagaatttccagttgatcgcggcgccactccagcccccagcaggggctccaactccttctcaacctgctccaccagagcaggacaaaatcattttacagttcgggaaggtgtcaaaagatatgttcacgatggactaccgctatccgctctcagcattccaggcttttgcaatctgcttgagtagcttcgacacgaagttggcctgtgaatagatcgacatggaaagtcgatggaagcataacctgaagtgaagggatgtgtgttcctttaggattctagatcatgggtgccttgtgtttccatcttgttgcttgtaatctctgctcgtttgtagcttggaattggtctgtgatctttcaccagctggaaccatgatctctaggctcctttgtggctataagttcatggatgtgcttcctcgtttaacttagagatttctttaactttaagcctatgttaatggttgttttaaagctttacatgggtacctctgtctggt

SEQ ID NO: 2167 - DNA, 2238 bp, Brachypodium distachyon
agcctcatctcgtcatttccccgtctttctcttccgttggtctctcgtctccctcttcacacccgcctcgcctcctcagctcctcttctctctctctctctctctctcccgtcccaccctcttcgcgtggccaagaaaagggaaccagcagacacggaaggcgtgcggagtcggagaaggaagggagctctggatcgacccggcgtttcgattcgcctacccaggtgacggcgcagccgggaggaggcaggctccggatcgggaaggtcgtggcccggcgttcgcgctgatgtacagattgatgattgtttctacgtagacatacttcaaaccagtaatcctcgctctggcgacgtgatctttgataactgttccaataagtggaacatataggaagcttgtcggtggccttagccggtatatacaggcaatttggcagcaggctgagtgtcggagtctcctgcttcgcagctagctagcgcagatgtcgttccgcagcatagttcgtgatgttagggatggtttcggtagcttgtcgagacgaagctttgaggtgaccatctctggcctctctggtctcaccgggcatcacaggggaaagtcccaaagcacggtgcatgagctccgtgacgccgatctcatagtccaggagagccgttgggcttgccttcctcctgaactgctccgcgacgtgatccggaggctggaggccagcgagagcacctggccgtcgcggaagcatgtggtgtcctgtgcagcagtttgtagggcctggagggagatgtgcagggagattgtgattagcccagagttttgtggaaagcttaccttcccagtctctctaaagcagcctggtcctcgagatggaatgattcaatgctttataaagcgagataaatcgaagtctacttaccatctctacttgtgcctaagcactgcggtacttgtggagaatggtaaattcctcttatctgctaaaaggaaccgcaagacaacctgcacagagtatgttatctcaatggatgctgataacatctcaagatcaagcagcacctatattggaaagctgaggtcaaacttcctcggcacaaaatttatagtatatgacacacagccccctcatgatggggctgtagttcctcccgttggacggagtagccggagatttaactccaagaaagtctctccaaaggtgccatctggaagttacaacatagctcaggtcacttacgagttaaatgttcttggcactaggggccctaggaggatgaattgcatcatgcagtccatacctgcctcctctgttgagcctggtggcatagtcccggggcagcctgaacagattttgccccgagctttagaagagtcgtttcgaagcatcacctccttctccaagtcatccattatggaccggtccatggatttcagtagttcccgtgatttcagcagtacccacttttcggacatcgctggaggcacaataaacagtgatgaagaggaacaaaataaggagaggcccctagtgctccgcaacaaggtcccgaggtggcatgagcagttgcaatgctggtgcctcaacttccgtggccgggtaacaattgcctcggtgaagaatttccagttgatcgcggcgccactccagcccccagcaggggctccaactccttctcaacctgctccaccagagcaggacaaaatcattttacagttcgggaaggtgtcaaaagatatgttcacgatggactaccgctatccgctctcagcattccaggcttttgcaatctgcttgagtagcttcgacacgaagttggcctgtgaatagatcgacatggaaagtcgatggaagcataacctgaagtgaagggatgtgtgttcctttaggattctagatcatgggtgccttgtgtttccatcttgttgcttgtaatctctgctcgtttgtagcttggaattggtctgtgatctttcaccagctggaaccatgatctctaggctcctttgtggctataagttcatggatgtgcttcctcgtttaacttagagatttctttaactttaagcctatgttaatggttgttttaaagctttacatgggtacctctgtctggtaaagaacagaaaaaggccgttccttctgttttacaactgttgggcatgtgtgcttgcttattctataagatgagaatcatactctcccatcatggggactttgtctcacacgatgaagccttctcctta

SEQ ID NO: 2168 - DNA, 2125 bp, Hordeum vulgare
gccctcctgctccctcgcctttcctcatcccccccccccccctccgctccgctccctccctccctccctcttcacaaccacctcccctcacctcccccctccatcttcgcgtgcccaagaaaggggccggaggcgtgagcgcggagctgcagcagccggatcggatcggccaccattcgccacccgaggcggcggcacggccgcaggaactccttcggatcggcacccgaggctcggctccagagtcaagcgctgagatgtacaagttgattattgcttccgtctagaaacactccagagcaatccctgccctgttaccgtgatctgtaatccctgttcctcaagtggaacggtttcggagcagtctagaaaggttatcggtgacaatttggcaggcttacgcttcttccagctttgcttgttcacctcgccaccgcccagcacaaaaagcaaaaaagaaaccagctttgcagatgtcgttccgcagcatagttcgcgatgtccgggatggtatcggaagcctctcgaggcggagcttcgaggtgaccatctccggcctgtccggtctcaccggccaccacaggggcaagcaccagagcacggtgcatgagctccgcgacgccgacctcatagtgcaggagagccgctgggctagcctcccgccggaactcctccgcgacgtcgtccggaggctggaggcaagcgagagcacctggccttcccgcaagcatgtggtgtcctgcgcggccgtatgcaaggcgtggagggagatgtgcagggagatcgtgacgagcccggagttttgcggaaagctcaccttccccgtatctctaaagcagccaggccctcgagatggaatgattcagtgtttcataaagcgagataaatcaaagtccacttaccatctctacctatgcctgagtaatgcggtacttgcggagaatggcaaattcctcttatctgctaaaaggaaccgcaagacaacctgcacagaatatgtgatctcaatggacgctgaaaacatctcaagatcaagcagcacctatattgggaaactgaggtcaaacttcctcggcacaaaattcgtagtgtacgacacgcagcccccctacaatggggctatagttccttcagttggacggagtagccggagattcaactccaagaaagtgtctcccaaggtgccatccggtagctacaacatagctcaggtgtcttacgagctaaatgttcttggcacgaggggccctaggcggatgaattgcatcatgcactccatacctgcctcctctgtcgagcccggcggcacagtccctgggcagcctgaccagatcatggcccgagccctagaggactcgtttcgcagcatgagctccttctccaagtcatccatcatggaccggtccaccgatttcagcagctcgcgttatttcagcagctcccggtttctttcggacattgccggaggtgcgataagccgcgatgaagacggggagaacaaggagaggccgctggtgctccgcaacaaggttccgaggtggcacgagcagctgcagtgctggtgcctcaacttccgcggccgcgtgaccatcgcctcggtgaagaacttccagctgatcgcggcgccgagccagccgccgccagccccggcaggtgccccgaccccgaccccgtcgcagcctgccccggcgccggagcaggacaagatcatcctgcagttcggcaaggtgtccaaggacatgttcaccatggactaccgctacccgctgtcggcgttccaggccttcgccatgtgcctgagcagcttcgacacgaagctggcctgcgagtaaatccggctgacggcggttgctcgtaggatgcatttgaggggaagggaagaaaaagtagacgcggacgcacgccttttgtttccgccttcattgttgctttgttcgtagtactagtagcttggaactggacttgatagcacgtaatgtctcgcacgccatgatcgcttcccttgaagctaagtttcgtggaagcggttcccggattttaacctaaggttcggctcccatgattgtcttcgagctttttctatggatgcctgctgtctggtaaagaggagaaagaggttcggtgc

SEQ ID NO: 2169 - DNA, 2167 bp, Hordeum vulgare
agcgcggagctgcagcagccggatcggatcggccaccattcgccacccgaggcggcggcacggccgcaggaactccttcggatcggcacccgaggctcggctccagagtcaagcgctgagatgtacaagttgattattgcttccgtctagaaacactccagagcaatccctgccctgttaccgtgatctgtaatccctgttcctcaagtggaacggtttcggagcagtctagaaaggttatcggtgacaatttggcaggcttacgcttcttccagctttgcttgttcacctcgccaccgcccagcacaaaaagcaaaaaagaaaccagctttgcagatgtcgttccgcagcatagttcgcgatgtccgggatggtatcggaagcctctcgaggcggagcttcgaggtgaccatctccggcctgtccggtctcaccggccaccacaggggcaagcaccagagcacggtgcatgagctccgcgacgccgacctcatagtgcaggagagccgctgggctagcctcccgccggaactcctccgcgacgtcgtccggaggctggaggcaagcgagagcacctggccttcccgcaagcatgtggtgtcctgcgcggccgtatgcaaggcgtggagggagatgtgcagggagatcgtgacgagcccggagttttgcggaaagctcaccttccccgtatctctaaagcagccaggccctcgagatggaatgattcagtgtttcataaagcgagataaatcaaagtccacttaccatctctacctatgcctgagtaatgcggtacttgcggagaatggcaaattcctcttatctgctaaaaggaaccgcaagacaacctgcacagaatatgtgatctcaatggacgctgaaaacatctcaagatcaagcagcacctatattgggaaactgaggtcaaacttcctcggcacaaaattcgtagtgtacgacacgcagcccccctacaatggggctatagttccttcagttggacggagtagccggagattcaactccaagaaagtgtctcccaaggtgccatccggtagctacaacatagctcaggtgtcttacgagctaaatgttcttggcacgaggggccctaggcggatgaattgcatcatgcactccatacctgcctcctctgtcgagcccggcggcacagtccctgggcagcctgaccagatcatggcccgagccctagaggactcgtttcgcagcatgagctccttctccaagtcatccatcatggaccggtccaccgatttcagcagctcgcgttatttcagcagctcccggtttctttcggacattgccggaggcgcgataagccgcgatgaagacggggagaacaaggagaggccgctggtgctccgcaacaaggttccgaggtggcacgagcagctgcagtgctggtgcctcaacttccgcggccgcgtgaccatcgcctcggtgaagaacttccagctgatcgcggcgccgagccagccgccgccagccccggcaggtgccccgaccccgaccccgtcgcagcctgccccggcgccggagcaggacaagatcatcctgcagttcggcaaggtgtccaaggacatgttcaccatggactaccgctacccgctgtcggcgttccaggccttcgccatgtgcctgagcagcttcgacacgaagctggcctgcgagtaaatccggctgacggcggttgctcgtaggatgcatttgaggggaagggaagaaaaagtagacgcggacgcacgccttttgtttccgccttcattgttgctttgttcgtagtactagtagcttggaactggacttgatagcacgtaatgtctcgcacgccatgatcgcttcccttgaagctaagtttcgtggaagcggttcccggattttaacctaaggttcggctcccatgattgtcttcgagctttttctatggatgcctgctgtctggtaaagaggagaaagaggttcggtgctcacgtattttatacagctgttggtgtgttgagcatgtgtgctttgccatattctgcacacttttctcgcatgattgaagtcttctcctcggtctttgcccttttggcatggctggagtaacatgcacagttgttttgtctaatgggagaatcattgcacatgcgccgtatgtacctgc

SEQ ID NO: 2170 - DNA, 1981 bp, Triticum aestivum
tcgcgtgcccaagaaaggaacctccaggcggggacggcgtgagcgcggcagctggggctggagccggatcgacctcgttcgtctccagaggcggcggcacgggcgcgggagctccggatcggcgctcaagacccccagagtccgcgctgatgtacacgttgatgattgcttctatctagacatactccggagcagcaatccttgctctggtgccgtgatctgtgacctctgctcaataagaggaacagtttagaaagcttcgagcttccagcctgcatctacctagcgcagatgtcgttccgcagcatagttcgtgatgtcagggacggtttcggcagcctgtcgaggcggagcttcgaggtgaccatctccggcctgtccggcctcaccgggcaccacaggggcaagtgccagagcacggtgcacgagctccgcgacgccgatctcatagtccaggagagccgctgggccagcctccctcccgagctcctcagcgacgtgatccggaggctggaggcaagcgagagcacctggccgtcgcgcaagcatgtggtgtcctgcgccgccgtttgcaaggcgtggagggacatgtgcagggagattgtgacgagcccggagttttgcggaaagctcaccttccccgtctctctgaagcagcctggccctcgagatggaatgattcaatgttttataaagcgagataaatcaaagtctacttatcatctctacttgtgcctgactaatgcggtacttgtggagaatggcaagttcctcttgtctgctaaaaggatccgcaggacaacctgcaccgaatatgttatctcaatggatgctgaaaacatctcaagatcaagcagcacctacattggaaaactgaggtcaaacttcctcggcacaaaattcatagtatatgacacgcagcccccctacaatggggctttagttcctccggttggacggagtagccggagattcaactctaagaaagtgtctcccaaggtgccatccggcagctacaacatagctcaggtgtcttacgagctaaatgttcttggcacgaggggccctaggcggatgaactgcatcatgcactccataccggcctcatcggtcgagcccggcggcatagtccctgggcagcctgaccagatcatgccccgagctctagaggactcgtttcgcagcatgagctccttctccaagtcatccatcatggaccggtccacggatttcagcagctcccgttatttcagcagttcccggtttttgtccgacatcgccggaggcgcgataagccgcgacgaagacggagagaacaaggagaggccgctggtgctccgcaacaaggttccgaggtggcacgagcagctgcagtgctggtgcctcaacttccgtggccgcgtgaccatcgcctcggtgaagaacttccagctgatcgcggcgccgagccagcccgcgccgccccccgcaggggcgccgaccccgaccccggccccgtcgcagcccgccccggcgccggagcaggacaagatcatcctgcagttcggcaaggtgtccaaggacatgttcaccatggactaccgctacccgctgtcggcgttccaggccttcgcaatgtgcctgagcagcttcgacacgaagctggcctgtgaataaaaccggcgaccgacggaggtcgacgacgacacaggcgcggtcgagggaaggaagcagtagaaccctcatccccccataggacttccattctagatcacggacacgccctttgtttgcttgtaattctgctttgtttgtagcttgttggaactggactcggtagcatgtgatgcttcgcaccatgattgcttcctttgaagctaagtttcgtggatgcggttggttccggatttaacctaaggttccgtcaccttcatgattgcctttgagctttctctatggattcctgttgtctggtaaagaacagaaaaaggttcagtgctta

SEQ ID NO: 2171 - DNA, 1588 bp, Secale cereale
gcgctcatgtacacgttgatgattgcttctacatctagaaatactccagagtagcaatcctcgctccggtgctgtcatctgtaaccgccctcccataagaggaacagtttggaaaggttgtcggcggcctaagcttgacatacatccaggcagtttagaaagctccaagcttcggcctgcatctagctagcgcagatgtcgttccgcagcatagttcgtgatgttagggacggtttcggcagcctgtcgaggcggagcttcgaggtgaccatctccggcctcaccggtctcaccggccaccacaggggcaagtgccagagcacggtgcacgagctccgcgacgccgatctcatagtccaggagagccgctgggccagcctccctcccgagctcctcagcgacgtcatccggaggctggaggcaagcgagagcacctggccgtcgcgcaagcatgtcgtgtcctgcgcggccgtttgcaaggcgtggagggagatgtgcagggagatcgtgacgagccctgagttttgtgggaagctcaccttccccttgtctctgaaacagcctggccctcgagacggaatgattcaatgttatataaagcgagataaatcaaagtctacttatcatctctacttgtgcctgagtaatgcggtacttgtggagaatggcaagttcctcttgtctgctaaaaggaaccgcaggacaacctgcacagaatatgttatctcaatggatgctgaaaacatctcaagatcaagcagcacctatattggaaaactgaggtcaaacttcctcggcacaaaattcgtagtctatgacacgcagcccccctacaatggggctatggttccttccgttggacggagtagccggagattcaactccaagaaagtctctcccaaggtgccatctggtagctacaacatagctcaggtgtcttacgaactaaatgttcttggcacgaggggccctaggcggatgaactgcatcatgcactccataccggcctcatcggttgagcccggcggcatagtccctgggcagcctgaccagatcatgccccgggcactagaggactcgtttcgcagcatgagctccttctccaagtcatccatcatggaccggtcgacggatttcagcagctcccgttatttcagcagttcccggtttttatccgacatcgccggaggcgcgataagccgcgaggaagacggagagcacaaggagaggccactggtgctccgcaacaaggttccgaggtggcacgagcagctgcagtgctggtgcctcaacttccgaggccgcgtgaccattgcctcggtgaagaacttccagctgattgcggcgccgagccagcccccccccccgctgcgggggcaccgacaccgaccccgaccccgtcgcagccgccccggcgccggagcaggacaagatcatcctgcagttcggcaaggtgtccaaggacatgttcaccatggactaccgctacccgctgtcggcgttccaggccttcgcaatgtgcctgagcagcttcgacacgaagctggcctgtgaataaaatcggcgacgacggaggtcgacgacacgg

SEQ ID NO: 2172 - DNA, 2110 bp, Secale cereale
tcgcgtgcccaagaaaggaaccaccaggcggggacggcgtgagcgcagccggggctggagccggatcgacccccttcgtatccacaggcggcggcggcggcgacacgggagcaggagctccggatcggcgctcatgtacacgttgatgattgcttctacatctagaaatactccagagtagcaatcctcgctcctgtgctgtcatctgtaaccaccctcccataagaggaacagtttggaaggttgtcggcggcctaagctttacatacatccaggcagtttagaaagctccgagcttcggcctgcatctagctagcgcagatgtcgttccgcagcatagttcgtgatgttagggacggtttcggcagcctgtcgaggcggagcttcgaggtgaccatctccggccttaccagtctcaccggccaccacaggggcaagtgccagagcacggtgcacgagctccgcgacgccgatctcatagtccaggagagccgctgggccagcctccctcccgagctcctcagcgacgtgatccggaggctggaggcaagcgagagcacctggccctcgcgcaagcatgtcgtgtcctgcgcggccgtttgcaaggcgtggagggagatgtgcagggagatcgtgacgagccccgagttttgtgggaagctcaccttccccttgtctctgaaacagcctggccctcgagacggaatgattcaatgttatataaagcgagataaatcaaagtctacttaccatctctacttgtgcctgagtaatgcggtacttgtggagaatggcaagttcctcttgtctgctaaaaggaaccgcaggacaacctgcacagaatatgttatctcaatggatgctgaaaacatctcaagatcaagcagcacctatattggaaaactgaggtcaaacttcctcggcacaaaattcgtagtctatgacacgcagcccccctacaatggggctatggttccttccgttggacggagtagccggagattcaactccaagaaagtctctcccaaggtgccatctggtagctacaacatagctcaggtgtcttacgaactaaatgttcttggcacgaggggccctaggcggatgaactgcatcatgcactccataccggcctcatcggttgagcccggcggcatagtccctgggcagcctgaccagatcatgccccgggcactagaggactcgtttcgcagcatgagctccttctccaagtcatccatcatggaccggtccacggatttcagcagctcccgttatttcagcagttcccggtttttatccgacatcgccggaggcgcgataagccgcgaggaagacggagagcacaaggagaggccactggtgctccgcaacaaggttccgaggtggcacgagcagctgcagtgctggtgcctcaacttccgaggccgcgtgaccatcgcctcggtgaagaacttccagctgatcgcggcgccgagccagcccctgccccccgccgcgggggcaccgacaccaaccccgaccccgtcgcagcccgccccggcgccggagcaggacaagatcatcctgcagttcggcaaggtgtccaaggacatgttcaccatggactaccgctacccgctgtcggcgttccaggccttcgcaatgtgcctgagcagcttcgacacgaagctggcctgtgaataaaatcggcgacgacggaggtcgacgacacgggcgcggccgcgagggaaggaagcagagctctcattcccccccataggacttctattctagatcacggacacgccttttgtttccctgtaattctgctttgtttgtagcttgctcgaactggactcggtagcatgtgatgcttcgcaccatgattgcttcctttgaagctaagtttcgtggatgcggttggttccggatttaacctaaggttccgtcaccttcatgattgcctttgagtcttttttctctatggatggattggatgcccggtgtctaagtaaagggacagaaaaggttcagtgctttctgttacttttacattagctattgtgtgtcttcgtcctttattcctaacgaaggtcggacaacgaggtaatggaagtggaaacgtccc

SEQ ID NO: 2173 - DNA, 1617 bp, Secale cereale
cttcggcctgcatctagctagcgcagatgtcgttccgcagcatagttcgtgatgttagggacggtttcggcagcctgtcgaggcggagcttcgaggtgaccatctccggcctcaccggtctcaccggccaccacaggggcaagtgccagagcacggtgcacgagctccgcgacgccgatctcatagtccaggagagccgctgggccagcctccctcccgagctcctcagcgacgtgatccggaggctggaggcaagcgagagcacctggccctcgcgcaagcatgttgtgtcctgcgcggccgtttgcaaggcgtggagggaaatgtgcagggagatcgtgacgagcccggagttttgtgggaagctcaccttccccttgtctctgaaacagcctggccctcgagacggaatgattcaatgttatataaagcgagataaatcgaagtctacttatcatctctacttgtgcctgagtaatgcggtacttgtggagaatggcaagttcctcttgtctgctaaaaggaaccgcaggacaacctgcacagaatatgttatctcaatggatgctgaaaacatctcaagatcaagcagcacctatattggaaaactgaggtcaaacttcctcggcacaaaattcgtagtctatgacacgcagcccccctacaatggggctatggttccttccgttggacggagtagccggagattcaactccaagaaagtctctcccaaggtgccatctggtagctacaacatagctcaggtgtcttacgaactaaatgttcttggcacgaggggccctaggcggatgaactgcatcatgcactccataccggcctcatcggttgagcccggcggcatagtccctgggcagcctgaccagatcatgccccgggcactagaggactcgtttcgcagcatgagctccttctccaagtcatccatcatggaccggtcgacggatttcagcagctcccgttatttcagcagttcccggtttttatccgacatcgccggaggcgcgataagccgcgacgaagacggagagcacaaggagaggccgctggtgctccgcaacaaggttccgaggtggcacgagcagctgcagtgctggtgcctcaacttccgaggccgcgtgaccatcgcctcggtgaagaacttccagctgatcgcggcgccgagccagccccggcccccgcgcgggggcaccgacaccaacccgaacccgtcgcagcccgcccggcgccggagcaggacaagatcatcctgcagttcggcaaggtgtccaaggacatgttcaccatggactaccgctacccgctgtcggcgttccaggccttcgcaatgtgcctgagcagcttcgacacgaagctggcctgtgaataaaatcggcgacgacggaggtcgacgacacgggcgcggccgcgagggaaggaagcagagctctcattcccccccataggacttctattctagatcacggacacgccttttgtttccctgtaattctgctttgtttgtagcttgctcgaactggactcagcagcatgtgatgcttcgcaccatgattgcttcctttgaagctaagtttcgtggatgcggttggttccggattt

SEQ ID NO: 2174 - DNA, 1938 bp, Elaeis guineensis
tttccatctcgatttggaattgttgagccatctatatctggtgtgtttctgatttgaaggttttccagttaaaacagaacattaaaatttgaagcaaggttgatgtacttataatacaaaaaaaaggggcggtggtcctgagacgagagaagctgttgtttgtatgcctattggccacctctagtgatcctgggttgctgctttgtttcttcagtttgcctagatgtcgttccgcagtatagttcgtgatgtaagagatagttttggcagtttgtcaagacgtagttttgaggtgaggctttcaggcttctcaggtcatcacaagggaaaatcgcagggttcagtgtatgagctgcaagaccagcctccagtgatccagcagagtcgctgggcttgccttcctcctgagctactttgtgatgtaattaaaaggttggaagcaagtgaaagtacgtggccatcacgcaagaatgttgtttcctgtgcagctgtttgtcgatcatggagggagatgtgtaaagagatagtcagaagtccagagttttgtggaaagcttactttcccagtatccctgaaacagcctgggcctcgagatggaaccattcaatgcttcattaagagggataaatcaaaattaacttatcatctctacctgtgcctcagccctgctgtggttgttgagaatggaaagttcctcctatctgcaaaaaggaatcgccggacaacctgcacagagtacattatatcgatggatgctgaaaacatatcaagatcgagcaacacttatattggaaagttgaggtcgaatttccttggcacgaaattcataatctatgatacccaaccaccatacaatggggctgccctctgtccaccacctggacgaacaagccgcagattctactccaagaaagtctctccaaaggtcccatctggcagttacaacatagctcaggtgacctatgagctgaatgttcttggcacaagaggcccacggcggatgcactgcatcatgtactccattcctgcttctgcccttgagccgggtggcacagtccctggccagcctgataacctcattcctcgctccctagaggactcattccgcagcatgtccttctccaagtcctctatcatggaccgttccatggattttagcagttctcgcttctctgacatcactggagggatccaggagggagatgaagaggaggagaacaaggaggtgaggcctctcgtgctccgcaacaagcctcctagatggcatgaacagctgcagtgctggtgcctcaatttccggggcagggttactgtcgcctccgtcaagaactttcagctcatcgccgcaacacagcctgctgcaggagctcccacatcatcacagcccgcaccatctgagcatgacaaaatcattctgcagttcggcaaggtggcaaaggatatgttcaccatggactatcgctatccactctcggccttccaggcattcgctatctgcttgagcagcttcgacaccaagttagcatgtgaatagaacagtgaaagcagtggagaaaaggaagtttaattaccaaaagaaaaggcaatagtttacagagtgggcatccacaatgtatttgctgtttgttgttgatttttcttggttgttagtgtatcgggcactagcctgcaactggcttttgaagcatttatctatcatctgttcactgaagtcctctgctattatgacagcctttggatgaagtgatcaggtggtagttccatacgatgcgttgatgctttgtgtgtatcttcttcatgttttccttcagcctgcttatgtgaagatttaactagtagtcaaaagtaataaaataaaataaaatacttctcagtctcaacaaaaaaaaaaataaaatagatacgccaacggaacgacaacaacgggagggtaagagg

SEQ ID NO: 2175 - DNA, 1813 bp, Saccharum officinarum
cgcgctctctcggcttcttcctcgcttgtctgtctccctccctccctccctcccctagtcccctcctcgctcgctggttcgctccgggtctccgtccgtctccctcaccagtcaccacacccaattccaccctcccgtcgttcctttcctcggtcggccggctcctcgtcgcgtggtcacaagggaagcccagaggtggagagagctaaccccggtgaaggaatctgagccacctgcgctccgatctgtcttccgaaggacgcggagggaggaaggctccggatcggggatttgcgtccttccggcacgccctgatgtccaaatcggcgattgcttctgtgtagacacactcaaaagcagcattttcccctgtggggtggcgtgatctccactgttctatcagtggagcacccacgaaggctgtcggaaccttccctgttatatattggcactttggcaggctaagccccaagtttctagttggcgaagatgtcgttccgcagcatcgttcgtgatgttcgggacagttttggtagcctgtcaaggcgcagctttgaggtgactatcgctggcctttctggactcaccgtgcatcacagggggaaatctcagagcacggtgcatgaactccgtgatacggatctcataatccaggagagccgttgggctaatctccctcctgagctcctccgtgatgtgatccggaggctggaggccagtgagagcacctggccaaatcgcaagcatgttgtgtcctgcgctgctgtttgtcgggcatggagggagttgtgccgggagattgtgctgagcccggaattcagtgggaagcttaccttcccagtctctctaaagcagcctgggcctcgcgatggaatgattcagtgtttcataaagcgagataaatcaaagtccacatatcatctctacttgtgcctgagcactgctgtacttatggagaatggcaagtttctcttatcagcgaaaaggaaccgcaaaacaacctgcacggagtatattatctcgatggatgctgacaacatatcgagatctaacagcacatatattggaaagctgaggtcgaacttcctcggcacaaaatttatgatctctgacacgcagcccccatatagtggagctgcagtccctcacgctggccggacaagccgaagattcaactccaagaaggtctcacctaaggtgccaactggtagctacaacatagctcaggtgacatacgagctaaatgttcttggcacgagaggccctaggcggatgcactgtgtcatgcactccatacctgcctccgcagttgagcccggtggcatagtccctggtcagcctgagcagattctgccccgggcactagaggagtccttccgcagcaccacctccttctccaagtcatccatcatggaccggtccatggatttcagcagctcccgggacttcagcagcgcccgcttttctgacattgccggaggcgccatggctgacgacgaagagggacagaacaaggagaggccgcttgtgctccgcaacaaggccccaagatggcacgagcagctgcagtgctggtgcctcaactttcggggccgtgtaaccattgcctcggtgaagaatttcagctgatcgccacgccaagccaggcccctgcccctggcgccgctggggctccaaccccatcacagccttgctcgcgagaccaagatagatcattcttcgttttggtaaggggccaaagatatgttaacgatggactaccgttacccgtcttagccttcaggttttcgcctttggtggatagcttcaaaac

SEQ ID NO: 2176 - DNA, 2550 bp, Musa acuminata
cttctcgcttctcccttctcccttctgactcccccctcctctcaattggatttaacggggctttgaattccgtcgtcttctgcgtctgggtcgatcttgtgagagagaggagggcggcgagaagggatgtcgtgactgggagatttggcgggcggccggttaggttcgtaagttcggagggatcgaagcgttgagtcctccgttcctctttgggtgtttctgccttcagattcaagagatttgagttcaacgtcttgaccatcttatcactccgacacaagtgggctgccatattacctccttggtggttctgtctatcctattctgtgccgtttctggcattggttagactagatgtcgttccgtagtatagttcgagatgtgcgggatagttttgggagcttgtcaaggcgtagtttcgaagtgagactttcaagtctttctgggcatctccggggtaaatctcaagtgtttgtgcctgagccacatgacacacctccagttatccagtcaagtcgctgggctagccttccacctgagctacttcgggatgtgattaaaagattggaagcaagtgaaggtacctggccatctcgtaaggatgttgtcgcctgtgcagctgtgtgcagagcttggagggaaatgtgcaaagagatagtaagaagtcccgagttttgtgggaagctcacttttccaatatcattgaaacagcctggaacccgagatggaatgattcaatgtttcatcaagagggacaagtcgaaattaacttatcatctatatctatgtcttagccctgctgtgctggttgagaatgggaagttccttctatcagctaaaaggatccgtaggacagcttgtactgaatatgttatctcaatggatgccaataacatatcacgatcgaccaacacgtacattgggaagttgaggtcaaattttcttggtacaaagttcataatttatgacacacagcctccatataatggggctgccatctgcccgcctggacgaacaagccgcagattttactccaagaaagtgtctcctaaagtcccatcgggcagctacagcatagctcaggtgacatatgagctgaatgtccttggcaccagaggaccacgtcgaatgcattgcgttatgcactctattcctgcctcagcccttgagcctggtggcacagttcctggccagcctgacagccttgtttcacgctccctggaggagtccttccgcagcatgtccttctccaagtccatcatggatcgttccatggacttcagcagctctcgcttctctgatatcataggaggaactcaagagggggatgaaggcggagaggccaaggagagaccactggttctcaggaacaaaccccccaggtggcatgagcagctgcagtgctggtgcctaaattttcgtggtcgggtcactgttgcctcagtgaagaacttccagctcatcgctgcatcacagcctgccgccggggcacctacaccatctcagccagcaccatccgagcatgataagattatactgcagtttggcaaggttgcaaaggatatgttcacgatggattatcgctacccactctcggcgttccaggcattcgcaatctgtttgagtagcttcgacaccaagctggcttgtgaatagaacaatgagaatagataacatctacatcatggtcactctgttatcgattcctcatggctgttgatgcactagttgtgacctgcaacccatttcttggagcactaacctgcttcctgatcagtcccaagcttctccagccgctctgcatgaagcagtgaactgataactccaccagattcttcatgtttgtgtagaattctgtctagatcaaggctttgtttagtaggcacaacattgactctttatggagagatcggttggtactatttttcttccttctgtcttgatctccctcatgaatccattgactttttattcttcttccatctgctttctgtaaaggagttccccctgtgggcctgagcacagtccatgagctgcttttgttttacaattttatctccttttccaaagtggtactctaccatggaggagatgttgggtttgttctggcagatcacacttgcagcaggagtagattccatgctgtcttggatgaagagtaagacatgtttgaattgtaggcttttcatacagctgggggaataaaagcaaaagaaacaacaaagtcttgtgaccaaaacagacagaagccaaggagaacagctggtaggcactaagctcctggcccatcttgatctcacctactaatggatgaaaccactattcatgtagtgacagcctagctgggatggttgtgctatttattagcagggaaaaggtgcagaggttgatggcctctgtcacattcaagatcaccattttgccatgctcttaagtacaaaaggggagcagtagtttcaagcatcaactacactggtttgctatgtttaaaccattgcctacaatggtcagatttaatttaatgggagtaaacttatcaatttttaaaac

SEQ ID NO: 2177 - DNA, 2114 bp, Elaeis guineensis
atttctgttcatccgctgtctcccccacccgtgaactggatttaacgaagctttgggatcccccggaagagagagagagagagagagctggcgagaaggaagggatcttggagagagagggggatttggaaaggcgatacctttcgtgcgatcggagcggaggctggggcataaagcttcgatatttgagattttctctggggattttccctcttgatttgggaaactcgagtttgacgtgcttatcatacaaaagaaaaaggcttttgtggtcgttgctgtgacacaagtgaagctgctgtttttatgcctattgttgggctctagttatcctggcttgtttgctttgtggctttagtttgcctagatgtcgttccgcagtatagttcgtgatgtaagagacagttttgggagtttgtcaagacgtagttttgaggtgaggttttcagccttttcgggtcattacaggggaaaatctcagggttctgtgcatgagctgcaagaccagcctccggtgatccagcagagctgctgggctagccttcctcctgagctacttcgtgatgtaattaaaaggttggaagcaagtgaaagtacctggccatcgcgcaagcatgttgttgcctgtgcagctgtttgccgatcatggagggagatgtgtaaagagattgttagaagtccagagtttaatgggaagctcactttcccagtatccctgaagcagcctgggcctcgagatggaaccattcagtgcttcattaagagggataagtcaaaattaacttatcatctctacctgtgcctcagctctgcggtgcttgttgaaaatggaaagttcctcctatctgcaaaaaggaaccgccggacaacctgcacagagtacattatatctatggatgctgacaccatatcaagatcaagcaacacttatattggaaagttgaggtcaaatttccttggcacaaagttcataatctatgacactcaaccaccatataatggggctgccctatgcccactcggacgaacaagccgcagattctactccaagaaagtgtctccaaaggtcccatctggcagttacaacatagctcaggtgacatatgagctgaatgttcttggcacaagaggacctcgtcggatgcacatcatcatgcactccattcctgcctcttcccttgagcctggtggcatggtacccggccagcctgatcatctccttcctcgctccttagaggattcctttcgcagcatgtccaagtcctccctcatggaccgctctatggatttcagcagctctcgcttctctgacatcactggagggactcaggaaggagatgaagaggacgagaacaaggagaggcctcttgtgctccgcaacaaggcccctagatggcatgaacagctgcagtgctggtgcctcaacttccggggccgggttactattgcctccgtcaagaactttcagctcattgcagcaacacagcctgctgcaggagctcccacgccatcacagccagcgccatctgagcatgacaaggtcatactgcagtttggtaaggtggcaaaggatatgttcaccatggactaccgttatccactctcggccttccaggcatttgctctctgcttgagtagcttcgacaccaagttggcttgtgaatagaacaatgaaaggagtgggaaaaaggaataggttgcagagtgggcttccacaatatgcttgctgtttgtcaatgaattttttcttgactgttagtgtattgggtggtagcctgcgactgcattttgaagcatttatccatcatctgctcactgaattcctctgttattgtgatggcctccggataaagtggtcgggaggtggttccattctgtgcattgatgctttctgtgtatcttcttcatgttgtcctttagcattgtttatatgaatgttttatcttagtattaagataaaaataatctcaaattcttatgggcagaggaatatcctgtgaaaatttaaattagtattgtttttttaaattttatacgagaaattattcaattatgatcatctggtaatttttactataacaatatgtattaagtgaagaaattgataaatgtca

SEQ ID NO: 2178 - DNA, 1581 bp, Saccharum officinarum
tgaatcaggaggagtaggaggaaggaggagagtcgccggcgagcagcaatgccttactgcgaggtaggcaggcacgcggacggcgacaagtgggagggcgtccgcctcttctaccgccgctacggccgcggcgccaccaaggtgctcctcatcatcggattggcggggacgcacgactcgtggggcccgcagataaaggggctgaccgggtcgctggagcccgccgacgacgaggccgtgcgtccggacgaggaggccggcgtcggtgccgccggcgcggcggaggcggcccccgcggaagcggatgaggccgtcggcggcggcgatggcatcgaggtctgctgcttcgacaaccgcggcgtcggccgcagctccgtgctccccaacaaatcctactactcgacggcaatcatggcgatggatgccttggccttgatggatcatctggggtggaagaaagctcacgtttttggccactccatgggtgccatgattgcttgcaagctagcggcaatggcacctcacaggctatgttcgctggcattgcttaatgtcactggaggtggctttcaatgcttcccaaaggtagatgggcagatgctatctcttgcattccgtttcttaagggcgaaaactccggaggaaagagcccttgtggacttggaaacacattatacgaaggaataccttgaggagactattgggtcgtgtaccagaagaatggtcctctatcaagaatatgtgaagggcatatcgtcgacagggatgcaatctaattgtggttttgaagggcaagttaatgcatgctggactcacaaaatgactactaaggaactagatacaatacgatctgccggttttctagtttcagttattcatggaaggtacgatatcattgcacaattgtgccatgcaaaacgtctagcagaaaggcttcttcctgttgcaagaatggtagaacttcatggtgcacatctagtgagccatgaaagaccagacgaggtgaacaatgcacttatggatttgataaaggccaccaaatcttcgatgaaacctgaagagtggtcagcccagcctgagaacacatcgggggtgatagtcatggggtttgagcacatgaggaacattgtaagggtaatgaagccagtaagggttgcagcaattgagtcataagaaccaaagacatgtaaattattcttgagaccttgtgggagtcgagatgatactttcagttctccccaattcaccattgccctttgtgggagtcgagatgatactttcacttctccccattaccttggagatgaagattttagagtagcatctccaagacatatgaaactgttctgaggaaaggcctgctcctggtagcagaataatacgagacagaaacattgagaaaacagtgtgctgcgcgcctggacagaagtgtccaagggcacggttggtgtatgtacctgtacctgcaagagtgtccgtaacttgctgcttctatttcacggccacatgctgcgctggtgctgtactgctgtcaccatgctcctgtatcgtaccgagatttaaaatcgattctttgttgtt

SEQ ID NO: 2179 - DNA, 1917 bp, Zea mays
gggccggccggtttgactcggcggcggacggcgacgcgccgacgtgtctccgccgccccgctcacatccgcccccgcgccatccgtccacgtgttcgcgcctctggaacggactcccccgcctgcaccttcttttccctcgcgccgcggcgcccgttctttccgagtcccgcggatataactacaaccagccgcccccttcctccgcagctccgctccccttcccccctcgtttttcctctgcgcactttttctcgtttccagccttccaggcagccacgcctcgcccgttctcggatcccctccaaaacggtcaaagccaaaccagccaaatcgcgcgcggcggcggcggcgacgagaacgagacggacgcgcgcgcgctagctgaatcaggtcaggaaggaggagagccgccggcgagcacagcagcaatgccttactgcgaggtgggcaggtacgcggacggcgacaagtgggagggcgtccgcgtctactaccgccgctacggccgcggcgccaccaaggtgctcctcatcatcgggttggcggggacgcacgactcgtggggcccgcagattaaggggctgacggggtcgctggagccggccgacgacgaggccctgcggccggacgaggaggccgccggcggcgacggcgacggcatcgaggtctgctgcttcgacaaccgcggcgccggccgcagctccgtgcccccgaacaaatcctactactcgacggcaatcatggcgacggatgccttggccttgatggatcatttggggtggaagaaagctcacgtctttggccactccatgggtgccatgattgcttgcaagcttgcggcgattgcgcctcacaggctatgttcgctggcattgcttaatgtcactggaggtggctttcagtgcttcccaaaggtagatgggcagatgctttctcttgcattccgtttcttaagggcaaaaacaccagaggaaagagcccttgtggacttggaaacgcattatacgaaggaataccttgaggagactgttgggtcgtgtaccagaagaatggtcctctatcaagaatatgtgaagggcatatcgtcgacagggatgcaatctaattgtggttttgaagggcaaatcaatgcatgttggactcacaacatgactactaaggagctagatacaatacgatctgccggctttctagtttcagttattcatggaaggtacgatatcattgcgcaattgtgccatgcaaaacgtctagcagaaagccttcttcctgttgcaagaatggtagaacttcatggtgcacatctagtgagccatgaaagaccagacgaggtgaacaatgcacttatggatctgataaaggccaccggatctgcgatgaaacctgaagagtggtcagcccagcctgagaacacatcggagaccggggcactcatttccgcgaggcccattaccgtcacgatgcgaacagatgaaggggtgatagtcatggggtttgagcacatcaggaacattgtaaggataatgaagccagcaagggttgcaccaattgactcgtgaggaccaaaatacgtgtaaattattctttgagaccttgttgtgggagtcgagatgatactttttcacttctcccccatacctggagatgatgattttagagtagcatctccaacacatgtgaaactcttcggaggaaaggcctgctcatagtggcagaataatccgacacggataacactgaacaaacagtgcccgcctggacagaagtgtctgggccacggttggtgtatgcacatgtacctgtataaagagtatctgtaacttgctgcttctatttcacggccacatgctgtgctggtgctgtccaccatgcttctgtaccatactgaaatttcaaaaccattctttgttgctca

SEQ ID NO: 2180 - DNA, 1877 bp, Setaria italica
ctcgtttttcctctgctcattttcacaattccaggcttccagcccacgcccattcctggactactccccaaccccaaacggtcaaagccaagccgatcgcgtgcggcggcgataacgagaagctagctgtaggaggaggaggacgacgagtcgccggcgagcagcaatgccttactgcgaggtgggcaggtacgcggacggcgacaagtgggagggcgtccggctcttctaccgccgctacggctgcggggccaccaaggtgctcctcatcatcggattggcggggacgcacgactcgtggggcccgcagataaaggggctgaccgggtcgctggagcccgccgacgacgagccaccgcggccggacgaggaggccggcgccggcgccgcaggggcggcggaggcggcgcccgcggaaggggatgatgccggcggcgacggcatcgaggtctgctgcttcgacaaccgcggcgtcggccgcagctccatccccccgaacaaatcctactactcgacggcaatcatggcgaaggacgccttggccttgatggatcatttggggtggaagaaagcacatgtctttggccactctatgggtgcgatgatttcttgcaagctagcggcgatagcgcctcacaggctgtgctcactggcattgcttaatgtcacgggaggtggctttcagtgtttcccaaaggttgatgggcagatgctatctcttgcattccgtttcttaagggcgaaaactccagaggaaagagctcttgtggacttggaaacccattatacgaaggaataccttgaggagactgtcgggtcatgcactaggagaatggtcctttatcaagaatatgtgaagggtatatcatcaacagggatgcaatctaattgtggttttgaagggcaagttaatgcatgctggacccacaaaatgactacgaaagaactagatacaatacgctcagccggttttctaatttctgttattcatggaaggtatgatatcattgcacaattgtgtcatgcaaacgtctagcagaaaggcttcttcctgctgctagaatggtagaacttcatggtgcacatctagtgagtcacgaaagaccagacgaggtgaacaatgcacttatggatctaataaaggctaccaaatctgcgatgaaacctgaagagtggtcagcccagcctgagaatgtatcagaaaccggggcacttgtttccggaagacccattaccgtcacgatgcgaacagatgaaggtgcaaacgtcgccgtagcagtctataacttgcttggcaagctgcaactaagctttctttatctcataggggtgatagtcatggggtttgagcacatgaggaacatagtaaaggtaatgaagccagtaagggtggcggcaattgagtcataaggaacaaggacatgtaaattattctcaagaccttgtgggagtcgagatggtattttcacttctccccagtacttcggagatgatgattttagagtagcatctcccaacaactgtgaaatttttctgagggaacgcctgctcttagctgaataatacgacacaaaaacatagaaggaaaaccgttgttggcgcctggacagaagtgtcgtagggcacggttgatgtaatacctgtgaagagagtttctgtaagcacggccacacatgctgcgctggtgctgtcagcctgtcaccatgttcctgcgtacgataccatgccgagatttcaaagcgattctttgttgctttatgtatctgcgtggtgtcgctgaacgcttatgtaacttccggcatgacatgagctgtgcaagcaaacctacagctacagcagctactatcaaatcgcatatcaggattttcacgacgtat

SEQ ID NO: 2181 - DNA, 1978 bp, Panicum virgatum
ctcgttttttccctgcctcttttctgaattccagccttccagcccacgcccattcctggactgctccccaaacggtcaaagccagagccgatcgcgcgcggcggcgataacgagaactcgagaaggtagctgaaccggggggaggagggagagccgccggcgagcagcaatgccttactgcgaggtgggcagatacgcggacggcgacaagtgggagggcgtccggctcttctaccgccgctacggccgcggcgccaccaaggtgctcctcatcatcggattggcggggacgcatgactcgtggggcccgcagataaagggattgaccgggtcgctggagcccgccgacgacgagcccccgcggccggacgaggaggccggcgccggagccgccggcgcggcggaggcggcgcccgcggaagggggtgatgccggcggcgatggcatcgaggtctgctgcttcgataaccgcggcgtcggccgcagctccgtgcctcctaacaaatcctactactcgacggcgatcatggcgaaggatgccttggccttgatggatcatttggggtggaagaaggcacatgtctttggccactctatgggtgcgatgatttcttgcaagctagcagcgatagcgcctcacaggctgtgttcactggcattgcttaatgttaccgggggtggctttcagtgtttcccaaaggtagatgggcagatgctatctcttgcattccgtttcttaagagcgaaaactccagaggaaagagcgcttgtggacttggaaacccattatacaaaggaataccttgaggagactgtcgggtcatgtactagaagaatgatcctttatcaagaatatgtgaagggcatatcttcaacaggaatgcaatctaattgtggttttgaagggcaagttaatgcatgctggacacacaacatgagtacaaaagaattagagacaatacggtctgccggttttctaatttcagttattcatggaaggtacgatataattgcacaattgtgtcatgcaaaacgtctagcagaaaggcttcttcctgctgctaggatggtagaacttcatggtgcacatcttgtgagccatgaaagaccagatgaggtgaacaatgcgcttatggatctaataaaggctaccaaatctgcggtgaaacctgaagagtggtcggcccagcctgagaatgtatcagaaaccggggcactgatatccgggagacccattaccgtgacgatgcgtacagatgaaggtgcaaacgccaccaatgctgccgtagcagtctataacttgcttggcaagctgcaactaagctttctttatctcataggggtgatagtcatggggtttgagcacatgaggaacattgtaaaggtaatgaagccagtaagggtggcagcaattgagtcataattcatcataagaaacaaggacatgtaaattattctcggtaccttgtgggagctcgagttgatatctcacttctccccaatacttcggagatgatggttttagagtagcatctccaacaaatgtggaacttttctgagaaaacgcctgctcatatataggagaataataggacacaagaaaatcgacgaaaccatactaggcacctggacagaagtgtcgcagggcgcggtgatgtatgtacctgcaagaaagaatctgcagcctgtatcagtttcacggccatttcaaatcgattcttcgttgcttcatacgtctgtgtgtggtgtttctgagcgcttacttcaacttcctgataatcgaggtggatggttgcatgcttcattatcgcttgctctccccggcgacggaagcgtcgtcgtcggccgacggcttcgaccagattgtggccgcatgggaggaggctcgggagaggaaatggtaggcccggccacgagcacgaagcaaggacgacgaggtgatgagaagagaggagaggaattgtggccgtgcggtgcc

SEQ ID NO: 2182 - DNA, 1813 bp, Zea mays
tccgacggctataaataaccgccccccttcctccgcagctctgctctgctcccccgcgtctttccctctttttccaagcggtcaaagccaaatcagtcgcgagcggcggcggtaacgagaacgagacgcgcgcgctagctgaatcaggagcagggcccagggaggagagtggagagccgccggcgagcagcaatgccttactgcgaggtgggcaggtacgcggacggcgacaagtgggagggcgtccgcctcttctaccgccgctacggcagcggcgccaccaaggtgctcctcgtcatcggattggcggggacgcacgactcgtggggcccgcagataaaggggctgaccgggtcgctggagccctccgacgacgaggccctgcggccggacgaggaggccggcgtcggcgcggcggaggccgcgccggcggaagcggacgacggcatcgaggtctgctgcttcgacaaccgcggtgtcggccgcagctccgtgctccccaacaaatcctactactcgacggcaatcatggccacggatgccttggccttgatcgatcatttggggtggaagaaggctcacgtcttcggccactccatgggtgccatgattgcttgcaagctagctgccatggcacctcacaggctatgttcgctggcattgcttaatgtcaccggaggtggctttcagtgcttcccaaaggtagacgcgcagatgctatctcttgcattccgtttcttaagggcaaaaactccagaggaaagagcccttgtggacctggaaacacattatacgaaggaataccttgaggagactgtcgggtcatgtactagaagaatggtcctctatcaagaatatgtgaagggcatatcgtcaacagggatgcaatccaattgtggttttgaagggcaagttaatgcatgctggactcacaaaatgactactaaggaactagatacaatacggtctgccggttttctagtttcagttattcatggaaggtacgatatcattgcacaattgtgccatgcaaaacgtctagcagaaaggcttcttcctgttgcaagaatggtagtgcctcatggtgcacatctagtgagccatgaaagaccagacgaggtgaacaatgcacttatggatttgataaaggccaccaaatctgagataaaacctgaagagtggtcagcccagcccgagaacacgtcggaaaccggggcgctcatttctgcgagacccatcaccgtcatggtgcgaacagatgcaggcgtagacgctaccgcagcggtctataacttgcttgggaagctgcaactgagcttcctttatctcataggcatgatactcatggggtttgaactcatgaggaacattgtaagggtgatgaagccagtaagggttgcagcaattgagtcgtaagtcataaggtctctttcttccagcagttgtccggccaatcctggattcatggcagaccgcggaacaagttcctccacctcttctaaatgatgtggttgcaggtgtcaccggcaagaaaaagtagtgaacttgcattgttttctcatgccaatgttgccccacattttcttccccgtgttttttctggcgaccagattggaaggcttttcccaagagtacgtcttgaactctagatggtatccgcggaataatcattgtacctgaatcatatactgcaatgtggcagttttgaaaatgtttcccctcctacaaaggttgatagaatgccataccctttgaactgtgttcgagatgtcatcgtttatgatttctcggtcgagctgtatagatttcgttt

SEQ ID NO: 2183 - DNA, 2689 bp, Oryza sativa
gtgataatgaaactgatcttcatataagaatatgaaccttttcttttcaagtaaaacatgaactgaacttgtttcaacttcatgcagctcagctctacagtaaatcaaacagtaatcacactccaaacaaaaacaaagtgtttcttgggtgcccatctcaaaacaaaatgaacgtctatcgccgggccgaaacaaaatcaactttggaacgagcaacttcgcagatcctaccagtttactccagcttcttaacttcttgatactgactcacaatctgttcgaacaaactctctgtcctccaaacgtggtccaaaaccaaatgccctccttttctcctgatcaagtattccaaccaacacgatcaaggaaaacctcataaaaatgcaagctttctcctcttccttcaattaaaaacgcacaaactttctccaggtcagtacgtaagccacttgatccatccaatcaatctccagtagtattgtactaatctctcacactattacaggcttacagcacggtcctgaaactccgaaattcgccgaaaattctggacctcaagctcacgactctcaagtactccgaattatctcatccttcttctccctcctcccgtccgcgccgcgacgatgcgagcgcaaccacgtttgactcagccgacggcgaccggccgcgtagtacgcgtgtcatcgtcgagctcgagcccatccatccacgtgttcctcctccttcctcgcggcgacgccgacgacggctataaataacccgcgcccccatcccgaccaccgctcctccgcctccgcctctcatatttttcccatttttcacctgccttaattcgccctcctcccataaccgtagtagtaatcgtactcctccattctcgccggaatccagagcgaagctgtaggaaattgttgggaggaggagcaatgccttactgcgaggtggacaggtaccagaacggcgacgagtgggacggcgtccgcctcttctaccgccgcttcggccgcggcgccaccaaggtgctcctcgtcatcggattggcggggacgcacgactcgtggggcccgcagatcaaggggctgaccgggtcgctggagccggccgccgacgacgaggagtccggcgacgccgcggcggcggagggggacgacggcgatggcatcgaggtctgctgcttcgacaaccgcggcgtcggccggagctccgtgctcccgcacaaatcctactactcgacggtgatcatggcgagggacgctctggccttgatggaccatctggggtggaagaaagctcatgtattcggccattccatgggcgcgatgatatcctgcaagctggcagccatggcgccgcacaggatttgctcgttggcgttgcttaatgttactggaggtggcttccagtgcttcccgaagttagatgggcagatgctctcgcttgcattccgtttcttaagggcaagaactccagaagaaagagctctggtagatttggaaacccattatacaaaggaatatcttgatgagaaagttggatcatgcacgaggagaacaatcctctatcaagaatatgtgaagggcatatcatcgacagggatgcagtctaactgtgggtttgaaggtcaagttaatgcatgctggactcacaatatgacaactaaagaactagatacaattcggtctgccggttttctagtttcagttattcatgggaggtctgacattattgcgcaattatgtcatgcgagacgacttgcagaaaggcttattcctgttgctagaatggtcgaacttcatggtgcgcatctagtaagccatgaaagaccagaggaggtcaacaatgcactaatggaattaataaaagccacaaaatctatgatgaaacctgaggaatggtcatcccagccagagaattcatcagaaaccggggctcttatttctgcaagacctgtttccgtcacaatacgaacagatgatgggggaaatgccgcaatagcagtctataacttacttgccaagctgcaactaagctttctttatgtcataggagtgatactgatggggtttgagcatatgaggaacattgtaaaagtaatgaagccagtaagggtcgcagcaatcgaatcataagaaacaaaactcatgtaaattactctcagagccgtcgaggagacctggtattttcatgtctcctcagtactgtggagatgatggttttagaatagcatctccgaagacttcctgagaaaacttctgctctaagcagaataagtgaacaatacggaagaaaattgatgaggtatttggtgcgcgccttggacagaagcgtcccagggcagaaatgcacaaactgatgtacccgtatgagtgtaaatgttgttaccgtatcacggccttatgctgtcgccattcttttgtatcagcatgaaatgtgattattcccatcaataataaacctggttccctgcatgatatatgtatgtaattataagtaacagtaatatgtgtaaacgcccactgaacgacacaaaaagctataaaagagtgcataaatcgtatcataattaactggtctaacaaaacaagaacagtaaccttttcattcattgccaattcacccgatcggtctggcaaacaatctgtatatgaaaaggtttggactaacttgttcctgatccctctttgga

SEQ ID NO: 2184 - DNA, 1992 bp, Oryza sativa
attaaaaacgcacaaactttctccaggcttacagcacggtcctgaaactccgaaattcgccgaaaattctggacctcaagctcacgactctcaagtactccgaattatctcatccttcttctccctcctcccgtccgcgccgcgacgatgcgagcgcaaccacgtttgactcagccgacggcgaccggccgcgtagtacgcgtgtcatcgtcgagctcgagcccatccatccacgtgttcctcctccttcctcgcggcgacgccgacgacggctataaataacccgcgcccccatcccgaccaccgctcctccgcctccgcctctcatatttttcccatttttcacctgccttaattcgccctcctcccataaccgtagtagtaatcgtactcctccattctcgccggaatccagagcgaagctgtaggaaattgttgggaggaggagcaatgccttactgcgaggtggacaggtaccagaacggcgacgagtgggacggcgtccgcctcttctaccgccgcttcggccgcggcgccaccaaggtgctcctcgtcatcggattggcggggacgcacgactcgtggggcccgcagatcaaggggctgaccgggtcgctggagccggccgccgacgacgaggagtccggcgacgccgcggcggcggagggggacgacggcgatggcatcgaggtctgctgcttcgacaaccgcggcgtcggccggagctccgtgctcccgcacaaatcctactactcgacggtgatcatggcgagggacgctctggccttgatggaccatctggggtggaagaaagctcatgtattcggccattccatgggcgcgatgatatcctgcaagctggcagccatggcgccgcacaggatttgctcgttggcgttgcttaatgttactggaggtggcttccagtgcttcccgaagttagatgggcagatgctctcgcttgcattccgtttcttaagggcaagaactccagaagaaagagctctggtagatttggaaacccattatacaaaggaatatcttgatgagaaagttggatcatgcacgaggagaacaatcctctatcaagaatatgtgaagggcatatcatcgacagggatgcagtctaactgtgggtttgaaggtcaagttaatgcatgctggactcacaatatgacaactaaagaactagatacaattcggtctgccggttttctagtttcagttattcatgggaggtctgacattattgcgcaattatgtcatgcgagacgacttgcagaaaggcttattcctgttgctagaatggtcgaacttcatggtgcgcatctagtaagccatgaaagaccagaggaggtcaacaatgcactaatggaattaataaaagccacaaaatctatgatgaaacctgaggaatggtcatcccagccagagaattcatcagaaaccggggctcttatttctgcaagacctgtttccgtcacaatacgaacagatgatgggggaaatgccgcaatagcagtctataacttacttgccaagctgcaactaagctttctttatgtcataggagtgatactgatggggtttgagcatatgaggaacattgtaaaagtaatgaagccagtaagggtcgcagcaatcgaatcataagaaacaaaactcatgtaaattactctcagagccgtcgaggagacctggtattttcatgtctcctcagtactgtggagatgatggttttagaatagcatctccgaagacttcctgagaaaacttctgctctaagcagaataagtgaacaatacggaagaaaattgatgaggtatttggtgcgcgccttggacagaagcgtcccagggcagaaatgcacaaactgatgtacccgtatgagtgtaaatgttgttaccgtatcacggccttatgctgtcgccattcttttgtatcagcatgaaatgtgattattcccatcaataataaacctggttccctgca

SEQ ID NO: 2185 - DNA, 838 bp, Zea mays
ccatcacacgacgccacaaatcgcaactcccaaccgaaacgagaacaaggacgccgtgtaaaaactcgcgcgcgccccaggaaggagaggaagagggagtaatgtaccaggccatcccgtacagcgccggccggccgtggccgcggcccgcgccggcgatgggcgtcgaggccgcggcggcggtggcggaggaggagaggctgctcgcggctgcacagcagcagcagccgtcggcgggggcggaggcggcggcgaggggggaggaggtgcgacgggcggtggcggagtgccccgtgctcgtggtggggaagcgcgggtgctgcctcagccacgtggtgaagcggctgctgcagggtctcggggtcaaccccgccgtgcacgaggtcgccgacggcgccgaggcgaagcttattgccggggtcgtcgacggcggcggcgacgttgccctcccggccgtgttcgtcgggggcaggctcctcggcggcctcgaccggctcatggccgtgcacatctccggcgacctcgtgcccatactcaaggacgccggcgcgctgtggctctgatgagaggaccaaggcgttcgtagtctcgctcccccgtccatccttccttggcctctccatcgtcgtcagctccccttgtccatgttatttttaacttgttatttttactctattaaatagaccagataggcatgcatataggacttttaactctttcggtagaaacagaatattaggtagttagaacaatggagtacgtgtgttaagcgatttacagtatatatttatcttggtttcccgtcatgtgaatatgaaagagtgctgaaattacctga

SEQ ID NO: 2186 - DNA, 1241 bp, Saccharum officinarum
ggccatcccgtacagcgccggccggccctggccgcagcccgcgccggcgatgggcgtcgacgtggcggaggaggagaggctgcgggcggctgcgcagcagcagcagctggcgccggcggcagaggcggaggcggcggcgagggaggaggaggtgcggcgggcggtggcggagtgccccgtgctcgtggtgggcaggcgcgggtgctgcctcagccacgtggtgaagcggctgctgcaggggctcggggtcaaccccgccgtgtacgaggtcgccgacgccgaggcggagctcgccggagtcgtcgacggcggtggcgacgtcgcgctcccggcggtgttcgtcgggggcaggctcctcgggggcctcgaccggctcatggccgtgcacatctccggcgacctcgtgcccatactcaaggacgccggcgcgctgtggctctgatgagaagcgaccgtaccaggccgttcgttcttgcctctccatcgtcagatcttcttcttcttttttggtttccatgtccttgcttggaattaaacgatgatgatgtgttgttaacttatttttatttactcgattagataggcatgcacataggactttaattcttttagtataaaaacaagaatatctaagtgttaagcgatagtatttatattttgtgtattttccatcatgtgaatatgagtgagtgctgatattagcagagctctatgtggactttatgctgtcgagctgtgttctctttttcaagacagtggattgcagcttctggctggtgcggccgtttttgaggatccaaccgttacgttcccctgcattcggagattttcatttttttatagggtcaccctaaattaaatttactgggccgggattttttccaacctgggggaatgggtaaaaacccctggggttaacccaacctttatgaccgtttccaaacaaatctccctttttccccaatttggcctaataaaacagaaatgtcccgtcccctgatcgtcattttatcataccattattccttatcgttaaattgtgtaaaaatgaacagcgcctcttgaaatctgtcctctatatttgccttgctggaactgtgctaattccagccacactaatattgcgttaatacatatggaaagtccacttcatactgataatcttcttattcttggctacactctattattatttacgcacaacggcgacggttttatgaccccgttgatgcttaaagact

SEQ ID NO: 2187 - DNA, 1682 bp, Zea mays
gcacctacccggctacccctgcggccttgccggggagtcggggacggggaaggaaacggcaacgagcctgctgctccagctaccccgaaaccccgtccaacgtccatggctatccacctccgggcacacgccttcgcggccaacccgctgcgtggcgtctccgccgccaccaccgccatgtccccctccgcggccgccgaggcactccgctacctcctcgaccccagctccgccgccgccgccgccaatcccagccagtacctctccaagatccttcctttccgccggggccgcccgctcgcgcgctccacggaccctcccgcggcgccggcctggcgcctcgcgtggctcccgccgtcccgcgtccccggggtggccccggacgccttcgtcttcctgggcgcgctcgtcgagggggacggcaaggaagccgccgcgtactgggcggtcgacgtcagcgagggcgagggagccagggttggtgggccggcggacggggatgggccgtcggcgtttgtggacttgaggacgctcatggtggccacggactggagcgacaaggacgccatggcggagctcgccatcgcaggacatgctcgagcactgctagaatggcacagcacggcaaaattttgtggagcttgtggagcaaaggctgtacctactgaagccgggaggcgtaagcagtgcagcaacgattcctgcaagaagaggatataccctagaattgatccggttgtgatcatgttggtcattgataaagaaaatgatcgggcactcttaagccgccagtcaagatttgtgcctcgtatgtggagttgtcttgctggtttcatagagccaggagaaagcctggaagaggcagtgagacgagaaacatgggaggaaactggtatcgaagttgggcaagtcgtttatcacagttctcaaccatggcctgttgggccaaatactatgccgtgtcaactgatggtgggcttctttgcttatgctaaatcattggagataaacgtggacaagcaggagcttgaagatgcccagtggcacaaccgggaagacgtcaagaaagcgttgacgtttgctgaatacgagaaagcccagagaacaagcgctgccaaggtcgatcagatctgcaagggcgctgagaaagggcagaacccctctgccgacttcaaagttggaagcggcgagcctgctccaatgtttgtcccaggaccctacgccattgctcaccaccttatctcgtcgtgggctttcgagggagcaccgaagctgcctagttcattctcaaacctataagcctggaccctggtgttcagacagacgatgacaggaactggacccctgtgctgcgggctcatggatcacctgtgttgccgtgagtgtaattctgatagtgtgtgtccgttgccggttgtgataaaataaaatagcaatagagtactgggtacagaagacttgccggaggatttggcatcaatggacatgtatatccattgcctttttacatgttgatcctttttgtatcacacgtaatgttgcatacttgcatagatacaacaatgatgtacaacacacagtgtactcatgcatttatacatgtattcagataactggattcaatagtagagtctttgtctgtctctctctctttttctcacatgtggtttgataattgctac

SEQ ID NO: 2188 - DNA, 1608 bp, Panicum virgatum
ccacgcgtccggaagctgcagcctgcagctaccagacacacccaccccgccatggccatccatctccgcgcccacgccttcgcggcgaacccgctgcgtggcgtctccgcctccaccaccgccgtctccccctccgcggcagccgaggccctgcgctccctcctcgatcccagctccgccgccgcggacgccgccaatccccacccgccgcacctctccaagatcctccctttccgccggggccgcccgctcgcgcgctccccggaccctcctgcctctgctccacccgcggcgccagcctggcgcctcgcgtggctcccgccctcccgcgtccccggggtcgccccggacgccttcgtcttcctgggtgcgcacgccgagggggacggcaaggaggccgcggcgtactgggccgtcgatgtcagcgacggcgaggggccgagggtcgacggcggctcgggggacggggatgggtcggcgtttgtggacctgagaacgctcatggtggccacggactggagcgacaacgacgccatgggggacctcgccatcgccggacatgctcgagcactgctggagtggcacaataccgcaaaattttgtggagcttgtggagcgaaggctgttcctacagaagccggaaggcgtaagcagtgcagcaatgagtcctgcaagaagaggatataccctcgagttgacccggttgtgatcatgctggtcatcgataaagaaaatgaccgtgcactcttaagccgccagtcaagatttgtgcctcgtatgtggagttgccttgctggttttatagagccaggagaaagcctggaagaggcagtgagaagggaaacgtgggaagagactggtattgaagtcggtcaagtaatatatcatagctcccaaccatggcctgtcggtccaaatactatgccatgccaacttatggtgggtttctttgcatatgctaaatcattggagatacatgtggataagcaggagcttgaagatgcccagtggcacagccgtgaagacatcaagaaagcgctgacatttgcagaatatgagaatgctcagagaaccaacgctctaaaggtcaatcaaatgtgcaagggtgctgagaaagggcagagcatcgccgaagacttcaaagtgggaggtggcgaacctgttcctatgttcgtccctggacccttcgccattgctcatcacctaatatcggcatgggctttcgagggagcaccaaaggtgcctagttccttctcaaatctataagcctggaccctaaggtagggttcctattgttcagattcattggatggaaggtatagtgaattggaatccttgcaggcacatgaatcatgccttgtcgttcttgtgagatttgatatggtagtggtactattcattgccagttgtaatatgcggtcaagagaaatactagctaggtacaggagatttgctgaaggatttagcgtcactggacatttctatccattgtttgtcaaattttgatggttttagtacatggtatgtatttgtatagatacagcacaaatacactcgtgtatagttagttattcagagaactggaatgaagcctgattttccatcttt

SEQ ID NO: 2189 - DNA, 1573 bp, Setaria italica
ctgcagctaccagacacccacccgccatggccatccacctccgcgcccacgccttcgcggcgaacccgctgcggggcgtctcggcctccaccaccgccgtctccccctcagcggccgccgaggctctgcgccccctccttgaccccagctcccccgccgacgccgccagtcccctcccgccgcacctctccaagatcctccctttccgccggggccgcccgctcgcgcgctccccggaccctcccgcgccaccccccgcggcgccagcctggcgcctcgcgtggctcccgccctcccgcgtccccggggtggccccggacgccttcgtcttcctgggcgcgcacgccgagggcgacggcaaggaggccgcggcgtactgggccgtcgacgtcagcgaaggtgagggcccgagggtcgacggcggctcgggggacggggatggatcggcgtttgtcgacttgaggacgctcatggtggccacggactggagcgataaggacgccatgggggacctcgccatcgccgggcatgctcgagcactgctggagtggcacaatacggccaaattttgtggagcttgtggggcaaaggcggtccctaaagaagctggaaggcgtaagcagtgcagcaacgagtcttgcaagaagaggatataccctcgagttgatccagttgtgatcatgttggtcatcgataaagaaaatgaccgtgcactcttaagccgccaatcaagatttgtgcctcgtatgtggagttgtcttgctggttttatagagccaggagaaagcctagaagaggcagtgagaagggaaacatgggaagagactggtattgaagttggtcaagtcatatatcatagctctcaaccgtggcctgtcgggccaaatactatgccatgtcaacttatggtgggtttctttgcttatgctaaatcattggagattcgtgtggataagcaggagctcgaagatgcccagtggcacagccgtgaagacatcaggaaagctctgacatttgcagaatatgagaaagctcagagaaccaatgctctaaaggtcaatcaaatgtgcaagggtgctgagaaagggcagagcatcaccgatgacttcaaggtagacagtggtgaacctgttccgatgtttgtccctggaccctttgccattgctcatcacctaatatcggcatgggctttcgagggagcaccaaagctgcctagttccttctcaaatctataagcgtgtacccaacaatagggttcctattgttcagattcattcgatggaaggcggtatagtgaattggaatcctttgaggcacatgtatcgtgccttgcgttcttgtgagtgtagatgtggtacttttcatagccaactgtaataaaaggtcaagaggagttctagctaggtaaacagcagatttgccaaaggattttggcgtcactggacatttatatccattgtttgtcacatttggatggtttttgtatacggtatataatgtgcatatatacagcacaaatacacttatgtatagttattcagagaactggagtgaagcctgattttccatcttt

SEQ ID NO: 2190 - DNA, 1612 bp, Pennisetum glaucum
acacccaccccgcgccatcgccatggccatccacctccgcgcccacgccttcgcggcgaacccgctgcgtggcgtctcggcctccaccaccgccatcacaccctccgcggccgccgatgccctgcgctccctcctcgacaccagctccgccgccgccgccgcggacgccgccattaatccccacccgccgcacgtgtccaagatcctccctttccgccggggccgcccgctcgcgcgctcccccgaccctcccgcgcaatcccccgcggcgccggcctggcgcctcgcatggctcccgccctcccgagtccccggggtggccccggacgccttcgtcttcctcggcgcgcacgccgagggcgacggcaaggaggccgcggcgtactgggccgtcgacgtcactgatggtgagggaccgagggtcgacggaagctccggggacggggatgcttcggcgtttgtggacttgaggacgcttatggtggccacggactggagcgacaaggacgccatgggggacctcgccatcgcgggacatggtcgagcactgctggagtggcacaatacggccaaattttgtggagcttgcggggcaaatgcggttcctaaagaagctggaaggcgcaagcagtgcagcaacgagtcctgcaagaagaggatataccctcgagttgatccagttgtgatcatgttggtcattgataaagaaaacgactgcgcactcttaagccgccaatcaagatttgtgcctcgtatgtggagttgtcttgctggttttttagagccaggagaaagcctggaagaggcagtgagaagggaaacatgggaagagactggtattgaagtcggtcaagtcatatatcacagctctcaaccgtggcctgtcgggccaaatactatgccatgtcaacttatggtgggattctttgcttatgctaaatcattggagatttgtgtggataagaaggagctcgaagatgcccagtggcacagccgtgaagacatcaagaaagctctcacatttgcagaatatgaggaagctcggaaaaccaacgctctaaaggtcaatcaaatgtgcaatgatgctgagaaagggcagagcatcagcgatgacctcaaggtggaaagtggtgaacctgttccgatgtttgtccctggaccctttgccatcgctcatcacctaatatcggcatgggctttcgagggagcaccaaaggtgcctagttccttctcaaatctataagcgcgcattcctattgttcagattcattctatggaaggtggtatagtgaattggaatccttggaggcacatgtatcatgctttgcgctcttgtgagtgtagatgtgttacttttcacagccaactgtaataaaaggtcaagaggagtactagctaggcaaacagcagatttgccaaacgatttgggcatcactggacatttaaatccactgtatgtcacattttgttggattttgcacacggtatgtaatgtgcatatatacaacacaaatacactcctgtatagtttattcagagaaatggagtgaagcctgatttagaaaactaaaaaaaaaaaaaaaaaaaaaaaaaaaaacgtaaaactaactag

SEQ ID NO: 2191 - DNA, 1159 bp, Setaria italica
cccgccatggccatccacctccgcgcccacgccttcgcggcgaacccgctgcggggcgtctcggcctccaccaccgccgtctccccctcagcggccgccgaggctctgcgccccctccttcagctcccccgccgacgccgccagtcccctcccgccgcacctctccaagatcctccctttccgccggggccgcccgctcgcgcgctccccggaccctcccgcgccaccccccgcggcgccagcctggcgcctcgcgtggctcccgccctcccgcgtccccggggtggccccggacgccttcgtcttcctgggcgcgcacgccgagggcgacggcaaggaggccgcggcgtactgggccgtcgacgtcagcgaaggtgagggcccgagggtcgacggcggctcgggggacggggatggatcggcgtttgtcgacttgaggacgctcatggtggccacggactggagcgataaggacgccatgggggacctcgccatcgccgggcatgctcgagcactgctggagtggcacaatacgtgtggagcttgtggggcaaaggcggtccctaaagaagctggaaggcgtaagcagtgcagcaacgagtcttgcaagaagaggatataccctcgagttgatccagttgtgatcatgttggtcatcgataaagaaaatgaccgtgcactcttaagccgccaatcaagatttgtgcctcgtatgtggagttgtcttgctggttttatagagccaggagaaagcctagaagaggcagtgagaagggaaacatgggaagagactggtattgaagttggtcaagtcatatatcatagctctcaaccgtggcctgtcgggccaaatactatgccatgtcaacttatggtgggtttctttgcttatgctaaatcattggagattcgtgtggataagcaggagctcgaagatgcccagtggcacagccgtgaagacatcaggaaagctctgacatttgccagagaaccaatgctctaaaggtcaatcaaatgtgcaagggtgctgagaaagggcagagcatcaccgatgacttcaaggtagacagtggtgaacctgttccgatgtttgtccctggacccttgcatgggctttcgagggagcaccaaagctgcctagttccttctcaaatctata

SEQ ID NO: 2192 - DNA, 1951 bp, Oryza sativa
ccgaccaatagatggcctcctgcaactgcaacactgaacacgagggcccacatgtcagtgacacaacctccctacgctttctcctaccaatccaaccacctactacccccaccttgccgggaagctgcaactgcacactcgccgccgccgccatgtccatccacctccgcgcccacgccttcgcggcgagccctctgcgcggcctctccgcctccaccgccgccgtctccccgtcggccgcggccgacgccctccgctccctcctcgacgcgggggccggggcagccgacgccgcgcacccgcacccgcacccgcacctctccaagatcctccccttccgccgcggccgccccctcgcgcgctcctacgactctcctcctccccccgctgccgcggccgcggcgccgccgcctcctcccgcctggcgcctcgcgtggctcccgcccgcgcgcgtccccgacgtgccctcggacgccttcgtgttcctgggcgcgcacggcgaggaggaggggaaggaggccgcggcgtactgggccgtcgatgtgagcgagcgcgacggggagggcgccggggatgggtcggcgtttgtggatttgaggacgctcatggtggccacggactggagggacaaggacgccatgggagacctcgccatcgcgggccacgctcgggcgctgctagaatggcatagcacagcaaaattctgcggagcttgtggatcaagggctgttcctgctgaagccggaagacggaagcagtgcagcaatgaatcctgcaagaagaggatataccctcgagttgatcccgttgtgattatgttggtcatagataaggaaaacgatcgtgcgctcttaagccgccagtcgagatttgtgcctcgaatgtggagctgtcttgctggttttatagagccaggagaaagcttggaagaggcagtgagaagggaaacgtgggaagagactggtattcaagttggggaagtcatttatcacagttctcaaccgtggcctgttgggccgagtactatgccatgccaactgatggtgggattctttgcttacgctaaatcattggagatacatgttgacaagaaagagcttgaagatgcccaatggcacagccgtgaggatgtcaagaaagcactaacatttgcagaatacgagaaagctcagagaacaaatgcgctcaaggtcaatcaaatatgcaagggtgttgagaaaaggcagagcatctctgctgacctcaaaatcgaaagtgaggagcctgctccaatgttcgttcctgggccctatgcgattgctcaccacctcatatcatcatgggcttttgaaggagcaccaaaggcacctagctccttctccaacctatgagccttgatcctgttattcattttcactaaacaacacaacaacaggagatagggaataaaaaattttagtcccatgtatcatgtatgccttagtttcttgttagtgtagatgtgaaatgtgtccattgccggttgtaataaaaggttaagaaaagtacatcacgttcactggaggatttggggggagtacagattacagagcaagtgtaatattttagcatacaatttgtaacagtgtatagatgcagcacagatgtgctgatgtttgtatcttccatattcaaagagctggcatcaagtgtgaaattttgccaggtttgttacaagttgaggacaatcttttacatgttgactggtatagttctgcttggagaaaactggaatattcaagttaattttccacatgagtacatctgtttgtcatgcaagtgaatcaagaattcttgtgcaggggttgatttttcagtgtataggggtatgaaatgaatgtagagagtgatgtgcctggacttttgttgctaatcataattgaagcttctccttgaaacaagcaaccacatgacatctttgactaatctgttg

SEQ ID NO: 2193 - DNA, 1626 bp, Oryza sativa
atgtccatccacctccgcgcccacgccttcgcggcgagccctctgcgcggcctctccgcctccaccgccgccgtctccccgtcggccgcggccgacgccctccgctccctcctcgacgcgggggccggggcagccgacgccgcgcacccgcacccgcacccgcacctctccaagatcctccccttccgccgcggccgccccctcgcgcgctcctacgactctcctcctccccccgctgccgcggccgcggcgccgccgcctcctcccgcctggcgcctcgcgtggctcccgcccgcgcgcgtccccgacgtgccctcggacgccttcgtgttcctgggcgcgcacggcgaggaggaggggaaggaggccgcggcgtactgggccgtcgatgtgagcgagcgcgacggggagggcgccggggatgggtcggcgtttgtggatttgaggacgctcatggtggccacggactggagggacaaggacgccatgggagacctcgccatcgcgggccacgctcgggcgctgctagaatggcatagcacagcaaaattctgcggagcttgtggatcaagggctgttcctgctgaagccggaagacggaagcagtgcagcaatgaatcctgcaagaagaggatataccctcgagttgatcccgttgtgattatgttggtcatagataaggaaaacgatcgtgcgctcttaagccgccagtcgagatttgtgcctcgaatgtggagctgtcttgctggttttatagagccaggagaaagcttggaagaggcagtgagaagggaaacgtgggaagagactggtattcaagttggggaagtcatttatcacagttctcaaccgtggcctgttgggccgagtactatgccatgccaactgatggtgggattctttgcttacgctaaatcattggagatacatgttgacaagaaagagcttgaagatgcccaatggcacagccgtgaggatgtcaagaaagcactaacatttgcagaatacgagaaagctcagagaacaaatgcgctcaaggtcaatcaaatatgcaagggtgttgagaaaaggcagagcatctctgctgacctcaaaatcgaaagtgaggagcctgctccaatgttcgttcctgggccctatgcgattgctcaccacctcatatcatcatgggcttttgaaggagcaccaaaggcacctagctccttctccaacctatgagccttgatcctgttattcattttcactaaacaacacaacaacaggagatagggaataaaaaattttagtcccatgtatcatgtatgccttagtttcttgttagtgtagatgtgaaatgtgtccattgccggttgtaataaaaggttaagaaaagtacatcacgttcactggaggatttggggggagtacagattacagagcaagtgtaatattttagcatacaatttgtaacagtgtatagatgcagcacagatgtgctgatgtttgtatcttccatattcaaagagctggcatcaagtgtgaaattttgccaggtttgttacaagttgaggacaatcttttacatgttgactggtatagttctgcttggagaaaactggaatattcaagttaattttccacatgagt

SEQ ID NO: 2194 - DNA, 1578 bp, Triticum aestivum
acccaacaacctccgccggcgaggcagagcgccaccaaccaacccgggctgccgccggcccgccgtgcccccctcgccatgtccatccacctccgcgcccacgccttcgcggccaacccgctgcgcggcctcgccggcacgcgctcctccggtgccgtctccccctccgcggccgccgaggccctccgcgccctcctcgacggcgccgacgccgccgccggacaccacctctccagggtcctcccgttccgccgcggccgccccctcgcgcgctccccggaccctcctgcttcctcgtcctcgtcccccgcgccgccgccggcctggcgcctcgcgtggctcccgccctcgcgcgtccccggcgtcccctcggacgtcttcgtgttcctgggctcccacggcggcgaggggggcggcgaggaggccgccgcgtactgggccgtcgacgtcagcgaggtggagggcgccaggttcggcggcgctggggaggggtcggcgttcgtcgacttgaggacgctcatggtggccgccgactggagggacaaggacgccatgggggagctcgccatcgccggccacgctcgagcgctgctagaatggcacaacacggcgaaattctgcggagcgtgcggggcaaaggcagttcctaccgaagctgggacgcggaagcagtgcagcaacgagtcctgcaagaagaggatataccctcgagttgaccccgttgtgattatgttggtcattgataaacaaaatgaccgcgctctcttaagccggcagtcaagatttgtgccccggatgtggagttgtcttgctggttttatagagccaggggaaagcttggaagaggcggtgagaagggaaacatgggaagaaactgggattgaagttgggcaagtcatttaccacagttctcaaccatggcctgttgggccaaataccatgccatgccagctgatggtgggtttctttgcttatgctaaatcattggacatacatgttgataaaaaagagcttgaagatgcccagtggcacagccgtgaggacgtcaagaaggcgctaacgtttgccgagtacgagaaagcccagagatcaagcgcgctcaaggtcaaccagatatgcaagggcacggagagagggcagagcacctcctccgacctcagggtggagagcgaggaacccgctccgatgttcgtccccgggccctacgccatcgctcaccacctcatatcgtcgtgggccttcgaaggggcgccaaaggtgcccagctccttctccaacctatgatgagcctggaccatactacttcgtcttcggatttacggcaggggatgtttgtatagcacactgaaacattgtaggcgcacgccatgtatttcttacgctgtcgatagctacagtagatatgttgttactcattgctggtggttgtaacagaagggcagaagaggaccggggaggatttgcaagatcggcgtcgtggatatattgacggttattggtgatttgatttcaagtgtatgatgtataagaacttgcacggatgtacttgcattgatacatgtacaaactgaagatgaa

SEQ ID NO: 2195 - DNA, 1023 bp, Saccharum officinarum
ggaggagacagagagatggacccggagacgcagcgccagcacgacggcgacggacggcggcgcggcggaggcgtacatcgagcggctccccgtcgacctcctcgcgcacatcctctccctcctgtcgcccttccgcgacctgtccatggctgggggagtgagccgcaggtggcgctgggcggtggagcgggcgctggcgtcgcggcggcggctgagcttcgcgggccagcgcaccggcaacgacaccgccgcgcgcctcatccgcgccgccgtcaacctccgcgacctcgacatctgctggggctgccatattaccgacgaaggcttgatcaagatttcgtccgcgggttgcgtcgccaacctgacgtccatatcgctctggggattggccggcatcaccgacaagggcgtggttcatctggtttccagggcttattctctgcagcacctgaacattggtggaacatttatcacagatgaatccctgtatgcagttgcaaacagctgcacaaatctgaagagcatcatcctgtggagctgccgccacgtgacggaggccgggctggtggcgctggtgaacaagtgccggcggctggagtgcatcaacgtcggcgggatgcgcgtgccgccggagagcttcgtgggcctgctctccatcagccccgccctgcagatcaggtccatcccccgcatcctcaacgccggcgtgcaggtctcttgatcccatccatccatgcatgcatggacgacaaggattatgtatcagtcagttatcaagcctgccatgaacccacattgttgccactggttttcatggaaaaagaattgtcacaatggattcattcatcaaattaaggatcaacatacgtgtgtgtgcgcgcgcgcgctcgtgttatcttattgttgttgtaaaaaaacgatacattatcttgattctgtcttttgtacatgtatacatgttgcacagaacaaataaattgtaccgccactgcaccacaggaagtgctaggaactaggaaaggc

SEQ ID NO: 2196 - DNA, 1256 bp, Setaria italica
atggcgcgagggtgtccacatgatcggctcatccccacgcgcccccggcgcagccgagttccacgccgcgcccgcgtccactcgcgtcgcgtcgcgctgcacgcatcggcgtcacgtgccggtggcgacgtctggcgctacaagaagcccccgcgccccgcaggcctttctgatcagcttctttctccgagcgtcgagcgagagagagagatggagcagcagcagcagctgcgcgacggcgatggcggcgcggcggagggggacatcgagcggctccccgccgacctcctcgcgcacgtcctctccctcctcccctccttccgcgacctctccatggcggggggagtgagccggaggtggcgccgggcggtggagcggtcgctggcgtcgcggcggcggctgagcttcgcggggcagcgtaccggcgacgacaccgccgcgcgcctcgttcgcgccgccgtcaacctccgcgacctcgacatttcacgaagctgctgggggtgccaaatctccgacgaaggcttgatcaagatttcaaccgcggattgcgtcgggaagctgacgtccatatcgctctggggattggctggaattacagataagggcgttgttcagctggtttcaagggcttattctcttcagcacctgaatattggtgggacattcatcacagacgagtccctgaatgcagttgcaaatagctgcacagatctgaagagcatcatcctgtggagctgccggcacgtgacggaggccgggctggtggcgctggtgaacaattgccggcggctggagtgcatcaacgtgggcggcatgcgggtcccgccggagagcttcgtgggcctgctctccatcagccccgccctgcggatcaggtccatcccccagatcctcaacgccggggtgcaggtctcttgattgatgccgccgtccatggacaaggattgttacaaaagcccgccatgagcccatgcccatcactactacttgttcatggcaggaatcatcacaagggatccatgaaataaaggatcaattgttgtttcgtgttgtcctgattattgctctccaaaaaaaagatgtgttgatttgaaaattgtatcttttgtatattcattcacacctgtacatgattttacacagaataagtggtaccaccacaagtacagcttgtgagaggaagggcatacatgactatgtactaatgaaccatatagtaagttaaagttcagataaatcttaatgttcagtttgat

SEQ ID NO: 2197 - DNA, 1192 bp, Pennisetum glaucum
ctcatcccccccgcgccccgacgcagccgagagagtttccacgccgcgcccgcccgcgtccactcgcgtcgcgtcgcgcctgcacgcatcgtcgtcacgtgccgctggcgacgtcctggcgctacaagagaagcaccccgcgcgcccccgcaggccgcaggcctctctgatcagcttcttctttcccgacagagagagagatggagcagcacctgcagctgcgcgacggcgatgagggggacatcgagcggctccccgccgacctcctcgcgcacgtcctctccctcctcccctccttccgcgacctctccatggcggggggagtgagccggaggtggcgccgggcggtggagcggtccctggcgtcgcggcggcggctgagcttcgcggggcagcgcaccggcgacgacaccgccgcgcgcctcgtccgcgccgccgtcaacctccgtgacctcgacatttcacgaagctgctggggttgccaaatcaccgacgaaggcttgatcaagatttcgaccgcggattgcgtcgggaagctgacgtccatctcgctctggggattggctggaattacagacaagggcgttgttcagctggtttcaagggcttattctcttaagcacctgaatattggcgggacattcatcacagacgaatccctgaatgcagtcgcaaatagctgcacaaatctgaagagcatcatcctgtggagctgccggcacgtgacggaggccgggctggtggcgctggtgaacaagtgccggcggctggagtgcatcaacgtgggcggcatgcgggtcccgccggagagcttcgtgggcctgctctccatcagccccgcgctgcagatcaggtccatcccccacatcctcaacgcgggggtccaggtctcttgatggatggtgccgccgtcacccgtcagtcagtccgtccatggacaaggaaggatcgtttacaaagcccgccatgtgcccatcatgcccgtcactacttgttcatggcgggaatcatcagaagggatccatgaaatgaagtaccaattgtttgtttgtactgctgtcttcattgttgctctccaaagaaagaagtgttgatttgaaaattgtatcttttctgtattcacacatgtacatatttctaaactgaataaaattgtaccaccacaagtgcatatttattgtgaaaagaagtg

SEQ ID NO: 2198 - DNA, 1239 bp, Panicum virgatum
agaattccacgccgcgcccgcgtccactcgcgtcgcggtgcacgcatcggcgtcacgtgacggtggcggcgacgtctggcgccacaagaagccccgcccggcgggctttctcagcttcagcgagagagaagcagaagcagcagcgcgacggcgatggcggcgcggcggaggcggacatcgagcggctccccgccgacctcctcgcgcacgtccactccctcctccccaccttccgcgacctctccatggcgggggggagtgagccggaggtggcgccgggcggtggagctgtcgctggcgtcgcggcggccgctgagcttcgcggggcagcgcaccggcgacgacaccgccgcgcgcctcgtccgcgccgccctcaacctccacatatcacgacatctgctggggttgccaaatcaccgacgaaggcttgatcaagatttcgtccgcggattgcgtcgggaacctgacatccatatcgctgtggggattggctggaattactgataaaggcgttgtccagctggtttcaagggcttattctctgcagcacctgaatattggtggcacattcatcacagacgaatccctgaatgcagtcgcaaatagctgcacaaatctgaagagcatcatcctgtggagctgccgccacgtgacggaggccgggctggtggcgctggtgaacaagtgccggcggctggagtgcatcaacgtgggcggcatgcgggtgccgccggagagcttcgtgggcctgctctccatcagccctgccctgcgcatcaggtccatcccccagatcctcaacgccggggtgcaggtctcttgatgatgtgtgtctgtctgtccatggacaaggattttcacgaagccagccatgagcccatcactggttcatggcaagaattgtcagaaagggatacatgaaaggatcaaatgtttgttcacttgtttgtgttgtgttgattgttgttcttctcaaaaaaaaattgattgtatctttaaattataccatcatggcggcacagaataatttggaccatcagaaccacagattgtgctagtaagggcatacatgtactacgaatcatatatcacactgtacatataaagtttagtaggttacagtgcagatacatctcaaaagtgctgattgctgaaccgtcatgcatggacgatctgatgtggtatcatatagtaatgctcagtttgatgggccgatctgataaaagaagagatttggtt

SEQ ID NO: 2199 - DNA, 890 bp, Zea mays
actcctactttattattgtttttattttaatttatttaccgggagagagagaggccgagggagagcagtctctccacaccagtgcggcttttcctttccgttccactccacatcgattcgcctcctccgctctttactcttcgtcgtactcgtctcctcccacccgcaaccgcagggagagaaaggggaagcccgccgccgccccggcccccagcaaccagcagatcgggacctctgttctgcgcaatccatccatggcggaggaatcaggccgtcccttgccaaagtttggtgaatgggatgtcaacgatccggcttccgcagacggatttactgtcatattcaacaaagccagagatgagaagaagggtgggaatggtcaagacacagactcaccttccaaggaccccaggactgagagggtggagtcttatgctgcaaaaccaagcacgaagaaatggttttgttgtgtgacagccagccctacgcaatcctgaggaaggcaattgcatgcgctggaaatactgcccctttaattttctatacatactatccataagacactgtagaggtacccatggctctctgggctccaggatgggtgtctcataaaactctggcgtgcatgtatgtatgtatggtgtgagagttgtcggcatacatttgcaaagtggacttctgcttgtaattctagtcctgtctctcttttttttttcctgttggtctgctagtacgggtccgaatttgtgtgttcgtttcaaagtggattgagtgggattaaacccttcccgttcaaaattgaacatgaagggatataatcctcctcaatcccttccaatctagatgcaactgaacaaaggctccgatccaccaatcctctaaattgtttg

SEQ ID NO: 2200 - DNA, 521 bp, Triticum aestivum
  misc_feature (412)..(412): n is a, c, g, or t
  misc_feature (511)..(511): n is a, c, g, or t
ccgccgccgccccggcccccagcaaccagcagatcgggacctctgttctgcgcaatccatccatggcggaggaatcaggccgtcccttgccaaagtttggtgaatgggatgtcaacgatccggcttccgcagacggatttactgtcatattcaacaaagccagagatgagaagaagggtgggaatggtcaagacacagactcaccttccaaggaccccaggactgagagggttggagtcttatgctgcaaaaccaagcacgaagaaatggttttgttgtgtgacagccagccctacgcaatcctgaggaaggcaattgcatgcgctgggaaatactgcccctttaattttcctatacatactatcccataaagacactgttagaggtacccatggtctcctgggctcccaangatgggtgtctcaataaaaccctggcgtgcatgtagtatgtatggtgtgaagagttgtccggcatacatttgcaaagtgggcttcggcttgtaatccantcctgtcccc

SEQ ID NO: 2201 - DNA, 893 bp, Zea mays
ccttttctttttcaattctccacagcgattcgtctcctctgctcttatctccgctgtgcctgtgcctgacttttcctcctcttcgtcccctcccacccgcaaccgcacagagaaaggggaggaggctctctacccagcgcagcccgagcacccctccgccccggatcgggacccctgctctgcgcaatccacccatggcggaggaatcaggccgccccttgccaaagtttggcgattgggatgttaatgatccagcttccgcagacggattcactgtcatattcaacaaagccagagacgagaagaagggtgggaacggacaagacactgagtcaccttccaaggacaccaggactgagagggtggaatcttatgctgcaaagccaagcacgaagaaatggttttgttgtgtgacagccagccctacgcaatcctgaggaagacaactgcatgcgttttggaaatactgtccctttaattttctatacatactatccataagacaatgtaggggtacccagggctccaggatgggctatctcgtaaaactcttgcgtgcgtgtatgtatggtgtgagagaattcacaaagtggacttctggttgtaattcttagtcgtctctctctctctttttgggttggtcacggttctatgatccagcaatccactgaactgtttggtactgcttctcggatagcttttagaagctgtttgtgtgatgcatcgcagataggttagggagaatgggagatgctgctccgtgcatgaagacagcacactggcgcagggcgtcaaggcgggagggatggggccgcgacggggaggcccagctggagaattggcgcgggctgtgacgacgaggcatctctaagcgcgggcgtgggcctccttcg

SEQ ID NO: 2202 - DNA, 687 bp, Panicum virgatum
gagttctctcccttcctttccacctcgattcgtctccgctcttatcccccgcggcgcccctgcctttcctcttcgtctccgccgccgccgtcgtcgcctcccacccgcgagcgcgccactttcccggcggatcgggacctctgctcggcgcggtccatccatggcggaggaatcaggtcgccccttgcctaagttcggtgaatgggacgtgaacgacccagcttccgctgatggattcacagtgatattcaacaaagccagagatgagaagaagggtggcaatggacaggagactgattctccttccaaggacaccaggaccgagagggtggaatcttacgctgccaagccgaactcgaagaaatggttttgctgtgtgacagccagccccacacaatcctgaggaagacgatctcacccgctcgcgggaatactgcccctttaatttttctatacatactatccataagacagtgtagaggtgcccagcgctctccgggctccaggatgggtacctcgtaaaactctggagtgcgtgtatgtatgtgtgtgtgagggttgtcggcacaaatttgaaaagtggacttctgagttctgattgtaattgtagtcaccgtctgtcttatatttgttggtctcgctgcctgagcctgactgcctgagtgatggatggtgctcttccactgc

SEQ ID NO: 2203 - DNA, 608 bp, Panicum virgatum
cctcgattcgtctccgctctttatcccccgctgcgcccgtgcctttcctctccatctccgccgccgccgccgccgccgtcgcctcccacccgcagccgcaccactctccccggcggatcgggacgtctgctcggcgcggtccatccatggcggaggaatcaggtcgccccttgcctaagtttggtgaatgggatgtgaacgacccagcttccgctgatggattcacggtgatattcaacaaagccagagatgagaagaagggtgggaatggacaggatacagagtctccttccaaggacaccaggaccgagagggtggaatcttatgctgccaagccgaattcgaagaaatggttttgctgcgtgacagccagccccacacaatcctgaagacgatcacccgctcgtgggaatactgcccctttaatttttctatacatactatccataagacagtgtagaggtacccagcgctctccgggctccaggatgggtacctcgtaaaactctggagtgcgtgtatgtatgtgtgtgtgagggttgtcggcacacatttgcaaagtggacttctgagttctgattgtaattgtagtccccccgtctgtctta

SEQ ID NO: 2204 - DNA, 749 bp, Pennisetum glaucum
cggggaggagagaagaaatacgcccccccccactcgaggtagtacaggttctctctccatcaaccgctcctcttttttccacctcgattcgcagtctccgctcgctcttatccccgtccgcctttcccctccgtcgtcgtcgtcttcgtcgtcccctttcccctcctcccacccacgaccgcgcgcggaagtttccccagcggatcgggcgggacctctgctccgcgcaatccgtcgtccatggcggaggaatcaggtcgccccttgcctaagtttggtgaatgggatgtgaacgacccagcttccgctgatggattcacagtgatattcaacaaagccagagatgagaagaaaggtgggaatgggcaagagactgattccccttccaaggacaccaggaccgagagggtggaatcttatgccgccaagccgaactcgaagaaatggttttgctgtgtgacatccagccccacacaatcttgaggaagacaaccaccacctgcttgcggaaatactgcccccctttaattttttttctatacatactatccataagacaatgtagggatacccagggctctccgggctgcaggatgggtgtctcgtaaaactctggagtgcgtgtatgtatgtatgtgtgagggttgtcgacacacatttgcaaagtggacttctgagttctgaattgtaattgtagtcctccatcagtattatctttgttggtctcgcaaccttagtgatgcgaatgg

SEQ ID NO: 2205 - DNA, 765 bp, Setaria italica
cggggaggagagaaatactccctccactcgaggtagtacaagttctctctccatcaaccgcttctcttttccacctcgattcgccgtctccgctcttatccccgctgtgccctgtgcctttcctctccgtcgtcgtcttcgtcgtctcctcccacccgcaaccgcaggacttttcccagcggatcgggacctctgctccgcgcaatccatccatggcggaggaatcaggtcgccccttgcctaagtttggtgaatgggatgtgaacgacccagcttctgctgatggattcacagtgatattcaacaaagccagagatgagaagaagggtgggaatggacaagagaccgagtctccttcgaaggacaccaggaccgagagggtggaatcttatgccgccaagccaaactcgaagaaatggttttgctgcgtgacatccagccccacacaatcttgaggaagacaaccacccgcttgcggaaatactgcccctttaattttttctatacatactatccataagacaatgtagggatacccagggctctccgggctccaggatgggtatctcgtaaaactctggagtgcgtgtatgtatgtgtgggtgttgtcgacacacatttgcaaagtggacttccgagttatgaattgtaattgtagtcctccatcagtcttatccttgttggtctcgctacctcagtgatgcgaatggatatgtggtctgtggattggtagaaaacagtagcgatgcagtagggagcgtttag

SEQ ID NO: 2206 - DNA, 550 bp, Cynodon dactylon
aagaggagactttcttcccccccgaccccaacgaacgtctttggcttgaccccgccggcggatcaaagaacccgtccatgtcggaggaatcaggtcgccctttacctaagtttggtgagtgggatgtcaatgacccagcttccgctgacggattcacagtgatattcaacaaagctagagatgagaagaagggtgggaatgggcaagacaccgattctccctgtaaggacactaggactgagagagtggaatcttatgctgccaagccaaactcgaagaagtggttttgctgtgtgacgtccagtcccacacaatcctgaggaagacgatcttgcaagtagcaaagatacggggcttaatttttttttccctttatacatactatccataagtccttgtagaggtagccaaggctctctgggcctctgggatgggtgcctcataaaactctgaagtgtgtgtatgtatttgtgagggttatcaaacacagctggataagtggtcgtcatttgtaaaagtggacttctgattgccattcttaccttcctca

SEQ ID NO: 2207 - DNA, 755 bp, Setaria italica
acctcgattcgccgtctccgctcttatccccgctgtgccctgtgcctttcctctccgtcgtcgtcttcgtcgtctcctcccacccgcaaccgcaggacttttcccagcggatcgggacctctgctccgcgcaatccatccatggcggaggaatcaggtcgccccttgcctaagtttggtgaatgggatgtgaacgacccagcttctgctgatggattcacagtgatattcaacaaagccagagatgagaagaagggtgggaatggacaagagaccgagtctccttcgaaggacaccaggaccgagagggtggaatcttatgccgccaagccaaactcgaagaaatggttttgctgcgtgacatccagccccacacaatcttgaggaagacaaccacccgcttgcggaaatactgcccctttaattttttctatacatactatccataagacaatgtagggatacccagggctctccgggctccaggatgggtatctcgtaaaactctggagtgcgtgtatgtatgtgtgggtgttgtcgacacacatttgcaaagtggacttccgagttatgaattgtaattgtagtcctccatcagtcttatccttgttggtctcgctacctcagtgatgcgaatggatatgtggtctgtggattggtagaaaacagtagcgatgcagtagggagcgtttagttctaccagtatatgcactcaatcttgtctgggtgttatttttacatttcacggtggggact

SEQ ID NO: 2208 - DNA, 569 bp, Eragrostis curvula
  misc_feature (530)..(530): n is a, c, g, or t
  misc_feature (543)..(543): n is a, c, g, or t
tcccaacgtctcttgcgccggccgccggatcaaagcagcccatccatgtcggaggaatcaggtcgccctttacctaagtttggtgaatgggatgtcaacgacccagcttctgctgacggattcacagtgatattcaacaaagctagagacgagaagaagggcggaaatgggcaagacaccgattctccttgcaaggacactaggactgagaggtcggaatcttatgctgccaagccaaactcgaagaaatggttttgctgtgtgacgtccagtccaacacaatcctgaggatgatggttgccgcgggtagcgaagatactgggctttaaaattttccctttatacatactatcataagtccttgtagaggtagccgaggctctctgggcctctgggatgagtgcctcgtaaaactctggagcgtgtgtatgtatttgtgagggttatcagacacaattggataagtggtcttcatttgtgaaagtggacttctggttgtaattcatatcttccactacgtccatctcaanagtggcaattcantgatgcgaatggagtgcattcatgtg

SEQ ID NO: 2209 - DNA, 594 bp, Avena sativa
tcccctcccctcccaaccgacgagcgagactttcccccaagctcatcttcgtcctcggatcgggctccggccggcgccgctcaatccatgtcggaggaatctggtcgccctctacccaagtttggcgaatgggacgtcaacgacccagcttctgctgatggcttcacagtcatattcaacaaagccagggatgagaaaaaagctgggaatggacaagatactgagtctccttgcaaagacacccggactgagagggtggaatcttatgccaccaaggcgaacacgaagaaatggttttgctgcgtgacgcccagccctacacaatcttgaagtgtcaccggaaggaagaaatggtcgtgaaagtatggtcctttgattttgctatatatacatactactatccataagacccttgtaagaggtacccgggccgtcacgatgggtacctaccatgtaaaactttgaagtgtgtatgtatggtgtgagggttgtcagacactcagtatggttggataagtgaacttctgattgtaattctggcctttccttgttggtctcattttgtgcagtagcggtcatagttctgtgtctacg

SEQ ID NO: 2210 - DNA, 577 bp, Avena sativa
acgagcgagacctttcccccaagctcatcttcgtcctcggatcgggctccggccggcgccgctcaatccatgtcggaggaatctggtcgccctctacccaagtttggcgaatgggacgtcaacgacccagcttctgctgatggcttcacagtcatattcaacaaagccagggatgagaagaaggctgggaatggacaagatactgagtccccttgcaaggacacccggactgagagggtggaatcttatgccaccaaggcgaacacgaagaaatggttttgctgcgtgacgcccagccctacgcaatcttgaagtgtcaccggaaggaagaaatggtcgtgaaagtatggtcctttgattttgctatatatacatactactatccataagacccttgtaagaggtacccagggccgtcacgatgggtacctaccatgttaaaactttgaagtgtgtatgtatgatgtgagggttgtcagacactcggtatggttggataagtgaacttctgattgtaattctggcattccttgttggtctcattttgtgcagtagtggtcatagttctgtgtctacg

SEQ ID NO: 2211 - DNA, 917 bp, Brachypodium distachyon
gcttttggagaggagaaaaaaaaaaatcttttctctcttctggggggtttctctttctcattctttctttctccccctcttctctaggtggagtataaatctatcaatcaaccgctgctacttttccactccgattcgtcgcctcctcccctcccggccgctgctgctgccccttatccccgtccctttcccctcccacccgcccgcaaccagcgaactttcccctccccggtggatcggacctccgccgcgctcaatccatgtcggaggaatcaggtcgccctttacccaagtttggagaatgggacgtcaatgacccagcttctgctgatggattcacggttatattcaacaaagcaagagatgagaaaaaggctgggaatggacaagatactgaatctccttgcaaagacacaaggactgagagggtggaatcttatgccgccaagacaaactcaaagaaatggttttgctgtgtgacacccagtcctacacaatcttaagggggaagacaagtgtcagcagaagaaatggtcgcgaaagtatggtcctttaattttgctatatatacatactatccataagaacttgtagagatagccaggctctctgggccatcacgatggttatctcataaaactctgaagtgtgtgtatgtatggtgtgagggttatcagacatcatttggataagtgaacttctgattgtaattctggtcttccccatcgatctgcttttgtgctatagtggagtacttcctctgatcctaagttcttactcaaatttgcccaaatatggatgtatctgttcttaaaaaacgtctagatacatgtaatatttcgacaacaatttaggatcggagggagcagtatttaagtgatgatatgaaccggtctggcctgttgctacatctccaa

SEQ ID NO: 2212 - DNA, 929 bp, Brachypodium distachyon
cttgcttttggagaggagaaaaaaaaaaatcttttctctcttctggggggtttctctttctcattctttctttctccccctcttctctaggtggagtataaatctatcaatcaaccgctgctacttttccactccgattcgtcgcctcctcccctcccggccgctgctgctgccccttatccccgtccctttcccctcccacccgcccgcaaccagcgaactttcccctccccggtggatcggacctccgccgcgctcaatccatgtcggaggaatcaggtcgccctttacccaagtttggagaatgggacgtcaatgacccagcttctgctgatggattcacggttatattcaacaaagcaagagatgagaaaaaggctgggaatggacaagatactgaatctccttgcaaagacacaaggactgagagggtggaatcttatgccgccaagacaaactcaaagaaatggttttgctgtgtgacacccagtcctacacaatcttaagggggaagacaagtgtcagcagaagaaatggtcgcgaaagtatggtcctttaattttgctatatatacatactatccataagaacttgtagagatagccaggctctctgggccatcacgatggttatctcataaaactctgaagtgtgtgtatgtatggtgtgagggttatcagacatcatttggataagtgaacttctgattgtaattctggtcttccccatcgatctgcttttgtgctatagtggagtacttcctctgatcctaagttcttactcaaatttgcccaaatatggatgtatctgttcttaaaaaacgtctagatacatgtaatatttcgacaacaatttaggatcggagggagcagtatttaagtgatgatatgaaccggtctggcctgttgctacatctccaattcccgcct

SEQ ID NO: 2213 - DNA, 790 bp, Cenchrus ciliaris
gcattatgacacctgcatatttagcggaacccaatcaccaaagtcttgtacgtttctgtcttttcctcaattgtctcttatgtaccatgtctgcattttgctgcttgcaaaagctggtgtttactttgttagtagatacatatgctgacacaagctcagcaatgtcagcatctctgatttctaataacagcagttgcttgggcactagcagcatgtcccagtatttcaccgttatgccactctcagtacaaaataacaagtagattcactcttcatggattctgttgtgttttccaggaggaatcaggtcgccccttgcctaagtttggtgaatgggatgtgaacgacccagcttccgctgatggattcacagtgatattcaacaaagccagagatgagaagaaaggtgggaatggacaagagaccgattccccttccaaggacccaaggaccgagaaggtggaatcttatgccgccaagccgaactcgaagaaatggttttgctgcgtgacatccagccccacacaatcttgaggacgacaaccaccaccgtacccgcttgcggaaatactgcccccctttaattttttttttctatacatactatccataagacaatgtagggatacccagggctctccgggctccaggatgggtgtctcgtaaaactctggagtgcgtgtatgtatgtgtgagggttgtcgacacacatttgcaaagtggacttctgagttctgaattgtaattgtagtcctccatcagtgttatcattgttggtcttgccacctta

SEQ ID NO: 2214 - DNA, 688 bp, Avena sativa
ccgtattcgccgtcgcctcttccccctcctcctccagtcctcctccttatcccgtccctttcccctcccctcccctcccctcccaaccgacgagcgagactttcccccaagctcatcttcgtcctcggatcgggctccggccggcgccgctcaatccatgtcggaggaatctggtcgccctctacccaagtttggcgaatgggacgtcaacgacccagcttctgctgatggcttcacagtcatattcaacaaagccagggatgagaaaaaagctgggaatggacaagatactgagtctccttgcaaagacacccggactgagagggtggaatcttatgccaccaaggcgaacacgaagaaatggttttgctgcgtgacgcccagccctacacaatcttgaagtgtcaccggaaggaagaaatggtcgtgaaagtatggtcctttgattttgctatatatacatactactatccataagacccttgtaagaggtacccgggccgtcacgatgggtacctaccatgtaaaactttgaagtgtgtatgtatggtgtgagggttgtcagacactcagtatggttggataagtgaacttctgattgtaattctggcctttccttgttggtctcattttgtgcagtagcggtcatagttctgtgtctacgacgaaaaaatcgctgcgcatcttc

SEQ ID NO: 2215 - DNA, 518 bp, Triticum aestivum
  misc_feature (324)..(324): n is a, c, g, or t
  misc_feature (366)..(366): n is a, c, g, or t
  misc_feature (375)..(375): n is a, c, g, or t
  misc_feature (386)..(386): n is a, c, g, or t
  misc_feature (419)..(419): n is a, c, g, or t
  misc_feature (421)..(421): n is a, c, g, or t
  misc_feature (426)..(426): n is a, c, g, or t
  misc_feature (441)..(441): n is a, c, g, or t
  misc_feature (449)..(449): n is a, c, g, or t
  misc_feature (457)..(457): n is a, c, g, or t
  misc_feature (485)..(485): n is a, c, g, or t
  misc_feature (487)..(487): n is a, c, g, or t
  misc_feature (512)..(512): n is a, c, g, or t
ctctttcttatctccgctgtgcctgtgcctgacttttcctcctcttcgtcccctcccacccgcaaccgcacagagaaaggggaggaggctctctacccagcgcagcccgagcacccctcccccccggatcgggacccctgctctgcgcaatccacccatggcggaggaatcaggccgccccttgccaaagtttggcgattgggatgttaatgatccagcttctgcagacggattcactgtcatattcaacaaagccagagatgagaagaagggtgggaacggacaagacactgagtcaccttccaaggacaccaggactgaganggttggaatcttatgctgcaaagccaagcacgaagaaatggntttgttgtnttaaaagcaancctacgcaatcctgaggaagacaactgcatgcncnttggnaatacgtcccttaantttccatncatactancataagacaatttggggtaccaagctcncnggctcaagatgggtatccctaaaancttgct

SEQ ID NO: 2216 - DNA, 672 bp, Secale cereale
cccctccctcccacccgcagccgacgaaactttcccccaagcccctcggtggatcggaccgccgcgctcaatccatgtcggaggaatctggtcgccctttgcccaagtttggcgaatgggacgtcaacgacccagcttctgctgatggattcacagttatattcaacaaagccagggatgagaagaaggctgggaatggacaagataccgaatcacctagcaaagacgccaggactgagagggtggaatcttatgccaccaaggcaaattcaaagaagtggttctgctgcgtgacgccaagtcctacacaatcttgaggaggacaagcgtcacccgaagaagattggttgcgaaagtatggtcgtttaattttgctatatacatactatccataagaccttgtaagaggtacccaagccccctgggccgtcacgatgggtatctcgtaaaactctgaaacgtttgtatgtatggtgtgagggttgtcagacgctcgtttggataagtgaacttctgattgtaattctggtcttccttgtcggtctcgttttgtgtagcagtagtggtgaagttgatatgtgatttgagtctcgcctattgccagaactgcaaacatccaaaattccaatcccccaccttgatttggcccgttatgtgataacacaagtatcc

SEQ ID NO: 2217 - DNA, 635 bp, Secale cereale
ttcccccgtctcgaggtataaatccgtcaatcggctgctgctcctttccacttcgattcgccgtctcctcctcctccccccttcccctccgtctcgctcctcgcccttatccccgtccctttcccctccctcccacccgcagccgacgaaactttcccccaagcccctcggtggatcggaccgccgcgctcaatccatgtcggaggaatctggtcgccctttgcccaagtttggcgaatgggacgtcaacgacccagcttctgctgatggattcacagttatattcaacaaagccagggatgagaagaaggctgggaatggacaagataccgaatcccctagcaaagacgccaggactgagagggtggaatcttatgccaccaaggcaaattcaaagaagtggttctgctgcgtgacgccaagtcctacacaatcttgaggaggacaagcgtcacccgaagaagattggttgcgaaagtatggtcgtttaattttgctatatacatactatccataagaccttgtaagaggtacccaagccccctgggccgtcacgatgggtatctcgtaaaactctgaaacgtttgtatgtatggtgtgaggttgtcagacgctcgtttggataagtgaacttc

SEQ ID NO: 2218 - DNA, 575 bp, Secale cereale
ttcccccaacgccctcggtggatcggaccgccgcgctcaatccatgtcggaggaatctggtcgccctttgcccaagtttggcgaatgggacgtcaacgacccagcttctgctgatggattcacagttatattcaacaaagccagggatgagaagaaggctgggaatggacaagataccgaatcacctagcaaagacgccaggactgagagggtggaatcttatgccaccaaggcaaattcaaagaagtggttctgctgcgtgacgccaagtcctacacaatcttgaggaggacaagcgtcacccgaagaagattggttgcgaaagtatggtcgtttaattttgctatatacatactatccataagaccttgtaagaggtacccaagccccctgggccgtcacgatgggtatctcgtaaaactctgaaacgtttgtatgtatggtgtgagggttgtcagacgctcgtttggataagtgaacttctgattgtaattctggtcttccttgtcggtctcgttttgtgtagcagtagtggtgaagttgatatgtgatttgagtctcgcctattgccagaa

SEQ ID NO: 2219 - DNA, 1023 bp, Oryza sativa
gccctgtgggccccgcccccacccgccgacgcgtgggcccccacacgccgccggccgcggcgggtcacatgcgcgtcgtccaaactccgaggcgcgcacgaaaaagagagagacaaaaaaaaaagaaaagagaaattctttttaggcgctctaggtataaaaatctactcctactcatcaactacttttccacttcgattcctctccccttccccctcctcttcctccctctcctctcctctcctctccgccgctgccgctgctgctgcgtgctcctctcatccccgtctcttccccctccgcgcgcgccgcccactcgctgggaggaggaggaagaggagaccttccccggaattcgtgctcgccggatcgggctcgccgcaatccatgtcggaggaagcaggtcgtcccttgcccaagtttggtgaatgggatgtcaacgacccagcgtccgctgatggattcacagtgatattcaacaaagccagagatgagaaaaagggtgggaatgggcaagatactgattcaccctgcaaagaaactaggactgagagggtggaatcatatgcccccaagacaaactcgaagaaatggttttgctgcgtgacatccagtcctacacaatcttgatgaaaacgagttccatgggttgcaaaattactatcctttaattttgctatatacatactatccataagaccttttagagatgcccagactctactgcggtgctagattgggcatctcttaaaactttgaggtgtgtgtatgtatgtgtgagggttatcagatgcacattcggataaatgaacttctgattgtaattctagccttccgtcctgtgacattctgtgatgtagtcgttattcagtgatataatgaatctcacctattgatataactgcacactgtttctcttgctttccgaggaaacaaacactgttttaccaaagttggctgtgctccaaaagaggattaaattccatatgattctcatattgcaattgcaattttgattctctc

SEQ ID NO: 2220 - DNA, 717 bp, Oryza sativa
acttttccacttcgattcctctccccttccccctcctcttcctccctctcctctcctctcctctccgccgctgccgctgctgctgcgtgctcctctcatccccgtctcttccccctccgcgcgcgccgcccactcgctgggaggaggaggaagaggagaccttccccggaattcgtgctcgccggatcgggctcgccgcaatccatgtcggaggaagcaggtcgtcccttgcccaagtttggtgaatgggatgtcaacgacccagcgtccgctgatggattcacagtgatattcaacaaagccagagatgagaaaaagggtgggaatgggcaagatactgattcaccctgcaaagaaactaggactgagagggtggaatcatatgcccccaagacaaactcgaagaaatggttttgctgcgtgacatccagtcctacacaatcttgatgaaaacgagttccatgggttgcaaaattactatcctttaattttgctatatacatactatccataagaccttttagagatgcccagactctactgcggtgctagattgggcatctcttaaaactttgaggtgtgtgtatgtatgtgtgagggttatcagatgcacattcggataaatgaacttctgattgtaattctagccttccgtcctgtgacattctgtgatgtagtcgttattcagtgatataatgaatctcacctattgatata

SEQ ID NO: 2221 - DNA, 983 bp, Hordeum vulgare
ccggccgacacgcgggccccgccggccgcgcggctcacatgcgtgcgcgtcccccgtagaaaacctcccgctgcctctctctgcttcgcttcgcttgggacgggaaaaaatatctgtttttacggggctgcggggtgcgtttcccccgtctcgaggtataaatccgtctgctccttttccacttcgattcgtcgtctcctcctccgctccgtcgctcgcccttatccccgtccctttccccttcctcctcccaccagcagccgacgaaactttcccccaagcccctctccctccccctcggcggatcggaccgccgccgcgctcaatccatgtcggaggaatctggtcgccctttgcccaagtttggcgaatgggacgtcaacgacccagcttctgctgatggattcacagttatattcaacaaagccagggatgagaaaaaggctgggaatggacaagatactgaatccccttgcaaagacgccaggactgagagggtggaatcttatgccaccaaggcaaattcaaagaagtggttttgctgcgtgacgccaagtcctacacaatcttgaggaggacaagctgccaccccagaagaagaatggttgggaaagtatggtcgtttaattttgctatatacatactatccataagaccttgtaagaggtacccaggctccctgtgccatcgcgatgggtatctcgtaaaactctgaagtgtttgtatgtatggtgtgagggttgccagacactcgtttggataagtgaacttctgattgtaattctggtcttccttgtgggtctccttttgtgtagtcgtagtggtggtgaagttgatatatgatttgagtctcgcgtattgcctgaactgcaaacatccaaaattccaatgcccacctgtggtatggcccattatgtgttatcacaagtatttttatccttttctgtccttgttcacctcactgtgagctgccctatttggac

SEQ ID NO: 2222 - DNA, 520 bp, Secale cereale
tccatgtcggaggaatctggtcgccctttgcccaagtttggcgaatgggacgtcaacgacccagcttctgctgatgggttcactgttatattcaacaaagccagggatgagaaaaaggctgggaatggacaagatactgaatcccctggcaaagatgccaggactgagagggtggaatcttatgccaccaaggcaaattcaaagaagtggttttgctgcgtgacaccaagtcctacacaatcttgaggaggacaagcgtcgcccgaagaaaaaatggttgccgaagtatggtcgtttaattttgctatatacatactatccataagaccttgtaagaggtacccaggctccctgggccatcacgatgggtatctcgtaaaagatgggtatctcgtaaaactctgaagtgtgtgtatgtatggtgtgagggttgtcagacactcagtttggataagtgaacttctgattgtaattctggtcttccttgtcggtctcgttttgtgtagtagtagtggtgaag

SEQ ID NO: 2223 - DNA, 1056 bp, Triticum aestivum
cccccttcccctccgtctcgctcctcgcccttatccccgtccctttccccttcctcccacccgcagccgacgaaactttccccacgcccctcggcggatcggaccgccgcgctccatccatgtcggaggaatctggtcgccctttgcccaagtttggcgaatgggacgtcaacgacccagcttctgctgatgggttcactgttatattcaacaaagccagggatgagaaaaaggctgggaatggacaagataccgaatccccttgcaaagatgccaggactgagagggtggaatcttatgccaccaaggcaaattcaaagaagtggttttgctgcgtgacaccaagtcctacacaatcttgaggaggacaagcgtcgcccgaagaaaaaatggttgcgaaagtatggtcgtttaattttgctatatacatactatccataagaccttgtaagaggtacccagcccccctgggcatatcgcgatgggtatctcgtaaaactctgaagtgtgtatgtatggtgtgagggttgtcagacactcatttggataagtgaacttctgattgtaattctggtctccttgtcggtctccttttgtgtagtagtagtggtgaagttgatatgtgatttgagtctcgcctattgccagaactgcatacatccaaaattccaatccccacctgtgatttggccccaccaaacaaacccaccacccccaccagcatcaatatctccaaggaagaggacatgtgattcgacccttcaccggaaaaggggggccggctaaaattttccccggggggcccaagtttaccgttcccaattttttggaaaaaaggggccccctaaggggggttgttttataagcttgggccgggcgcgtggtttcaaaacctggggaatgggaaaacgggcccactggggaactttgggaaaggaaccctacttctgtgggggggggacaaaggggggaaacaccctacagagatttaaggcccctagggaaaattaaaattttgagggtgataaaggggttaacaaaaccgggattgtgggg

SEQ ID NO: 2224 - DNA, 962 bp, Triticum aestivum
tgcgtgcgcgtcccccgtacaaagcgagccagccactgccgctgccgctgctgctcgggggagaaaaaatatctttttttacggggccgcggggtgcgtttcccccgtctcgaggtataaatccgtcaatcggctgctgctccttttccacttcgattcgccgtctcctcctcccccttcccctccgtctcgctcctcgcccttatccccgtccctttccccttcctcccacccgcagccgacgaaactttccccaagcccctcggtggatcggaccgccgcgctccatccatgtcggaggaatctggtcgccctttgcccaagtttggcgaatgggacgtcaacgacccagcttctgctgatgggttcactgttatattcaacaaagccagggatgagaaaaaggctgggaatggacaagatactgaatcccctggcaaagatgccaggactgagagggtggaatcttatgccaccaaggcaaattcaaagaagtggttttgctgcgtgacaccaagtcctacacaatcttgaggaggacaagcgtcgcccgaagaaaaaatggttgccgaagtatggtcgtttaattttgctatatacatactatccataagaccttgtaagaggtacccaggctccctgggccatcacgatgggtatctcgtaaaagatgggtatctcgtaaaactctgaagtgtgtgtatgtatggtgtgagggttgtcagacactcagtttggataagtgaacttctgattgtaattctggtcttccttgtcggtctcgttttgtgtagtagtagtggtgaagttgatatgtgatttgagtctcgcctattgccagaactgcaaacatccaaaattccaatccctacctgtgatttggcccattattatgtgataacacaagtatccttatccttttctgtccgtgctgacctaactattcgctgccctatttggac

SEQ ID NO: 2225 - DNA, 1265 bp, Hordeum vulgare
accaacagccgacgaaactttcccccaagcccctctccctccccctcggcggatcggaccgccgccgcgctcaatccatgtcggaggaatctggtcgccctttgcccaagtttggcgaatgggacgtcaacgacccagcttctgctgatggattcacagttatattcaacaaagccagggatgagaaaaaggctgggaatggacaagatactgaatccccttgcaaagacgccaggactgagagggtggaatcttatgccaccaaggcaaattcaaagaagtggttttgctgcgtgacgccaagtcctacacaatcttgaggaggacaagctgccaccccagaagaagaatggttgggaaagtatggtcgtttaattttgctatatacatactatccataagaccttgtaagaggtacccaggctccctgtgccatcgcgatgggtatctcgtaaaactctgaagtgtttgtatgtatggtgtgagggttgccagacactcgtttggataagtgaacttctgattgtaattctggtcttccttgtgggtctccttttgtgtagtcgtagtggtggtgaagttgatatatgatttgagtctcgcgtattgcctgaactgcaaacatccaaaattccaatgcccacctgtggtatggcccattatgtgttatcacaagtttttttatcctttaaaaaaaaaaaaaaaaaaactctaggggggccccgggcacccatatcgccttatattgaattctttttacatttaactgccccgtttttttacaacctccttaattggaaaaacccctgcccgttccccaacttaattcccctttgcacacaattcccctttttccccattttggctttataaccaaaaaaggcccccacccaatcgccctttcccaaacaattttcccacccctttaatggcaaaatgaccaaaattgtaaccctttaaaatttttcttaaaaaattcccttttaaattttcttttaaaataaccttatttttttaacccaatatctgccttaaattcgcgcaaaatccccctctttaaacccaacaaaaatatccccccaatatagggttacaagtgtcttttccaactttctaaaacctaaaaattacctcttttcagaaaaaagctggaatctccaaccttccaaatgccgtaaacaaaatctcttttatataggtccaatagctccccatatctctttaatcatcttactcctctataaccaatatttgtctatgagacc

SEQ ID NO: 2226 - DNA, 662 bp, Festuca arundinacea
  misc_feature (80)..(80): n is a, c, g, or t
  misc_feature (94)..(95): n is a, c, g, or t
  misc_feature (119)..(119): n is a, c, g, or t
  misc_feature (343)..(343): n is a, c, g, or t
ggcacgaggcggcgtctccggtcctccctccctcctcgcccttatccccgtcactttccctttcctcccaaccgcaccgncgaaactttccccnncctcctcctccgccgcggatcggnctcggacggcggcgctcatatccatgtcggaggaatctggtcgccctctacccaagtttggcgaatgggacgtcaacgacccagcttctgctgatggattcacagtcatcttcaacaaagccagagatgagaaaaaggctgggaatggacaagataccgaatccccttgcaaagacgccaggactgagagggtggagtcctatgccaccaaggcgaattcaaanaaatggttttgctgcgtgacgcccagtcctacacaatcttgaagtgtcacccgaagaaatggttgcgaaaagtatggtcctttgattttgctatatacatactatccataagatccttgtaagaggtacctgggccgtcacgatgggtatctcgtaaaactctgaagtgtgtatgtatggtttgagggttgtcggacacagatttggttggataagtgaacttctgattgtaattctggtctttggtgtcggtttcattttgtgcagtagtggtcatagttttgtgtcaacgcaaaaatatacatgttcctcttctgtt

SEQ ID NO: 2227 - DNA, 343 bp, Setaria italica
ctgacccgctctcccgatctgaaactttccccaagcccctcggtggatcggaccgccgcgctcaatccatgtcggaggaatctggtcgccctttgcccaagtttggcgaatgggacgtcaacgacccagcttctgctgatgggttcactgttatattcaacaaagccagggatgagaagaaggctgggaatggacaagataccgaatccccttgcaaagatgccaggactgagagggtggaatcttatgccaccaaggcaaattcaaagaagtggttttgctgcgtgacgccaagtcctacacaatcttgaggaggacaagcatcgcctgaagaagaatggtt

SEQ ID NO: 2228 - DNA, 785 bp, Triticum aestivum
tcttttttacggggccgcggggtgcgtttcccccgtctcgaggtataaatccgtcaatcgactgctgctccttttccacttcgattcgccgtctcctcctcccccttcccctccgtctcgctcctcgcccttatccccgtccctttccccttcctcccacccgcagccgacgaaactttccccaagcccctcggtggatcggaccgccgcgctccatccatgtcggaggaatctggtcgccctttgcccaagtttggcgaatgggacgtcaacgacccagcttctgctgatgggttcactgttatattcaacaaagccagggatgagaaaaaggctgggaatggacaagataccgaatccccttgcaaagatgccaggactgagagggtggaatcttatgccaccaaggcaaattcaaagaagtggttttgctgcgtgacaccaagtcctacacaatcttgaggaggacaagcgtcgcccgaagaaaaaatggttgccgaagtatggtcgtttaattttgctatatacatactatccataagaccttgtaagaggtacccaggctccctgggcaatcgcgatgggtatctcgtaaaactctgaagtgtgtgtatgtatggtgtgagggttgtcagacactcagtttggataagtgaacttctgattgtaattctggtcttccttgtcggtctcgttttgtgtagtagtagtggtgaagttgatatgtgatttgagtctcgcctattgccagaactgcaaacatccaaaattccaatccccacctg

SEQ ID NO: 2229 - DNA, 665 bp, Lolium multiflorum
agcgtggtcgcggccgaggtacgtcggggtcggaggaatctggtcgccctctacccaagtttggcgaatgggacgtcaacgacccagcatctgctgatggattcacagtcatcttcaacaaagccagagatgagaaaaaggctgggaatggacaagataccgaatccccttgcaaagatgccaggactgagagggtggagtcctatgccaccaaggcgaattcaaagaaatggttttgctgcgtgacgcccagtcctacacaatcttgaagtgtcacccaaagaaatggttgcgaaaagtatggtcctttgattttgctatatacatactatccataagatccttgtaagaggtaccttggccgtcacgatgggtatctcgtaaaactctgaagtgtgtatgtatggtttgagggttgtcagacacagatttggttggataagtgaacttctgattgtaattctggtcttcgttgtcggtttcattttgtgtagtagtggtcgtagttctgtgtcagcgcaaaaatatatacctgttccttttctgtttttcccttgcctgttctctacctagatctcctattgtcctattggacctatgtttccgtaagccgatatttggcagtttcagaagggaactttggctagcagctggctgacagccag

SEQ ID NO: 2230 - DNA, 755 bp, Triticum aestivum
gtctcgaggtataaatccgtcaatcggctgctgctccttttccacttcgattcgccgtctcctcctcctcccttcccctccgtctcgctcctcgcccttatccccgtccctttcccctcccttcctcccacccgcagccgacgaaactttccccaagcccctcggtggatcggaccgccgcgctcaatccatgtcggaggaatctggtcgccctttgcccaagtttggcgaatgggacgtcaacgacccagcttctgctgatgggttcactgttatattcaacaaagccagggatgagaagaaggctgggaatggacaagataccgaatccccttgcaaagacgccaggactgagagggtggaagcttatgccaccaaggcaaattcaaagaagtggttttgctgcgtgacgccaagtcctacacaatcttgaggaggacaagcatcgcctgaagaagaatggttgcgaaagtatggtcgtttaattttgctatatacatactatccataagaccttgtaagaggtacccaggccccctgggccatcacgatgggtatctcgtaaaactctgaagtgtgtatgtatggtgtgagggttgtcagacactcgtttggataagtgaacttctgattgtaattctggtcttccttgtcggtctccttttgtgtagtagtagtagtggtgaagttgatatatgatttgagtctcgcctattgccagaactgcatacatccaaaattccaaaccccacctg

SEQ ID NO: 2231 - DNA, 820 bp, Triticum aestivum
gaaaaaatatctttttttacggggccgcggggtgcgtttcccccgtctcgaggtataaatccgtcaatcggctgctgctccttttccacttcgattcgccgtctcctcctcctcccttcccctccgtctcgctcctcgcccttatccccgtccctttcccctcccttcctcccacccgcagccgacgaaactttccccaagcccctcggtggatcggaccgccgcgctcaatccatgtcggaggaatctggtcgccctttgcccaagtttggcgaatgggacgtcaacgacccagcttctgctgatgggttcactgttatattcaacaaagccagggatgagaagaaggctgggaatggacaagataccgaatccccttgcaaagacgccaggactgagagggtggaagcttatgccaccaaggcaaattcaaagaagtggttttgctgcgtgacgccaagtcctacacaatcttgaggaggacaagcatcgcctgaagaagaatggttgcgaaagtatggtcgtttaattttgctatatacatactatccataagaccttgtaagaggtacccaggccccctgggccatcacgatgggtatctcgtaaaactctgaagtgtgtatgtatggtgtgagggttgtcagacactcgtttggataagtgaacttctgattgtaattctggtcttccttgtcggtctccttttgtgtagtagtagtagtggtgaagttgatatatgatttgagtctcgcctattgccagaactgcatacatccaaaattccaaaccccacctgtgatttggcccattatgtgat

SEQ ID NO: 2232 - DNA, 621 bp, Secale cereale
gtccacgccggaccgaaaactttccccctaacgacccgtccggtcggagtcggaccgccgcgctcaatccatgtcggaggaagtctggtcgtcccttacgccgaagttggcggaatgggacgtcaacgacccagcttctgctgatggattcacagttatattcaacaaagaccagggatgagaagaaggctgggaatggacaagataccgaatcacctagcaaagacgccaggactgagagggtggaatcttatgccaccaaggcaaattcaaagaagtggttctgctgcgtgacgccaagtcctacacaatcttgaggaggacaagcgtcacccgaagaagattggttgcgaaagtatggtcgtttaattttgctatatacatactatccataagaccttgtaagaggtacccaagccccctgggccgtcacgatgggtatctcgtaaaactctgaaacgtttgtatgtatggtgtgagggttgtcagacgctcgtttggataagtgaacttctgattgtaattctggtcttccttgtcggtctcgttttgtgtagcagtagtggtgaagttgatatgtgatttgagtctcgcctattgccagaactgcaaacatccaaa

SEQ ID NO: 2233 - DNA, 548 bp, Secale cereale
cgccctttgcccaagtttggcgaatggacgtcaacgacccagcttctgctgatggattcacagttatattcaacaaagaccagggatgagaagaaggactgggaatggacaagataccgaatcacctagcaaagacgccaggactgagagggtggaatcttatgccaccaaggcaaattcaaagaagtggttctgctgcgtgacgccaagtcctacacaatcttgaggaggacaagcgtcacccgaagaagattggttgcgaaagtatggtcgtttaattttgctatatacatactatccataagaccttgtaagaggtacccaagccccctgggccgtcacgatgggtatctcgtaaaactctgaaacgtttgtatgtatggtgtgagggttgtcagacgctcgtttggataagtgaacttctgattgtaattctggtcttccttgtcggtctcgttttgtgtagcagtagtggtgaagttgatatgtgatttgagtctcgcctattgccagaactgcaaacatccaaaattccaatcccccacctt

SEQ ID NO: 2234 - DNA, 913 bp, Triticum aestivum
tcggtcggcgtcatggcatacaacggccgtgaccagcggtacggcggcggcatcgctacgccggggtacgcaccgccggtgccgtacgggatgtcgcaggtgaacatcgagggcaacgggtgcggtcggccgctgccgccgcagccgaccgtgaaggtgtactgccgcgccaaccccaactacgccatgaccatccgcgacggcagggtggtgctggcgccggcgaaccccaaggacgagtaccagcactggatcaaggacatgaggtggagcacgagcatcaaggacgaggaaggttacccggcgttcgcgctggtgaacaaggcgaccggggaggccatcaagcactcgctggggcagtcccacccggtgcgcctggtgccctacaacccggacttcctggacgagtccgtgctctggaccgagagccgcgacgtcggcaacggattccgatgcatccgcatggtcaacaacatctacctcaacttcgatgccctccacggcgacaagtggcacggcggtgtccgcgacggcaccgacatcgtgctctggaagtggtgcgagggcgacaaccagcgctggaagatccagccctactactgaaccaactgatcgatgatgagatctatcgatgatcatccatcgtcgcgtcgatcgatcctgtcgtcatgcatggagacgacgtgcatgtacgtatggcctatgtatatgtatctatatatgtacgcatgtatacgcactagcagaataactgagcctcgatcatctcctatgccgtctgctcgtctttctgcacgcatgtctgtcagcatgtgtgcatattagataaagcagcaggagcgagatgaggggtactcatggtcatgtatatgtaccttgcaacaataagtagcgatacaacacatacttatta

SEQ ID NO: 2235 - DNA, 1020 bp, Saccharum officinarum
gagcctcatcagggcaagaagagaacaccggccaccagagaagaggtgaggtgaggttgcaacttgcaaatcggcgtcatggcatactacggccgtgaccagcgctacggcgggtacggcggcggcatcgcgacgccggggtacgctccgccggtgccgtacgggatgtcgcaggtgaacatcgagggcgacgggtgcgggcggccgctgccgccgcagccgaccgtgaaggtgtactgccgcgccaaccccaactacgccatgaccatccgcgacgggaaggtggtgctggcgccggcgaaccccaaggacgagtaccagcactggatcaaggacatgcggtggagcacgagcatcaaggacgaggagggttacccggcgttcgcgctggtgaacaaggcgaccggggaggccatcaagcactcgctggggcagtcccacccggtgcgcctggtgccctacaacccggacttcctggacgagtccgtgctctggacggagagccgcgacgtcggcaacggattccgctgcatccgcatggtcaacaacatctacctcaacttcgacgccctccacggcgacaagtggcacggcggcgtccgcgacggcaccgacatcgtgctctggaagtggtgcgagggcgacaaccagcgctggaagatccagccctactactgaacggacggtcgttgatcatcatccatcgtcgcgtcgatcgatcgtgcacatgctcgatcatgcatggaggagacgtgcgtgcatgcacttataccagtacacactggcctatgtatgtatctatgtacgcatacatatacgtactagcagaataactgagcctcgtctcgtgtgccgtctttctgcatgcatgtcagcatgtgtgcatagataaagcaggagcgaggcaaagggcttcatgtatacgttgcagctgtatgtatgtatgtatgtaccttgtaataataaagttgcgatacatatacttatgggagtacatacataataaagttgctcgagtgt

SEQ ID NO: 2236 - DNA, 940 bp, Triticum aestivum
tcggtcggcgtcatggcatacaacggccgtgaccagcggtacggcggcggcatcgctacgccggggtacgcaccgccggtgccgtacgggatgtcgcaggtgaacatcgagggcaacgggtgcggtcggccgctgccgccgcagccgaccgtgaaggtgtactgccgcgccaaccccaactacgccatgaccatccgcgacggcagggtggtgctggcgccggcgaaccccaaggacgagtaccagcactggatcaaggacatgaggtggagcacgagcatcaaggacgaggaaggttacccggcgttcgcgctggtgaacaaggcgaccggggaggccatcaagcactcgctggggcagtcccacccggtgcgcctggtgccctacaacccggacttcctggacgagtccgtgctctggaccgagagccgcgacgtcggcaacggattccgatgcatccgcatggtcaacaacatctacctcaacttcgatgccctccacggcgacaagtggcacggcggtgtccgcgacggcaccgagatcgtgctctggaagtggtgcgagggcgacaaccagcgctggaagtcctcccttgggtaaacgaacgaaagaaactactagctggtaccctaataataattctgctggctgcggcgatcccaaaataaaagaggccgggtgcgatgcatctcggacttctcgagtggtgtttgcgtcagacagccagccactgtggggctagtgttccaacatttgtcagcctgcttgcggaaggaaggggggtcactgactcaagagaagggcctggtcataggctgctgcattatgaatttctgatgatgtcttatgtctgtactctgaatcaactatgtatgagatctcatctcctttctcctactgaatgaatgaacattattggctttgctttaaaaaaaaaaaa

SEQ ID NO: 2237 - DNA, 1172 bp, Zea mays
caagaacgactagaaaccgaatcgctttttccctcggctagtttcgcatggcatcgtccttcctgcccatgcgcgcacaaccatccatccactgacgatgcgatgcctacccaccacctcgcgcagcgtgatgctaacgccaccacatgcaccaccagtggggcagctggggacgccgggagcaaccggcagcgccctataaatctgccggcccggccgttgcattgtctgcgtcagggcctcttgatcatcagtcgccagaggagctgttgatcgaggtgagtgaggttgaaaagcaggcggcgaacaaaggcaccatcgtcatggacggcggatactacggcggccgcgatcagcgctacagcggcgggtactacggcggcggtggcatcgcgacgccggggtacgctccggcggtcccgtacgggatgtcgcaggtgaacatcgagggcaacgggtgcgggcgggcgctgccgccgcagccgaccgtgaaggtgtactgccgcgccaaccccaactacgccatgagcgtccgcgacgggaaggtggtgctggcgccggcgaaccccaaggacgagtaccagcactggatcaaggacatgcggtggagcacgagcatcaaggacgaggaaggttacccggcgttcgcgctggtgaacaaggcgaccggggaggccatcaagcactcgctggggcagtcccacccggtgcgcctggtgccctacaacccggacttcctggacgagtcggtgctgtggacggagagccgcgacgtcggcaacggcttccgctgcgtccgcatggtcaacaacatctacctcaacttcgatgccctccacggcgacaagtggcacggcggcgtccgtgacggcaccaacgtcgtgctctggaagtggtgcgagggcgacaaccagcgctggaagatccagccctactactgaaccaacggatgatatgaccatcgcgcccatcgatcgtgcacatgcatgcatacgtactagcagaataacaggggtcttatctcccgaggcgtcttttgcatgcatgccagcagttgcatagataaacaggagcgagacaaagggtgttcatgtatacgttattgcagctgtatgtatgtgccttgtaataatacatataataaagttgctcggggtgtattaattagaaca

SEQ ID NO: 2238 - DNA, 996 bp, Setaria italica
caaaacgactagaaacggaatcacgcaaagctgggctgctagtgtcgcatggcatcatccttcctgcccatgcacgcccccgtcgctcgatagatgcagatcgccatcgatcacctgctacaccgcgcagcgtgatgctaacgccacgcacccacgatgcagcgccgcgacgcgagagccctataaatcccccgtccgttgccctataaatcaatcacacaaacaagaaccacaacacaagtgcttgctgctagctgcttaagaaaagaaccaggcacaccaaagagagaagagagatggacttttacggtggtcgtgagcgttacggcggcggttacggcggcatcgcgacgccggggtacgctccgccggtgccgtacgggatgtcgcaggtgaacatcgagggcaagggttgcgggcgccctctgccgccgcagccgacggtgaaggtgtactgccgcgccgaccccaactacgcgatgacggtccgcaacggcaaggtggtgctggcgccggcgaaccccaaggacgagtaccagcactggatcaaggacatgcggtggagcacgagcgtcaaggacgaggaggggtacccggcgttcgcgctggtgaacaaggccaccggggaggccatcaagcactccctggggcagtcccacccggtgcgcctggtgccctacaacccggacttcctggacgagtcggtgctgtggacggagagccgcgacgtcggcaacggcttccgctgcgtgcgcatggtgaacaacatctacctcaacttcgacgcgctccacggcgacaagtggcacggcggcgtccgcgacggcaccgagatcgtgctctggaagtggtgcgagggagacaaccagcgctggaagatccagccatactactgaacaactgattcatcatctgcctcatccctatgcacgctactacgcctgcaggagcaggagcatggagatcttgaaatgatatatggaataattgtctagc

SEQ ID NO: 2239 - DNA, 1042 bp, Panicum virgatum
ccacgcgtccggattgccgtgccagagcacagagctcagaggaaggccggaagaagcacaatattattaacctagcttagcaccagcagcatactagcagcagcagcagcatggacgtgtactcctacggtcgtgatgagcagcggtacggcggcctggccacgcccgggtacgcgccgccggttccgtacggcatgtcgcaggtgaacatcgaggggcacgggtgcgggcgtccgctgccgccgcagccgacggtgaaggtgtactgccgcgccaaccccaactacgccatgacggtccgcaacggcaaggtggtgctggcgccggcgaaccccaaggacgactaccagcactggatcaaggacatgcggtggagcacgagcgtcaaggacgaggaggggtacccggccttcgcgctggtgaacaaggccaccggggaggccatcaagcactcgctggggcagtcccacccggtgcgcctggtgccctacaaccccgacttcctggacgagtcggtgctctggacggagagccgcgacgtcggcaacggcttccgctgcgtccgcatggtcaacaacatctacctcaacttggacgccctccacggcgacaagtggcacggcggcgtccgcgacggcaccgagatcgtgctctggaagtggtgcgagggagacaaccagcgttggaagatccagccatactactgatcgatccatccatcatcggcgacaacttatcagcagcagcaacacacgcatacatcctctcgtactgctggatccaattaaaatgaataaattcagccttgatgtcctgctgcctgctgcttcgttctctctccacatatatatgcagtagataataaagcaggagacaagagcttacttaattaattactgtcatgtatatgatacagctctatctatgtgtacaatataataagttgcaatatactccttacgtacaataaaacactagtgtgtatgtatatattgggaggtgtatttgggcgcgaaatacatataaaaacattattttgatt

SEQ ID NO: 2240 - DNA, 1127 bp, Zea mays
gcccatgcgcgcacaaccatccatccactgacgatgcgatgcctacccaccacctcgcgcagcgtgatgctaacgccaccacgtacatgcaccaccagtggggcagctggggacgccgggagcaaccggcagcgccctataaatctgccggcccggccgttgcattgtctgcgtcagggcctctcgatcgctcatcagtcgccagaggagtagttgatcgaggtgagtgaggttgaaaagcaggcggcgaacaaaggcaccatcgtcatggacggcggatactacggcggccgcgatcagcgctacagcggcgggtactacggcggcggtggcatcgcgacgccggggtacgctccggcggtcccgtacgggatgtcgcaggtgaacatcgagggcaacgggtgcgggcgggcgctgccgccgcagccgaccgtgaaggtgtactgccgcgccaaccccaactacgccatgagcgtccgcgacgggaaggtggtgctggcgccggcgaaccccaaggacgagtaccagcactggatcaaggacatgcggtggagcacgagcatcaaggacgaggaaggttacccggcgttcgcgctggtgaacaaggcgaccggggaggccatcaagcactcgctggggcagtcccacccggtgcgcctggtgccctacaacccggactttttggacgagtcggtgctgtggacggagagccgcgacgtcggcaacggcttccgctgcgtccgcatggtcaacaacatctacctcaacttcgacgccctccacggcgacaagtggcacggcggcgtccgtgacggcaccgacgtcgtgctctggaagtggtgcgagggcgacaaccagcgctggaagatccagccctactactgaaccaacggatgatatgaccatcgcgcccatcgatcgtgcacatgcatgcatacgtactagcagaataacaggggtcttatctcccgaggcgtcttttgcatgcatgccagcagttgcatagataaagcaggagcgagacaaagggtgttcatgtatattgcagctgtatcactgtatgtatgtgccattgtgccttgtaataatacatataataataaagttgctcggagtgtattaattat

SEQ ID NO: 2241 - DNA, 967 bp, Setaria italica
gaaagcatgaaaagctcacgacaaaacagactagatcacaagtgcttgctgctagctgcttaagaaaagaaccaggcacaccaaagagagaagagagatggacttttacggtggtcgtgagcgttacggcggcggttacggcggcatcgcgacgccggggtacgctccgccggtgccgtacgggatgtcgcaggtgaacatcgagggcaagggttgcgggcgccctctgccgccgcagccgacggtgaaggtgtactgccgcgccgaccccaactacgcgatgacggtccgcaacggcaaggtggtgctggcgccggcgaaccccaaggacgagtaccagcactggatcaaggacatgcggtggagcacgagcgtcaaggacgaggaggggtacccggcgttcgcgctggtgaacaaggccaccggggaggccatcaagcactccctggggcagtcccacccggtgcgcctggtgccctacaacccggacttcctggacgagtcggtgctgtggacggagagccgcgacgtcggcaacggcttccgctgcgtgcgcatggtgaacaacatctacctcaacttcgacgccctccacggcgacaagtaccacggcggcgtccgcgacggcaccgaggtcgtgctctggaagtggtgcgagggcgacaaccagcgctggaagatccagccatactactgaacaactgattcatcatctgcctcatccctatgcacgctactacgcctgcaggagcaggagcatggagatcttgaaatgatatatggaataattgtctagcctcgtcactagacaaaagcaggatcaagcgcttacttatggtcatgtatgcgttgcatgtgtacctactgtatgtaataaccagttgcgataccataaagtatcttcagtgtattcggccgtgaaatacgtatatgtatggtgattaataccgatgggctgttgaaacac

SEQ ID NO: 2242 - DNA, 877 bp, Avena sativa
gatcaagcaaccagccatggactactaccgtcgccacgagaactacggcgggtacgggctggcgacgccggggtacgcgccgccggtgccgtacggcatgtcccaggtgaacatcgagggcaactgctgcgggcgtcccctgccgccgcagcccacggtgaaggtgtactgccgcgccaaccccaactacgccatgtccgtcaggaacggcaaggtggtgctcgcgccggccaaccccaaggacgagtaccagcactggatcaaggacatgagatggagcaccagcgtcaaggacgaggaggggtaccctgccttcgccctggtgaacaaggccacgggggaggccatcaagcactcccttggacagtcccaccctgttcagcttgtgccgtacaacccagacttcctggacgagtctgtgctgtggacggagagcagggacgtgggcaacggcttccggtgcgtgcgcatggtgaacaacatctacctcaacttcgacgccctcaacggcgacaagtaccacggcggcgtccgcgacggcaccgagatcgtgctctggaagtggtgcgagggcgacaaccagcgctggaagatccagccatactagtatatatactactgagccagccacacccaactggtacatccgtatctactgaagagcgacgtgcactgtcccggatagtcaacttcatctctcgctacgcatcgtagaataaaggccggaggtcagatgacgagagctcgtgtatgggatgtatgcataagctgttgtgcttgtacctataatatataaagtgtgatatcaagtgttagtatcaataaagcacctttgtgggtgtgattgtacaactgaaacacgactgcgcagtgcaaa

SEQ ID NO: 2243 - DNA, 868 bp, Avena sativa
cgagcagctagccatggactactaccgtcgccacgagaactacggcgggtacgggctggcgacgccggggtacgcgccgccggtgccgtacggcatgtcccaggtgaacatcgagggcaactgctgcgggcgtcccctgccgccgcagcccacggtgaaggtgtactgccgcgccaaccccaactacgccatgtccgtcaggaacggcaaggtggtgctcgcgccggccaaccccaaggacgagtaccagcactggatcaaggacatgagatggagcaccagcgtcaaggacgaggaggggtaccctgccttcgccctggtgaacaaggccacgggggaggccatcaagcactcccttggacagtcccaccctgttcagcttgtgccgtacaacccagacttcctggacgagtctgtgctgtggacggagagcagggacgtgggcaacggcttccggtgcgtgcgcatggtgaacaacatctacctcaacttcgacgccctcaacggcgacaagtaccacggcggcgtccgcgacggcaccgagatcgtgctctggaagtggtgcgagggcgacaaccagcgctggaagatccagccatactagtatatatactactgagccagccacacccaactggtacatccgtatctactgaagagcgacgtgcactgtcccggatagtcaacttcatctctcgctacgcatcgtagaataaaggccggaggtcagatgacgagagctcgtgtatgggatgtatgcataagctgttgtgcttgtacctataatatataaagtgtgatatcaagtgttagtatcaataaagcacctttgtgggtgtgattgtacaactgaaacacgactgcgcag

SEQ ID NO: 2244 - DNA, 857 bp, Cynodon dactylon
acgaagaaccagaacaagtgcttgttgttgcttgccactaacaacactctgatcaccagaccatggactactacgggcgtgagcgccacggcggcggctatggcggcggctacggcgtcgcgacgccggggtacgcaccgccggttccgtacggcatgtcgcaggtgaacatggagggcaacggctgcggtcgcccgctgccgcctcagccaaccgtgaaggtgtactgccgtgcaaaccccaactacgccatgagcgtccgcaacggcaaggtcgtcctcgcgccggccaacccaaaggatgactaccagcactggatcaaggacatgagatggagcacgaacatcaaggacgaggaaggctaccctgcctttgctctggtgaacaaggcaacaggggaggctatcaagcactcccttggtcaatcccaccctgtccggctggttccttacaaccctgaccaccttgacgagtccgtgctgtggactgagagccgcgacgtcggcaacggcttccggtgcatccgcatggtgaacaacatctacctcaactttgatgcgctcaacggcgacaaatggcacggcggcgtgcgggacggcaccgagatcgtgctctggaagtggtgcgagggcgacaaccagcgctggaagatccagccctactactgatgagactattgaaccctgctctacgaaacaaccaaggagatgatcgtacctatcttataacatgtgacaaaataattgagccttgtccctgcctagtgcatcgataaagcaggagacgagctgcttgattgtgatattgtatatgttgcagctgtatgtgtaataattaataaactgcaatatatatac

SEQ ID NO: 2245 - DNA, 1038 bp, Avena sativa
agcaaccagccatggactactaccgtcgccacgagaactacggcgggtacgggctggcgacgccggggtacgcgccgccggtgccgtacggcatgtcccaagtgaacatcgagggcaactgctgcgggcgtcccctgccgccgcagcccacggtgaaggtgtactgccgcgccaaccccaactacgcgatgtccgtcaggaacggcaaggtggtgctggcgccggccaaccccaaggacgagtaccagcactggatcaaggacatgagatggagcactagcgtcaaggacgaggaggggtaccctgccttcgccctggtgaacaaggccacgggggaggccatcaagcactccctcggacagtcccaccctgttcagcttgtgccgtacaacccagacttcctggacgagtcggtgctgtggacggagagcagggacgtcggcaacggcttccggtgcgtgcgtatggtgaacaacatctacctcaacttcgacgccctcaacggcgacaagtaccacggcggcgtccgcgacggcaccgaggtcgtgctctggaagtggtgcgagggcgacaaccagcgctggcagatccagccatactactgagtcctaagccagccagccagccatcatacccaactcgtacatccgtatctactgaagggcgacgttcactgtcctggatagacaacttcatctctcgctacgcatcgtagaataaaagccggagatcatatgaaagagcttgggatgtatgcataagctgttgtgctcgtacctgaatatataaagtgtgatatcaaatgttagtatcaataaaacatcttttgtgagtatgactaggtactgaaatacgtttgcataatgcaaattaagtattttcagttgcatctagtgaccaagataaatttacttggcaagtttaagttctacgtttgtgttaagtaagtattttatatgtccggtatatatagtgcatccttcaagacactagcattgacttgatgctcaagtatacggacttattatgaatttcttt

SEQ ID NO: 2246 - DNA, 1117 bp, Avena sativa
gcagatcaagcaaccagccatggactactaccgtcgccacgagaactacggcgggtacgggctggcgacgccggggtacgcgccgccggtgccgtacggcatgtcccaagtgaacatcgagggcaactgctgcgggcgtcccctgccgccgcagcccacggtgaaggtgtactgccgcgccaaccccaactacgcgatgtccgtcaggaacggcaaggtggtgctggcgccggccaaccccaaggacgagtaccagcactggatcaaggacatgagatggagcactagcgtcaaggacgaggaggggtaccctgccttcgccctggtgaacaaggccacgggggaggccatcaagcactccctcggacagtcccaccctgttcagcttgtgccgtacaacccagacttcctggacgagtcggtgctgtggacggagagcagggacgtcggcaacggcttccggtgcgtgcgtatggtgaacaacatctacctcaacttcgacgccctcaacggcgacaagtaccacggcggcgtccgcgacggcaccgaggtcgtgctctggaagtggtgcgagggcgacaaccagcgctggcagatccagccatactactgagtcctaagccagccagccagccatcatacccaactcgtacatccgtatctactgaagggcgacgttcactgtcctggatagacaacttcatctctcgctacgcatcgtagaataaaagccggagatcatatgaaagagcttgggatgtatgcataagctgttgtgctcgtacctgaatatataaagtgtgatatcaaatgttagtatcaataaaacatcttttgtgagtatgactaggtactgaaatacgtttgcataatgcaaattaagtattttcagttgcatctagtgaccaagataaatttacttggcaagtttaagttctacgtttgtgttaagtaagtattttatatgtccggtatatatagtgcatccttcaagacactagcattgacttgatgctcaagtatacggacttattatgaatttctttagtaattcgtttcagctgtactctaacttagagtttgctcgtggagttattttgcaattggatcttttggc

SEQ ID NO: 2247 - DNA, 893 bp, Cynodon dactylon
agaaccagaacaagtgcctgtttgttgcttgccactaacaacactctgatcaccagaccatggactactacgggcgtgagcgccacggcggcggctatggcggcggctacggcgtcgcgacgccagggtacgcgccgccggttccgtacggcatgtcgcaggtgaacatggagggcaacggctgcggtcgcccgctgccgccgcagccaaccgtgaaggtgtactgccgtgcaaaccccaactacgccatgagcatccgcaacggcaaggtcgttctcgcgccggccaacccaaaggatgactaccagcactggatcaaggacatgagatggagcacgaacatcaaggacgaggaaggctaccctgcctttgctctggtgaacaaggcaacaggggaggctatcaagcactcccttggccaatcccaccctgtccggctggtgccttacaaccctgactaccttgacgagtccgtgctgtggactgagagccgcgacgtcggcaacggcttccggtgcatccgcatggtgaacaacatctacctcaacttcgatgcgctccacggcgacaaggcccacggcggcgtccatgacggtaccgaggtcgtgctctggaagtggtgcgagggcgacaaccagcgctggaagatccagccttactactgatgagactgaaccctgctctacgaaacaacaatggatatgtacctatcttataacatgataaaataattgagccttgtccatgcctagtgcgtcgataaagcaggagatgagctgcttaataaactgcaatatatataccacgaatatattcaatgtcctttcccgtgaaataatgatccatttgtataaactttggtatattaataaattgattatttgacttgttag

SEQ ID NO: 2248 - DNA, 990 bp, Panicum virgatum
gagctcagaggaaccacacgcagacaaataaccaccagcaggtacaggtagcatatatatatactagctagctaggaacatggacgtgtacggtggtgagcgctactatggcagttacggcggcgccggcggcctggccacgcccgggtacgcgccgccggttccgtacggcatgtcgcaggtgaacatcgaggggcacgggtgcgggcgtccgcttccgccgcagccgacggtgaaggtgtactgccgcgccaaccccaactacgccctgacgatccgcaacggcaaggtggtgctggcgccggcgaaccccaaggacgactaccagcactggatcaaggacatgcggtggagcacgagcgtcaaggacgaggaggggtacccggccttcgcgctggtgaacaaggccaccggggaggccatgaagcactcgctggggcagtcccacccggtgcgcctggtgccctacaaccccgacttcctggacgagtcggtgctctggacggagagccgcgacgtcggcaacggcttccgctgcgtccgcatggtcaacaacatctacctcaacttggacgccctccacggcgacaagtggcacggcggcgtccgcgacggcaccgagatcgtgctctggaagtggtgcgagggagacaaccagcgctggaagatccagccatactactgatgatgatcgatcgatcgacaagctacttaattagcagactcgatcagatgatcagcagcagcaacacagatgatgcatcgtcacgtacgactacatacgaacgaactgctggatcagatcttaataaaatgaataaataaattgagccttgtcctgctgcatgcatgcatatagaattacagatagataaagcaggagacaagagcttaattactttacttatggtcatgtatgcatatggttgcagctgtgtatgtgtaataataagttgcaatacttacctacagtatataaacagtatatac

SEQ ID NO: 2249 - DNA, 902 bp, Secale cereale
cagcttggcaaccatggactactaccgcgagagctacggcgcctacgggatggcgacgccggggtacgcgccgccggtgccgtacggcatgtcgcaggtgaacatcgacggcaactgcggcgggcggccgatgccgccgcagccgacggtgaagatctactgccgcgccaaccccaactacgccatgtcggtgcgcaacggcaaggtggtgctggcgccggccaaccccaaggacgactaccagcactggatcaaggacatgaggtggagcaccagcatcaaggacgaggaggggtaccccgccttcgccatggtgaacaaggccaccggccaggccatcaagcactcccttggccagtcccatcctgtacgtctggtgccgtacaaccctgacttcctggacgagtcggtgctgtggacggagagtagggacgtgggcaacgggttcaggtgcgtgcgcatggtgaacaacatctacctcaacttcgacgccctcaacggcgacaagtaccacggcggcgtccgcgacggcaccgaggtcgtgctctggaagtggtgcgagggcgacaaccagcgctggaagctccagccgtactactgagccagccagccagcgcgcgccatgcatggctcgtgcacgtaagcgtggaggtcgacatatccacagttaactgccatgcgcacgtacgtatctacggaagaaacgatgtgttgtctctgataaacaacatgtatgcgtctctctcgctatctacgctgcagaataacggagctgttgtgcttgtatagttgtatgtgtaatgacaagttacgtaacaataaaggacctttgtgagctgattgaacatgtgaaatactccatccgttcaagaatataagtctttttagagattccaaaaaaa

SEQ ID NO: 2250 - DNA, 791 bp, Secale cereale
tcagcgagcatatagccatggactactaccgcgagagctacggggcatacgggatggcgacgccggggtacgccccgccggtgccgtacggcatgtcgcaggtgaacatcgacggcaactgcggcgggcggccgatgccgccgcagccgacggtgaagatctactgccgcgccaacccgaactacgccatgtccgtccgcaacgggaaggtggtgctcgcgccggccaaccccaaggacgactaccagcactggatcaaggacatgaggtggagcaccagcatcaaggacgaggaggggtaccccgccttcgccatggtgaacaaggccaccggccaggccatcaagcactcccttggccagtcccacccggtgcgtctggtgccgtacaaccctgacttcctggacgagtcggtgctgtggacggagagcagggacgtgggcaacggcttcaggtgcgtgcgcatggtgaacaacatctacctcaacttcgacgccctcaacggcgacaagtaccacggcggcgtgcgcgacggcaccgaggtcgtgctctggaagtggtgcgagggcgacaaccagcgctggaagctccagccgtactactgagccagccagcgcgcgccatgcatggctcgtgcatgtactcgtggaggtcgacatatcgttaactgccatgcgcacgtacgtatctactgaagagacgatgtggactgtctctgataaacaacatgtatgcgtctctctcgctatctacgctgcagaataacggagctgttgtgcttgtatgtgtaa

SEQ ID NO: 2251 - DNA, 833 bp, Secale cereale
gcagcttggcagccatggactactaccgtgagagctacggggcctacgggatggcgacgccggggtacgcgccgccggtgccgtacggcatgtcgcaggtgaacatcgacggcaactgcggcgggcggccgatgccgccgcagccgacggtgaagatctactgccgcgccaaccccaactacgccatgtccgtgcgcaacggcaaggtggtcctggcgccggccaaccccaaggacgactaccagcactggatcaaggacatgaggtggagcaccagcatcaaggacgaggaggggtaccccgccttcgccatggtgaacaaggccaccggccaggccatcaagcactcccttggccagtcccacccggtgcgtctggtgccgtacaaccctgacttcctggacgagtcggtgctgtggacggagagcagggacgtgggcaacggcttcaggtgcgtgcgcatggtgaacaacatctacctcaacttcgacgccctcaacggcgacaagtaccacggcggcgtgcgcgacggcaccgaggtcgtgctctggaagtggtgcgagggcgacaaccagcgctggaagctccagccgtactactgagccagccagcgcgcgccatgcatggctcgtgcatgtactcgtggaggtcgacatatccacagttaactgccatgcgcacgtacgtatctacggaagaaacgatgtgttgtctctgataaacaacatgtatgcgtctctctcgctatctacgctgcagaataacggagctgttgtgcttgtatagttgtatgtgtaatgacaagttacgtaacaataaaggacctttgtgag

SEQ ID NO: 2252 - DNA, 925 bp, Secale cereale
tggcaaccatggactactaccgcgagagctacggcgcctacgggatggcgacgccggggtacgcgccgccggtgccgtacggcatgtcgcaggtgaacatcgacggcaactgcggcgggcggccgatgccgccgcagccgacggtgaagatctactgccgcgccaaccccaactacgccatgtcggtgcgcaacggcaaggtggtgctggcgccggccaaccccaaggacgactaccagcactggatcaaggacatgaggtggagcaccagcatcaaggacgaggaggggtaccccgccttcgccatggtgaacaaggccaccggccaggccatcaagcactcccttggccagtcccaccctgtacgtctggtgccgtacaaccctgacttcctggacgagtccgtgctgtggacggagagcagggacgtggggaacgggttcaggtgcgtgcgcatggtgaacaacatctacctcaacttcgacgccctcaacggcgacaagtaccacggcggcgtccgcgacggcacagaggtcgtgctctggaagtggtgcgagggcgacaaccagcgctggaagctccagccgtactactgagccagccagcgcgcgccatgcatggctcgtgcatgtactcgtggaggtcgacatatccacagttaactgccatgcgcacgtacgtatctacggaagaaacgatgtgttgtctctgataaacaacatgtatgcgtctctctcgctatctacgctgcagaataacggagctgttgtgcttgtatgtgtaatgacaagttacgtaacaataaaggacctttgtgagctgattgaacacgtgaaatactccctccgtttccgaatataagtctttttagagatttcaataagggattgcatatgaaaataaaaatgagtgaatctacaaattt

SEQ ID NO: 2253 - DNA, 1523 bp, Oryza sativa
cccggggaattttctgtcgaaaaattgtataggtaatccctaataaatttctaaatgtgcttggctgattccttttcttctcgatcgatcccgttattcctttttaatcttttcttgtgcggaattgcagcactttttctctgcttgatcacaacgcagcaaggacatgagaatacgtgagattctccgggcgatggagctgcaccgtggctttgctatcgtctcgcgtcggctcgcctgcaataatacggcagccagatcgagatggttcccaaaacgactagaaacggaatcacgtaaagcaccatggatggatggaatcaccttttccccaggaaagcgcaagtgtggaatggcatcatctatcctaccaagttcctaagcccctgaccatgcagtgcacgaataatgcacatcgatcagctatctagagagagagagagagagagagagagagatagatagcatctcgatcagtgctactgatcaatcgatcatcccctataaatcccccatcccattgccatgcatagaggcagcacatcaacgatcgaacgaacaacgcactctgcagctagctatacaatctctgtttaattagctaggtagctagcgagtcataaatcaagaagccatggacttttacgggcggcgcgagcagtacggcgggtatggcgggtacggtggcggcggcgccctggcgacgccggggtacgcgccggcggcgccgtacgggatgtcgcaggtgaacatcgaggggaacgggtgtggcaggacgctgccgccgcagccgacggtgaaggtgtactgccgggcgaacccgaactacgcgatgacggcgcggaacggcgcggtggtgctggcgccggcgaaccccaaggacgagtaccagcattggatcaaggacatgaggtggagcaccagcatcaaggacgaggagggctaccctgccttcgccctcgtcaacaaggccaccggccaggccatcaagcactccctcggccagtcacaccctgtgaggctggtgccgtacaacccggaggtgatggacgagtcggtgctgtggacggagagccgcgacgtggggaacgggttcaggtgcatccgcatggtgaacaacatctacctcaacttcgacgccttccacggcgacaagtaccacggcggcgtccgcgacggcaccgacatcgtgctctggaagtggtgcgagggcgacaaccagcgctggaagatccagccctactactgagctgatcgatacatcgatccagctctctatcaaggctcaagttgatatcaacgaatctggtgcagaataattattctctgctagctacccacctatatacgtagctaagagtaacttatgctcgtccgtaccgtatgattatcgtgtggtgtgcttgtatcttgtacaagttaattaattacctggcaataagagctcctctcgctgggcgacacatatataaacacatacagttggggcttgattcaacttgcatatatgctgtgcatatgcg

SEQ ID NO: 2254 - DNA, 991 bp, Oryza sativa
gaggcagcacatcaacgatcgaacgaacaacgcactctgcagctagctatacaatctctgtttaattagctaggtagctagcgagtcataaatcaagaagccatggacttttacgggcggcgcgagcagtacggcgggtatggcgggtacggtggcggcggcgccctggcgacgccggggtacgcgccggcggcgccgtacgggatgtcgcaggtgaacatcgaggggaacgggtgtggcaggacgctgccgccgcagccgacggtgaaggtgtactgccgggcgaacccgaactacgcgatgacggcgcggaacggcgcggtggtgctggcgccggcgaaccccaaggacgagtaccagcattggatcaaggacatgaggtggagcaccagcatcaaggacgaggagggctaccctgccttcgccctcgtcaacaaggccaccggccaggccatcaagcactccctcggccagtcacaccctgtgaggctggtgccgtacaacccggaggtgatggacgagtcggtgctgtggacggagagccgcgacgtggggaacgggttcaggtgcatccgcatggtgaacaacatctacctcaacttcgacgccttccacggcgacaagtaccacggcggcgtccgcgacggcaccgacatcgtgctctggaagtggtgcgagggcgacaaccagcgctggaagatccagccctactactgagctgatcgatacatcgatccagctctctatcaaggctcaagttgatatcaacgaatctggtgcagaataattattctctgctagctacccacctatatacgtagctaagagtaacttatgctcgtccgtaccgtatgattatcgtgtggtgtgcttgtatcttgtacaagttaattaattacctggcaataagagctcctctcgctgggcgacacatatataaacacatacagttggggcttgattcaacttgcatatatgctgtgcatatgcg

SEQ ID NO: 2255 - DNA, 920 bp, Hordeum vulgare
gccgtgcattgcgcagatcgatcagctagccatggactactaccgcgagagctacggctcgtacgggatggcgacgccggggtacgcgcccccggtgccgtacggcatgtcgcaggtgaacgtcgacggcaactgcggcggtcggccgatgccgccgcagcctacggtgaagatctactgccgcgccaaccccaactacgccatgtccgtgcgcaacggcaaggtggtgctcgcgccggccaaccccaaggacgactaccagcactggatcaaggacatgaggtggagcaccagcatcaaggacgaggagggctaccccgccttcgccatcgtgaacaaggccactggccaggccatcaagcactccctcggccagtcccaccctgtgcgtctggtgccgtacaacccggacttcctggacgagtcggtgctgtggacggagagcagggacgtgggcaacggcttcaggtgcgtgcgcatggtgaacaacatctacctcaacttcgacgccctcaacggcgacaagtaccacggcggcgtccgcgacggcaccgaggtcgtgctctggaagtggtgcgagggcgacaaccagcgctggaagatccagccctactactgagcagggcagcgcgcgccgtgcatggatcgatgcatgcatggctcgcgcacgtacgcgtggacatgcatcggcatatccacgctcatgtgtacgtacgtatctactgaagaaacgatgtgggctgtcccggatgaacaacatgcatgcgtctctcgctagtcgctccctacgccgcagaataacggagccgttgtgcttgtatgtgtaatcacaagttacgtactaataaaggacctttgtgagctgattgaacatgtgaaatactccctacgtttctaaatataagtcttttaaaatttgc

SEQ ID NO: 2256 - DNA, 798 bp, Triticum aestivum
ccatggactactaccgcgagacctacggcgggtacgggatggcgacgcccgggtacgcggcgccggtgccgtacggcatgtcgcaggtgaacatcgacggcaactacggcgggaggccgatgccgccgcagcccacggtgaagatctactgccgcgccaaccccaactacgccatgtccgtccgcaacggcaaggtggtgctggcgccggccaaccccaaggacgactaccagcactggatcaaggacatgaggtggagcaccagcatcaaggacgaggagggctaccccgccttcgccatggtgaacaaggccaccgggcaggccatcaagcactccctcggccagtcccaccctgtgcgtctggtgccgtacaacccagactacctggacgagtcggtgctgtggacggagagcagggacgtgggcaacgggttcaggtgcgtgcgcatggtgaacaacatctacctcaacttcgacgccctcaacggcgacaagtaccacggcggcgtccgcgacggcaccgaggtcgtgctctggaagtggtgcgagggcgacaaccagcgctggaagctccagccgtactactgagcgagccagccagcgcgtgccatgcatgcgtgcgtggctcgtgcacggtgcacgcacgcgtggagatcgacatgcccaaacctacccatgccgtacgtacgtatctactagtactactgaagaaacgatgtggactgtcccggataaacaacatgcatgcgtctctcgctacctacgccgcagaataacggagccagctgtgttgtgc

SEQ ID NO: 2257 - DNA, 888 bp, Festuca arundinacea
  misc_feature (735)..(735): n is a, c, g, or t
  misc_feature (751)..(751): n is a, c, g, or t
  misc_feature (753)..(753): n is a, c, g, or t
  misc_feature (799)..(799): n is a, c, g, or t
  misc_feature (842)..(842): n is a, c, g, or t
  misc_feature (875)..(875): n is a, c, g, or t
agctatctagccatggattactaccgtcgccacgagaactacggtgggtatggaatggcaacaccggggtacgggatggcaactccggggtacgcgccgccggtgccatacggcatgtctcaggtgaacatcgagggcaactacggtggccgtaccctgccgccgcagcccacggtgaaggtgtactgccgggccaaccccaactatgccatgtccgtccgcaacggcaaggtcgtgctcgcgccggccaaccccaaggacgagtaccagcactggatcaaggacatgaggcacagcaccagcatcaaggacgaggaggggtacccggccttcgccctggtgaacaaggccacaggggaggccatcaagcactcccttggccagtcccacgctgttcggcttgtgccgtacaaccctgacttcctggacgagtcggtgctgtggacggagagccgggacgtgggcaacggcttccgctgcgtgcgcatggtgaacaacatctacctcaacttcgacgcccttaacggtgacaagtaccacggcggcgtccgcgacggcaccgaggtcgtgctctggaagtggtgcgagggcgacaaccagcgctggaagatccagccttattactgatggaaccactgaatatgactgaaccagccatgcttggtccgcacggagcatacgtattactgcagagcgatgcctccctacactgaagaataacggagccgtcgtctnctgccttccgatgatncnatccacgctgatgatatacagaaggtcggatgacaagagctcgtgngcgggcaccagacgctggctgttgtgcttgtacgtgtaatganaagttaatagtatgtcaataaagtaactttgantgtgattcctcca

SEQ ID NO: 2258 - DNA, 865 bp, Festuca arundinacea
ggcacgaggcgagcagctagctagccatggactactaccgtcgccatgagaactacggtgggtacggaatggcaacgccggggtacgggatggcaactccggggtacgcgccgccggtgccatacggcatgtcccaggtgaacatcgagggcaactgcggcgggcggacgctgccgccgcagcccacggtgaaggtgtactgccgggccaaccccaactacgccatgtccgtccgcaacggcaaggtcgtgctcgcgccggccaaccccaaggacgagtaccagcactggatcaaggacatgaggcacagcaccagcatcaaggacgaggaggggtaccctgccttcgccctggtgaacaaggccacaggggaggccatcaagcactcccttggccagtcccacgctgttcggcttgtgccttacaaccctgacttcctggacgagtcggtgctgtggacggagagccgggacgtgggcaacggcttccgctgcgtgcgcatggtgaacaacatctacctcaacttcgacgccctcaacggcgacaagtaccacggcggcgtccgcgacggcaccgaggtcgtgctctggaagtggtgcgagggcgacaaccagcgctggaagatccagccttactactgatcgaaccactgaatgactgaaccagccatgcttggtccgtacggagcatacgtattactgcagcgcgatgtctccctacactgaacaataacggagccgtcgtcccctgccttccgatgatccgatccacgctgatgatatatagaagttcggatgacaagagctcatgtgcgggtactccatacgcaggctgttgtgcttgtacgtgtaatatcaagttaata

SEQ ID NO: 2259 - DNA, 802 bp, Pseudoroegneria spicata
gcgagagctacggcgcctacgggatggcgacgccggggtacgcgccgcccgtgccgtacggcatgtcgcaggtgaacatcgacgggaacggcggcgggcggccgatgccgccgcagcccacggtgaagatctactgccgcgccaaccccaactatgccatgtccgtccgcaacggcaaggtggtgctcgcgcccgccaaccccaaggacgactaccagcactggatcaaggacatgaggtggagcaccagcatcaaggacgaggagggctaccccgccttcgccatggtgaacaaggccactggccaggccatcaagcactcccttggccagtcccaccctgttcgtctggtgccgtacaacccagacttcctggacgagtcggtgctgtggacggagagccgggacgtgggcaacggcttcaggtgcgtgcgcatggtgaacaacatctacctcaacttcgacgccctcaacggcgacaagtaccacggcggcgtccgcgacggcaccgaggtcgtgctctggaagtggtgcgagggcgacaaccagcgctggaagatccagccatactactgagccagccagtgcgcgccatgcatggctcgtgcacgtacgcgtggagatcgacgtatccatactaacccatgcgtacgtacgcgtatctactgaagcaacgatgtggactgtcccggataaacaacatgcgcgcgtctctcgctacctacgccgcagaataacggagctgttgtgcttgtgtatgtgtaaatgacaagttacgtaacaataaaggacctttgtgagct

SEQ ID NO: 2260 - DNA, 869 bp, Triticum aestivum
ccacgcgtccgagcatattgccatggactactaccgcgagacctacggcgggtacgggatggcgacgcccgggtacgcggcgccggtgccgtacggcatgtcgcaggtgaacatcgacggcaactgcggcgggcgccccatgccgccgcagccgacggtgaagatctactgccgcgccaaccccaactacgccatgtccgtgcgcaacggcaaggtggtgctggcgccggccaaccccaaggacgactaccagcactggatcaaggacatgaggtggagcaccagcatcaaggacgaggaggggtaccccgccttcgccatggtgaacaaggccaccgggcaggccatcaagcactccctcggccagtcccaccctgtgcgtctggtgccgtacaacccagactacctggacgagtcggtgctgtggacggagagcagggacgtgggcaacggcttcaggtgtgtgcgcatggtgaacaacatctacctcaacttcgacgccctcaacggcgacaagtaccacggcggcgtgcgcgacggcaccgaggtcgtgctctggaagtggtgcgagggcgacaaccaacgctggaagctccagccgtactactgagccagccagcgcgcgccgtgcatgcatcatgcatggctcgtgcacgtacgcgtgcagatcgacatacacatacccatacctacccatgcgtgcgtacgtatctactgaagaaacgatgtggagttgtggtctgtcctggataaaaacatgcatgcgtctctcgctatctacgctgcagaataacggagctgttgtgcttgtatgtgtaatgacaagttacgtaacaataaaggacctttgtgagctgaaaaaaaaaaaa

SEQ ID NO: 2261 - DNA, 1065 bp, Triticum aestivum
aggtcgatcaggagatcgagcatatagccatggactactaccgcgagacctacggcgggtacgggatggcgacgcccgggtacgcggcgccggtgccgtacggcatgtcgcaggtgaacatcgacggcaactgcggcgggcgccccatgccgccgcagccgacggtgaagatctactgccgcgccaaccccaactacgccatgtccgtgcgcaacggcaaggtggtgctggcgccggccaaccccaaggacgactaccagcactggatcaaggacatgaggtggagcaccagcatcaaggacgaggaggggtaccccgccttcgccatggtgaacaaggccaccgggcaggccatcaagcactccctcggccagtcccaccctgtgcgtctggtgccgtacaacccagactacctggacgagtcggtgctgtggacggagagcagggacgtgggcaacggcttcaggtgtgtgcgcatggtgaacaacatctacctcaacttcgacgccctcaacggcgacaagtaccacggcggcgtgcgcgacggcaccgaggtcgtgctctggaagtggtgcgagggcgacaaccaacgctggaagctccagccgtactactgagccagccagcgcgcgccgtgcatgcatcatgcatggctcgtgcacgtacgcgtgcagatcgacatacacatacccatacctacccatgcgtgcgtacgtatctactgaagaaacgatgtggagttgtggtctgtcctggataaaaacatgcatgcgtctctcgctatctacgctgcagaataacggagctgttgtgcttgtatgtgtaatgacaagttacgtaacaataaaggacctttgtgagctgattgaacaagtaaaatacgtataaacagtgaaatacgcatgcaccgttcatgtgaaatactcacacacccacgtttccaacggactcggtagtttgattcggggcaaggaaacttgtccaaactttttccattgggaatggctagaaattagtcggctgatttttcatttgtggtcagtcgatttctcggccgttgaatgc

SEQ ID NO: 2262 - DNA, 824 bp, Triticum aestivum
atggactactaccgcgagacctacggcgggtacgggatggcgacgcccgggtacgcggcgccggtgccgtacggcatgtcgcaggtgaacatcgacggcaactacggcgggaggccgatgccgccgcagcccacggtgaagatctactgccgcgccaaccccaactacgccatgtccgtccgcaacggcaaggtggtgctggcgccggccaaccccaaggacgactaccagcactggatcaaggacatgaggtggagcaccagcatcaaggacgaggagggctaccccgccttcgccatggtgaacaaggccaccgggcaggccatcaagcactccctcggccagtcccaccctgtgcgtctggtgccgtacaacccagactacctggacgagtcggtgctgtggacggagagcagggacgtgggcaacgggttcaggtgcgtgcgcatggtgaacaacatctacctcaacttcgacgccctcaacggcgacaagtaccacggcggcgtccgcgacggcaccgaggtcgtgctctggaagtggtgcgagggcgacaaccagcgctggaagctccagccgtactactgagcgagccagccagcgcgtgccatgcatgcgtgcgtggctcgtgcacggtgcacgcacgcgtggagatcgacatgcccaaacctacccatgccgtacgtacgtatctactagtactactgaagaaacgatgtggactgtcccggataaacaacatgcatgcgtctctcgctacctacgccgcagaataacggagccagctgtgttgtgcttgtatgtgtaatgacaagttacgtaac

SEQ ID NO: 2263 - DNA, 843 bp, Triticum aestivum
actactaccgcgagacctacggcgggtacgggatggcgacgcccgggtacgcggcgccggtgccgtacggcatgtcgcaggtgaacatcgacggcaactacggcgggaggccgatgccgccgcagcccacggtgaagatctactgccgcgccaaccccaactacgccatgtccgtccgcaacggcaaggtggtgctggcgccggccaaccccaaggacgactaccagcactggatcaaggacatgaggtggagcaccagcatcaaggacgaggagggctaccccgccttcgccatggtgaacaaggccaccgggcaggccatcaagcactccctcggccagtcccaccctgtgcgtctggtgccgtacaacccagactacctggacgagtcggtgctgtggacggagagcagggacgtgggcaacgggttcaggtgcgtgcgcatggtgaacaacatctacctcaacttcgacgccctcaacggcgacaagtaccacggcggcgtccgcgacggcaccgaggtcgtgctctggaagtggtgcgagggcgacaaccagcgctggaagctccagccgtactactgagcgagccagccagcgcgtgccatgcatgcgtgcgtggctcgtgcacggtgcacgcacgcgtggagatcgacatgcccaaacctacccatgccgtacgtacgtatctactagtactactgaagaaacgatgtggactgtcccggataaacaacatgcatgcgtctctcgctacctacgccgcagaataacggagccagctgtgttgtgcttgtatgtgtaatgacaagttacgtaacaataaaggacctttatgagctga

SEQ ID NO: 2264 - DNA, 2653 bp, Triticum aestivum
ccacatacgcgcggtcggagtggcatttttcagcctaagcaacgtcacgatggcacagttgcttggttagcggcgtgcatgtctgctgctctcgcagatccatcctctgagccacgcacgtatcaagctgctatgcgcattcctcattggagagaggccatggagcaggagtatcaagcgcttcttcgcaatcagacatggactcttgttcctccacaatcacgggtaaatgtcattgattccaaatgggttttcaaagtgaagaggcattctgatgggtccattgagcgctataaggctcgtctggttgctcgtggttttcgacagcgttttggacttgactatgaagacaccttcagtctagtggtcaagcctactaccatcagacttcttctctctctggctgttactcgaggttggtttcttcgtcagcttgatgttcaaaatgcttttcttcatggtgtcttggcggaggaggtttacatgcgccagcctccgggtttctctgatccggatcgccccgatcatctctgtcgtctgtccaaggcaatttatggtctgaagcaggctcctcgtgcttggcatgctcgtcttgcaatggctcttcgtgctcatggttttgcatcatcaactgctgactcctcattgtttcttcttcaaaggcctgaggttactatgtacttgttggtctatgtagatgatatcattttggtcagctcctctcagtcggctgctactgcgcttgttcgctcacttggtgctgattttgcggtcaaggaccttgggaagcttcattactttcttggtgtggaggttacttctcgtgatgctggccttgttatgacgcagaagaagtactctctggatttgttgcagcgagctgggatgcttaagtgcaaaccgacgactacacccatgtctaccactgataagctcaatgctgttgatggtgtgcttctttcttcttctgatgcgacagagtacaggagtattgttggtgggctccagtacttgacgatcacgcgaccagacatttcctatgctgttaaccgagtctgccagtatctgcagtcaccccgtgacactcattggtctgctgttaagcggattttgcgctatattcgtttcacggtggctcatggtttgcatattcggccgtctgactctggttgtctttcagcatattctgatgcagactgggctggcaatccggatgacaggcgatccacggggggttatgctgtcttctttggctctaacctgattgcctggagtgctcggaaacaggctactgtctcgcgtagcagtactgaggctgagtataaggctgtggccaatgccacatcagagatcatctgggtacagtccttgcttcaggagttaagtataccccaatcacagcctcctgttctttggtgtgataacatcggtgctacatacctttctgcaaatccggtattccatgcccgaacgaaacacattgaagttgactatcactttgtgcgtgaacgtgtctctcagaagcaactacagatcaagtttatttcttccaaggatcaacttgctgacatcttcaccaagccattgcctttgccacagtttgagacttgcaggcgcaatcttacccttctagattcattagaaagtggctaagattgagggagggtgttagactctatttacatgtgtatattgtaacgttgtataccacctcattatatatatatgtgataggccacccctagagggttgtgccggttcccccaaagcctattgtcttacactgtgcatgcgtatttcattgtttttacgtatcacgaaggtcctttattgttacgtaacttgtcattacacacacaagcacaacagctccgttattctgcggggtaggtagcgagagacgcatgcatgttgtctatccgggacggtccacatgacatcgtttcttcagtagatacgtacgtacgcatgtgtggatatctcgatctccccgcgtacgtgcacgagccatgcatggcgcgcgctggctggctggctcagtagtacggctggagcttccagcgctggttgtcgccctcgcaccacttccagagcacgacctcggtgccgtcgcgcacgccgccgtggtacttgtcgccgttgagggcgtcgaagttgaggtagatgttgttcaccatgcgcacgcacctgaacccgttgcccacgtccctgctctccgtccacagcaccgactcgtccaggtagtctgggttgtacggcaccagacgcacagggtgggactggccgagggagtgcttgatggcctgcccggtggccttgttcaccatggcgaaggcggggtagccctcctcgtccttgatgctggtgctccacctcatgtccttgatccagtgctggtagtcgtccttggggttggccggcgccagcaccaccttgccgttgcgcacggacatggcgtagttggggttggcgcggcagtagatcttcaccgtgggctgcggcggcatcggcctcccgccgtagttgccgtcgatgttcacctgcgacatgccgtacggcaccggcgccgcgtacccgggcgtcgccatcccgtacccgccgtaggtctcgcggtagtagtccatggctatatgctcgatctcctgatcgacct

SEQ ID NO: 2265 - DNA, 611 bp, Eragrostis curvula
  misc_feature (13)..(14): n is a, c, g, or t
  misc_feature (21)..(21): n is a, c, g, or t
gggtggcggccgnngggagtngggaacaagaacaggacagtgcttgctcatatagtgaccatggcctactacgggcgtgagagctacggcggctatggtggcgccatcgccacgccggggtacgcgccgccggcgccgtacgggatgtctcaggtgaacatcgagggcaacggctgcgggcgcccgctgccgccgcagcccaccgtgaaggtgtactgccgcgccaaccccaactacgccatgtccatccgcaacggcaaggtcgtccttgccccggccaaccccaaggacgactaccagcactggatcaaggacatgagatggagcacgaccatcaaggacgaggaaggctaccctgcctttgctctggtgaacaaggcaacaggggaggctatcaagcactcccttggccagtcccaccctgttcggctggtgccttacaaccctgactacctggacgagtccgtgctgtggacggagagccgcgacgtcggcaacggcttccgctgcgtcaggatggtgaacaacatctacctcaacttcgacgctctccacggcgacaagtggcacggcggcgtgcgcgacggcaccgagatcgtgctctggaaatg

SEQ ID NO: 2266 - DNA, 2668 bp, Triticum aestivum
gtctccgttcaccttcgcctccgccggctcctgctgctgctctacgtccacatacgcgcagtcggagtggcatttttcagcctaagcaacgtcacgatggcacagttgcttggttagcggcgtgcatgtctgctgctctcgcagatccatcctctgagccacgcacgtatcaagctgctatgcgcattcctcattggagagaggccatggagcaggagtatcaagcgcttcttcgcaatcagacatggactcttgttcctccacaatcacgggtaaatgtcattgattccaaatgggttttcaaagtgaagaggcattctgatgggtccattgagcgctataaggctcgtctggttgctcgtggttttcgccagcgttttggacttgactatgaagacaccttcagtctagtggtcaagcctactaccatcagacttcttctctctctggctgttactcgaggttggtttcttcgtcagcttgatgttcaaaatgcttttcttcatggtgtcttggcggaggaggtttacatgcgccagcctccgggtttctctgatccggatcgccccgatcatctctgtcgtctgtccaaggcaatttatggtctgaagcaggctcctcgtgcttggcatgctcgtcttgcaatggctcttcgtgctcatggttttgcatcatcaactgctgactcctcattgtttcttcttcaaaggcctgaggttactatgtacttgttggtctatgtagatgatatcattttggtcagctcctctcagtcggctgctactgcgcttgttcgctcacttggtgctgattttgcggtcaaggaccttgggaagcttcattactttcttggtgtggaggttacttctcgtgatgctggccttgttatgacgcagaagaagtactctctggatttgttgcagcgagctgggatgcttaagtgcaaaccaacgactacacccatgtctaccactgataagctcaatgctgttgatggtgtgcttctttcttcttctgatgcgacagagtacaggagtattgttggtgggctccagtacttgacgatcacgcgaccagacatttcctatgctgttaaccgagtctgccagtatctgcagtcaccccgtgacactcattggtctgctgttaagcggattttgcgctatattcgtttcacggtggctcatggtttgcatattcggccgtctgactctggttgtctttcagcatattctgatgcagactgggctggcaatccggatgacaggcgatccacggggggttatgctgtcttctttggctctaacctgattgcctggagtgctcggaaacaggctactgtctcgcgtagcagtactgaggctgagtataaggctgtggccaatgccacatcagagatcatctgggtacagtccttgcttcaggagttaagtataccccaatcacagcctcctgttctttggtgtgataacatcggtgctacatacctttctgcaaatccggtattccatgcccgaacgaaacacattgaagttgactatcactttgtgcgtgaacgtgtctctcagaagcaactacagatcaagtttatttcttccaaggatcaacttgctgacatcttcaccaagccattgcctttgccacagtttgagacttgcaggcgcaatcttacccttctagattcattagaaagtggctaagattgagggagggtgttagactgtatttacatgtgtatattgtaacgttgtataccacctcattatatatatatgtgataggccacccctagagggttgtgccggttccccccaaagcctattgtcttacactgtgcatgcgtatttcattgtttttacgtatcacgaaggtcctttattgttacgtaacttgtcattacacacacaagcacaacagctccgttattctgcggggtaggtagcgagagacgcatgcatgttgtctatccgggacggtccacatgacatcgtttcttcagtagatacgtacgtacgcatgtgtggatatctcgatctccccgcgtacgtgcacgagccatgcatggcgcgcgctggctggctggctcagtagtacggctggagcttccagcgctggttgtcgccctcgcaccacttccagagcacgacctcggtgccgtcgcgcacgccgccgtggtacttgtcgccgttgagggcgtcgaagttgaggtagatgttgttcaccatgcgcacgcacctgaacccgttgcccacgtccctgctctccgtccacagcaccgactcgtccaggtagtctgggttgtacggcaccagacgcacagggtgtgactggccgagggagtgcttgatggcctgcccggtggccttgttcaccatggcgaaggcggggtagccctcctcgtccttgatgctggtgctccacctcatgtccttgatccagtgctggtagtcgtccttggggttggccggcgccagcaccaccttgccgttgcgcacggacatggcgtagttggggttggcgcggcagtagatcttcaccgtgggctgcggcggcatcggccgcccgccgcagttgccgtcgatgttcacctgcgacatgccgtacggcaccggcgccgcgtacccgggcgtcgccatcccgtacccgccgtaggtctcgcggtagtagt

SEQ ID NO: 2267 - DNA, 690 bp, Hordeum vulgare
ggcgacgccggggtacgcgcccccggtgccgtacggcatgtcgcaggtgaacgtcgacggcaactgcggcggtcggccgatgccgccgcagcctacggtgaagatctactgccgcgccaaccccaactacgccatgtccgtgcgcaacggcaaggtggtgctcgcgccggccaaccccaaggacgactaccagcactggatcaaggacatgaggtggagcaccagcatcaaggacgaggagggctaccccgccttcgccatcgtgaacaaggccactggccaggccatcaagcactccctcggccagtcccaccctgtgcgtctggtgccgtacaacccggacttcctggacgagtcggtgctgtggacggagagcagggacgtgggcaacggcttcaggtgcgtgcgcatggtgaacaacatctacctcaacttcgacgccctcaacggcgacaagtaccacggcggcgtccgcgacggcaccgaggtcgtgctctggaagtggtgcgagggcgacaaccagcgctggaagatccagccctactactgagcagggcagcgcgcgccgtgcatggatcgatgcatgcatggctcgcgcacgtacgcgtggacatgcatcggcatatccacgctcatgtgtacgtacgtatctactgaagaaacgatgtgggctgtcccggatgaacaaca

SEQ ID NO: 2268 - DNA, 828 bp, Brachypodium distachyon
caagcaagcaaaccatggactactaccgcgagagcagctacggcgggggttacggggcgatggcgacgccggggtacgcgccgccggtgccgtacgggatgtcgcaggtgaacatcgacggctgcggcgcgccgcggcgcccgctgccgccgcagccgacggtgaaggtgtactgccgcgccaaccccaactacgccatgtccgtccgggacggcaaggtggtgttggcgcctgccaacccaagagacgactaccagcactgggtcaaggacatgcgctggagcacgagtgtcaaagacgaggaaggttaccctgctttcgccctcgtcaacaaggccactgggcaagccatcaagcactccctcggccagtcccaccccgttcggctggtggcgtataacccggagtatatggacgagtcggtgctgtggacggagagccgggatgtcgggaacgggttcaggtgcgtgcgcatggtgaacaacatctacctcaacttcgacgcgctcaacggggacaagtaccacggcggcgtccgtgacgggaccgaggtcgtgctctggaagtggtgcgagggcgacaaccagcgctggcagatcaagccttactactgatcatgcatgcatccagccatcagtcagtcagttaagcaagcccctctgcactgcgcacctatggcatggcatatctactcaagtctgaagatctgaataatggttgagctgctgtcgatctcccgccgccttccatgcggaggaaggccggatgacacgctctcgtataataatctgtctaacagaaggatggagtaacaataagaagcgcttc

SEQ ID NO: 2269 - DNA, 714 bp, Zea mays
atcccatgcgccgcgccgcgccgcgccgcgttgcgttcgtccagaatccaaacagtacggtacatcacctcctcccttgacctctcgtctccgaagaagagattctgccgagacaagatgatggagaagcagagcagggagcaccaggaaggctggcggcggcagaagcagcagcaggaggaggaggtggtgatggtgatgcacagccaggtgatgcggatcaagcaggaggaggacgagcgggccaaggtgcacgagacgtaccagcaccacgtctccgagatgcgccgaggcctgcgggacctcgacaggcagcgctcccgctccccgctcggccgcgccgcccgcaccgccatctccatcggcggcgactcctagggaatttactggagctggagctggagccgatcgatcccctcggggatgggctgtggggaaggcgtcctcggtcggcgatcgccgtcgtctcgccctcgccctcgccattccctcgctagggtcgattgatcgatcgttggtaggatccgtttcgtatcgtcgtcttcttggcacggtcggagtgctttttgagaagcacgcattttcattctatattggttttagggtgatataatggatcaatcatgtaaatatttttcttcatcattcgatcgatctacaggatgatgcaaaaatctgtttggtttgagaaataagtttatcttctcaatcttt

SEQ ID NO: 2270 - DNA, 904 bp, Saccharum officinarum
aaaacccaccgcaccctttcaacctctcttccctgacctcgccgaggcacagcgctttcactgttgctgtggtgacttcctccgccccgcttgcctccccgccgctcccgaacggtcggtctttgcatggcagcagcagctagctccaaggggcgggcgatcgctggaagcttcgtcagccgcgtcctggccggcaaggccgcctccccgaggagggccgtgcacgcctcggcgtacgacaagaacctggaggagcaggtgcgcccggcgttcgtgccggacgatgtgatcggcggcgccgggaaccccgacaagtactggagcccgcaccccacgaccggcgtgtttggcccggcggcggtggaccccaagctggccgctggtggcgcgccggacgccgccgcgaatgctgcgggaggcacggtgctggaccagaaggtgtggttccgcccgctcgaggacgtcgagaagccgcccccggtcgcctgagccgcgcggcgctgtgccagcccacactgctgataaggagagcctggcgctgatacacctatcactctgctcagctgggctccctgcttatcactacaatattattatactactagtagtgcttgatagcagtgtggctgtgctaataccagtgttatcaatatagtacataatactggttctgtagtacagtagtggtatcaggcattgcgtgcatcaggactggttgcgatagtagcaacatgatgctcgtgcctgtaataagaacaagcaggagatgtgtgcctgtgctgcttgtgcctgtgatgtactggtgtcgttatcagtgttataagtacttgggtcactggtttgtgcatgtgtttgttaccatgacgcagttcatataattgattgataaccactaatctgttct

SEQ ID NO: 2271 - DNA, 1116 bp, Zea mays
ccggtaggagtccacggaatcgaaaacccaccgcaccctttcatcagcctgcctgtccactgttggcttggtgacttcctccgctccgctccgctcccctccgctcccgaacggtcgatctttgcatggcagcagcagctggctccaaggggcgggcgatcgctggaagcttcgtcagccgcgtcctcgccggcaaggccgcctcgccgaggagggccgtgcacgcctcggcgtacgacaagaacctggaggaccaggtgcgcccggcgttcgtgccggacgatgtgatcggcagcgccgggagccccgacaagtactggagcccccaccccaagaccggcgtcttcggcccggcggcggtggaccccaagctggccgctggtggcgcgccggacgccggcgcggatgctgcaggaggcacggtgctggaccagaaggtgtggttccgcccgctcgaggacgtcgagaagccgccccccgccgcgtgagccgcgcggcgctgctaggccagcccacactgctgctcgctcataaaaagggcggcgggagagcctggcagtggcaggcactctgctcgtgctcggccgggctgggctccctgcttatatcactgcaatattatactactagtagtggtgcttgatagcagtgtgtggctgtgctaataccagtataatactggttctactataatacagtcgtatcaggcatggcgtgcatcaggactggttgtgatagtagcaacgtgatgctcgtgcctgtaataagaacaagcaggcgatgtgtgcctgtgatgtaccggtgtcgtcagtgttataagtacttgggtcaatggtttctgcatgtgtttgttaccttgttgcacttggcatctagagctcaaactctggtcattacaagccgagcacaccacaccacccaaatagcccttgaaacctcctacacatgcatggtaaacatcatacacaatcaccctaagaaaaccattatcatttaaagagcatatgttctatctatcgatattcatgcagatcgtacgccgtgacggcagatcttctgcgagaacactcgcttcgctaacacaacctttgatgttcacgcagaccatttgcatga

SEQ ID NO: 2272 - DNA, 818 bp, Panicum virgatum
tttcgacttcttcccccatctcgcagcagagggctgtgctgctgttcgtccggcgactcctctcccgcgcttgcccttcctcccgaacggccggtccttgcatggcagcagcagctagcttcaaggggcgggcgatcgctgggagcttcgtcagccgcgtcctggccggcaaggccgcctccccgaggagggccgtgcacgcctcggtgtacgacaagaacctggaggaccaggtgcgccccgcgttcgtgccggacgatgtgatcggcggcgccgccaaccccgacaagtactgggccccccaccccaggaccggcgtcttcggcccggccgcggtggacgccacgctgcccgccgccggcgcgccggacgccgccgcggatgctccgggcacggtgctggaccagaaggtgtggttccgccccctggaggacgtcgagaagccgccgcccgtcgcctgaggcgcgccggccgggcgctcgcagccggcgcgctgccttgctgataaggcagggagagcctggcgctgatacgcctatcactctgctcagccgggctcccttgcttatagctataatactgcttggttagtagtggctctggctgtggcgctgtgcttatagtagtactggtttctattatcgtggtgtgagtaatcgggcatgacgggcctcaggaccggtagcggctgtacaaaaatgatgctcgtgctcgtgcctgtaataagagcaagcaggaggtgtgtgcccgtgctgcttgtggatgtgatgtacctgtattcttatcagtgttataagtatctggatccttggttgtgc

SEQ ID NO: 2273 - DNA, 821 bp, Panicum virgatum
tttcgacttcttcccccatctcgcagcagagggctgtgctgctgttcgtccgggcgactcctctcccgcgcttgcccttcctcccgaacggccagtccttgcatggcagcagcagctagcttcaaggggcgggcgatcgctgggagcttcgtcagccgcgtcctggccggcaaggccgcctccccgaggagggccgtgcacgcctcggtgtacgacaagaacctggaggaccaggtgcgccccgcgttcgtgccggacgatgtgatcggcggcgccgccaaccccgacaagtactgggccccccaccccaggaccggcgtcttcggcccggccgcggtggacgccacgctgcctgccgccggcgcgccggacgccgccgcggatgctccgggcacggtgctggaccagaaggtgtggttccgccccctggaggacgtcgagaagccgccgcccgtcgcctgaggcgcgacggccggacgctcgcagccggcgcgctgccttgctgataaggcagggagagcctggcgctgatacgcctatcactctgctcagccgggctcccttgcttatagctataatactgcttggttagtagtggctctggctgtggcgctgtgcttatagtagtactggtttctattatcgtggtgtgactgtgtgagtaatcgggcatgacgggcctcaggaccggtagcggctgtacaaaaatgatgctcgtgcctgtaataagagcaagcaggaggtgtgtgcccgtgctgcttgtggatgtgatgtacctgtattcttatcagtgttataagtatctggatccttggttgtgc

SEQ ID NO: 2274 - DNA, 1139 bp, Setaria italica
cgggcatgccggtgccttcagcctgcagcccccccggggcccggagcgctataaaacggggggcagccggaggagtgcaaaggaattgaaaacccaccactccctttcgacttcttcccccaatctcgcagtcgcagcacaggactgttcgtccgtccggcgattcatcttctgcgctcccttccctcccgaacggtcggtccttgcatggcagcagcggcaagctccaaggggcgggcgatcgctggaagcttcgtcagccgcgtcctggccggcaaggccgccgcctccccgaggagggccgtgcacgcctcggcgtacgacaagaacctggaggaccaggtgcgcccggcgttcgtgccggacgatgtgatcggcggcgccgccaaccctgacaagtactggggcccccaccccaagaccggcgtgttcggccccgcggcggtggacgccaacaaggccgccggcgcgccggacgccgccgcgaatggtgcgggctcggtgctggaccagaaggtgtggttccgcccccttgaggacgtcgagaagcctccccccgccgcctgaggccggccgtcagcccactgccgataagtttgtgtgagagcccggcactgatactcctatcactctgctccgctgggctcccttgcttatcgaccgctataatactgcttggaagtagtagtgtggctgtgctaatactgggtttatggtagtagtatcaggcatggcgtgcatcaggactggtagtagctgtagtagcaacgtgatgctcgtgcccgtgcctgtgcctgtaataagagcaagcaggagatgcgcgcatgtcctgcttgtgggtgtgatgtacctgcgtcctttatccgtgttatataagtgttcgggtcactggtttgcgcatgtttcatgtcctcgatgccgttcaattatggttggtttcgttttggtttgaaatcaaatcagtccgtatcaggaattcagagtagagggcgacatgaatccaatcggtgattgtttagcaatcggtaaccacgattgtcacgtgattacggctgaattggagtgggcgagtggctggtgctgtatcgacgtgtttaacgttacgatgagttcgtcgcctgccctgcctcttcgggatt

SEQ ID NO: 2275 - DNA, 745 bp, Zea mays
gactactatcatcatttcaacctctctccctcggcctcgccggcggcacagcgcagcgcttccactgttgggtgtggtggatttcctccgcccccgaacggtcgatcttttgcatggcagcagcggctagctccaaggggcgggccatcgctgggagcttcgtcagccgcgtcctggccggcaaggccgcctccccgaggagggccgtgcacgcctcgtcgtacgacaagaacccggaggagcaggtgcgcccggcgttcgtgccggacgatgtgatcggcggcgcggggagccccgacaagtactggagcccccaccccaagaccggcgtgttcggcccggcggcggtggacaccaaccagctgggcgtcgccgctgacgctgccgccgcgaatgcggctgcagcaggaggcacggtgctggaccagaaggtgtggttccgcccgctcgaggacgtcgagaagccgccccccgtcgcctgaaccgcgccacgcccacgcgacgcgacgctgccagcccacactgctgatacaaggggcggcgggagggagagtcctggcaatgtgatgctcgtgcctgtaataagaacaagcaagagatgtgtgtgcctgtgatgtaccggtgtcgttatcagcgttatacaagtacttgcggttcatatgatcgataaccactagaactagcttcctttattccgtgaccgcgactcaaatcaatccctatagcacaccactcaggcgcccac

SEQ ID NO: 2276 - DNA, 1442 bp, Setaria italica
ctgatttgatttcaaaccaaaacgaaaccaaccataattgaacggcatcaaggacatgaaacatgcgcaaaccagtgacccgaacacttatataacacggataaaggacgcaggtacatcacacccacaagcaggacatgcgcgcatctcctgcttgctcttattacaggcacgggcacgagcatcacgttgctactacagctactaccagtcctgatgcacgccatgcctgatactactaccataaacccagtattagcacagccacactactacttccaagcagtattatatcggtcgataagcaagggagcccagcggagcagagtgataggagtatcagtgccgggctctcacacaaacttatcggcagtgggctgacggccggcctcaggcggcggggggaggcttctcgacgtcctcaagggggcggaaccacaccttctggtccagcaccgagcccgcaccattcgcggcggcgtccggcgcgccggcggccttgttggcgtccaccgccgcggggccgaacacgccggtcttggggtgggggccccagtacttgtcagggttggcggcgccgccgatcacatcgtccggcacgaacgccgggcgcacctggtcctccaggttcttgtcgtacgccgaggcgtgcacggccctcctcggggaggcggcggccttgccggcgaggacgcggctgacgaagcttccagcgatcgcccgccccttggagcttgccgctgctgccatgcaaggaccgaccgttcgggagggaagggagcgcagaagatgaatcgccggacggacgaacagtcctgtgctgcgactgcgagattgggggaagaagtcgaaagggagtggtggagattcgatgcgccgtaggaacgatgagaactcagtccgtgtcaccaacctctcagaggacacccgtgagcccgacctcctcgagctgttccgcgcgttcggccctgtcagccgtgtctatgtcgcggtggaccagaagactgggtcaagcagggggttcggcttcgtcaactttgttcacagagaggacgcggagaaggcgatcagcaagctcaatggttatggttatgataaccttatcctccgcgttgagtgggcgacgccaaggcccaactagttttttcgctgctacctacttactagagttgcatattttcgcaaagaagtgctacattggtatgttgtttggaatagcacttgtgtcatgcgcatatgctgtgtcgtaaaaacctgctgttaagtgttaattttggttggacgcggataattacactcgctgctgttttgttttgctgtctctgctgtctttattcattttgtttggtgctcggtgcagtcagaaaaaggtttgaggatggtcaaggaattggtgttcacatgacggtgcccgaatgcattgctttcactctagtttcgtt

SEQ ID NO: 2277 - DNA, 835 bp, Panicum virgatum
gaccaccactccctgtttcgacttgttcttcccccatctcgcagcagaggggctgtgctgcttgcagttcgtccggcgactcgtctcctacgcttccccttcctcccgaaaggccggtccttgcatggcagcagcagctagcttcaaggggcgggcgatcgctgggagcttcgtcagccgcgtcctggctggcaaggccacctccccgaggagggccgtgcacgcctcgtcgtacgacaagaacctggaggaccaggtgcgcccggcgttcgtgccggacgatgtgatcggcggcgccgccaaccccgacaagtactggggcccccaccccaagaccggcgtcttcggcccggccgcggtggacgccaacctgcccgccggcggcgcgccggacgccgctgcggatgctccgggcacggtgctggaccagaaggtgtggttccgccccctggaggacgtcgagaagccgccgcccgtcgcctgagcgaggcgcaccggccgggcgctcgcagccggcgcacggccttgctggtaaggcagggagagcctggcgctgatacgcctatcactctgctcagctgggcccccttgctgcttatcgctataatactgcttggttagcaagtgtgtgtgtggctgtgcttatagtagtactggttaatcaggcatggcgtgcgtcaggacctgtacaaaaatgatgctcgtgctcgtgctcgtgcctgtaataagagcaagcaggaggtgtgtgcctgtgctgcttgtggatgtgacgatgtacctgtgttcttatcagtgttataagtatctggatccttggttgtgcatgtttcgtgtc

SEQ ID NO: 2278 - DNA, 813 bp, Panicum virgatum
ccactccctgtttcgacttgttcttcccccatctcgcagcagaggggctgtgctgcttgcagttcgtccggcgactcgtctcctacgcttccccttcctcccgaaaggccggtccttgcatggcagcagcagctagcttcaaggggcgggcgatcgctgggagcttcgtcagccgcgtcctggctggcaaggccacctccccgaggagggccgtgcacgcctcgtcgtacgacaagaacctggaggaccaggtgcgcccggcgttcgtgccggacgatgtgatcggcggcgccgccaaccccgacaagtactggggcccccaccccaagaccggcgtcttcggcccggccgcggtggatgccaacctgcccgccggcggcgcgccggacgccgctgcggatgctccgggcacagtgctggaccagaaggtgtggttccgccccctggaggacgtcgagaagccgccgcccgtcgcctgagcgaggcgcaccggccgggcgctcgcagccggcgcacggccttgctggtaaggcagggagagcctggcgctgatacacctatcactctgctcagctgggcccccttgcggcttatcgctataatactgcttggttagcaagtgtgtgtgtggctgtgcttaatagtagtactggttaatcaggcatggcgtgcgtcaggacctgtacaaaaatgatgctcgtgctcgtgcctgtaataagagcaagcaggaggtgtgtgcctgtgcttcttgtggatgtgacgatgtacctgtgttcttatcagtgttataagtatctggatccttggttgtgc

SEQ ID NO: 2279 - DNA, 821 bp, Pennisetum glaucum
accactgcctttcgactttctccttcacccaaacccaagcaaagcaatctcgctcgcagtcgccgagtccttttcttgcgcgctcttcttcctcccgaacggtcggtctcccttgcatggcagcagcggcaagcttcaaggggcgggcgatcgctggaagcttcgtcagccgcgtcctggccggcaaggccgccgccgcctccccgaggagggccgtgcacgcctcggcgtacgacaagaacctggacgaccaggtgcgcccggcgttcgtgccggacgatgtgatcggcggcgccgccaaccccgacaagtactggagcccccaccccaagaccggcgtgttcggccccgcggccgtcgacgccgccaaggccgccggcgcgccggacgccgccgcgaatggtcccggctccgtgctggaccagaaggtgtggttccgccccctcgaggacgtcgagaagccgccccccgccgcctgaggcgcgccgcggccggccgtcagcccactgccgataagcctgctgtgactgtgagagcccggcactggtccgcctaccactctgctccgctgggctccctgcttgcttatcgaccgctatagtacttagtagtgtggctgtgctgatactgggtttatatggtagtcgtatcatcaggcgtggagggcatcaggattggtactagcgacatggtgctcgtgaccgtgcctgtaataagagcaagcaggaggtgtgtgcctgccctgcttgcggatgtcatgtacctgtgtcctctgtcagtgttatataactgtttgggtcactggtttgtgcaaaaaaaaa

SEQ ID NO: 2280 - DNA, 633 bp, Setaria italica
gagtgcaaaggaattgaaaacccaccactccctttcgacttcttcccccaatctcgcagtcgcagcacaggactgttcgtccgtccggcgattcatcttctgcgctcccttccctcccgaacggtcggtccttgcatggcagcagcggcaagctccaaggggcgggcgatcgctggaagcttcgtcagccgcgtcctggccggcaaggccgccgccttgtgcaggagggccgtgcacgcctcggcgtacgacaagaacctggaggaccaggtgcgcccggcgttcgtgccggacgatgtgatcggcggcgccgccaaccctgacaagtactggggcccccaccccaagaccggcgtgttcggccccgcggcggtggacgccaacaaggccgccggcgcgccggacgccgccgcgaatggtgcgggctcggtgctggaccagaaggtgtggttccgcccccttgaggacgtcgagaagcctccccccgccgcctgaggccggccgtcagcccactgccgataagtttgtgtgagagcccggcactgatactcctatcactctgctccgctgggctcccttgcttatcgaccgctataatactgcttggaagtagtagtgtggctgtgctaatac

SEQ ID NO: 2281 - DNA, 731 bp, Brachypodium distachyon
gaggagtccacccacagaaactgaaaccctcttctccccacagtttcgcagcagccgctccatcctttcaacttctctcttcctcgatcgacctttgcatggcagcagtggctaactccaaggggcgggcgatcgctggaaacttcgtcgcgcgcatcctggccggcaaggccgcctccccgagcagggccgtgcacgcgtcggcgtacgacaagaacgtggaggagcaggtgcggccggccttcgtgccggacgatgtgatcggcggtgccgccgggagccctgacaagtactggggccctcacccgaccaccggcgtcttcggcccagctgccgtggacccgaaactcgccgccgctgcgggcgcgccggcgaccgccgcgaatggtggcggcggctccgtgctggaccagaaggtgtggttccgcccgctcgaggacgtcgagaagccccccgtcgcctgatcgacgctaccaggacgagagcctagctctactaataactctctatcactcaacttagctgggatcctcctctattataactagtggactggatcgagtgctgcttatctgtagtgtgcttctgcttgagtacagacatggcgggcaccggaactagtagtaatgtggtgctactgcctagaataagaacaagcagaagatgtgtgttgttggttgtgatgtactcccgtcccaaaccagtactaatatattgcaagtgtttggtaa

SEQ ID NO: 2282 - DNA, 740 bp, Cenchrus ciliaris
  misc_feature (8)..(9): n is a, c, g, or t
  misc_feature (11)..(11): n is a, c, g, or t
  misc_feature (13)..(15): n is a, c, g, or t
ccgctccnntncnnntcgacttgttcacccaagcaatctcgtcagtcgcagcgactcctctcctgcgcttccccttcctcccgaacggtcggtccttgcatggcagcagcggcaagctccaaggggcgggcgatcgctggaagcttcgtcagccgcgtcctggccggcaaggccgccgccgcctccccgaggagggccgtgcacgcctcggcgtacgacaagaacctggaggaccaggtgcgcccggcgttcgtgccggacgatgtgatcggcggcgccgccaaccccgacaagtactggggcccccaccccaagaccggcgtgttcggccccgcggccgtcgacgccagcagcaacgcgccggacgccgccgcgaatggtgccggctcggtgctggacctgaaggtgtggttccgccccctcgaggacgtcgagaagccgccccccaccgcctgagagcccggcactggtccgcctaccactctgctccgctgggctcccttgcttatcgatcgctataatattgcttgcaagcagtgtggctgtgctaatactagtgagtttgtatggtagtagtatcatcaggcatgtcgggcatcaggactggtagtagcaggagcaaaatggtgctcgtgaacgtgcctgtaataagagcaagcaggaggtgtgtgcatgccctgcttgcggatgtgatgtaccttccgtcctctgtcagtgttatacaactactgtttgggtca

SEQ ID NO: 2283 - DNA, 1073 bp, Triticum aestivum
ccttcaccttcgtcttccttcctctcggcagttcgacctttgcatggcagcagtggctagctccaaggggcgggtgatcgctgggagcctcgtcgcgcgcgtcctcgccggcaaggccaacgcctccccgaggagggcggtgcacgcgtcggcctacgacaagaacgtggacgagcaggtgcgcccggccttcgtgccggacgatgtgatcggcggcgccgggagcccagacaagtactggggccctcacccgaccaccggcgtcttcggccccgccgcggtcgaccccaagctggccgccagcctcgcgccggcgagcgccgctgcgaatggtggcgcctccgtgctggaccagaaggtgtggttccgcccgctcgaggacgtcgagaagccccccgtcgcctgatcatcgccgacggcgacgatagcccagctcgacatctctatcactccgcttagctgggctcgacttcctacttataattacatataatctgtagtggtgtgctcgtgctatagtacagacatggcaggcaccagaaccagtagtagtaacgcggtgttgctgcccggaataagagcgagcagaagatgtgtgatgatgatgacagtgatgttggtggctgtgatgtactcccgtcttaaaccagtgctattgcaagtgtttggtacactatccgcccggtgtccttccccaagattagctttgaccgcgcgtgcagcctcatcgtattccgacccgctcacaatttcgccctacatcaatcaacgaatgtcccgtcccaccacaacccgcctcaccagcttacttcttaacatacgcctccccaatccccctctgcaccgccggcctctctgcaatcctatccacccacttcaacaaatgcggaaacgccatctcctccttggaaaacccactcctctcccaattcttcacccaagggtaggtttttatgtcagcaatggaatatcgtcccctttccaataaccgccaaatactccttttcttcccccgtgtcactggccgggggggcgctccaatccaatttcccccgccgccaatgggggcggga

SEQ ID NO: 2284 - DNA, 914 bp, Triticum aestivum
ctccacccaaccgtctcggagcagagcagagcctctctttgtccttcaccttcgtcttcctccctctcggcagctcgacctttgcatggcagcagtggctagctccaaggggcgggtgatcgctgggagcctcgtcgcgcgcgtcctcgccggcaaggccaacgcctccccgaggagggcggtgcacgcgtcggcctacgacaagaacgtggacgagcaggtgcgcccggccttcgtgccggacgatgtgatcggcggcgccgggagcccagacaagtactggggccctcaccccaccaccggcgtcttcggccccgccgcggtcgaccccaagctggccgccaccctcgcgccggccagcgccgccgcgaatggtggcgcctccgtgctggaccagaaggtgtggttccgcccgctcgaggacgtcgagaagccccccgtcgcctgatcgccggcgaccaccaagacgacgatagcccagctcgacatctctatcactccgcttagctgggctcgaccacccacctaattataatctacagtagtgtgcttgtgctatagtacagacatggcaggcaccagaaccagtagtagtattgcggtgttgctgcctggaataagagcgagcagaagatgtgtgatgatgatgatgacactgatgttggtggctgtgatgtactcccgtcttaaaccggtactattgcaagtgtttggtaaccgctgcgtctcttgattgtgcaaattttgctcttttggggacgttctctgtcaggcattcagtatagacagggacttgaacacatcgtgactgagctgcatttggctggggtttgatcaacgtgtatcacgctgtgaatttgctgtgtggtccagacccatattttttgaaactcggcaaaagatttgccattttc

SEQ ID NO: 2285 - DNA, 1066 bp, Triticum aestivum
cgctcaaccgtctcggagcagaggctctcccttcaccttcgtcttcctccctctcggcagttcgacctttgcatggcagcagtggctagctccaaggggcgggtgatcgctgggagcctcgtggcgcgcgtcctcgccggcaaggccaacgcctccccgaggagggcggtgcacgcgtcggcctacgacaagaacgtggacgagcaggtgcgcccggccttcgtgccggacgatgtgatcggcggcgccgggagcccagacaagtactggggccctcacccaaccaccggcgtcttcggccccgccgcggtcgaccccaagctggccgccagcctcgcgccggccagcgccgccaagggcggcccctccgtgctggaccagaaggtgtggttccgcccgctcgaggacgtcgagaagccccccgtcgcctgatcgccggcgacgaccagtcgaccatagcccagctcgacatctctatcactccgcttagctgggctcgacgacctacctaattatagtctacagtggtctgctcgtgctatagtaagtacagacaatggcaggcaccggaaccggtagtagtaatgcggtgttgctgcccggaataagagcgagcagaagatgtgtgatggtgatgatgacagtaatgttgttggctgtgatgtacccccgtcttgaaccagtactattgcaagtgtttggtacccgctgcgtctcttgatgttgcaaattctgctcttttggggccgttctctgtcaggcattcagcatgacagtgacttgaacgccaccttgtggccgaattgcatctgaatcaaggaaaaaagtagcgcgctatacaaaataggttcgcctctgaaaatatgctattaacgagacattgcacactgatgattaatttagcgagacaattctctatacgttgtgctattagcagcgctatagctcgttattttttctggtgatctgaaccgtgtttgatcaacgtctttcacgctgtgaattgtcgtgcggtcgagacacgtctgctcggcagccattccgaataaagatggtgttaatggtt

SEQ ID NO: 2286 - DNA, 715 bp, Triticum aestivum
gcgaaacccactccacccacccgtctcggagcatgagcacagcctctctttgtccttcaccttcgtcttcctccctctcggcagctcgacctttgcatggcagcagtggctagctccaggggcgggtgatcgctgggagcctcgtcgcgcgcgtcctcgccggcaaggccaacgcctccccgaggagggcggtgcacgcgtcggcctacgacaagaacgtggacgagcaggtgcgcccggccttcgtgccggacgatgtgatcggcggcgccgggagcccagacaagtactggggccctcaccccaccaccggcgtcttcggccccgccgcggtcgaccccaagctggccgccaccctcgcgccggccagcgccgccgcgaatggtggcgcctccgtgctggaccagaaggtgtggttccgcccgctcgaggacgtcgagaagccccccgtcgcctgatcgccggcgaccaccaagacgacgatagcccagctcgacatctctatcactccgcttagctgggctcgaccacccacctaattataatctacagtagtgtgcttgtgctatagtacagacatggcaggcaccagaaccagtagtagtattgcggtgttgctgcctggaataagagcgagcagaagatgtgtgatgatgatgatgacactgatgttggtggctgtgatgtactcccgtcttaaaccggtactattgca

SEQ ID NO: 2287 - DNA, 430 bp, Zostera marina
atctcgcagcagaggggctgtgctgcttgcagttcgtccggcgactcgtctcctacgcttccccttcctcccgaaaggccggtccttggatggcagcagcagctagcttcaaggggcgggcgatcgctgggagcttcgtcagccgcgtcctggccggcaaggccacctccccgaggagggccgtgcacgcctcgtcgtacgacaagaacctggaggaccaggtgcgcccggcgttcgtgccggacgatgtgatcggcggcgccgccaaccccgacaagtactggggcccccaccccaagaccggcgtcttcggcccggccgcggtggacgccaacctgcccgccggcggcgcgccggacgccgctgcggatgctccgggcacggtgctggaccagaaggtgtggttccgccccctggaggacgtcgagaa

SEQ ID NO: 2288 - DNA, 674 bp, Triticum aestivum
ccttcaccttcgtcttccttcctctcggcagttcgacctttgcatggcagcagtggctagctccaaggggcgggtgatcgctgggagcctcgtcgcgcgcgtcctcgccggcaaggccaacgcctccccgaggagggcggtgcacgcgtcggcctacgacaagaacgtggacgagcaggtgcgcccggccttcgtgccggacgatgtgatcggcggcgccgggagcccaaacaagtactggggccctcacccgaccaccggcgtcttcggcccggccgcggtcgaccccaagctggccgccagcctcgcgccggctgctggcgccgcgaatggtggcgcctccgtgctggaccagaagtgtggttccgcccgctcgaggacgtcgagaagccccccgtcgcctgatcgccaacgacgacgaccatagcccagctctacatctctatcactccgcttagctgggctcgacttcctacttataattacatataatctgtagtggtgtgctcgtgctatagtacagacatggcaggcaccagaaccaatagtagtaacgcggtgttgctgcccggaataagagcgagcaggagatgtgtgatgatgatgatgatgacagtgatgttggtggctgtgatgtactcccgtcttgaaccagtaatattgccagtgtttgg

SEQ ID NO: 2289 - DNA, 720 bp, Hordeum vulgare
cacacacccacacccactcttcttcccccaaccgtctcggatcggagcagagcagaggctctcccttggccttcctccctctcggcagcaggctcgacctttgcatggcagcagtggctacctccaaggggcgggtgatcgctgggagcctcgtcgcgcgcgtccttgccggcaaggccgccaacgcctccccgaggagggcggtgcacgcgtcggcctacgacaagaacgtggacgagcaggtgcgcccggccttcgtgccggacgatgtgatcggcggcgccgggagcccagacaagtactggggccctcacccgaccaccggcgtcttcggcccggccgcggtcgaccccaagctgtccgccagcctcgcggcgccggccagcgccgcgaatggtggcggcgcctccgtgctggaccagaaggtgtggttccgcccgctcgaggacgtcgagaagccccccgtcgcctgatcgccgccggcgaccacagcccagctcgacatctctatcactctccttagctgggctcgaccacctacttaactattatctctagtagcgtgcttgtgctatagtacagtcatggcaggcaccggaagaagaaccggtagtagtgacgcggtgttgctgcctggaataagaacctgtgaaagatgtgtgatgatgatgacagtgatgtgctcccgtcgaaaaccagtattattacaagtgtttggta

SEQ ID NO: 2290 - DNA, 736 bp, Avena sativa
tcactccctttctcctccccagcacatctcgcggcacctgccccctctccatctctcccacctctcgtctcgaccgacctttgcatggccgcagtggctggctccaaggggcggatcgctggaaacctcgtcgcgcgcgtcctcgccggcaacggcaagtccgcctccccgaggagggcggtgcacgcctcggcctacgacaagaacgtggacgagcaggtgcgcccggccttcgtgccggacgatgtgatcggcgggcccgacagccccgacaagtactggggcccgcacccgaccaccggcgtcttcggccccgcggtggtggacggcaagctcgtcgccgccggcgcgccggtggccgccgccgcgaatggtaccggcggctcggtgctggaccagaaggtgtggttccgcccgctcgaggacgtcgagaagccgcccccggtcgcctgatcgcgccaccgcgcgccaaggcgacgaacgagcctagcaccgcgactcttatcactctctttagctgggctcattcgcttatacccactgcttgatcatcatctctagtgtgcttgtgctatagtacagacatggcgtgcaccaggacgtgtagtagtagtaatgtggtgttgctgcctggaataagatcgagcagaagatgtgtgatgatgatgacaatgatgctatattcctgtcttaaaccagtatgtattattacaggtgttgcaaatccatgctcttg

SEQ ID NO: 2291 - DNA, 855 bp, Avena sativa
ctccctttctcctccccaagcacatctcgcggcacctgccccctctcccacctttctcctcctctcgtctcgaccgacctttgcatggccgcagtggctggctccaaggggcggatcgctggaaacctcgtcgcgcgcgtcctcgccggcagcggcaagtccgcctccccgaggagggcggtgcacgcctcggcctacgacaagaacgtggacgagcaggtgcgcccggccttcgtgccggacgatgtgatcggcgggcccgaccgccccgacaagtactggggcccgcacccgaccaccggcgtcttcggtcccgcggtggtggacggcaagctcgtcgccgccggcgcgccggtggccgccgccgcgaatggtaccggcggctcggtgctggaccagaaggtgtggttccgcccgctcgaggacgtcgagaagccgcccccggtcgcctgatcgcgccaccaagacgacgagcctagctccgcgactctatcactctctttagctgggctcattcgcttatacccactgcttgatcatcatctctagtgtgcttgttgtgctatagtacagacatggcagacaccaggacgtgtagtagtagtaatgtggtgttgctgcctggaataagatcgagcagaagatgtgtggtgatgatgatgatgacaatgatgctatattcctgtcttaaaccagtatgtattattacaggtgttgcaaatccatgctcttggctacgtacgctcttttggggttggttttggtttcagaatagtccctgtcaggcattcagtggagatagggacctgaattataccttgtgcctgaattgcatctggctggtgtgtgaacaac

SEQ ID NO: 2292 - DNA, 858 bp, Avena sativa
gaaaacccacctccctttctcctccccaagcacatctcgcggcacctgccccctctcccacctttctcctcctctcgtctcgaccgacctttgcatggccgcagtggctggctccaaggggcggatcgctggaaacctcgtcgcgcgcgtcctcgccggcagcggcaagtccgcctccccgaggagggcggtgcacgcctcggcctacgacaagaacgtggacgagcaggtgcgcccggccttcgtgccggacgatgtgatcggcgggcccgaccgccccgacaagtactggggcccgcacccgaccaccggcgtcttcggtcccgcggtggtggacggcaagctcgtcgccgccggcgcgccggtggccgccgccgcgaatggtaccggcggctcggtgctggaccagaaggtgtggttccgcccgctcgaggacgtcgagaagccgcccccggtcgcctgatcgcgccaaggcgacgaacgagcctagcaccgcgactctatcactctctttagctgggctcattcgcttatacccactgcttgatcatcatctctagtgtgttcttgtgctatagtacagacatggcagacaccaggacgtgtagtagtagtaatgtggtgttgctgcctggaataagatcgagcagaagatgtgtggtgatgatgatgatgacaatgatgctatattcctgtcttaaaccagtatgtattattacaggtgttgcaaatccatgctcttggctacgtacgctcttttggggttggttttggtttcagaatagtccctgtcaggcattcagtggagatagggacctgaattataccttgtgcctgaattgcatctggctggtgtgt

SEQ ID NO: 2293 - DNA, 856 bp, Phaseolus vulgaris
tctgtttcacacaacacagaacagaacagaacagagaagagatgggaggctcatggaaactcacatgtgccctcttgctactcatctccgccgcagccaccgccactgaccacattgtgggtgccaatcgtgggtggaaccctaacatcaactacactctctgggccaacaaccacactttctatgtcggcgaccttatctcattcaggtaccagaaaaaccaatacaatgtgtttgaggtgaaccaaactgggtatgacaactgcaccacagaaggggcagtggggaattggaccagtggcaaggatttcatacccctgaataaggccaagagatattacttcatttgtgggaatggccaatgcttcagtggaatgaaggtgtctgttattgtccatcctctgccaccacctcccacctctgcgcttgctgctgaacattcaacaccaaactcagcttctcctctgctcttcaaacgctctctgctgctgtcctctgttttggcttgctttggatttgtttggatgtagcagctgttgctcattcttttctcctttcttctctattcatcgttgtatcttccttgtttttttctgattcacgtctttctaagccaaatgtaagcttgttttgttagtgctgaaattaaatgtctccaattctgggtacaagagtctcctctgtagtttcgatgcagaacaaagagaataggttttcttgacacctctgtagtacttgaaaaaaaacactgttttagagttaaagttcctgcacaaatttaatatctttatgtttttgtttgactacaaaattaaatgtgtttgatttacgtcagtatcagattatgaaaaaaaca

SEQ ID NO: 2294 - DNA, 808 bp, Phaseolus vulgaris
  misc_feature (804)..(804): n is a, c, g, or t
ctgtcggtttcacacaacacagaacagaacagaacagagaagagatgggaggctcatggaaactcacatgtgccctcttgctactcatctccgccgcagccaccgccactgaccacattgtgggtgccaatcgtgggtggaaccctaacatcaactacactctctgggccaacgaccacactttctatgtcggcgaccttatctcattcaggtaccagaaaaaccaatacaatgtgtttgaggtgaaccaaactgggtatgacaactgcaccacagaaggggcagtagggaattggaccagtggcaaggacttcatacccctgaataaggccaagagatattacttcatttgtgggaatggccaatgcttcagtggaatgaaggtgtctgttattgtccatcctctgccaccacctcccacctctgcgcttgctgctgaacattcaacaccaaactcagcttctcctctgctcttcaaacgctctctgctgctgtcctctgttttggcttgctttggatttgtttggatgtagcagctgttgctcattctttctcctttcttctctattcatcgttgtatcttccttgtttttttctgattcacgtctttctaagccaaatgtaagcttgtgtttgttagtgctgaaattaaatgtctccaattctgggtacaagagtctcctctgtagtttcgatgcagaacaaagagaataggttttcttgacacctctgtagtactagaaaaaaatttgttttagagttaaagttcctgcacaaatttaacatctttatgtttttgtttgnctcc

SEQ ID NO: 2295 - DNA, 769 bp, Cajanus cajan
atcaacgcagagtacggggagggaagagagagagaagatatggcaagggcatgctcatgggaactgacatgtgccctccttctgctcctctgcgccgttgccaccgccaccgaccacattgtgggagccaatcgtgggtggaaccctggcattaactacactctttgggccaacaaccacactttctatgtcggcgaccttatctcattcaggtaccaaaagaaccaatacaatgtgtttgaggtgaaccaaacagggtatgacaactgcaccacagaaggggcagtggggaattggagtagtggcaaggatttcataccccttaacaaggccaagagatactacttcatttgtggcaatggccagtgcttcaatgggatgaaggtctcagttattgtccatcctcttccttcacctcctacctctgctgaacattcaactccaaagtctgcatctcctgtgctcttcaaaaggagttttcactcactaatgctgtcttttgtgttagcttggtttggatgtgtttggatttagcaactgtggagcataatggcttattcttttctcttttctttttccttccatctcaatttgttcgtgtatcttccatgtttacttcggattctcgtcatgaatggattcatatttctaagtgacatgcaaacttgttagttctgaattgtttctcctgtggtgtaggttctccattccaattcaagctattgtttccacgagtcttatctatttagaggcaaattaaagaaaatat

SEQ ID NO: 2296 - DNA, 869 bp, Cajanus cajan
cccaaatgcaataattgttgtcctctacttacttctacttaccgttaatgttcctttgctttgaaatactcaactctagaaactagaaagcaaagggaagagagagagaagatatggcaagggcatgctcatgggaactgacatgtgccctccttctgctcctctgcgccgttgccaccgccaccgaccacattgtgggagccaatcgtgggtggaatcctggcattaactacactctttgggccaacaaccacactttctatgtcggcgaccttatctcattcaggtaccaaaagaaccaatacaatgtgtttgaggtgaaccaaacagggtatgacaactgcaccacagaaggggcagtggggaattggagtagtggcaaggatttcataccccttaacaaggccaagagatactacttcatttgtggcaatggccagtgcttcaatgggatgaaggtctcagttattgtccatcctcttccttcacctcctacctctgctgaacattcaactccaaagtctgcatctcctgtgctcttcaaaaggagttttcactcactaatgctgtcttttgtgttagcttggtttggatgtgtttggatttagcaactgtggagcataatggcttattcttttctcttttctttttccttccatctcaatttgttcgtgtatcttccatgtttacttcggattctcgtcatgaatggattcatatttctaagtgacatgcaaacttgttagttctgaattgtttctcctgtggtgtaggttctccattccaattcaagctattgtttccacgagtcttatctatttagaggcaaattaaagaaaatataaaaaaaaaacaattaatgccttggt

SEQ ID NO: 2297 - DNA, 524 bp, Cajanus cajan
tcatgggaactgacatgtgccctccttctgctcctctgcgccgttgccaccgccaccgaccacattgtgggagccaatcgtgggtggaatcctggcattaactacactctttgggccaacaaccacactttctatgtcggcgaccttatagcattcaggtaccaaaagaaccaatacaatgtgtttgaggtgaaccaaacagggtatgacaactgcaccacagaaggggcagtggggaattggagtagtggcaaggatttcataccccttaacaaggccaagagatactacttcatttgtggcaatggccagtgcttcaatgggatgaaggtctcagttattgtccatcctcttccttcacctcctacctctgctgaacattcaactccaaagtctgcatctcctgtgctcttcaaaaggagttttcactcactaatgctgtcttttgtgttagcttggtttggatgtgtttggatttagcaactgtggagcataatggcttattcttttctcttttctttttc

SEQ ID NO: 2298 - DNA, 717 bp, Vigna unguiculata
  misc_feature (42)..(42): n is a, c, g, or t
ccacgcgtccgaaaaagtatcacaaaactacactaaacacanaacagaactccaacagaacagaacagagcagaaaagaaaaagagatgagaggttcatggaagctcacatgttccctcattcttctcatctccgccgtcgccaccgccaccgaccacattgtcggcgccaatcgtggctggaaccctggcctcaactacacactctgggccaacaaccacactttctacgtcggcgaccttatctcattcaggtaccagaaaaaccagtacaatgtgtttgaggtgaaccaaactgggtatgacaactgcaccacagaaggggcagtgggaaattggagcagtggcaaggatttcatccctttgaataaggccaagaaatattacttcatttgtgggaatggccaatgcttcagtggaatgaaggtttctgttactgttcttcctcttcctccacctcccacctctgcaatttctgctgaacattcaacgccacactctgcttcttctctgctcttcaaacgctctctgttgctttcttctcttttggcttgttttggatctgtcttcatgtagcaactgtttctcattcttttctctttcttttctctattgttgtattgtttcttgtttgtttttgtttctgattcacgcctcttaaatcccaatgtatgcttgttttgttaatcctgaaattgaacatctccgattctcgcta

SEQ ID NO: 2299 - DNA, 676 bp, Vigna unguiculata
cataacagaactccaacagaacagaacagagcagaaaagaaaaagagatgagaggttcatggaagctcacatgttccctcattcttctcatctccgccgtcgccaccgccaccgaccacattgtcggcgccaatcgtggctggaaccctggcctcaactacacactctgggccaacaaccacactttctacgtcggcgaccttatctcattcaggtaccagaaaaaccagtacaatgtgtttgaggtgaaccaaactgggtatgacaactgcaccacagaaggggcagtgggaaattggagcagtggcaaggatttcatccctttgaataaggccaagaaatattacttcatttgtgggaatggccaatgcttcagtggaatgaaggtttctgttactgttcttcctcttcctccacctcccacctctgcaatttctgctgaacattcaacgccacactctgcttcttctctgctcttcaaacgctctctgttgctttcttctcttttggcttgttttggatctgtcttcatgtagcaactgtttctcattcttttctctttcttttctctattgttgtattgtttcttgtttgtttttgtttctgattcacgcctcttaaatcccaatgtatgcttgttttgttaatcctgaaattgaacatctccgattctcgc

SEQ ID NO: 2300 - DNA, 1109 bp, Glycine max
atggagaaaaggggaagacagaattggaagcagtgagaactgagaactcttatcattcttttttccacttgacattgccgacgccaccaaatacacaaccttaactttcccacaacactacccatccatcattcgttttctctctagattttttcagttagttattgctgtcttctttttgtgtgtgccaacaacacagaaagagagagaaagacatggctctgaaccaatcaaaggccgtgttgttgagggtgagtttggtggtggtggcgctgtgtatagcaggatacatagtgggtccccctctctactggcatttcgttgcagtgaacaaccactcttcatcttctacttgtgcaccctgcatctgcgattgctcttcacaacccattctttctattccacaaggacttagcaacacttccttcggagattgtgcaaagcctgacccagaagtgagtggagacactgaaaagaattttgctgagctattgacagaagaactcaagcttcaggagagccaagctgtggaaaatcagcaacgtgctgacatggcattgcttgaggcaaaaaagattgcatctcagtatcagaaggaagcagacaagtgtaattcaggaatggaaacgtgcgaggaggctagggagaaggctgagttgacattagtcacgcagaagaagctaactgcattgtgggaacttagagcacgtcagaaagggtggaaggaagggcttgccaaatctcatgcacactctcaagggaaagtacagagttcttagatacgttacacagccacctccatggaggtgagtggttgcataatactacaatagttttcaaatgttggtaatagcaaaagtgagtcatcgaggctcatgtgttcatgaaaggtcaagtgtaaaatgcaaatgttgtatttctgtcattcatttttgggtctttattccatgtgtaacacggtttaaagctagaaatcaccaaatgttgggtaaaacttgcataaaaaatagactgtcttttttgtattattttggcttcagatttgaaccaaggctcggactgttgcttcttcgttgtgtttaattaattttagatttgattgacaagga

SEQ ID NO: 2301 - DNA, 930 bp, Vigna unguiculata
ggagtgtgaacaacttctcaaaccttccacttgacattgccgacggccccaaaagacactatcattcgttccctttctctcactagatttctgttatcactgtcttcacttgtgtttgtgtgtgccaaagcacagagagagaataatggctatgaaccaatcaaaggctgtgttgttgagagtgagtttggtggtggtggctctctgcatagcaggatacatagtgggtccccctctctactggcatttcgttgaaggtttggctgcagtgagccactcttctccttctgcttgtgccccctgcgtctgtgattgctcttctcaacccattctttccattcctcaagggctgagcaacacttcctttggagattgtgcaaagtctgatccagaagtgagtggagacactgaaaaaaactttgcagagctattgacagaggaactgaagctgcgggagaaccaagcgatggaaaatcagcaacatgcagacatggcactgcttgaggcaaagaagattgcatcacagtatcagaaggaagctgacaagtgcaattcaggtatggaaacttgcgaagaggctagggagaagtctgagttggcattggtggaacagaagaagctaactgcattgtgggaacttagagcacgtcagaaagggtggaaagaagggcttgccaaatctcatgcacgctctcaaggaaaagtgcagagttcttagatacattacatgataatacttttcaaccaaatggttttcgatactgataatagaaaaagcaagtaatcgtgtctctcacctgtgtttgtgaaagatcaagtgtaacatacaaatgttgttgaatttctatcattcatttttggatattgaatccacgtgtatcattatttaaagcaagaaagtgttaaatgttgtgatgaaataaaataaag

SEQ ID NO: 2302 - DNA, 921 bp, Vigna unguiculata
  misc_feature (73)..(73): n is a, c, g, or t
  misc_feature (98)..(98): n is a, c, g, or t
  misc_feature (214)..(214): n is a, c, g, or t
ggagtgtgaacaacttctcaaaccttccacttgacattgccgacggccccaaaagacactatcattcgttccntttctctcactagatttctgttatnactgtcttcacttgtgtttgtgtgtgccaaagcacagagagagaataatggctatgaaccaatcaaaggctgtgttgttgagagtgagtttggtggtggtggctctctgcatagcnggatacatagtgggtccccctctctactggcatttcgttgaaggtttggctgcagtgagccactcttctccttctgcttgtgccccctgcgtctgtgattgctcttctcaacccattctttccattcctcaagggctgagcaacacttcctttggagattgtgcaaagtctgatccagaagtgagtggagacactgaaaaaaactttgcagagctattgacagaggaactgaagctgcgggagaaccaagcgatggaaaatcagcaacatgcagacatggcactgcttgaggcaaagaagattgcatcacagtatcagaaggaagctgacaagtgcaattcaggtatggaaacttgcgaagaggctagggagaagtctgagttggcattggtggaacagaagaagctaactgcattgtgggaacttagagcacgtcagaaagggtggaaagaagggcttgccaaatctcatgcacgctctcaaggaaaagtgcagagttcttagatacattacatgataatacttttcaaccaaatggttttcgatactgataatagaaaaagcaagtaatcgtgtctctcacctgtgtttgtgaaagatcaagtgtaacatacaaatgttgttgaatttctatcattcatttttggatattgaatccacgtgtatcattatttaaagcaagaaagtgttaaatgttgtgatgaaat

SEQ ID NO: 2303 - DNA, 1139 bp, Phaseolus vulgaris
gaaatctgtgatggagaaaataaaaaacattaaaaatggagaaagaaaggggaagacaagaggaagcagtgtcaacaacgcagagtggccacttggcattgccgacggccccaaagacaccgtctttactttccattactcattccttttctctcactagatttctgttattactgtcttcccttgagtttgtgtgtgccaaagcacagagagagaaagatggctatggaccaatcaaaggctgtggtgttgagagtgagtttggtggtggtggctctctgcatagcaggatacatagtgggtccccctctctactggcatttcgttgaaggtttggctgcagtgagccactcttctccttctacttgtgccccgtgcgtctgtgattgctcttctcaacccattctttccattccccaagggctgagcaacacttcctttggagattgtgcaaagtctgatccagaagtgagtaaagacaccgaaaagaattttgcagagctattgacagaagaactgaagctgcgggagaaccaagccatggaaagtcagcaacatgctgacatggcactgcttgaggcaaagaagattgcatctcagtatcagaaggaagctgacaagtgtaattcagggatggaaacgtgcgaggaggctagggagaagtctgagttggcattagtggcgcagaagaagctcactgcattgtgggaactcagagcacgtcagaaagggtggaaagaagggcttgccaaatctcatgcacactctcaagggaaagtgcagagttcttagatacatgacaacatggcctccatggagctcagtggttgcataatagttttcaagcaaatggtttttggatactgataatagaaaaaggcaagtaatggctctcacgtgtgtttgtgaaagttcaagtgtaacatacaaatgttgttgtatttctatcattcatttttttatattcaatccacgtgtatcatcgtttaaagcaagaaattgtaaaatgttgtgataaacttcataaaaattatttactactatctatttttggtttttttttgctttagtttcgaaccaaggttcagactgttgcttcttcgtcacgcctgttcaatttttggcttcattcacaatga

SEQ ID NO: 2304 - DNA, 1121 bp, Cajanus cajan
gaaatgaaatctttgaataaagaaagggaacaaaataaattatagatggagaaaaggaaagccagaaggagaaacagctagtgccaactgacaacctcttctcaatcttccacttgacatttccccattcccacaacacaacacccatcatttgctttctctctctagatttgagttattgttgtgtctgccatggcattggctatgaaccaatcaagggctgtgttgttaagggtgagtttggtggtggtggctctctgcatagcaggctacatagtggggccccctctctactggcacttcgttgaaggcttggctgccctcaaacactcttcctctgcttgtgctccctgcatctgtgattgctcttcccaacccatcctttccattccccaagggctgagcaactcttcctttggagattgtgcaaaggctgatccagaagtgggtggagacactgaaaagaactttgcagagctattgacagaagaactaaagctacgtgagaatcaagccgtggaaaatcagcgacacgctgacatggcactacttgaggcgaagaagattgcatctcagtatcagaaggaagcagacaagtgtaactcagggatggaaacctgtgaggaggcgagagagaaggctgagttggcattagttgcgcagaagaagctaacggctctgtgggaactcagagctcgtcagaaagggtggaaggaagggcttgccaaatctcatacacactctcaagggaaggtacagagttcttagatactaagtggcatggtctccatgcaggtgagtggttgcataatagttttcaaacaagtgagttttagtgctggtaatagcaaattatgattgctctcatgtgttcatgaaagatcaagtgtaaaatatgaatgttgttgtatttctatcattcaattttgagtattgattccacgtgtatcaccgttaaaagctagcaattgttacaagtttggataaacttttacataagtaatatttaatgactatctttttgttattatcatcattagttttggcttcagatctgaaccaagtttcagacccttgcttcttcattgtgtttaatgaactttaggtttgattgacaagga

SEQ ID NO: 2305 - DNA, 925 bp, Phaseolus vulgaris
  misc_feature (613)..(613): n is a, c, g, or t
  misc_feature (645)..(645): n is a, c, g, or t
  misc_feature (784)..(784): n is a, c, g, or t
tttccattactcattccttttctctcactagatttctgttattactgtcttcccttgagtttgtgtgtgccaaagcacagagagagaaagatggctatggaccaatcaaaggctgtggtgttgagagtgagtttggtggtggtggctctctgcatagcaggatacatagtgggtccccctctctactggcatttcgttgaaggtttggctgcagtgagccactcttctccttctacttgtgccccgtgcgtctgtgattgctcttctcaacccattctttccattccccaagggctgagcaacacttcctttggagattgtgcaaagtctgatccagaagtgagtaaagacaccgaaaagaattttgcagagctattgacagaagaactgaagctgcgggagaaccaagccatggaaagtcagcaacatgctgacatggcactgcttgaggcaaagaagattgcatctcagtatcagaaggaagctgacaagtgtaattcagggatggaaacgtgcgaggaggctagggagaagtctgagttggcattagtggcgcagaagaagctcactgcattgtgggaactcagagcacgtcagaaagggtggaaagaanggcttgccaaatctcatgcacactctcaaggnaaagtgcagagttcttagatacatgacaacatggcctccatggagctcagttgttgcataatagttttcaagcaaatggtttttggatactgataatagaaaaaggcaagtaatggctctcacgtgtgtttgtgaaagntcaagtgtaacatacaaatgttgttgtatttctatcattcatttttttatattcaatccacgtgtatcatcgtttaaagcaagaaattgtaaaatgttgtgataaacttcataaaaattatttactactatcaaaaaaaaa

SEQ ID NO: 2306 - DNA, 937 bp, Lotus japonicus
gaacctctctttcacactcgtcccggttgacatcgccgacagctacaaagatacaaccttaaaccttaatttcacacacccatcattgctttccctctctagattcattcgtgttctgaatcttgtctgtgcgatcgatcaccaatagagagagaaagagaaagccatagctatgaaccagacaggggttgcggttttgagggtgggtttggtggtggtggctctctgcatagctagctacatactcgctcctcctctctattggcatttcagagaaggtttggctgcagtcaaacactcttcttcttcatgtgccccttgcctctgtgattgttcctcacaacaacccatcctttcgattcctcaagggctgagcaacacttcatttggagattgtgcaaagcctgatccagaagtgactggagacactgaaaagaattttgcagagctgttgtctgaagagctaaagctacgtgaaaatgtagctttggaaaatcaacgacgtgctgacatggctctgctcgaggcaaagaagattgcatctcagtatcagaaagaagcagacaagtgcaattcagggatggagacatgtgagggggctagggagaaagctgagttggcattggtcgcacagaagaagctatctgcattgtgggaacttagagcgcgccagaaaggatggaaagaaggggttaccaaatctcagtctcaagggaaagtacagagttcttagaagcatagcatgtccacttgttgcatattacttttcaaagaagtgatttaaattgctggtaatagtaaatcatcttagctcccgaatttgttattgatagttaaagtgtaatgtaatacaaatgctgttgtatttttgacgcccttttttggacattgattccacaggtaccactgctgaaagctagaaattgttatatgttat

SEQ ID NO: 2307 - DNA, 989 bp, Cicer arietinum
ccttaacttcattgaattcaaccacagagacaaggggaacaagtagcactagtagagagcagcaaaacctgttcacactcttccaattgaaaaacaaagaaacaaccttaacttcattgaattcaaccacatcaactcttgtgttgtgtgtgccataacctatattcagagagacatagcgatgaacaattcaagggttatgttattaagggtaagtttgttagtagtagctgtatgcatagcaggatacatattaggtcctcctctctattggcatttcaaagaaggtttagctgctgtcaaacattcttcttcttcttcttctgctacttgttccccttgtctctgtgattgctcttcacaacccactttttcaattccacaagggctgagcaacatttcatttggagattgtgcgaagcctgatccggaagtgaatggagacaccgaaaagaattttgcggagctattgtcggaagaactgaagctacgcgaaaacgaagctttggaaaatcagcgtcgtgctgacatggctcttctcgaggcaaagaagatcgcgtctcagtatcagaaggaagcagacaagtgtaattctgggatggaaacgtgcgaacaagcgagggagaaagctgaactgacattagtcgctcagaagaagctaactgcgttgtgggaacttcgagctcgccaaaaaggatggaaagaaggggttgccaaatcgaacactcagtctcaaggaaaagtacaaacttcttagaaatatagcagcatggcatctatggaatgtgtttgttgcatattacttttcaaagtgtttttatatgctggtaatagcaaatcatgtatctctcttatgtgttcatgatgaaaggtaaagtgtcaaatacaaatgttgttctatcttaacatccattttagacattgattccacttgtaccatggttgaaagctaaaaatcgttatttattgtgaaatatagacatcaagta

SEQ ID NO: 2308 - DNA, 958 bp, Arachis hypogaea
ggggaaggtcaagtgataccaggaagcagcacaaacctctttactctttctaacacttgccaattgccgacacctaaatagtaaatactaaatagtaatactactaccacaccataatcatcgtttgtttctgtttctctctctagagagagaaagatggctacgaacaacacaggggttatattgaagattggtttgggggttgtggcactgtgcatagcagggtacatagtgggtccccctctttactggcacttaatggaaggattgcttgatgtcaaccactcttcttctccttcttcttcttcttcttgtgctccttgtctctgtgattgttcttcccaacccatactttcaattccacaaggtctgagtaacacttcatttggagattgtgcaaagcctgatccggaggtgagtggagacaccgaaaagaattttggcgaactattgtcagaagaactaaagctaagggagaaccaagctttggaacaacagcagcatgctgacatggcactcctcgaggcgaagaagatcgcatcttcgtatcaaaaggaagcagacaagtgcaattcagggatggaaacgtgcgaggaggcgagggagaaagccgagttaaccttggtagctcagaagaagctgactgcattgtgggaacttagagcacggcagaaagggtggaaagaaggagctgccaagtctcaaggaaatgtacaaactaaactgcttagagaataggcattgcatgacactactcaaagaaactgagtttaaagtgttggtaacagaaacaaatttgttcatggaagattaagtgtataaaaacaaatgatgtttgtaactttaacgcccattttgggtattgcttccacatgcaactgtgcaagataatgctaatgttacatctaaaattttttgtttaagcaggttcaacataattctgattttagtggtaata

SEQ ID NO: 2309 - DNA, 1954 bp, Glycine max
accataggcataaataatcgaactatcaaagaaaagagagcagaatagtgagagtgagagatggatcagtttttgtggagggtgttgcctttgcttacaatccttgtttcctttggagtgttcttctacttgcaggattcttacacagcacagttatttcctctcataaagttaccgcgggataagtgcagccttcttccccatcgccacttctggatatccagcaaacgtattgtgaccccacaagggatcatttctggttcagtggagataaatgatgggaaaataatatctgtcgttgagggacatgctattcaggggaagcctaagcaagaagaagtaattgattatggagatgctgttatcatgcctggcttgattgatgtgcacgtacatcttaatgagcctggaagaactgagtgggaaggatttgatactggtaccagagctgctgctgctggtggtgtaaccacagtggttgacatgcctctaaactgttaccctacaactgtgtctaaggaaaaactgaaacttaagcttgatgctgcagaggataaaatctatgttgatgttggattttggggaggcctaatccctgaaaatgcacttaatacaagtattcttgatggtctcttaagtgctggtgttcttggtgtgaagtcttttatgtgtccttcaggaatagatgacttccccatggctactattgaccatatcaaggcaggattgtctgtgttggcaaaatatagaaggcctatagttgtgcatgctgagattcaacaagattttgaaaatcatttggagcttaatgaggataaccttgatccacgtgcttacttgacctatctcaataccaggccaccttcatgggaggaggcagccattaaacaacttgtaagtgttacgaaggacacaagaaaaggtggccctttagaaggagcacatgttcacatcgtccacttgtctgattcaagtgcttccttagatctgattaaggaagcaaaaagtcatggtgacagcataagtgttgagacttgtcctcattacttagctttcacgtctgaagagataccaaatggggatactcgttttaagtgttccccacccattcgtgatgcatacaacaaagacaaattatgggaggctgtattagagggacacattgacctattaagtactgatcattcaccaactgtgcctgaactcaagcttatggaggagggtgacttcttaaaagcttgggggggcatatcatctttgcagtttaatcttccagtgacgtggtcatatgggaagaaatatggacttactctggaacaattgtctttattgtggagcaagaaacctgcaacactggcggggttagaatcaaaggggaccattgcagttggaaaccatgcagatattgtagtttggcaaccagagctggagtttgacctggatgatgattatcctgttttcatcaaacattctgagctctctgcttacatgggaagaaggttatccggaaaagttttggagacttttgtcagaggaaaccttgtgtttaaggatgggaagcatgctcctgcaccctgtggtgttcaaattttagccaaatgagttagttaaatattgacaggtttctttcagatgctagtttcgttgggacctaaataagagatggaagtagctgctggcgtcgaccattgacctagcattctccttctcatagactagtgcattaccatatgtattattgtcgtttgaatgttaggacaatgacataataatgttcttttcttgaatgtgtatgtaggttacaattgtacaaattctaaagttcctctcttcgcatatcatttcatgaaaagaatatgcatgtttcctaactaagaagcatcatgttaacatagtcctgatcaatttgtaagggaatataacagagaagaaaaaaaaagaatcctctcgtcca

SEQ ID NO: 2310 - DNA, 2121 bp, Cajanus cajan
agaattgatttgattcagataatccatcgtctttctgaacaaagaaatctgtagttgatgtatgatgtaccctaaaataatgtaaccccatagtttgttatctaagatgaacgagagtgtattaagctgacatatataatctgctgtaataaccattcaccatagcataggcataatcgaagtatcaaagagagagtgagagatggagcaacttctgtggagggtactgcctttgctaacaatccttgtttccttcatagtattcttctacttgcaggattcttacagggctcagttatatcctatcataaagttaccagggggtaagtgcagccttcttccccatcgccacttctggataaccagcaaacgcattgtcaccccacaagggatcatttctggttcagtggagataaatgaagggaggataatatctgtcatcgagggaaatggtaagcagggaaaatctaagcaagaagaagtaattgattatggagatgctgttgtcatgcctggcttgattgatgtgcacgtacatcttgatgagccaggaagaactgaatgggaaggatttgatactggtaccagagctgccgctgctggtggtgtaaccacagtggttgacatgcctctaaacaatcaacccacaactgtgtctaaggaaacactggaacttaagcttgaagctgcagaggataaaatctatgttgatgttggattttggggaggcctaatccctgaaaatgcacttaatacaagtattctcgaaggtctcttaagtgctggtgttcttggtgtgaagtcttttatgtgtccttcaggaattgatgacttccctatgactactattgaccatatcaaggagggtttgtctgtgttggcaagatacagaaggcctttacttgtgcattctgagattcaacaggattctgaaaatcgtttggagcttaatgataatcgtgatccacatgattacttgacctatcttaacactaggccaccttcatgggaacaggcagccattacagaacttgtaggtgttacgaaggacactagaattggtggtcctttagaaggagcacatgttcacattgtccacttgtctgattcaagtgcttccttagatttgattaaggaagcaaaaaatcgtggtgacagcctaagtgttgaaacttgtccccattacttagctttctcgtctgaagagataccgaatggagatactcgttttaagtgttccccacccattcgtgatgctttcaacaaagaaaaattatgggaggctgtattagagggagacattgacctattaagttctgatcattcaccaactgtgcctgaactcaagcttcttgaggagggtgacttcttgagggcttggggtggtatatcatcgttgcagtttgatcttccagtgacgtggtcatatgggaagaaatatggactaactctggaacagttgtctatattgtggagcaagaaacctgcagcatttgcagggttagaatcaaagggggccattgcagttggaaaccatgcagatattgtagtttggcatccagagctggagtttgacctcaatgatgatcatcctgttttccttaaacatcctagcctctctgcttatatgggaaaaaggttttccggaaaagttttggacacttttgttagaggaaaccttgtgtttaaggatggaaagcatgctcctgcagcctgtggtgttccaattctagcaaaatgaattagttaaatattgatggtagtttggttggggcataaataagagatggaagtagctgctggaatcgaccattgagctagcattctccttctcattgactagtgcactaccatgtattatagtcgtttggatgttggacaggacaatggcatattaatgtcgtacttttcttgaatgtatatctagtagattactaattccaagcttgtcttcacatatcatttcgtgaaaagaatatgcaggtttcttagcttagaaacatcatggtaacataatcctagtcaatttgtcagggaattaaatagacaaataggagaaactgaaatctcttgtccatttctagtacatgtttagttgtacgtttaatatccacgtttaag

SEQ ID NO: 2311 - DNA, 2027 bp, Phaseolus vulgaris
gtgtggaacatcctctgcagtaataaccacacatttcataggtctagttatataatactcaaactatcaaagaagagagtgcacaatatcagtgagagtgtgaaatggatcagtttatctggagggtgttgcctttgctatcaatccttgtttcctttttggtattcttctacttccagaattcacacacggcccagttatatcctctcataaagtttccacggagtaagtgcagccttcttccccatcaccacttctggatatccagcaaacgcattgtgaccccacaggggatcatttctggttcagtggagataaatgaagggagaatagtatctgtcattgagggatatggtaagcaggggcagtctaagcaagaagaaataatagattatggagatgctgttgttatgcctggcctgattgatgtgcacgtacatcttgatgaaccgggaagaactgagtgggaaggatttgatactggtaccagagctgctgctgctggaggtgtaaccacagtggttgacatgcctttaaacaattacccttcaaccgtgtctaaggaaacgctgaaacttaagcttgacgctgcagaggataaaatctatgttgatgttggattttggggaggcctagtccctgaaaatgcacttaatctaactattcttgacgatctcttgagtgctggtgttcttggtgtgaagtcttttatgtgtccttcaggaattaacgactttcctatgacaactattgaccatatcaaggctggattgtcggtgttggcaaaatataaaagacctatagtagtgcatgctgagcttcaacaagattatggcaatcatttggatattaatgataaccgtgatccacatgattacttgacctatctcaacaccaggccaccttcatgggaggaggcagccattaggcaacttgttggtgtttcgaaggacactggaattggtggtcctttagaaggagcacatgttcacattgtccacttgtctgattcaagtgcttccttagatctgattaaggaagcaaaaagtcgaggtgatagcataactgttgagacttgtcctcactacttggctttcacctctgaagagataccaaatggagatactcgttttaagtgttccccacccattcgtgatgcacacaacaaagacaaattatgggaggctgtattggagggacacattgacctgttaactactgatcattcaccaactgtgcctgaactcaagcttcttgaggagggtgacttcttgaaggcttgggggggcatatcatctttgcagtttaatcttccggtgacatggtcatatgggaagaaatatggactaactctggaacagttgtcattattgtggagcaagagacctgcagcacttgcaggaatagaatcaaaggggaccattgaagttggaaaccatgcagatattgtagtttggcaaccagagcaggagttcgacctggatgacaattatcctgttttcattaaacattacgaactctctgcttacatgggaagaaggttatccggaaaagttttggacacttttgtgagaggaaatcttgtgtttaaggatgggaagcatgctcctgcagcatgtggtgtccaaattctagccacatgagttagttaaatattgacaggtactatctttcagatgctagtttcggtgggggcataaataagagaaggaagtagctgctggcatcggccattgagctaccattttccttctcagagactagtgcgtttgcatgtattatattatatccgtttggatgttttggatgttttggataatggcataatattgtacttttcttgaatgtagattacaactttgcaaattctagagttccttttctgctcatatcatttcatgtaaaaaatatgcatgtttcatagctaataagcatcgtgttaacataatccttatcagattgcaagggaatataaatagaaaatagaagaaactgaaactgttctccatttctactaatcttgaaag

SEQ ID NO: 2312 - DNA, 1872 bp, Phaseolus vulgaris
gcagtaataaccacacatttcataggtctagttatataatactcaaactatcaaagaagagagtgcacaatatcagtgagagtgtgaaatggatcagtttatctggagggtgttgcctttgctatcaatccttgtttcctttttggtattcttctacttccagaattcacacacggcccagttatatcctctcataaagtttccacggagtaagtgcagccttcttccccatcaccacttctggatatccagcaaacgcattgtgaccccacaggggatcatttctggttcagtggagataaatgaagggagaatagtatctgtcattgagggatatggtaagcaggggcagtctaagcaagaagaaataatagattatggagatgctgttgttatgcctggcctgattgatgtgcacgtacatcttgatgaaccgggaagaactgagtgggaaggatttgatactggtaccagagctgctgctgctggaggtgtaaccacagtggttgacatgcctttaaacaattacccttcaaccgtgtctaaggaaacgctgaaacttaagcttgacgctgcagaggataaaatctatgttgatgttggattttggggaggcctagtccctgaaaatgcacttaatctaactattcttgacgatctcttgagtgctggtgttcttggtgtgaagtcttttatgtgtccttcaggaattaacgactttcctatgacaactattgaccatatcaaggctggattgtcggtgttggcaaaatataaaagacctatagtagtgcatgctgagcttcaacaagattatggcaatcatttggatattaatgataaccgtgatccacatgattacttgacctatctcaacaccaggccaccttcatgggaggaggcagccattaggcaacttgttggtgtttcgaaggacactggaattggtggtcctttagaaggagcacatgttcacattgtccacttgtctgattcaagtgcttccttagatctgattaaggaagcaaaaagtcgaggtgatagcataactgttgagacttgtcctcactacttggctttcacctctgaagagataccaaatggagatactcgttttaagtgttccccacccattcgtgatgcacacaacaaagacaaattatgggaggctgtattggagggacacattgacctgttaactactgatcattcaccaactgtgcctgaactcaagcttcttgaggagggtgacttcttgaaggcttgggggggcatatcatctttgcagtttaatcttccggtgacatggtcatatgggaagaaatatggactaactctggaacagttgtcattattgtggagcaagagacctgcagcacttgcaggaatagaatcaaaggggaccattgaagttggaaaccatgcagatattgtagtttggcaaccagagcaggagttcgacctggatgacaattatcctgttttcattaaacattacgaactctctgcttacatgggaagaaggttatccggaaaagttttggacacttttgtgagaggaaatcttgtgtttaaggatgggaagcatgctcctgcagcatgtggtgtccaaattctagccacatgagttacttaaatattgacaggtactatctttcagatgctagtttcggtgggggcataaataagagaaggaagtagctgctggcatcggccattgagctaccattttccttctcagagactagtgcgttttcatgtattatattatatccgtttggatgttttggatgttttggataatggcataatattgtacttttcttgaatgtagattacaactttgcaaattctagagttccttttctgctc

SEQ ID NO: 2313 - DNA, 1825 bp, Vigna unguiculata
ctgtaataaccacacattccattgttatataacaatcaaagtatcaaagaagagagagcacaataacagtgagagtgtgaaatggatcagttggtgtggagggtgttgcctttgctaacaatccttgtttcctttttcttattcttctacttccagaattcacacacggcgcagttatatcctctcataaagttgccacggagtaaatgcagccttcttccccatcaccacttctggatatccagcaaacgcatcgtgactccacaggggatcatttctggttcagtggagataaatgaagggagaatagtatctgtggttgagggatatgggaatcaggggcagtccaagcaagaagaaataatagattatggagatgctgttgttatgcctggcctgattgatgtgcacgtacatcttgatgaaccgggaagaactgagtgggaaggatttgataccggtaccagagctgctgctgctggtggagtaaccacagtggttgacatgcctctaaacaattaccctacaaccgtgtctaaggagacgctgaaacttaagcttgacgctgcagaggataaaatctatgttgatgttggattttggggaggcctagtccctgaaaatgcccttaatctaactattcttgacgatctcttgagtgctggtgttctcggtgtgaagtcttttatgtgtccttcaggaattgatgactttcctatgacaactattgaccatatcaaggcgggattgtctgtgttggcaaaatataaaagacctatagttgtgcattctgagcttcaacaagattatggcaatgatttggtgcatgatgataaccgtgatccacatgattatttgacctatctcaacaccagaccaccttcatgggaggaggcagccattagacaacttgtaggtgtttcgaaggacactggaattggtggtcctttagaaggagcacatatccacattgtccacttgtctgattcaagtgcttccttagatctgattaaggaagcaaaaagtcgaggtgatagcataagcgttgagacttgtcctcattaccttgctttcacctctgaagagataccaaatggggatactcgttataagtgttccccacccattcgtgatgcacaaaacaaagacaaattatgggaggctgtattggagggacacattgacctgttaacaactgatcattcaccaaccgtgcctgaactcaagcttcttgaggagggtgacttcttgaaggcttgggggggcatatcatctttgcagtttaatcttccggtgacgtggtcttacgggaagaaatatggactaactatagaacagttgtcgttattgtggagcaagagacctgcagcacttgcggggatagaatcaaaggggactattgcagttggaaaccatgcagatattgtagtttggcaaccagaggaggagttcgacctggatgacaattatcctgttttcattaaacattacgaactctctgcttacatgggaagtaggttatcaggaaaagttctggacacttatgtgagaggaaatcttgtgtttaaggatgggaagcatgctcctgcagcctgtggtgttcaaattctagccacatgaatcagttaaatattggtacctttcagatgcaagtttcagtggggccataaataagagatggaagtagctgctggcatcggccattgttgagcaagcattttccttctcatagaatagtgcgtttgcatgtattatatccgtttggatgttttggataatgaaataatattctacttttctataatgtagattacaactttgcaca

SEQ ID NO: 2314 - DNA, 1845 bp, Vigna unguiculata
ctgtaataaccacacattccattgttatataacaatcaaagtatcaaagaagagagagcacaataacagtgagagtgtgaaatggatcagttggtgtggagggtgttgcctttgctaacaatccttgtttcctttttcttattcttctacttccagaattcacacacggcgcagttatatcctctcataaagttgccacggagtaaatgcagccttcttccccatcaccacttctggatatccagcaaacgcatcgtgactccacaggggatcatttctggttcagtggagataaatgaagggagaatagtatctgtggttgagggatatgggaatcaggggcagtccaagcaagaagaaataatagattatggagatgctgttgttatgcctggcctgattgatgtgcacgtacatcttgatgaaccgggaagaactgagtgggaaggatttgataccggtaccagagctgctgctgctggtggagtaaccacagtggttgacatgcctctaaacaattaccctacaaccgtgtctaaggagacgctgaaacttaagcttgacgctgcagaggataaaatctatgttgatgttggattttggggaggcctagtccctgaaaatgcccttaatctaactattcttgacgatctcttgagtgctggtgttctcggtgtgaagtcttttatgtgtccttcaggaattgatgactttcctatgacaactattgaccatatcaaggcgggattgtctgtgttggcaaaatataaaagacctatagttgtgcattctgagcttcaacaagattatggcaatgatttggtgcatgatgataaccgtgatccacatgattatttgacctatctcaacaccagaccaccttcatgggaggaggcagccattagacaacttgtaggtgtttcgaaggacactggaattggtggtcctttagaaggagcacatatccacattgtccacttgtctgattcaagtgcttccttagatctgattaaggaagcaaaaagtcgaggtgatagcataagcgttgagacttgtcctcattaccttgctttcacctctgaagagataccaaatggggatactcgttataagtgttccccacccattcgtgatgcacaaaacaaagacaaattatgggaggctgtattggagggacacattgacctgttaacaactgatcattcaccaaccgtgcctgaactcaagcttcttgaggagggtgacttcttgaaggcttgggggggcatatcatctttgcagtttaatcttccggtgacgtggtcttacgggaagaaatatggactaactatagaacagttgtcgttattgtggagcaagagacctgcagcacttgcggggatagaatcaaaggggactattgcagttggaaaccatgcagatattgtagtttggcaaccagaggaggagttcgacctggatgacaattatcctgttttcattaaacattacgaactctctgcttacatgggaagtaggttatcaggaaaagttctggacacttatgtgagaggaaatcttgtgtttaaggatgggaagcatgctcctgcagcctgtggtgttcaaattctagccacatgaatcagttaaatattgggtacctttcagatgcaagtttcagtggggccataaataagagatggaagtagctgctggcatcggccattgttgagcaagcattttccttctcatagaatagtgcgtttgcatgtattatatccgtttggatgttttggataatgaaataatattctacttttctataatgtagattacaactttgcacattcttgagttcctctctgc

SEQ ID NO: 2315 - DNA, 1898 bp, Glycine max
agtgagaaatggagcagtttgtatggagggtgttgcctttactcacaatcctcatgtctttagtagtattcttctacttgcaggattcttacagggcccatttacatcctctcgtaaagttaccgcggagtaagtgcagtcttcttccccatcgtcatttctggataaccagcaaacgcattgtgaccccacaagggatcatttctggttcagtggagataaatgaagggaaaataatatctgtcatcaagggatatagtaagcaggggaagtctaagcaagaaaaaataattgattatggaggtgctgttgtcatgcctggcttgattgatgtgcacgtacatcttgatgagccaggaagaactgcgtgggaaggatttgatactggtaccagagctgctgctgctggtggtgtaacaacagtggttgacatgcctctgaacaatcaccctacaactgtgtctagggaaacactgaaacttaagcttgaagctgcagagaataaaatctatgtcgatgttggattttggggaggcctaatccctgaaaatgcacataatacaagtattcttgaaggtctcctaagtgctggtgttcttggtttgaagtcttttatgtgtccttcaggaattagtgactttcctttgactactattcaccatatcaaggagggattgtctgtgttagcaaaatatagaaggcctttacttgtgcattctgagattcaacaacattctaaaaaacatttggagcttaatgataaaggtggtccacgtgcttacttgacctatctccacactaggccaccttcatgggaggaagcagccattaaagaacttgtaggtgttacgaaggacacaagaaaaggtggtcctttagaaggagcacatgttcacgtggttcacttgtctgattcaagtgcttccttagatctgattaaggaagcaaaacgtcgtggtgacagcataagtgttgagacttgtccccattacttagctttctcgtctgaagagataccaaatggagatactcgttttaagtgttccccgcccattcgtgatgcatacaacagagaaaaattatgggaggctgtattagagggacacattgacctattaagttctgatcattcaccaactgtgcctcaactcaagcttctagaggagggtgacttcttgaaggcttggggaggagtaacatctttgcagtttgatcttccagtgacgtggtcttatgggaagaaacatggactaactctggaacagttgtcgttattgtggagcaagaaacctgcaacatttgcggggttagaatcaaagggggccattgcagttggaaaccatgcagatattgtagtttggaaaccagaggtggagtttgacctgaatgaagattatcctgttttccttaaacatcctagcctctctgcttatatgggaagaaggctatccggaaaagttttggagacttttgtcagaggaaaccttgtgtttaagaaaggaaagcatgctccttcagcctgtggtgttccaattctagccaaatgaattagttaaatattggcaggtttctttcagatactagtttctttggggcataataagagatagaagtagctgccggcagcattctccttctcatcgactagttcataccatgtatgagaagagacacctagatcactctgtctttcagtcacgtaaatactcttttctatatagtccaaagttgcaaatggataagcgtggttggattggtgcgatatatatcagtcacataaaatattgtttttccaatagtccaaagctaagttacttatggatagacgtaattggtttggtccatgcttacggataaacacaaatgacaatagagatttcgggaggggttattattgg

SEQ ID NO: 2316 - DNA, 1856 bp, Phaseolus vulgaris
tataaaaggagagagaacacaatgacaatggtgaattggtgagaaatggagaggtttgtgtggagggtgttgcctttcttaacattcctggtttccttcatagtattcttttacttgcaggattcttacagagcacagttacatcctcaagtaaagttgactgagaataagtgcagccttcttcaccatcgtcatttctggataactagcaaacgcattgtgaccccacaagggatcatttctggttcagtggagataaaagaagggaacataatatctgtcattgagggatatggtaagcagggtaactctaagcatgaagaagtaattgattatggagatgctgttgtcatgcctggcttgattgatgtacatgtacatcttgatgaaccaggaagaactgcatgggaaggatttgatactggtaccagagctgctgctgctggtggtgtaaccacagtggttgacatgcctctaaacaatcacccaacaactgtgtctaaggaaacactgaaacttaagcttgaagctgcagagaacagaatctatgttgacgttggattttggggtggcctaatccctgaaaatgcccttaatacaagtattcttgaaggtctcttaagtgctggtgttcttggtttgaagtcttttatgtgtccttcaggaattagtgactttcctatgactactattcaccatatcaaggagggattgtctgtgttggcaaagtatagaaggcctttatatgtgcactctgagattcaacaacatttggagcttactgataaaggtggtcctcgtacttacttgacctatctccacactagaccaccttcatgggaggaagcagccattaaagaactcgtaggtgttacgaaagacacaagaattggtggtccattagaaggagcacatgttcacattgctcacttgtctgattcaagtgcttccttagatctgattaaggaagcaaaaagtcgtggtgacagcataagtgttgagacttgtccccattacttagctttctcttctgaagagataccaaatggagatactcgttttaagtgctctcctcccattcgtgatgcatacaacaaaggcaaattatggaaggcagtattggagggacacattgacctattaagttctgatcattcaccaaccctgcctcaactcaagcttcttgaggagggtgacttcttgaaggcttgggggggcatatcatctttgcagttcgatcttccagtgacgtggtcttatgggaagaaacatggactaactctggaacacttgtcgttattgtggagcaagaaacctgcaacatttgcagggatagaatcaaaggggtccattgctgttggaaaccatgctgatattgtagtttggaaaccagaggtggagtttgagctgaatgaacattatcctgttttccttaaacatcctagcctctctgcttacatgggaagaaggttatcaggagaagttttggagacttttgtgagaggaaaccttgtctttaagaaaggaaagcatgctcctgcagcctgtggtgttcctattctagctaaatgaattagttaaatattggaaggtttatttcagatactggtttctttggtgcataaataagagatggaagtagctgatggcattgaccattgacctaccattctccttctcatccaccaagcataccatgaattattgcagtttggatttttggacaatgacaacaatgtcctacttgaattatatgtagactataattttaaacattctgaagtttctgtcttcacatatcattgcatgaaatgaatagcatgcttcctaagaaaaatcatgaaacctttcatcta

SEQ ID NO: 2317 - DNA, 1674 bp, Lotus japonicus
aaatggagccgctactatggagggtgttgcctatgttagcactgttagtttccttcatattattcttctacttccaggattcgcacttatctcctctcacaaagttagcaggagatgggtgcagccttcttccccaccgtcattactggattaccagcaagcgcattgtcaccccacaagggatcatttctggatcagtggagataaatgaagggaagatagtatctattactgaaggatatggtaagcaggggaattctaagcaagaagtggtgattgattacggagaggcggttatcatgccgggcttgatcgatgttcacgtgcatcttgatgagccgggaagaactgaatgggagggatttgttactggtaccagagctgctgcagctggaggtgttacaacagtggttgatatgcctctaaacaatcaccctacaactgtgtctcaggaaacactgcaacttaagcttgaagctgcagagaatgaactccatgttgatgttggtttttggggaggcctagtccctgaaaatgcactcaataccagtattcttgaaggtctcctaagtgccggtgttcttggcttgaagtcttttatgtgtccttcaggaattaatgactttcctatgactactattgaccatatcaaggaaggattgtctgtattggcaaaatatagaagacctttacttgtacatgctgagattcaacaagattctaaaaataatttggaactcaagggtaatgatgacccacgtgtttactcgacctatctcaacactaggccaccttcatgggaggaggcagccattaaagagcttgtagatgttacaaaggacactatacatggcggtcctttagaaggagcacatgttcacattgtccacttgtctgattcaagtgtttccttagatctgattaaggaagcaaaactccgtggtgacagcataagcgttgagacttgctcccattacttggctttctcatctgaagagataccagatggtgatactcgttttaagtgttccccgcccattcgtgatgcattcaacaaagaaaagttgtgggaggctgtattggagggccacattgacctattaacttctgatcactcacccactgtacctgaactcaagcttcttaaggagggtgacttcttgaaggcgtggggtggcatatcatctttacagtttgatcttccagtgacatggtcatatgggaagaaacacggattaactctagagcaattatcgttattgtggagccagaaacctgcaacacttgcggggatagcatcaaagggagccattgtagttggaaaccatgcagatattgtagtttggcacccggagctggagtttgagctgaatgatgattatcctgttttccttaaacatccgaacctctctgcttatatgggacgaaggttatccggaaaagtgttggacacttttgtcagaggaaaccttgtgttcaaggatgggaagcatgctcctgcagcctgtggtgttccaattctagccaaatgaaaatgtttgatacttgatcactgctcagaaagtatcatcaaattcaaacttggtgtaataatactaactaaaatattctacagattgagtttgcggattcatgtctattgagattcaatcctgagtcctaacccttcaagtt

SEQ ID NO: 2318 - DNA, 1925 bp, Trigonella foenum-graecum
agtgaagtgtttctagttttggagtaaatatatatatattcaccctcttctaaggtttttactcttttcctttatttttcacttgtctctacttcaatgcatcaataccttgttaacaaagaaatcgtaagagtaagaaaagaaatggatcagctactatggagggtattgcctttgtcagcacttgtaatttccttttcactattcttctatcttcaaggttctaacaacgcccaattttcttctctcattaagttaaaaaggggtgagtgcagtcttcttccatataatcattattggatatccagtaaccgtatttttacttcacaaggattcatttctggatcagtggagataaatgaagggaagattgtgtctattgtggaagggtatgataagcagaggaattctgtggaacaagtgattgattatggagaggctgttgtcatgcctggcttgattgatgtgcatgtacatcttgatgagcccgggagaactgattgggagggatttgttactggtacacaagctgctgctgccggaggtgtaactacagtggttgacatgcctctaaacaatcaccctacaaccgtctctaaggaaacactagaacttaagcttgaagctgcagaggataaaatctatgtcgatgttggtttttggggaggcttgattcctgaaaatgcacttaataccagtattcttgaaggtctcttaggtgctggtgttcttggtttaaagtcttttatgtgtccttcaggaatcaatgactttcctatgactactattgaacatatcaaggagggattgtctgtgttggcaaaatacagaagacctttacttgtgcactccgagattgaacaagattctaaaagtcattcggaacttgaaggtaatggcgaccctcatgcttacaagacatatctcgatactaggccaccttcatgggaggaggcagccattaaagaacttgtagatgctacaaaggatactagagttggtggttctttagaaggagcacatgttcacattgtccacttgtctgattctagtgcttccttagatcttattaaggaagcaaaacgtcgtggggacagcataagcgtcgagacttgtccccattacctaacattctcatctgaagagataccagataaagatactcgttacaagtgttcaccgcccattcgtgatgcattaaacaaagaaaagttatgggaggctctactggatggacacattgacctattgagttctgatcattcaccaactgtgcctgaactcaagcttcttaaggaaggcgacttcttgaaggcgtggggtggcatatcatctttgcagtttaatcttcccgtgacgtggtcgtatgggaagaaacacgggttaactctagaacaactatcgttattgtggagccagaaacctgcaaccttgtcggggttagagttaaagggagccattgcagttgggaaccatgcagatattgtagtgtggcagccagaggtagagtttgaccttaacgacgattatcctgttttccttaaacatcctagtctgtctgcttatatgggaagaaggttatccggaaaagttttggacacttttgtgagaggaaaccttatctttaaggatggtaagcatgctcctgcagcctgtggtgttccaattctagccaaatgaattggttaaaaatgatgctattcgccttgtgacctaaataagaggcggaagtagctgttggcatcagtgattaagctagattgtaacctgttttgtttctgtatccagttcgacactgaggatatttatgcatgtatatatgcgtgcgtgtttctatattaaataaatgttaataataacggcgttgtagaaatattgttagttaaatgaaactttcatgaaagctggtagtatatatctatcat

SEQ ID NO: 2319 - DNA, 2361 bp, Arachis hypogaea
gtcatttgactcagaaacaaaaattatacggtgattagtgattagtgattagtgaagtaggtatgtgaatgtgtacactatgcagagtattattatatatagtttgaagaattgaaggaataatcaaaagtgaagtgtgtgaatcagaaatggataattttgtgtggagagtgttacccctttttgcactgcttgttgccttcgttacattcttctacttgcaggattcctacaaggctcaattttctccttttataaagttaccagttgatgatgataatgagtgcagccttcttccctttcgacactattggatatccagcaagcgcattctgaccccacaaggcttcatttctggctcagtggagataaatgaagggaagattgtatctgttgttgaaggatatggtaagcaggggaattctaggcaagaagaggttattgattatggagaggctgttgtcatgcccggcttgatcgatgtgcatgtacatcttgatgaacctgggagaactgaatgggagggatttgttactggtactagagctgctgctgctggtggcgtgacaacagtggttgacatgcctctaaacaatcaccctacaactgtgtctaaggaaacgctagaacttaagcttgaagctgcaaataagaaactccatgttgatgcggggttttggggaggcctggtccctgaaaatgcacttaataccagtattcttgatggcctcttaagtgctggtgttcttggtgtaaagtcttttatgtgtccttcaggaattaatgactttcctatgactactattgatcacatcaaggagggactaactgtgttggcaaaatataaaagacctttaattgtgcatgctgagattcaactagattccgaaagtcattcggaactcaaagataatagagaccctcgagtttatttgacctatctcaacactaggcccccttcatgggagcaggctgctattaaagaacttgtgggtgttacgaaggacactatagtcggaggacctttagaaggagcgcatgttcacattgtccacttgtctgattccagtctttccctagatatgattaaggaagcaaaacgtcgaggtgacagcataagtgttgagacatgctcccattacttagctttttcatctgaagagataccggatggagatactcgttttaagtgttccccacccattcgagatgcacacaacagagagaaactgcgggaggctgtactggaagggcacattgattttttgacttctgatcattcacctactgtgccagaactcaagcttcttgaggagggtgacttcttgagggcttggggtggcatttcaggtttgcagtttgatcttccagtgacatggtcatatggaaagaaatatggattgactctggagcaattatcgttattgtggagcaagaaacccgcagcatttgcaggaatagaatcaaagggaaccattgcagttggataccatgcagacattgtagtgtggcaaccagaggtggagtttgatgtgaacgaaaattatcccattttccttaaacatcctagcctctctgcttatatgggaacacggttatccggaaaagttttggacacttttgttagaggaaaccttgtatttaaggaggggaagcatgcttctgcagcctgcggtgttccaattctagccaaatgaattggttcaaagtttggttaatgtaatttatcctgcatgatcctaatccatgctatagaggggttccaaagatgctatgctatttggcttgtgtcataaataagagataacattctccttctccaagctatagattaagattagtgttgtagtttatattattgctgtatgcatgtttgaacactaaaatttctcaaaacctttcttgttagaacatttcgaagtttagttttctgtaatcttccacataattttagtaataataattcaatagcacttgtaaagttgagttatacttttaattattttatcaaataactatgtagtcaatgttaatagcttgtgagaaatacaaagttgtcttccaattctagacgttttccctagcttgaacgttgattggaagaatataatttgaattattaaataaaaaggataaatttgatttatgaatggagcctgaaccatctagatgtttcttcaaaaaaaaaaaaggtttgaaaattaaaactgtatgataaggtgctagaatgccatagaatgacagtgacacaccactaatttattcaagaaaactttttgaaatttttttaatggtagggtcaacagtccaagtactacaattaggtgaaccaattttgcttacataataatagtaggagga

SEQ ID NO: 2320 - DNA, 2011 bp, Medicago truncatula
atctaaagttccgacaaataaagagaaatggatcagctactatggagagtattgccactgttaacactcctaatttcattctcactattcttctatttacaatctcctattataaagttaccaggagatgagtgcagtcttcttccatatagtcattattggatatccagcaaacgtattttgacttcacaaggattcatttctggatcagtggagataaacgaagggaagatagtttctattgttgaaggttatggcaagaaggataattctgtgcatcaagtgattgattatggagatgctgttgtcatgcctggcttgattgatgtgcatgtacatcttgatgaacccgggagaactgattgggagggatttgttactggtacccaagctgctgctgctggaggtgtaactaccgtcgttgacatgcctctaaacaatcatccaacaaccatgtctaaggaaacgctagaacttaagcttgaagctgcagaggataaaatctatgtcgatgttggtttttggggaggcctggttcctgaaaatgcacaaaataccagtattcttgaaggtctcttagatgctggtgttcttggtttaaagtctttcatgtgtccttcaggaattgatgacttcccgatgactactattgaacatatcaaggagggattgtctgtgttggcaaaatacagaagacctttacttgtgcactccgagattcaacaagattctgaaagtagttcggaacttgaaggtaatggcgaccctcattcttacaagacatatctcgacactaggccaccttcttgggaggaggcagccattaaagaacttgtagatgctacaaaggatactagaatcggtggttctttagaaggagcacatgttcacattgtccacttgtctgattcaagtgcttccttggatcttattaaggaagcaaaacgccgtggggacagcatcagcatcgaaacttgcccccattacctaacattctcatctgaagagataccagataaagatactcgttacaagtgttccccgcccattcgtgatgcatcaaaccgagaaaagttatgggaggctctactggacggacacattgacctattaagttctgatcattcaccaactgtacctaaactcaagcttcttaaggaaggtgacttcttgaaagcgtggggtggcatatcatctttgcagttcgatcttccagtgacttggtcatatgggaagaagcatgggttaactctagaaaaattatcgttattgtggagccagaaacctgcaaaattagcggggttagaatcaaagggagccattgcagttggaaatcatgcagatattgtagtgtggcagccagaggtggagtttgaccttaacgacgattatcctgttttcattaaacatcctagcctgtctgcatatatgggaagtaggttagcaggaaaagttttggacacttttgtgagaggaaaccttgtctttaaggatggtaagcatgctcctgctgcctgtggtgttccgattctagccaaatgaattggttaagaacatgatgctattcaccttgtgacataaataagaggtgaaagtagctgttggcatcagtgattaagctagattgtagcttgttttgttgctgtatccgttttgacgctgaggatatttatgtatgtatatatgcgtgcgtgtttctatattaaataaatgttaataagaacggtgtcgtgtcatgtgcagatacgtcttcgccaagaaaaagtagcagtagcagtaaatttaaagtacttgacttgaaatcatgctattcggttacattttttgatttgtctggttgagttttactttattttgaactacgttcttaaaacaatttctcatgtcttcgttggttaattccttattatttggacgatatcatctgtatttctgttgaaactctagccaacattattgatctcagacatcactatggccacctgagaagctatggttatgatttgcagcc

SEQ ID NO: 2321 - DNA, 2163 bp, Medicago truncatula
attcaatgcatctaaagttccgacaaataaagagaaatggatcagctactatggagagtattgccactgttaacactcctaatttcattctcactattcttctatttacaatctcctattataaagttaccaggagatgagtgcagtcttcttccatatagtcattattggatatccagcaaacgtattttgacttcacaaggattcatttctggatcagtggagataaacgaagggaagatagtttctattgttgaaggttatggcaagaaggataattctgtgcatcaagtgattgattatggagatgctgttgtcatgcctggcttgattgatgtgcatgtacatcttgatgaacccgggagaactgattgggagggatttgttactggtacccaagctgctgctgctggaggtgtaactaccgtcgttgacatgcctctaaacaatcatccaacaaccatgtctaaggaaacgctagaacttaagcttgaagctgcagaggataaaatctatgtcgatgttggtttttggggaggcctggttcctgaaaatgcacaaaataccagtattcttgaaggtctcttagatgctggtgttcttggtttaaagtctttcatgtgtccttcaggaattgatgacttcccgatgactactattgaacatatcaaggagggattgtctgtgttggcaaaatacagaagacctttacttgtgcactccgagattcaacaagattctgaaagtagttcggaacttgaaggtaatggcgaccctcattcttacaagacatatctcgacactaggccaccttcttgggaggaggcagccattaaagaacttgtagatgctacaaaggatactagaatcggtggttctttagaaggagcacatgttcacattgtccacttgtctgattcaagtgcttccttggatcttattaaggaagcaaaacgccgtggggacagcatcagcatcgaaacttgcccccattacctaacattctcatctgaagagataccagataaagatactcgttacaagtgttccccgcccattcgtgatgcatcaaaccgagaaaagttatgggaggctctactggacggacacattgacctattaagttctgatcattcaccaactgtacctaaactcaagcttcttaaggaaggtgacttcttgaaagcgtggggtggcatatcatctttgcagttcgatcttccagtgacttggtcatatgggaagaagcatgggttaactctagaaaaattatcgttattgtggagccagaaacctgcaaaattagcggggttagaatcaaagggagccattgcagttggaaatcatgcagatattgtagtgtggcagccagaggtggagtttgaccttaacgacgattatcctgttttcattaaacatcctagcctgtctgcatatatgggaagtaggttagcaggaaaagttttggacacttttgtgagaggaaaccttgtctttaaggatggtaagcatgctcctgctgcctgtggtgttccgattctagccaaatgaattggttaagaacatggtaatccccataacttactgatctcatctcaatttcttttagtttgctgatgcttatcaagatcctgattcatgttttggtcggtttttcattagatgctattcaccttgtgacataaataagaggtgaaagtagctgttggcatcagtgattaagctagattgtagcttgttttgttgctgtatccgttttgacgctgaggatatttatgtatgtatatatgcgtgcgtgtttctatattaaataaatgttaataagaacggtgtcgtgtcatgtgcagatacgtcttcgccaagaaaaagtagcagtagcagtaaatttaaagtacttgacttgaaatcatgctattcggttacattttttgatttgtctggttgagttttactttattttgaactacgttcttaaaacaatttctcatgtcttcgttggttaattccttattatttggacgatatcatctgtatttctgttgaaactctagccaacattattgatctcagacatcactatggccacctgagaagctatggttatgatttgcagcctataacattgttaatcactggtcataaagtatagcaatcaaattttaa

SEQ ID NO: 2322 - DNA, 1622 bp, Solanum phureja
atcatatataccacacaattattaagagtcttacaagtcaaagatttctctcacacaatactaaattgacctcgaactttgaacttaggttctattcttaagtttgtgagtgtaaaaatggtgcaaccccatgtcctcttggtgacatttcccgcacaaggtcatatcaatccatctcttcaatttgccaagaggctaatcaaaatgggcattgaggtgacattcaccactagcgttttcgcccatcgtcgtatggcgaaaaccgcagcttccaacgcacccaagggcttaaacttggcggcattctctgacggatttgatgatggtttcaagtctaacgtggatgattctaaacgttacatgtcggagataagaagtcgtgggtcccaaacattaagggatatcattctgaagagttcagacgagggacgtcctgtcacgtccctcgtctacactcttctgctaccttgggcagctgaggtagcgcgtgaactccacattccatccgcgttactatggattcaaccagcaactgtgctagacatatactactattacttcaatggctatgaggatgaaatgaagtgtagctcaaatgatccaaattggagtatccaattaccaaggcttccattactaaaaagccaagatcttccatcctttttagtttcatctagctcaaaagatgataagtatagttttgctctaccaacatttaaagagcaactaaatacattagatggtgaagaaaatccaaaggtacttgtgaatacatttgatgcattagagctagagccactcaaagctattgaaaaatacaatttaattggaattggaccattgattccttcatcattcttgggtggaaaagattcattggaatcttcatttggtggtgatctttttcaaaagtcaaatgatgactacatgaaatggttaaacacaaagcctaaatcatcaattgtttatatctcatttgggagtctattgaatttatcaagaaatcaaaaggaggagattgcaaaagggttgatagagattaaaaggccattcttatgggtaataagagatcaagaaaatataaaagaagtagaaaaagaagaagagaaattaagttgcatgatggaattagagaagcaagggaaaatagtaccatggtgttcacaacttgaagtcttaacacatccatctttaggatgttttgtacgtctcgcactgtggatggaattcgactctggagagcctgtcgtcaggcgtacctgtggtggcatttcctcattggacagatcaagggactaatgcaaaattgattgaagatgtttggaagacaggtgtcaggatgagagtgagtgaagatggtgtggttgagagtgaagagataaaaaggtgcatagaaattgtaatggatggtggagaaaaaggagaagaaatgagaaagaatgcacaaaaatggaaagaattggcaagagaagctgtgaaagaatgtggatcttcagaagtgaatctaaaagcttttgttcaagaagttggcaaaagttgttgaaaaattaaatctcttgatgagaaattgttttcctaattataattttctttttttcgtaataaaatttagagttttatac

SEQ ID NO: 2323 - DNA, 1637 bp, Capsicum annuum
attcatacaagtcaatatttctcctacaaatttctctcacacaatactaaagtctttcaaaattaggttctctagcttctattttcgaagttcgttcacttttttatttataagtttgtatcaatcaaagtctgatagtgtaacaatgtctcgacctcatatcctcttggtcacatttccaacacaaggccatatcaatccatctctccaatttgccaagaggctaatcaaattgggcattgaggtgacatttgctacgagtgtttccgctcatcgtcgtatggcgaagaccgcggcttgcacgcttcccgagggcttaaacttcgaggcattctccgacggatatgacgatggtttcaagtgcgacgtggatgattctgagcgttacatgtctgagataagaagccgcgggtcccagacaataaaagatatcattctgaagagttcagacgaggaacgtcctgtcacgtccctggtctacactcttctacttccttgggccgcggaggtagcacgtgaacttcatgtgccctccgcgttactatggattcaaccagcaactgtgctagacatatactactattacttcaatggatatgaggatgaaatgaagtgtaacaccaatgatccaaattggtgtatccaattgcctaggcttccactacttaagagccaagatcttccatcttttatagcttcttctagctctaaagatgagaaatatagctttgctctaccaacatttaaagagcaactagacacactagatggtgaagaaaatccaaaggtacttgtgaacacatttgatgcactagaactagatgcactcaaagctattgaagggtacaatttgattggaattggaccattgattccttcatcattcttggatggaaaagaaccattggattcttcatttggttttgatctttttcaaaagtcaaatgatgactacatggaatggttggattcaaaccctaagtcatcaattgtttatatctcatttggaagtctattgaatttatcaagaaaccaaaaggaggagatagcaagagggttgatagagattaaaaggccattcttgtgggtaataagagatgaagagaatgcaaaagaagtagaaaatgaacaagagaaattaagttgcatgatggaattggagaagcaaggtaaaatagtgccatggtgttcacaacttgaagtgttaacacatccatctattggatgtttcgtctcgcactgtggatggaactcgactctggagagcctgtcgacaggcgtgcctgtcgtggcatatcctcattggacagatcaagggactaatgctaagttgattgaagatgtttggaagacaggtgttaggctgagagtgaatggagatggtgtggttgatagtgaagagataaaaaggtgcatagaaattgtaatgaataatggtgaagaaatgagaaagaatgcacaaaaatggaaagaattggcaagggaagctgtgaaagaaggtggatcttcacaaatgaatctaaaagcttttgttcaacaagttggcaaaggttgttagagattgaatttttagtaagcaatatattgttttcctatttctaattaatattctctttcctaataaaatttaatgttta

SEQ ID NO: 2324 - DNA, 1788 bp, Nicotiana tabacum
cgcggggacaattattagagtcatacaagtcaagatttctcttcccttttctctcacacaatacaacaacatactttcctctctctaatccaactctttttaggataggttctctaacttctattctcaataagtttatctaagtgtaacaatggtgcaaccccatgtcctcttggtgacttttccagcacaaggccatattaatccatgtctccaatttgccaagaggctaattagaatgggcattgaggtaacttttgccacgagcgttttcgcccatcgtcgtatggcaaaaactacgacttccactctatccaagggcttaaattttgcggcattctctgatgggtacgacgatggtttcaaggccgatgagcatgattctcaacattacatgtcggagataaaaagtcgcggttctaaaaccctaaaagatatcattttgaagagctcagacgagggacgtcctgtgacatccctcgtctattctcttttgcttccatgggctgcaaaggtagcgcgtgaatttcacataccgtgcgcgttactatggattcaaccagcaactgtgctagacatatattattattacttcaatggctatgaggatgccataaaaggtagcaccaatgatccaaattggtgtattcaattgcctaggcttccactactaaaaagccaagatcttccttcttttttactttcttctagtaatgaagaaaaatatagctttgctctaccaacatttaaagagcaacttgacacattagatgttgaagaaaatcctaaagtacttgtgaacacatttgatgcattagagccaaaggaactcaaagctattgaaaagtacaatttaattgggattggaccattgattccttcaacatttttggacggaaaagaccctttggattcttcctttggtggtgatctttttcaaaagtctaatgactatattgaatggttgaactcaaaggctaactcatctgtggtttatatctcatttgggagtctcttgaatttgtcaaaaaatcaaaaggaggagattgcaaaagggttgatagagattaaaaagccattcttgtgggtaataagagatcaagaaaatggtaagggagatgaaaaagaagagaaattaagttgtatgatggagttggaaaagcaagggaaaatagtaccatggtgttcacaacttgaagtcttaacacatccatctataggatgtttcgtgtcacattgtggatggaattcgactctggaaagtttatcgtcaggtgtgccagtagtggcatttcctcattggacggatcaagggacaaatgctaaactaattgaagatgtttggaagacaggtgtaaggttgaaaaagaatgaagatggtgtggttgagagtgaagagataaaaaggtgcatagaaatggtaatggatggtggagagaaaggagaagaaatgagaagaaatgctcaaaaatggaaagaattggcaagggaagctgtaaaagaaggcggatcttcggaaatgaatctaaaagcttttgttcaagaagttggcaaaggttgctgacatctttctaattaagcaattgttttcctatttgtaatttgcttctttttttcctaataaagtttagtgttcaacatctatatacggaatattatataaaaaaaactgcacactaccatgtcgtctaaaagagaatcacaagacaaataagtgtgcataataagggaaatacctgttatacagtcagacttctctgtaacaatatctctatataataaccattc

SEQ ID NO: 2325 - DNA, 1658 bp, Solanum tuberosum
cagcttgtttcgtcttattgtttccttgaatttatcagttgttgatgaattcggcaaagttttagcgattggttgttcaaacacacaagaagaagagtgagtgttatacgattttctttataattgcggaatgtcttttggtgagactaaaactgtaactccaactgaaccgagtacggaagctgcaagaaggagacgcatggaaattcatcagtttcgatttgttgccagcgatatggcggtggctccaccgactagtatggagaatggaggaaggaagagacagaaattggagaaaactgtgtcggtaaaaagctatgatagtaaagagaagaagcgattcaagttggaaagaattgtttccctgccactatcgctgccgtgcacaagtgaaattgagatgggtgaaaagaaggtagcagagaataaagaaaccgaaacgaacgctttggatttgacggaatcttcgtcgaatattgaacgtcagggagtatccgattgtccaaaattcgggatgacatctgtatgtggaaggagaagagatatggaagatacggtgtcgatctacccgtcgtttcttcaggataaacatgaaaagtccagcaacttacatttcttcggtctctacgacggccacggctgctctcatgcggcgatgaaatgtaaagatggaatgcatgagatagtgaagaacgaagttgagagcgcaggggaagaagctacatggaaagagatgatgattcagagcttctcaaaaatggacaaagaagttgttgaatattcgaaaggtgctggaggcacacagactacggattgtagatgcgaacttcagacgccgcagtgcgatgctgttggatccactgctgttgtggccgtcctaactccaaacaaaatcgtcgtgtccaactgcggtgattctcgcgctgtgctctgcagaaacggtgtcccaattcctctgtccactgaccacaagcctgatcgacccgatgaactcaatcggattgaagaagctggcggtcgtgtaatctattgggatggtgcaagagttcttggagttttggctatgtctcgagcaatcggtgacagttacttaaaaccatatgttacatctgaaccggaggtgaccataacggagagaacagtagaagatgagtgtttgatattagcgagcgacgggctatgggatgttgtctcaaacgagacagcatgtggtgtagctcgcatgtgcttgcgatctgggcagagctccgaccaggcttgcactgatgcgtcaatcctcttgacaaggctggctttggctcggcacagttcggataatgttagcgttgtcgttgttgatttgaaaagaggtctatagggatggattgatttaattataagttttgcatgtacatgtacttgtgtttttctttataggcaagattttccacggttggttcctgggatgcaactctcctaaggaagggaaactgcttgagctggagagagtctgttgtattactaagtagtaggtgttctggacatcggaaacagatcgccctactttgattttcgcaggctttgttttctgctcaattggattgtttttactgtgttaaagtttttgcatatttctttattggagaagaaacttctacgaattaattgtaagtgcattt

SEQ ID NO: 2326 - DNA, 1633 bp, Solanum phureja
gcttgtttcgtcttattgtttccttgaatttatcagttgttgatgaattcggtaaagttttagcgattggttgatcaaacacacaagaagaagagtgagtgttttatacgattttctttttaattgcggaatgtcttttggtgagactaaaactgtaactccaactgaaccgagtacggaagctgcaagaaggagacgcatggaaattcatcagtttcgatttgttgccagcgatatggcggtggctccaccgactagtatggagaatggaggaaggaagagacagaaattggagaaaactgtgtcggtaaaaagctatgatagtaaagagaagaagcgattcaagttggaaagaattgtttccctgccactatcgctgccgtgcacaagtgaaattgagatgggtaaaaagaagttagcagagaataaagaaaccgaaacgaacgctttggatttgacggaatctgcttctatatcgttgaatattgaacgccagggagtatccgactgtccaaaattcgggatgacatctgtatgtggaaggagaagagatatggaagatacggtgtcgatctacccgtcgtttcttcaggataaacatgaaaagtccagcaacttacatttcttcggtctctacgacggccacggctgctctcatgcggcgatgaaatgtaaagatagaatgcatgagatagtgaagaacgaggttgagagcgcaggggaagctacatggaaagagatgatgagtcagagcttctcaaaaatggacaaagaagtcgttgaatattcgaaaggagctggaggcacacatactgtggattgtagatgcgaacttcagacgccgcagtgcgatgctgttggatccactgctgttgtggccgtcctaactccaaacaaaatcgtcgtgtccaactgcggtgattctcgcgctgtgctctgcagaaacggtatcccaattcctctgtccactgaccacaagcctgatcgacccgatgaactcaatcggattgaagaagctggcggtcgtgtaatctattgggatggtgcaagagttcttggagttttggctatgtctcgagcaatcggtgacagttacttaaaaccatatgttacatctgaaccggaggtgaccataacggagagaacagtagaagatgagtgtttgatattagcgagcgacgggctatgggatgttgtctcaaacgagacagcatgtggtgtagctcgcatgtgcttgcgatctgggcagagctccgaccaggcttgcactgatgcgtcaatcctcttgacaaggctggctttggctcggcacagttcggataatgttagcgttgtcgtcgttgatttgaaaggaggtctataagggattgatttaattataagttttgcatgtacatgtacttgtgtttttctttataggcaagattttccacggttggttcctgggatgcaactctcccaaggaagggaaactgcttgagctggagagagtctgttgtattactaagtaggtgttctggacatcggaaacagatcgccctactttgatttttgcaggctttgttttctgctcaattggtttgtttttattgtgttaaaagtttttgcatatttattggagaagaaacttcta

SEQ ID NO: 2327 - DNA, 1493 bp, Nicotiana benthamiana
attatatttctcgagtctcgattcaatcccttaattttattaaagaaaaaacttcagtgcgagtaaattgcaacaaaaacatcaagtacgaataactttgtttcatgacgggaatgtattttggtgagactaagactgtaaatccaactgaaccgagttcagaaggtgctagaaggagacggatggaagttcaccagttccgttttatcgccagtgatacggcggtggctccacctctagagagtgaaaggaagagacagaaactgaataaacttgtctctgtaaagagctttgagattaaggagaagcgatctaagttggaaaggattgtttccctgccgctatcgctgccatgcaggagtgatattgagaagggcgaaaagaaggtaacagagaacaaagaaaccgaaaggaacgcattggatttaacggactctgcttcaatatcgtcgaatattgaacgccgaggagtttctgattgtcccaaattcggcgtgacatctgtttgtggaaggagaagagatatggaagatgcggtgtcgatctaccctacgtttattcaggagaaacatgaaaaatcaagcaacttgcatttcttcggtctctacgacggccacggctgctctcatgctgcgatgaaatgtaaagatagaatgcacgatatcgtgaagaacgaggttgaaagcgcaggggaagctacgtggaaagagatgatgatgcggagcttcactaaaatggatgaagaagtcgttgagtattcgagaggaggcggtggtgcaccaaccgctgattgtagatgtgaacttcagacgccgcagtgtgatgcagttggatccactgctgtcgtagcggtggtaactccaaacgaaatcgttgtgtccaattgcggtgactctcgcgctgtgctttgcagaaatggcgttgctattcctctttccactgatcataagccggatcgacccgatgaactcagtcggattgaagaagctggcggtcgtgttatctattgggatggtgcaagagttcttggagttttggccatgtctcgagcaattggtgacaattatttaaaaccatacgttacatctgaacctgaagtgaccgtaactgaaagaacagtggatgatgaatgcttgatattagctagcgatgggctatgggacgtggtgtcaaacgagacggcatgtggtgtggcccgcatgtgcttgagatccgggcgaccagagtctccccctgggtcgccggctaatgatgtcacaccgacggtctccggggataactccgagcaggcctgtactgatgcgtccattctcttgactaggctggctttggctaggcatagttctgataatgttagtgttgtcgtcgttgatttgaagagagatttataaaatcaaaaacaaataaatgtacatgtataatttcgagtttataggaagagtatatgatttcatttatcaaaagcccaaaggccagagtttccatggttgcat

SEQ ID NO: 2328 - DNA, 1682 bp, Nicotiana benthamiana
  misc_feature (1103)..(1103): n is a, c, g, or t
  misc_feature (1543)..(1543): n is a, c, g, or t
tatatttctctgagtctcaatattggtctaatcgatcccttccttttatgaacttcagtattgttaattgagttcgaagaatttgcaaacaaaaacatcaagtgcgagtaaatttatttcatgacgggaatgtgttttggtgagactaagactgtaaatccaactgaaccgagttcagaaggtgctagaaggcgacggatggaagttcaccagttccgttttctagccagcggtatggcggtggctccacctctggagagtgaaaggaagagacagaagctgaataagcttgtctctgtaaagagctttgagattaaggagaagcgatcgaagttggaaaggattgtttccctaccgctatcgctgccttgcataagtgatattgataagggcgaaaagaaggtaggagagaacaaagaaaccgaaaggaacgcattggatttatcagaatctgcttcaatatcgtcgaatattgaacgcccaggggtttctgactgtcccaaattcggcgtgacatctgtttgtggaaggagaagagatatggaagatgcggtgtcgatctaccctacctttattcaggagaaacatgtaacatcaaggaacttgcatttcttcggtctctacgacggccacggctgctctcatgctgcgatgaaatgcaaagatagaatgcacgatataatgaagtacgaggttgaaagcgcaggggaagctacgtggaaagagatgatgacacggagcttcactaaaatggataaagaagtcgttgagtattcgagaggaggcggtggtgcaccaaccgccgattgtagatgtgaacttcagacgccgcagtgtgatgccgttggatccactgccgtcgtagccgtggtaactccaaacgaaatcgttgtgtccaattgcggtgattctcgcgctgtgctttgccgaaatggcgttgctattcctctatccactgatcataagccggatcgacccgatgaactcaatcggattgaagaagctggtggtcgtgttatctattgggatggtgcaagagttcttggagttttggccatgtctcgagcaattggtgacaattatttaaaaccatacgttacttntgaacctgaagtgaccataactgaaagaacagtggatgatgaatgcttgatattagctagcgatgggttatgggacgtggtgtcaaacgagacggcatgtggtgtggcccgtatgtgcttgagatccggacgaccgcagtttccgccaggttcgccggctaatgatgtcaccccaacggtctccggggataactccgaccaggcctgtattgatgcgtcgattttcttgactaggctggctttggctaggcatagttctgataatgttagtgtcgtcgtcgttgatttgaagagagatttatagagtcgaaaaacaaataaatgtacatgtatagtttcgagtttcgagtttataggaagagtgcatgatttcatttatcaaagcccaaaggccagattttccatggttgcattttattgctggagaaaatttcgttagngtgtttttactaatattcaagataagaaattgtataggagagttgatggagacattgttattaatttaattatgcaacaatttgatggaccagattcgctttattaaccaaataattctagtattaattatggttagtt

SEQ ID NO: 2329 - DNA, 1531 bp, Solanum phureja
tttgaattcatccagcgccaaactatcttcttcttcttcacctctctttcacacaaacccagagaatgctctctcagtcctaaagttcaagctttaatctttccaagaatcaaactttaacaaccccaacaatgtcttttattaagccatcatctcgctatgctaaaacttcttttgattcttcaagatcttcaactaaatctgacccttcttcttctacagacaaagctctaatcaaaatcaagaaaggttcaaatggggttactcaaactacccatcaatccaattttagctcaatggtcaagaaatttgttgaacacaaatctgcttcttctaaattgatgaagcagcagcagcagcagaaaaagggtgatttgaaattggttattcctgtggattttatagctgaagatttgaagaaaacagcgaaaagaggcagtggtttgagttctctgcataaaaaattgtttaaaggttcttcttctggtggtggtgtgaaaaaagaggaaggaagcgcgatgaaggcgttaacggaggttaagggtaatacgaggacattaggaatggttcttagaagtgagagggagctgttaagtatgaataaggagcaggaggatcagattgttgagcttaagctgatgctcgaggagaagaatcgagaggttgagaagcttaaggatttgtgcttaaagcaaagggaagagataaagtcactgaaaaattccatactgttcccggatgttatgaactatcaagttcaggatcttttggaaaagcaaggttcagaactcaaacaggcaaagcagcttataccaaatcttcaaaggcaggtcacttctcttactgggcaactacaatgcctagctgaagatctcgctgagatcaaagcagataaatatgctatacgagggagctatgactcttttggtagccctccagaatatgatcaagaagaagcagctaattctctggaattcagctctgaggatcacacaattcccggtagtccagatgacatgtttctcaaggatgtaaacccctgcttaacaccttattacgccaagacaaagtccaaggaatttgatgacttcaattctcctgatgctaaagatttggttaaaaacaacattcaagtgtatcatgagacaagctacaattcctgtgcaaggaagctgtcgaaaagttcagattgtcgccaatgttccaatacaggcaacaaagcaactcgtgcagctcgtaggtctgatgaaagcaaatgtacttatggaaagcaggttcacaataagttctactgagttgtgctcaatcctgacaatgcttcttgagcgtcacaacgccttaaatccaatatagcttgcccgttgacaacattcttagtgtcaattcctgttccattctctccttttcgatgtatttttcagaaaatcaatctgcctgagttgcctagaccaagtatgtaatcagcatacattttgttggtatgatcttaataagatgcacgtttggaggctaaattgcgtttttaagattg

SEQ ID NO: 2330 - DNA, 732 bp, Solanum tuberosum
cggagtgaaacaacaatggcggatgttcagagaagaggaagaccattacctcctcctccacccagaggtccacttggtccacctcctcaaaggattgctccacggcccgtaccagttgatcgcgaaaagacttgtcctctgttgcttcgtgttttcactaaggttggaggccatcacaatgtcaatgaatttgctgtgagaggcaaggaacccaaagatgaggtccaaatctatacatggatggatgctactctgcgcgaactaactgatctggttaaagaggtagctccagaagcaagacgaagagatgcaattttgtcctttgcttttgtctatccggataaaagggggcgctttgtcgttagagaggtggggactacattttcttaccccaatatgaggcgaccagataatggcagcaaaacattgagtgaacttaaatttcagataggagattacttggatgtggctatcatgttccagtgagcgttatggcacctgtattggaattggaattggaattacgcagacttgtactactttgtgtttcttcttaattctacatatctgtatttttcttgataagctgacctaatgttcatttttgctgtaaatctgagattctgtctagagttctctatgactagatctgttatattacgttagtatgtcatgggatttaactgcattcttcgctaactccatcgttatgaattgtcaacacttttatga

SEQ ID NO: 2331 - DNA, 858 bp, Solanum phureja
agaaaaaattgcttaaacccctgttgtatgaaagagtgacagaccgacggagaccggagtgaaacaacaatggcggatgttcagagaagaggaagaccattacctcctcctccacccagaggtccacttggtccacctcctcaaaggattgctccacggcccgtaccagttgatcgcgaaaagacttgtcctctgttgcttcgtgttttcactaaggttggaggccatcacaatgtcaatgaatttgctgtgagaggcaaggaacccaaagatgaggtccaaatctatacatggatggatgctactctgcgcgaactaactgatctggttaaagaggtagctccagaagcaagacgaagagatgcaattttgtcctttgcttttgtctatccggataaaagggggcgctttgtcgttagagaggtggggactacattttcttaccccaatatgaggcgaccagataatggcagcaaaacattgagtgaacttaaatttcagataggagattacttggatgtggctatcatgttccagtgagcgttatggcacctgtattggaattggaattggaattacgcagacttgtactactttgtgtttcttcttaattctacatatctgtatttttcttgataagctgacctaatgttcatttttgctgtaaatctgagattctgtctagagttctctatgactagatctgttatattacgttaagtatgtcatgggatttaactgcattcttcgctaactccatcgttatgaattgtcaacacttttatgatactttgtgatttcctttagtgaattctatgtcccaaaagtttgtggaactgtgattttgtgtcttccctt

SEQ ID NO: 2332 - DNA, 750 bp, Solanum melongena
aaatccctgttgtgttacagagtgacagaccaacggagacgagagtgaacaacaatggcggatgttcagagaagaggaagaccattacctcctcctccaccaagaggtctgcctccccaaaggattgctccacgacccgtaccagtcgatcgcgaaaagacttgtccgctgttgctccgtgttttcactaaggttggaggccatcacaatgtcaatgaatttgctgtgagaggcaaggaacccaaagatgaagtccaaatatatacatggatggatgctactctgcgtgaactaactgatctggttaaagaggtagctccagaagcaagacgaagagatgcaactttgtcctttgcttttgtctatcctgataaaagggggcgatttgtcgttagagaggttgggagtacgttttcttaccccaatatgaggcgaccagataatggcagcaaaacattgagtgaacttaaatttcagataggagattacttggatgtggccatcctgttccagtgagcttttatgatggcacctgtattggaattagaattatgcaggacttgtactactctatgtttcttcttacttctacatataaatatctgtattttttcttgataagcttagacctaatgttcatttttgctgtaaatctgagattgtctctctatgactagttctgttatatggatgtaactgcagtctttttagagctaactccatcattatgaattatgattatttgtcaag

SEQ ID NO: 2333 - DNA, 710 bp, Capsicum annuum
gagacgacgaaacgggagtgacggcaatggcggatgttcaaagaagaggaaggccattaccacctcctccaccaaggggtggcccacttggtccacctctcgcaaggattcctccacgccctgtacctgtcgatcgcgagaagacttgtcctctgttgcttcgtgttttcactaaggttggaggccatcacaataagaatgaatttgccgtgagaggcaaggaacccaaagatgaggtccaaatctatacatggatggatgctactttgcgcgaactaactgatctggttaaagaagttgctccagaagcaagacggagagatgcaactttgtcctttgcttttgtctatcctgataaaagggggcgatttatcgttagtgaggtggggagaacgttttcttatcccaatataaggcgaccagatgatggcagcaaaccactgagtgaacttaaatttcagataggagattacttggatgtggctatcatgttccaataagcttttatgacctgtattggaattagaattatgcagacttgtactagtttgtgtttcttcctgcgtctagatatctgtatttttctgttaagttgacctaatgtttattttttctgaaattccctctagagctgtctggctagttatgttatgttacgttcggtatgtgatggatttaactagtcttctcagagctaactcaattgttat

SEQ ID NO: 2334 - DNA, 721 bp, Capsicum annuum
ggcacgagagacgacgaaacgggagtgacggcaatggcggatgttcaaagaagaggaaggccattaccacctcctccaccaaggggtggcccacttggtccacctctcgcaaggattcctccacgccctgtacctgtcgatcgcgagaagacttgtcctctgttgcttcgtgttttcactaaggttggaggccatcacaataagaatgaatttgccgtgagaggcaaggaacccaaagatgaggtccaaatctatacatggatggatgctactttgcgcgaactaactgatctggttaaagaagttgctccagaagcaagacggagagatgcaactttgtcctttgcttttgtctatcctgataaaagggggcgatttatcgttagtgaggtggggagaacgttttcttatcccaatataaggcgaccagatgatggcagcaaaccactgagtgaacttaaatttcagataggagattacttggatgtggctatcatgttccaataagcttttatgacctgtattggaattagaattatgcagacttgtactagtttgtgtttcttcctgcgtctagatatctgtatttttctgttaagttgacctaatgtttattttttctgaaattccctctagagctgtctggctagttatgttatgttacgttcggtatgtgatggatttaactagtcttctcagagctaactcaattgcctcgtgc

SEQ ID NO: 2335 - DNA, 837 bp, Nicotiana tabacum
  misc_feature (519)..(519): n is a, c, g, or t
  misc_feature (529)..(529): n is a, c, g, or t
  misc_feature (642)..(642): n is a, c, g, or t
ccgggggcagtaaaacagatcaagaaaacgcagagcaatggcggaagtgcagagaaggggaagaccgttgcctcctcctccagcgagagtcccaccgggtcctcctcccctcagaatgggccctcgggtccaacccgttgaccgtgaaaagacttgtccactcttgcttcgcgttttcaccaagattggaggccatcatagtgataatgattttgccgtgagaggcaaggaacctaaagatgaggtccagatctatacatggatggatgctactctgcgtgaattaactgatctggttaaagaggtagctccagaagcaagacgaagagatgcaagtttgtcatttgcttttgtgtatcctgataaacgagggcggtttgtggttagagaggtggggagaacgtactcttatccaaatgggagacgacctgatagtggcagcaaaagcttgagtgaactaaaatttcagattggagattacttggatgtggctatcacgttccagtgacctgtaacagnacccgcattnaaaatagaaccatcttagcttgtagtatactttgtgttccttttcttaacttccctatccttgatatgtatgtagccccaagcttatgcattagttcattatatgctctgggntaatgctacctttttctgtaaaattaacatcaaatccagtgtgtcgatgcattccagaccttgtctagtattcgtttatatctgcaagatggttaaacaagtatctaagggtatgtgctaatgttcaatcaaatggcccattgaagaccagggttcaatttccaacaatgaaattacaataggtgatttttctta

SEQ ID NO: 2336 - DNA, 644 bp, Olea europaea
cacaaatttctcgcaaacacagcaatggcagaagtgcagagaagaccaggaggaaggccgctgcctccgtcggcgaggggtccaccaccgcctcctgccaccaagcctgggcctcgctcggaacccgtcgatcgggagaagacttgtccattgttgcttcgtgttttcactaaggttggaggccatcatactgatggggagtttgcggtgaggggcaaggaacccaaagatgaggttcaaatttatacatggatggatgcgactctacgtgaattaactgatctggttaaagaggttgctccagaggcaagaagaagagatgctattctgtcctttgcttttgtatatcctgataaacgtggtcgttttgtggttagagaggtgggaagaaccttttcttaccccaatgggaggcgacctgacagtggaagcaaatccttgagtgagctttgctttcagataggtgattacttggatgtagcaattctgttgcagtaaccagtctgcttcatgatatgatatctatgaacatgttgcgggcttgcttttgggagacggtggcccttccgacgtgccttcaatttctctgttattttgttatgatgcactggagagacagtaatccatgtagtagtatctcctaa

SEQ ID NO: 2337 - DNA, 676 bp, Petunia hybrida
gtgcagtaacacacacgaccaagaagaagaagaagaagaagaagaagagcaatggcgcaagatcagagaaggggaagaccactgccacctcctccggcgagaggcccattgggccctcctcctttcagaatggctcctcggcttgagcccgtcgaccgtgaaaagacttgtccactcttgcttcgtgtcttcaccaaggttggaggccatcatagtgataatgattttgccgtgagagggaaggaacccaaagatgaggtccagatctacacatggatggatgctactctgcgtgaattaactgatctggttaaagaggtagctccagaagcaagacgaagagatgcagagttgtcatttgcttttgtgtatcctgataaatgggggaaatttgtggttagacaggtgggtagaacaaactcttatctaaatgcgaggcgagcagataatggcagggcaaccttgagtgaactaaagtttcagatcggagattacttggatgtggctatcacgttccaggaccgcttctaaaaatagaactgtgcagacttctagtatgctgtgttccatttttacttttgtatccttgatatgtagcccaagaccagttctgcattaattgttcattgtatccttggctaatgctaactttttctgtaaaagtactaaagaggga

SEQ ID NO: 2338 - DNA, 840 bp, Nicotiana tabacum
  misc_feature (18)..(18): n is a, c, g, or t
  misc_feature (26)..(26): n is a, c, g, or t
  misc_feature (29)..(29): n is a, c, g, or t
  misc_feature (34)..(34): n is a, c, g, or t
  misc_feature (55)..(55): n is a, c, g, or t
  misc_feature (698)..(698): n is a, c, g, or t
taggcgggagaagggaanacattacntcntccancaccgagaggcccgcttggtncactcccgctagacttgctccccgccttcaaccagtcgatcgtgaaaagacttgtcctctgttgcttcgtgttttcactaagattggaggccatcacagtgacaatgagtttgcggtgagaggcaaggaacccaaagatgaggtccaaatctatacatggatggatgctactctgcgtgaattaactgatttggttaaagaggtagctccagaagcaagacgaagagatgcaactttgtcctttgcttttgtctatcctgataaaaggggccaatttgtcgttagagaggtggggagaacgttttcttatccaaatatgaggcgaccagatagtggcagcaaaactttgagtgaacttaaatttcagataggagattacttggatgtggctatcctgttccagtgatctgttatggcacctctgtcgggattagaattatgcaaaacttgtattgctttatgttcttcatacttatacatatctgtaattttcttgataatctgagctctaatgttcattttcgctgtgagattgcctccagagtgctctatgaccagttacgttcgtaggcaattgatttaactgggctcttcttagagccaactccattgttacgttgctgtcagcacttatatgattctntgtggtttcattttctttcttcttttttcaattctatcacctgcaagtgtctcttgagctcatgttcctgctttttaaacacaacttacgtactagtaaacttttgggttgtaccgatgttattgtcagtagtctaaacaag

SEQ ID NO: 2339 - DNA, 748 bp, Orobanche aegyptiaca
caaaactgcgacgaaagttatagcagagacgcagagagcgacaatggcagacgtgcagagaagaaggggtctaccgccgccaccgccgctaagaggtctgccgccacctccggcgtccaaaccttctgtccttcgccctgaacctgttgaccgcgagaagacttgtccccttttgcttcgcgttttcaccaaggttggagggcatcacactgatgatgattttgcagtgagaggcaaggaacccaaagatgaggtccagatttatacatggatggatgcaactttacgggaattaactgatctggttaaagaggtagctccagaggcgagaagaagagatgctttgctttcctttgcttttgtgtatcctgacaaacgaggccgttttgtggttagagaggtgggaagaacattttcttacccgaatgggaggcggcctgatagtggaagcaaagccttgggtgatcttagtttccagataggcgattacttggatgtggcaattctaacccagtaatccgtgttggtgtctttaactatgtcatctttgtactatgatcttctcacttaaggggcaaaattttagaatttattaaaattttgctcatttttcttaatgatcctcgtgaatggttccttgggatgatgtgtattttgtctaaacgtggacaaatgcgtaaggcgtgcatcgtgattttgtcggtagttgatgaacagttgggcttttccaaaattcagctttattttg

SEQ ID NO: 2340 - DNA, 824 bp, Amsonia hubrichtii
atccagcgtcgttgagaagaatggcagaagttcaaagaagggcaggaggaagaccgctgcctccggtggggagaggcccaccaccgcctccaccctcagccaaggcagcccctcgcttcgaacccgttgatcgcgaaaagacatgtcccttgctgcttcgtgttttcaccaagataggaggccatcatacggaaggggaatttgctgtgagagggaaagaacctaaggatgaggtccaaatctatacttggatggatgcaactttgcgagagcttacagatctggtgaaagaggtagcttctgaagctaggagaagagatgcaattctatcatttgcttttgtgtatcccgataaacgtgggcgttttgtcgttagagaggtgggcagaactttttctcagccaaatgccaggcgaccagaccagggtagcaaagccttgggggaacttaactttcagataggagattacttggatgtggccatactacttcagtaatgcatgctgcttccttgattttctagatttgtgaagagtgctcggttcatgcagttggtttatgttgcaagaccgggagtcactgtagctttgatctcttataacatgcaaatttatgaacatattgctttggctgtgtttgttccaattctgtagtatttctgatggtggtcagactatctataaaaaaagcctttgttgttagaattaacagagaagagaatcgtgatcgtggttagaatgatgtaaaagttaaatattcaggtgaatgcatatctcattctcatggttaaatggagtaatagtatatctatgccacgttaggtt

SEQ ID NO: 2341 - DNA, 858 bp, Sesamum indicum
cacagactgtgtgatggctgaagggcagagaagaccaggaagacaaatgcctccgcctggaaggggtccgccaccgcctcccccggccaagcccgccgcccctcgccttgaacctgttgaccgcgagaagacctgtccattgttgctccgcgttttcaccaaggttggaggccatcattccgatgaagattttgcagtgagagggaaggaaccgaaagatgaggtccaaatttatacatggatggatgcaactttgcgtgaattaactgatctggttaaagaggtagctccagaagcgagaagaagagatgctatcctgtcctttgctttcgtgtatcctgataaacgtggtcgttttgtggtcagagaggtggggagaaccttttcttacccgaatgggaggaggcctgacagtggaagcaaagccttgggtgaccttagctttcagataggtgattacttggatgtcgcaattcttacccagtaacagatgctgctcttatcctcgtttgattcattgcatacatgtagtgagtttaaccatgccatttttgtaatatgatcctcaaccaaggggcgacatctacaaaaaagtccacttctgtatgctaatgattgttgggagtagctcctcctgggtatgatttggtgtgtttttattccctagttgtactgcatccggtggtaatttatatgggagttgcctcgtctttcctaaatatatcttccgtctcctagagttgctaagttgctatatggtgattgaaaaaggaaaattctgccgtatcattagtagtctcatgctgttgaaagagggctggaatcagtatctaactatactatgttattaaagaagag

SEQ ID NO: 2342 - DNA, 723 bp, Triphysaria pusilla
gggtagcacgcaacagagacatagagagtgagatggcagacgtgcagcgaagaaggggtccattgccgcctccgcccggaaggggtctaccgccgcctccgattaccaagcctgccgcccctcgacctgaacctgtcgaccgggagaagacttgtccattgttgcttcgcgttttcaccaaggtaggaggcaatcacactgatgatgattttgcagtgaaaggcaaggaacccaaagatgaggtccaaatttacacatggatggatgcaactttacgtgaattaactgatctggttaaagaggtggctccagaagcaagaagaagagatgctattctgtccttctcttttgtctatcctgataaacgtggccgttttgtggttagagaggtggggagaacgctttcttacccgaatgggaggcggcctgatagtggaagcaaagccttgtgtgatcttagttttcaggtaggcgattacttggatgtggcgattcttactcagtaatccatgttggcattccatttgttttgattcatgcttgcgtagagttagttttaactttgtcatccttgtactatgatatacaacaaaatttgctcatgtatgcttattaattattgtcgtaattcgatttgtgggatgatgtttacatcatggttttgtgtttgtactttgtagttgataatttgttacctatttttaaaattcggcattatttccc

SEQ ID NO: 2343 - DNA, 756 bp, Antirrhinum majus
  misc_feature (21)..(21): n is a, c, g, or t
  misc_feature (713)..(713): n is a, c, g, or t
aaaaagtgagcgatgacggangtgccatacgagcaggaaggccgatgcctccgccggggaggggcccaccaccgccgcctcccttatcaaaggcacccgtacccgtcgtcgatcgcgagaagacttgtccattgttgcttcgcgttttcactaaggtgggagcccatcatactgatggagattttgcagtgagaggcaaggaaccaaaagacgaggtccaaatttatacatggatggatgctacattacgtgaattaactgatctggtcaaagaggtggctccagaagcaagaagaagagatgctattctgtcctttgcgtttgtctatcctgataaacgtggccgctttgtagttagagaggttggaagaacattttcctaccccaacgggaggcggcctgacaatggaagcaaagccttaggtgaacttagctttcaggtaggtgattacttggatgtggcgatcctgacccagtagtctttgctggtcttttgttgtcaaagatttgtgtcgtagattgagtatttgctttaatggagaatgcgggtcttcggacattgagcaactgtatccacaatgctatgtacctcccttaaacacaattcaagtttgcactaatggtttccagtggggtgcaatatgaacaaaattgctctgtgtatgctaatgatctggcttttgtattcattttgtaaagcttgaatcagtttncatgagttggtgtctggattttatagttaatctgcattaggta

SEQ ID NO: 2344 - DNA, 681 bp, Lippia dulcis
agtgatggcagaaattcagagaagaccgggtagaggacctatggctccgccgggaagaggcctccctccgcctccagctgccaggcccgcacctcgccctgaacctgtcgatcgcgagaagacttgtccactattgcttcgagttttcaccaaggttggaggccatcatactgatgaagattttgcagtgaggggcaaggagcctaaagatgaggtccaaatatatacatggatggatgcaaccttgcgtgaattgactgatctggttaaagaggtagctcctgaagcaagaagacgagatgctatgctgtcgtttgcttttgtctatcctgataaacgtggtcgttttgtcgttagagaggtggggagaacattttcttaccctaacgcaaggcggcctgatagcggaagcaaagcactgggcgatcttagctttcagataggcgattacttggatgtggcaatcaccctgcctcagtaatccttgctgctgttgtgttgctgaatcttattgtgagcataaccaaccgcatttctctttaggtagaatcacgttttgctcatgtttgtaatagacctttttgagttagctctaggaatgatgtgaattctacttggagctccgtttgatggatagctttgaagcggacatgagttgtacttttgagaaatgtcaacaga

SEQ ID NO: 2345 - DNA, 724 bp, Lippia dulcis
agctttgagtgatggcagaaattcagagaagaccgggtagaggacccatggctccgccgggaagaggcctccctccgcctccagctgccaggcccgcacctcgccctgaacctgtcgatcgcgagaagacttgtccactattgcttcgagttttcaccaaggttggaggccatcatactgatgaagattttgcagtgaggggcaaggagcctaaagatgaggtccaaatatatacatggatggatgcaaccttgcgtgaattgactgatctggttaaagaggtagctcctgaagcaagaagacgagatgctatgctgtcgtttgcttttgtctatcctgataaacgtggtcgttttgtcgttagagaggtggggagaacattttcttaccctaacgcaaggcggcctgatagcggaagcaaagcactgggcgatcttagctttcagataggcgattacttggatgtggcaatcaccctgcctcagtaatccttgctgctgttgtgttgctgaatcttattgtgagcataaccaaccgcatttctctttaggtagaatcacgttttgctcatgtttgtaatagacctttttgagttagctctaggaatgatgtgaattctacttggagctccgtttgatggatagctttgaagcggacatgagttgtacttttgagaaatgtcaacagaaaattgaaattgcttgatccatttgtgaaaaaagaa

SEQ ID NO: 2346 - DNA, 1090 bp, Solanum phureja
attttctcttaattacaaatcttgaagaagaaaaaaatcttgtctttctctatcaagtccaaacccagatctacggttgaaatcttggattataataatgtcgacagatgtgcattctaattcaaaagcattcaagattttcataggttatgatcctcatgaagatgttgcttatgaggtctgtcgttattcccttctcaaaagatcttcaatcccacttgaaatcatacccattaaacaatcagagttaagggaaaaagggttgtactggcgtgaaagggggaaattagaaagcactgagttttcattttctcgttttttgacaccccatttggctaattttgaagggtgggctatgtttgttgattgtgatttcttgtatttaggggatattaaggaattgagggatatggttgatgataaatatgctttaatgtgtgtacaacataattatgctccaaaagagactaccaaaatggatggggcagtgcaaactgtgtatcctaggaagaattggtcatcaatggttctttataattgtgggcatccaaagaataaggtgttgacacctgagattgtgaatactgaatctggggcatttcttcataggtttacttggttggaagatgaggagattggggaagttccgttcgtttggaacttcctcgtcgggcataataaggttgttgaaggggatcctgctacatttcctaagtcgattcattatacgcttggtggaccttggtttgaggcttggaaggattgtgaatttggggatttgtggataaaggaactcgaggagtacaagaaggcggcagagaagaaggtggattaaggcaatgtaggttattggtattgtttgattcacacagtttttagttaaggtaattcattcgttatgtgttttccttgatttagtcttccatattgtttcaattgtgagatgtaatcggttcattccaaatcaagtactttgtattctagttttactgcctttagttagtaagcagtttttcagtcatatcttttgtattgtaatcataatagattcatgaaggaaagaataagatcatcttgatctttgaatgat

SEQ ID NO: 2347 - DNA, 1165 bp, Capsicum annuum
gcacgaggctcctttttttcctaaaataaaatcttttattttctcattctagtccaaacccagaccgatctactctcttgtttttggtgaaatcttgaattataatgtcgacagtggtgcattctaatggaaatggtcattcacaaaatgccccaaattcgaagccattcaagattttcataggctatgatccacgtgaagatgttgcatatgaggtctgtcgttattcccttctcaaaagatcttcaatcccacttgaaatcatacccattaaacaatctgagttaaggggaaaagagttatactggcgtgaaagagggaaattggaaagcactgagttttcattttcgcgttttttgacaccccatttggctaattttgaagggtgggctatgtttgttgattgtgatttcttgtacttaggagatattaaggaattaagggatatggttgatgataaatatgctttgatgtgtgtacaacatgactatgctccgaaagagacaacgaaaatggatggggcagtacaaactgtgtatcctaggaagaattggtcatcaatggttctttacaattgtgggcatcctaagaataaggtgttgacacctgagatagtgaatactgaatctggggcatttcttcataggtttacgtggctggaagatggggagattggggaagttccgtttgtttggaactttcttgtggggcataataagtttgttgagggtgatccggctacatttcctaaggcaattcattatacgcttggtggaccttggtttgaggcttggaaggattgtgaatttggagatttgtggttgaaagagctcgaggagtacaagaaggcgactgagaagaagttggattaggccaatgtagctcgtggtattgattcccacagtttatatttaaggtaactgattcgttacgtgcatcttcagatgtttgagggctatgttcccttgatttagtcttccatattgtttcgatctatattgtctccgttatgagatgtaaccgatttatttcaattcaaatactttgtattctagttttactgcatattaggaaacagtttttcagtcaaatcttcgtattgtaatcattatagattcattaaggaaagaataagatcaacttgatctttgttctggcctcgtgc

SEQ ID NO: 2348 - DNA, 1050 bp, Petunia hybrida
cgcggggaagctcctatactttagtgttaaatactacacaattctctctcaaaaaaatacaaatcttgactttaactttaggaaaaaaaaaaattagtattttgtctatcttagtccaaaccaatatctactctctctatttaggttgaaatattgaacaaaaatgtctaatgatggacatgttgattcacaaaatggcccaaattcaaaggcattcaaggttttcataggttatgatccacgtgaagatgatgcatatgaggtctgtaaatattcattattgaaaagatcatcaatcccacttgaaatcataccaattaaacaatcagagttaaggcaaaaagggttatattggcgtgaaagagggaaattagaaagcactgagttttcattttcacgtttcttgacacccaatttggctaattatgaaggatgggctatgtttgttgattgtgatttcttgtacttaggtgatattaaggagttagtgaatatggttaatgataaatatgctgttatgtgtgtaaaacatgattatgcaccaaaagaaactactaaaatggatggtgctgtacaaactgtgtatcctaggaagaattggtcatcaatggttctttataattgtggacatcctaagaataaggtgttgacacctgagatagtgaatactgaatctggagcatttcttcataggtttacttggttggatgataaggaaatcggtgaagtcccgttcgtttggaacttcctcgtcgggcatagtaaggttgttgagggtgatcctagtacatttcctaaagctattcattatacacttggtggaccttggtttgaggcttggaaggattgtgaatttggtgatttgtgggtaaaggagctcgaggaatacaagaaggcaacggtgaagaaggtcgattaggccaatgcagctaatagtaattgagaagaaggtggattaggccaatgcagctagtggtaattgattagtggttgttgttcaattggtgtatcttcggaggtttgaaggctatgccgccccttgatttagtt

SEQ ID NO: 2349 - DNA, 1234 bp, Solanum lycopersicum
caattattacttctcttacaaatctttgactctttttcttcaaccaaaaaaggaaaaaaaaatattgttttctcttttcagtccaaactagatctgttatcgctctaaaaagagactgtaatgtcgaaagatttgcattcagatgtagagaaatctgagacccctttgaagccattcaagattttcgtaggctatgatccacgagaagatgttgcgtatgaggtttgtcgttattcccttttgaaaagatcatcaattccacttgagataacacccattaagcaatgtgagttgagggagcagggtctgtattggcgtgaaagagggaaactggaaagtactgagttttcattttcgcgatttttgacgccttacttggcagattatgagggttgggctatgtttgttgattgtgatttcttgtacttaggggatattaaagaattgagggatattgtcgatgataaatatgctttaatgtgtgtacaacatgattatactcctaaagagactacgaaaatggatggtgcagtgcaaacggtttatcctaggaagaattggtcgtccatggttctttataactgtggacatccaaagaaccgagggctaacacctgaggtggtgaatgctgagtccggggcatttcttcatcgcttcatgtggttggaggatgaggagattggggaggttccatttgtgtggaactttcttgtggggcataataaggttgttgaaggtgatccagctacatttcctaaggcgattcactatacacttggtggaccctggtttgaagcttggaaagattgtgaatttggtgatttgtggttgaaggaattggaagagtccaagaaggcaaaggagaaggtggtttgagccaatgtagacaacattgtttgaatcgcagggtgtatgttaaggtaatcagctggtggttattgttgtaagtgtgttcagtgaccagaaggttatgccatttatttaaccttccacattatttattttgtattttctcacttcgaggttctttgtaattcaagccagtattttattctgtgttgctatatctgataagcaaacttttaagtcatctagagttgtattattattttaatagatgtctgtttgtatagaaggtagtagattgtgtgatgatctacaactttattattgatatctgctctggatttgtaatttggtttcattaatgagaaacgatggaggtttggttgct

SEQ ID NO: 2350 - DNA, 1240 bp, Solanum lycopersicum
cacaattattacttctcttacaaatctttgactctttttcttcaaccaaaaaaggaaaaaaaaatattgttttctcttttcagtccaaactagatctgttatcgctctaaaaagagactgtaatgtcgaaagatttgcattcagatgtagagaaatctgagacccctttgaagccattcaagattttcgtaggctatgatccacgagaagatgttgcgtatgaggtttgtcgttattcccttttgaaaagatcatcaattccacttgagataacacccattaagcaatgtgagttgagggagcagggtctgtattggcgtgaaagagggaaactggaaagtactgagttttcattttcgcgatttttgacgccttacttggcagattatgagggttgggctatgtttgttgattgtgatttcttgtacttaggggatattaaagaattgagggatattgtcgatgataaatatgctttaatgtgtgtacaacatgattatactcctaaagagactacgaaaatggatggtgcagtgcaaacggtttatcctaggaagaattggtcgtccatggttctttataactgtggacatccaaagaaccgagggctaacacctgaggtggtgaatgctgagtccggggcatttcttcatcgcttcatgtggttggaggatgaggagattggggaggttccatttgtgtggaactttcttgtggggcataataaggttgttgaaggtgatccagctacatttcctaaggcgattcactatacacttggtggaccctggtttgaagcttggaaagattgtgaatttggtgatttgtggttgaaggaattggaagagtccaagaaggcaaaggagaaggtggtttgagccaatgtagacaacattgtttgaatcgcagggtgtatgttaaggtaatcagctggtggttattgttgtaagtgtgttcagtgaccagaaggttatgccatttatttaaccttccacattatttattttgtattttctcacttcgaggttctttgtaattcaagccagtattttattctgtgttgctatatctgataagcaaacttttaagtcatctagagttgtattattattttaatagatgtctgtttgtatagaaggtagtagattgtgtgatgatctacaactttattattgatatctgctctggatttgtaatttggtttcattaatgagaaacgatggaggtttggttgcttctg

SEQ ID NO: 2351 - DNA, 1325 bp, Capsicum annuum
aatctttgactctttttcttaccaaaaaagaaagaaaaaaaaaagattgttttctcttaccagtccaaaccagatctaataacaaggactgtaatgtcgtctactgtgaaatctttgtattcaaatggcgttgatgtaacgaaatctgagaccccttttgttgtttctgatccaattttaagcaatggaaccaaaaattccaagccgttcaagatttttataggctatgatccacgagaagatgttgcttatgaggtttgtcgttattcccttttgaaaagatcatcaatcccacttgagataacacccattaagcaatctgagttgaggcaacaggggttgtattggcgtgaaagagggaaattggaaagcactgagttttcgttttcgcgatttttgacaccccatttggctgattatgagggttgggctatgtttgttgattgtgatttcttgtacttaggtgatattaaagaattgagggatagggttgatgataaatatgctttaatgtgtgtacaacatgactatactccgaaagagactacgaaaatggatggtgcagtgcagactgtttatcctcggaagaattggtcatccatggttctttataactgtgggcatccaaagaaccgggctttaacacccgaggtggtgaattctgagtccggggcatttcttcatcgattcatgtggttggaggatgaggagattggggaggttccatttgtgtggaacttccttgtggggcataataaggtcgttgagggtgatcccgctacacttcctaaggcaattcactatacacttggtggaccctggtttgaggcttggaaagattgtgaatttggtgatttgtggttgaaggaattggaagagtgcaagaaggcaaaggggaaggttggttaagacgatgtagacaacgtcatttaaattgcagtgtgtattttaaggtaatcggctggtggtaattgttgtaagtgttatgttcagagattagaaggctatgccattattgtaatcttccacattattcattttgtattgtctcactttgagtcctcctaattcaagccagtattttattcttatttgccacatatgttaagcagacttttaagtcatctagagtggtattataaatgtaatagatgtttgttattataaatggtagtagattgtgtgatgatctataaatttattattgatatgttctctggatgtgttgtttggtttcactaatgagaaacatttcccctctctacatgactgaggttttgttgcttctgtaattggttttaagaaatgtactttttccctcctgc

SEQ ID NO: 2352 - DNA, 1271 bp, Capsicum annuum
gcacgaggaatctttgactctttttcttaccaaaaaagaaagaaaaaaaaaagattgttttctcttaccagtccaaaccagatctaataacaaggactgtaatgtcgtctactgtgaaatctttgtattcaaatggcgttgatgtaacgaaatctgagaccccttttgttgtttctgatccaattttaagcaatggaaccaaaaattccaagccgttcaagatttttataggctatgatccacgagaagatgttgcttatgaggtttgtcgttattcccttttgaaaagatcatcaatcccacttgagataacacccattaagcaatctgagttgaggcaacaggggttgtattggcgtgaaagagggaaattggaaagcactgagttttcgttttcgcgatttttgacaccccatttggctgattatgagggttgggctatgtttgttgattgtgatttcttgtacttaggtgatattaaagaattgagggatagggttgatgataaatatgctttaatgtgtgtacaacatgactatactccgaaagagactacgaaaatggatggtgcagtgcagactgtttatcctcggaagaattggtcatccatggttctttataactgtgggcatccaaagaaccgggctttaacacccgaggtggtgaattctgagtccggggcatttcttcatcgattcatgtggttggaggatgaggagattggggaggttccatttgtgtggaacttccttgtggggcataataaggtcgttgagggtgatcccgctacacttcctaaggcaattcactatacacttggtggaccctggtttgaggcttggaaagattgtgaatttggtgatttgtggttgaaggaattggaagagtgcaagaaggcaaaggggaaggttggttaagacgatgtagacaacgtcatttaaattgcagtgtgtattttaaggtaatcggctggtggtaattgttgtaagtgttatgttcagagattagaaggctatgccattattgtaatcttccacattattcattttgtattgtctcactttgagtcctcctaattcaagccagtattttattcttatttgccacatatgttaagcagacttttaagtcatctagagtggtattataaatgtaatagatgtttgttattataaatggtagtagattgtgtgatgatctataaatttattattgatatgttctctggatgtgttgtttggtttcactaatgagaaacatttcccctctct

SEQ ID NO: 2353 - DNA, 1275 bp, Ipomoea nil
acgagctccgattcccttgcagcgttgtctatctctcgtctttgtctctccgttatccactttcacaaaggtttgagaatcttgatctagaatgtcgtcggtggcacaagatttgcctgtgaatggcgtggaggtaaagaaatctgagattacttccgttccagtttcaatgaatacgaatagtggaactactaaaccagagaatggaaatgcctcaaagccattcaagattttcataggctatgatccccgtgaagatgttgcttatgaggtctgccgccattcccttttgaaaagatcttcaatccccattgaaatccaccccattaaacaatctgaattgaggcagaagagcctttattggcgtgagagagggaaactggagagcactgagttttccttttcgcggttcttgaccccttaccttgccaattatgagggttgggccatgtttgtggattgtgatttcctctacctgggtgacattaaggaattgagggatttgattgatgataagtatgctgtaatgtgtgtacaacatgattatgctccaaaggagaccacaaaaatggatggggcagtgcaaacagtttatccgaggaagaactggtcatccatggttctctacaattgtggacatcccaagaataaggtgctaacccctgaggtggtgaattctgagtctggtgcatttcttcataggttcacgtggttagaagatcacgagatcggagatgtcccttttgtatggaatttccttgtagggcacaatcgggttgttgagggcaatccttctactcttcccaaggcaatccactacacccttgggggtccctggtttgaggcatggaaggattgtgactttgcagacttgtggttgaaggagttggaggaatacaagaaaacagagaaggtggattagacattgttttggttgtgctctctggttggctggctagaggtaattcataaatggtggtactatttgtgttggtgctttttgctttggtatattgatggagtattcatttagtttcatttagaaattgttcaatgtgggatgctattcaattgattccaaaatttgactctgtaatctcatctctggctatatagcatacgttgtagtttttcacaattgtccatggctttgcagacaagagccatgttgatgtattagtattgtattggttccacatagtagtcttctatgttgaagaggaattagatattgtggctagttatctgggaattcttttattcttcatgtcctat

SEQ ID NO: 2354 - DNA, 1219 bp, Nicotiana tabacum
  misc_feature (291)..(291): n is a, c, g, or t
  misc_feature (293)..(293): n is a, c, g, or t
  misc_feature (330)..(330): n is a, c, g, or t
  misc_feature (341)..(341): n is a, c, g, or t
  misc_feature (352)..(352): n is a, c, g, or t
  misc_feature (365)..(365): n is a, c, g, or t
  misc_feature (410)..(410): n is a, c, g, or t
  misc_feature (446)..(446): n is a, c, g, or t
  misc_feature (473)..(473): n is a, c, g, or t
  misc_feature (476)..(476): n is a, c, g, or t
  misc_feature (581)..(581): n is a, c, g, or t
  misc_feature (632)..(632): n is a, c, g, or t
  misc_feature (641)..(641): n is a, c, g, or t
  misc_feature (657)..(657): n is a, c, g, or t
  misc_feature (659)..(659): n is a, c, g, or t
  misc_feature (671)..(671): n is a, c, g, or t
  misc_feature (719)..(719): n is a, c, g, or t
  misc_feature (731)..(731): n is a, c, g, or t
  misc_feature (738)..(738): n is a, c, g, or t
ccagtaaaatcttgactcttttttatcaacaaaaaaatcttgttattttctctatctagtccattcccagatctaccctctcttgcaacttttttatttatttttaattaccctgttagttttcttggttttgcaggttgaaatattgggttataatgtcaacaatggtcaaagatgtgtattctaatggaaatgttaattcagaaaatgacccaaattcaaagccattcaagattttcataggctatgatcccagtgaagatgttgcatatgaggtctgtaaatattccntnttgaaaagatcttcaatcccaattgaaatcatacccnttaaacaatcngagttaaggcnaaaagggttatantggcgtgaaagagggaaattagaaagcactgagttttcattttcncgtttcttgacaccccatttggctaattatgagggntgggctatgtttgttgattgtgatttnttntacttaggtgatattaaagaattaagggatatggttgatgataaatatgctgtaatgtgtgtacatcatgattatgcaccaaaagaaacaacaaaaatggatggngcagtgcaaactgtataccctagaaagaattggtcatcaatggttctttanaattgtggncatcctaagaataagntnttgacacctganatagtgaatactgaatctggagcatttcttcataggttcatgtggttngaagataatganatcgggnaagttccgttcgtttggaacttccttgtggggcacaataaggttgtcgagggtgatccgaatacatttcctaagtcaattcattatacacttggtggaccttggtttgaggcttggaaagattgtgaattcggagatttgtggataaaggagctcgaggagtacaagaaggtggattaaggccaatgtagctaatggtattgtttaactgccatagatttttagttaaggtaattgattcaagggtttgagggctatgcctccttgatttagtattcaatattgttttggtctgtattgtctccattagggagatgtaaccaattcattccaaacccaatactttgtattctggtttttacaagtattagttagtaagcagtttttcagtcatataattgtaatagattcatttaaagaataagatcatcccgatctttgagtgatgtatcgagtatgcttttggttatgttataaatgaa

SEQ ID NO: 2355 - DNA, 1247 bp, Solanum phureja
cacaattattacttctcagttacaaatcttttgactctttttcttcaaccagaaaaggaaaaaaaattattgttttctcttttcagtccaaaccagatctgttatcgctctaaaaagagactgtaatgtcgtctgtggtgaaagatttgcattcaaatgtagagaaatctgagacccctttgaagccattcaagattttcgtaggctatgatccacgagaagacgttgcgtatgaggtttgtcgttattcccttctgaaaagatcatcaatcccacttgagataacacccattaagcaatgtgagttgagggagcagggtctgtattggcgtgaaagagggaaattggaaagtactgagttttcattttcgcgatttttgactccttatttggcagattatgagggttgggctatgtttgttgattgtgatttcttgtacttaggggatattaaagaattgagggatatggttgatgataaatatgctttaatgtgtgtacaacatgattatactcctaaagagactacgaaaatggacggtgcagtgcaaacggtttatcctaggaagaattggtcgtctatggttctctataactgtggacatccaaagaaccggggactaacacccgaggtggtgaattctgagtctggggcatttcttcatcgcttcatgtggttggaggatgaggagattggggaggttccatttgtgtggaactttcttgtggggcataataaggttgttgaaggtgatccagctacatttcctaaggcgattcactatacacttggtggaccctggtttgaggcttggaaagattgtgaatttggtgaattgtggttgaaggaaatggaagagtccaagaaggcagaggagaaggtggtttaagccaatgtagacaacattgtttaaatcgcagggtgtatgttaaggtaatcagctggtggttattgttgtaagtgtgttcagtgattagaaggttatgccatttatttaatcttccacattatttattttgtattttctcacttcgagattctttgtaattcaagccaatatttattctgtgttgctatatctgataagcagacttttaagtcatctagagttgtattataattgtaatagatgtctgttagtatagaaggtagtagattgtgtgatgatctacaaatttattattgatatctgctctggatttgtaatttggtttcattaatgagaaacgatggaggtttggttgct

SEQ ID NO: 2356 - DNA, 1052 bp, Tabernaemontana elegans
atatttaacaccagtcctccgcaatctctgtacttcctcagacttccactttcttgactcttttcccattgttccagtataaatctattctcacttcccatttttaagtccaacccagatctaaaaactgacaaattttcgcaacccggaaggagtggaatcttgaagtggaaatgtcggcattggtggcagaaatgaattctaatggccatgttgctgagagtaatggttctgcgaagccattcaagatcttcattgggtatgatccgcgcgaggatgttgcatacgaggtgtgtcgttactcattgctcaagagatcttcaatcccaattgagatcacccccattaagcaatctgaattgagggaaaagagcctttattggcgcgaaagagggaaattggagagcactgagttctcattttcccgtttcttgactcctcacctagccaattatgagggctgggccatgtttgtggactgtgattttctctacttaggtgatatcaaggagttaaccaacttgattgatgacaagtatgcagtaatgtgcgttcaacatgattatactccaaaagaaacaaccaaaatggatggggctgtgcaaacggtttatcctaggaagaattggtcttcaatggttctgtataattgcggccaccccaaaaacaaggtcttgaagccagaggtggtgaatactgagtcgggggcatttctgcataggttccaatggttggacgataaggagattggggagataccatttgtgtggaactttcttgtggggcataataaggttgttgagggtgatccgagcactcttcctaaggcaatacattacacattaggtggaccctggtttgagcaatggaaagattgtgaatttggagacttgtggttgaaggagcttgatgagtacaagaatgcaatgcagaaggcaaattagatgataatgtagcttgagatattgtttcatttctattggcattattttagctgaggtaattggttgattgataatagtttcaattgttctgatatgttctggtagagg

SEQ ID NO: 2357 - DNA, 1101 bp, Solanum melongena
ttcttctcggaatccctcacaattattactggtttcagatacaaatcttttgactctttttcgaccaaacaaagaaaaattattgttggatctaatatcgctcgaacaaggactgtaaatgtcgtctgtggtgaaagatttggatgcaaatggtgttgacgtaatgaaatctgagaccccttttagcaatggcacgaattcgaagccattcaagattttcataggctatgatccacgagaagatgttgcctatgaggtttgtcgttattcccttctgaaaagatcatcaatcccacttgaaacaacacccattaagctatctgagttgagacaacagggcatgtattggcgtgaaagagggaaattggaaagcactgagttttcattttcgcgatttttgacgccttacttggcagattatgagggttgggctatgtttgttgattgtgatttcttgttcttaggggacattaaagaattgagggatatggttgatgataaatatgctttaatgtgtgtgcaacatgattatactccaaaagagaccaccaaaatggatggggcagtgcaaacggtttatcctaggaagaattggtcatccatggttctctataactgtgggcatccaaagaaccgggcgttaactcctgaggtggtgaattctgagtctggggcatttcttcatcgcttcatgtggttggaagatggggagattggggaggttccatttgtgtggaacttcctagtggggcataataaggttgttgagagtgatccagctacatttcctaaggcgattcactatacgcttggtggtccgtggtttgaggcttggaaagattgtgaatttggtgatttgtggttaaaggaattggaagagtgcaagaagacaaaggagaaggtggttaagacaatttagacaacatttgtttaaatcgcagggtgaatgttaaggtaattggctggtggtaattattgtaagtgttatgttgagcgatgagaaagctatgctattaatttaatcttccacattaattattttgtattgtgccactttgagattctttgtaattcaagccagtattttattctgtattgcgc

SEQ ID NO: 2358 - DNA, 1305 bp, Coffea canephora
accgaagatatcaatgcccctaaaatttccgcgtttcctctcttacttccttagactccttttctccaccccacagaccaaaattctcactctttttccattttcaggtccatcccagatctagaagatccaattcttccaagaaggagtgaaactcttggaaaaacggtaatgtctacattggtggcagaaacgaatttcaagaatgaagaggtaaagaaatctttgagccctactaaggctggacttgattcgcttcccaagagtttggttaacggcaatgctaacaaggacaatgctgataagccccccaaattgaagatctttattgggtatgatccccgtgaggacatcgcttacgaggtttgccgttattcattgctgaaaagatcttctatcccagttgagattaccccaattaagcaatctgaattgaggggaaagggtctttattggcgtgaaagagggaagctagagagcactgaattttcgttttcgcggtttttgactccccatttagctgattatgaaggttgggccatgtttgttgattgtgattttctgtaccttggtgatataaaggaattaaccgatttgattgatgatagatttgctataatgtgtgtacaacatgattatgcccctaaagaaacaactaaaatggatggggctgtgcagacggtttatccgaggaagaattggtcttccatggttttgtacaattgtagtcaccctaaaaataggatcttgactcctgaggtggtgaacacagaatcaggggcatttttgcacaggtttcagtggttggaggatgatgagattggggagattccgttcgtgtggaattttcttgtggggcataacagggttgttgagggcgattcaagcacattccctaaggcaatacattatacattaggaggcccatggttcgaggcatggaaggattgtgagtttggagacttgtggttgaaggagcttgaggagtataagaaggcgaaagagaagaaggtagatagctaaaatgtagctcaggaaattgtttgattactgtttaattccacactgagattaccatttggtttccatttattatcccaattattcttgctagtcttgtagagttgctcccctttaggggtcgtttcgatgtaatatttgtattattcaatttctagcagtttcttattgaagaatgatgctattagttctccggatttactactagtttccatatttctttcttacaattgaccagctatttgtaggaaacaatttgaaacttatccaaaaaaaaaaaaaaaa

SEQ ID NO: 2359 - DNA, 1277 bp, Lippia dulcis
cctccaatcttttctgcataaaaatccaatcttggcttgtttttttcctctgtagccagtaagatatattcttcttttgtcagtccattctccgtcccagatctatcaagaagtttgcagttattgacagaaaaaaatcatgtcgggcggcgttgatgtgcatcgttcgagcaatgccgaggtgagaaatcccgaccccatttccaagaatctgatcaacggcaatgagaattgccaggatgggaattcgaagccgttcaaggttttcattggctacgatccgcgtgaagatctcgcttacgaggtttgccgccattctttactaaagagatcttcaatcccaattgagattttccccattaagcaatctgaattaagagaaaagggcctttattggcgggagaggggcaaattggagagcactgagttctccttttcccgtttcttgaccccacatttagcaaattacgagggatgggcaatgtttgttgattgtgatttcttgtacttagatgatatcaagaaactagttgatttaatcgatgataagtacgcgatcatgtgcgtgcagcacgattacgcccctaaggagagcactaaaatggatggggctgttcagacggtgtatcctagaaagaattggtcttctatggttttatacaattgtgggcatcctaagaataaggttctatctcctgaggttgttaataaggagacaggtgcgttcttacataggtttcaatggctgaatgatgatgagattggtgagatcccatttgtttggaattttcttgtgggccataataaggttgtggagtgtgattctagcacctttccgaaggcgatacattatacgctaggggggccgtggtttgagcaatggaaggattgtgagtttggagatctttggttgaaggagttggaggagtttcagaaggctgatgtgaagaaggagaattgattcagtttggtgaaatttggtgcattttgaatatttgttgcatttgttagttgattgtatgttctgtattattttgtagcattgatgtttgatcactcgttcgtcagtactgtatttgtatgagtttgtagtcaagagttcttcaggatcagtctgtaatattgtatttctgatctgattattaattggatcacgagatcggtagaatgctcgtataatggaaattagactgttattatgtttttctttttcgtgtattatgcataaaatttgtcgtaatattgttctcttttctatctgaaatatgtttcgttcg

SEQ ID NO: 2360 - DNA, 1267 bp, Amsonia hubrichtii
ttttcattctcaccaatgactgatatttaacatcaatcccgcgatatctttgtacttcctcagattttctcgactcgtttcacatttactagcataaatctatcctccctttccgttttaagtccaacccagatctaaagagagacaaacttaactaacccggggaggagtggaatcttgaagcgtaaatgtctacattggtggcagaaatgaattccaatggcaatgctgctaagagtaatggtgatgcaaaaccgttcaagatcttcattgggtatgatccaaaagaggatgttgcatatgaggtctgtcgttactcattgctcaagagatcttcaatcccaatcgatatcacacccattaagcaatccgagttgagggaaaagggactttattggcgcgaaagagggaaattggagagcactgagttctcattttcccgtttcttgaccccttacctagccaattatgagggctgggccatgtttgtggactgtgattttctctacttaggtgatatcaaggagttaaccaacttgattgatgacaagtatgcgataatgtgcattcaacatgattatactccgaaggaaactaccaagatggatggggctgttcaaacagtttatccgaggaagaattggtcttcaatggttctgtataattgcggccacccaaaaaacaaggtcttgaagccagaggtggtgaattctgagtcgggggcatttctgcataggttccaatggttggaggataaggagattggggagataccatttgtgtggaacttccttgtgggacataataaggttgttgagggtgatccaagcacccttcccaaggcaatacattacacattaggcggaccctggtttgaggcatggaaagattgtgaatttggagacttgtggttaaaggagcttgaggagtacaagaattctatgcagaaggcaaattagattgtaatgtagcttgagattcctttcatttctattggcattacttagctgaggtaattggttgattggtatttgtttcaattgttggtgtatgttccggcagaggcactctactggagtggtgctctttagctatcatatagactggcttaatgtcattcaggtgtaacatttatatcgttcaccttgtagctgtttcttactcgaattttttatgctaattctcaagtcaagatttgattgtatgttatatttcttcactgatatagatcaataagaatatagctcagttgtttgctgagttttaa

SEQ ID NO: 2361 - DNA, 1119 bp, Solanum phureja
gcacacaggagtagaacttcagtcacctttgcttttgtatgtatttcttcaaattacataaagtttgctgaatttttctcttttgatatctgaaaaattctcttcagattcaaatttgggaaagttgaagaagaagaagagaaaatgagaggaaacgatccgaatccgtttgatgaagaggagcctgaagtcaatcctttttcaaaaggtggctccgctcctgcatcgaaatcacgcttccctcaaatgattgctagtactcttggttttggccaaaagcatgatgcaactgttgatgtcccattggattcaatgaatggttccaacaagaagcaaaaagaattagcaacctgggaagcagatctgcaaaggagagaaagagatattaaacgaagagaagatgctgttgctggtgctggtgtgccaactgatgatagaaattggccgcccttttttccaattattcatcatgatatagcaaatgaaataccagctcattctcagcggctgcagtatttggcttttgcgagctggttaggtattgttttttgtctggcgttcaatgttcttgccgtgactatctgttggattaagggtggcggtgttaaaatctttttcctggctataatatatgctttaatgggatgtcccctttcgtacattttgtggtacaggcctctgtataacgcgatgaggaccgacagtgcattgaagtttggatggtttttcatgttctacttggtccacattggattttgcatacttgctgctattgctcctcccattgtatttcaaggaaaatccttaacgggtatcctttcagcaattgatgtcttctctgaccatgtgttggttgggatattttatttgattggatttggcttcttctgcttggaaggtttgcttagcttgtgggttctgcagaaagtgtacatgtatttccgggggaacaagtgatgcacctgtttggacgtagcaacaaaacaattctttggctgagtaatgacttgcgtgatatagttgcatattttctaggtttaataacatattcgtttcattgtcatttttgtatgtaatcacagtttgaccttcgatcattagactactacattacctata

SEQ ID NO: 2362 - DNA, 1279 bp, Solanum melongena
acctttgctttgtatctctgcaaattacataaattttgctgaattttttacttttaatatctgaaaaattctctccagattccaaaattgaaaggttgaagaagaaggagagaaaatgagaggaaacgatccgaatccgtttgatgaagaggagcctgaagtcaatcctttttcaaagggtggctctgatcctgcatccaaatcacgctttcctcaaatgattgctagtactcttggttttggccaaaagcatgatgcaactgttgacgtcccattggattcagtgaatggtcccaataagaagcaaaaagaattagcagcttgggaagcagatctgcaaaggagagaaagagatatcaaacgaagagaagatgctgttgctggcgctggtgtgcaaattgatgataggaattggcctccgttttttccaattattcatcatgatatagcaaatgaaataccagctcattctcagcgtctgcagtatttggcttttgcgagctggttaggtattgttttttgtctggcgttcaatgttcttgctgtgactatctgttggattaaggatggcggtgttaaaatctttttcctggctgtaatatatgcattaacgggatggcccctttcgtatgttttgtggtacaggcctctgtataatgcgatgaggactgacagtgcattgaagtttggatggtttttcttgttctacttgtttcacattggattttgcatacttgctgctattgctcctcccattgtatttcagggacgatccttaacgggtatccttgcagcaattgatgtcttctctgaccatgtgttagttgggatattttatttgattggatttggcttcttctgcttggaagttttgcttagcttgtgggtgctgcagaaagtgtacatgtatttccgagggcacaagtgatgcatgtgtttggactataagacctcattatcgtagcaacaaaacagttattttccagagaatgctaaacatatgccttcattatcaatctgctgagttatgacttgtgtgatatagttgcatgttttctaggtttaatagctatctttgcttcattcaagcatattcgttttcattgtcatttttgtatgtaatcacagtttgacctttgatcattagactaccgcaatattttacctatatagtaccttcattgggattcattttgaatcagataccctttctgtttggattgtatgaggattgagtcaatgtcatgatttgtggggagggcatcatccattaacaata

SEQ ID NO: 2363 - DNA, 1163 bp, Capsicum annuum
cataactttcgcgcagttcaattaaatcgaagaagagaaaatgagtagaaacgatccgaatccgtttgacgaagaagaacctgaagtcaatcctttctcaaagggtggctctgctcctgcatctaaatcacgctttcctcaagtgatcgctaatactcttggttttggtcaaaagcatgatgcaactgttgacatcccattggattcaatgaatgggcctaatcagaagcaaaaagagttagcaacctgggaagcagatctgcaaaggagagaaagagatattaaacgaagagaagatgctgttgctggtgctggtgtgccaaccgatgataggaattggcctcccttttttccaattattcatcatgatatagcaaatgaaataccagctcattctcagcggctgcagtatttggcttttgcaagctggttaggtattgttttttgtctggtgttcaatgttcttgccgtgaccatctattggattaagggtggtggtgttaaaatctttttcctggctgtaatatatgctttaacgggatgtcctctttcatatgtcttgtggtaccggcctctgtataacgcgatgaggactgacagtgcattgaagtttggatggtttttcttgttctacttgctgcacattgggttttgcatacttgcagctattgctcctcccattgtatttcatggaaaatccctaacgggtatccttgccgcaattgatgtcttctctgacattgtgttggctgggatcttttatttgattggattcggcttattctgcttggaggttttgcttagcttgtgggtgctgcagaaagtgtacatgtatttccgagggcacaagtgatgcacctgtttgggactcaaagacctcagcgttgtcctagcaacaattcttttccagagggagctaaacatatgtctttatttcttcattaatgttttgggtgggtgatgactttcgcggtatagttgcatgttttctaggttcaatagttatttttagttgattcgagccatatgttccttttcattgtcattcctgtatgtaaccgcagtttgccctttgatcattagactaccgtgttattgtacctatataataccttcatttgggactcattttgaatcaaatatgtccatttggttcggatagt

SEQ ID NO: 2364 - DNA, 1224 bp, Capsicum annuum
tttttttctctctttatataatccataactttcgcgcagttcaattaaatcgaagaagagaaaatgagtagaaacgatccgaatccgtttgacgaagaagaacctgaagtcaatcctttctcaaagggtggctctgctcctgcatctaaatcacgctttcctcaagtgatcgctaatactcttggttttggtcaaaagcatgatgcaactgttgacatcccattggattcaatgaatgggcctaatcagaagcaaaaagagttagcaacctgggaagcagatctgcaaaggagagaaagagatattaaacgaagagaagatgctgttgctggtgctggtgtgccaaccgatgataggaattggcctcccttttttccaattattcatcatgatatagcaaatgaaataccagctcattctcagcggctgcagtatttggcttttgcaagctggttaggtattgttttttgtctggtgttcaatgttcttgccgtgaccatctattggattaagggtggtggtgttaaaatctttttcctggctgtaatatatgctttaacgggatgtcctctttcatatgtcttgtggtaccggcctctgtataacgcgatgaggactgacagtgcattgaagtttggatggtttttcttgttctacttgctgcacattgggttttgcatacttgcagctattgctcctcccattgtatttcatggaaaatccctaacgggtatccttgccgcaattgatgtcttctctgacattgtgttggctgggatcttttatttgattggattcggcttattctgcttggaggttttgcttagcttgtgggtgctgcagaaagtgtacatgtatttccgagggcacaagtgatgcacctgtttgggactcaaagacctcagcgttgtcctagcaacaattcttttccagagggagctaaacatatgtctttatttcttcattaatgttttgggtgggtgatgactttcgcggtatagttgcatgttttctaggttcaatagttatttttagttgattcgagccatatgttccttttcattgtcattcctgtatgtaaccgcagtttgccctttgatcattagactaccgtgttattgtacctatataataccttcatttgggactcattttgaatcaaatatgtccatttggttcggatagtacgaggatcgagtcaattttatgatgtgtgatatgtgg

SEQ ID NO: 2365 - DNA, 1230 bp, Coffea canephora
cggccggggggcgtcactaatcactctgagtagttttaagtgctccttactcgcttcctcactttctctctctaccaatacatatatctacatttccctttctcattctgtatagattcattttcctgcttttttgtggttgatttttgccggaaatattttgaattcacttaggacgatgaatcggagtagcgatccaaatccatttgatgaagaagagcaagaagtcaatccgttttcgaagggtaatgctgctcctggatcaaagtcgcgtgttcctcaatttgtcagcaatactctgggttttggccaaaaacatgacgcgactgttgatatacccttggactcaatgaatgattcaaagaaaaaacagaaggagcttgctgattgggaagcagatattaaaaggagggaaagggatatcaaacgcagagaagatgctgttgccagtgctggtgtccccgctgatgacagaaattggcctcccttttttcctattattcatcatgatatagccaatgaaatccctgttcatgctcagaggttgcagtatttagcttttgctagttggttaggaatcgttctttgcctcgtgtttaatgttatcgcagtgactgtttgttggataaggggtggtggtgtcaaaattttcttcctttctataatctatgccttgcttggttgtcccctatcatatgttctttggtacaggcctctgtatcgggcaatgaggactgatagtgctttcaagtttggttggtttttcctgtgttacttgatccacattggcttttgcatattggcagctattgctcctccaattgttttccatgggagatcactaacgggcatccttgcagcaattgatgtcttttctgaccatgtattggtggggattttctacctggttggctttggcttgttttgcttagaatcattgctaagcttgtgggtagttcagaaagtttatatgtacttccgagggcacaagtgatctatgacattggattagtttcttgtgttcgaggtcccttggcagatgtttcatccgtcagttcttaccagcactcatttagaggtggttaattgagttgtgagatgtgatgatcggtttgagcgacgttcttttgcatttttttttatctgttgagctcatagttgaagatgatcttgtaatttttcatattgacaatcccctacaggtgagtatacgcattctatcctacagtg

SEQ ID NO: 2366 - DNA, 1503 bp, Lippia dulcis
tttcagataactgaagtgaagagagccacagtgagggtcgtcacacgggagtcaaacccaccgctggtagcaagggtatttcacgtaatttcctctatttttggtggcaattgtagtagttagtttcattccaaatgcacttccgtcccgcgtcgtaataaagcagcaaaggagggttcactctaccggaaattcgtgctccccatcccccttctcgctctctctagctttttatgtacgtacgcatacgtctgtatgtattgagctgcatattagtctgtttgcagagtttcagtgttccggagaagttgcaatgaatcgaggacacgatcccaatccatttgacgagggagagcccgaagtcaatccatttgcgaatggagctgggtcaaagtcacgcgttcctaaagtggttgctaatacatttggttttggtcagaaacatgatgccactgtggatataccattagattctatgaatggctccaagaaaaaagagaaagaacttgcaacatgggaagcagatttgaacaggagagaaagggagattaaacggagagaaaatgcagtttccagcgctggtgttcccgtggatgatagaaattggcctccattcttccccattattcaccatgatatagccaatgaaataccagctcatgctcagaggttgcagtatctggcttttgcaagttggttaggtatcctgctttgccttgtgttcaatgttattgcaatcactatttgctggataaagggtggtggagtcaagattttcttccttgccattatatatgcactaatgggatgtcccctatcctatgtgttatggtacagacctttgtatcgtgcagtgaggactgatagtgcattgaagtttggctggtttttcttgttctacatgctccatattgggttttgcattttagctgcaattgcacctccaattgtctttcatggacaatcattaacgggcatccttgcagcgattgatgttttctctgatcatgttttggttgggatttttttacctggtcgggtttgcattcttttgcttggaatcactgctgagcttgtgggtactccagaaagtttatatgtacttcaggggacacaagtaatactggaagtttcaggtcttagcttctgagatgccgaattatatagctttacttcccttttgtctgatatgattgattcagctgtcttatgatgattgggttgctcgtggaaaatcatccattacgactgcgaggatatacaaaatccgtcatcagtaacaagtatctttaacatttcaagttctttgtattcattttaagcaaaataccaaatgagggagtcccctcatttaggcgcacatgttttcccttgagaagtatagcatatagaatcgattctttcatcctgagtcctggcaacattttcattgtgtgtgtatatcagagaccagcaataaggtttagtttggatgtgctgaatcctctcgtttgcataccaaaa

SEQ ID NO: 2367 - DNA, 1159 bp, Amsonia hubrichtii
gaagaatactatacagtaagggaagatgcatcggagagacgatccaaatccatttgacgaagagcagcaagaagtcaatccgtttgggaatggtggtgctgctcctgcatcaaaatcacgcttccctcaaatggttgctagtactctgggttttggccaaaaacatgatgccactgttgatatacccttggattcaaagaatgatccaaagaaaaaagagaaagagcttgctgattgggaagcagatttgaaacggatggaaagggatatcaaacgcagagaagaagctgttgctggtgctggtgttcctacggatgatagaaattggcctccctttttcccgatcattcatcatgacatagccaatgaaattcctgctcatgctcagaggttgcagtatttggcttttgctagttggttaggtattgttctttgccttgtctttaatgttgtggcagtgactacttgttggataaggaatggtggtgtgaaaattttcttccttgctataatctacgctcttctgggagttccgctttcttatgttctctggtacaggcccttgtatcgtgcaatgaggactgacagtgctctgaagtttagttggttttttatgttctacttgctccatattgctttctgcatatttgccgctattgctcctccagtagtgtttcatgggaaatcactgacgggcatccttgcagcaattgatgtcttctctgaccatgtggtggtggggattttctacatggttgggtttggtttgttttgcttggaatcattactaagtttgtgggtgcttcagaaagtctatatgtatttccgagggcacaagtgataccataaataagggtttaggcttatcttcatctggaggatgtgcagacatgcttcatctgtcaatccatctccttcccatatagaggtggtagagttaggctggatattgttattgtaatgagtgatgtatttctaggcttctagataaaaaatttcttctacctggaggcgcattattcttttgtaccagtatgcagttatcacgtgttcattctgatttcatgctctctaaaaaaggtcttttagtacagcaatatttcttgtattatgatatgattgaattgcgcttgaagtaaatcttgttaatttgtggaat

SEQ ID NO: 2368 - DNA, 1269 bp, Mimulus guttatus
gcttcgtaataaagcagcaaaaccagcacactcacagtacggcagtgccactgttctctctctatttttctctctctagctttataaaaacgtatacaaacatctgtctgtgtgtgtatatatataagccgcatactttgcgtgtatcgggagctctagctttggggaaaatagttagccatgaatcgaggaaacgatcccaacccgtttgacgatgaagagcccgaagtcaatccattttcgcaaggtgcagggaagtcacgcatgcctaatgtcgttgctagtacactgggttttggtcggaagcatgacgccactgtggatataccattagataacatgaatgactccaggaaaaaggagaaagaactttcaacttgggaagcagatttggacaggagagaaagggacattaaacggagagaagctgctgttgccagtgctggtgttcccgtggatgataaaaattggcccccatttttccctcttattcatcatgatatagccaatgaaataccagttcatgctcagaggttgcaatattttgcttttgcgagttggttaggtattgtcctatgcctcgtgttcaatgtcattgcagtcactatttgctggataaggggtggtggagtcaagattttcttccttgctattatatatgccctaatgggtgtccccctctcgtatgtactgtggtacaggcctttgtatcgtgcagtgaggactgatagcgcactcaagtttggctggtttttcttgttctatttgatacatattggtttttgcatccttgctgcaattgcacctccaattgtctttcaagggagatcacttacgggaatccttgcagccattgatgtcttctcggaccatgttttggttgggatcttctacctgcttggattcggatttttttgcttagaatcactgctgagcttatgggtactccagaaagtatatgcatatttcagggggaataagtgatatacttgaattcatctggaagctggctaagtagaaatgtattctgttattttgcgaaaaaaatttatcgtttcgatttcgtattctcacatgtagcagaaagcacgaagggtttacatgtatttgctatctaaattcaactctatagctttattctcttctgcactattctttatggattccctatagtttcatttggtatgtaaattctttatgaatcatgatattcatggcggattgattgttcactcttgaaaatattatattctgtttggcacctgtatt

SEQ ID NO: 2369 - DNA, 1228 bp, Tabernaemontana elegans
agaatttcataaaaaggcatcgcaatctgcgttgtatggttcgctactcaacaagcactctttctctctctacacctatatatctatctatagacaatttctcgctctcaaagacattgtaatttccgtgtttggaattatttggtgaattttggagaatagtatatagagtaagcgaggatgaatcggagagacgatccgaatccatttgacgaagagcagccggaagtcaatccatttgcgaatggtggcgctgctcctgcatcaaagtcacgctttcctcaaatggtagctagcactctgggttttggccaaaaacatgatgctactgttgatatacccttggattcaatgaacgatccaaagaaaaaagagagagaccttgctaactgggaagcggatttgaaacggagagaaagggatatcaaacggcgggaagaagctgttgctggtgctggtgttcccacagatgatagaaactggcctccctttttcccaatcattcatcatgatatagccaatgaaattcctgctcatgctcagaggttgcaatatttggcttttgccagttggttaggtattgttctttgccttgtgttcaatattgttgcagtgactgcttgttggataaggaatggtggtgtgaaaattttctttcttgctataatctacgcccttctgggagttcctctttcttatgttctctggtacaggcccttgtatcgtgcaatgaggactgacagtgctctgaagtttggttggttttttatgttctacttgcttcatattgctttttgcatatttgccgctattgcgcctccagtagtctttcatgggaaatcattaacgggcatccttgcagcaattgatgtcttctctgaccatgtggtggtggggatcttctacattgttggctttggtttgttttgcttggaatcagttttaagcttgtgggtgcttcagaaagtctacatgtttttccgcgggcacaagtaatacataaataagggtttaggtcttcatctgaaggatgtgcttacattcttcatctgtcaatgcatctcctccacatcagaggtggtagatttaggtttgatgtttattatttgctcgagggatatatttctagggttttagataaacttgcttctatctgaaggctctttattctttttctaccggtaatcaattattgcatatgtccatattctgatatcataattgtctt

SEQ ID NO: 2370 - DNA, 1122 bp, Sesamum indicum
ctctcccccctttctctctctagctatattatacatatacgtacgtaaatatctgtatcgctatataaacctcatttactactcgactttttccgaagttttagctttgcgagaaattgttggcaatgagtcggggaaacgatcccaatccatttgacgaggaagagcctgaagtcaatccattttcgaatggtggcgggtcgaagtcacgcattcctaaagttgttgccaatacactgggctttggtcagaaacatgatgccacagtggatattccattagatgccatgaacgatcccaagaaaaagcagaaagagcttgcagcttgggaagcagatttgaacaggagagaaagggagatcaaacggagggaagatgctgttgtcagtgctggtgttcctgtggatgatagaaattggcctccatttttccccatcattcatcatgatatagccaacgaaataccagttcatgctcagaagctgcagtatttggcttttgcaagttggttaggtattgtcctttgccttgtgttcaatgttattgcaatcactgtttgctggataagaggcggtggagtgaagatctttttccttgccattatatatgccctaatggggtgccccctctcgtatgtgctatggtaccggcctttgtatcgtgcaatgaggactgatagtgcgctgaagtttggctggtttttcttgttctatatgctccatattggtttctgcattgttgctgcaattgcacctccaatcgtctttcatgggaaatcattaacgggcatccttgctgccattgatgtgttctctgaccacgttttggttgggatcttttacctgattggatttgcattcttttgcttagaatcactgctgagcttatgggtgctccagaaagtatacgcatttttcaggggaaacaagtgatactagagcacatctggacgtgccgtgcttttcctttggggtgcttgaatatatagatttatttctccttcatttgtgtttatcatttttcagagggttaattcagctgttatacgaagattgtattggacataaaaatacattcttttatgactcatcggttgcttagtaaccagattttttgcttcaa

SEQ ID NO: 2371 - DNA, 1212 bp, Vaccinium corymbosum
ctctctctctcgcccactcagtatttcaaaaaccactctctgcggaaggttttcctgcaaaattgctggtgggtcaccatgaacggccgtaacgatcccaacccatttgacgaagaacaagtcaatcctttttcgaatggcagtgctcctggatcaaagtcccgcattccccaaatggttgctcaaaccctgggtttttggccaaaaaacacgatgcaaatgttgatataccattggattcaatgaatgatggtaataaaaagcagaaggaacttgcaacttgggaagcagatctgaaaaggagggaacgagaaattaagcggagggaagatgctgttgccagtgctggtgtccctgtagatgataggaactggcctccattttttcccattattcatcatgacatagccaatgaaattcctgttcatgctcagaggttgcagtatttggcttttgcaagttggttaggtatagttctttgccttgtatttaatgttgtcgctgtgacagtttgttggattagaggcggaggtgtaaaaatctttttcctggcaacaatctatgctctacttggatgccctttatcatatgtcctatggtataggccactttatcgtgcaatgaggacggacagtgcattgaagtttggctggtttttcctgttctacatgctccaccttattttttgcatatttgctgctattgctccacctatcgtttttctacgggcagtcattgacgggaattcttgctgcagttaatgccttttctgacgatgttttggtgggggttttctacttgatcggatttggcttgttttgcttggagtcacttttaagcttgtgggttcttcagaaagtttacatgtacttccgtggtaacaagtgaagtgatgcatgaatctgggccacgttcccgttcagatgtttggcgttaccggttgttgagctcctcatcatattccttccatcccccattgccatcctttcatcacttgggcagttgatgccttcgagagagtgattgacgtggtatatacatatatgttattttttcatgttacattcgatgcatattttttgttcaaccattgaaagaccttgcgtgttctcatacgttagtcacacttcatgcttactagtttttgttgctttctttcaacacgtatcattcgtacaaaaatgttattgggccgcaattgatcacggtgtt

SEQ ID NO: 2372 - DNA, 1102 bp, Actinidia deliciosa
  misc_feature (521)..(521): n is a, c, g, or t
  misc_feature (638)..(638): n is a, c, g, or t
gctccattttcaatctcgccactctttgaggaaggtttttctgcaaaaattgctgggccgcagaagccatgaatagccggaacgatccgaacccttttgacgaagaagaagtcaatccattttcgaaaggcaattctgctcctggatcaaagtcacgcattcctcaaatggttgctcaaaccctgggttttggccaaaaacatgatgctaccgttgatataccattggatacaatgaatgatggtaagaataaggagaaggaacttgcagcttgggaagcagatctgaaaaggagggaaagagacattaaacgaagggaagatgctgttgccagtgctggtgtgccctcagatgatagaaattggccaccgttctttccaattattcatcatgatatagccaatgaaatccctgttcatgctcagaagttgcaatatttggcttttgcaagttggttaggtatagttctttgccttgtttttaatgttgttgctgtgacagtttgctggattagaggcggnggtgtaaaaatatttttcctggcaataatctatgctctacttggatgtcccctatcctatgtcctatggtataggccactttatcgtgcaatgaggacagacagtgcattgaagttnggttggtttttcatgttctacttgatccacattggattttgcatatttgctgctattgctcctcctattgtctttcacgggaagtcattcacgggcattcttgcagcagttgatgtctttgctgaccatgtgttggtggggattttctacttgatcggttttgccttgttttgcttggagtcacttttaagcttgtgggttcttcagaaaatttacttgtacttccgaggtaacaagtgatgcgtgaatctgggtcgtattccattctgatgttaagtgttactgttttatgagctcctcattgagctagttgattgagtttgagtttgaatgactggttgacatgccatattgtttttttttggggttctgtattctaagaataatttttcccaacctttgaaggacctcatttgttgtcatattgtactgatcaatgcatatcaatggtatgaaaaaaaaaa

SEQ ID NO: 2373 - DNA, 1021 bp, Salvia sclarea
ctactagaccttggctgtcactcaggaaaagtttggcggcgatgaatcggggaaacgatccgaatccgtttgacgaggaagaacctgaagtcaatccatttgcgaatggtggcaagtcaaagtctcgtattcccaaagtggttgcaagtacactcggttttggtcagaaacatgatgccaccgtagatataccattagatactagtactgcgaacgattcaaagaaaaaggagagagaacttgcctcatgggaagcagatttaaataaaagagaaagggacattaaacggagagaagatgctgttaccagtgctggtgttcctgtggatgatagaaactggccaccattttttcccattattcatcatgatatagccaatgaaataccagttcatgctcagaagttacagtatctggcttttgcaagttggttagggattgtaatttgtcttgtattcaatgtcattgcaatcaccatttgctggataaggggtggtggagtcaaaatctttttccttgccataatctatgccctaatggggtgccccatgtcatacgtgctgtggtacaggcctttgtatcgtgctatgagaactgatagtgcattgaagtttgggtggttttttatgttctatatgattcacattggtttttgcattttggctgcaattgcacctccaattgtctttcatggtcaatcattaactggcatccttgcagctgttgatgtcttctctgaccatgtccttgttgggatcttttacctgattgggttcgcattcttttgcttggagtcactgttaagcttatgggtactccagaaagtatatacatatttcaggggacagaaatgatatatggaaaggcatctgaaagttgcaggccttttcggttgagtgcccaagtatatagaggatttatttccctacgtttgatttcctcggtgattcggcaatcatacaacacgcgagatgaacttttgtaatatgaggaaatgtaatctgttatccagtggtgatca

SEQ ID NO: 2374 - DNA, 1159 bp, Valeriana officinalis
taaatacggaacacacaatttctacacaccaaaaccaactctctctaaccgccctctctccgcggaatttaaggtgcgaaattgttgcgcaaaaaatttagtatcatgaatagaagggacgatcctaatccttttgatgaagaagaagtcaatccatttgcgaatgggaaagctgcacctgcgtcaaaatctcgtattcctcaaatggttgcgagttcccttggttttggccagaagcatgatgccacaacggatataccgttagattccatgaatgatcctaagaaaaaggagagagaactttcagattgggaagctgatctcaagagaagggaaagggacatcaagcgtagagaagatgctgtttcaaatgctggtatcccagcagatgataggaattggcctccattttttccaattatccatcatgatatagctaatgagattccagttcatgctcagaggttgcagtatttggctttcgccagctggctaggaatagttctttgcctcgtgtttaacgttgttgctgtaactgtttgttggattagaggcggtggggtgagaatttttttccttgcaataatatatgcactaacaggatgccctctttcatatgttctttggtatagaccactttatcgtgcaatgaggacagatagtgccttgaagtttagctggtttttcttgttttacttgcttcatattggtttttgcataatcgctgctattgctcctccaatcgtctttcggggaaagtcattcacgggtatcctttcagcgatcgatgtattttcagatcatgttttggtcgggatattctatctcattggatttggctttttttgcttagaaacgcttctaagtatatgggttcttcagaaagtctatatgtttttccgagggcataaatgatgcatgaatcctaatgtggcggagctcggtgattatatgtgtgattctgattcagtatattctactctttctccgtacccgaagtacgtttaacttttttttatatgaaatcataaaaacttttgaaggattctaaagattttttctttatgaaatttggtagagcacagttgttgaatttttggaggatatgaaattttcacatttgttctcgtttcagtatttactttttgtttgattgcaa

SEQ ID NO: 2375 - DNA, 1102 bp, Catharanthus roseus
agaaagcattgtgagttttgaagatattttacaggaaacgaggatgaatcggagggacgatccgaatccatttgatgaagagcagccagaagtcaatccatttgcgaatggtggagccgctcctgcatcaaagtcccgttttcctcaaatggttgccagcactctagggtttggtcaaaaacatgatgctactgttgatatacccttggattcaatgaatgattctaagaaaaaagagagagagctagctgattgggaagcagatttgagaaggagggaaagggatatcaaacgcagggaggaagctgttgctggtgctggtattcccacggatgatagaaattggcctcccttttttcccatcattcatcatgacatacccaatgagattcctgctcatgctcagaggttgcagtatttggctttcgctagttggttaggcatcgttctttgccttgtgtttaatgttggtgcagtgactgcttgttggataaggaatggcggtgtaaaaattttcttccttgctataatctatgctcttctgggagttcctctttcctatgttctctggtacaggcccttgtatcgtgcaatgaggactgacagtgctctgaagttcagttggttttttatattctacatgctccatatagctttttgcatattcgctgctattgctccgccagtagtctttcatgggaagtccttgacgggcatccttgcagcaattgatgtcatttctgaccatgtggtcgtggggatcatctacatggtggggtttggcttgttttgcttggagtcgcttctaagcttgtgggtacttcagaaagtgtatgtgtttttccgagggcacaagtgatgctataaaaaggcttgaggttttcttcatctggaggatgtcctaacatccttcatctttcgatgcatctcgtctccaattagaggtggtagttttaggttggactttattattagattgagtgatatatttctaggtatgaattttcttcaatgtgagaggctctttattcttttgtacaagtaatcaccatttatcacatatgctcattctgataaaaacgtacgtgtcttacaagagcca

SEQ ID NO: 2376 - DNA, 1144 bp, Ipomoea nil
ggggaagcaaaatactttccttgcggcgtggtgttaactaaaatacaggagtgtttgtccaactgaaccaccacttctgagttctgagttgttattaatttggcgaaattgttcggagaatctggtcggagaaatcgggacgaccatgaatcggcggaacgaccccaatccttttgacgaagaagagcaagaagtcaatccattttcgaatggcagcactgctgcaggatcaaaatcacgcattcctcaaatggtagctaatactcttggttttggccaaaagcatgatgctactgttgatataccgttggattcaatgaatgatccaaagaagaaagagagggaactggcgaattgggaagccgatttgaaaaggagggaaagggacatcaaacgcagagaagatgctgttactagtgctggtgtgcctgtcaatgataagaactggcctccctttttgccaattatacaccatgatatagccaatgaaataccagctcattctcagaggatgcagtatttggcatttgctagttggttgggcattgttctttgccttacattcaatatcattgcggtgattgtttgttggataaagggtggaggtgtcaaaatctttttcctcgctgtaatatatgccttacttgggtgccccttatcctatgttttgtggtataggcccctctataatgcaatgaggactgacagtgcactcaaatttggttggttttttctgttctacatgcttcatattggattttgcatatttgctgccattgctcctcccgttgtctttcatggaaaatcattaacgggcatccttgctgcaattgatgtattctctgaccatgttcttgttgggatcttctatttggttgggttcggcttattctgcttagaatcattgctaagtttgtcggtgctgcagagagtttacatgcacttccgagggaataagtgatattaaaactgtcgttccaatgatcatccagagaatgtttatggaaacatttttccatgctgcccgattatagagttgtttattagctgccttgggttaggttgaggtgaaaatgactggattcttatatttatttgtaactttgtaatgtttattagtggtaggctttatatgtgcttcctt

SEQ ID NO: 2377 - DNA, 1212 bp, Vinca minor
aagaacagaagccgaatttcactaaaaaggcattgcaattgtggaattgtttttggtgaatttttgaagactatacagtaaaacgaggatgaatcggagagacgatccgaatccgtttgacgaagagcaacctgaagtcaatccatttgcgaatggtggtgctgctcctgcagccaagtcacgttttcctcaaatggttgccagcactctaggttttggtcaaaaacatgatgctaccgttgatataccattggattcaatgaatgatccaaagaaaaaagagaaagagcttgctaattgggaagcggatttgaaaaggagggaacgggatatcaaacgcagggaagaagctgttgctggtgctggtgttcccacggatgataggaattggcctccctttttcccactcattcatcatgacatagccaatgaaattcctgctcatgctcagaagttgcagtatttggctttcgctagttggttaggtatcgttctttgccttgtgttcaatattgttgcagtgaccacttgttggataaagaatggcggtgtcacgattttcttacttgctattatctacgcatttctgggagttcctctttcttatgttctctggtacaggcctttgtatcgtgcaatgaggaccgacagtgctttgaagttcagttggttttttatgttctacttgctccatattgctttttgcatatttgctgctattgctcctccagtagtctttcgtgggaaatcattggcgggcatccttccagcaattgacgtcttctctgaccatgtgctggtggggatcttctacctggttgggtttggcttgttttgcttggaatcgctgctaagcatgtgggtgcttcagaaagtctatatgtttttccgagggaacaagtgatccgatatataggacttccctaacatcatttcccctaaagagtttcttgcaagggccattcttgtattataatggtcgactttggatcgaaatatatattggatgtagttgaatttttatcaaaattgttgaactggtcagatgatcatggtccttccataatagaagtctttttaatttttacgtctcttctcaaagtatcttttttttttccttcaaatttgaaggatgtttttcttggatcactttgatccatattatggaatagagtgagaaatagattggtgtttgagacttaattgtatttt

SEQ ID NO: 2378 - DNA, 1182 bp, Sarracenia psittacina
caaaattttgggggactaaagaagaagaaaccatgaatagtaggaacgatccgaacccttttgacgaggaagaagtcaatccattttcgaatggcactgctggtcctggatcaaagtcacgcattcctcaaatggttgctcaaaccttgggtttcggccaaaagcatgatgcaactgttgatataccattggatacaatgaacgatactaggaaaaaggacaaggatcttgcagcttgggaagcagatttaaaaaggagggaacgagaaattaaaagaagggaagatgctgttgccagtgctggtgtcccgtcagacgataagaactggcctccattttttccaattattcatcatgatatagctaatgaaattccaattcatgcccagaagttgcagtatttggcttttgcgagttggttaggtatagttctctgccttgtatttaatgttgtcgctgtgacagtttgttggattaggggcgagggtgtaaaaatctttttcctggcaacaatctatgctattcttggatgccccctttcatatgttttatggtacaggccactttatcgagcaatgaggacggacagtgcattgaagtttagttggttttttctgttctacttgatccatattgggttttgcatattcgctgctattgccccaccaattgtctttcatgggaagtcattgacgggcatccttgcagcaattgacgtcttttctgaccatgtgttggtggggattttctacttagttggatttgccttgttttgcttggaatcacttttaagcttgtgggttcttcagaaagtttacatgtatttccgaggtaacaagtgaagcaagaatccgggatgattcgtttaagatgttgagctcctaggtacatatattttcatcatttcatgacagaggtggttgagttttgagtttgagaaacggattgattgtcatgccatacagtttttctgttctatatcgtgggttatactgcctcttcttcgcggacattaaagacctcccacgttcttgtattctaaaatcagatatttttttttgaaattggagtgagccaaaatttgatgagcatatttatcttggttacaacttccacaatcatgacgtggttacaaaaaatgaaataaaaaactagagcctttccatatggtgaatgccatag

SEQ ID NO: 2379 - DNA, 1282 bp, Eucalyptus grandis
gagggagtgagataaggacggggggagtgggactttcccccaaacactctgcttcgacagcacatcgtttctcttttcggttcaaattatctctctcttctctctctctctctctctctgtctctgtgtctctgtgcgcgtgcgaaggggacgagctttccggcgctacaatgaatcgccaccacgatcccaaccccttcgacgaggaagaagaggtcaatcccttctcgaagggtactgctccagcatcaaagtcccgccttcctccgcttgcatctgaaccccttggctttggtcagaaacatgatgcaacagtggatatacctctggatacaatgaatgattccaaggaaaaagtgaaagaattagcttcatgggaagcagatctgaaaagaagagagagggaaataaagcggagagaagatgctgtttctaaagctaatgtcccattggatgataagaactggcccccctgctttccaattatacatcacgatatagcaaatgagatacctgtccatgcgcaacggcttcaatatctggcttttgcaagttggttaggtatagttctttgccttactttcaatgtccttgcagtgaccgtatgttggattaggggcgggggtgtcaaaatatttttccttgcgataatctatgcgttgatgggatgcccactgtcctatgtattgtggtacaggcccctataccgtgcaatgaggactgacagtgcattgaactttagttggttcttccttttctatttgctacatgttggcttttgcatatttgctgctattgctccaccaattgtctttcatgggaaatcactcacgggtattctcgctgcaattgacgtgttttctgaccatgtgttggttgggattttctacttggttgggttcgctttattttgcttggagtcactgctgagcatgtgggttcttcagaaaacctacatgtatttcaggggacacaagtgattttcgatcctggtttttcatgactgacttgggttggtcagtcttgccgatggatgttcgagctgctttattatgatgagatatgctttcttttgtaattattgtatccatttacacagtcgtgagtacactctggtattgtaccttccccattgtggggagattcgaatctgccatgcctttttcttcgatgacgtagttgttagtatcccttggctcatcatgcccgcttcttgtatcccttggctcatcatgcctgcttcttgatagtatattaatgattttattactttatatgtccc

SEQ ID NO: 2380 - DNA, 1326 bp, Plantago ovata
gccctgccagcttgctgaacaacgcaatttatcaaaattatcaactcggagtgactttatacgtacgtattacccgcaaatatagtcggcgtgtttgtttacattcattcattttcattctatactatatatctccactatactgccgagattcgaatccatctgctatctttcaggtgagatttgcctgcgaattttcagaacaatttgccccaaatgaatcgccgaaacgatcccaatccctttgacgaggaagaacctgaagtcaatccattcgcgaatggtggaggatcaaagtcacgtatcccacaagctgtagccagtacatttggttttggtcagaaacatgatgcaactgttgatataccattggacaacatgaatgattccagaaagaaagaaaaagagctctcgaactgggaagcagatttgagcaggagagaaagggagataaaacgtcgagaagatgctgttgccaatgctaatgttcccgtggatgatagaaactggcctccgttttttcccattatccatcatgatattgccaatgagatacctgttcatgctcagaggttgcagtatctagcatttgccagttggttaggtatcgtcctctgccttgtgttcaatgtcatagcgatcactgtttgttggataaggggtggtggtgtcaggattttcttccttgccataatatatgctctaatgggatgcccaatttcctatgtgctgtggtacaggcctttgtatcgtgctatgaggactgaaagtgcattgaattttggctggttcttcctattctatatgattcatatcggtttctgtatacttgctgcgattgccccaccaattgtctttcaggggagatccctaacgggcattcttgctgcaattgatgtcttctcagaccatattttagttgggatcttttacctggttggatttggcttgttttgcgtagaaacactgctgagcatctgggttctccagaaagtatatgcttatttcagaggaaacaagtagtggtgaaatgcatttcgggccggagcctttttccttatgagtggcctaagtatatattctgttcaggaatttgtactgctttacgcgatagtaaatttagatgtcatacaatgattgaatttgatacaccgtctccttactcgtaggaacatgttgcgttgttaaataatttgatttttttcttcttcctgaagttcaacattgagtgcaaagacggttgtcattgtacagactctttatcggtttgtgatgcaacttttggacaaaacatactaatccgtactactgtgaagtttttctacc

SEQ ID NO: 2381 - DNA, 1255 bp, Carthamus tinctorius
  misc_feature (1200)..(1200): n is a, c, g, or t
taatctagcaacaaaccacttcattcggtgcaagatttctagtttcaatttccagaaaagagcttaataaatcagccatgaatcatcgtgaagatccgaatccgtttgatgatgaagaagtcaatccattctcgaatggcaatgctgctcctggatcaaaatcccgcattccgcaaatggttgctagtacctttggttttggtcaaaaacatgatgcaactgtagacataccattggactccatgaatgatccgaagaaaaaagagaaagaactttcaaattgggaagcagacttgaaaagaagggaaagggacatcaagcgaagagaagaagccgttgctggtgctggcatccccacagatgatagaaactggcctccgttcttcccgataattcatcatgatataagcaacgagatacctgttcatgctcaaaagttgcagtatttggcgttcgcaagttggttaggcatagttctttgccttacatttaatgctgtagcggtgaccgtctgttggattaagggtggtggtgtcaagatttttttccttgcaacaatttacgctcttcttggagtacccctttcctatgttctatggtacaggccactctaccgtgcaatgaggactgacagtgctttcaaatttggatggtttttcatgttttacttgcttcacctcggcttttgtatatttgctgctatcgctcctccaatcgtttttcatgggaagtcgttaacaggcattcttgctgctgttgatgtcttctctgaccatgtattagtcgggattttctatttagtaggattcggattattttgcttagaatcccttctaagcttctgggtacttcagaaagtttacatgtttttccgggggaacaagtgagatggaagaaaagacggaggtttcgagtcggtgtggtggtatattcttgtatttccctcttcatgctgagattgttatagttagttagaatgattggtgtgttaaattgttcttttagaattggttgtgtttaggcagcagtcttcctaccttttttggttgataattgcatggaaacttttatagagaaaagtacatttttgagcatttgaaaaaagcatagtatatagcagtaggaaattagggaatgtgggaagagagagaagtgcatacatgggatacaaggagaaatggttcataagagcctctagancatgttgtatcatgtgaatctactcccgtaatcacggtttttcgtcttttcgtaa

SEQ ID NO: 2382 - DNA, 1118 bp, Cirsium arvense
aaatagggggagggataagacgtaaatctaacaacaaaccacttgataagctgcaagatttttggtttcaattccaaaaagaggtaaagaaaacagtcatgaatcatcgtgacgatccgaatccttttgatgaagaagtcaatccattctcgaatggcggtgctgctcctggatcaaaatcccgtattccgcaaatggttgctagtacccttgggtttggtcaaaaacatgatgcaactgtagacataccattggactcgatgaatgatccgaagaaaaaagagaaagaactttcaaattgggaagcagacttgaaaagaagggaaagggacattaagcgaagagaagaagctgttactggtgcgggcattcccacagatgatagaaactggcctccattctttccgataattcatcatgatataagcaatgagatacctgttcatgctcaaaagttgcagtatttggcctttgcaagttggttaggcatagttctttgccttacatttaatgttgtagcggtgactgtctgttggattaagggtggtggtgtcaagatttttttccttgcaacaatttatgctcttcttggagtacccctttcctatgttctatggtacaggccactctatcgtgcaatgaggactgacagtgctttcaaattcggatggtttttcatgttttacttgcttcacctcggcttttgtatatttgctgctatcgctcctccaattgtttttcatgggcagtcattaacgggcatccttgctgctgttgatgtcttttctgaccatatattagttgggatattctatttagtaggattcggattattttgcttagaatcgcttctaagcttctgggtaattcagaaagtttacgtctttttccgtggaaacaagtgagagatgcgtttttttggatggatacaagattggaagctttgagtttgtgtggtcgtatattctttctgctgagatagtgagattgttattgttagttagaatgattggtgtgttaaattgttcttttagaatgattgtgtttaggcagcagtcgtttttgtggaaaaggttaataattgcatggaacgttatgatgaaaaaaatacatctttt

SEQ ID NO: 2383 - DNA, 1184 bp, Cirsium arvense
atagtgagagagacgaagcaacgacaacccctctctctacggaacttctttctgcaaaaaattggattaaatttctaaataagaagctgaagatcagtagtcatgaatcgccgtgaagatcccaatccttttgatgaagaagtcaatccattttcgaatggagatgctgctcctggatcaaaatctcgtattcctcagatggttgctagtactcttggttttggtcaaaagcatgatgcaactgttgatataccattggattcaatgaatgatccaaagaaaaaagagaaagaactcacaaactgggaagccgacttgaagagaagagaaaaggacatcaaacgacgagaagaagttgttgctggtgctgccatccccacggatgatagaaactggcctccattttttccgataattcatcatgatatagccaatgagataccagttcatgcacaaaagttgcagtatttggcgtttgcaagttggttaggtctagttctctgccttgtatttaacgtgatagcagtgattgtctgttggatcaaaggcggtggtgtcaagatttttttccttgcaacaatttatgcacttcttggagtacccctttcctatgtattatggtataggccactctatcgcgcaatgaggactgacagtgctttgaaatttggcgggtttttcttgttttacttgctccatcttggcttttgcatatttgctgctatcgctcctccaatagtctttcatgggaagtcattgacgggaatcctagctgcaatcgatgtcttttctgaccatgctttagcagggatcttttatctggtaggatttggattcttttgcttagaatcacttctaagtttctgggtacttcagaaagtttacacgtatttccgtgggaacaagtgagatttttcgacttactttatatcgtccgttggttggttttgtatctatctatctatatgaaacactcatagttgagttagaatgtattggttgcggcttggcttgttacgtggagggtttcaaatttcttgtgagaagatgcatataatgcttgaatcttatgtatgtatgtatgtataattgaaattgattgattataggaacataaaataaaacatatctactcttgcctacatttcgttatttatttatttattattataggttttcttatt

SEQ ID NO: 2384 - DNA, 1248 bp, Cucumis melo
aaattgctcgatcttagggatctgagaattcgccatgaatcgccacaacgatcccaatccgttcgatgaagaagaggtcaatccattctcgaaaggtggtggtgctcctggatcaaagtttcgaatcccgcaaatggtatcagacactcttggctttggacagaagcatgatgctacagtggatatcccactggatacgatgaatgatccgaagaagaaggagagagagcttgctgcctgggaagctgaacttaatcggaaagaaaaggaaatcaaaaagagggaagaagctgtttctaaagctggtgtccctgctgatgatagaaactggcctccatttttccccattattcatcatgatatagctaatgaaataccagtacatgctcagaagttgcagtacttggcttttgctagttggctaggtattgttttgtgcttgttcttcaatgttattgcaataactgtctgctggattagaggcgggggagtcaaaatttttttccttgctgttatatacgcgatacttggaattcctctttcctatgtgctatggtacaggcctctataccgagctatgaggacagatagtgccttgaaatttggttggttcttcatgttttacttgctacatattgcattttgcatttttgctgccattgcgcctcctgttgtgtttcacggacagtcattgacgggtatcttagcagcaattgacgtcttctctgatcatgtcttggttgggatattttaccttattggttttggctttttttgcttggaatcacttcttagtttgtgggtccttcagaaaatctatttgtattttaggggaaacaaatgagtgaagagatcatcaagcaacggttgcgatgttgcagcggaaaaatctttggtttgtcatttcttgtgatggggggtttatagggtagtatggttattgtattttaggatgttgattttttattttaatgagccaagagagagatgtggattctaaaattgatgattgatattattgatgtgatataaatatataattttgtgcgaaaattgctattttattttctgtatgctcattcagatcacacaataatatttgatgtagctttacttattgacaaaatataggttttaatcttgtgctcatacaaacaacagctatgggtgaaattattttctgattttatttggcaaagatgatgtcagcattgtgtaaatttaatgtgaattacacttctgatttct

SEQ ID NO: 2385 - DNA, 1220 bp, Glycine max
gtagctagaaaaagcgataaaagtgcggtctctcaccgcacgcactagcactgtctctcactgaaacttgttcgcacattttcacggatctaactaagttatcgccatgaatcgccaccacgatcccaatcccttcgaagaagaagaagtcaatcctttttcgaatggcactactgctcctgcatcaaagtcacgtattccaccattagcatctgagtcactgggctttggtcaaaggcatgatgctacagttgatattcctttggatactacaaatgactccaagaaaaaaggtcaagagctagcagcttgggaagcagatttaaaacggagagagaaggaaataaaaagaagagaagaggctgtttctagagctggtgttcctgttgatgataagaattggcctccatttttcccaatcattcaccatgatattgccaatgagataccagttcatgctcagaggcttcaatatttggcctttgcaagttggttaggaattgttctttgcctaggttttaatgtagttgctgtgactgtctgttggattagaggcggcggtgttaaaatttttttccttgcggttatatatgctctacttggtgttcccctttcatatgttctttggtacagacccctctatcgtgctatgaggacggacagtgcactgaagtttggttggtttttcatgctctacttgcttcatattggattttgtatctttgctgcaattgcacctcccattgtttttcatggaaaatcattaacgggcatccttgctgcaattgatgtcttctcagaccatgtattggttgggatattctatttgattggatttggcatgttttgcttggaggctcttctaagcttttgggtgcttcagaaaatatacatgtatttccgggggcataagtgagactttctcctcaggattttgctccgggcttctataatgtctgtcacttcacaatgtggctcagcatattctttttgtctatcctcatttttctcttacaatatctgggtgtgatattggtcgtgttctttgtagttaccagtgtttagtttgtactatacagtataatgaattctgtgaagttcagtatctctacttgtgtgtttccctccagtgaaaagaatatttgctttcgattagcagatatatagtgaatttccaatgaactattattttattggtattgcaattgtgatgcgcctcc

SEQ ID NO: 2386 - DNA, 1371 bp, Glycine max
atcaattccaaaactatatcccgcgttacgaacaagccaggtagccagaaaaaagggagagaagtgcggtctctcaccgcacgcactagcactgtctcactctctcacgcacgcatcatctcaaacttcttcgcactttttcacggatctgatctaactaagttctcgccatgaatcgccacaacgatcccaatcctttcgaggaagaagaagtcaatcctttttcgaatggtggtgctgctcctgcatccaaatcacgtattccaccattagcatctcagccactgggctttggtcaaaggcatgatgctacagttgatattcctttggatactacaaatgactccaagaaaagaggtcaagagctagctgcttgggaagcggatttaaaacggaaagagaaggaaataaaaagaagagaagaggctgtttctagagctggtgttcctgttgatgataagaattggcctccaattttcccaatcattcatcatgatattgccaatgagataccggttcatgctcagaggctgcaatatttggcctttgcaagttggttaggaattgttctctgcctagtttttaatgtagttgctgtgactgtctgttggatcagaggcggcggtgttaaaatttttttccttgcggttatatatggtctacttggtgttcccctttcatatgttctttggtacagacccctctatcgtgctatgaggacggatagtgcactgaagtttggttggtttttcatgttctacttgcttcatattggattttgcatctttgctgcaattgcgcctccaattgtttttcatggaaaatcattaacgggcatccttgctgcaattgatgtcttctcagaccatgtattggttgggatattctatttgattggatttggcatgttttgcttggaggctcttctaagcttatgggtgcttcagaaaatatacatgtacttccgggggcataagtgagactgttctcttctggattttgatccgacggcttttataatgtcaatcacttcacaatgtggcttagcatattctttttgtctatcctcattttctcatacaatatcttggtgtgatattggtcttgttctttgtagttaccagggtttagtttgtatcagggtttagtttgtttgtaccatactgtgtaatgaattctgtgaagttcagtatctcttctagagtgtttcgctccagtgaaaagaaaatatgctttcgataagcagacatgtagtggatttccattgaagtattattgtatggtattgcagttgtgatgcgcctcaaaaaagctagtcctctagacaagaaaaaaaaaatacaaaaattcactagcatacgttgtgaatga

SEQ ID NO: 2387 - DNA, 3733 bp, Solanum lycopersicum
ctatgtatcctacgaatccttaccaaaggaaccaagtaccttacaatcctcattattatccccgtttcgaatcaaatcctcatcatcatatgaacattgatccaactagatctactttaccttatgaatcttggccttgtggtggtagcaactataggcatccttatccacctgagtgccacagttgctgtatccataacacttctccgagccagtgtgcgtttagccctccatatccttaccttccaccatctacatatcctgtgatgtatcctactcattatgttcctcatccccattttactatggagcagccccggtacgagtatgaaaagaatatgggcagagatcatcactgttgtggttgttcaaatcataaatgtggcagtaagaaaggagggagtagtgtcaaaatagaagaacatgaccaggacaagggaaacgattgtaacgactcattggttccttttgggttcaataattgtccttatccagttgtgtgcttaccacctgatgacatgaagaatagggagcgcatgaagcctgatggatccaattgtaaagagcaggaggagaatccacaacctttgaagccgcttggtgatttcaggccttcccagcaaccaaatttctggaagttatggccttctcattatgggaacagctcgggatcaccaaaggaaaacggagatttccctgaaaagcaacatcatgatgatgcaatcaggaagcagtttccatttccaataatatggatgccttatagacctgaggaagacagagaggaagttggtaaggagaccgagtctggcctcattgctgagaaggagccaacctccccctcaaaattaaccaaattaatgtcacatgattctgaagacaagagaagcagttctaaagaaaacgaagtgaatagtggaggtgatttccatggaaagggactgaataaagggtctgttgtgaaaaccattcctgtaaagcaagtggagcagaatgagatctttgatggaaaaaaagaggaggcttcccagaggcatgaaagtgatgctaaacagaagaaaatcactcaagaagctgggagaaaacagtcgacttctcctacaaagtcatcgaagttgcctcctgtttgtttaagggttgatccccttcctaggaagaaaagcagtagtggcaattctaggtctcctagtcctcctcgtgggaaagggaaattagtagaatcgcgcagtgacagctccaaacctcccatcaaatcaaatgagaaggagaatgttcaactagacaaatcatcaacaacaagcatgccaagaaaaagcacagaagtggagccaagtaaaagcaaggcaaaagttgttgaagttgcacaagggacagctaaagaagatatacttcatgatcaatgtactgttttccctgatctgaaacgccaggcaaggagcaaaattgctgagggtgatactggtaaagcagcaaataagccaaaagatgaacttgatgcagtagttgcgaaagctcagtccagcaatgaagcacatcagagaggtgaggccagacaagcagtaaatgaagaagtggatgcaggcaataagacgaaacgagaaaagaggagtaaaatgtccaatgatgaggcagctaccaagattcaatcagcataccgaggtttcaccttgcggagatgggagcctctgaagaaattgaagcagttagccaaaatagaggagcagatggctgagcacaaaaggcatattcagactttggagagctcagctgacaatggggtggacaacaaacaaagaactttcctcacagaagtcataatgggtcttctactaaagctcgacactattcaggggttgcatccaactgttagggaatatagaaaatccgtagcgaaggagcttgttagcctgcaggagaagctggatcttctaaactgtaaaaagcaaccagcagaaagtgaacagactgttactgccaaatctagcgaggacacaagcatggcggtggaagacaacccttccttgcagggtggccaggaggtgcagaagttggaaagggatgacgattttgtgaagggggatgaaggaataaagtttgatgcaaagggactttgtgaagagcagactctttgtgcaacagagctgctagccaactctcatgatgtgggcaatgcagtactagagggaaaagaattaaacaaggacgttgaagaggtgatggagggtgttttgggtagcagtgcagtgaagaccggagatggggcatcagtacaacattttgaatctgaagaaaaaacagataagttatttgatgagaacacagcagtagttgagaaattagaagagcgtggagatggtgtggatgagttggaagaacttcctcgaggagtccttgatgaagagaccagcattaaaggttctgctgaaatcagaaaagacacagtagaccttactgcacttacccttgacgaaaaagtctctgatacagcgagtctagagcaccaccacttggaagcattgggtgaaacaccatttattttggggacggagaatatgcacagcagcaatggagtagaggaaaatgcagaaattctggaaagagatgcagcagtaccaattgacattcccaaacgagagaaagaagatgcaaaaccattaagtgaagatgcaaacatatccgatgtggatgacaaggttggtatggagaagaatgaaaaagagcttgatcaaggcggtagtgcatcagatggtttttcaataccatcacaggaagacgcaatcaccacagagcagcctacagatactaccaacgcagaggaatcagaaacagttgaggttctgcaggagaaaatgcaaaatgcagttgacaaagatattgaaatccttgattcaggaaaaccagtagaaaaatcggtggaacctcaactatccactggtaccaatgacgaagctcgagagtaccatattcaagataagcagaaaattggggaggaaaataaggaggtgcaaggtgaggaattgccagttcgtgatgatgctgtcgtctctgaacctaataatgaaggaaaagagcgtaatgtggtggttgagcagcggcttgtggaggagagctttgagatgcaagggaacgaaccagtggctgctgaaccagaaactgccgataatgctgcacatgtgatcgaggaaccagtggatggaactaaagctacggctgctccagcatcagaagctgtaactaccgagacagacctgtcaagggagaaagagcttggtgtagcagatgaccacaacacacatcgatcttgtgatgccgtggaaggtaattctgttgatacttcccattcttttggttcttctacgcctattgaagtacaagttatggatgcaaacaagcttaaagaatggatgaaagtggacatgtccccatcgtcacctactgccagccaagaatcctgtgatagtgatgcgctgtctgagagcgataaaaaacttattgaggagaatgaaaaattaagggagatgatggagaagttaattaaatcagggaatgaacaactgactgccatatccagtctttatggaagagttaaggacctggagaagagattgtctaagaagaagaagctaaaattgaaacgaaatagggtaccagcagctggatcagcctgtgtaaagccattgaatgactcacttagaaacaggtctgtggggttggcaatgtaagaacaaaaagc

SEQ ID NO: 2388 - DNA, 4031 bp, Solanum phureja
aaaaaaaaagattttcagagcagttttacaaagagagaagcgaagtttgagtactgaagaagctgggttggtggagtgatttgtgctggaaattgagttatttggattttgtggaaccgattggacggagcttttattcttccttaattgtaattctatacacacataaaagggaagcttaatttggacctgcatttgaaccaagctatgtatcccatgaatccttaccaacggaaccaagtaccttacaatcctcattattatccccacttcgaatcgaatcctcatcatcatatgaacattgatccaactagatctacattaccttatgaatcttggccttgtggtggtagcagctatgggcatccttatccacctcagtgtcacagttgctgtatccataacaattctccgagccagtgtgcatttagccctccgtatccttaccttccaccacctacatatcctgtgatgtatcctactcattatgttcctcctccacattttagtatggagcagccccgatacgagtatgaaaagaatatgggcagagatcatcactgttgtggttgttcaaatcatcaatgtggtagtaagaaaggaggagggagcagtgtcaaaatagaagaacatggccaggataagaaaaacgaaagtaacgagtcattggttccttttgggttcaagaattgtccttatccagttgtgagcttaccacctgatgacatgaagaatagggagcacatgaagcctaatggatccaattgtaaagaggaggaggagaatccgcaagttgtgaagccgtttggcgatttcaggcccttccagcaaccaaatgtctggaatttatggccttctcattatgggaacagctcagaatcaccaaagcaaacgggagatttacccggaaaacaacaagatgatgattcgatcaggaagcagtttccatttccaataatctggatgccttataagcccgaggaagacggagagagagttggtaaggaaactgagtctggcctcattgctgagaaggagccaacctccccctcaaaattaaccaaaccaatgttacatgattctgaagacaagagaagcagttctaaagaaaatgaagtgattagcggaagtgaaatccgtggaaagggactgaataaagggactgttgtgaaaatcattcctgtaaagcaagtggagcagaatgagatctttgatggaaaaaaagaggaggcttccgagaggcatgaaagtgatgctaaacagaagaaaattgctcaagaaggtggtaagaaacagtccccttctcctacaaagtcatcgaagttgcctcctgtttgtttaagggttgatccccttcctaggaagaaaagcagtaatggcaattctaggtctcctagtcctccttgtgggaaagggaaattagtagaatcgcgcagtgagagctccaaacctcccatccaatcaaatgagaaggagaatgttcaactagacaaatcatcaacaacaagcatgccaaaaaaaagcacagaagtggagccaagtaaaggcaagacaaaagttgttgaggttgcccaagggacatctaaagaagataaacttcaggatcaatgtactgttttctctgatctgaaacgccaggcaaggagccaaactggtgaaggcgatactagtaaagcggcaaataagccaaaagatgaacctgatgcagtagctgcaaaagctcagtccagcaatgaaggacatcacagaggtgaggccagagaagcagccaatgtagatgtgggtgcaggcaatgagatgaaacgagtaaagaggagtcaactgtccgatgataaggcagctaccatgattcagtcggtataccgaggtttcaacgtgcggagatgggagcctctgaagaaattaaagcagatagccaaaatagaggagcagatggctgagatcaaaaaacgtattcaggatttggagagctcagctgacaatggagtcgacaacaaacagagaactattatcacagaaatcataatgagtcttctgctgaaactagacgctattcaggggttgcatccagctgttagggaatatagaaaatccgtagcgaaggagattgttagcctgcaggagaagctggatcttctaaactgtaaaaagcaaccagcagaaagtgaagagacttttactgccaaatctagtgaggatacatgcacggcggtggaagacaacccttccttgcagggccaagaggtgcaaaagttggaaagggatgatgattttactaagggggatgaaggaataaagtttgatgcagaaggactttgtgaagagcagcctctttgtgcaacagagatgctacccgactcccatgatgtaggcaatgcagtactagagggaaaagaagaaaacaaggacgttgaggaggtaatggaaggcgtttcgggcagcagtgcagtgaagacaggagatggagcatcagtaaaaccttttgaatctgaagaaaaaacagataagttgcttgatgagaacacagcagtagttgagaaattagaagagcgtggagatggtgtggatgagttggaagaacttcctcgaggagtccttgatgaagagaccagcattaaaggttctgctgaaatcagaaaagacacagtagaccttactgcacttacccttgacgaaaaagtctctgatacagcgagtctagagcaccaccacttggaagcattgggtgaaacaccatttattttggggacggagaatatgcacagcagcaatggagtagaggaaaatgcagaaattctggaaagagatgcagcagtaccaattgacattcccaaacgagagaaagaagatgcaaaaccattaagtgaagatgcaaacatatccgatgtggatgacaaggttggtatggagaagaatgaaaaagagcttgatcaaggcggtagtgcatcagatggtttttcaataccatcacaggaagacgcaatcaccacagagcagcctacagatactaccaacgcagaggaatcagaaacagttgaggttctgcaggagaaaatgcaaaatgcagttgacaaagatattgaaatccttgattcaggaaaaccagtagaaaaatcggtggaacctcaactatccactggtaccaatgacgaagctcgagagtaccatattcaagataagcagaaaattggggaggaaaataaggaggtgcaaggtgaggaattgccagttcgtgatgatgctgtcgtctctgaacctaataatgaaggaaaagagcgtaatgtggtggttgagcagcggcttgtggaggagagctttgagatgcaagggaacgaaccagtggctgctgaaccagaaactgccgataatgctgcacatgtgatcgaggaaccagtggatggaactaaagctacggctgctccagcatcagaagctgtaactaccgagacagacctgtcaagggagaaagagcttggtgtagcagatgaccacaacacacatcgatcttgtgatgccgtggaaggtaattctgttgatacttcccattcttttggttcttctacgcctattgaagtacaagttatggatgcaaacaagcttaaagaatggatgaaagtggacatgtccccatcgtcacctactgccagccaagaatcctgtgatagtgatgcgctgtctgagagcgataaaaaacttattgaggagaatgaaaaattaagggagatgatggagaagttaattaaatcagggaatgaacaactgactgccatatccagtctttatggaagagttaaggacctggagaagagattgtctaagaagaagaagctaaaattgaaacgaaatagggtaccagcagctggatcagcctgtgtaaagccattgaatgactcacttagaaacaggtctgtggggttggcaatgtaagaacaaaaagcttggtgattcctttgaatggaatagtagtttggttcatgtagtctgtttgtgttccatagtatgctatgtataaataaggctttttctgctca

SEQ ID NO: 2389 - DNA, 4245 bp, Solanum tuberosum
tttcagagcagttttacaaagagagaagcgaagtttgagtactgaagaagctgggttggtggagtgatttgtgctggaaattgagttatttggattttgtggaaccgattggacggagcttttattcttccttaattgtaattctatacacacataaaagggaagcttaatttggacctgcatttgaaccaagctatgtatcccatgaatccttaccaacggaaccaagtaccttacaatcctcattattatccccacttcgaatcgaatcctcatcatcatatgaacattgatccaactagatctacattaccttatgaatcttggccttgtggtggtagcagctatgggcatccttatccacctcagtgtcacagttgctgtatccataacaattctccgagccagtgtgcatttagccctccgtatccttaccttccaccacctacatatcctgtgatgtatcctactcattatgttcctcctccacattttagtatggagcagccccgatacgagtatgaaaagaatatgggcagagatcatcactgttgtggttgttcaaatcatcaatgtggtagtaagaaaggaggagggagcagtgtcaaaatagaagaacatggccaggataagaaaaacgaaagtaacgagtcattggttccttttgggttcaagaattgtccttatccagttgtgagcttaccacctgatgacatgaagaatagggagcacatgaagcctaatggatccaattgtaaagaggaggaggagaatccgcaagttgtgaagccgtttggcgatttcaggcccttccagcaaccaaatgtctggaatttatggccttctcattatgggaacagctcagaatcaccaaagcaaacgggagatttacccggaaaacaacaagatgatgattcgatcaggaagcagtttccatttccaataatctggatgccttataagcccgaggaagacggagagagagttggtaaggaaactgagtctggcctcattgctgagaaggagccaacctccccctcaaaattaaccaaaccaatgttacatgattctgaagacaagagaagcagttctaaagaaaatgaagtgattagcggaagtgaaatccgtggaaagggactgaataaagggactgttgtgaaaatcattcctgtaaagcaagtggagcagaatgagatctttgatagaaaaaaagaggaggcttccgagaggcatgaaagtgatgctaaacagaagaaaattgctcaagaaggtggtaagaaacagtccccttctcctacaaagtcatcgaagttgcctcctgtttgtttaagggttgatccccttcctaggaagaaaagcagtaatggcaattctaggtctcctagtcctccttgtgggaaagggaaattagtagaatcgcgcagtgagagctccaaacctcccatccaatcaaatgagaaggagaatgttcaactagacaaatcatcaacaacaagcatgccaaaaaaaagcacagaagtggagccaagtaaaggcaagacaaaagttgttgaggttgcccaagggacatctaaagaagataaacttcaggatcaatgtactgttttctctgatctgaaacgccaggcaaggagccaaactggtgaaggcgatactagtaaagcggcaaataagccaaaagatgaacctgatgcagtagctgcaaaagctcagtccagcaatgaaggacatcacagaggtgaggccagagaagcagccaatgtagatgtgggtgcaggcaatgagatgaaacgagtaaagaggagtcaactgtccgatgataaggcagctaccatgattcagtcggtataccgaggtttcaacgtgcggagatgggagcctctgaagaaattaaagcagatagccaaaatagaggagcagatggctgagatcaaaaaacgtattcaggatttggagagctcagctgacaatggagtcgacaacaaacagagaactattatcacagaaatcataacgagtcttctgctgaaactagacgctattcaggggttgcatccagctgttagggaatatagaaaatccgtagcgaaggagcttgttagcctgcaggagaagctggatcttctaaactgtaaaaagcaaccagcagaaagtgaagagacttttactgccaaatctagtgaggatacatgcacggcggtggaagacaacccttccttgcagggccaagaggtgcaaaagttggaaagggatgatgattttactaagggggatgaaggaataaagtttgatgcagaaggactttgtgaagagcagcctctttgtgcaacagagatgctacccgactcccatgatgtaggcaatgcagtactagagggaaaagaagaaaacaaggacgttgaggaggtaatggaaggcgtttcgggcagcagtgcagtgaagacaggagatggagcatcagtaaaaccttttgaatctgaagaaaaaacagataagttgcttgatgagaacacagcagtagttgagaaattagaagagcgtggagatggtgtggatgagttggaagaacttcctcgaggagtccttgatgaagagaccagcattaaaggttctgctgaaatcagaaaagacacagtagaccttactgcacttacccttgacgaaaaagtctctgatacagcgagtctagagcaccaccacttggaagcattgggtgaaacaccatttattttggggacggagaatatgcacagcagcaatggagtagaggaaaatgcagaaattctggaaagagatgcagcagtaccaattgacattcccaaacgagagaaagaagatgcaaaaccattaagtgaagatgcaaacatatccgatgtggatgacaaggttggtatggagaagaatgaaaaagagcttgatcaaggcggtagtgcatcagatggtttttcaataccatcacaggcagacgcaatcaccacagagcagcctacagatactaccaacgcagaggaatcagaaacagttgaggttctgcaggagaaaatgcaaaatgcagttgacaaagatattgaaatccttgattcaggaaaaccagtagaaaaatcggtggaacctcaactatccactggtaccaatgacgaagctcaagagtaccatattcaagataagcagaaaattggggaggaaaataaggaggtgcaaggtgaggaattgccagtttgtgatgatgctgtcgtctctgaacctaataatgaaggaaaagagcgtaatgtggtggttgagcagcggcttgtggaggagagctttgagatgcaagggaacgaaccagcggctgctgaaccagaaactgccgataatgctgcacatgtgatcgaggaaccagtggatggaagtaaagctacggctgctccagcatcagaagctgtaactaccgagacagacctgtcaagggagaaagagcttggtgtagcagatgaccacaacacacatcgatcttgtgatgccgtggaaggtaattctgttgatacttcccattcttttggttcttctacgcctattgaagtacaagttatggatgcaaacaagcttaaagaatggatgaaagtggacatgtccccatcgtcacctactgccagccaagaatcctgtgatagtgatgcgctgtctgagagcgataaaaaacttatagaggagaatgaaaaattaagggagatgatggagaagttaattaaatcagggaatgaacaactgactgccatatccagtctttatggaagagttaaggacctggagaagagattgtctaagaagaagaagctaaaattgaaacgaaatagggtaccagcagctggatcagcctgtgtaaagccattgaatgactcacttagaaacaggtctgtggggttggcaatgtaagaacaaaaagcttggtgattcctttgaatggaatagtagtttggttcatgtagtctgtttgtgttccatagtatgctatgtataaataaggctttttctgctcagttgttgttccttttggttttggttcttatgcaatagcgactttaaagttgcttgtttggcactgaggcgtgacaatagcgacttcaaagttacttgtttggcactgaggcgtgacaatatcgacttcaaagttacttgtttggtattgaggcgtgacagtagtttttcatgttttaaattccacgtttaaatggttaatagatgatcacccttttcaaacaaaaa

SEQ ID NO: 2390 - DNA, 2105 bp, Solanum phureja
gagagagagagagagaaagagtatcaaggggaaagaagggtctgaagaaatcaccgattctctaggagaagaagaagccaatagaaaaaaatgggtacgcttcaaacttggaggaaagcttatggagctctcaaagaccatacaactgttggccttgcccatgttaatagcgatttcaaggatgtggatgtggcgatcgttaaagctaccaatcatgttgagtgcccaccaaaagacagacatcttagaaaaattttggtttatacatcagcgatgcgacctcgtgctgatgttgcgtactgcatacatgcacttgcgaggcgattggcgaagacacataattggacggtagcgctgaagacgttgatagtaatccacagaacattgagggaaggtgatccgacatttagagaggaactattgaatttccaacagagaggacacgttctccaaatgtccaatttcaaggatgattcaagtccaattgcttgggactgctctgcctgggtacgaacatatgcactctttctggaagaacgacttgaatgctttagggttctgaagtatgatattgaaggagagcgccttcctaaacctgcccaagggcaagaaaagggatacagcagaactagggagttgcccagtgaggaacttttggagcagttgcctgctttgcagcagttgctgtatcgtctaattggatgtcggcctgagggagtagcacttggaaattatgtgatacaatatgcccttgctctggtcctcaaggagagcttcaaaatctattgtgctataaatgatggaataattaatcttattgacaagttttttgacatgccaagacatgaagctattaaggcccttgatatctacaaacgagctggccaacaggccatgaacctgtctgacttttatggggtatgcaaaggattggaacttgccaggaactttcagtttcctgttttgagagagcctcctcagtccttccttgtgaccatggaagagtatataaaagaagcacccaggattgtctctgtgccaatagaaactctggattatccggagaggcttatgcttacgtataaacaagaggatgaaccttcagcttctgaagatgctcaagattcagccaatgaaaccccacctcctctgcctttagatgatgctgttgtttcaaccaccgagactccttccccgccaatgcctccacctccaagcagcttggaatctgatgatttactggggctaaatgcaccaactggttatgcatcagcaattgaggacagcaatgctttggctttggcgatagttccatctgggacaacgccatttgactcaaatcctgctcagccaaaagattttgatcctactggatgggagcttgccctggtcactactcccagcagcgacttatctgcagctcaggagagacaattggctggtggaatggactccctcacactgaatagtttgtatgatgaaggagcatatagagcatctcaacgaccagtatatggagcaccagcccctaatccatttgaagttgctgatccatttgccatgtctaccaccatggctccccctccatcagtgcaaatggctgcggtgcctcaacatcaaatgaatccttttggaccattcgaacctgcctatccacaacctcaaaatccaatgatgaatccccacaatccttttggtgatgcagggttcagtgcttttcctaccaatcatgttgctcatccacaaacaaccaatccttttgggagcaccggcctgatataatagaagttgtgcatccacacgacatatcaaagtcttggcagttcagtgtatcgcctgtcaatcatgttgctttcccacaaacaatcaatcctttcgcggagcactgggttgctatattcaaaagttgcacatacatgagttgtagcagacttggcatagtcgattttgttagtgaatctgcggttgtgtaaatcattcacgtgatatagttttcgaaagcagtctatatgtttgcttttaagatgtaaagatggttataatggagattcaactttttttcagttgattgaaatcactccctctatgttatggacttaatagat

SEQ ID NO: 2391 - DNA, 2024 bp, Sesamum indicum
acgcttcagacatggagaaaagcgtacggtgctctcaaagaccacactagagtcggccttgcccatgtcaattccgatttcaaggatgtggatgtggcaatcgttaaggctacgaatcatgtggagtgcccacccaaagagagacatctcagaaaaattttggttgcgacatcagcaatgcggcctcgggctgatgttgcatactgcatacatgcacttgcaagacgattggcaaagacacataattggacggttgcattgaaaactctaatagttatccatagagctttgagagaaggtgatcctacgtttagggaggaactgttgaacttccagcagaggggacgcgtgctccaaatgtcgaatttcaaggacgattctagccctattgcttgggattgctctgcctgggtccgaacatatgcactcttcttggaagaacgactggaatgctttaggatacttaagtatgatattgaagccgagcgtcttcctagacctgcacaaggccaagacaagggttacagtagaactagagacttggacagtgaagaacttttagatcagttgcccgcattgcagcagttgctatatcgtcttattggatgtcggcccgaaggagctgctgtgggcaattatgtaattcagtatgctctagcattggtgctgaaagagagcttcaaaatatactgtgcaataaatgatggaatcatcaatcttgttgacaagttttttgagatgccaagacatgaagccattaaagccctcgatatctataaaagagctggccagcaggcaaatagtctttctgatttctatgaagtatgcaaaggacttgaacttgctagaaatttccagttccctgtgttgagagagcctccacagtcctttctagtgaccatggaagagtatataagagaagcaccaaggatggtttctgttccaagtgtggccttggaatacccagaaaggctgatgctgacctataaggaagaggatgttcctccaccttctgaagagacaaaaatcgtgtccgaggaacccagtccaccacaatccgatgaagttgccatctcaactgctgagacagctcctcctgttccccctcctccaaccaacttggacacggatgatctgctgggtttgaatgtgactacacaagatgcatctgccattgaggaaacaaatgcgttggctttagccatagttccatctggcactacaccatttgactctgatgctccccaagtgaaagatttcgaccccactgggtgggaacttgccctggttactacgcccagtaccaatttatcatcagtgcaggaaagacaattggcgggtgggctggattcacttactctgaacagtttatatgacgaaggcgcatatagagcatcccaacagccagtatatggagcacctgccccaaatccatttgaagtcagcgacccgtttgctatttctaacaacgttcctcctcctcctaccgttcaaatggctgcaatgacacaaccacaaaacaacccatttgctccgtttcagcctgcttatccaccaccccagcagcagcaacatttactgatgagcccacaaaatccttttggtgatgctgggtttggagcattccctgctgcccctgctgctcacccgcaaactaccaatccgttcgggagcaccagccttctataatgaagatgcacatatacagatatgtaatttactcggccgtagttgattttggtgtattcgatacgagtgccagtgtgaagtgtagtccatccacaaagggagttggttttttgagctctgagtgatacctttgtcttgagtggagttgtatagctattcatcagtgctaagaaaatgtaatacttgttgatatgatgcttcttcattaacgtttcctgttatcactatttcttaaagccagatttataagtaaaaaatatgtatattaggattaagaagacatttacagaaattcatgagtggatatgtcttaattcttttaggtttatgtgcgg

SEQ ID NO: 2392 - DNA, 1439 bp, Solanum phureja
atcaacaaacaaacagcaatcttctcaaaaaacaatctttttttttcaacactttactagcttcttttttctaatcttaaatctctcaaaaaacactcatttctaagttaccaaaaaaaatggcacctaatgtttttggtcttgcaactaaggctactggtttggctaaggcaaaaagtttgccaagccgtgcctatgttacgttcttagctggaaatggtgattactggaaaggcgttgttggtttggttaagggattgcgaaaggcgaaatccgcttatccacttgttgtggcttgtttgcctgacgtcccggaggaacatcgacgtatactcattaaccaaggttgcatcgttcgagagatcgaacctgtttatcctcctgagaatcaaactcaatttgctatggcttattatgttatcaactattccaaactccgtatttgggagtttgtggagtatagcaagatgatatacttggatggtgatattcaggtgtttgataacatagaccacttgtttgacttgccagatggctatttttatgcagtgatggattgtttctgtgagaaaacttggagtcacaccccacaatataaagttgggtactgtcaacagtgtcctgataaggtccagtggactcaagacttgggccctaagccatcactctatttcaatgctggcatgtttgtctatgagccaaatctctccacttatgatgatctcttgaaaacggtcaaagttacacctcctaccccatttgctgaacaggattttttgaacatgtatttcagagatgtatacaagccaattccaaacaattacaacttagttttagctatgttgtggcgtcaccctgagaatgtggatcttgagaaagtgaaagttgttcactactgtgcggcggggtctaagccatggaggtacactggaaaggaagagaacatggacagagaagacattaagatgctaataaaaaaatggtgggatatttatgatgacgtatcattggattacaagaattccaacgttgttatgactgccgttgatggtgaagttgaagctgagaaatttatggcagcgttatcagaggctggtgttgtgcactacataactgctccatcggcggcttagaatattatagctttcaaattgttttatagttttttttctaaaaaaaaaaaaaacctttgggatatatagtcttaaagcaaattatactagctttacagagtgcttttttttttttttttttatttacaaaaagattagagattgtctgtatataataggggagcaggcaatttcagttcttctataagtttcgagtgattttttttttgttttgtttgtggatattggaagagtacagaaatgaaaaaagtacgtatttatgttaatactgaatcttgagatacgtatttatgttgtggcttgagt

SEQ ID NO: 2393 - DNA, 1404 bp, Solanum tuberosum
aaacaatctttttttttttcaacactttactagcttcttttttctaatcttaaatctctcaaaaaacactcatttctaagttaccaaaaaaaatggcacctaatgtttttggtcttgcaactaaggctactggtttggctaaggcaaaaagtttgccaagccgtgcctatgttacgttcttagctggaaatggtgattactggaaaggcgttgttggtttggttaagggattgcgaaaggcgaaatccgcttatccacttgttgtggcttgtttgcctgacgtcccggaggaacatcgacgtatactcattaaccaaggttgcatcgttcgagagatcgaacctgtttatcctcctgagaatcaaactcaatttgctatggcttattatgttatcaactattccaaactccgtatttgggagtttgtggagtatagcaagatgatatacttggatggtgatattcaggtgtttgataacatagaccacttgtttgacttgccagatggctatttttatgcagtgatggattgtttctgtgagaaaacttggagtcacaccccacaatataaagttgggtactgtcaacagtgtcctgataaggtccagtggactcaagacttgggccctaagccatcactctatttcaatgctggcatgtttgtctatgagccaaatctctccacttatgatgatctcttgaaaaccgtcaaagttacacctcctaccccatttgctgaacaggattttttgaacatgtatttcagagatgtatacaagccaattccgaaccattacaacttagttttagctatgttgtggcgtcaccctgagaatgttgatcttgagaaagtaaaagttgttcactactgtgcggcggggtcgaagccatggaggtacactggaaaggaagagaacatggacagagaagacattaagatgctaataaaaaaatggtgggatatttacgatgacgtgtcattggattacaagaattccaacgtggtgactgccattgatggcgaagttgaagctgagaaatttatggcagcgttatcagaggctggtgctgtgaactacataactgctccatcggccgcttagaatattatagctttcaaattgttttatggagtagttttttttctaaaaaaaaaaagctttgggatatatagtcttaaagcaaattatacagctttacagagtgcttttgttattttttatttacaaaaagattagagattgtctgtatataataggggagcaggcaatttcagttcttctataagtttcgagtgttttttttgtttttgtttgtggatattggaagagtacagaaatgaaaaaagtacgtatttaagttaatactgaatcttgagatacgtatttatgttgtggcttgagt

SEQ ID NO: 2394 - DNA, 1375 bp, Capsicum annuum
cttaacacacatagaaacaatcttttctttaaaacttccaaagcgctagctagcttgttttttctcatcttaaaatcactcaaagaagactcattcctaagtgacagtaatggcacctaatgtttttggtcttgcaaataaggcaactggtttggccaagacaaaaagtttgtctagccgtgcctatgtgacgtttttagctggaaacggtgattactggcaaggtgtagttggcttggttaagggattgcgtaaggcaaaatctgcttacccacttgttgtggcttgtttgcctgacgtccctgaggaacatcgacgtatactcatcaaccaaggttgtattgttcgagagatcgagccagtttatcccccggagaaccaaactcaatttgctatggcttattatgtcatcaactattccaaactccgtatatgggagtttgtggagtatagcaagatgatatacttggatggagatatccaggtgtttgataacatagaccacctttttgacttgccagatggttatttctatgcggtgatggattgtttctgtgagaaaacatggagtcacactccacaatacaaggttggatactgccaacagtgcccagataaggtccagtggactcaagacttgggccctaagccatcactctatttcaatgctggcatgtttgtctatgagccaagtctctccacttatgatgatctcttgaagaccctcaaagttacccctcctaccccatttgctgagcaggatttcttgaacatgtatttcagagatgtatacaagccaattccaaacaattacaacttagtattagctatgttgtggcgtcaccctgagaatgttgatcttgacaaggtaaaagttgttcactactgtgcagcggggtcaaaaccatggaggtacactggcaaagaagagaacatggacagagaagacattaagatgctaatcaaaaaatggtgggatatttacaatgacataacactagattacaagaatgccaacgtgactcctgttgttgatgaccaagttgaagctaacaaattaatgacagcgatatcagagcctgatgttctgcactacataactgctccatctgccgcttagaatactgctttcaaattgtttttttttttctttctgatttgactttgggatatatagaaatcctaaagcaaattatactactactagccttacagagtgctttgaattttcttagattacaaaagattagagattgtctgtggaataggggagcaggcagtttcagttctactacaagtttcgagtgttgtatttcttttccatgttcttttgttctgtggatattgaaagagtacataaatggaagtacgtgtt

SEQ ID NO: 2395 - DNA, 1584 bp, Petunia hybrida
tacgcggggactcaaactcatcaacaaacatcagagtatacattctcttcttagcgcacacaaaaaacaatcttttaatttgttcaaaacttccaagagtttcttctattttcatcttaaatctcacaaagaacactaatttttaagttcaaaatatggctcctaccgttgtgaatggtcttgcaagaaaggctagtactggtttagccaaggcagcaagtttgtcaagccgtgcctatgtaacatttttggcaggaaacggtgactatgtgaaaggtgtagttggtttggctaagggacttagaaaggcaaaatcagcttatccacttgttgttgctattttgcctgatgttccagaggaacatcgacgtatacttgtcaaccaaggttgcatcgtccgagagatcgagccagtttatcctcctgagaatcaaactcaatttgctatggcttattatgtcatcaactattccaaactccgtatttgggagtttgtggagtatagcaagatgatatacttggacggtgatatccaggtgtttgacaatatagaccacctctttgacttgccagatggctatttctatgcggtgatggactgtttctgtgagaaaacttggagtcacactccacaatacaaggttggatactgccaacagtgccccgataaggtccagtggactgaagagttgggccctaagccaccactctactttaatgctggcatgtttgtctatgagccaagtctctcaatttatgatgatctcttgaaaaccctcaaagtaacccctcctactccttttgctgagcaggatttcttgaacatgttcttcagagatgtatacaagccaataccaaacaattacaacttggtattagctatgttatggcgtcatcccgagaatgtggatcttaacaaggtgaaagttgttcactattgtgcggcgggttctaagccatggaggtacactggcgaggaagagaacatggacagagaagacattaagctgctggtgaacaaatggtgggatatatacaacgatgagtcattggactacaagaatgtcaatgtgaccgcagttgacgacgaagctgaagctaataaattcatggcagcacttacgaagggtggtgttgtgcactatataactgccccatcagctgcttagagtattgtgttgcagttctcttagtagtactatttatttttttttctgatttaaatttgggacgtatagggtctaaagaaaattatactatagctttacagagtgcttttatttgtctgtaaaataggggaacaggttatttgaggttcttctacagactagtgaactttgagttttttttttttttaatttctttttttaaacttcttttgtattgtggctaatgaaaaataaccccggcgccaacccccctaagggcaatttctttaaacccggcaggacaatcccctttatggagggtaatttcgaacctgggcgaatcctgggcctaaccggttcccgggggaaatttgtaacccccccacatttccccccaccttacaacccgaaaccttaaatggaaagcccggggggg

SEQ ID NO: 2396 - DNA, 1382 bp, Aquilegia formosa
caacaacaacaacaacaagctttcttattttgctctcactagctttcaaactttcttcttcttcttttagcttcaagaaacttttttaaacatggcacctaacatcatttcaactgcaactaagactgttggtttcacaaaacaagcgagtataccaagcagagcttttgtaacgtttttggctggtaatggagattatgtgaaaggtgtagttggtttagccaaagggttaagaaaagtgaaatctgcttacccacttgttgtcgcaatcttgcctgacgttccagaagaacatcgtcggattcttgaatctcagggatgtattgttcgtgaaattgaacctgtttatccaccagaaaaccaaactcagtttgctatggcttattacgtcattaactactccaaattacgtatttgggagtttgtggagtatagcaagatgatatacttagatggtgatattcaagtgtttgaaaacattgatcatctttttgatcttcctaacgggtatttttatgctgttatggattgtttctgtgagaaaacatggagtcatactcctcagtataaacttgggtattgccaacagtgtccaaacaaggtgcagtggcctgccgagatgggccaacccccatcactctatttcaatgcaggcatgtttgtgtatgagccaagtttatcaacttatgatgatctattgaagcaagtcaaaaccacccctcctacaccttttgctgaacaagactttttgaacatgttctttaaggatatttacaagcctatccctttggtgtacaacctcgtattagctatgttatggcgccacccagaaaatgtagaactggagaaagtgaaagtggttcattattgtgctgcgggatcaaagccatggaggtatacagggaaggaagaaaacatggacagagaagatataaagatgttagtgaagaaatggtgggacatttacgatgacgcttcacttgattacaagaggagtgttgctccttcaattccagagactggtgaaaaccttcaaccatttctggctgctttatctgaagctggagtggttcactatgttactgctccatcggccgcatgatgcatggaccatctgctgtgctgattgctgagtgtgtgtgtgaagttataatgcagtattaatgtaatagaatagaaattgtatacaggcagatggtctcaaatttctgttttcgtttgttagatttgcgacttggaattggccgtatatgtggctgtttcaaagagatgcaaggcactctagctgtcaatatatatttatacctaatgtaaatggattttgcttgtttattcttttgagcatgagattgattagtaatcctatccaacgcttgaatctt

SEQ ID NO: 2397 - DNA, 1125 bp, Catharanthus roseus
cttagacagaaagaagaaaaaagaatggctcctgaaatcgttagtagtaaagccggcaccacaggtctagttaaggcagctagtttgcctagccgtgcttacgtcacattcttagcaggaaacggtgactacgttaagggtgttgtcggtttagccaaaggtttgagaaaagtgaaaactgcttatccacttgtggtggcagttttgcctgacgtgccggaggagcaccgccgtatattggttagccaaggctgtattgttcgtgaaattgagcctgtttatccaccggaaaaccagactcaatttgccatggcgtattatgttattaactactccaaacttcgtatatgggagtttgtggagtacagcaagatgatatacttggatggagatatacaagtgtatgagaacatagatcatctatttgacttggctgatgggtatttctatgctgtgatggattgcttttgtgagaagacatggagtcacactccacaatacaaaatcggttattgccaacaatgtcctaacaaagtacaatggcctgaacaagaattgggtcctaaaccccctctttacttcaatgctggcatgtttgtttttgagcctagcctccctacttatgatgatctcttggctactctcaaaattacccctcctaccccttttgctgagcaggatttcttgaacatgttctttagggacatatacaagccaatcccaaacatttacaacttggttttagccatgttatggcgccatccggagaatgtgaacctcgaaaaggttaaggttgtccattactgcgccgccggctcaaaaccgtggaggtataccggcgaggagctaaatatggacagagaagacatcaagatgctagtgaagaaatggtgggacatttacaatgatgagtcccttgattacaagaggtgtatcaatgcggcggtggcagtggcggctcatgaaggcaaagccggtggactgaaaccggtgccggctggtgttgttaagtacatcaccgccccatctgccgcttgatttcgccgtcggctgttagggatttcataattaatacatatatatagtttggagttgtatagggaatatatattatatatttaagtt

SEQ ID NO: 2398 - DNA, 1295 bp, Tabernaemontana elegans
atcaaactcatccaacaatttgaaagcaattcgtggatttttgcaagaaaaaccaagtttctcaaaactttccaactttcttctcgagactcaaatctctcagaccctttttgattcttgatatcatttccttcaaaagaacccagagaaaaatggctcctgaacttgttagtagtgctgcacccaccggtcttgttaaggctgctagtttgtctagccgtgcttacgttacgtttttggctggcaacggtgactatgttaagggtgtggttggtttggccaaggggttgaggaaggcgagaactgcgtatccactggtggtggcagttttgcctgacgtgccggaggagcaccgccgtatactggtgaaccagggctgtatagttcgtgagatcgagcctgtttatccacctgaaaaccagactcagtttgccatggcgtactatgttatcaactattccaaacttcgtatctgggagtttgtggaatacagcaagatgatttaccttgatggtgacatccaagtatttgagaacatagatcatctctttgatttgcctgacggcaacttctatgctgtgatggactgcttctgtgagaaatcatggagtcactccccacagtaccagattggttactgtcaacagtgtcccaacaaggtccagtggcctgaggagttgggtcctaagccctcactttactttaatgccggcatgttcgtgtttgagccaagtcttcccacctatgatgatctcttaagtaccgtcaagatcaccactcctaccttatttgccgagcaggatttcttgaacatgttctttagggacatttacaagccaattccaaatgtctacaacttggtcctagccatgctatggcgccatccggagaatgttgagcttgaaaaggtaaaggttgtccactactgtgctgctggctcgaagccatggaggtacaccggcgaggagcagaacatggacagagaagacatcaagatgctggtgaagaaatggtgggacatttacaatgatgagacactcgactacaagagacatatcaatgctggagcggccactaatcaagccgaaacgggaggaatgaaggcggtgatgtcgaaggctggtgtggttaagtacatcaccgccccatctgcagcttaatttggccgtcacggcgtcaccgatttgataatggactggtgtgtttaagtatatcactcctcgcacctcatttgatgaacaggattttctgaaccattttcttcctaagaaaaatgccagtccattcctccattg

SEQ ID NO: 2399 - DNA, 1154 bp, Euonymus alatus
accaaaccatctttcaacacaaaaagagccaaactttattgcaaaaaatggctcctgatctcagtaccaataccacaaccaacttaaccaagacggctagcatatctagctgtgcatatgtgactttcttggcagggaatggtgactacgtgaagggagtggttgggctggccaagggtttgagaaaggccaagagcaagtacccacttgtggtggccatcttgcctgatgtcccggaggagcacaggaagatactggtggatcagggatgcatagtcaaggagatcgagccggtttaccctccccagaaccagacccagttcgctatggcttattatgtcattaactactccaagcttcgtatttgggagtttgtggagtatagtaagatgatctatttggatggagacattcaagtgtttgagaacatagaccatctctttgacatgcaagatggctacttttatgccgtgatggactgtttctgtgagaaaacttggagccacactcctcagtacaagattgggtactgccagcagtgccctaacaaggtccaatggcctgaggagttgggccctaagcctcctctctatttcaatgctggcatgtttgtctatgagcccagtttgtccctctatgatgacctcttgaagactgtcaaagttacccctcctactccctttgctgagcaggacttcttgaatatgtacttcagagacatatacaggccaatcccaccaatttacaatcttgttcttgctatgctatggcgccaccctgagaacattgagcttcacaaagtcaaagttgtgcactactgtgctgctgggtctaagccatggagattcacggggaaagaagagaacatggagagggaagacataaagatgttggtgaagaaatgggaggacatatacaacgatgagtccctggactacaagaacgtagttgctcgtggtgcagttgaaccagttgattcagagcaggttaggctccatcccttcttggctgcactatcggaggctggtgttgtccactacaaaagtgccccatcggctgcgtagttctctggtctctttcaaagcttgatcgacatcctaatgtggaggacttcatatgtgtaatctaagtcttcatattggagattgttttgg

SEQ ID NO: 2400 - DNA, 1383 bp, Populus trichocarpa
aaccataacctttcaaagatcaaagcaatacagtttgtgcaacctgaaattctctcttcttttcttagtaaacaaacaacttgtttcaaaaccttttgatttctctaaccaaaaacaactaaaaagttttgcacatcacttttttttactactttgataccatggctcctgatattactgctactcttgctaacaacaccaactcccttgtcaagcaagctagcatttcaagttgtgcatatgttacgtttttggctggtgatggagactactggaaaggtgttgtagggttagccaaggggttgaggaaggcaaagtgcaactaccctttggtggtagctatcttgcctgacgttcctgaggagcaccggaagatacttgcctctcaagggtgcatagtgagggagattgagcctgttaacccaccggagaaccagacccagtttgctatggcttattatgtcatcaactactccaagcttcgtatatgggagtttgtggagtatagcaagatgatatatttggatggtgacatccaagtgtttgatagcatagaccacctctttgacatgcctgatggctacttctatgctgcgatggactgcttctgtgagaaaacatggagcaatagcccccagtacaagattggttactgccaacagtgtcccgataaggtccattggcctgctgagatgggtcctaagcctcctctctacttcaacgctggcatgtttgtttatgagcccaacttgtctacatatcatgacctcctggagaccctcaaagtcacccctcctaccctctttgctgagcaggatttcttgaacatgtttttcagggatgtttataagccaattccttcagattacaaccttgtgttggccttgttatggcgccatcctgagaacatcaaccttgacaaagtcaaagttgttcactattgtgctgctgggtccaagccatggaggtacacaggaaaagaagataacatggacagagaagacatcaagatgctggttaacaaatggtgggacatttaccacgacgagtccttggactacaagaatactgtggtggctgctgctggagctgaactgcaaccattcttggcggcgctatcagaagctggtattgctcactacattaccgccccatctgccgcttaaagctggtgattgtggagctagtagccttctaaagtggtcaaattgtagaggaaaaacaaagtcttttttagcttctttttttgtgacagtttgctggttgttaatatcccctaaattcatgattcatgaagtgggatagtgttcttttgagttttcttccaagtctgggaggaccttttatccctcattttgtaaataaaactattgttctctgtgt

SEQ ID NO: 2401 - DNA, 1578 bp, Populus trichocarpa
gaaaccaaaaacacgaagccaccagaaaaaacagccagctttagtttcttctccatttcgtctctctcaaattctctttcaaacccttctctgtaaccctcattcacctccctctcccgcaaccgcaaccgcaacatggctcctgagcttgtccaggctgctttgaaaccagctgggttcaccaaacctgctagcttacctagccgggcttatgtaacattcttggctggtaatggagattacgtcaaaggtgttgttgggttagccaaaggattaaggaaagtcaaaacggcatacccattaatcgttgcagttttgcctgacgtgccagaggaacacaggcggattttagagtcgcagggttgcatagtccgggaaattgaacccgtttatccaccagagaatcagacccagtttgccatggcttattatgtcatcaactactccaagctccgtatttgggagtttgtggaatacagcaagatgatatacttggatggagatatccaggtttatgacaacatagaccacttatttgatctgcctgatggtcatttctatgcggtgatggattgtttctgtgagaaaacatggagccacactccacagtacaagattggctattgccagcaatgccctgacaaggttaactggcctgctgagatgggtcaaccaccatctctttacttcaatgctggtatgtttgtatttgaacctagtatctccacctaccatgacctcttgaagactctcaaggtcactccgcctacgccattcgcagagcaggacttcttgaacatgtacttcaaggatatttacaagccaattcctctagtatacaatcttgttcttgccatgttatggcgtcacccagaaaacgtggagctagacaaggtcaaagttgttcactactgtgcagcgggctcaaagccatggagatacactggcaaagaagagaacatgcaaagggaggacataaagatgctggtggagaaatggtggggcatttacaatgatgaatcgctggattacatgaaatttgtggcggatggttttgatgctgagccagtgaacttgcagtctttcattgcagctctctctgaagccggtgctgttcagtacgtcactgccccatccgctgcttagagatggaagagagagagagagagagcgagagagagagagagggagggagagcagagcaacaacctatagatttagaaatgatcagggtgaaagagaaatgtcggaatccttttactcttgaaattgggggcggtgatttcttgtctagaaagggaataaacttaattttgatcgatggcggtccttaattatctttttcttggtagttaaatctgttgataatatgtgatgagcgttgtatcatgggtgcatgcacagaggtgcgccattgtaagctactggagcaatggtgaaatgaaaaatgtgcgtgtgattaattactggagcaagagtagtttaatttactcctcttttttttctttttttacgttttgcaatagaactcacatagttttactgcagcgagtaattctcacttttcgtctaaaatta

SEQ ID NO: 2402 - DNA, 1362 bp, Populus trichocarpa
tcactcataaccaaaaccttcgaagatcaaagcagcatacttttctgcaaccttaaactctcttttttttctcttagcaaacaaatttgtttcaaaacccttttgatttctcttaaccaaagactcattttttgatagctttgataccatggctcctcatattacaactacccttgctaacaccaccagctctctagtcaagcaagctagcttgtcgagctgtgcatatgttacctttttggctggtgatggagactactggaagggtgttgtggggttggccaaggggctgaggaaggccaagagcaagtatcctttagtggtggctatcttgcctgatgttcctgaggagcatcggatgatactcgtctctcaagggtgtatagtgagggagattgagcctgttcatccaccggagaaccagactcggtttgctatgccttattatgtcatcaactactccaagcttcgtatctgggagtttgttgagtatagcaagatgatatatttggacggggacatccaggtatttgacaacatagaccacctgttcgacatgcctgatggttacttctatgctgtgatggactgtttctgtgagaaaacatggagcaacagccctcagtacaagattggttactgccaacagtgtcctgataaggtccagtggcctgctgagatgggtcctaagccccctctgtacttcaatgctggcatgtttgtttatgagcccaacttgtccacttatcatgatctgttggagaccgtcaaagtcacctcccccaccctcttcgctgagcaggacttcttgaacatgtttttcagggatgtttacaagccaattccttcggattacaaccttgtactggccatgttatggcgccatcctgagaacattaaccttgacaaagtgaaagttgttcactattgcgctgctgggtctaagccatggaggttcactggaaaagaagagaacatggacagagaagacatcaagatggtggtcaacaaatggtgggacatttaccaggacgaatcattggactacaagaatactgttgctgctgctgctgcttctgctggagctgaactgcatccattcttggcggctctctctgaggctggtgttgtccactatgttaccgccccatccgccgcttagtgcttgtaaattgtggagctactagtttcaatcagtccaattgtagaggaaaaacaacttttctttcagctctttttggtggttaacatcccctatattgttaacagggatgggatattgctcttttgaattttctaggaagtttatgaggaccttgtatccatcctatagtaaataatatgaacaagtattttctttgt

SEQ ID NO: 2403 - DNA, 959 bp, Capsicum annuum
gcacgaggaatttctctacttaacacacatagaaacaatcttttctttaaaacttccaaagcgctagctagcttgttttttctcatcttaaaatcactcaaagaagactcattcctaagtgacagtaatggcacctaatgtttttggtcttgcaaataaggcaactggtttggccaagacaaaaagtttgtctagccgtgcctatgtgacgtttttagctggaaacggtgattactggcaaggtgtagttggcttggttaagggattgcgtaaggcaaaatctgcttacccacttgttgtggcttgtttgcctgacgtccctgaggaacatcgacgtatactcatcaaccaaggttgtattgttcgagagatcgagccagtttatcccccggagaaccaaactcaatttgctatggcttattatgtcatcaactattccaaactccgtatatgggagtttgtggagtatagcaagatgatatacttggatggagatatccaggtgtttgataacatagaccacctttttgacttgccagatggttatttctatgcggtgatggattgtttctgtgagaaaacatggagtcacactccacaatacaaggttggatactgccaacagtgcccagataaggtccagtggactcaagacttgggccctaagccatcactctatttcaatgctggcatgtttgtctatgagccaagtctctccacttatgatgatctcttgaagaccctcaaagttacccctcctaccccatttgctgagcaggatttcttgaacatgtatttcagagatgtatacaagccaattccaaacaattacaacttagtattagctatgttgtggcgtcaccctgagaatgttgatcttgacaaggtaaaagttgttcactactgtgcagcggggtcaaaaccatggaggtacactggcaaagaagagaacatggaca

SEQ ID NO: 2404 - DNA, 925 bp, Solanum phureja
aatgaggataagccttacacagaaaattgtacagttatttctcttcttcggataagccttaaaacacagaaaaattcaagaagctcctaagaaggagagctccaatctccattagagaccaaattcgaactcaaaatcgaattttagtgaatacccaaatggcgatttcatcgtcttcactgtcagcagctctttttccagtgtgtaattcatcttccatttctgctcaacccaagttttctcttctgtctttgccttcaaattctgttaagttacaggttttcaaccaatctcgagtgtcaacaactaaggtttttgcttctcctgaagtcttggatgcccagaatgttgaggctgatgttgaggatattccagctgcttcaacgctgagtattggtggtgactctgataaggcagctccaaagcagaagattaggatcaaattgaggtcatactgggtacccttaatagaagactcttgtaagcaaattatggacgctgcaagaacaacaaatgcaaaaaccgtaggtcctgtaccactgcccaccaaaaagagaatttactgtgtcctcaaatctccacatgttcacaaagatgccaggttccatttcgaaataagaactcatcaacgccttattgacattctttacccgactgcccaaactatcgacaagttaatgctgcttgaccttcctgctggtgttgatgtggaggtcaagctctgagaaaattgcttctcctccttgtttcacatcgtaaccttgtctatctcttgctagtttgcttcttgttttgaattttgtactcatagacacacaatcatttctctgggaaaagtagggtaaacagattttttttttctgtgtaatgatttgattacttgattactaagcatcttttcaatctcatatcattgttaccttac

SEQ ID NO: 2405 - DNA, 916 bp, Solanum tuberosum
cacagaaaattgtacagttatttctcttcttcggataagccttaaaacacagaaaaattcaagaagctcctaagaaggagagctccaatctccattagagaccaaactcgaactcaaaatcgaattttagtgaatacccaaatggcgatttcatcgtcttcactgtcagcagctctttttccagtgtgtaattcatcttccatttctgcacaacccaagttttctcttctgtctttgcctttaaattctgttaagttacaggttttcaaccaatctcgagtgtcaacaactaaggtttttgcttctcctgaagtcttggatgcccagaatgttgaggctgatgttgaggatattccagctgcttcgacactgagtattggtggtgactctgataaggcagctccaaagcagaagattaggatcaaattgaggtcatactgggtacccctaatagaagactcttgtaagcaaattatggacgctgcaagaacgacaaatgcaaagaccgtaggtcctgtaccactgccgaccaaaaagaggatttactgtgtcctcaaatctccacatgttcacaaagatgccaggttccatttcgaaataagaactcatcaacgtcttattgacattctttacccgactgcccaaactatcgacaagttaatgctgcttgaccttcctgctggtgttgatgtggaggtcaagctctgagaaaattgcttctcctccttgtttcacatcgtaaccttgtctatctcttgctagttcgtttcttgttttgaattttgtactcaatagacacacaatcatttctcggggaaaaatagggtaaacagatattttttttctgtgtaatgatttgattacttgattactaagcatcttttcaatctcatatcgttgttaccttaaaaaaaaa

SEQ ID NO: 2406 - DNA, 912 bp, Solanum melongena
atagagaaaaaattgtacagttatttctgtgcttcggataagccttaaaaattccaaaaagctcgtaaggagagcttcaatctccattagtgaccaaaatcgaactccaaatcgaattttagtgaatacccaaatggcgatttcatcttcttcactggcagcagctctctttcctgtgtgtaattcatctcccgtttctgcaaaacccaagttttctgttctttctttgccttcaaattctgttaagttacaggtttttagccagtctcgagtgtcaaaaactaagatatttgcttctcctgaagtcttagatgcccagaatgttgatgctgatgttgaggatattccagctgcttcgaccctgagtgctggtggtgactctgataaggcagcgccaaagcaaaagattaggatcaaattgaggtcatactgggtacccctaatagaagactcttgtaagcaaattatggatgctgcaagaacgacaaatgcaaagctcgtaggtcctgtaccactgccgaccaaaaagaggatttactttgtcctcaaatctccacatgttcacaaagatgccaggttccatttcgaaataagaactcatcaacgacttattgacattctttacccaactgcccaaactatcgacaagttaatgctgctcgaccttcctgctggtgttgatgtggaggtcaagctctgagaaaattgcttctccttctttctgtaacatcataaccttgtctatttcttgctagttcatttctggttttggattttgtactcatagagacttatgcacaatcatttcttggggaaaagtagggtaaacacattttttttctgtgtaatgatttggttacttgattactaaccctcttttcaatctcatatcattgttaccttacaggttag

SEQ ID NO: 2407 - DNA, 744 bp, Capsicum annuum
aggtaaaattatacagttttatactattatttttctcttcttgggataagcctctactgaggaagatttgcaaaatggcaatttcatcgtctgcactgtcaacagcactttttccagtgtgtaattcatcatccatttcagcaaaacccaagatttctcttctttctttgccttcaaattcaactaaatttcaagtttttaatcagtcaagattgttgacaactaaggtttttgcttctcctgaagtgttggagactcaggacgtctctgacgatgttgagaatatcccagctgcctcaacgctgagtgtggacggtgacgctgataaggcggcaccaaagcagaagattaggatcaaattgaggtcatactgggttccgctgatagaggattcttgtaagcaaattatggatgctgcaagaacgacaaatgcaaagaccgtaggtcctgtaccactgcccaccaaaaagagaatttactgtgtcctcaaatctccacatgttcacaaagatgccaggttccatttcgaaatcagaactcaccaacgccttattgacattctttacccgactgcccaaactattgacaagttaatgctacttgaccttcctgctggtgttgatgtggaggtcaagctctgagaaaactgcttctactcattaacgttgtagccttgtctatctcctactagtccgtttcttgttttttgtactcgtagagacttatgcacaatcttttcttggc

SEQ ID NO: 2408 - DNA, 715 bp, Capsicum annuum
tttttctcttcttgggataagcctctactgaggaagatttgcaaaatggcaatttcatcgtctgcactgtcaacagcactttttccagtgtgtaattcatcatccatttcagcaaaacccaagatttctcttctttctttgccttcaaattcaactaaatttcaagtttttaatcagtcaagattgttgacaactaaggtttttgcttctcctgaagtgttggagactcaggacgtctctgacgatgttgagaatatcccagctgcctcaacgctgagtgtggacggtgacgctgataaggcggcaccaaagcagaagattaggatcaaattgaggtcatactgggttccgctgatagaggattcttgtaagcaaattatggatgctgcaagaacgacaaatgcaaagaccgtaggtcctgtaccactgcccaccaaaaagagaatttactgtgtcctcaaatctccacatgttcacaaagatgccaggttccatttcgaaatcagaactcaccaacgccttattgacattctttacccgactgcccaaactattgacaagttaatgctacttgaccttcctgctggtgttgatgtggaggtcaagctctgagaaaactgcttctactcattaacgttgtagccttgtctatctcctactagtccgtttcttgttttttgtactcgtagagacttatgcacaatcttttcttggc

SEQ ID NO: 2409 - DNA, 856 bp, Nicotiana tabacum
ggccattacggccggggtctgcaaaggatattgcaaaattctcgcagctccattccctctacttatcaccgagtaaaagacccaaatggcaatttcatcatcttcactctcagcagctctattcccagtgtgtaattcgtccatcattttatcccaacccaaattctctgttctatctttgccttcaaattccgctaaaaccagaatacacattttcaaccaatcaaaagtgtccacgtcaaaggtttttgcttctccagaagttttggatgccgagaatgtctctgctgatgttgaggatattcctgctgcctcaacgctgagtgttggtgttgacgctgataaggcagcaccaaagcagaagattaggatcaaattgaggtcatattgggtacccttaatagaagactcgtgtaagcaaattatggacgctgcaacaacaacaaatgcaaagaccgttggtcccgtaccattgcctaccaaaaagagaatttactgtgtcctgaaatctccacatgtgcacaaagatgcacggttccattttgaaataagaactcatcaacgccttattgacattctctacccgactgcccaaacaatcgacaaattaatgctgctcgaccttcctgctggcgttgatgttgaggtcaagctctgagaaaatagcttctcctccttgtagcactgtaactctgtttatctcttacaagttcatttccagttttggattttgtaccagtacatgccacaatatttgttggggaaaagtaggtagatgcatatctttttttgtgtattaatttggattgttggattagcaagcacctattcaagctcgtttcatcgttaaaaaaaa

SEQ ID NO: 2410 - DNA, 2029 bp, Solanum phureja
ctgaaattcttggctctcctctttgtttcttcctcatggcctgtggcctagcaagtacatacacaaatgtgtggtctatcaatcttcatattttgcctatttctttttactgtttttttaaaaataaaaataaattctgtccataaactaattgcagaagatgacacaaccatggcgttgtatagctgaaagccacaaaatacttttctagttttatcagtcaccactttgttctgcatttgcattttaatggggttttgaagattttttttttttaaaagatttgaactttaattaacaaatttcaagattcagccatgcaaactatcaaagcttcttccttttcaccatttcacctcaacttgaactcaactagttcatttcccaaaattaccaacttgtacattcaacaaaattatgaaaaccccatttcttgttttccctcaattcagagccaaaatgcaaaattcaaggtttttactgctatttccccaagtgtttcaactgaatcagaaaccccatttgatgaaaggactgaaaatgaaaatcaagaagagaaatttgagtggtatgctgagtggtacccaataatgccaatttgtgatcttgataagaggaggccacatgggaagaaagtgatgggtattgatgtggttgtgtggtgggataagaatgagaaagaatggaaagtaatggatgattcttgtcctcatagatatgctccactttctgaaggaagaattgatcaatggggaagattgcagtgtgtgtatcatggttggtgctttaatggagctggtgattgtaagtttatccctcaagctcctagggatgggcctccggttcatacgtccaaaagagcttgtgcaactgtttatccaagttgtgtgcaaaatgacattctttggttttggccaaactctgatcctctatacaaggacatatatttgacgaaaaggcctccttatatacctgaacttgatgacagttcgttttcgaaaaccttcatagtcagagatatatcatatgggtatgagcttctgattgaaaaccttatggacccagctcatgtccaatattcacactatggcattatgaataattgtttatgcactgtgaaagctgatagagaagggggaagaccacttgacataactgtcacgaagttggatgtaaatgtcattactgcaaaccagggacctggacggaacacatttgttccgccttgtgtgtattatagttattttgctttcggaggacctcagggaaaaacatctgctgtatcatctggaactgtacaggaaaaaccttcagctgagaagcagaaaaaagcacttctagttttcatctgtattccggttagtccaggtcatagcagaattatatttgcatctccaagaaactttgccacttgggcagatcgaataattccacgttggatatttcacctgggacaaaatctaattctggattctgatttgtatcttcttcatgtggaggagcgcaagctaaaggaaattggctcttacaattggcataaagcttgctatgtgccaacaaaggcagatgccattgttgttgcttttagaaggtggctaaacaaatatgcaggtggtcaagttgattggcgtggaaagtacaatggggacctcccgccaactcctccaagggagcagctgctggacaggtattggactcatacagtgaattgcacaagttgcaatcttgcatataaaggtctcaatgctcttgaagttgtactgcagatcgcctccattggtgtgctcggaattgttgctgctgcaaagcagggcacattgtcagtggtggctaggtattctttggtcaccattgcattactatgcttcgtggcctcgagatggttatctcattttatatacaaaaatttccatttccacgattatgatcacgcctttcgttgacacttgagtactatcatatgacttggagctaaatattcactgtataaacaaattacttatagttgaaatttgcagagaagttttct

SEQ ID NO: 2411 - DNA, 1419 bp, Solanum phureja
atgttaaaatatactgataatagtattaaattattatttttacactagtatagtctagagtagtttttttttttggtgtgtgtagcatgcaaatgaagagtattttagtattaaagttttgagagtggatctgaacttgtatctcaaaaattcatagttccaaggccttagtattctctgctttgctcttcaacatgtaaatgatctgccttgtaaatccatggtaattgttggaaaagtagaagtattcgtggtggagaaggtattttccgtaagattttcaagtgttaaaagagtgagaaaatgagatctatagaggataaaggatgtttgaattatggacaaaaacaacaagaggttgtaggaggtagtagtatgaattttgagtttcatggaacaaatcgagcttcgactcatcatagaacagcagcattaggtaaaccaacaccatcaaaatgggatgatgcacaaaaatggttagttaatctatcaagaggagaaaaacatcaatcgaaagccacacctcgaaactcgaatgctgatgatttaaggttgattgcacctgttccaaagaaagaagagtattcgagtgacgatgaaggagattctagtatgattcaatttgaagttgaaacaaagaaagttgattgtgatgaatcaatatggagagtaaataggaataattctgcatccgttgttcgatcgatatgtgttagggatatgggaacagaaatgacaccaattgccagccaagaaccatcaagaacagcaacaccaattagagcaacaactccagcggtaagaagcccaatatcatcaggatcttctactcctattaggggacaaaatgggacaatcgaaaatggtcaaattgttgccaacattggtcagaacaggggaaatgcagggacaacacgaattgttcgtgatgtagaggaaactgttgacaatgaattagcagctaagaaggaaacagatcatcccaacaaggttaatccactcgagactcgtgcaatggcgtgggatgaggctgaacgcgctaagtatatggcaaggtataagcgcgaagaggtgaaaatacaagcttgggaaaatcatgaaaagaggaaagctgaaatggaaatgaaaagaatggaggtgaaggcagagagaataaaagcaagggcagaggagaagtacaaaaacaaattggcagcatcaagaagaatagcagaagagaaaagaggtaatgcagaagcagagttgaatgaaaaagctgtgaagacatcagaaaaggcagattatataaggaggactggtcatcttccttcttctttctcttttaagttaccttcttctttctgttggtaataatactatccatttatgtacctatattcacatttactaactattagtactagtaactttctttcttaa

SEQ ID NO: 2412 - DNA, 544 bp, Solanum phureja
gtcataaagttattttttcaaaaatattagcattttctctctttcttccctttttattattatcttaaagataagatggatacacaaattcctatattgagtcctaacaataatattgatgaatttgaagatttggaagtgacacaatttgatgaagacacactaagaaaattattatttgaagaagaattacaaccaaattatgacaatattaatattgtccaagattgtgtaatacaaccaatggtggttgatatggctccgaatttctcgaaaatcgaggaggagagggaggaggaggaggagcttgtaatcgaagatttcgagtggctagaaatgatggaattgtcagatacaattgtctcccacgagggagtaaacgagattttcgatgtgggagaattagagtttgatttttctcatttttgttcttcttcaattcctatggaagaaataggatatgatgttttgtggcaaaacaacttataatagtattattattttaataaaatcaattaaattaagtactaatgttatgaaattt

SEQ ID NO: 2413 - DNA, 419 bp, Solanum lycopersicum
atggatacacaaattcctatattgagtcctaacaataatattgatgaatttgaagatttggaagtgacacaatttgatgaagatacactaagaaaaatattatttgaagtagaattacaaccaaataataacagtattaatattgttcaagagtgtgttatacaatcaatggtgattgatatagtctcgaattattcgaaaattgagaaggaagaggagcttgtaatcgaggatttcgattgaatagaaatgatgaaattatcagataaaattgtctgccatgagggagtaaatgagatttttgatgtgggagaattagattttgatttttctcatttttgttcttcttcaattcctatggaagaaataggatatgatgttttgtggcaaaataacttataatagcaattaatggagaa

SEQ ID NO: 2414 - DNA, 485 bp, Solanum lycopersicum
tttttcaaaaatattacattttctctcttttcttccctttttattattattatcttataagataagatggatacacaaattcctatattgagtcctaacaataatattgatgaatttgaagatttggaagtgacacaatttgatgaagatacactaagaaaaatattatttgaagtagaattacaaccaaataataacagtattaatattgttcaagagtgtgttatacaatcaatggtgattgatatagtctcgaattattcgaaaattgagaaggaagaggagcttgtaatcgaggatttcgattgaatagaaatgatgaaattatcagataaaattgtctgccatgagggagtaaatgagatttttgatgtgggagaattagattttgatttttctcatttttgttcttcttcaattcctatggaagaaataggatatgatgttttgtggcaaaataacttataatagcaattaatggagaa

SEQ ID NO: 2415 - DNA, 1276 bp, Solanum phureja
gtgtcttttggtgcgcatttctaacggatagagcacctcgaaactaactaaactcaagaaccagacattcaaaagctctcaataacggccaataatggccgcagcattcagcagcagctttgctaatttcgccattggagctcaattctacaggcccaaattcgtaaaacccaagactttcgtaaacccaattcgctgtgctggtagactagaatgggacccagatggtttattgggtccggcccaaacgggtcatatagcccgactcgagttccagcggcgccttgagaatgacgctgcggccagagaagaatttgaacggcaagttcgtgaagagaaagagcgtcgcagagttcttcgtgagtcacgagtgattccggatacagtggaagggcttgtggaattttttcttgacactgaagctcaagagattgagtttgagattgcaagaatgagaccacgattgaacaaagaattttttgaccatctgcaagtcgaacttggaaagctgcgcttttctgtaaacaaaactcaggccgtggaagacagattaattgaactggaagcactgcaaaaggccctgcaagaagcaacagaagcctatgataaattgcaagcagatcttgtagcaacaaagaagaacttaactgagattttgacttcaaaggatgtcaaggccactctattggatttggttgggaggaatgcactgaatagacccttgttgacacttcttgatgaaaacattgcaactgcacatagtgttaaccagaaacaagctgcggaatacatggaaaagctgaggggacttgttctgaagtacttaacagtataggcttcatcttaagcttatcaaattcttgtctctcatgtttatacagagaaatgggcgtggtatgaatggaaatgtgaaagctgctttaaggttgagaatacttcatgttgcacaagttactagtaatgcacttgctttggttaatcgatttgcggatcgacaccggcctagtccttaatgtgactgaagcagggagcgtgaatttgaattagtcagatcagtgatgaggttgcaagttttgatgtgtataggtcatgtttttttttttttgaattttcataagcatgaatttggggatttgtgcggagtggtaacattatatatatttactgttgtagcaaggtttgtgtgaaaaggttcaattttgtagctgcaatgaagatagtgcagcttagtttgttttctatatgtgaatgtaataatataatcttcttgcttgta

SEQ ID NO: 2416 - DNA, 1101 bp, Solanum tuberosum
gtgtcttttggtgcgcatttctaacggatagagcacctcgaaactaactaaactcaagaaccagacattcaaaagctctcaataatggccgcagcattcagcagcagctttgctaatttcgccattggagctcaattctacaggcccaaattcgtaaaacccaagactttcgtaaacccaattcgctgtgctggtagactagaatgggacccagatggtttattgggtccggcccaaacgggtcatatagcccgactcgagttccagaggcgccttgagaatgacgctgcggccagagaagaatttgaacggcaagttcgtgaagagaaagagcgtcgcagagttcttcgtgagtcacgagtgattccggatacagtggaagggcttgtggagttttttcttgacactgaagctcaagagattgagtttgagattgcaagaatgagaccacgattgaacaaagaattttttgaccatctgcaagtcgaacttggaaagctgcgcttttctgtagacaaaactcaggccgtggaagacagattaattgaactggaagcactgcaaaaggccctgcaagaagcaacagaagcctatgataaattgcaagcagatcttgtagcaacaaagaagaacttaactgagattttgacttcaaaggatgtcaaggccactctattggatttggttgggaggaatgcactgaatagacccttgctgacacttcttgatgaaaacattgcaactgcacatagtgttaaccagaaacaagctgcggaatacatggaaaagctgaggggacttgttctgaagtacttaacagtataggcttcatcttaagcttatcaaattcttgtctctcatgtttatacagagaaatggtgagaatttctggttatttatattttagtaatgttgtagtatattacaaaattttgtagtaatatgaacttagaatgtatcccttgtaataataagaagaaagtatccccatcatttgtgaaaagaatgagtgaaccatgtaactgaaaattcatgttcttcttccttgtctgttggaaagtgtgaaatcctatttttactgaaagtgaaaactacattgta

SEQ ID NO: 2417 - DNA, 1331 bp, Capsicum annuum
gcacgagggcgttttgtaacggataaagcacccgggaaactaaccaacttcaacaaccagacatttgaaagctctgaattaacggccaacgatggccacagcagcagcattcggcatcggatttactagttccgccattggagctcaattcaacaggcccaaattcgtaaaacccaagattttcgtaaatccaattcgatgtgctggtagactagaatgggatccagatggaatattgggtccgcgacaaacgggtcatatagcccgactcgagttccagagacgccttgagaatgatgctgctgctagagaagaatttgaacgccaagtacgtgaagaaaaagagcgtcgcagagctcttcgtgagtcacgagtgattccggatacagtggaagggcttgtggagttttttcttgacactgaagcgcaggagatcgagtttgaggttgcaagactgagaccacgattgaacaaagaattttttgaccatctgcaagtcgaacttggaaagctgcgattttctgtaaacaaaactcaggacgtggaagacagattaattgaactggaaacactgcagacggccctgcaggaagcaacagaagcttatgataaattgcaagcagatcttgtagcaacaaggaagaacttaaccgagatttttacttcaaaggatgtcaaggcaactctgttggatttggttgagaggaatcagctgaatagacccttgttgacgcttcttgatgaaaacatcgcaactgcacatagtgctaaccagaagcaagcagcggaatacatggaaaagctgaggagacttgttctgaagtacctaacagtataggtttcatctgaagattatcaaatgctcgtctcatttttatacagaggaatgtatctcaaacccgttggcctggctagtccaaattcgtaggactcatagaagcactagcagcctgctgcactacggaaggatctaactacaagtatttagtgcatgcggcctaagagactatttccgcaggttgagtcggcgacctcctaatcacatggaggaaactttaccgtactccatggctcccttgtctattataatttggttatggttgaaattttattacagtactggatgtgttatcagctgcttctttcatttctattaattgtatcatcatagctggctgccagcacttatttatgagtattattattgttattaccagaccctcttgcaaatatgtacggggtccttcttctataatattgcctgttcatcaaccataatatattggttagtaggtgaaccttccacatgcatgaataacaataacagaggt

SEQ ID NO: 2418 - DNA, 1334 bp, Capsicum annuum
gcacgagggcgttttgtaacggataaagcacccgggaaactaaccaacttcaacaaccagacatttgaaagctctgaattaacggccaacgatggccacagcagcagcattcggcatcggatttactagttccgccattggagctcaattcaacaggcccaaattcgtaaaacccaagattttcgtaaatccaattcgatgtgctggtagactagaatgggatccagatggaatattgggtccgcgacaaacgggtcatatagcccgactcgagttccagagacgccttgagaatgatgctgctgctagagaagaatttgaacgccaagtacgtgaagaaaaagagcgtcgcagagctcttcgtgagtcacgagtgattccggatacagtggaagggcttgtggagttttttcttgacactgaagcgcaggagatcgagtttgaggttgcaagactgagaccacgattgaacaaagaattttttgaccatctgcaagtcgaacttggaaagctgcgattttctgtaaacaaaactcaggacgtggaagacagattaattgaactggaaacactgcagacggccctgcaggaagcaacagaagcttatgataaattgcaagcagatcttgtagcaacaaggaagaacttaaccgagatttttacttcaaaggatgtcaaggcaactctgttggatttggttgagaggaatcagctgaatagacccttgttgacgcttcttgatgaaaacatcgcaactgcacatagtgctaaccagaagcaagcagcggaatacatggaaaagctgaggagacttgttctgaagtacctaacagtataggtttcatctgaagattatcaaatgctcgtctcatttttatacagaggaatgtatctcaaacccgttggcctggctagtccaaattcgtaggactcatagaagcactagcagcctgctgcactacggaaggatctaactacaagtatttagtgcatgcggcctaagagactatttccgcaggttgagtcggcgacctcctaatcacatggaggaaactttaccgttactccatggctccccttcgtctattataatttggttatggttgaaattttattacagtactggatgtgttatcagctgcttctttcatttctattaattgtatcatcatagctggctgccagcacttatttatgagtattattattgttattaccagaccctcttgcaaatatgtacggggtccttcttctataatattgcctgttcatcaaccataatatattggttagtaggtgaaccttccacatgcatgaataacaataacagaggt

SEQ ID NO: 2419 - DNA, 1001 bp, Nicotiana tabacum
  misc_feature (179)..(179): n is a, c, g, or t
  misc_feature (192)..(192): n is a, c, g, or t
  misc_feature (786)..(786): n is a, c, g, or t
  misc_feature (792)..(792): n is a, c, g, or t
  misc_feature (808)..(808): n is a, c, g, or t
  misc_feature (810)..(810): n is a, c, g, or t
  misc_feature (846)..(846): n is a, c, g, or t
ggccattacggccgggggcatttcaaacggataaagcagcaggaaacgaaccaaccgcaagaaccagacatttgaaagctcaatcaataacggccatcaatggccgcaatattcagcatcagctttgctagttccgccattggagctcacttccacaggaccaaattcaataaacccangacttttgtaaanccaattcgttgcacgggtagactagaatgggacccagaaggcgtattgggtgcgccccaaacaggtcacatagctagactcgagttcaagagacgccttgagcaagatgctgctgccagagaagaatttgaacgtcaagtccgtgaagaaagagagcgtcgaagagttcttcgcgagtcacgagtgattccggatacagtagaagagcttgtggagttttttcttgacactgaagctcaagagattgagtttgagattgcccgactgagaccacgattgaacaaagagttttttgaccatctgcaagtcgaagtgggaaagctgcggttttctatgaccaaaactcaggaagtggaagacagattaattgaactggaagcactgcaaaaggccctgcaggaagcaacggaagcctatgataaaatgcaagcagatattgtttcaacaaagaagaacttaaccgagattttgacttcaaaggatgtcaaggctactctattggaattggttgagaggaatgagctgaacagacccttgttgacccttctcgatgaaaacattgcaactgcacatagtgttaaccagaaacaagcngcagantacatggaaaagctgngnggacttgttctgaagtacttaacagtataggttttngttttaaaaatatcaactgctcgtctcatttttataccgagtaatggtgagaatttctggttgtttatattctactaatggtattatagtacaaaattttgtaggaatatgatcccttgtaataagaaaaagaaagtatcccagcgccgcatgag

SEQ ID NO: 2420 - DNA, 1044 bp, Nicotiana benthamiana
  misc_feature (19)..(19): n is a, c, g, or t
  misc_feature (29)..(29): n is a, c, g, or t
  misc_feature (39)..(39): n is a, c, g, or t
  misc_feature (49)..(49): n is a, c, g, or t
  misc_feature (111)..(111): n is a, c, g, or t
  misc_feature (179)..(179): n is a, c, g, or t
  misc_feature (471)..(471): n is a, c, g, or t
  misc_feature (501)..(501): n is a, c, g, or t
  misc_feature (685)..(685): n is a, c, g, or t
  misc_feature (699)..(699): n is a, c, g, or t
  misc_feature (738)..(738): n is a, c, g, or t
  misc_feature (817)..(817): n is a, c, g, or t
  misc_feature (834)..(834): n is a, c, g, or t
  misc_feature (869)..(869): n is a, c, g, or t
  misc_feature (956)..(956): n is a, c, g, or t
  misc_feature (958)..(959): n is a, c, g, or t
  misc_feature (985)..(985): n is a, c, g, or t
cggcacgaggcaaacgaancaaccgtaanaaccagacanttgaaactcnatcaataacggccatcaatggccgcaatattcagcatcagctttgctagttccgccattggnagctcactttccacaggaaccaaattcaatagacccaagacttttgtaaatccaattcgttgcgcggntagactagaatgggacccagaaggcgtattgggtgcaccccaaacaggtcacatagctagactcgagttcaagagacgccttgagcaggatgctgctgccagagaagaatttgaacgtcaagtccgtgaagaaagagagcgtcgcagagttcttcgcgagtcacgagtgattccggatacagtagaagagcttgtggagtattttcttgacactgaagctcaagagattgagtttgagattgcccgactgagaccacgattgaacaaagagttttttgaccatctgcaagtngaagtgggaaagctgcggttttctatgacnaaaactcaggaagtggaagacagattaattgaactggaagcactgcaaaaggccctgcaggaagcaacggaagcctttgataaaatggaagcagatattgtagcaacaaagaagaacttaaccgagattttgacttcaaaggatgtcaaggctactctgttggatttggttgagaggaatgagntgaacagacccttnttgacccttctcgatgaaaacattgcaactgcacatagngttaaccagaaacaagcagcagagtacatggaaaagctgagaggacttgttctgaagtacttaacagtataggtttttngttttaaaaatatcaantgctcgtctcatttttataccgagtaatggtgagnatttctggttgtttatattctactaatgtatatagtacaaaattttgttggaatatgatccctttttagtaataagaaaaagaaagnanncccatctattttgaaaatcaaagtgnaaagaatgagtaaaccagtagtaattgaaaatgcatgtttctgaaggtactattaaaaa

SEQ ID NO: 2421 - DNA, 838 bp, Solanum phureja
gttttcttctgcttccctatcttcttcttcttctactttttggtctagtggaagcagagaaaaagcagaaatatgactatggctactcatatttctccaatgcttcaattaccttcaatcttcttcaaccattcccatcagtctttcaaagaaaaccagcactaatttcttcacttagaaaaactcctcatcttttctcttattcatttcccaagtcattcgttccgctttctgcttgccttgctattcttctatggtcctctcctgctaatgctggatttctttcgggttatactggaatagaatcagttcctggccctgaattacctaagattgattttcttaatcgttggaacgatgataatcagaaaaagtatgcagaacttgatgaaaaattcaaagagtcacccctgcttaaacagttactcgaaaaatccaagcaaaacaaagaaaagaacaaaaagtcaattgaagacaagtattgtttacgcggagctgaatggggagttggagattgctcaacagcaggaatgacaccagaagatagagatagcttcattgccatgttgaaacagaaggctggtgtagaatgaacgcgcaattatgtactctttatcgataatgctggtttcaattttcgaatgcaaagagtgaagattgaatcgtaatggtgagaattcgcgttaggagacggggagtttgattgagcctccaagacattagaagcttttagtataagtagaagaacatgtcaagggacattcttccattgttctatagcttgtaaatacattgcatgagtatactatgagcttgagagtggcatattgatattagg

SEQ ID NO: 2422 - DNA, 889 bp, Solanum tuberosum
ggttttcttctgcttccctatcttcttcttcttcttcttatactttttggtctagtggaagcagagcaaaagcaaaaatatgactatggctactcatatttctccaatggcatcaatgaagcaatttccttcaaccaccttcaatctccttcaaccattcccatcagtctttcaaagaaaaccagcactaatttcttcacttagaaaaaatcatcttcttctctcttattcatctccatcccctttcgaaaacttcacatttcccaagtcattcgttccgctttctgcttgccttgctattcttctatggtcctctcctgctaatgctggatttctttcgggttattctggaatagaatcagttcctggccctgaattacctaagattgattttcttaatcgttggaacgatgataatcagaaaaagtacgcagaacttgatgaaaaattcaaagagtcacccctgcttaaacagttactcgaaaaatccaagcaaaacaaagagaagaacaaaaagtcaattgaagacaagtattgtttacgaggagctgaatggggagttggagattgctcaacagcaggaatgacaccagaagatagagatagcttcattgccatgttgaaacagaaggctggtgtagaatgaacgcgcaactatgtactttatcgataatgctggtttcaattttcgaatgcaaagagtgaagattgaatcgtaatggggaaaattcgcgttaggtgacggggagtttgattgagcctccaagacattagaagcttttagtataagtagaagaacatgtcaagggacatttttccattgttttatagcatttaaatacattgcatgagtaaactatgagcttgagagtggcatattgatattagg

SEQ ID NO: 2423 - DNA, 1609 bp, Solanum tuberosum
gccaaaagaagaagaaaatgaaagcgaaaaagaagaaaacaccatcactacatcacacttttctcacataacccccttttccttttccttcttctttgatgagcctataccattttgacttgcttcattcttcacagatcaggatagtgagtcgtgccacgttagctgttgtgatctttttgtattttagctttgaagtccaccatgtaatgaagattatacccagggctttttgatctctacttattttaaacttcaccagattcagcttttttttttgcgaagaatatgtctgtattaccaaaaactgattctatccaaattagagaagtatggagcgataatcttgaggaggaatttgctttgattcgtcaaattgtggatgactatccttacattgccatggacactgagtttccaggggtggtgcttcgtcctgttggcaatttcaagcatatcaatgagtataactatcagaccttgaaggacaatgttgatatgttgaatttgattcagttgggtctcacattttccgatgaaaatggcaatctacctacttgtgggagtgagtactactacatttggcaattcaactttcgtgagttcgacacaagtgcagatatttttgcaaatgattcaatcgaattgctgattcagtctgggattgatttcaagaagaacaatgaaatgggtattgatgcaaaacagtttggtgagctcttaatgtcttctggaatcgttttgaatgacatggttcattgggtgacatttcacagtgggtatgattttgggtacttgctcaaattattaacttgtaggaccttaccggaaacacaagcagggttctttgatttgctaaacatgtactttccgctggtttatgacatcaagcacctgatgaagttctgtaatagccttcatggtggcttgaacaagttggcggaactactggaacttgagagggtcggtatttgtcatcaagcaggttcagatagcttacttacctcgtgtgccttcaagaagttaaaagataacttctttaatgggtctaccgagaagtatgcaggtgtcctgtatggtcttggcgttgagtatggatctgataataaatagattgactttgtgtacttactagaaaataaaatagaaggaaagggttcagtgtatgtcaagtggggtaggtaatgtatcatgtgtctgtaagaaattaattgtgataaaagtatttgtaagacagtttggactttcactgagggtactcagtttctaatccattgtttaatcagctttgagctttttacagcaagacaagtttgtgtctctaccttcactcatttctaatctacgaagagatgctgcagccttctagttaatccattgctacctccaacaatagggctcttcaccaacttgatgtctagaatgctttcgtacatggtgacctccaagaaagtgttttcatggtccaattgtctggatacacaaacacacatcttctttacctatatagctaaaacaggctatatgtgcttacttcatttcttgctggctatggatttcaaatgttccaaaactgatgcatctgtatttatttataattctgatcctc

SEQ ID NO: 2424 - DNA, 1680 bp, Solanum phureja
gcccactcgtccaaaagcagacttcaatcacacaaaataataaataaaaagaaaaggccaaaagaagaagaaaatgaaagcaaaaaagaagaaaacaccatcactacatcacacttttctcacataacccctttttccttttccttttttcttcttctttgatgagctctaccattttgacttgcttcattcttcacagatcaggatagtctgtcgtgctgcgttagctgttgtgatcttttttgtattttagctttgaagtccaccatgtaatgaagattatacccagggctttttgatctgtctacttattttaaacttcaccagattcagctttttttttgcgaagaatatgtctgtattaccaaaaactgattctatccaaattagagaagtatggagcgataatcttgaggaggaatttgctttgattcgtcaaattgtggatgactatccttacattgccatggacactgagtttccaggggtggtgcttcgtcctgttggtaatttcaagcatatcaatgagtataactatcagaccttgaaggacaatgttgatatgttgaatttgattcagttgggtctcacattttccgacgaaaatggcaatctacctacttgtgggagtgaatactactacatttggcaattcaactttcgtgagttcgacacaagtgcagatatttttgcaaatgattcaatcgaattgctgattcagtctgggattgatttcaagaagaacaatgaaatgggtattgatgcgaaacagtttggtgagctcttaatgtcttctggaatcgttttgaatgacatggttcattgggtgacatttcacagtgggtatgattttgggtacttgctcaaattattaacttgtaggaccttaccggaaacacaagcagggttctttgatttgctaaacatgtactttccgctggtttatgacatcaagcacctgatgaagttctgtaatagccttcatggtggcttgaacaagttggcggaactactggaacttgagagggtcggtatttgtcatcaagcaggttcagatagcttacttacctcgtgtgccttcaagaagttaaaagataacttctttaatgggtctaccgagaagtatgcaggtgtcctgtatggtcttggcgttgagtatggatctgataataaatagattgactttgtgtacttactagaaaataaaatagaaggaaagggttcagtgtatgtcaagtggggtaggtaatgtatcatgtgtctgtaagaaattaattgtgataaaagtatttgtaagacagtttggactttcactgagggtactcagtttctaatccattgtttaatcagctttgagctttttacagcaagacaagtttgtgtctctaccttcactcatttctaatctacgaagagatgctgcagccttctagttaatccattgctacctccaacaatagggctcttcaccaacttgatgtctagaatgctttcgtacatggtgacctccaagaaagtgttttcatggtccaattgtctggatacacaaacacacatcttctttacctatatagctaaaacaggctatatgtgcttacttcatttcttgctggctatggatttcaaatgttccaaaactgatgcatctgtatttatttataattctgatcctcttggttt

SEQ ID NO: 2425 - DNA, 1338 bp, Nicotiana tabacum
  misc_feature (1003)..(1003): n is a, c, g, or t
  misc_feature (1090)..(1090): n is a, c, g, or t
  misc_feature (1282)..(1282): n is a, c, g, or t
  misc_feature (1288)..(1288): n is a, c, g, or t
  misc_feature (1330)..(1330): n is a, c, g, or t
cagagcagacttcaataaatataaataaaaagaaaaagccaaaaaaagaaaaagcaaaaaagaagaagaaaacaccatcactacacatcacacttttctcacataagggcctctgctttttcttcttcatctttgatgagctctttgattttgacttagcttcactcttctcagatcaggatagtctgtcgtgccgtgttagctgtactgatattcttgtagttgtagctttggagtcaaccatgtgatgaagattgtacccaggccttcttaatatacctgcttattcaaaacatcgccagattcaactctttttgctacaaacatgtctgcgttaccgaaaagtgattctatccaaattagagaggtatggagcgataatcttgaggaggaatttgctttgatccgtgaaattgtggatgcctatccttacattgccatggacactgagttccctggggtggtgcttcgccctgttggcaatttcaagcatatcaatgagtataactatcagaccttgaaggataatgttgatatgttgaagttgattcagttgggtctcacattttccgacgaaaatggaaacttacctatttgtgggagcgagcgttattgcatttggcaattcaacttccgtgaatttgacacaagtgcagatatatttgcaaatgattcaattgaattgctgatgcaatctgggattgatttcaagaagaacaatgaaatgggaattgatgcaaaacggtttggtgagctcttgatgtcttctggaattgttttgaatgatggggtccattgggtgacatttcacagtgggtatgattttggatacttgctcaagctattaacatgtaggactttgccggaaacacaagcagggttctttgatttgcttaacgtgtactttccactggtttatgatatcaaacacctgatgaagttctgtaatagccttcatggtggcttgaacaagctggcggagctgttggaactcgagagaatnggtatttgtcatcaggcaggttcggatagcttactaacctcgtgtgccttcaagaagttaaaagataacttctttaatggcgctacngagaagtatgcaggtgtcctgtatggtctcggtgtcgagtatggatctgataataaatagattgactttgtgtacttactggaaaataaaatagagaaaggggttcagtgtatgtcgagctgggtaggttatgtatcatgtgtctgtaagaaattaattgtgataaagtatttgtaagacagtttggacttncactgngggtactcagtttctaatccattgtttattcagctttgagcntttaagct

SEQ ID NO: 2426 - DNA, 1239 bp, Ipomoea nil
ctcttcatcttcttcctctcactaaactctctctctctctccctttctctctctctctctccctgtttctctctcttaaattgactcttccgacttctctcagatcaggctagctatattggctttttggattgtgctaataaaaggattaaaagcaaatctagctgaaaccccaacaaaaaggatgaattggtcaaatcccaagcctgcttgatccatctaattaaataacaaggccataataattgattcactgaaaaacctgcgcttcatttgtgaccgatacaaatatgtctgagttgctgaaaaatgattctatccaaattagagaggtttggaatgataatcttgaaaaagagtttgctcttatccgtgaaatcgttgatgagtatccttttatcgccatggacactgagtttcccggggtagttcttcggcctgttggcaacttcaagaacattaacgagtataactatcagacgttgaaggataatgttgatatgttgaagttgattcaattaggtctcacattttcagatgaagatggtaacttgcctacatgtggaacagatcactattgcatttggcagttcaactttcgtgaatttgacatgagcgaggatatctttgcaaatgattccatcgacctgttgaggcaatctggcattgatttcaagaagaacaatgaaatggggatcgatgcaacccgctttggtgagctactgatgtcgtctggtattgtattgaacgatggtgtgcaatgggtgacatttcacagtggatacgactttgggtacctcctcaagctattaacctgcaagaatttaccagatacccagagtgggttcttcgatttgctgaatatgtacttcccaatagtgtacgacattaagcacttgatgaggttctgcaatagcctccacggtgggttaaacaaactcgcagagctgttggaggtcgagagaatcgggatctgccatcaagctggttcagatagcttgctcacctcttgcgcattcaagaagttgaaggaaaacttctttagtggcgcaaccgagaaatatgcaggtgttctgtatggtctcggtgttgaaaatggttctgacaataaatagacttaaggaggaggtaatgtacttgtgaagaaaaataagaagattagaagagtttatgtatgttgagttgtgtagaagaacatgtatcatgtctgtaagaaatttaattgtgatcaaatatctg

SEQ ID NO: 2427 - DNA, 1259 bp, Vaccinium corymbosum
aaacatggattatatagagatatatatgtggtatacatgcttcttcttcaatcagcgaacgttgacctacaaacccatctcaaaaaactctcagttcaaatctctataactgttcacaagttcaagatctgttcatttcaaccctagattcgactaacccagatcctgtactgattaaactagggttttgatctgctcatttcgtgccccaaaattggttcaatcaaagatgtcagagttggccaagaacgatccgattcaaatccgtgaggtatggaaggaaaatcttgaagaggagtttgctttgattcgcgatattgtcgacgattacccttatatcgcgatggatacggagtttccaggtgttgttcttcgcccggtgggggcttttaagaatattaatgactataactatcagactttgaaggataatgttgatatgttgaagttaattcagttgggtctcactttttcggatgagaatgggaacttgcccacttgtgggacggacaagtactgcatttggcagttcaatttctgcgaatttagtgtgagtgaggatattttcgcaaacgattcgattgagctgttgaagcagtgtggcattgatttcaagaagaataatgagatgggtattgatgctaaccgatttggcgaacttctgatgtcgtcagggattgttttgaatgataatgtgcattgggtgacttttcacagtggctatgattttgggtatttgctgaagttgttaacttgcagggatttacccgatactcaagctggttttttgacttgatcaatatgtatttcccaatgttgtatgatatcaagcacttgatgaagttttgcaatagtcttcatggtgggttgaacaagcttgcggagcttttggaggttgagaggattggcatttgccatcaagcaggttcggatagcttactcacttcatgtgcatttaagaagttgaaagataacttctttaacggctccacggagaaatatgctggcgttctatatggccttggtgttgagaatggctccgaaaataaatgagagggcaaacatttgaatgcttgtttcaccagttaggcatgagattcacattttcatctgtatactattggcagaaagttgttgcttgttaactttccttgattgctttgtactttttcctgattttatgtgtaactcaaccctaagtgggcgttgtagcttgagtgctgtaaattatcacatttcaataacagtcgtaacatttt

SEQ ID NO: 2428 - DNA, 1313 bp, Actinidia deliciosa
  misc_feature (309)..(309): n is a, c, g, or t
ctctctttctctctcaatcttttctctatcttctcctctccctctctctgcaacctccaacgttgacccacaaatcttctcaaatctcagttcaaatctccataaatcttcaagaactaaaacaccactcttcacaaagttcaagatctgttcgtttcagtcttcaatttcactgatccaagatctggatctactaatatgctcaatcgctttattgtccaaaattgatttccaaacatgtcagagatgccaaagggtgatgattcgattcagattcgagaggtttgggagtcgaatcttgaagagganttcgctttgattcgagaaatcgtcgatgatttcccttttattgccatggatacagagtttccgggcgttgttcttcgccctgtagggactttcaagaacatcaatgactataactatcagactttgaaggacaacgttgatatgctgaagttgattcagttgggtctcacgttttcggacgaaaacgggaacttacccacttgtgggtctgataagttctgcatttggcagttcaatttttgcgaatttaatgttggtgaggacattttcgcgaatgattcaattgagttgttgaggcagtgtggcattgattttaagaagaataatgagatgggtattgatgctaatcggtttggcgaacttttgatgtcctcgggcattgttttgaatgataatgttcattgggtgacctttcacagtggctatgattttgggtatttgcttaagttgttaacttgcaggaatttgcccgattcgcaagctgggttctttgatttgatcaatatctattttcctgtggtttatgatatcaaacacttgatgaaattctgcaatagtcttcacggtgggttgaacaagcttgcggagctcttggaggtcgaaaggattggcatttgccatcaagcaggttcagatagtttactcacttcttgcgcctttaagaagttgaaagacaacttctttaatggctccacagagaaatatgctggtgttctttacggtcttggtgtcgagaatgcctctgaaaataaatgattggcaaacagttgagtgcttgtttgaccagttaagcatggttggcaaacaattgagtgcttgtacgactaggttaggcatgagacttccatttccatctgtatacaattggcataaaagttgttgtttcttaactttccgggttgctttttcctttttctgattttacgtgtaacccaaccctcgatgggttttgtagcttgagtgttgtaaattattgcatatcaataacaatcttaacattttag

SEQ ID NO: 2429 - DNA, 1144 bp, Tabernaemontana elegans
tcctcctctctttctctctggctttcgttgacaaaataattactccttcgatcttcagacttagtttttcagatcttccttacggtttagattctgggatttgccagtttcgatgcgaagctgactgatttgaagtgtttcttgtccaagaaagaaacgggattttattccttttgttttcagaagatgtctgacttggccaaaggtgattcgatacatattagagaggtatggaatgataatctcgaggaagaatttgctctgattcgagaaatcgtggacgattatccctacatcgctatggacactgagtttcctggagtggttcttcgtccggtggggagtttcaagcatattaacgaatataactatcagactttgaaggataatgttgatatgttgaagttgattcagttgggcctcacattttctgatgaaaaggggaatttgccaacttgtgggactgatgttggttgcatttggcagttcaattttcgcgagtttaatgtgaatgaagatatttttgctaacgattcgatcgagctactgaagcagtctggaattgattttcagaagaataatgatatgggcatcgatgcaaataggtttgcggagcttctgatgtcttctgggattgttctcaatgattctgtccgttgggtcacattccacagcggctatgattttggctacttgctcaagctgttgacttgcaggagcttgccggatacacaagcaggcttccttgatctgattaaaatgtatttcccaatggtatatgatgtcaagcatttgatgaagttctgcaacagccttcatggtggactgagcaagctagctgagcttttggaggttgagcgaattggaatttgccatcaggctggttcggatagtttgcttacttcatgtgcattcaagaagttgaaggacaatttcttcaacggctccactgagaagtatgctggtgttttatatggtcttggtgttgaatttggatctgaaaaataaataggaaatcaaatacttgtgtaatgtattgttagcctgctaatttttactagcttgttaattagacacggatgtcaaattggttgtgtacacaatttgcaaaaaagttagcagtttatggatttctctttattgc

SEQ ID NO: 2430 - DNA, 1420 bp, Fraxinus spp
ggggggttatgtggccaaatttcccaatgttttaccaggtcaatcttggctgctgaagtcagccccgagccatcgcccatggacagaaatgaatctctatagaaaccaatgtagcgactttgtattgccaatcctcctttgattaccttcctctcttttacctctgtcgtgtctgtctctttatatgattctggagtcgacttcagccccctctcttgcttttcatcgtcctcttgttgacaccaagatcggttcgcacaaaactcgagatctgttcaattctgccctctattcaccaattgaagatctggttggttcagttgaagactacgcgtttcctggttgtttcattaccaaagaaaaaaaaatagtttgttacccataaaagtaaaagttgacctgaatggaagaaatcccggagttgccgaaaaatgattctattcaaattagggaggtatggaatgacaatcttgaacaagagcttgctctaattcgtgaaatagtggatgactatccttatatcgcgatggatactgagttcccgggtgtggttcttcgccccgtaaggaattttaagcatattaacgagtataattatcagactttgaaggataatgttgatatgttgaagttgattcagttaggtctgacattttcggatgaaaatgggaacttacccacttgtggaactgatacttgttgcatttggcaatttaattccgtgaattcgatgtgaacaaggacatattcgctaatgattcaattgagcttttgaggcaatcaggtatcgattttgagagaataatgagatgggcattgattcaaaccatttcgccgagctcttgatgtcttcaggatcgtttgaataatgacgtgcattgggtaactttccacagtggctatgatttggatatctgcttaagtattgacttgtaggaatttgcccgagtctcagtctgattctttgatttgctgaacatgtatttcccatggtgtatgatatcaagcatttgatgaaattctgcaacaaccttcatggtggtctgaataagttggcagagctcctggaacttgagaggattggcatatgtcaccaggcaggttcagacagtttgcttacttcttgcgcattcaaaaaattgaaagataacttcttcaacggttccaccgaaaagtattctggcgttttgtatggacttagtgttgagaatgggtctgaaaaataagtaggagtcgttccctgtgcatgttcccttctgtattaacctgtaaggcatgaaaatctcatcttggttgtaaacatttgcagtaagctgttgctcattagttctgttgattgctttttttaactctcttttctgtaactgaacccgtgatgggcgttgtagtttgaatactgtaaaatatggcagtaattgtt

SEQ ID NO: 2431 - DNA, 1254 bp, Sesamum indicum
ccccctctatctgcactttaccatctccacgttgacacaccaatcagtgttcgcaaagctcccaatctattcacttcagtacattatttcatctgctaaagtattctgcagatttagcttcagttgaagattaccaatattaagattattttgttgcgaaagcatatttcttttttgctgctagtacctagtaaattttaagaagaaaggacagaaatgtttgagttgccaaagaatgaccaaattcagattagggaggtgtggaatgacaatcttgaacaagaatttgctctgattcgtgatatagtcgatggttatccctatgttgctatggatactgagttcccgggcgtggttcttcgacccgttggcaactttaatcatatcaatcagtacaattatcaaaccttgaaggataatgttgatatgttgaagttgattcagttgggtctcacattttcggatgaaaatgggaatttacccacttgtgggactaatacttgctgcatttggcaatttaatttccgtgaattcaatgtcagcgaggacatttttgctaatgattcaattgaattgttgaggcaatctgggattgattttaagaagaataatgagctgggaattgatgctggccgctttgcagagctcttgatgtcttccgggattgttttgaatgatggcatgtgttgggtgacatttcacagtggttatgactttggatacctacttaagttattgacttgtagaagtttgcccgagactccagcagggttcttcctattgctgaacatatacttcccaatggtgtatgatatcaagcatttgatgaagttctgcaatagccttcatggaggactgaataagctggcagaacttttagaagttgagagaattggcgtctgtcatcaggcaggttctgatagtttactcacgtcatgtgctttcaagaagttaaaagataacttcttcaatggatccacagagaagtatgctggtgtgttgtatggtcttggcattgagaatggatcttgaaaaataacaagaacacacctgtgtattagctgtagtacttgtaaggcgtggaaatgtcaggtggattttatagtttcagaaattgttgcttgttagttcctttgattgcccttttaactttgtgtggtactgaatccctggagggtgttgtagcttaagcattgtaaaatatcacatacacattccaataacagtcattacagctccatccttctcaacgac

SEQ ID NO: 2432 - DNA, 1092 bp, Scabiosa columbaria
tttttcttactcgaatgctttaactatttgcagatctgttctactcgaagtcaaattgttctatttatcgatggaaaaatgtctcttttcgaaaaaagcgatttgatccagatcagagaggtatggaatgataacctagaagaagagtttgcgttgattcgtgaaattgttgatgattatccgtttatagctatggataccgagtttcctggtgttgttcttcgtcctgttggggcttttaagaatattaatgagtataattatcaaactttgaaggataatgttgatatgttgaagttgattcagttagggctcactttttctgataaaaatgggaacttgcctacttgtggaacggatagttattgtatttggcagtttaatttccgtgagtttaacatgagtgaagatatctttgctaatgattctatggagttgttgactcagtctgggattgatttcaaaaagaacaatgagatggggatcgacgcgagtcgtttcggcgagctgtttatgtcgtccgggattgtattgaatgatggggttcagtgggtgacttttcatagtgggtatgattttgggtatttgcttaagctgttgacttgcagagaattgcccgatacacaagccgggtttttcaagttgattaacatgtatttccccatggtgtatgatatcaagcacttgatgaagttttgtaatagtcttcatggtggattgaacaagcttgctgagctcttggaggttgagaggatcgggatttgtcatcaggcgggttctgatagtttgctcaccgcttgtactttcaataagttgaaagataacttctttaatggatcgaccgagaaatatgctggtgtgttgtatggtctaggtgttgagaatgggaatgataaataaagtaagaagaagaaagtctgttccgttctcggtttctttttgttattcaatgaatctcttgtttgagtagttgggcactaaacctcccattttaatgtgtacacaagtggcaaatgatgttactgtttagttttatgtttgattgttcttggtcttcttgatgtttgtgtaaccgaacccattcacaacacg

SEQ ID NO: 2433 - DNA, 1345 bp, Lippia dulcis
aacctttccttacttttttttttcagtgttgattttccttatgggtcgcttgtagttgctccgttgatctgttatccatgattttaagttcaaagtttcaatctttatgctgaaatactttctgggtcttacttctttttcgttgttgtttcagatctggctgatttgggttcacgattagccctgtcgagatttgtttcgtggtcaaagattggttccttttgctgcgaggtgaaaataaagaaaaagaggaagaagagaaatgtctgagctgccgaaacccgactcgattcaaattagggaggtatggaatgagaatcttgagcaagaatttgctctgattcgtgatatagtcgataattacccttatgttgctatggatactgagtttcctggtgtggttcttcgtcctgtcgggaattttaaccatatccacgagtacaattaccaaaccctaaaggataatgttgatatgttgaagctaattcaattgggtctcacgttttctgatgaagatgggaatttacccacttgtggcactgacaccggctgcatttggcaattcaattttcgcgaatttaatctcaccaaggatatctttgccaatgattcaattgaattattgaagcaatccggtattgatttcaagaaaaacaatgaaatgggcattgattcgaaccgttttgctgagcttctaatgtcgtctgggattattttgaacgataacgttcattgggttacctttcatagtggctatgactttggatatttgcttaagttactgacttgtaaaagcttacccgaaaccccagccgggttttttgacttacttaagatgtatttcccagtagtttacgatatcaaacacttgatgaagttctgcaatagccttcacggtggtttgaataagttagcagagcttctcgaagtggagaggtttggtatttgtcatcaggcaggttcagatagtttgctcacttcttgtgctttcaagaaactgaaagataacttctttaatggcgatactgagaagtatgtcggtgttctgtatggtcttggtgttgagaatggtaccgataaatcctgggcttgaggatggttctggcgagtggagagacgaaccccttgtgcattagcttgtatgttagtactttgtgcggcttggaaatggaaaccccgtgtgggttttgttatacttgtcgaaagaagttgcttcgttagtttttcctttttctctttgtgttgtttttcttgattgatctctttttaactttgtggtcatgtgttggtgaatcccttctgggggtgttgtagctttgagcactgtaaagtatgacataaatgt

SEQ ID NO: 2434 - DNA, 983 bp, Antirrhinum majus
  misc_feature (634)..(634): n is a, c, g, or t
  misc_feature (637)..(637): n is a, c, g, or t
tctccccgttgaccaataatcacctctggatctcttcactttttgccaattaaagatctggtcgatttgagttcaaaattgctaaaacctagagttacttttggtgaaggtgtctttttttcattctgctgctgttgaaaagaggaggaattgtttaatagagaaggagaaatgtccgatttgccgacgaaagagtcgattcagattagggaggtatggaatgagaatctggagcaagagtttgctctgattcgtgagatagttgatgattatccgtatattgcgatggatacggagtttccgggtgtggttcttcgccccgttggcaactttaagcatatcaatgagtataattatcagaccttgaaggataatgttgatatgctgaagttgattcagctgggtctcacgttgtccgacgagaatgggaacttgccttcttgcgaggcgggtacttgctgcatttggcagtttaatttccgtgaattcaatgttggccaggatatgtttgcggacgattctattgagttgttgaggcaatcggggattgattttacgaagaataatgagatggggatcgatgtcggtcgctttgctgagctgttgatgtcttctgggattgttttgaacgacngtntgtgttgggtgacgttccacagtggttatgatttcggttacttgcttaagttgttgacttgtaggaagttgcctgagactcaatcggggttcttcgatttactcaggatgtattttttgatggtgtacgatattaagcatctgatgaagttctgcggcggccttcatggaggactgaacaagctggcagagctattggaagttgagaggtttggcatttgtcatcaggcaggttctgatagtttactcacatctagtgcgttcaagaagttgaaagataacttctttaatggctccactgagaagtatgctggtgttttgcatggtcttggtgttgagtatggggc

SEQ ID NO: 2435 - DNA, 2095 bp, Glycine max
gcccagttgtaaacgacacctcccgtgtagttgttgctaaccaaaacgaccccacgccccatccccagtacaaatcaggtctcaacccctcgcccccaatttcctgtcgcctcccccttcttcgctcccacccttcgttgacctcctattctcccctcatcggagctcaaatctccgatcccttcatccatatcgcttcaccgcaactttctcttcatccatcgcaagatctagttgaatctcaaccgcgctcctccgattcgaagctccactcactcaaatcctcttcagatctggggggtttgattgcgattctcactctgctgctcggatttgttcgtctgagatgtcgattttaccgaaaggcgattcggttcaaatcagggaagtttggaacgataacctcgaggaggagttcgcgttgatccgtgaaatcgtggacgagtataactacgtggcgatggataccgagttccccggcgtggttctccgtccggtggggaatttcaagaacatcaacgactacaactaccaaaccttgaaggacaacgtggacatgttgaagctgatccaattaggtctcactttctccgacgagaatggtaacctccctacctgcggcacggagagcacctgcatctggcaattcaacttccgcgagttcaacatcagcgaagacatcttcgcgagcgactcgatcgagttgctgcgccagtgcgggatcgacttcaagaagaacagcgagaaagggatcgacgtgaaccggttcggggagctcctcatgtcctccgggatcgtgttgaacgacgccgtgcactgggttaccttccacagcgggtacgatttcgggtacctcctgaagctgttgacatgccggagcttgccggagacgcaggccgggttcttcgatctgatcaagatgtattttccgatggtgtatgacatcaagcacctgatgaagttctgcaacagcctccacggagggttgaacaagcttgcggagttgttggaggttgagagggttggcgtgtgccatcaggctgggtctgatagtttactcacttcttgtacatttagaaagttgagggatgcgttcttcagtggctccacggagaaatatgctggtgtcttgtatggtttaggtgttgagagtggacagactaattgaaatgaaaagaaaaagaaaagaaacgaaagaagaaggatataattggttgtagagtacgtcttaagtgtgagtctctctttttactttgtgtacacttctgccaaaagaatggttgttgtttacttgtaacattttcatcatcatcatcatccttgcttgaactgtaacttgaaaccgtagctggttttgttagcttgagttctttgtaaatcatcaccttcagtttagtgtcttcaaatttcaaataataatttatgatgattcctttagtttgctttgctgctgcagctatatttgtttcttgtaatcgttgctcaacttataaccaatactaccaacacagtttctctgaactctgaaaatgttaagtccagttcttagttcgaataagaagtcttgtttctgtgtctgtgaattatggtttgttctgattgactgggtgcaatgcataaaggtccttctttcagaataggccaaggttttattggctttgttgggtaaattgagttcttctctaaacgtgggcgaagcattgcacgcgattcataaattgaattttcgaagacagcatcaagatgtgatggatggccttggtgcttccattatttgatttctctcgcttttcgaagacatggctactgtgcatctgatgatttcacattttccacttatgagaggtattgattactattctgctttggcaatttagcagtctcaccgcaatgaagagatgacacgggcaggtttggatcgaagttgacgtttcttgcttgttttcaaattgaatataataatgtggtaatgaaattattcattcaatatatgaaattattatttcttttgggaaaattagttatttggttccaataatcttacgatcttattatctcttttaattattcgtagtctttatcatttatattttaa

SEQ ID NO: 2436 - DNA, 1290 bp, Fagus grandifolia
taaaggtctcaaaccccatatctattctctctcctctctggttcgttgacctagagagttcgcttccaccaccaaaatcactcccaccaacttcacgatctggtcatttccaacccctgatttcactaatccaagatctagtggaaccacaaaaaacgaggtcgttttatgggactctgattcgcagtaaccaacccagacactgttcatgtatttttggggttcttctttttatttatggatttattattatttttgtctttggtcttttctagatctgtctgaagcagaaaacgctgtcggttttttgcaaaacctcgtacttaggcagaagtataaaacttgttgtgtttttagatctgggttttagagtatttccaatcctgttgcttgaattgagatattggaaatgtcgattttaccgaaaggcgattcgattcaaatcagggaggtttggaatgataatttggaggaagaatttgctctgatccgtgagattgttgatggttataattttattgctatggacactgagttcccgggtgtggttcttcggcccgtggggacttttaagaatattaatgactataattatcaaacattgaaagacaatgttgatatgttgaaattgatccaattgggtctcactttctccgacgggaatgggaatcttcccacttgcgggaccgataagttttgcgtctggcaattcaatttccgtgagtttaatgtgagtgatgatatcttcgcgagcgattccattgagttgttgcaccagtgcgggattgatttcaagaagaataatgagaagggtattgatgtgaatcggttcggtgagcttttgatgtcgtcggggattgtgttgaatgatggtgtgcattgggttactttccatagtgggtatgatttcgggtacttgcttaagctgttgacatgccggagtctgcctgatacgcaagcggggttctttgatttgatcaatatgtatttccccatggtgtatgatatcaagcatttgatgaagttttgcaatagcctccatggtgggttgaacaagcttgcggagttgttggatgtggagagagttggtgtgtgtcatcaagcaggttctgatagtttgctgacggcttgtacgtttaggaagttgagggatagcttcttcaatggttcaacagaaaaatacgcgggtgttttatatggtcttggtgtcgagaatggacagagtactaattgaaagaaaataattgggaaaaaagattgatgaatatttgtagactacttaagtgtgag

SEQ ID NO: 2437 - DNA, 1252 bp, Vigna unguiculata
  misc_feature (11)..(11): n is a, c, g, or t
ccgagctcaantctcccacttcttcgcacagatcgcaccgccttcaccttcgattcatccataacaagatctacttgaatctcgctcgcggatctccaattccaaattctattgtcactcaaatcctcttcagatctggggggtttgattcctgttgtgattttgtccctcggattcgatcataggaaatgtcgattataccgaaaggcgattcggttcaaatcagggaggtttggaacgataacctcgaggaggagtttgcgttgatccgtgaaatcgtggacgagtataactatgtggcgatggataccgagttccccggcgtggtactccgtccggtggggaatttcaagaacatcaacgactacaactaccaaacgttgaaggacaacgtggacatgctgaagctgatccaattaggtctcaccttctccgacgagaacgggaacctccctacctgcgggagcgagagtccctgcatctggcaattcaactttcgcgagttcaacatcagcgaagacatcttcgcgagcgattcgatcgagttgttgcgccagtgcgggattgatttcaagaagaacagcgagaagggaatcgacgtgaaccggtttggggagcttctcatgtcctctggaatcgtgctgaacgacgctgttcattgggttacctttcacagcggctacgattttggttacctccttaagctgttgacatgccgaagcttgccagatacgcaggctgggttcttcgatttgatcaagatgtattttccgatggtctatgatatcaagcatctgatgaagttctgcaacagcctccatggtgggttgaacaagcttgcagagttgttggaggtggaaagggttggtgtgtgccatcaggctgggtctgacagtttactcacttcttgtacatttagaaagttgagggatacattcttcagtggctcaacggagaaatatgctggtgtcttgtatggtttaggtgttgagaatggacagactaattgaaagagaaaaaagaaagaaagaagaaatggatataattggttgtagagtacgtctaagtgtgagtctttttacttgtgtacacttctgccaaaaatggttgttgtttacttgtaacattttcatcatccttgcttgaactgtaactcaaaccgtagctggttttgttagcttgagttctttgtaaatcatcacttcagtttagtgcttcaaatttcaataaataatttatgatgattccttta

SEQ ID NO: 2438 - DNA, 1071 bp, Mimulus guttatus
aaatgtctgagttgccaaagaacgactctgttacaattagggaggtatggaacgacaatctcgagcaagagtttgctctgattcgtgatatagtcgataattatccttatgttgccatggatactgagttccccggtgtggttcttcgcccactgggcagttttaatcatatccatgagtacaattatcaaaccctcaaggataatgttgatatgttgaagttaattcagttgggtctcacattttcggatgaaaatgggaatttacccacctgtgataatacatgctgcatttggcaattcaatttccgcgaattcaatgtgagcgaggacatatttgctaatgattcgatagaattgttgagggaatcagggattgatttcaagaagaacaacgaggcgggcatcgatgctagccactttgctgagctgctgatgtcatctgggattgttttgaatgataacgtgcgctgggtgacattccacagtggctatgactttgggtacttgcttaaattattgacttgtagaagtttgccggagagtgcagtggggttcttcaatatgctgaatttgtacttcccagtggtgtatgatataaagcatttgatgaagttttgcaatagccttcatggcgggctgaataagctagcagagctgttggaaattgagaggattgggatttgtcatcaggcaggttctgatagtttgctcacatcttcggctttcaagaagttaaaagacaacttcttcaatgggttcaccgaaaagtatgcaggtgtattgtatggacttggtgttgagaatggatttgaaaagtaaagatataaagaagatctttgtttgtaagacctccactcctccacccctttgtatttgatcttgatgtattattaggtgtagaagtagtagtacgttgatggttttcaaagtttgtttgttgcttgttttttgttttttgttttttgaaattaactttgtcctcggaggaggaggtgttgtagcttgaacattgtaaagtttgatatacacatgttgcaataacagttgtaccatttcatcctcgtgaatt

SEQ ID NO: 2439 - DNA, 1179 bp, Euphorbia peplus
ttgacctaattttattcccccaaatctcaaatccctaatcatcgcttcaagatccatcaatcccactaccagattcttcagattcaagatccccatcatcggaaaagtcgaaaaggtgacgcctttttagggttttcggtaccggagtggatttttaagttgtgggtatgcttgtttttgttcagatctagtgttttgattttgaaaattatgtcaattttacaaaagggtgactctattcatatccgtgaggtgtggaatgataatcttgaggaagagtttactttgattcgagaaattgttgatcagtttaattatgttgctatggatactgagttccccggggttgttctccgtccggtcgggaactttaagaatattaatgattataattatcagacgttgaaggataatgttgatatgttgaaattgatccaattggggttaactttttctgatgagaatgggaatttgcctacttgtgggacggataagttctgcatttggcagtttaatttccgcgagtttaatatcaccgaggatatatttgctagtgattcgattgagttgttgcgccaatgcgggattgattttaagatgaatagtgaaaagggtattgatgttagtcgatttggagaacttcttatgtcttcggggattgtgttgaatgatggggtgaattgggttacgtttcatagtgggtatgattttgggtacttgttgaagcttttgacttgcaggatgttgcctgagacacaatcggggttctttgatttgatcaatatgtactttcctatggtgtatgatatcaagcatttgatgaagttctgcaatagtcttcatggtggtttgaacaagttggctgaattgttggaggttgaaagagtcggggtttgccatcaagcgggctccgatagtttgcttacttcttgcacatttaggaagttgagggacaacttcttcaatggttcgacagagaagtatgcaggtgttctttacggtctcggtgttgaaaatggtcagaataatactaattgataagccagccatgatttgcagattaaagattgatgaatatttgtagactacttcaagtgtgagatgatcattttaattatcttcttgtatactttggcaacaaaggttgttgttttagtgatgacttatttctaaatttgc

SEQ ID NO: 2440 - DNA, 2352 bp, Ricinus communis
aatgatgttttttaaaaaaagtaacggagccaaagtctgactttagtactgatcctaatggagagaccgaaaccgaagattgagaaacgccgtcgtttaagtaatgctggaaacaacgtgcaaacgccctcgtttttgactcgttcttctggcgacgacatcactttccctctttttttattgcactgtcctttcacttgtgtttgcagacaccaaccagccagaaacgcaaatcatttatcacctcttcaagatctattcaccagtaaccttgatttctcatttctaaggttagattttgtcactttagctttctagggttttgacaacaacaagaagttctcttatttttctaacccatgtttgcttttattgcagatccgtttcataggaattagaaaggaggagtctttctgtgaattttaactcacaagaagaaacccagttcaggttttgagtgatatgcttgtatttcttcagatctggggcttatagtattattagctaatctgtaacttttgaacatattgagtatgtcaattatacctaagggtgattccattcatatccgagaggtgtggaatgataatctcgaggaagaattcactttgattcgtgaaattgttgatcaattcaattatgtagctatggatactgagttccctggcgtggttttgcgtccggtagggaatttcaagaacatcaatgattataattatcaaactttgaaagataatgtcgatatgttgaagttgattcagttgggtcttactttctctgatgagaatgggaatttgcctacctgtggaacggataagttttgcatttggcagtttaattttcgtgagtttaatatcagtgaggatatatttgctagtgattctattgaattgttgcgccaatgcggaattgattttaagaagaataatgaaaagggtattgatgttaatcggtttggtgagcttatgatgtcgtctgggattgttttgaacgatggcgtgcattgggttacatttcacagtgggtatgattttggatacttgcttaagcttttgacttgcaggagtttgcctgatacacaagctggtttctttgacttgattaatacgtacttcccaatggtgtatgatatcaagcatttgatgaagttttgcaatagccttcatggtgggctgaacaagcttgcagagttgttggaggtggaaagagttggcatttgccatcaagctggctccgatagtttgctcacgtcttgcacatttaggaagttgagagataactttttcaatggctccacagagaagtatgctggagttttgtatggtcttggtgtcgagaatggacaaaatactatttgaaagaaataaatttgaaaaaatattgatgaatagttgtagactactttaagtgtgagattttatttctgttgtatactttggcaacaaaggttgttttttagtggtgacttccatttgcttctttgtgactgaaaccttgactggttttatagcttgttgtccttgtacattattgcagttagtgtttcaataataattttagttattcagctgatctcttatgcgttcaatgtaatttctcttgaagcttactgatttatggttctccctctgtttctctctcaaaattcagtttttacatgtgtgtaaaacctcggttcagttgttttatatttgtatcattctagatggcgtaaaggcttcctgatggtgccttttcttatccatgtttgtctccatatctagaactgtttgttcttgtcaatgggattacggagtttgcagaactttataagaacataacgagattgtagaataccaggtccaatactctctcttgcacatcgatgggcacgtgacctcgtttctccttgtacagagcacaatgtcatttctcattgtatgaaatatgagggaggtgcaacagtgctgcatatttctgatgatacatcttctactggtcaatttagtttggtcatttttccagcagtatggtgtcaagagtatgcgcagcatgagtccttctggaacatgcaagtacagaagagggtccggaggccagaactgtggtaatggagttcttaatgcagtagctcctggaataaaatggggaaagcaagccttgataagcttgatgatatatcttcatacaatatataagactagcccaattgatctgggagatttaaactgccacatctccttcctgtttctgtccagaactgaaatcacagaggctggtagaacctggaatggagtgattaaaacaactagattagctcttaccttttcggtcatgggatgcacgttttatggataagtataataataataa

SEQ ID NO: 2441 - DNA, 1131 bp, Phaseolus vulgaris
ggtttttcttgccagatctggggggtttgattcctgttataagtttgttccccggattccatcgtagaaaatgtcgattataccgaaaggcgattcggttcaaatcagggaggtttggaacgataacctcgacgaggagtttgcgttgatccgcgaaatcgtggacgagtataactacgtggcgatggataccgagtttcccggcgtggtactccgtccggtggggaatttcaagaacatcaacgactataactaccaaacgctgaaggacaacgtggacatgttgaagctgatccaattaggtcttaccttctccgatgagaacgggaacctccctacctgcggctccgagagtccctgcatctggcaattcaactttcgggagttcaacatcagcgaagacatcttcgctagcgattcgatcgagttgttgcgccagtgcgggatcgatttcaagaagaacagcgagaagggaatcgacgtgaaccggttcggggagcttctcatgtcctctggaattgtgctgaacgacgccgttcattgggtcacctttcacagtggctatgattttggttacctccttaagctgttgacatgccgaagcttgccggatacgcagactgggttcttcgatttgatcaagatgtattttcctatggtgtatgatatcaagcatctgatgaagttctgcaacagcctccatggtggattgaacaagcttgcagagttgttggaggtggagagagttggtgtgtgccatcaggctgggtctgatagtttactcacttcttgtacatttagaaagttgagggatacattcttcaacggctcaacggagaaatattctggtgtgttgtatggtttaggcgttgagaatggacagactaattgaaagagaaaaaaagaaagaagaaatggatataattggttgtagagtacgtctaagtgtgagtctttttacttgtgtacacttctgccaaaaaatggttgttgtttacttgtaacattttcatcatccttgcttgaactgtaactcaaaccgtagctggttttgttagcttgagttctttgtaaatcatcacttcagtttagtgcttcaaatttcaataataatttatgatgattcctttt

SEQ ID NO: 2442 - DNA, 1213 bp, Manihot esculenta
gtcctttttcctcttctttttccacagctttttttgggctatataaatgttcgcgtctctgtctagaatctgcaggttaagatctgcaatcagatgcttcaaacctctctgataccagatttggtgatttcaactgggttggcaatatttttttactagggtttcctcgtgaaattggaattcttaatttgattagaggcctgggattgagcaattttgtttcttttatttcgttcctctttttcgagtccaaggaatgtcgctgttgctaaaaggcgattctatccagattcgcgaggtgtgggatgacaatcttgaagaagaatttgctcttctccgtgaaattgttgatgattatccatatatagcgatggacacggaattcccaggcattgtgttgcgccctgtaggcaattttaagaatagcaatgaatatcattatcaaaccttgaaggataatgttgacatgttgaagttaattcaattgggtctgacattttcagatgagcaagggaatttacccacatgtggaactgataaatattgcatttggcagttcaactttcgtgaattcaacgtgaatgaggatgtttttgcaaatgattcaattgaactcttgcgccagagtgggattgatttcaagaagaataatgagaagggtattgatgcaaagaaatttggtgagctcttgatgtcttcagggattgtgttgaatgatagtgtgcactgggtaactttccacagtggctatgattttggctacttgcttaagctcttgacatgccagaatttgcccgacacacaagtagggttctttaacttgatcaagatgtattttccaaccctgtatgatataaagcatttgatgaagttctgcaatagccttcatgggggcttgaacaaactagccgagttgttggaagtggagagagttgggatatgccatcaggcaggttcagatagtttgctcacagcctgtactttcaggaaactaaaagagaatttctttagtggctccttggaaaagtatgctggtgtgttgtatggtttaggtgttgaaaatggagtgaatactaattgattatgaaaaattaaaaaaaattatgattagaaaggtgctcattcaaatgtatgtgtgatgagcaccacaatttatgtacacttttgtcttcaaattttcatgttttatgaatattttcatatttttgttgtt

SEQ ID NO: 2443 - DNA, 1484 bp, Ricinus communis
aatgatgttttttaaaaaaagtaacggagccaaagtctgactttagtactgatcctaatggagagaccgaaaccgaagattgagaaacgccgtcgtttaagtaatgctggaaacaacgtgcaaacgccctcgtttttgactcgttcttctggcgacgacatcactttccctctttttttattgcactgtcctttcacttgtgtttgcagacaccaaccagccagaaacgcaaatcatttatcacctcttcaagatctattcaccagtaaccttgatttctcatttctaagatccgtttcataggaattagaaaggaggagtctttctgtgaattttaactcacaagaagaaacccagttcaggttttgagtgatatgcttgtatttcttcagatctggggcttatagtattattagctaatctgtaacttttgaacatattgagtatgtcaattatacctaagggtgattccattcatatccgagaggtgtggaatgataatctcgaggaagaattcactttgattcgtgaaattgttgatcaattcaattatgtagctatggatactgagttccctggcgtggttttgcgtccggtagggaatttcaagaacatcaatgattataattatcaaactttgaaagataatgtcgatatgttgaagttgattcagttgggtcttactttctctgatgagaatgggaatttgcctacctgtggaacggataagttttgcatttggcagtttaattttcgtgagtttaatatcagtgaggatatatttgctagtgattctattgaattgttgcgccaatgcggaattgattttaagaagaataatgaaaagggtattgatgttaatcggtttggtgagcttatgatgtcgtctgggattgttttgaacgatggcgtgcattgggttacatttcacagtgggtatgattttggatacttgcttaagcttttgacttgcaggagtttgcctgatacacaagctggtttctttgacttgattaatacgtacttcccaatggtgtatgatatcaagcatttgatgaagttttgcaatagccttcatggtgggctgaacaagcttgcagagttgttggaggtggaaagagttggcatttgccatcaagctggctccgatagtttgctcacgtcttgcacatttaggaagttgagagataactttttcaatggctccacagagaagtatgctggagttttgtatggtcttggtgtcgagaatggacaaaatactatttgaaagaaataaatttgaaaaaatattgatgaatagttgtagactactttaagtgtgagattttatttctgttgtatactttggcaacaaaggttgttttttagtggtgacttccatttgcttctttgtgactgaaaccttgactggttttatagcttgttgtccttgtacattattgcagttagtgtttcaataataattttagttattcagctga

SEQ ID NO: 2444 - DNA, 1460 bp, Glycine max
cagatgttaacgactgatatcacattgtcgcatcccgaattgcaagagcccagttgtaaacgacacctcccgtgtagttgttgctgaccaaaacgaccccacgccccatccccagtacaaatcaggtctcaacccctcgcccccaacttcctgtcgcttccccttcttcgctccccccccgctcgttgacctccgattctcccctcatcggagctcaaatctccgatccctcccttcatatcgcttcacggcaaccttctcttcacccatcgcaagatctagttgaatctcgaccggttcgaagctctactcactcaaatcctcttcagatctggggggtttgattgcaattctcactctgctgctcggatttgttcgtttgaaatgtcgattttaccgaaaggcgattcggttcaaatcagggaggtttggaacgataacctcgaggaggagttcgcgttgatccgcgaaatcgtcgacgagtataactacgtggcgatggataccgagttccctggcgtggttctccgtccggtggggaatttcaagaacatcaacgactacaactaccaaaccttgaaggacaacgtggacatgttgaagctgatccaattaggtctcaccttctccgacgaaaacgggaaccttcccacctgcggcacggagagcccctgcatctggcaattcaacttccgcgagttcaacgtcagcgaagacatcttcgcgagcgactcgatcgagctgttgcgccagtgcggaatcgacttcaagaagaacagcgagaatggaatcgacgtgaaccggttcggggagctcctcatgtcctccgggatcgtgttgaacgactccgtgcgctgggttaccttccacagcggctacgatttcggctacctcctgaagctgttgacatgccggagcttgccggacacgcaggccgggttcttcgatctgatcaagatgtattttccgatggtatatgatatcaagcacctgatgaagttctgcaacagcctccatggagggttgaacaagctcgcggagttgttggaggtggagagggttggcgtctgccatcaggctgggtctgatagtttactcacttcttgtacatttagaaagttgagggatacgttcttcagtggctccacggagaaatatgctggtgtcttgtatggtttaggggttgagagtggacagactaattgaaattgaaagagaaaaagaaaaaaggaaagaagaatataattggatgtagagtacgttttaagtgtgagtctctttttacttcgtgtacacttctgccaaaaaatggttgttgtttacttgtaacattttcatcatcatccttgcttgaactgtaactcaaaccctagctggttttgttagcttgagttctttgtaaatcatcacttcagtttagtgtttcaaatttaaataataacttatatgatgattccctt

SEQ ID NO: 2445 - DNA, 1135 bp, Citrus sinensis
gttttagtgtctatcttgttggttggtattgttgttgttgttgttgttgttgtgttcagtttaggtttaaaatttgctgtcttggaaatgtcggttttgcctaaggggggcgatgaaattcaaattcgagaggtgtggaatgataatctcgaagaggaatttgctttaattcgtgaaattgttgataagtataactatatagccatggatacggagttcccaggcgtggttttgcgtcccgtgggagcttttaagaatattaatgattataactaccaaacgttgaaggataacgtcgacatgttgaagttgattcaattgggtttaacattttcggatgaaaatgggaatttgcctacttgtgggactgacaagttttgcatttggcaattcaactttcgcgagtttaatttaattgatgatatttttgctagtgattcagttgagttgctgcatcagtgtgggattgattttaagaagaataatgagaagggtattgatgtgaaccgctttggtgagcttttgatgtcgtcggggattgtgttgaatgatgttgttcgttgggtcacgtttcatagtgggtatgattttggttatttgcttaagttgttgacttgccggagtttacccgatacccaagctggattctttgaattgatcaatatgtattttcctgtagtatatgatatcaaacatttgatgaagttttgcaacagccttcatggtgggttgaacaagcttgcggagttgttggaggtagaacgagttgggatttgtcatcaagcaggttcagatagtttgctcacttcctgcacatttaggaagttgagggaaaacttcttcaacggctgcacagaaaagtatgctggtgtactgtatggtctcggtgtcgagaatgacaagactaattaaaaacaaataattgggaaaaggttcatggatatttgtagactactcaagtgtgaaactctgttttctctttgtatactttggcaaaagattgttgttttagttgtgacttttgctgtttgttgcattgtaaccgaaaccttgactggttttgtagtttcagtttcttgtaaattattgcagttagtgtttcaataataatcataatgattctcaacttatttta

SEQ ID NO: 2446 - DNA, 1688 bp, Citrus clementina
gcgtttgaccggttcactttcccattttatctcactgtcctatcagttctacttctaacgcccccaggcaaggcaacggattcaaaacaaaaccctcgggatatcttctcttctctctcctctcgcaattcgttgacctcaaaatttttcttcgaaagaacacgaaatcactcaagatctgttcgcttcgagttttaatttcatcaatccaagatctgttgagaagtgttgaaacggtgacgtttcttccagcggagagaacccagttcaggtttttgaggtttcgagttacttatgatctgtttacggatctgggcgttttagtgtctatcttgttggttggtattgttgttgttgttgtgttcagtttaggtttaaaatttgctgtcttggaaatgtcggttttgcctaaggggggcgatgaaattcaaattcgagaggtgtggaatgataatctcgaagaggaatttgctttaattcgtgaaattgttgataagtataactatatagccatggatacggagttcccaggcgtggttttacgtcccgtgggagcttttaagaatattaatgattataactaccaaacgttgaaggataacgtcgacatgttgaagttgattcaattgggtttaacattttcggatgaaaatgggaatttgcctacttgtgggactgacaagttttgcatttggcaattcaactttcgcgagtttaatttaattgatgatatttttgctagtgattcagttgagttgctgcatcagtgtgggattgattttaagaagaataatgagaagggtattgatgtgaaccgctttggtgagcttttgatgtcgtcggggattgtgttgaatgatgttgttcgttgggtcacgtttcatagtgggtatgattttggttatttgcttaagttgttgacttgccggagtttacccgatacccaagctggattctttgaattgatcaatatgtattttcctgtagtatatgatatcaaacatttgatgaagttttgcaacagccttcatggtgggttgaacaagcttgcggagttgttggaggtagaacgagttgggatttgtcatcaagcaggttcagatagtttgctcacttcctgcacatttaggaagttgagggaaaacttcttcaacggctgcacagaaaagtatgctggtgtactgtatggtctcggtgtcgagaatgacaagactaattaaaaacaaataattgggaaaaggttcatggatatttgtagactactcaagtgtgaaactctgttttctctttgtatactttggcaaaagattgttgttttagttgtgacttctgctgtttgttgcattgtaaccgaaaccttgactggttttgtagtttcagtttcttgtaaattattgcagttagtgtttcaataataatcataatgattctcaacttattttacggtgattcttttctatcatattcttcctttttccccatcttgtggttgatgatgtcatgtttatgctgccgagatgtagttatctcctcgtagatcgtctacttttgaactttttcctcccttaaccttgatacatctttcacgtatagcttgggaaatctttgtcactcttaaattcatttgacgtttgagcacatgaaacctgttcacaagctctttatattggaagaatagctaaacgtgt

SEQ ID NO: 2447 - DNA, 1697 bp, Citrus sinensis
gcgtttgaccggttcactttcccattttatctcactgtcctatcagctctacttctaacgcccccaggcaaggcaacggattcaaaacaaaaccctcgggatatcttctcttctctctcctctcgcaattcgttgacctcaaaatttttcttcgaaagaacacgaaatcactcaagatctgttcgcttcgagttttaatttcatcaatccaagatctgttgagaagtgttgaaacggtgacgtttcttccagcggagagaacccagttcaggtttttgaggtttcgagttacttatgatctgtttacggatctgggcgttttagtgtctatcttgttggttggtattgttgttgttgttgttgttgttgtgttcagtttaggtttaaaatttgctgtcttggaaatgtcggttttgcctaaggggggcgatgaaattcaaattcgagaggtgtggaatgataatctcgaagaggaatttgctttaattcgtgaaattgttgataagtataactatatagccatggatacggagttcccaggcgtggttttgcgtcccgtgggagcttttaagaatattaatgattataactaccaaacgttgaaggataacgtcgacatgttgaagttgattcaattgggtttaacattttcggatgaaaatgggaatttgcctacttgtgggactgacaagttttgcatttggcaattcaactttcgcgagtttaatttaattgatgatatttttgctagtgattcagttgagttgctgcatcagtgtgggattgattttaagaagaataatgagaagggtattgatgtgaaccgctttggtgagcttttgatgtcgtcggggattgtgttgaatgatgttgttcgttgggtcacgtttcatagtgggtatgattttggttatttgcttaagttgttgacttgccggagtttacccgatacccaagctggattctttgaattgatcaatatgtattttcctgtagtatatgatatcaaacatttgatgaagttttgcaacagccttcatggtgggttgaacaagcttgcggagttgttggaggtagaacgagttgggatttgtcatcaagcaggttcagatagtttgctcacttcctgcacatttaggaagttgagggaaaacttcttcaacggctgcacagaaaagtatgctggtgtactgtatggtctcggtgtcgagaatgacaagactaattaaaaacaaataattgggaaaaggttcatggatatttgtagactactcaagtgtgaaactctgttttctctttgtatactttggcaaaagattgttgttttagttgtgacttctgctgtttgttgcattgtaaccgaaaccttgactggttttgtagttccagtttcttgtaaattattgcagttagtgtttcaataataatcataatgattctcaacttattttacgatgtttcttttctatcatattcttcctttttccccatcttgtggttgatgatgtcatgtttatgctgccgagatgtagttatctcctcgtagatcgtctacttttgaactttttcctcccttaaccttgatacatctttcatgtatagcttgggaaatctttgtcactcttaaattcatttgacgtttgagcacatgaaacctgttcacaagctctttatattggaagaatagctaaacgtgt

SEQ ID NO: 2448 - DNA, 2086 bp, Phaseolus vulgaris
taatgtcgcatttgagctcagttgtaaacgacacctcccgtgttgttgttgctaaccaaaacgaccccacgccctttacccagtacaaatcaggtctcaaccctcgcccccaacttcctgtctcttctccttcttcgctgccaatccccttcgttgacctcaccctccccttcttcggagctcaaatctcccactctttcgcacagatcgcaccaccttcaccttcgattcatccataacaaggttagattcctaacttctccactacttcaatttctagggttcctacttcaaccctagtaaacaccaaatatctcaccatcactcgcaaacactcttccttctctaacggatcttatacttttccttttcttccagatctacttgaatctcggctgcggatctccaattccaacttttccagtcactcaaatccgcttcaggtatgctcatccttagatttgtggatttcatcttcgttttgtttaaataccagagctgtttatcttgaatttgttaggttttgagatctgaaccgtttccgctgtttttcttgccagatctggggggtttgattcctgttataagtttgttccccggattccatcgtagaaaatgtcgattataccgaaaggcgattcggttcaaatcagggaggtttggaacgataacctcgacgaggagtttgcgttgatccgcgaaatcgtggacgagtataactacgtggcgatggataccgagtttcccggcgtggtactccgtccggtggggaatttcaagaacatcaacgactataactaccaaacgctgaaggacaacgtggacatgttgaagctgatccaattaggtcttaccttctccgatgagaacgggaacctccctacctgcggctccgagagtccctgcatctggcaattcaactttcgggagttcaacatcagcgaagacatcttcgctagcgattcgatcgagttgttgcgccagtgcgggatcgatttcaagaagaacagcgagaagggaatcgacgtgaaccggttcggggagcttctcatgtcctctggaattgtgctgaacgacgccgttcattgggtcacctttcacagtggctatgattttggttacctccttaagctgttgacatgccgaagcttgccggatacgcagactgggttcttcgatttgatcaagatgtattttcctatggtgtatgatatcaagcatctgatgaagttctgcaacagcctccatggtggattgaacaagcttgcagagttgttggaggtggagagagttggtgtgtgccattacggccgggtctgatagtttactcacttcttgtacatttagaaagttgagggatacattcttcaacggctcaacggagaaatattctggtgtgttgtatggtttaggcgttgagaatggacagactaattgaaagagaaaaaaagaaagaagaaatggatataattggttgtagagtacgtctaagtgtgagtctttttacttgtgtacacttctgccaaaaatggttgttgtttacttgtaacattttcatcatccttgcttgaactgtaactcaaaccgtagctggttttgttagcttgagttctttgtaaatcatcacttcagtttagtgcttcaaatttcaataataatttatgatgattcctttagtttgcagctatttgtttattctaattgcgctctcgactcattcatcaccaaaggccacacggttgtctgatctctgaaaactgaaaatgcttacccaaatcttgtctgttcgagttaggagtcatgtttgtgactgttctggttgactgggtgcaatgcatcaagcgagatcttctttcagaatggtccaaggttttggtggcattgttgtgcaaattgagttgtcctttttgttatatggtcttacaattatggcgtgatgcgtttggcttgtaaccgacgacggattcacaacggggccgaagcactgcacgctattcataaattgattttcgaagacagtaccaagatgtgatggatgagatggccttggtgcttttcattatttctctccgggatgtattatttg

SEQ ID NO: 2449 - DNA, 1693 bp, Gossypium raimondii
gctattttctagtacagtcctaactccaatatctaaatatcactacaaatacaatgttctctctcatcatccatcatgcgggaataaaatatttcctattttagcaggtcttttaagactggaaaaggcaacctcagaacgatgtcgtatcaatgagtttcaagttacaacgccgtcgtttttgacattgtccatccctttccctttgtacatccctgtccttccttccttccttccttgcctttaagatgacaccccagtcgtacatggggaagcctcgtccgcgttttcctcttttccctttactcgttgaccgaaatttctcgactcaccgtgttcacaacctctagatctgttacttacaaggcccgatttcataatttcaagatctgcttccagcatctaaacgcgaccgttttcggaactcaactcggagcttcaatttttaaggtttggaatttggatgtgcttgtcttttatttggtctactggaaatgtcggttttgcccaaaggtgattcagttcatattcgagaagtttggaacgataatctagaagaagagtttgctttgatccgtgaaattgttgatacctataattatgtagctatggatactgagttcccgggtgtagttctacgtcctgttggttctttcaagaatatcagtgattataactaccaaactttgaaagataacgtggatatgttgaagttgatccaattagggctcactttctcggatgagaatggcaaccttcccacttgtggaactgacagctcttgcatttggcaattcaatttctgcgagttcaatataagcgaagatatctttgctagtgattccattgagttgttgcgccagtgcgggattgattttaagaagaacaatgagaagggtatcgacgtgaagcggttcggcgagcttctgatgtcttccgggattgtgctgaatgatggtgtgcattgggtaacttttcatagtggatatgactttgggtatttgctaaagctattgacttgcaggagtttgcccgataatcaagcgggattctttgatttgatcaatatgtattttcccatgttgtacgatatcaagcatatgatgaagttttgcaatagcctgcatggtggtttgaacaagcttgctgagttgttggaagtggaaagagttggtgtgtgtcatcaagctggctcggatagtttgctcacatcgtgcacgtttaggaagttgagagataactttttcaatggctccactgagaaatatgcaggtgtactgtatggcctaggggtcgaaagtggacagactactaattagaaagaagaaataataattgggaaaaggttgatgaatgtagactacttgagtgtgagactttataattttcattgtatacattggcaaaaatgattgttaatttagttgtgagcttatctcctttgcttgcattgtaactgaaaccttaactggttttctattctagttctagttgaaagtcatgtataaattatgcagttagtgtttcaataataatttgaaccattggcatctcacttgagatatcctcttcatctatttcctcgtttgtgttaatttgtgcttagtctctggaaaagagaaattctgttttggggatcctttcgaaaaactatataatctgttttagtgtgggcataacaaacctgtttatc

SEQ ID NO: 2450 - DNA, 2100 bp, Theobroma cacao
atatatatatatatatatttttttaaaaaaaacatactaggtaataaaaacaaatgaaccttttaaaaaaaagtatttagtaataaatttgttttcagaaaaatagaataactaggtgtcctaaatgtctggaaaatggaatctgcaatttacctgaaaaatctgcatttattttagatttctctcctttctgttcataaggaggtgagcaaagggaaaggctataggctccagaccattccccttctcactccactatatgtataaaataacagaaacgtgaagcctctccttttcccaggaaacaaacagaacagataaacaaaaaaaaaaaaaaaccttaaaacgataaccacagcaagtcaacaaccagttcttaaagaaaaaaggaaaaatcaaaccccagtctagggcctccgataatactccaaaccccgaaaccttacagagagaaaggaaggacctttcagaaattttctagatctttctgtctagaatctgccttatttaatctgtttctctgaaaaatccttccccttttcacttcaaaagatctggtgaaattcaatctgggtgttttgcaaattgattccctgtttgggggtttcgtggtaatttaggaatctttgtcttcttgggttgttattggttgaaatagaaattagttttttttgttggtttttcaagtgatgtctttgttgccaaagagcgattcaatccaaatccgtgaggtctggaacgataaccttgaagaagaattcgctttgattcgtgaaatagttgatgactacccctacgttgccatggatactgagtttccaggcgttgtgttgcgtcccctgggcaattttaagtacatctgtgactacaactaccaaactttgaaggacaatgtcgatatgttaaagttgattcaattgggtcttacattttccgatgaggaaggaaacttgcctacttgtggaactgataagtattgcatctggcaattcaatttccgagagtttaatgtgaatgaggatgtgtttgctaatgattctattgagcttttgaggcaaagtgggattgatttcaagaaaaacaatgagaagggtattgatgcaatgaggtttggtgagcttttgatgtcttcagggatcgttttgaatgatagtgtgcattgggttactttccatagtggttatgatttcgggtacttgcttaagctcttgacttgccagaatttgccggatacacaagttgggttctttagtttgattaatatttactttcctactctctatgatatcaagcatttgatgaagttctgcaatagtctgtacggtggattgaacaagcttgcggagttgttggaagtagaaagagttgggatttgtcatcaagcgggttcagatagtttgctcacatcttgtacattcatgaaattgaaagagaatttctttagtggctcgttggaaaagtattccggtgtgttgtacggtttaggtgttgagaatggacagagtactcattgaaaatgaaaagtaataaaaaccaaaaaatatttggacaactgcttgtttgtctgtacgagtgtgcctcatacccacacttcaatgtacactattggcaacaattttcgtaatttatgaatattttcttttgcttactgttctctttgttcttgctgttactgcgttataaagctttatgttccatgtatctatcaagtgtcaagtggtgcatttacgttcataaattatgtgatagcaaattgggaaaatgacggaatataatcttgatggttatatttaatggtagacgtccatttcttgtaagtgttagaatgttatcatccttttcttaattgccctgtttttgtatctatcatattgtctagaattagattcaaagagtttattgtgtttggatgttggtaccagatggaattcaatactgctccaaaatttgaaaaggcttttgcaccctttgatgtggccgatagttgttacaatataatgaaagacaaatttaacaaggaccaaaagaatgtggaaaaattgaatttggtattgtacatcgtcttgattcttaatttaaaaaaaaattgattttgttgag

SEQ ID NO: 2451 - DNA, 1354 bp, Manihot esculenta
gtgtaggaagtcacccagaagtgaagggcttgagcctctgcctcttttctgtctttctggtctctggccatctcttgttgacgcctaaatctttgttcaaagaagcgtatttactgatcctcacttctagatctattcactacaagccctgatttcacaaatccaagatctatttaaaataaaaactacttgtcggaaattaaatttacgataggtctcgcttcaggttttgagtgattatgcttatttttcttcagatctggggtttatagtattagctgctgcgttgctttctgaatccgtgtgttggaaatgtcaattatacctaagggcgactctattcaaatccgggaggtgtggaatgataaccttgaggaggaattcgctttgattcgtgaaattgttgatcaattcaattatgtagctatggatactgagttcccaggtgtggttttgcgccccgtggggaattttaagaacatcaacgattataactatcagactttgaaagataacgttgatatgttgaagttgatccaactgggtctcacgttctctgacgagaaggggaatttgccctcttgtgggacggacaagtcttgcatttggcagttcaatttccgtgagttcaatatcagtgaggacatctttgctagtgattctattgagctgttgcgccaatgtggaattgattttaagaagaataatgagaagggtattgatgtaaaccggtttggcgagcttctgatgtcgtccgggattgttttgaatgacggcgtgcattgggttacatttcatagcgggtatgattttgggtacttgcttaagcttttgacttgcaggagtttgcctgatacacaagcaggattctttgacttgatcaatatgtacttccccatggtgtatgatatcaagcatttaatgaagttttgcaatagccttcacggtgggttgaacaagcttgcagagttgttggaggtggaaagagttggtgtctgccatcaagcaggctctgatagcttgctcacgtcttgcacattcaggaaattgagagataacttcttcagcggctccacagagaagtacgcaggtgttctgtacggtcttggtgtcgagaatggacaaaatactaattgaaaagaaataattgggaaaatgattgatgaatatttgtagactacctgagtgtgaggctttcaattctcttgtatactttgccaaaaatattgttgttctagtggtgactttcatttgcttatttgtgactgaaaccttgactggttttgtagcttgttatccttgtacattgttgaagttagtgtttcaataataattttagctcttggcaatttat

SEQ ID NO: 2452 - DNA, 1454 bp, Glycine max
gagcaaccaaagaaaaaaccaattccatgaccactaatttctaacaaaatattttaatttgctcctcctctttcgcccccttctccctctctctattttttttttctttcccgctttttcatagcaaaacgaaaaagaaaaccctagaacgggagagatttcattccccaaaaaatctcttccttctctctcctcatttctgagttcccaactttcctcacctgagatctggtgtgacgtgcatcacaattgaatcgaattgaaatttgttgtcgtggttgcagcaaggaatgccgctggtattagcgaaaagcgattcgatccagattcgcgaggtatggaacgataacctggaagaggagttcgcgttgattcgcgaaattgtggacgattacccttacatcgccatggacacggagtttccagggatcgttctccgacctgtggggaatttcaagaacagctacgattaccattaccaaaccctaaaggacaacgtcgacatgctcaaactcatccaattgggcctcactttctccgacgagcacggcaaccttcccacgtgcggcgacgaatccggcacgtgctgcatctggcaattcaactttcgcgaattcaacgttaacgaggacgtcttcgccaacgactccatcgagctcttgcggcagagcgggattgatttcaagaggaacaacgaaaacggcatcgacgcccaccgtttcggggagcttctcatgtcctccgggatcgtcttgaatgacaacgttcattgggttactttccacagcggttacgatttcgggtacttgttgaagctcttgacgtgtcaggatttgcccgatacacaagtgggcttcttcaatttgataaacatgtatttcccaactgtgtacgacataaaacacctcatgaagttttgcaacagcctccatggaggcttgaacaagcttgccgagttgttggaggtcgagagggttgggatttgccatcaggccggttccgatagcttgctcacttcctgtacattcaggaaattgaaggacaatttctttagtggctccttggagaagtatgcaggtgtcttgtatgggttaggtgttgagaatggacagggttctcattgagaaggaaaaaaaaaacaaataaaaaatgaaattagaaaaaaaaaaaaaaaaacttggtagatctctctttgtttgagctgctgtatatctggcgtaataccaatttctattaatttaaacctttggcattaagtgtctttactaatactccctctttgttacttactactttatcttgtgttgtgtgtgcctaactctctggctttgattatcctttttcctgtatctgtgttgttgcttgcttttgatgtgaatttgtaggctaacatgaagcaagtcaggcttgtttctgtgttatttgcttgttttagacatgaatttgcaggctaa

SEQ ID NO: 2453 - DNA, 1011 bp, Amsonia hubrichtii
ataatcactccttcgatcttcagacatagtttgtcagatcctccttacgattttagtttcttggtgtttcatatgctgatgcagagctgaatgatttgaaagtgtttctttttccaatagtagaaaaagggttgattcttttgctgttagaagatgtctgacttgcctaaaggtgatccgatacatattagggaggtatggaatgataatctcgaagaagaatttgctctgattcgagaaattgtggacgattatccctacatcgctatggacactgagtttcctggagtggttcttcgtccggtgggaactttcaagaatattaacgagtttaactatcagactttgaagggtaatgttgatatgttgaagttgattcagttgggcctcacattttctgatgaaaaagggaatttgcccacttgtgggactgatgttggctgcatttggcagttcaattttcgcgagtttaatgtcagtgaggatattttcgccaatgattcgatcgagctgctgaagcagtctggaattgactttcagaagaataacgatattggcatcgatgcaaaccggtttgcggagcttctgatgtcttccggaattgttctgaacgattctgtccactgggtcacatttcatagtggctatgatttcgggtacttgctcaagctattgacttgtaggagtttgccggatacacaagccgggttctttgatctgattagaatgtattttccaatggtttatgatatcaagcatttgatgaagttctgcaacagccttcatggtggactgaacaagctagctgagctcttggaggttgagcggattggaatttgtcatcaagctggttctgatagtttgcttacttcttgtgcattcaagaagttgaaagacaatttcttcaacggctccaccgagaagtatgctaggggttttatatggtcttggtgtttgagtattggatctgacaaataaataggaaatcaaatacttgtgtaatgtattatt

SEQ ID NO: 2454 - DNA, 1261 bp, Ricinus communis
atcatcatttttgaccttataaaaaaaaatttgaaaaatatctctttccctatctcccctcgtcctctttctataagacccctccatgttgattcctctctctcgaatttgcaggttaagatctgcaaccaaatctctctgatttcagatttctgcgatatcaactgggttggaaaaagattctttttgaaaatttgggtttcaagaaattggattgagcaaatcttgctgttgtggtttatttggatctgggcttttctatacaaggaatgtcgctgttgttaaaaggggattctattcagattcgcgaggtttggaatgataatcttgaagaagaattttctcttattcgtgaaattgttgatgagtattcctatatagctatggacaccgagtttccaggcattgtgttgcgtcccgtaggaaatttcaagaatagtaatgagtatcattatcaaactttgaaggataacgttgatatgttgaagttgattcaattgggtcttacattttcagatgagcaaggaaacttacccacgtgtggaactgataaatattgcatttggcagttcaatttccgtgaatttaatgtgaatgaggatgtttttgcaaatgattcgattgaacttctgcggcaaagcgggattgattttaagaagaataatgaaaggggtattgatgctatgcgatttggtgagctgttgatgtcatcagggattgttttgaatgatagtgtgcattgggtaactttccacagtggttatgattttggttacttgcttaagctcttgacatgccagaatttgcctgatacacaactggggttctttaacttgatcaatatgtacttccccaccctatatgatatcaagcatttgatgaagttttgcaatagccttcatggagggttgaataagcttgcagagttgttggaagtggagagagttgggatatgtcatcaagcaggttcagatagtttgctcacagcttgtacattcaggaaattaaaagagaacttctttagtggctccttggaaaagtacgccggtgtgttgtatggtttaggtgttgagaatggacagagtactcattgattgtgaaaataaaataagaaaatcctgaaaaaaaaattattagagagatgcttaatcaactgtatgtgcgtgtgcttaacacccacagttcatgtacacttttgtcatcaagtcttcttaatttatgaacattttaatattcttaatattcgtctgttcttgtgcac

SEQ ID NO: 2455 - DNA, 1613 bp, Ricinus communis
aagaaaaaaaaagttttctcccgaatgaaagatcattgtggttcttctggacatttctctctcttctcctaagcttttgataaggaggtgagaaggggaaagaaaaaaggctaattagtgttttccttttctctcttcaaaaagaacctttttttttttattaggaagaaggaaattattttcttttctttcttttctttttcttttctctgaaagcaaacaaacaaactaacaatactccaaaattataaacaggaacagaaaattgaaaataagaaaaagaaaacattacgaataaaaagaaagaaaaccaagaaaacccatcatcatttttgaccttataaaaaaaaatttgaaaaatatctctttccctatctcccctcgtcctctttctataagacccctccatgttgattcctctctctcgaatttgcaggttaagatctgcaaccaaatctctctgatttcagatttctgcgatatcaactgggttggaaaaagattctttttgaaaatttgggtttcaagaaattggattgagcaaatcttgctgttgtggtttatttggatctgggcttttctatacaaggaatgtcgctgttgttaaaaggggattctattcagattcgcgaggtttggaatgataatcttgaagaagaattttctcttattcgtgaaattgttgatgagtattcctatatagctatggacaccgagtttccaggcattgtgttgcgtcccgtaggaaatttcaagaatagtaatgagtatcattatcaaactttgaaggataacgttgatatgttgaagttgattcaattgggtcttacattttcagatgagcaaggaaacttacccacgtgtggaactgataaatattgcatttggcagttcaatttccgtgaatttaatgtgaatgaggatgtttttgcaaatgattcgattgaacttctgcggcaaagcgggattgattttaagaagaataatgaaaggggtattgatgctatgcgatttggtgagctgttgatgtcatcagggattgttttgaatgatagtgtgcattgggtaactttccacagtggttatgattttggttacttgcttaagctcttgacatgccagaatttgcctgatacacaactggggttctttaacttgatcaatatgtacttccccaccctatatgatatcaagcatttgatgaagttttgcaatagccttcatggagggttgaataagcttgcagagttgttggaagtggagagagttgggatatgtcatcaagcaggttcagatagtttgctcacagcttgtacattcaggaaattaaaagagaacttctttagtggctccttggaaaagtacgccggtgtgttgtatggtttaggtgttgagaatggacagagtactcattgattgtgaaaataaaataagaaaatcctgaaaaaaaaattattagagagatgcttaatcaactgtatgtgcgtgtgcttaacacccacagttcatgtacacttttgtcatcaagtcttcttaatttatgaacattttaatattcttaatattcgtctgttcttgtgcacaaatatcagtctctgtggtatgttgctcct

SEQ ID NO: 2456 - DNA, 1079 bp, Primula obconica
atcaattacaacagcttaaagatctggtcaactgggaggttcattaaatttatgagataaaaaattaggtcccgaaaatgtcggagctttcaaaaagcgattcgattgagatccgagaggtttggaacgacaacctagaggaagagtttgcgcttatacgcgaaattgtcgatgaatatccatatatagcgatggatacggagtttccaggtgtcgttcttcgtcccgtaggggcttttaagaacataaacgactttaattaccaaacccttaaagataatgtagatatgttgaagctcatccagttaggtctcactctctcggacgaggatggtaacttgcccacttgcgggaccggaaaatactgcatttggcagtttaatttccgtgagttcaacttaactgatgatatattcgcgaatgattcgatcgagttgttgaaacaatgcggtattgattttaagaaaaataacgaaatgggtattgaggtgaatcgttttgctgagcttttgatgtcgtctggggtcgtattgaacgatcgcgtgaattgggtgacttttcatagcggatacgattttgggtatttgctaaaattgttgacttgtaggagtttgcccgatactcaagcggggtttttttatttgataagtacttattttcctttggtgtatgatattaagcacttgatgaagttttgcaatagtctccatgggggtttgaacaagctcgcagagattctagaggttgagaggatcggtatttgtcaccaggctgggtcggatagtttgctcactttatgtgcatttaagaaattgaaagataatttctttaatggcttcacggagaaatatgctggtgttctctatggtcttggagttgaaagtggaccggaaaaataaatcatttggtagtgttgatcgtatgttaacctttgaatgcttattaatttagttagcatgtttggaatataaggttcttgtttgttagtttacctagtatttgctttttcggtattttggatttggatattttgtgtaacacgacccttcgatgggtgttgtagctttgtgtaatgtaat

SEQ ID NO: 2457 - DNA, 1316 bp, Gossypium hirsutum
gcctttaagatgacaccccagtcgtaaaagggctctaagcctcgtccgcgttttcctcttttccctttactcgttgaccgaaatttctcgactcaccgtgttcacaacctctagatctgttacttacaaggcccgatttcataatttcaagatctgcttccagcatctaaacgcgaccgttttcggaactcaactcggagcttcaatttttaaggtttggaatttggatgtgcttgtcttttatttggtctactggaaatgtcggttttgcccaaaggtgattcagttcatattcgagaagtttggaacgataatctagaagaagagtttgctttgatccgtgaaattgttgatacctataattatgtagctatggatactgagttcccgggtgtagttctacgtcctgttggttctttcaagaatatcagtgattataactaccaaactttgaaagataacgtggatatgttgaagttgatccaattagggctcactttctcggatgagaatggcaaccttccctcttgtggaactgacagctcttgcatttggcaattcaatttctgcgagttcaatataagcgaagatatctttgctagtgattccattgagttgttgcgccagtgcgggattgattttaagaagaacaatgagaagggtatcgacgtgaagcggttcggcgagcttctgatgtcttccgggattgtgctgaatgatggtgtgcattgggtaacttttcatagtggatatgactttgggtatttgctaaagctattgacttgcaggagtttgcccgataatcaagcgggattctttgatttgatcaatatgtattttcccatgttgtacgatatcaagcatatgatgaagttttgcaatagcctgcatggtggtttgaacaagcttgctgagttgttggaagtggaaagagttggtgtgtgtcatcaagctggctcggatagtttgctcacatcgtgcacgtttaggaagttgagagataactttttcaatggctccactgagaaatatgcaggtgtactgtatggcctaggggtcgaaagtggacagactactaattagaaagaagaaataataattgggaaaaggttgatgaatgtagactacttgagtgtgagactttataattttcattgtatacattggcaaaaatgattgttaatttagttgtgagcttatctcctttgcttgcattgtaactgaaaccttaactggttttctattctagttctagttgaaagtcatgtataaattatgcagttagtgtttcaataataatttgaaccattggcatc

SEQ ID NO: 2458 - DNA, 1409 bp, Carica papaya
gggcacaatcactttcctcctgttttaaccactgtctttgaagtccttcagaagacacagaataaagagctcgaagcctccgtctatcttcctctcgctccctctgtatttcgttgacctatgaatctctcttcgaggaaaccacaagttgcgcatccgcaagctcgagatctgcaatttgtaaggctcaatttcgtagttccaagatctctcttgatagcctgaaaaaagggtacggttctggagttcaactcactgcagccccagcggccaagttacaggttcttgagtgtctgagtacttatgtttgtttacagatctgggtttggttgtacttttgactttgttgattgattggaaatgtcggttttactgaaaagcgattcaattcaaattcgagaggtttggaacgataaccttgacgaagagtttgctctgattcgtgaaattgttgacacatataattatgttgcgatggacactgagtttcccggcgtggttttgcgcccagtagggaatttcaagaacattagtgactataactaccaaactttgaaagataatgttgatatgttgaagttgatccagttgggtctcactttctccgacgaaaatgggagtcttcctacttgtggaaccgataagttctgcatttggcagttcaatttcagggaatttaatgtaacggaagatatattcgcaagtgattccattgagttgttgcgccaatgcggaattgattttaagaagaataatgaaaagggtattgatgtcaatcggtttggtgagcttttgatgtcgtcggggattgtattgaatgataatgtccattgggttacctttcatagtgggtatgatttcggatatttgctgaagttgttgacatgcaggaatttgccggattctcaagcagggttctttgatttgattaacatgtattttcccatggtatatgatatcaagcatttgatgaagttctgcaatagccttcatggtggattgaacaagcttgccgagttactggaggtggaaagagttggtatttgccatcaagcaggctccgatagtctactcacatcttgcacttacaggaagttgagggatagctttttcagcggctcaacagagaagtatgctggtgttttgtatggactcggtgtcgagaacggacagaatactaccaattgaaattaaaaataatgggggattgattgatagatttgtgtagactactcaaatgtgagactgaattctctttgtatacgatggcaaaagattgttgctttagttgtgacttttatcctttggttgatctgtaactgaaaaaccttgataggttttgtagtttgagtttcttgtaaattactgaagttagtgtttcaataataatgttaatgatttccaacttc

SEQ ID NO: 2459 - DNA, 1695 bp, Amborella trichopoda
gagagaataagggaaaagagattttagagagagaaaattatagagagagaaaaccaaaactgcgtcctcgcagccgccttgccccctgttggttttggcgtcgtcttctctctctaaaaaggcaggtctcttcttccctctctcttttgctctctaaaaaggcgggtctcttcttccctctctctttctctctctaaaaaccctgacgggattaaaatccctcaatcttattcggccttcaagacgccgaatttttttactacgaatccatgcaatctctctctctaaaagctctccttacagagccctgtctcatcttctccaccgcctccgtctctctctaaaaaaaaaccctagatccagagatcgccgcgccaaccctagtttcagggctctcgttcgcggttgatctcgcttctcacctctcagatctacttctctgcgactcttcgcccccgttcggcctcttttctcccatatttctctgtttttcgctgcaccagaagagctagggcttcagcttccgccagatccgttagggtttcggatgttttcccgtcccttttgggttttcctctctgttttgacgaagggtttcactggtgagaccgcttggaactaccctgatttatagggtttctttctctgcaactgcttaagaaaaatgtcgatcttgcccaaaaacgagacgatcctgattagagaggtatggggcgataacctagaggatgagtttgcgctgattcgtgaaatagttgatgattacccctacatcgctatggatacagagtttccaggcattgttcttcgccctgttggtaatttcaagaacagttcagattttcattacaaaaccctaaaagcaaacgtggacatgctcaaactgatccagttagggttaactttctctgatgaagacggcaatctcccaacttgtggaaccgataagttctatatctggcaattcaatttcagggaattcaatgtccttgaagatgtttatgcgaatgattctatagaattgctcaggcaaagcgggatcgattttaagaagaacaacgagaaggggattgatgcccaaaggtttggagagcttctcatgtcatctggcatagttttgaatgatacagttcattgggtcacttttcacagtggttacgattttgggtatctgctaaagctcttgacttgccagaatttgcctgaaactcaagctgggttctttggcttgatcaatatgtatttccccactgtgtatgatatcaagcatctgatgaagttttgcaatagccttcatggtggattgaacaagcttgctgaattgctcgatgtggagaggattggaatttgccaccaagctggatcagatagtttgctcacctcttgtaccttcaggaagttgaaggagtcgttctttaatggatcgactgagaaatatgctggtgttttgtatggtctaggggttgagaatggaaacagtattaactgagtaaaggatgtgaaaaaaataataagaaaatgaatagaaagactgttgattacatgtggattttaggctccttttatctcttgtacaacctttagcaaatagattgctggtttctttttgaagtatgaattttccattcgtacaggaaatttttatttttatttttgcgtatttgtgtttgttccttggaatggtggtggtttttt

SEQ ID NO: 2460 - DNA, 1227 bp, Theobroma cacao
aatcatactgcaaacaggaaaccctacagagagaaaggaagtacctttcagaaattttcttgatctttctctctctagaatctgccttgtttatttatttctctcaaaaaaaccatccatttttccacttctttaagatctggtgaaattcaatctgggtgttttgcaaattgattccttgtttggggttttcgtggtaatctaggaatctttttcttgggttgttattggttgaaaaagaaattaggttttttttttttttggtttttcaagtgatgtctttgctgccgaagggcgattcaatccaaatccgtgaggtctggaacgataaccttgaggaagaattcgctttgattcgtgaaatagttgatgactacccctacgttgccatggacaccgagtttccaggcgttgtgttgcgtccgttgggcaatttcaagaacagctatgattatcactaccaaactttgaaagacaatgtcgatatgttaaagttgattcaattgggtcttacgttttccgacgaggaagggaacttgcctacatgtgcaactgacaagtattgcatttggcaattcaatttccgcgagtttaatgtcaatgaggatgtgtttgctaatgattctattgagcttttgaggcaaagtgggattgatttcaagaaaaacaatgagaagggtattgatgcaatgaggtttggtgagcttttgatgtcttctgggatcgttttgaatgacagtgtgcattgggttactttccatagtggttatgatttcgggtacttgcttaagctcttgacttgccagaatttgccggatacacaagctgggttctttagtttgatcaatatttactttcctaccctttatgatatcaagcatttgatgaagtttagcaacagtctgtacggtggattgaacaagcttgcagagttgttggaagtagaaagagttgggatttgtcatcaagcaggttcggatagtttgctcacatcttgtacattcaggaaattgaaagagaatttctttagtggctctttggaaaagtattctggtgtgttgtatggtttaggtgttgagaatggacagagtaattgaaaatgaaaagtaataataacaaaaaagatttggataactctttgtttgtctgtacaagtgtgcctcatacccacacttcaatgtaaactgttggcaacaattttcgtaatttatgaatattttcttatgc

SEQ ID NO: 2461 - DNA, 1204 bp, Catharanthus roseus
atttatgagtaaccccagatgctgcacttccgctgtgttcctcatctcatctctctctttctctctcttccgttgacccaacccaataatcgctctttcgatctttagacatagttcttcagatcctttttcaggattttagtttctgggttgtctgatttcgatgcaaagctgaatgatttgaagtgtttttttggtctaaaagaagagtaagggattgattcatttgctgtctgaagatgtccgacttgaccaaaggtgattcagtacatattagggaggtttggaatcacaatctcgaagaagagtttgctctgattcgagaactcgtggacgattatccatacgtcgctatggacactgagtttcctggagtggttcttcgtccggtaggaactttcaagaacatcaacgattataattatctgactttgaaggataatgttgatatgttgaagttgatccagttgggcctcacattttctgatgaagaaggaaatttaccaacttgtgggttcgatgttggttgcatttggcagttcaactttcgcgagtttaatctaaatgaagatatgttcgccaatgattcgatcgagctactgaagcagtctggaattgattttcagaagaataatgatatgggcatcgatgcaaatcggtttgcggagctgctgatgtcttctgggattgttctgaatgattctgtccattgggtcacattccacagcgcctatgattttggttatttgctcaagctcttgacctgcaaaagcttgccggattcacaagcaggattctttaatctgatcaaaatttactttccaatggtatatgatattaagcatttaatgaagttctgcaacagccttcacggtggactgaacaagctagctgagctcttggaagttgagcggtttggaatctgtcatcaggccggttctgatagtttgctcacttcttgtgcatttaagaagttgaaagacaatttctttaatggctccactgagaagtatgctggtgttttatatggtcttggtgaatatggatctgaaaaataaactagaaatcaaatacttgtgtaatgtattgttgttagcctgctaattttactagcttcttagttaggcatggttgtctaatttggttgtgtacacaatttgccaaaaaaaagttgctatttatgaattttacttgattctctttt

SEQ ID NO: 2462 - DNA, 1418 bp, Gossypium hirsutum
tatctttcccacgcgtccgcccacgcgtccgcaacgtcgtcgtttttgaccttgttcatccctttccctttgacatctctgtccttccttccttgcctttaagatgacaccccagtcgtaaaagggctctaagcctcgtccgcgttttcctcttttccctttactcgttgaccgaaatttctcgactcaccgtgttcacaacctctagatctgttacttacaaggcccgatttcataatttcaagatctgcttccagcatctaaacgcgaccgttttcggaactcaactcggagcttcaatttttaaggtttggaatttggatgtgcttgtcttttatttggtctactggaaatgtcggttttgcccaaaggtgattcagttcatattcgagaagtttggaacgataatctagaagaagagtttgctttgatccgtgaaattgttgatacctataattatgtagctatggatactgagttcccgggtgtagttctacgtcctgttggttctttcaagaatatcagtgattataactaccaaactttgaaagataacgtggatatgttgaagttgatccaattagggctcactttctcggatgagaatggcaaccttccctcttgtggaactgacagctcttgcatttggcaattcaatttctgcgagttcaatataagcgaagatatctttgctagtgattccattgagttgttgcgccagtgcgggattgattttaagaagaacaatgagaagggtattgacgtgaagcggttcggcgagcttctgatgtcttccgggattgtgctgaatgatggtgtgcattgggtaacttttcatagtggatatgactttgggtatttgctaaagctattgacttgcaggagtttgcccgataatcaagcgcgattctttgatttgatcaatatgtattttcccatgttgtacgatatcaagcatatgatgaagttttgcaatagcctgcatggtggtttgaacaagcttgctgagttgttggaagtggaaagagttggtgtgtgtcatcaagctggctcggatagtttgctcacatcgtgcacgtttaggaagttgagagataactttttcaatggctccactgagaaatatgcaggtgtactgtatggcctaggggtcgaaagtggacagactactaattagaaagaagaaataataattgggaaaaggttgatgaatgtagactacttgagtgtgagactttataattttcattgtatacattggcaaaaatgattgttaatttagttgtgagcttatctcctttgcttgcattataactgaaaccttaactggttttctattctagttctagttgaaagtcatgtataaattatgcagttagtgtttcaataataatttgaaccattggcatctcacttga

SEQ ID NO: 2463 - DNA, 1757 bp, Arachis hypogaea
ggtatcaacgcagagtgcggggaagttgtaaacgacaccccccgtgcagttgttggtaaccaaacgaccccacccctcttctctctcacacgcattacatatcagggtctcaaccctcgcccttgcgctcctcttccctgaccatttcttcttcttatcgcctcctccgttgacctgtcacttcccatcctccgaacctaaaatctccgattcaaactttcagatccgccaacctcaaccttcgttcacgcaacttcaagatctagttgaatctccaccggcaactcacgatttgcagctctttccgctgaaatccccttcagatctgggtttgtcttccattttcatcgatctgttagggttttctagttggacatgtcgattttaccgaaaggcgattcggttcaaatcagggaggtatggaacgataacctagaggaggagttcgctttgatccgtgaaatcgttgacgaatacaactatgtcgccatggatacagagttccccggtgttgttcttcgtcccgttgggaacttcaagaatatcaatgactacaactaccagaccttgaaggacaacgttgacatgttgaagctgatccaattaggtctcactttctctgacgagcacggcaacctccccacctgtggcactgagagctcctgcatctggcaattcaacttccgtgagttcaacatcagcgaggacatcttcgccagcgattcgatcgagcttctgcgccaatgtggcattgatttcaagaagaacaacgaaaaaggtattgatgtgaaccggttcggggagcttctcatgtcatcggggatcgtgttgaacgatagtgtgagttgggtaaccttccatagcggttacgacttcggttacctcctcaagctgttgacgtgccgaagcttgccggatacgcaggcagggttctttgaactgatcaagatgtatttcccgatgttgtatgatatcaagcatttgatgaagttctgcaacagtctccatggtgggttgaacaagctcgcggagttgttggatgttgagagagttggtgtgtgccatcaagctggatcggatagcttactcacttcttgtacatttagaaagttgagggatacatttttcagtggctccacagagaaatatgctggtgtcttgtatggtttaggtgttgagaatggacaaactaattgaaagaaagaaattataattggttgtagagtaagaagagtaagtctaagtgtgagtcctttttttttttctctttttctttcttacttgtgtacactttctgccaaaaagaatggttgttgtttacctgtaacatttctcatccttgtttggaactgtaactgaaaaaaaccttagctggttttgttagccctttgagttctttgtaaatcacttaagtttagtccttcaataataatttatgatgatgattccttttagttttagcttgtttacttgtaatcattgtgaccctgattttttctaagtctctgttcctcattgcaagaatcagaacagtctgaactctgaacatgtaaatccaaaatttgtcgcagtaaagtgatgtctagtcatgtgtcggaggaatctttctttatatcaaagatgaagtattcattatttttactttattgtcctttaggttatgctctgcattctgcaattgtgtggttcggtgtgtaagctataataagctacacggatttggcgatgtggtggaagcacagcatgctacgcacccc

SEQ ID NO: 2464 - DNA, 1869 bp, Cannabis sativa
aatcacgaaaaggaaattagaaatcaccacctccaattatttattttttttatttctaaaaaaaaaaaaaaaatctgattccattttccaccttcgcctgaaaaccctacaaatacatcttcttcttcttcctccctgtctacacccatgttgccctaattacgatcctctcggttctcaatgctcagattttccctcatctgagatctcctcgaatcgattgggttcgtttcgtggattctgggttttcatttccgtgggttctatcaaggaatgtcgctcttgccgaaatccgattcgattcatattcgcgaggtttgggatggaaatctagaggacgagttcgctttaattcgagaaatcgtggatgagtatccttacgttgctatggatacggagtttcccggaatcgttctccgtccagtgggaaatttcaagaacagttacgacttccattaccagactttgaaggacaacgttgatatgttgaagttaattcaattgggtttaacattttccgacgaagatggtaacttacccacttgcggaacagataagtattgcatttggcaattcaatttccgcgaattcaatgtcaatgaagatgttttcgccaacgattcgatcgagcttttgcgccaaagcggtattgatttcatgaagaacaacgaaaatggcattgatgttaagcgatttggggagcttctaatgtcatctgggattgtattgaatgacaatgttcattgggtaacttttcatagtgggtatgattttgggtacttgcttaagctcttaacttgccaggatttaccagaaacccaattagggttcttcaacttaatcaacatgtacttcccaacagtttatgatatcaaacacttgatgaagttctgtaacagccttcatggtggattgaacaagctagctgagttgttggaagtggaaagagttggcatatgtcatcaggcaggttcggatagtttgcttacttcttgtacattcaggaaacttaaagagaacttctttagtggttctatgacgaaatatgctggtgttttgtatggattaggagttgagaatggacagaatattactcagccttactgaatttgtgtgtgaaaaaccaaaaaacagaaaaacaaaaaatctttataagattagaaagcctgtgaattcattttcatatttctttgcttctccctcatatatccatgtttactaatctctgctttatttatgagaaaaaaaaagttatacttctactatttactgctactattataacctttgattgatgtttttgttgagcttattatttgctcataatctcattaaattagctaaatttgatacctacttgtatagtttgttggtggcttgtctaattaacaattgcatgattagcattatgattttgctttgataatttgtgtgtagtttttatcttttgtggaaggtctgtttattgatggaaaaatagtgggaaaatatgttattttaagtctttcctaacaagagattgaagttattactttcatttttcatgtcttccatggattcatttgtatcattttgtttcctaatatgctacttctatggcttgtgtaattgacaactgcataggtttatgattttgcttggataatttctttgtaatctttatattctgtccaagttttattgattggtggaaaatgagggaaaattctgaagaaaatgaagctaattctttcatttttcgtttttttatcattttatctcgtattttgcttcttcaacagttgaattatcatggaaaattctcgtatttttgtttgtgttctgttttcagcgaaatgttacagatagtataatttttctatgacaata

SEQ ID NO: 2465 - DNA, 1276 bp, Amborella trichopoda
  misc_feature (1090)..(1090): n is a, c, g, or t
  misc_feature (1194)..(1194): n is a, c, g, or t
gaatccatgcaatctctctctctaaaagctctccttacaaagccccgtctcatcttctccaccgcctccgtctctctctaaaaaaaaaccctagatccagagatcgccgcgccaaccctagtttcagggctctcgttcgcggttgatctcgcttctcacctctcagatctacttctctgcgactcttcgcccccgttcggcctcttttctcccatatttctctgtttttcgctgcaccagaagagctagggcttcagcttccgccagatccgttagggtttcggatgttttcccgtcccttttgggttttcctctctgttttgacgaagggtttcactggtgagaccgcttggaactaccctgatttatagggtttctttctctgcaactgcttaagaaaaatgtcgatcttgcccaaaaacgagacgatcctgattagagaggtatggggcgataacctagaggatgagtttgcgctgattcgtgaaatagttgatgattacccctacatcgctatggatacagagtttccaggcattgttcttcgccctgttggtaatttcaagaacagttcagattttcattacaaaaccctaaaagcaaacgtggacatgctcaaactgatccagttagggttaactttctctgatgaagacggcaatctcccaacttgtggaaccgataagttctatatctggcaattcaatttcagggaattcaatgtccttgaagatgtttatgcgaatgattctatagaattgctcaggcaaagcgggatcgattttaagaagaacaacgagaaggggattgatgcccaaaggtttggagagcttctcatgtcatctggcatagttttgaatgatacagttcattgggtcacttttcacagtggttacgattttgggtatttgctaaagctcttgacttgccagaatttgcctgaaactcaagctgggttctttggcttgatcaatatgtatttccccactgtgtatgatatcaagcatctgatgaagttttgcaatagccttcatggtggattgaacaagcttgctgaattgctcgatgtggagaggattggaatttgccnccaagctggatcagatagtttgctcacctcttgtaccttcaggaagttgaaggagtcgttctttaatggatcgactgagaaatatgctggtgttttgtatggtntaggggttgagaatggaaacagtattaactgagtaaaggatgtgaaaaaataataagaaaatgaatagaaagactgttgatt

SEQ ID NO: 2466 - DNA, 1178 bp, Cajanus cajan
ttgcatatgcagctccttccccttctttcgcccacttgcgcttttgataacaaaagaaaaaagaaaaccctaacacgggagagattttcattcccccacaaatctcttccctctctctcctcctcctcaacttccttccccgacccagatccggtggagtgattgcaaggaatgccgctgattttggcgaaaagcgactcgatcgagattcgcgaggtgtggaacgataacctggaagaggagttcgcgttgatccgggaaatcgtggacgattacccgtacatcgcgatggacacggagtttccgggaatcgttctccgaccggtggggaatttcaagaacagctacgactaccattaccaaaccctaaaggacaacgtggacatgctcaagctcatccaattgggcctcaccttctccgacgagcacggcaacctccccacgtgcggccccgcccacacgtgctgcatctggcaattcaacttccgcgagttcaacgtcaacgaggacgtcttcgccaacgactccatcgagcttctccgccagagcggcatcgatttcaccaagaacaaccaaaacggcatcgacgcccgtcgtttcggggagctcctcatgtcctccggcatcgttttgaacgacaacgtccattgggtaacgttccacagcggctacgatttcggctacttgctcaagcttttgacttgtcagaatttgcctgatacgcaagtcgggttcttcaacttgatcaacatgtacttccccaccgtctacgacatcaagcaccttatgaagttctgcaatagcctccatggcggcttgaacaagctcgccgagctcttggaggttgagagggttgggatttgccaccaggctggttccgacagtttgctcacttcatgtacattcaggaaattgaaggacaatttctttagtggctccttggagaagtatgccggcgtcttgtatgggttaggtgttgagaatggacagggttcttattgaaaaattaaaattaaaaaatctaaaataaaaacaaacaaaaaagatacaacttaaattagtccacaaaaaaagtgtttaaaaactttggtagattatccctctttgtttccactgctgtatatttcggtgaaataccaacttttattaatgtaaacctttggcattaagggtctttc

SEQ ID NO: 2467 - DNA, 1365 bp, Populus trichocarpa
cccagttctcttacaagacatcatagtgagttaacccgcctctctctcttaaaatctttatctggccaaaaaattctctctaaatcaaacccacgaatcacaaatcaccacttcaagatctgttcactacaacctctgatttcacacatgaaagatctgggttgtttgtgaaaggactgcgttttgtgactgaatttaagcaggcccttttcaggttttgaggtttcgaagtgtttatgtttgtgtgtttttgggatctggattcgtttaagtttggaactttctaggattttttaactggtttttttttttatggaaatgtcaattgcaccgccgaaagaagactctattcaaattagagaggtttggaatgataatctcgaagaggaatttgccttgattcgtgaaattgtcgatcagtttaatcacgtagctatggataccgagttccctggcgtggttttgcgccctgtcgggaattttaagaatattagtgattataattatcagactttgaaagataatgttgatatgttgaaattgatccaattgggtctaacgttctcggatgagaatgggaatttaccaacttgtgggacggataagttttgcatttggcaatttaattttcgtgagtttaatgtgactgaagacatctttgccagtgattcaattgaattgttgcgccaatgtgggattgattttaagaagaacagtgaaatgggtattgatgtgaatcggtttggtgagcttctgatgtcatctgggattgttttgaatgatggtgtgaactgggttacttttcatagtggatatgattttgggtatttgctcaagcttttgacttgcaggagtttgcctgactcacaagcaggattctttgacttgatcaatatgtattttccaatggtgtatgatatcaagcatttgatgaagttttgcaatagcctgcatggtggattgaacaagcttgcagagttgttggaggtggaaagaattggtgtgtgccatcaagctggctctgatagtttgcttacatcatccacatttaagaagttgaaggataactttttcagtggctccactgagaagtatgctggtgttttgtacggtcttggtgtcgagaatggacagaatactaattgaagtaaagaaaataattggttaaaagattgatcaatatttgtagactacgtgtgagactttctattttctttgtatactttggcaagaaagattgttgttctagtgttgaattctttcaatagctttccttgtaaccgaaaccttgactgctttgtagcttggttctttgtaaattattgcagttagtgcttctataataatcctagttttttcacaact

SEQ ID NO: 2468 - DNA, 1424 bp, Populus trichocarpa
actttcgagcaattcactttcctttttattgcaatgtcctctccgctctccctctctcctcggttctattacaagacgccctcgcagtaaaccctcctgtctctctccctctcgaaatcttatttgacccaaaatcctctctctaaatcaaagtacaaatcactaaccaccacttcaagatctgttcactgcaactcttgattccacacatcaaagatctgggttgtttctgatagaacagcgttttgggactgaagtaagcagacccttttcaagttcttaggttctatagtatttatgcttgtgttttttgggatccgggattggtaaagtctggaactttttgggttttttgtgaactgttatttatggaaatgtcaattgcaccaccaaaggaagagtccattcaaattagagaggtctggaatgataatcttgaagaggagtttgcgttgattcgtgaaattgttgatcagtttaattttgtagctatggatactgagttccctggcgtggttttgcgccctgttgggaattttaagaatattaatgattataattaccagactttgaaggataatgttgatatgttgaaattgatccaattgggtcttacgttctcggatgagaatgggaatttgccaacttgtgggacggataagttttgcatttggcaatttaatttccgtgagtttaatgtgaccaaagatatctttgccagcgattcaattgagctgttgcgtcaatgcgggattgattttaagatgaataatgaaaagggtattgatgtgaatcagtttggtgagctcttaatgtcatcggggattgttttgaatgatggtgtgcactgggttacttttcatagcgggtatgattttgggtacttgcttaagcttttgacttgcaggagcttgcctgacacaccagcaggattctttgacttgatcaatatgtattttccagtggtttatgatatcaagcatttgatgaagttttgcaatagcctgcatggcgggttgaacaagcttgcggagttgttggaggtggaaagaattggtgtgtgccatcaagctggctctgatagtttgctcacatcctgcacatttaggaagttgagggataactttttcaatggctccgccgagaagtatgctggtgttttgtacggtcttggtgtcgagaatggacagaatactagctgaagaaaataaaataatcaggataaaagattgatcaatatttgtagactactagagtgtgagactttcttttccctttgtattctttggcaagaaagattgttgttctagtgttgacttctctcaattgcttccttgtaaccgaaaccttgactagtttgtagcttggctctttgtaaattattgcaatcaatgtttcaataatagacctagttttttcacaaa

SEQ ID NO: 2469 - DNA, 1136 bp, Vinca minor
gaccagattcggtgctccacttttatttagcccttctctctcgttgacccaataatcattccttcgatcttcacatcaagttttgttttttcggatcctttttgtgattttagcttctgggtttgttagattttaagtgtttgtgttccaaaaagacgagaattttgggatgtctgatttggagaaaggcgattcaattcatattagggaggtttggaatcataatcttgaagaagaatttggtctgattcgagaactggttgacaattatccatatgtggctatggacactgagtttccaggtgttgttcttcgcccggtcggaactttcaagaacatcaatgactataattatcagactttaaaggataatgttgatatgttgaagttgatccagttgggcctcacgttttccgatgaagatgggaatttgccaatttgtggtgggtctgatgtgggttgtatttggcagttcaattttcgcgagtttgatgttaatgaagatatgtttgctaatgattcaatcgagttacttaagcagtccggaattgatttccagaagaataatgatatgggaatcgatgttaaccgtttttcggagcttctgatgtcttctgggattgttatgaatgattctgtccattgggtcactttccatagtgcatatgattttggatacttgctcaagatcttgacctgcaagaacctacccgaaacacaagccggattctttgatcttattaaaatatatttcccaattgtatatgatatcaagcatttgatgaagttctgcaacagccttcatggtggactcaacaagctagctgagctcttggaagttgagcgattcggaatttgtcatcaggcaggttctgatagtttgctcacttcttgtactttcaagaagttgaaagacagtttctttaatggctccactgacaagtatgctggtgttttatatggtcttggtgttgaatatggttccgataaataaattagttatatgtaatgtattcttgttgttgttgttgttgttgttgttgtctgctaagtcttactagcttgttaggtagacatggatgtcgaacttggttgtgtacacaattgcataaaaattgctaatttatgaatatttc

SEQ ID NO: 2470 - DNA, 2130 bp, Solanum phureja
aagaagcaacacaagtcttttactttttaacatttcaacaaaaactacaagtgtctctaatgcttcccactcctcctttttcctctcacaaaccccaaaatcactcacaaaataatggctttacaacaaccatttctatctgaattactccactcatcttcaaagaggacaacacttccaaaaagttcacttttttctctacaaatacctcaaagattcaatttttatcttcaaaataagcaattcaagaaacaaggaagaagttgttatgcaattgctgagaatcttggagctgaagtacttgatgaagatcaaagtgtgattttggaaaattcaagtttagatgaattgaggggacaaagggaaattgttggttatgattggactgaagaatggtatcctttgtatttgactaagaatgtacctgatgatgcacctttaggtcttactgtctttgataaacaagttgttttgtataaagatggaagtggtgaacttagatgctttgaagacagatgcccacataggttggccaaactctctgaaggacaactgtatgatggcaaactggaatgcttgtatcatggttggcagtttgacggagatggtaaatgtgtcaagataccacagctacctgaaaatgctaaaattcctcgatcagcttgtacgaagacatatgaaattcgggattcccaaggagtagtctggatatggatgtctcacagaacaccacctaatgttaacaaaatcccctggtttgaaaactttgacaggaaaggatttcgagacatttctactattcatgagctcccttatgatcactctattcttcttgaaaatctcatggatcctgctcatgtcccgatatcacacgataggacagattttacagcaaaaagggaagatgctggaccactgtttttcgaggtgacagaaaggactaaccgggggtttgcagggtggtggggtaaggaaaaagatcaaggcaaagcaaactatactccgaacttcttacgttttgaatctccttgtgttcttcagaataatagagaaattgttgatgagagtggggagaagcattacttttcaggtcttttcctttgtagaccatctggtcaagggaaatccatgcttattgtccggtttgggaatacaagaaaacgaacggggatacttaaatttatcccaaactggttcttgcaccagaatgcaagcaaggttttcgagcaagatatggggttcctttcgtcccaaaacgaaatcctgatgaaggaaaaggttccaacaaagaaactatacttgaaccttaagtcgtcggatacttgggtagctgaatacaggaagtggatggacaaagtggggcacggaatgccttatcatttcggtcacagcaccattttcctgccccaacaacctgctgtcgtagagcacgcccctgctggtttcgttgccaatttttcagctgctcagccagctaaaggaggaattggtgatatgtatgctccgaaccccgccaacaggtacttcaggcatgttgtacattgcagggattgcagcaatgttgttaaagcttttgagacttggaaaaaggccctctctgttatcgctctcgtgtcaactgcattcgcgattctagtgtctggaagacaatggaaggccttacttttgctttggacgtcgctatgtttagctggtgcatatgcttgttcaacagccattgcaatgaacacaaccaacttcataaggactcacagaagattgtaaaagaaattgaatgtccgcgggatgttggtgcaactatctacctggacgaggtgcgtgaaagttggtctagacactaagttctggatgattgcttagctttgatgggaagagttactcggtatatgtgtcgctgggagataataagtactcaatgaaaagtcgagatgtgtgcaagttgacgtgatcatttgttctcttgtaataaggttttgccatgatttaactatgttcctctatttccattgtccatgagagctcatgggattgctaatatttggtatgtagaagtatctaaatatgtatgccaattaacacatacaacactgaaatagatcataagaattaagtgataaatttgttcattat

SEQ ID NO: 2471 - DNA, 695 bp, Solanum tuberosum
ttagctatatcacacatcaaaagttgtcatggcctcatcaaaaaatttcttgattttcattttggctgcattaattgcaacccctgttgcagtagcccaattgggaggacttctgggtggcattcttggcacaataagtatagatggggttctattttgtagccttaacggcaaaatagatgtcctcaatggagccaccaccccaattttccctaatgcatcggtgcaattgcggtgtggaggtggaaatgtagtatcaagtacaacaacaaatggatcaggagcgttttcgctcttgttgaatcctgtacaaaatatattagtatcatcattgttgtctaactgcaacatagtggttacaactccgctctcaacatgtaatgctaccttaccatccgttggggttctgcaggcacctttgcagattgttgggagagctgctggacttcttaatatagttactggtgcttttcaacttattaactaaatggtactcgtttaattacgtcttgtttaattaattaatattgtcaatttgcataaataaggattaatgttgtttgtgtccactgtaattgtttgaatgttttgctttcttgttggagtgtttgtcattatacaagtgcaaataatatttgcagctaagtgtaatattatatatattgaagaaatctactcgtattgtttgggttttt

SEQ ID NO: 2472 - DNA, 674 bp, Solanum phureja
ttctcacaacaacaacttaattaattagctatatcacacataagaagttgtcatggcctcatcaaaaattttcttgattttcattttggctgcattaatagcaacccctgttgcagtagcccaattaggaggacttctgggtggccttcttggcccaataagtatagatggggttctattttgtagccttaacggcaaaatagatgtcctcaatggagccaccaccccaattttccctaatgcatcggtgcaattgcggtgtggagcaggaaatgtagtatcaagtacaacaacaaatggatcaggagcgttttcgttggtgttgaatccagtacaaaatatattatcatcattgttgtctaactgcaacatagtggttacaactccgctctcaacatgtaacgctagcttaccatccgttggggttctgcaggcacctttgcagattgttgggagaaccactggtggacttgtcaatttagttactggtgtttttcaacttattcccctactcaattaatgatgcatcagctagttaatgttccagctgattgcataaataaggattaatgttgtttgtgtccactgtaattgtttgaatgttggagtgtttgtcattatacaattgtgcaaataatatttgcagttaagtgtaatatcatcatatacattca

SEQ ID NO: 2473 - DNA, 568 bp, Ocimum basilicum
gcacgccgttctctctctcatctgtgtgtgtagaaagtcgcagaaatggcatctttcggggaagcaccaccaggtaaccctaaagccggagaaaagatcttcaagacaaagtgtgctcaatgtcacaccgtcgataaaggagctggtcacaaacaaggacccaacttgaatgggctctttggaagacaatctggtacaactgcaggttactcatactccaatgcaaacaaaaatatggctgtgaactggggagagaacacattatatgactacttgctcaacccgaagaagtatattcctgggacaaaaatggttttccctgggttgaagaagccacaggagcgggcggatctcattgcttatctgaaggaagcaactgcgtgaagatctctttggaacattaaaatacttttgctagtggtcaggagtcgtccattggtagcatttctcaatttatatttggaaggcatattttgcccgttttaaataaaaaccacatacagtgttatgccattcttctggttgagctaagccagtcttgaaggaattttgtccaaaaggttttatc

SEQ ID NO: 2474 - DNA, 783 bp, Solanum melongena
ttcaaaaagaactctctagaattgtctataaaagaaaaccctcacgcttgaaagaagcttcgctattttatttcgcctccttctggttctcctttttcaccgtcaaatctctctctaatattcatttgcgtcggaaaaatggcatcgttcgcggaagcaccaccaggtaaccctaaagccggagagaagatcttcaagaccaagtgcgctcagtgtcataccgtcgacaaaggagctggtcacaaacaaggacccaacttgaacgggctctttggaagacaatctggtacaactgcaggttactcatactctgctgcaaacaaaaacatggctgttacctggggagagaatacattatatgactacttgctcaatcctaagaagtatattcctggaacaaagatggtgttccctgggttgaagaagccacaggagcgggcagatctcatagcttatctcaaggaagcaactgcatgaagatctttttggaacattataatacttttgctagcggtcaggagattttctattggtagcatttcacattttatattttgaaaggcatattttgcccgtttaaataaaaaccacatacagtgtcatgccattcttctggttgaagctataagccagtctttgaggaattttgtctgagaattttgtcatttattgccacacaagatgttgacgtacttattgaatgcctgtttcggctctttgttatccaattttgttgtgtctatctgtgaccagttgcttttttcttggtataaataaggtttc

SEQ ID NO: 2475 - DNA, 639 bp, Solanum tuberosum
ctctctctctctctcatctgcgtgtgtagaaagtcggagaaatggcatctttcggggaagcaccaccaggtaatccaaaagccggagaaaagatcttcaagaccaagtgcgctcaatgtcacacagtcgataaaggagctggtcacaaacaaggacccaacttgaatgggctctttggaagacaatctggtacaactgcaggttactcatactccaatgcaaacaaaaacatggctgtgacctggggagagaatacattatatgactacttgctcaaccctaagaagtatattcctgggacaaaaatggttttccctgggttgaagaagccacaggatcgggcagatctcattgcttatctcaaggaagcaactgcgtgaagatgatctttttggaacattataatacttttgctagtggtcaggagtcgtccattggtagcatttctcattttatattttggaaggcatattttgcccgtttaaataaaaccaaatacagtgtcatgccattcttctggttgagctaagccagtcttgaaggaattttgtccaagagtttgtcatttattgtcacataaaatcttgacctacttatgaatgcctgatttatttctttcttatcccagtttaaaaaaaa

SEQ ID NO: 2476 - DNA, 685 bp, Solanum phureja
tcacatttgaagaagaatttcccttttttatttctctctgccaaacccctctctctctctctctctctctcatctgcgtgtgtagaaagtcggagaaatggcgtctttcggggaagcaccaccaggtaatcctaaagccggagaaaagatcttcaagaccaagtgtgctcaatgtcataccgtcgataaaggagctggtcacaaacaaggacccaacttgaatgggctctttggaagacaatctggtacaactgctggttactcatactccaatgcaaacaaaaacatggctgtgacctggggagagaatacattatatgactacttgctcaaccctaagaagtatattcctgggacaaaaatggttttccctgggttgaagaagccacaggatcgggcagatctcattgcttatctcaaggaagcaactgcgtgaagatctttttggaacattataatacttttgctagtggtcaggagtcgtccattggtagcatttctcattttatattttgaaaggcatattttgcccgtttaaataaaaccacatacagtgtcatgccattcttctggttgagctaagccagtcttgaaggaattttgtccaagagtttgtcatttattgtcacataaaatcttgacctacttatgaatgcctgatttatttctttctcatccagtttaa

SEQ ID NO: 2477 - DNA, 733 bp, Capsicum annuum
gaaccattctcctatttgtcgccgccaaacttttcattgttattcgtgtgtattgtaagccgtagaaatggcatcgttcggagaagcgccaccaggtaatcctaaagccggagaaaagatcttcaaaactaagtgcgctcaatgtcacaccgtcgataaaggagctggtcacaaacaaggacccaacttgaacgggctctttggaagacaatctggtacaactccaggttattcgtactctgctgcaaacaaaaacatggctgtgaactggggagaggatacattatatgactacttgctcaaccctaagaagtacattcccgggacaaagatggttttccctggtttgaagaagccacaggagcgggcagatctcatagcgtatctcaaggaagcaactgcatgaagatcttgttggaaaagttataatagttttgctagtggtcaggagttgtccattggtagctttcacatttttatattttgcaaggcaatactttgtctgtttaaataaaaccacatacggtgtcatcaattcttctggttgaactaagccagtcttaggggaattttgtcgagagagtttgtcattgattgccacataaaatctttacgctttatgtgactgactgtaccggttctttgttaaccagtttattttttggtctactaccttacggaaaatgggcttctatgagttctccgggttccacattgtggcgtctttgttgaa

SEQ ID NO: 2478 - DNA, 762 bp, Capsicum annuum
ggcacgaggcaaaaccctcccaccactctgaaccattctcctatttgtcgccgccaaacttttcattgttattcgtgtgtattgtaagccgtagaaatggcatcgttcggagaagcgccaccaggtaatcctaaagccggagaaaagatcttcaaaactaagtgcgctcaatgtcacaccgtcgataaaggagctggtcacaaacaaggacccaacttgaacgggctctttggaagacaatctggtacaactccaggttattcgtactctgctgcaaacaaaaacatggctgtgaactggggagaggatacattatatgactacttgctcaaccctaagaagtacattcccgggacaaagatggttttccctggtttgaagaagccacaggagcgggcagatctcatagcgtatctcaaggaagcaactgcatgaagatcttgttggaaaagttataatagttttgctagtggtcaggagttgtccattggtagctttcacatttttatattttgcaaggcaatactttgtctgtttaaataaaaccacatacggtgtcatcaattcttctggttgaactaagccagtcttaggggaattttgtcgagagagtttgtcattgattgccacataaaatctttacgctttatgtgactgactgtaccggttctttgttaaccagtttattttttggtctactaccttacggaaaatgggcttctatgagttctccgggttccacattgtggcgtctttgttgaa

SEQ ID NO: 2479 - DNA, 732 bp, Antirrhinum majus
ttcgaaaaaaaaaacaaaagaaaagttgtcaaattagggttttgattcgaatttttgatcgagagagaaatggcgtcgttcaacgaagcaccgccggggaattcgaaggctggtgagaagatcttcaagacgaagtgcgctcagtgccacaccgtcgataaaggcgccggtcacaagcaaggtcccaacttgaatggcctttttggaaggcaatctggcactacccctggttattcttactctgcagccaacaagagcatggcagtcaactggggagagaatactttgtatgattatttgctcaaccctaagaagtatattcccggtaccaagatggtctttcctggactgaagaagccgcaagagcgtgcagatctaattgcatatctcaaggaagcaactgcctgaaggcgctgtcatcttttggaaggatcctgttacattttgtgaaagctgctgatacaagttattggtttcgtatgggggttcatttttcttttaaagagtagttacatgagacttgatttaataagatcatcctatttctatgcctctgctggttttgcagtagggaatttttgttgcctgtgacggctattggtactgattattctttacgcaacagaattcaacatgtgcccttgaagcataggtgccatttgattcgttaataaagtacatttactggctttctgagtgaaaattcacttgcaatttcttgcaaaaaaaaaa

SEQ ID NO: 2480 - DNA, 716 bp, Quercus alba
tcggggagcttattgaaaattagaaactaaaaaccctagtaacccttttgtatcagagagcaatcaaaatctgagaacaaaaaaatggcgagcttcgcagaagcaccaccgggaaatcccaaggccggcgagaaaatcttcaagaccaagtgcgctcaatgccacaccgtcgacaaaggcgctggtcacaaacaaggacctaatctaaatggtcttttcggaaggcagtctggcacaactcctgggtactcctattctgctgcaaataagaatatggctgtgaattggggagagaatacgttgtatgactacttgcttaacccaaagaagtacattcctggaacgaagatggttttccctggtttgaagaagccacaagatcgtgcagacctcatttcttatctgaaggaatcaactgcgtgatccttttagttaggttagactaatattttgtcagaagttgaagagtttggctgatggagcgaatttgaaaaattttcattgaaatagtagaaaacagtatctattttaaataaaaccatcaggggtttagtgtatttctcttggagaataggctaaaactcgaacaattttgtgcaagacccttctcgtatggcatttcaccaaatatggatgcattttttttggggggctctgatatatatactgctgtttggcattctatgataatctttgaaatcatttcttttggcttc

SEQ ID NO: 2481 - DNA, 673 bp, Eragrostis curvula
  misc_feature (28)..(28): n is a, c, g, or t
  misc_feature (30)..(30): n is a, c, g, or t
  misc_feature (34)..(34): n is a, c, g, or t
  misc_feature (40)..(40): n is a, c, g, or t
  misc_feature (63)..(63): n is a, c, g, or t
  misc_feature (69)..(72): n is a, c, g, or t
  misc_feature (75)..(75): n is a, c, g, or t
  misc_feature (181)..(181): n is a, c, g, or t
  misc_feature (196)..(196): n is a, c, g, or t
  misc_feature (199)..(199): n is a, c, g, or t
  misc_feature (203)..(203): n is a, c, g, or t
  misc_feature (229)..(229): n is a, c, g, or t
  misc_feature (431)..(431): n is a, c, g, or t
  misc_feature (455)..(456): n is a, c, g, or t
  misc_feature (478)..(478): n is a, c, g, or t
  misc_feature (481)..(481): n is a, c, g, or t
  misc_feature (489)..(489): n is a, c, g, or t
  misc_feature (498)..(498): n is a, c, g, or t
  misc_feature (518)..(518): n is a, c, g, or t
  misc_feature (529)..(529): n is a, c, g, or t
  misc_feature (542)..(542): n is a, c, g, or t
  misc_feature (558)..(558): n is a, c, g, or t
  misc_feature (563)..(563): n is a, c, g, or t
  misc_feature (588)..(588): n is a, c, g, or t
  misc_feature (611)..(611): n is a, c, g, or t
  misc_feature (625)..(626): n is a, c, g, or t
  misc_feature (630)..(630): n is a, c, g, or t
  misc_feature (645)..(645): n is a, c, g, or t
gaaagagcgtaccaaaagttgcagttcncntccncttccncccctccttcggcggcggctcanatctcnnnntgnggcggcgatggcgtcgttctctgaggcgccccccgggaaccccaaggccggagagaagatcttcaagaccaagtgcgcgcagtgccacaccgtcgacaagggcgcnggccacaagcaaggnccnaacntgaatggtcttttcggcaggcagtcnggtaccactgctggctactcctactctgcggcaaacaagaacatggctgtgatctgggaggagaacactttgtacgactacctgcttaaccctaagaagtacattcctggaaccaagatggtcttccctggtctgaagaagccccaggagcgtgctgatctcatcgcctacctgaaggaagccacctcgtcttaaacaagangatgtgccgcaagtttttatatcnngaggagacaattcgattttacntantaaagagntgtagacanttgggatattctggttgaanggggttcaatncactagacttatnctgagtatttctttgntatgntttcaaatgtttaggtgtttagtgnaacaaacaagtcaaaacttgatnactgttgtttcaanngctngaaaatcccagcgcncatatttttgaccaccgggtggtggaac

SEQ ID NO: 2482 - DNA, 1095 bp, Amorphophallus konjac
gctttcgggtgaagcgtgcgtgggctctggcgagcgcttcctcggtgccggcgctgagacgagagagtacgggagaagagcggaaaccctaaccctagtttcagtcaggtaatggcgtccttcgcggaggcacctccgggcgatccgaaggccggggagaagatctttaagacgaagtgcgcgcaatgccacaccgtggacaagggagctggccacaagcaaggaccaaacttgaatggccttttcgggagacaatctggtacaactcctggttactcctactccactgctaacaagaacatggcagtgacatggggagagtcgacattatatgattatcttcttaatccgaagaagtatattccgggtaccaagatggtgttcccaggattgaagaagccacaggagcgggccgatctcatcgcctacctcaaggaatcaaccgcatagatagtatggtggggaagaaaagcagttcctcctttctttcgaaagcctgttcttttattagcagtctcgcgagcgcagttttttttctccctggcgcacgtaataaaataaaacctgttgaaaaggggttgtcttttgcagaccgacgggcagtagagagagagcctccaataccaccacttcgttttgctttgagatctcagtttactctctgggaaaatgttatctgttcccattactctataaacattcattcaattcgatggccctcgccagctgtttttttctttttttttgggtacttggggatttcgccatcgctctgttttatcccctaggggttgcctcgcaaaattgatcattctcctcttcatccctcggtacgaatgttttattatcatcatctataatgtatccaacaagctctctttgtttacggaagagagagatgccacataaggcgaccgattatcaagcaaggaagaagcgactggttttagagtcaatagtctaagggcactcttgagaagatgtgtgacaagaaatgaattttgatgtgagagattataaaatatttgaatcttattctaatgattagaatctatttcttatttttaaaatcttatcaaaatgagtttttaaatt

SEQ ID NO: 2483 - DNA, 746 bp, Petunia hybrida
cgggggacgaatttgtcttgacagttcccaaatcacatgctataaagccgctttcttcttcttgttacattcctttgaacgccacaaatattttctaaaaaaaaaacctatagccttgttcttctttcttctttaaagaaaggtcaaaaaatggcatcatttactgaagcaccaccaggcaatgaaaaggcaggagagaaaatcttcaaaactaagtgtgctcaatgtcatactgttgataagggtgctggtcataaacaaggacctaatctgagcggactttttggaaggcagtctggaacaactgctggttactcctactctactgccaataagaacatggctgtgacttggggagaaaacactttgtatgattatttgctcaaccccaagaagtacatccctggaacaaagatggttttccctggattgaagaagccacaggagcgtgcagacctcattgcctacctgaaatccgctactgcataagaaattattgatagtcaatttccattttgtagtccgataggcatgttttgctgttgcggaggaagataaaccattgattttttctataataattagacctactctggtcagactcttttgtttcccagagcactcgttcatagtaaattttttgttacctcttggacaagaggtgaaatatacttttggctaaaaggccaattttgacatattatactagtatcttttaagtactatcactattctcatgtttattt

SEQ ID NO: 2484 - DNA, 739 bp, Lippia dulcis
cacaggaagttgttaacaaacgctagaagcttcttcttcaccttatttctgccttctttccttcattcccggctcaaatctgtgaaaaccctagcatcaaatttctcattaggttttgtttcgttttaattcaatggcgtctttcgatgaagctccccctggcaatagcaaggccggcgaaaagatcttcaagaccaagtgcgcccagtgccacaccgtcgataaaggcgccggccacaaacaaggtcccaatttgaatggactcttcggaagacagtctggtaccgctgctggttattcttactcagccgccaacaagaacaaggctgtgaactgggaggagaacacactttacgattacttgctgaatcctaagaagtacattcctggaacgaaaatggtcttccccggattgaagaaacctcaagagcgtgcagatctaattgcatatctcaaggaggctactgcttgaagaaactttcttgatagttggagatacatttctacattttctcagacctttggagatacatttgtgattgctcctgttggggattttgttttccagtcggaaatagtagaatgaataagagaatcatatgtctactcttcgtttttcttaatttgtacactacagagaattttgctgccttggatgaaggcttattcttcccctagataattgaatgtgtcatgaaacatgtttaataaatttcaccttcattttttcgaaaaagaa

SEQ ID NO: 2485 - DNA, 416 bp, Solanum phureja
aacaaaacatatttggctttcttgtcctctctactttgagatcagaaaaaaaacttgttaaaaaaaatggcatcttttggtgaggcaccaccaggaaatgaaaaggcaggagagaaaatcttcaagactaaatgtgctcaatgtcatactgttgaaaaaggtgccggtcataaacaaggacccaatttgaatggactctttggaaggcagtctggaacaactgctggttactcctactctgctgccaataaaaacatggcagtcacttggggagaaaacactttgtatgactatttgctcaaccccaagaagtacatacctggaacaaagatggtttttcctggattgaagaagccacaggagcgtgcagacctcattgcgtacctgaaatctgctactgcctgaggaaaatgaca

SEQ ID NO: 2486 - DNA, 734 bp, Amorphophallus konjac
gggggtcgttcggccggtttgccagtttcctattagccgtgcgcatccgtggcatcgtcttgggagacggaaccctaaccccagttctcgctctcggaagtagatggcgtcgttcgcggaagcacccccaggcaatccgaaggccggggagaagatcttcaagacgaagtgcgcccaatgccacacggtggagaaaggagctggacacaagcaaggcccaaacctgaatggccttttcgggaggcaatctggtacaactccgggttactcatactctacctctaacaagaacatggcagtgatatggggagaacctacactgtatgattatcttcttaaccccaagaagtatattcctggtacaaagatggttttccccggattgaagaagccacaggagcgtgcagatctcattgcctacctcaaggagtcaacagcataagtttttatttgtgccttaaatttgcagtacaattattatttttcttctagcgcaataagtgttttggacctcactgcaactcgcgagctatcgggcatctaaaacttattcacaagttttgttgcattacatgtacgtagtatcaatttgatgacactattacgcgtgtcaaggcttttcattgtctcaaagcaaggaatgaaatttttggaaacatcctcgtaaattgaactttcgatgtgatgaacaacttcaaaaattcttgggacacctgcaaatctgttctcttctc

SEQ ID NO: 2487 - DNA, 839 bp, Setaria italica
atggtaaattggcgcgccgctcgcgtccctcgtacgcgcggtttgcactttgtttgtcccactgcggctgctgtgtcagcgtgtcgtctcctcgctcaaacgagcacacgcaccgccgccgcctcaaactgcgatcgaaactctaaccctaggccaggttccccttcgtgctcggcggcgatggcgtctttctcagaggcgcccccggggaaccccgcggccggcgagaagatcttcaagaccaagtgcgcgcagtgccacaccgtcgacaagggcgccggccacaagcaagggcctaacttgaatggtctgtttgggaggcagtctggtacaactcctggttactcttactcctcggctaacaagaacatggctgtgatttgggaggagaacactttgtatgactacctgcttaatcctaagaagtacattcctggaaccaagatggtgttccctggactgaaaaagccacaggaacgtgctgatctcattgcgtacctgaagaatgccaccgcttgacgagaggggactgatgtggccctaagatgaagtgcggcgattctttttgcagttaaaataatgatacaaatttactttaacttgacaggttgcgtgaatgagaaagttaaggactacaagtagttctaatggttttatttgttgggaaaaaaatcggaagagctttttattcagtggttgaaatgtcagaccaccataattcttttgacctgataatcattcaaacgccccatttgggaaggttaaagatacctatattatgtattcatgtccgtttctcatttgctgtctctgaaaaggtatcttgatttccggtcatg

SEQ ID NO: 2488 - DNA, 652 bp, Cucurbita pepo
agaaacattgcgagccctagccctcagatctgaacaacatctcattccaacgccatggccagctttgacgaagcccctcccggcaattccaaagctggagagaagattttcaagaccaaatgcgctcagtgccacactgtcgacaagggtgctggtcacaagcaaggtcccaatttgaatgggctatttggacggcaatctggcacaactgctggatactcttattctgctgccaacaagaatatggccgtgatatgggaagaaaagaccttgtatgactacttgcttaaccccaagaagtatattcctggaacaaagatggttttcccagggctgaagaaaccgcaggatcgtgccgaccttattgcttatctgaaggaagcaactgcttaattgcataatatatggttgatgcttcttccaatctacaattttttgctatcagttttccccatcatcgttaaaataagaacattgagaggagaggaaccttagatgaaaagttggaggtggtcacacacacacacactactttttttttttttcattaaaaatttcttacttcccttcctcgctacactcatttgcagagttcaccccatttgtagcttacattattgttatgtgaacataactgctacaatttttttgg

SEQ ID NO: 2489 - DNA, 797 bp, Pennisetum glaucum
gtttccattccttcgataccatcagcattggtcatgtagttacacacggaagacacacatcgcagagtacgcggggaagtccaaagggcaaaccagaagttgtagttggcctcctcttctccgtcggctccctccagatctctctctgcgtgctcgcggcggcggcgatggcgtcgttctcggaggctccccccggcaaccccaaggccggagagaagatcttcaagaccaagtgcgcgcagtgccacaccgtcgacaaaggcgccggccacaagcaaggtccaaacttgaatggcctctttgggaggcagtctggtaccactgccggctactcctactctgcaggaaacaagaacaaggctgtggtctgggaagagaacactttgtacgagtacctgcttaaccctaagaagtacattcctggaaccaagatggtcttccctgggctgaagaagcctcaggagcgtgctgatctcattgcgtacctgaaggaagccactgcatagaaagattggcatgctgaaccatgaggaggcaattcgttttacagtttaataaagaggtttagacaatttgggacaacactctggttgaacatggtgcagtccacgagacaactatttgagtattttggttcttattatggtgtcagtttcaaatgtctaggtgtttagctgaacaaaaaactctcaaactttgacatcccttgtttcgactgctggaggaatcccagcgccctatttttgaccaccgggtggtggaactggaaatctggaatgcacccattttgaaggatc

SEQ ID NO: 2490 - DNA, 787 bp, Mimulus guttatus
aaccgaccacaatacagaaaaaaagggggctcttggaggaaaaagaaatacagtgaaaggggatctgaaaaccctaacgaaaaaccagagaaatcgaaaatggcgtcgtttgatgaggcaccgcccggcgacggcaaggccggagagaagatcttcaagaccaagtgcgctcagtgtcacaccgttgataaaggcgccggccacaaacaaggtcccaacttgaacgggctttttggaaggcagtccggcaccacccctggttattcttactcgactgccaacaaaagcatggctgtaaactggggagagaatacactttatgattacttgcttaatcccaagaagtacattcctggaactaagatggtgttccccgggctgaagaaaccgaaggagcgtgcagatctgattgcatacctcaaggaggcaactgcttgaagtagttgttttgcacgtattttgttttgtggcagttggaaaatatggtgggttattggttgagtagaagattctttctttagtaaaagagagcaaaatatatacctcgtcgaataagataaaaattgttttccgttgctgtggtgtttatgtttcgacctatgccaacagtttttgagtttttgttaccctccgattattgtttcaacaatgttagagattacgttccgtttaaagacatgaataaactgcatatatcatttattggtgtttgcccagatattaacattctggtcttttggacaacctatgagcttttacttaatttgcctatttttaagtttctctt

SEQ ID NO: 2491 - DNA, 635 bp, Raphanus sativus
aaccctaagagaaccgagttccgtcttcattttctcttcctattgtctcccgcgaaaatggcgtcgtttgatgaagcaccaccagggaaccccaaggccggtgagaagatcttcaggaccaagtgcgctcagtgtcacaccgtcgacaaaggcgccggtcacaaacaaggaccaaacctaaacggtctgtttggaaggcagtctgggacaacagctggttactcttactctgctgctaacaaaaacaaagctgttgaatgggaagagaagaccttgtacgattacttgctcaaccccaagaagtacattcctggaactaagatggtcttccctgggcttaagaagccacaagaacgcgctgatctcatcgcctacttgaaggaagctactgcttagtgaaatcaaccaaccaatggtggtgtgggacatcatgaattattattcttttgacaaataaaatctccaaactccttttttgttttgcttttggaaattttctcatctttatttatatacgttttggctggaacttgggctgtttgagtaccaaatgtactccggatactttcattttctaaggttcacttatataagtaagtaagtgcatctatctagaataaacacatttcttttct

SEQ ID NO: 2492 - DNA, 639 bp, Raphanus sativus
accctaagagaacagagttccgtcttcattttctcttcctattatctcccgcgagaatggcgtcgtttgatgaagcaccaccagggaaccccaaggccggtgagaagatctttaggaccaagtgcgctcagtgtcacaccgtcgacaaaggcgccggtcacaaacaaggaccgaacctaaacggtctgtttggaaggcagtctgggacaacagctggttactcttactctgctgctaacaagaacaaagctgttgaatgggaagagaagaccttgtacgattacttgctcaacccaaagaagtacattcctggaactaagatggtcttccctgggcttaagaagccacaagaacgcgctgatctcatcgcctacttgaaggaagctactgcttagtgaaatcaaccaacaaaccaaccaatggtgggtgtgggacatcatgcatgaattattattcttttgacaaataaaatctccaaacttactttttgttttgcttttggaaattttctcatctttatttatatacgttctggctggaacttgggtgtttgagtaccaaatgtactccgaatacttacattttctaaggttcacttatataagtgcaactatctagaataaacacatttcttttcta

SEQ ID NO: 2493 - DNA, 645 bp, Raphanus sativus
ctcacagaaacctaaccctaagagaagcggagttccgtctcttgttggctatctttaacgaaaatggcgtcgtttgatgaagcaccaccagggaaccccaaggccggtgagaagatcttcaggaccaagtgcgctcagtgtcacaccgtcgacaaaggcgccggtcacaaacaaggaccaaacctaaacggtctgtttggaaggcagtctggaacaacagctggttactcttactctgctgctaacaagaacaaagctgttgaatgggaagagaagaccttgtacgattacttgctcaacccaaagaagtacattcctggaactaagatggtcttccctgggcttaagaagccacaagaacgcgctgatctcatcgcctacttgaaggaagctactgcttagtgaaatcaaccaaccaaccaaccaatggtggtgtgggacatcatgaattattattcttttgacaaataaaatctccaaactctttttttgttttgcttttggaaattttctcatctttatttatatacgttttggctggaacttggctgtttgagtacccaaatgtactccgaatactttcattttctaaggttcacttatataagtaagtgcatctatctagaataaacacgtttctttcct

SEQ ID NO: 2494 - DNA, 1038 bp, Oryza sativa
gcctttttctgcaagacacggaaaccttctggaaccgcgtggattccccgaaacgcccctgcccccacgctccacccgttcaataattctaggggtattatcgtagtttcgccacctgcccttccgccgcgctggtgtatactagggcacgcgctcctcggaatcgccacgagcccacgagccagaaaaaaaggaaaaaaagagagtcgtagttcgcctcttcttcctcctctcgttctcgcggcggcggcggagatggcgtcgttctcggaggctcccccgggcaaccccaaggccggcgagaagatcttcaagaccaagtgcgcccagtgccacaccgtcgacaagggcgccggccacaagcaaggtccaaacttgaatggtctgtttggaaggcagtcaggtaccacccctggttattcctactctacggccaacaagaacatggctgtgatctgggaggagaacacactttatgactacctgcttaatcctaagaagtacatccctggaaccaagatggtcttccctgggttgaagaagccacaggagcgtgctgatcttatttcctacctgaaggaagcaacctcttaaaaggagtggagctgtcgtaacatgagacaatcggacaattcattctacagttaaataaaaatatttagacatctgggtcgctctggttttacagggtgcaatccacgagacaattatcttgttatattttgttcttatggtttatgggttccatatcttaggtttagcaggaaaagtctttcacagcttttgctttaactgctggaaaacaccagtattttgatcaccagtcggtgagactggattgcatcccttttggaaaaatactgagatccttaaatttgtgatattttgatccattgcatttgctacggttagttctctgcctgtgatgttttcttttgtttgtgatgtttggccacgtaattgttctttggtatctcacgcatggatggacagttcggctgtcaatttatgttttgatggatgatctgtatattgatc

SEQ ID NO: 2495 - DNA, 871 bp, Oryza sativa
cacgagcccacgagccagaaaaaaaggaaaaaaagagagtcgtagttcgcctcttcttcctcctctcgttctcgcggcggcggcggagatggcgtcgttctcggaggctcccccgggcaaccccaaggccggcgagaagatcttcaagaccaagtgcgcccagtgccacaccgtcgacaagggcgccggccacaagcaaggtccaaacttgaatggtctgtttggaaggcagtcaggtaccacccctggttattcctactctacggccaacaagaacatggctgtgatctgggaggagaacacactttatgactacctgcttaatcctaagaagtacatccctggaaccaagatggtcttccctgggttgaagaagccacaggagcgtgctgatcttatttcctacctgaaggaagcaacctcttaaaaggagtggagctgtcgtaacatgagacaatcggacaattcattctacagttaaataaaaatatttagacatctgggtcgctctggttttacagggtgcaatccacgagacaattatcttgttatattttgttcttatggtttatgggttccatatcttaggtttagcaggaaaagtctttcacagcttttgctttaactgctggaaaacaccagtattttgatcaccagtcggtgagactggattgcatcccttttggaaaaatactgagatccttaaatttgtgatattttgatccattgcatttgctacggttagttctctgcctgtgatgttttcttttgtttgtgatgtttggccacgtaattgttctttggtatctcacgcatggatggacagttcggctgtcaatttatgttttgatggatgatctgtatattgatc

SEQ ID NO: 2496 - DNA, 497 bp, Sesamum indicum
cgaaaataaaaagcatttcgaaaccctagccacaagtagagtagtttcttcgttttggccgagaggatccgatatggcgtcgttcaatgaggcaccgcccggcgacgtgaaatccggtgagaagatctttaagaccaagtgcgctcagtgccacaccgtcgataaaggcgccggccacaagcaaggccccaacttgaatggcctttttggaaggcaatctggcaccacccctggttattcgtactctgctgccaacaagaacatggctgtaatttggggagagaatacactctatgattacttactcaatcctaagaagtacattcctggcactaagatggtcttccctgggctgaagaaacctcaagaacgtgcagatctaattgcttatctcaaggaggcaactgcttgaagatcatttaaagaacatattacttttcctgagagttagagacatttggtatctgttcaggcggtattctttttcccagtaaaca

SEQ ID NO: 2497 - DNA, 810 bp, Sesamum indicum
ataaataaaggcccgtctgcaaatcttctctgctttttcacctccgacgccgaaaataaaaagcatttcgaaaccctagccacaagtagagtagtttcttcgttttggccgagaggatccgatatggcgtcgttcaatgaggcaccgcccggcgacgtgaaatccggtgagaagatctttaagaccaagtgcgctcagtgccacaccgtcgataaaggcgccggccacaagcaaggccccaacttgaatggcctttttggaaggcaatctggcaccacccctggttattcgtactctgctgccaacaagaacatggctgtaatttggggagagaatacactctatgattacttactcaatcctaagaagtacattcctggcactaagatggtcttccctgggctgaagaaacctcaagaacgtgcagatctaattgcttatctcaaggaggcaactgcttgaagattatttaaagaacatattacttttcctgagagttagagacatttggtatctgttcaggcggtattttttttcccagtaaacatagctgaacgatactttgttgaataatagcgtcatattctacgccgtgatgttctctttggcctttgccagcggtagagaattttggtgccgagtataggctttgttgagacattgttttattgaaaaaacacgtaaccaagcgatcaattgtgaaatctaatggatttcgtttgccttttagtagttcaagattatttaaatttggtttgagtgtataagtactctgatatttcttcctggattttagtttgttttatgtac

SEQ ID NO: 2498 - DNA, 1190 bp, Sorghum bicolor
cgaacccccgaccaaacccaaagacgcgtcccacgaaatgccctagcacgtagcgcccgccgttcccaacggaacggaacggaacggggcgtggggcgcccacgcttcccgtccacgcgccgcccacggtttccttatcctccaagccacggaaaccttctcgaaccctcctcccctttccccattctacaccttttccacccctcggccctcagcacttctcaggggcagttccgtacttgcgcgacctccacgcctggtctatagaacagccggggtccctgcgaattcggcgcaagtccaaagggcagaccagaagttgcggttggcctcctcctcctcttctcctccgtcggctcagacttcagatctctgcgtgcggcgatggcgtcgttctcggaggctcccccaggcaaccccaaggcgggcgagaagatcttcaagaccaagtgcgcgcagtgccacacggtcgagaagggcgccggtcacaagcaaggtccaaacttgaatggtctttttgggaggcagtcgggtaccaccgcaggctactcctactctgcgggaaacaaaaacaaggctgtggtctgggaggagaacactttgtatgactacttgcttaaccctaagaagtacattcctggaactaagatggtcttccctgggctcaagaagccacaggagcgtgctgatctcattgcgtacctgaaggaagcaactgcatagtgcaatgacatgtctttgccatgaagagagaaattcgtttttgcagtttaataaagacattctagacaatttgggtcactctgtttgaacagggtgcaatccacgtttcagtattttcgttcttatggtgtcggtattgaatgcctaggtgtttagctgtgcacaaaaaaacagttaaactttgacggctcctatttcaactgctggagaaatgccagtgccctatttttgaccaccaggttgtcaaactggaaatctggatggaaatgcatccattttgaaagacctgggatgtttagatatgttctgttgatcctatgtgatggatatgctggatgaatatgctgcgctcgatgaaagtacagaattctgattgtgttgacgttgtgttacgatatttcatcttggagtttgggccgattgttttacgtagcgcctggatgtctggaccgacccacacgtctgga

SEQ ID NO: 2499 - DNA, 1414 bp, Sorghum bicolor
cgaacccccgaccaaacccaaagacgcgtcccacgaaatgccctagcacgtagcgcccgccgttcccaacggaacggaacggaacggggcgtggggcgcccacgcttcccgtccacgcgccgcccacggtttccttatcctccaagccacggaaaccttctcgaaccctcctcccctttccccattctacaccttttccacccctcggccctcagcacttctcaggggcagttccgtacttgcgcgacctccacgcctggtctatagaacagccggggtccctgcgaattcggcgcaagtccaaagggcagaccagaagttgcggttggcctcctcctcctcttctcctccgtcggctcagacttcagatctctgcgtgcggcgatggcgtcgttctcggaggctcccccaggcaaccccaaggcgggcgagaagatcttcaagaccaagtgcgcgcagtgccacacggtcgagaagggcgccggtcacaagcaaggtccaaacttgaatggtctttttgggaggcagtcgggtaccaccgcaggctactcctactctgcgggaaacaaaaacaaggctgtggtctgggaggagaacactttgtatgactacttgcttaaccctaagaagtacattcctggaactaagatggtcttccctgggctcaagaagccacaggagcgtgctgatctcattgcgtacctgaaggaagcaactgcatagtgcaatgacatgtctttgccatgaagagagaaattcgtttttgcagtttaataaagacattctagacaatttgggtcactctgtttgaacagggtgcaatccacgtttcagtattttcgttcttatggtgtcggtattgaatgcctaggtgtttagctgtgcacaaaaaaacagttaaactttgacggctcctatttcaactgctggagaaatgccagtgccctatttttgaccaccaggttgtcaaactggaaatctggatggaaatgcatccattttgaaagacctgggatgtttagatatgttctgttgatcctatgtgatggatatgctggatgaatatgctgcgctcgatgaaagtacagaattctgattgtgttgacgttgtgttacgatatttcatcttggagtttgggccgattgttttacgtagcgcctggatgtctggaccgacccacacgtctggacggccaaacctgtactcaactctctacgcacaactgcatttcgcttttgtctatgtgcgctcacaccacttggacctcatctgtgctgcctcgactgcacctggggagtcctagcttgcaccctctccctgtccacacagactcacaccttttggactctatcccatgttgcctcgactgcatccgaggagttctcgctcgcacctgctctgctgctcacgcgc

SEQ ID NO: 2500 - DNA, 406 bp, Solanum lycopersicum
caaatatcttgtttaaaaaaatggcatcgtttggtgaggcaccagcaggaaatgaaaaggcaggagagaagatcttcaagactaaatgtgctcaatgtcatactgttgaaaaaggtgccggtcataaacaaggacccaatttgaatggactttttggaaggcagtctggaacaactgctggttactcctactctgctgccaacaaaaacatggctgtcacttggggagaaaacactttgtatgactatttgctcaaccccaagaagtatatacctggtacaaagatggtttttcctggattgaagaagccacaggagcgtgcagatctcattgcctacctaaaatctgctactgcttgaggaaaataacattatttttttattatatagtttcataggcatgtttt

SEQ ID NO: 2501 - DNA, 465 bp, Solanum lycopersicum
aacaaaacatatttggctttcttgtcctctctactttgaaatcagaaaacaaatatcttgtttaaaaaaatggcatcgtttggtgaggcaccagcaggaaatgaaaaggcaggagagaagatcttcaagactaaatgtgctcaatgtcatactgttgaaaaaggtgccggtcataaacaaggacccaatttgaatggactttttggaaggcagtctggaacaactgctggttactcctactctgctgccaacaaaaacatggctgtcacttggggagaaaacactttgtatgactatttgctcaaccccaagaagtatatacctggtacaaagatggtttttcctggattgaagaagccacaggagcgtgcagatctcattgcctacctaaaatctgctactgcttgaggaaaataacattatttttttattatatagtttcataggcatgttttaccatgtggt

SEQ ID NO: 2502 - DNA, 843 bp, Musa acuminata
aagtaaagctcgagggtgtttctggcaagtcgaagctactgggtctctataaagatcggtctgcgacacgagaggcgtgttccagtggggtgtgctcgttggaaagcgttgggacgaggagggccgaagctagaaaactcttaaccccagatttagatcgagacgcctctttggcagaccgttgatggcgtcgttcgcggaagctccgccgggcgatcctaaggccggggaaaagatctttaagaccaagtgcgcgcagtgccacaccgtcgacaagggcgccggccacaaacaaggacctaatttgaatggcctttttgggagacaatctggtacaactccaggttattcttactctaccgctaacaagaatatggctgtgatctgggaggagtcaactttgtacgattacttgcttaaccctaagaagtatattcctggtaccaagatggtttttcctggtctgaagaagccacaagagcgtgcagatctcattgcttatctcaagcaatcaacggcttaagtaatttattttcctttcatactggaaacaatttttttccaccaataagataacatgttgccctgcttgtgaataagcagttgagctacgaaacattctttaaaaattcttactagtatcctttatttcatgggctcttgcctgaattatggttgttttagctgtagatgtagacagccactcttattttgatacgagttaacttaacattgtcccataattatctatactttggttttcttggtggtgcaaatttagtgtcttaaatctgatgcttctggtttcttacttggcacaaatattgtaaagctacaacttgg

SEQ ID NO: 2503 - DNA, 351 bp, Ricinus communis
aaaaatggcgacatttgagcaagcaccaccaggcgaatcaaaagccggagagaagatctttaagactaagtgcgctcaatgccacaccgtcgacaaaggcgctggccataaacaaggacctaatttgaatgggctatttggaaggcaatctggtacaaccgctggatattcttattcttcagctaacaagaacatggctgttatttggagcgagaatactctttatgactacttgctcaaccctaagaagtatattcctggaacgaagatggtgttccctggattgaagaagccacaagagcgagcagacctcattgcatatcttaaggaagcaactgcttaatctactgc

SEQ ID NO: 2504 - DNA, 556 bp, Gossypium hirsutum
caaaagcaatggcctcattcgagcaagcaccgcctggtaatgcgaaagctggggagaagatcttcaagaccaagtgtgctcagtgtcatacagtcgataaaggcgccggtcacaagcaagggccaaatttgaatgggctctttggaaggcagtctgggacaacaccgggatactcgtactccgctgctaacaaaaatatggctgtgatttggggagagaatactttgtatgactacttgcttaatcctaagaagtacattcccgggacaaagatggttttccccggattgaagaagccgcaagatcgtgccgacctgattgcatacctgaaggaatcaaccgcctgattcgtctctggttttattaatttcacctatattttggaactgtgacaaaatgaagaattttgatcaatgatgtatttttattacatggaaaaaaaaaccaattcttgaaataaagttaaaccttgaaaacaactccaaagataattggagttgaaaatgatttttgttaagactaaaatctcttgatgatgaggaatttgattatttca

SEQ ID NO: 2505 - DNA, 595 bp, Eschscholzia californica
acacaaactcgttcgctagatctagtttctctgtctacagatctgaaaatggcatcattcgatgaagctccaccaggaaaccctaaggccggagagaagatctttaagacgaagtgcgctcagtgtcatactgtcgagaaaggagctggtcacaaacaaggacccaatctaaatggtcttttcggaagacaatccggcacaactgctggttattcctactctgctgccaacaagaacatggctgtcaactgggaggagaagacattgtatgattacttgcttaaccccaagaagtatatcccaggaacaaagatggtgttcccaggattgaagaagccacaggaccgagctgatctgattgcttacctcaaggaatccacgtgctaatttttcaatttgagaatggaggagtattgctctaaaataggaaaaatataattttttagggaataaaaccttgatcttgttaaggctttccgtactctttttttctatttccagtctgaaaagtatagggagtagaagacactttgggtgactctcttttataaagaaaggcatcacccctgaaatagttgggtatgcttttatgaac

SEQ ID NO: 2506 - DNA, 1057 bp, Setaria italica
ccccccaccaactgagggacgcggcccaggaagcaccctggcacgtactagcacccggccgccgccacccgaacggggcgcctacgcccacgcttcccgtccacgcgccgcccacgctttcctttttctccaagccacggaaaccttctcgagccctccccgttccccaacctgcccctcctccgcacgccctagctctcccacgcctcaggggcagttccgtacttccgcgcacccaccgcggcctcgcccgctccgcgcctccacgcgcttggtctatagaaaaaccgggtcctcgcgatttcggcgcaagtccaaaggacaaaccagaagttgcagttggcctcctcttccttctcttctccgtcggctccagatctctctgcgtgcgtgcggcggcgatggcgtcgttctcggaggctccccccggcaaccccaaggcgggcgagaagatcttcaagaccaagtgcgcgcagtgccacaccgtcgaaaagggcgccggccacaagcaaggtccaaacttgaatggtctcttcgggaggcagtctggtaccaccgctggctactcctactccgcaggaaacaagaacaaggctgtggtctgggaggagaacactttgtacgagtacctgcttaaccctaagaagtacattcctggaaccaagatggtcttccctgggctgaagaagcctcaggagcgtgccgatctcattgcgtacctgaaggaagccaccgcatagaaagatggcatgctgaaccatgaggaggcaattcgttttacagtttaataaagaggtttagacaatttgggtcactctggttgaacatggtgcagccacgagacaattatttgagtattttggttcttattatggtgtcggtttcaaatgtctaggtgtttagctgaacaaaaaacagtcaaactttgacatctcttgtttcgactgctggaggaatcccagcgccctatttttgaccaccgggtggtggaagtggaaatctggaatgcacccattttgaaggatctgagatgttttaaagctttttcctgtcgttc

SEQ ID NO: 2507 - DNA, 487 bp, Eutrema parvulum
acagaaaccctaagaagcgagttccgtcttcattttctcttgcagtcgaaaatggcgtcgtttgatgaagcaccaccaggaaactccaaggccggtgagaagatcttcaggaccaagtgtgctcagtgtcacaccgtcgacaaaggcgccggtcataaacaaggacccaatctaaacggtctgtttggaagacagtctggtacaactgctggttactcttactctgctgctaacaagaacaaagctgtggagtgggaagagaagaccttgtacgattacttgctcaaccccaagaagtacatacctggaactaagatggtcttccctgggctaaagaagccacaagaacgtgctgatctcattgcctacttgaaggaagctactgcatagtgaatcaatggtgtgggacataatgatgaatttgagtctctcagatcggatattcttttgacaaataaaatcgcaagacttgtttgttttttttgct

SEQ ID NO: 2508 - DNA, 379 bp, Aquilegia formosa
tgtgttttttttttattgaaatggcatctttcgatgaagctccacctggaaatcctaaagcaggagagaagatcttcaagactaagtgcgctcagtgccataccgttgagaaaggagccggtcataagcaaggacctaacctgaatggcctttttgggaggcagtctggtacaactgctggttactcctattctgctgctaataagaacatggctgtgaattgggaagagaagactttgtatgattacttgcttaaccctaagaagtacattcctggaacaaagatggttttccctggattgaagaagccgcaggaacgtgctgacctcatttcctatctgaaggaatccacagcatcttgattttaccctcaaaaact

SEQ ID NO: 2509 - DNA, 767 bp, Musa acuminata
ggggaagtaaagctcgagggtgtttctggcaagtcgaaactactgggtctctataaagatccgtctgcgacattagaggcgtgttccggtggggtgtgcttgttggaaagctttagaacgaggagggccgaagttagaaaaccctaaccgcagatttagatctagaggtctctttggcagactgttgatggcatcgttcgcggaagctccgccgggcgatcctaaggccggggaaaagatctttaagaccaagtgcgcgcagtgccacaccgtcgacaagggcgccggccacaaacaaggacctaatttgaatggcctttttgggagacaatctggtacaactccaggttattcttactcttctgctaacaagaatatggctgtgatctgggaggagtcaactttgtacgattacttgcttaaccctaagaagtatattcccggtaccaagatggtttttcctggtctgaagaagccacaagagcgtgcagatctcattgcttatctcaagcaatcaacggcttaagttatttgttttcctttcataccggaaacaattttttttccaccaataagataacatgttgccctgcttgtgaagaagcagttgagctacgaaacattctttaaaaattcttagtagtatccttcatttcatgggctcttgcctgaattatggttgtttagctgtagatgcagacagccactcttattttgatatgagtacacttaacattgtcccataattatctatactttggttttct

SEQ ID NO: 2510 - DNA, 700 bp, Ricinus communis
gtttctagaaatcacgaattcgcgatccctctcttcaagtctcagctatatttcacgcctagctaggcaatagtgaattaatcgagaggaaaattcaaaccctaaacagaaaaatggcgacatttgagcaagcaccaccaggcgaatcaaaagccggagagaagatctttaagactaagtgcgctcaatgccacaccgtcgacaaaggcgctggccataaacaaggacctaatttgaatgggctatttggaaggcaatctggtacaaccgctggatattcttattcttcagctaacaagaacatggctgttatttggagcgagaatactctttatgactacttgctcaaccctaagaagtatattcctggaacgaagatggtgttccctggattgaagaagccacaagagcgagcagacctcattgcatatcttaaggaagcaactgcttaatctactgccttgtcccctttttttgtattcgttagtagtattgggttacttctcttaaaggaagaatctggccttgttgcaataaaaccagtcagggttcgaaatgctctgtattttgagagtttagatgtgtagggaaaattggtttctggtgtattgagccctttttcatgaggcatttcatgaacaatgataattttttctttcgaagagctaagctcatgtatagtatctgtttgtaattgtgg

SEQ ID NO: 2511 - DNA, 951 bp, Catharanthus roseus
ggagcttcgcccacgttccaagagtttccatcttcctcgtatcatcctacgcgaccacacttcccttttctttctacaaaaataaccacacttttcgaaagtcggcacatgcctctctccttcctccctctccttccgttgcctaactagttaatctcttctcctcttagatactagaccaaaatcaagaactcgaactccctttctcattcgattctgtcgaaaaagaagaagaagaagaagggaagaaaaggttaggtataagattattcggaaatttctgaatggcatcctttgcagaggcacctccaggaaatcctaaagccggggagaaaatcttcaagaccaaatgtgctcagtgccacactgttgaaaaaggagctggccataaacagggacccaatttgaatggcctttttggaagacaatctggaaccactcccggttactcctattctgctgcaaacaagaatatggctgtcatttgggaggaaaagacactttatgattacttgctgaatcccaagaagtatatccccggaacaaagatggttttcccgggtctaaagaagccacaggaacgagcggatctcattgcatatctgaaggaagcgacatcacaatgatttcttggacttatgtctctctgtctgtcttctatccatcttgaagttgaaaattaatgactttgattcattcatgcaagaaagaaagaggaatcatatatttttttctataataaagtctacatttttaggtattctctcaagttgtagttcacaactctcttatgttatccacgaaacactgcagcaacagcaacagcatgcattgttgctggggatgattgaagaataataatacacattttgtctgataattgaacctttttttatgttctattacttttttttcccttaataaatgagaagcggataatgtactggttgg

SEQ ID NO: 2512 - DNA, 580 bp, Cleome spinosa
agccatctatcaaatctctttctctatctatctcgcgtttgttctgtcggggaggaagaaaaaatggcgtcgttcgacgaagcaccacctgggaactctaaggcaggagagaagatcttcaggaccaagtgtgcgcagtgccacaccgttgacaaaggtgccggtcacaagcaaggtccgaacttgaacgggttgttcggaaggcaatctgggacaactcctggatattcctactccgcggctaacaagaacatggctgtgatgtgggaggagaagactctgtacgattacctgttgaaccccaagaagtacattcccgggacgaaaatggtgttccctggactgaagaaaccgcaagaacgtgctgatctcatcgcctatttgaaggaagccaccgcttaatttggagtttttgggaaatgtccccttagcttttgcattccgacaatggagtctattattctccgcaattctttagccaataaaataaatgaagactgtgttgggtcatgaaaccgagttttgtatcgtatgggcatatttctgatttttctccaaagaggagagtgttttcactgtc

SEQ ID NO: 2513 - DNA, 802 bp, Gossypium hirsutum
ttttagtcatttcgctagtcaaaagtctatttgtcttaccgtgtggcgccggcgcgtgttttcataaattcacatgctttgctttatttatgtaatacgcaaaataccctaacaaagctccaccgctaatccttcgataccgaaccttttgaagaacgaaaagcaatggcttcattcgagcaagcgccgcccggaaatgcgaaagctggggagaagatcttcaaaaccaagtgcgcgcagtgtcacaccgtagataaaggcgctggtcacaagcaagggccaaatttgaatgggcttttcgggaggcagtccggcacaactgcgggatactcttattccgctgctaacaaaaatatggctgtgatttggtcagagaacacattgtatgactacttgcttaatcctaagaagtatattcctgggacaaagatggttttccccggattgaagaagccacaggatcgtgccgatctcattgcttatctcaaggaatcaactgcctgatgggtgtgctttttatcagctattttggaacaaatgaaagagtttttgatcaatgattttttttctttttgttacatgatataaaaactaggcgattcgcataataaaaggaaaacagctccaatataaattgggttttggagttgaaccgagtagtgaaaaagatttgtgtaagaccaatcacatgaaaagtgaggcatttcaaattttcatgatttatttaggctccaacagtttcactgttaggtgctgataacttgtttatattaattcttgatgggatttggatgatttgctt

SEQ ID NO: 2514 - DNA, 634 bp, Gossypium hirsutum
aaaaagaatcaaaagcaatggcctcattcgagcaagcaccgcctggtaatgcgaaagctggggagaagatcttcaagaccaagtgtgctcagtgtcatacagtcgataaaggcgccggtcacaagcaagggccaaatttgaatgggctctttggaaggcagtctgggacaacaccgggatactcgtactccgctgctaacaaaaatatggctgtgatttggggagagaatactttgtatgactacttgcttaatcctaagaagtacattcccgggacaaagatggttttccccggattgaagaagccgcaagatcgtgccgacctgattgcatacctgaaggaatcaaccgcctgattcgtctctggttttattaatttcacctatattttggaactgtgacaaaatgaagaattttgatcaatgatgtatttttattacatggaaaaaaaaaccattcttgaaataaagttaaaccttgaaaacaactccaaagataattggagttgaaaatgatttttgttaagactaaaatctcttgatgatgaggaatttgattatttcatttatccccctgtagttgctgttgtggtatcttaattcctaacctgaaactttttacattacatgatggt

SEQ ID NO: 2515 - DNA, 948 bp, Gossypium hirsutum
ttttagtcatttcgccagtcaaaagtcgatttgtcttaacgtgtggcgccggcgcgtgttttcatatattcacatgcttgctttatttatgtaatacgcaaaataccctaacaaagctccaccgctaatccttcgataccgaaccatttgaagaacgaaaagcaatggcttcattcgagcaagcgccgcccggaaatgcgaaagctggggagaagatcttcaaaaccaagtgcgcgcagtgtcacaccgtagataaaggcgctggtcacaagcaagggccaaatttgaatgggcttttcgggaggcagtccggcacaactgcgggatactcttattccgctgctaacaaaaatatggctgtggtttggtcagagaacacattgtatgactacttgcttaatcctaagaagtatattcctgggacaaagatggttttccctggattgaagaagccgcaggatcgtgccgatctcattgcatatctcaaggaatcaactgcctgatgggtgtgctttatatcagctattttggaacaaatgaaagagtttttgatcaatgatttttttctttttgttacatgatataaaaactaggcgattcgcataataaaaggaaaacagctccaatataaattgggttttggagttgaatcgagtactgtaagaccaatcacatgaaaagtgaggcatttcaaactttcatgatttatttaggctccaacagtttcactgttaggtgctgttaacttgtttatcttaattcttgatgggatttggatgatttgcttggtagtctggtaggtgtagtgcaaatattgatttgaactttgtttagggcattgaatatctcatccttttttcaagagtgaataactcttttaaattggttttcaggtttcttctattgctcaaataataatcaacagccttgtctcgtcctctgcctgat

SEQ ID NO: 2516 - DNA, 729 bp, Cynodon dactylon
gggggacccagccagaaaagcgcgttccagaagttgcagttggcctcctcctcctcctcctcaccttctcctccggcggctcagatctctctgcttgcggcggcggcggcggcgatggcgtccttctccgaagcgcccccggggaaccccaaggccggagagaagatcttcaagaccaagtgcgcgcagtgccacaccgtcgacaagggcgccggccacaagcaaggtccgaacttgaatggtcttttcggcaggcagtcaggtaccacccccggctactcctactctgcggccaacaagaacatggccgtgatctgggaggagaacactttgtacgactacctgcttaatcctaagaagtacattcctggaaccaagatggtcttccctgggttgaagaagcctcaggaccgtgctgatctcattgcctacctgaaggaagccacatcgtcttaaaacaaatgggctgccagtttttatcctgaggagacaattcgttttttacttaataaagaggtttagacaattgggatattaaggttgaacagggttcaatccacgagacagtttatccttttctttcttattatggtgtctttcaaatgtctaggtgttctagtggagcaaaacagtgaataactttgatcgctcttgttccaacagctggaaaattccagcgagcatatttttgaccaccgggtggtggaactggaatgcacccattttgtg

SEQ ID NO: 2517 - DNA, 477 bp, Eschscholzia californica
taaaaaagacttggaagaagtaacacaaacccgttcgctagatctagtttctctctctctatacagatctgaaaatggcatcattcgatgaagctccaccaggaaaccccaaggccggagagaaaatctttaagacgaagtgcgctcagtgtcatactgtcgagaaaggagctggtcacaaacaaggacctaatctaaatggtcttttcggaagacaatccggcacaactgctggttattcctactctgctgccaacaagaacatggctgtcaactgggaggagaagacattgtatgattacttgcttaaccccaagaagtatatcccaggaacaaagatggtgtttccaggattgaagaagccacaggaccgagctgatctgattgcttacctcaaggaatccacgtgctaatttttcaatttgagaatggaggagtattgctctgaaataggaaaaataataatttttttaggta

SEQ ID NO: 2518 - DNA, 687 bp, Eschscholzia californica
ggaagaagtaacacaaacccgttcgctagatctagtttctctctctctatacagatctgaaaatggcatcattcgatgaagctccaccaggaaaccccaaggccggagagaaaatctttaagacgaagtgcgctcagtgtcatactgtcgagaaaggagctggtcacaaacaaggacctaatctaaatggtcttttcggaagacaatccggcacaactgctggttattcctactctgctgccaacaagaacatggctgtcaactgggaggagaagacattgtatgattacttgcttaaccccaagaagtatatcccaggaacaaagatggtgtttccaggattgaagaagccacaggaccgagctgatctgattgcttacctcaaggaatccacgtgctaatttttcaatttgagaatggaggagtattgctctgaaataggaaaaatataatttttttgggaataaaaccttgatcttgttaaggctttccgtactcttttttttatttccagtctgaaaagtatagggagtagaagacactttgggtgactctcttttataaagaaaggcatcacccctgaaatagttgggtatgcttttatgaacaaaattttgtttagggtttttttcatcaacatttgatgagatacatttcattaaatttggtttgttggtttatattttt

SEQ ID NO: 2519 - DNA, 622 bp, Euphorbia peplus
cttcatctctcttccaatttgtgtacagaaaaagaagccctaaaagaaaggaatggcatcattcgatcaagcacctcccggcgatcccaaggccggagagaagatcttcaagactaagtgcgctcaatgccacaccgtcgaaaaaggcgccggtcacaaacagggacctaatttgaatgggcttttcggtaggcagtctgggactacggctgggtattcgtactctgctgctaacaagaatatggctgtgacttggcaagagaacaccttgtatgattacttgctcaaccctaagaagtacattcctggaacgaagatggtcttccctggtttgaagaagccacaggatcgtgcagatctcattgcctatctgaaggaagcaactgcttgatcttcttgtttagtatgtggctatatagcaaatgattcatgacatttattaatatcctagtcagtttattttttttgaaagaagagaaaattatccacttcttcaaataaagatggattaaggcgcagatactcagatgttttgaaaattgagatcagtagaaaaagatactgttgttgtaaactctttttcatggatgatttcatgaaccccttattattttttgaaatc

SEQ ID NO: 2520 - DNA, 799 bp, Setaria italica
caaaccagaagttgcagttggcctcctcttccttctcttctccgtcggctccagatctctctgcgtgcgtgcggcggcgatggcgtcgttctcggaggctccccccggcaaccccaaggcgggcgagaagatcttcaagaccaagtgcgcgcagtgccacaccgtcgaaaagggcgccggccacaagcaaggtccaaacttgaatggtctctttgggaggcagtctggtaccaccgctggctactcctactccgcaggaaacaagaacaaggctgtggtctgggaggagaacactttgtacgagtacctgcttaaccctaagaagtacattcctggaaccaagatggtcttccctgggctgaagaagcctcaggagcgtgccgatctcattgcgtacctgaaggaagccaccgcatagaaagatggcatgctgaaccatgaggaggcaattcgttttacagtttaataaagaggtttagacaatttgggtcactctggttgaacatggtgcagccacgagacaattatttgagtattttggttcttattatggtgtcggtttcaaatgtctaggtgtttagctgaacaaaaaacagtcaaactttgacatctcttgtttcgactgctggaggaatcccagcgccctatttttgaccaccgggtggtggaactggaaatctggaatgcacccattttgaaggatctgagatgtttaaaagttttttcctgtcgttctgcctgcgtgtcaagttgttgtgcgttgatgtccgtgctgtatgttatttttttcttaggggtg

SEQ ID NO: 2521 - DNA, 1471 bp, Zea mays
gccgaggcccccagccaaacgcaagacgcgtcccacgactacacgagatgccctagcacgcagcgcccgccgcccccaactgactgaacggggcgtggggctcccacgcttcccgcccacgcgccgcccacgtttccttattctccaagccacggaaaccttctcgaacctcccctttccccattctaccccttctccaccactcgcccttagcccttttcaggggcagttccgtacttgcgcgagctccacgcgcccacgcctggttctagtggtctacagaacaaccggggtccctccctgcgaattcgccgcaagtccaaaggcaaagggcaaagcggaagttgcggttggcctcgtcctcctcttctccgtcgcggctcagatctctgcgtgcggcgatggcgtcgttctcggaggctccccccgggaacccgaaagccggcgagaagatctttaagaccaagtgcgcgcagtgccacacggtcgacaagggcgccggccacaagcaaggtccaaacttgaacggtctttttgggagacagtctggtaccactgcaggctactcctactctgcgggaaacaaaaacaaggctgtagtctgggaagaagacactttgtatgagtacctgcttaaccctaaaaagtacattcctggaaccaagatggtcttccctgggctgaagaagccgcaggagcgtgctgatctcatcgcgtacctgaaggaagcaactgcatagttcattgacatgccttttgccatgaagagaaaaattgttttgcagtttaataaaaaacattttagacaatttgggtcaccctgtttgaacagggtgcaaccacgtctcattattttcgttcttatggtgtccgtatggaatgcctaggtgtttagctgtgcacaaataacagttaaactttgacggctcctatttcaactgctggagaaatgccagtgccctatttttgaccaccagggtgtggaatggaaatcggctggtggcaatgggggctagaagggaggcgagaagggccctctaccgccccgcgcgaggcgataggcaggcgagagggagagagagggcgacgacactcacgcccggcgagagcgggcgatatcgcctcgctctcgcccgcgttggcgcgcgcgtctgggcgagagggaggcgagaggggggcgacgcactgacagggcgagagtgcggtggcgcgacgtgattggtccatgtgtgccacgtggactagccgttttttaccgtttggagtccaaaacattcgaaaaaaattgcaaaaaatcacaaatttcattcccaatccatctataaatatccctacctattggaggtcataattagatttatgtaattttctattaattgttatgtaattttttaattgtcatgtacttttcttttaattattatacactttgtaattttaaattcaataaaaaaaatattatgttgtgtga

SEQ ID NO: 2522 - DNA, 846 bp, Zea mays
aattcggacgcctggtctataaaacaaccgggtccttgcgaattcggcgcaagtccaaagacccaagggcacaagcagaagttgcggttgtacttttcttcctccgccgtcggctcagatctctgcgtgcgggctagcgatggcgtcgttctcggaggctcccccagggaacccgaaggcgggcgagaagatcttcaagaccaagtgcgcgcagtgccacacagtcgagaagggcgccggccacaagcaaggtccaaacttgaatggtctttttgggaggcagtcgggtaccaccacaggctactcctattccgcgggaaacaaaaacaaggctgtgatctgggaggagaacactctgtatgactacctgcttaaccctaagaagtacattcctggaaccaagatggtcttccctgggctgaagaagccgcaggaacgtgctgatctcattgcgtacctgaaggaagcaactgcgtagtataatgacacgcctttgccatgaagagaaaattcgttttgcagtttaataataaacatttttagacaatttgggtcactctggttggacagggtacacaatccacgtctcagtatttttgttcttatggtctcggtattgaatgcctaggtgagttttttttagctgtgcacaaaaaaacagttaaactcgatggtatctcaactgctggagaaatgctagtgccctatttttggctgtggaattggaaatctggaatgcatccattttgaaagacttggttgttgggatatgattctgctcgatgtgatggatatcctggatgaatgaaagtacagtgtttagaggagtccgcttagcagaccggc

SEQ ID NO: 2523 - DNA, 837 bp, Zea mays
ttcggcaagattgcaacagggtcgtccggtcgcgtttctcctacgcggtccgtgggctgtgctgcctgctgttgcatcgtctcctcgtttaaacgggcgaactcaagattgcaacagggtcgtccgccgccaccaattgctagcgcaatcctagccctagcccagcgccccctccggccctccctgcttcgtgcttggtagcgatggcgtcgttttctgaagcgcccccggggaacccaactgctggcgagaagatcttcaagaccaagtgcgcgcagtgccacaccgtcgacaagggcgccggccacaagcaaggtcctaatttgaatggtctgtttgggaggcagtctggtacaacacctggctactcttactcttcggctaacaagaacatggctgtgatttgggaggagaacactttgtatgactacttgcttaatcccaagaagtacattcctggaaccaagatggtattccctggactgaaaaagccacaggaacgtgctgatctcattgcatacctgaagaatgccactgtctgacgaggatgctgctgtggctctaaagatgaagagcagcgattctcttttttgcagttaaaataatgacacgaatttactttaatttgacagactggataatcaagaaagctaagaactccaggtagttctgtaacggttttgtctattgctgggggtaaacaccacccttgaagagcttttgattagtggttgaaatgtgacatcaccataatacgtttgacctgacgagcatttaaacacacgtttgggaagcttttgattagtgttttaatgttcgtttttcatgctgtctttg

SEQ ID NO: 2524 - DNA, 718 bp, Petunia hybrida
gttccactttgcattttcactaaccgaaaagccctttctagaaccctctcttaaacccctaacaattcccctaactatttattccacctgaaccttctaattgttctcattttgctctgtgaaattaattcataaaacaaaatggcgacattcgaagaagcaccagcaggtaatccaaaagctggagagaaaattttcaaaacaaagtgcgctcagtgtcacaccgttgataaaggcgctggtcacaaacaaggacctaatttgaacgggctctttggcagacagtctggtacaactccaggctactcttactctgctgcaaacaagaacatggctgttatctggggagagaatacattgtatgagtacttgctcaaccctaagaagtatattcctgggacgaaaatggttttccctgggttgaagaagccacaggagcgtgcagatctaatagcttatctcaaggaatcaactgcatgagcatctctttggtagaaacatcattatacttttgctgatggggcctggatttgtaaccattggtagtgttatacgttttatgtttttaaaatcatccttttctccgatcaaataacacattagtgtcatgccattcttctggttgagccagtatggaaggaaatcttgtcaggagtttgtaattgactattttttcaaatctttacgtggttatgaatgtactcagaggtttcagatt

SEQ ID NO: 2525 - DNA, 460 bp, Plantago ovata
gaaataataatccaaaaacagctcaatctcgattcttctaatcagctcatcaatggcatcattcgctgaagcaccacctggcaacaaagccgccggagagaagatcttcaagacgaaatgcgctcagtgccacaccgtcgacaaaggcgctggtcacaaacaaggacccaatttgaacggtctttttgggaggcagtctggaactacccctggttattcttactctgctgctaacaagaacatggctgtcatgtgggaagagaagactctttatgattatctgcttaaccccaagaagtatattcctggaacaaagatggttttccctggactgaagaagcctcaagagcgtgctgaccttatcgcttacctcaaggagtccacagcatgatcaattgattctcatacataataatcagacattttctccattttgcagttgagaagcatagtttgcttg

SEQ ID NO: 2526 - DNA, 456 bp, Plantago ovata
taataatccaaaaacagctcaatctcgattcttctaatcagctcatcaatggcatcattcgctgaagcaccacctggcaacaaagccgccggagagaagatcttcaagacgaaatgcgctcagtgccacaccgtcgacaaaggcgctggtcacaaacaaggacccaatttgaacggtctttttgggaggcagtctggaactacccctggttattcttactctgctgctaacaagaacatggctgtcatgtgggaagagaagactctttatgattatctgcttaaccccaagaagtatattcctggaacaaagatggttttccctggactgaagaagcctcaagagcgtgctgaccttatcgcttacctcaaggagtccacagcatgatcaattgattctcatacataataatcagacattttctccattttgcagttgagaagcatagtttgcttg

SEQ ID NO: 2527 - DNA, 766 bp, Plantago ovata
cggccgggggcagaccacgttcctttcccttggctcgttcattcattcctcattcattcattgtatagctttgccgcaaacctttattctccacttttccaaatttgcagctctagttcatattttcagcttccagcactaatattcaatcaattaattaattcagtaataaatcttgaagaagaagaagaagatggcatcgttcgatgaagctccacctggtaacaaagctgccggagagaagattttcaagaccaagtgcgctcagtgccacaccgttgacaagggagctggccacaaacaaggacccaatctgaatggtctctttggaaggcagtcgggaaccacagctggttactcctactctgcagccaacaagaataaggctgttaactgggaagaaaatacactatatgattacttgctaaacccaaagaagtatataccaggaacgaagatggttttcccaggactaaagaagcctcaggaccgtgcagacctcatcgcatacctcaaagagtccacagcttaagatcatgatcgcagttatttttttccattttgcagttgagaggcatagcttgcttatgcgggaaaaagctaattttttttttctcaataaaattcttgtgacaattaccttgctccattgtgctggagccctaaacattgtttcctatttacgggaggtcattattcatttgacaacaaaaagttgaaccattgacattgatattacatagcccggattatgtgttgtttaagc

SEQ ID NO: 2528 - DNA, 789 bp, Plantago ovata
cggccgggggcagaccacgttcctttcccttggctcgttcattcattcctcattcattcattgtatagctttgccgcaaacctttattctccacttttccaaatttgcagctctagttcatattttcagcttccagcactaatattcaatcaattaattaattcagtaataaatcttgaagaagaagaagaagatggcatcgttcgatgaagctccacctggtaacaaagctgccggagagaagattttcaagaccaagtgcgctcagtgccacaccgttgacaagggagctggccacaaacaaggacccaatctgaatggtctctttggaaggcagtcgggaaccacagctggttactcctactctgcagccaacaagaataaggctgttaactgggaagaaaatacactatatgattacttgctaaacccaaagaagtatataccaggaacgaagatggttttcccaggactaaagaagcctcaggaccgtgcagacctcatcgcatacctcaaagagtccacagcttaagatcatgatcgcagttatttttttccattttgcagttgagaggcatagcttgcttatgcgggaaaaagctaattttttttttctcaataaaattcttgtgacaattaccttgctccattgtgctggagccctaaacattgtttcctatttacgggaggtcattattcatttgacaacaaaaagttgaaccattgacattgatattacatagcccggattatgtgttgtttaagcaatatcagtattcttgtcaattt

SEQ ID NO: 2529 - DNA, 749 bp, Raphanus sativus
gggtcacacgcctaacagaaaccctttagaagctccagcgaagcgagttccgtctttgttttctccccctcctcgtattctcaggcgaaaaatggcatcattcgatgaagcaccaccaggaaactccaaggccggagagaagatcttcaggaccaagtgtgctcagtgtcacaccgtcgacaaaggcgctggtcacaaacaaggaccgaacctaaacggtctgtttggaagacagtctggtacaacagctggttactcttactctgctgctaacaagaacaaagctgtcgaatgggaagagaagaccttgtacgattacttgctcaaccccaagaagtacattcctggaacgaagatggtcttccctgggctcaagaagccacaagaacgtgctgatctcattgcctacttgaaggaagctactgcttagttggacatgatcatgactttttgagtctctctgatcaagatattcttttgacaaataagatctccaaacttttgtttttggttttcggaaatgctctcatcttcaatttacgttttggtgggggaaactttgctgtttaagttccaaatgtactcgagtcctttcattgtctgaggctcattcatataaaatgcatctctctagaagcgctttctttactatcaacatattttgcattgtacatagataacaaaaaccaagttatatcaactacgaataatggggcaagatcaatgtcaacctagatataacatgttat

SEQ ID NO: 2530 - DNA, 637 bp, Raphanus sativus
gggtcacacacctaacagaaaccctcagaagctccagcgaagcgagttccgtctttgttttctccaggcgaaaaatggcgtcgtttgatgaagcaccaccaggaaactccaaggccggagagaagatcttcaggaccaagtgtgctcagtgtcacaccgtcgacaaaggcgccggtcacaaacaaggaccgaacctaaacggtctgtttggaagacaatctgggacaacagctggttactcttactctgctgctaacaagaacaaagctgtcgaatgggaagagaagaccttgtacgattacttgctcaaccccaagaagtacattcctggaacgaagatggtcttccctgggctcaagaagccacaagaacgtgctgatctcattgcctacttgaaggaagctactgcttagtggggacatgatcatgactttttagtcttctctgatcagatattcttttgacaaataaaatctccaaacttttgtttttggttttcggaaatgctctcatcttcaatttacgttttggtgggggaaacttggctgtttgagttccaaatgtactcgagtcctttcattttctgaggctcattcatataaaatgcatctatctagaagcactttctttcctatca

SEQ ID NO: 2531 - DNA, 631 bp, Raphanus sativus
  misc_feature (244)..(244): n is a, c, g, or t
acctaacagaaacccttacaaggctccagcgaagctagttccgtctttgttttctcctcgtattctcaggcgaaaaatggcgtcgtttgatgaagcaccaccaggaaactcaaaggccggagagaagatcttcaggaccaagtgtgctcagtgtcacaccgtggacaaaggcgccggtcacaaacaaggaccgaacctaaacggtctgtttggaagacagtctgggacaacagctggttactcntactctgctgctaacaagaacaaagctgtcgaatgggaagagaagaccttgtacgattacttgctcaaccccaagaagtacattcctggaacgaagatggtcttccctgggctcaagaagccacaagaacgtgctgatctcattgcctacttgaaggaagctactgcttagtgggggcatgatcatgactttttagtcttctctgatcaagatattcttttgacaaataaaatctccaaacttttgtttttggtttcggaaatgctctcatcttcaattacgttttggctgagtaaacttggctgtttgagttccaaatgtactcgagtcctttcattttctgaggctcattcatataaaatgcatctatctagaagcactttcttt

SEQ ID NO: 2532 - DNA, 630 bp, Raphanus sativus
ggggtcacacgcctaacagaaacccttggaaggtcaagcgaagcgagttccgtctttgttttctcctcttcgtatcctctaggcgaaaaatggcgtcgtttgatgaagcaccaccaggaaactcaaaggccggagagaagatcttcaggaccaagtgtgctcagtgtcacaccgtcgacaaaggcgccggtcacaaacaaggaccgaacctaaacggtctgtttggaagacagtctggaacaacagctggttactcttactctgctgctaacaagaacaaagctgtcgaatgggaagagaagaccttgtacgattacttgctcaaccccaagaagtacattcctggaacgaagatggtcttccctgggctcaagaagccacaagaacgtgctgatcttattgcctacttgaaggaagctactgcttagtggggacatgatcatgactttttagtcttctctgatcagatattcttttgacaaataaaatctccaaacttttgtttttggtttttggaaatgctctcctaatcttcaatttggtggggggaaacttggctgtttgagttccaaatgtactcgagtcctttcattttctgaggctcattcatataaatgcatctatctagaa

SEQ ID NO: 2533 - DNA, 628 bp, Raphanus sativus
acagaaacctaaccctaagagaacagagttccgtcttcattttctcttcctagtatctcccgcgagaatggcgtcgttcgatgaagcaccaccagggaaccccaaggccggtgagaagatcttcaggaccaattgcgctcagtgtcacaccgtcgacaaaggcgccggtcacaaacaaggaccaaacctaaacggtctgtttggaaggcagtctgggacaacagctggttactcttactctgctgctaacaagaacaaagctgttgagtgggaagagaagaccttgtacgattacttgctcaacccaaagaagtacattcctggaactaagatggtcttccctgggcttaagaagccacaagaacgcgctgatctcatcgcctacttgaaggaagctactgcttagtgaaatcaaccaaccaaccaatggtggtgtgggacatcatgaattattattctttttgacaaataaaatctccaaactattttttgttttgcttttggaaattttctcatctctatttatatatgtttttgttttgagtaccaaatgtactccgaatactttcattttcttaggttcactcatataagtgcatctatctagaataaacacatttcttttcta

SEQ ID NO: 2534 - DNA, 829 bp, Sorghum bicolor
cgcggtgtgtgcctgcctgctgcatcgagcatcgtctcctttaaacgagagaacgcaacaccgcaacagggccgtccgtctccgccgccgccacctgcgtgcgaacgggaaccctaaccctagcccaggtcccccctgcttcgtgctcggcagcaatggcgtcgttctctgaggcgcctccggggaacccaactgccggcgagaagatcttcaagaccaagtgcgcgcagtgccacaccgtcgacaagggcgccggccacaagcaaggtcctaatttgaatggtctatttgggaggcagtctggtacaacacctggttactcttactccacagctaacaagagcatggctgtaatttgggaggagaacactttgtatgactacctgcttaatcctaagaagtacattcctggaaccaagatggtattccctggactgaaaaagccacaggaacgtgctgatctcattgcatacctgaagaatgccactgcctgatgagggtgctgctgactgctgtggctctaaagatgaagagcagcaattctttttgcagttaaaataatgatacaaatttactttaatttgacaggttggatgaacaagaaagttaagaactccaggtagttctgtaactgttttgtctattgttggggaaaaacgccccagacgagcttttgattagtggttgaaatgtgacaccaccataatacttttgacctgatgagcattcaaacacacatttcggaaggttaagatacctttattattacattttcatgttcgttcctcaattgctatctctgaaaagctatctgattttccttatgact

SEQ ID NO: 2535 - DNA, 1094 bp, Sorghum bicolor
ggtgccgctcgcgtttctcgtacgcggtgtgtgcctgcctgctgcatcgagcatcgtctcctttaaacgagagaacgcaacaccgcaacagggccgtccgtctccgccgccgccaccgccaccgccgcctccaactgcgtgcgaacgggaaccctaaccctagcccaggtcccccctgcttcgtgctcggcagcaatggcgtcgttctctgaggcgcctccggggaacccaactgccggcgagaagatcttcaagaccaagtgcgcgcagtgccacaccgtcgacaagggcgccggccacaagcaaggtcctaatttgaatggtctatttgggaggcagtctggtacaacacctggttactcttactccacagctaacaagagcatggctgtaatttgggaggagaacactttgtatgactacctgcttaatcctaagaagtacattcctggaaccaagatggtattccctggactgaaaaagccacaggaacgtgctgatctcattgcatacctgaagaatgccactgcctgatgagggtgctgctgactgctgtggctctaaagatgaagagcagcaattctttttgcagttaaaataatgatacaaatttactttaatttgacaggttggatgaacaagaaagttaagaactccaggtagttctgtaactgttttgtctattgttggggaaaaacgccccagacgagcttttgattagtggttgaaatgtgacaccaccataatacttttgacctgatgagcattcaaacacacatttcggaaggttaagatacctttattattacattttcatgttcgttcctcaattgctatctctgaaaagctatctgattttccttatgactttatataatcttttaggccttgtttggagaatgggggtcttaggatcctaatccctaggatttagtactaaatcataaaatttctaagagcagttctcttctcctaaatgggctcttaatgttaagccaaactgtggtaggagactaactatgtatatgtactgggaaaattgtgacctgtttgggaactgaaaaatagctgtgcaactgcatcttgaattcttg

SEQ ID NO: 2536 - DNA, 830 bp, Saccharum officinarum
ctgcactgcatcgtctcgtttaaaccagagaacgcaacactgcaacagggccgtccgtctccgccgccgccgcctccaactgcgagcgggaaccctaactctagctcaggtccccccctgcttcgtcctcggcagcgatggcgtcgttctctgaggcgcccccggggaacccaactgccggcgagaagatcttcaagaccaagtgcgcgcagtgccacaccgtcgacaagggcgccggccacaagcaaggtcctaatttgagtggtctgtttgggaggcagtctggtacaacacctggttactcttactcctcggctaacaagaacatggctgtgatttgggaggagaacactttgtatgactacctgcttaatcctaagaagtacattcctggaactaagatggtattccctggactgaaaaagccgcaggaacgtgctgatctcattgcatacctgaagaatgccactgcttgatgagggtgctgctgtggctctaaagatgaagagcagcaattctttttgcagttaaaataatgatacaaatttactttaatttgacaggttggatgaacaagaaagttaagaactccaggtagttctgtaacggttttgtttgttgttgggaaaaaaaatacccagaagagcttttgattagtggttgaaatgtgacaccaccataatacctttgacctgatgagcattcaaacacacatttcggaagggtaagatacctttattaataacgtttcatgttggttctcatttgctatttctgaaagctttctgatttttcttatgacttatatatctttttaggcctggttggga

SEQ ID NO: 2537 - DNA, 707 bp, Panicum virgatum
ccagaagttgcagttcgcctcctcctcctcttctccgtcggctcagatctctctgcgtgcgcgcggctgcgatggcgtctttctcggaggctccccccggtaaccccaaggcgggcgagaagatcttcaagaccaagtgcgcgcagtgccacaccgtcgagaagggcgccggccacaagcaaggtccaaacttgaatggtctctttgggaggcagtccggtaccactgctggatactcctactctgcaggaaacaagaacaaggctgtggtctgggaggagaacactttgtatgagtacctgcttaaccctaagaagtacattcctggaaccaagatggtcttccctgggctgaagaaaccgcaggagcgtgctgatctcattgcatacctgaaggaagccactgcatagaaaaatggcatgctgaaccatgaagcaattcgttttacagtttaataaagaggtttagacaattcgggtcactctggttgaacagggtgcaatccacgagacaattattgagcattttggttcttatgtttgtttcgaatgtctaggtgtttagctgaacaaaaaacagtcaaaactttgactgctgcttgtttcaactgctggagaaatcccagcgccctatttttgaccaccgggtggtggaactggaaatctggaatgcacccattttgaaggatctgagatgtgtaaagatgt

SEQ ID NO: 2538 - DNA, 743 bp, Panicum virgatum
gatttcggcgcaagtccaaagggcaaaccagaagttgcagttcgcctcctcctcttctccgccggctcggatctctctgcgcgcgcgcggcggcggcgatggcgtctttctcggaggctccccccggcaaccccaaggccggcgagaaaatcttcaagaccaagtgcgcgcagtgccacaccgtcgagaagggcgccggccacaagcaaggtccaaacttgaatggtctctttgggaggcagtccggaaccactgctggctactcctactccgcaggaaacaagaacaaggctgtggtctgggaggagaacactttgtatgagtacctgcttaaccctaagaagtacattcctggaaccaagatggtcttccctgggctgaagaagccgcaggagcgtgctgatctcattgcgtatctcaaggaagctaccgcatagaaaaatggcatgctgaaccatgagacaattcgttttacagtttaataaagaggtttagacaattcgggtcactctggtggaacagggtgcaatctacgagacaattattgagtattttggttcatatgtttgtttcgaatgtctaggtgtttagctgaacaaaaacagtcaaaactttgacggctcttgttccaactgctggagaaatcccagcgccctattttttgaccactgggtggtggaactggaaatctgaaatgcacccattttgaaggacctgagatgtgtaaagttgttatccttctg

SEQ ID NO: 2539 - DNA, 1106 bp, Triticum aestivum
ttaccgctttaaaaccaggcagaaccagaacagacctgaacgagcccgatcaccattccccgcccgcctccagcctccagcctcctgcgacccggatcgccttccgttcctccagccgagggatccccaaccctagcccggcaaccgtccgcgcgggatcagcgccggcagcggcgatggcgtcgttctcggaggcaccccccgggaaccccgcggccggcgagaagatcttcaagaccaagtgcgcccagtgccacaccgtcgacaagggcgccggccacaagcaagggcctaacctgaatggtctgtttgggaggcagtctggcacaactgctggatactcttactctacggccaacaagagcatggctgtggtttgggaggagaaaacactgtatgactacctgcttaatccgaagaagtacatccctggaactaagatggtgttccctggactgaagaagccccaggagcgtgctgacctcatcgcatacctgaagagtgccacagcttgaaagggctttgctttgctgccatggtcctaaaaagttaataaatatagacattgccacggtgtcactctggtttgacggggtgcatcgccgagacatttaaagagtttggtactagcatttctccttacgatggtttgttttcttcagcaaaatgcactgctataatggccgtttctcaggcctgttgtgaacctgttgttgttgttgttgacgatgatcagttgtttgggcggtagatctcaagcatcttgtgcgccgcatactataaacttatttcttcggcatggattattgtttgaagtttgaacacgcatgctagctcgtactaggagcgcagcaactcagacaatgagatgccacatggtggatggggtaaatttaagaccctgcacaactggacagtgcctagctgcaggggcagtgatgcggtgttgatgcgttccctggtctgaagtttccaattctggtgtaagattcagcgcctagccaccccatcagccatgtgagtgcagagtgcagggaaaggaaaccagcgcaatattgcgacagctcaccatcgtcttccccggtgacatgggccagaaaccagag

SEQ ID NO: 2540 - DNA, 967 bp, Gossypium hirsutum
ggtgttttagtcatttcgccagtcaaaagtcgatttgtcttaacgtgtggcgccggcgcgtgttttcatatattcacatgcttgctttatttatgtaatacgcaaaataccctaacaaagctccaccgctaatccttcgataccgaaccatttgaagaacgaaaagcaatggcttcattcgagcaagcgccgcccggaaatgcgaaagctggggagaagatcttcaaaaccaagtgcgcgcagtgtcacaccgtagataaaggcgctggtcacaagcaagggccaaatttgaatgggcttttcgggaggcagtccggcacaactgcgggatactcttattccgctgctaacaaaaatatggctgtgatttggtcagagaacacattgtatgactacttgcttaatcctaagaagtatattcctgggacaaagatggttttccccggattgaagaagccacaggatcgtgccgatctcattgcttatctcaaggaatcaactgcctgatgggtgtgctttttatcagctattttggaacaaatgaaagagtttttgatcaatgattttttttctttttgttacatgatataaaaactaggcgattcgcataataaaaggaaaacagctccaatataaattgggttttggagttgaaccgagtagtgaaaaagatttgtgtaagaccaatcacatgaaaagtgaggcatttcaaattttcatgatttatttaggctccaacagtttcactgttaggtgctgataacttgtttatattaattcttgatgggatttggatgatttgcttggtagtctggtaggtgtagtgcaaatattgatttgaactttgtttagggcattgaatatctcatccttttttcaagagtgaataactcttttaaattggttttcaggtttcttctattgctcaaataataatcaacagccttgtctcgtcctctgcctgatg

SEQ ID NO: 2541 - DNA, 579 bp, Gossypium hirsutum
gaatcaaaagcaatggcctcattcgagcaagcaccgcctggtaatgcgaaagctggggagaagatcttcaagaccaagtgtgctcagtgtcatacagtcgataaaggcgccggtcacaagcaagggccaaatttgaatgggctcttcggaaggcagtctgggacaacaccgggatactcgtactccgctgctaacaaaaatatggctgtgatttggggagagaatactttgtatgactacttgcttaatcctaagaagtacattcccgggacaaagatggttttccccgggttgaagaagccgcaagatcgtgccgacctgattgcatacctgaaggaatcaaccgcctgattcttctctggttttattaatttcacctatattttggaactgtgacaaaatgaagaattttgatcaatgatccattcttgaaataaagttaaaccttgaaaacaactccaaagataattggagttgaaaatgatttttgttaagactaaaatctcttgatgatgaggaatttgattatttcatttatccccctgtagttgctgttgtggtatcttaattcctaacctg

SEQ ID NO: 2542 - DNA, 3738 bp, Gossypium raimondii
cctaaaccaaataataataactgcaggatgccggaaaacttttctttgaaggagaccaagccaaatatcggtggagggagagtttccggtggcagggaaaagctcacatcctcattcgatctagttgaagtgacacattttttatttgtcagagtagtgaaagcaagagatttggcatgcagcaatgccaccgtcggcggtggcgtttgccacacgtttgttgaaataaagattggaaaatataaggggagcaccaagtacttggagatgaataaacgaaacccagaatggaaccaagtgtttgccttcacaaaagatcgaattcagtccttatccgtggagatcaccgtgagagaaaaggaatttgtaaacgatgagtttataggtaagattgcaattgacatgtccgacattccaactcgagttccaccggatagtccactcgccccacagtggtataaattggagtccgaggccaactcatcagtaggtgagttgatgatgattctttggttcggcacacaagctgatgaagtgttcattgatgcatggcattcagatgtagcctctgttagtggtgacagcattacgaatactcgttccaaggtctacctttcacctagactttggtatcttagaatcaatataattgaagcacaggatttggtggtgcccggagacaagaatcggaatccagaggtttatgtcaaggctgctcttgggaatgtgaagttgaggacaagagtttcggcagacaagtcattgaatcctagatggaacgaagatttgatgtttgttgcagtagagcccttctatgatcatttggttctgaccgtggtagataaaaacaatgaggaggaatttagccttggaaggtgcatggttcatctatctgaggcctacataaggtggctgcctgaacctgtgggtgcaaaatggtataatctagagggaggcggagatgtggtggaggagctaaagtttgctagtaagcttaacatgagaatatctttggatggtggctatcatgtgtttgatgaatccattgattgtagcagtgattaccgagcgacgtttaaggggttgtggccaccagcaattggtgtgttggagttggggattataggtgccagtgttttggttccaatgaagtcaagagatggacgtgaaactactgatgcttattgtgtggccaaatatggacctaaatgggtaaggacaagaactgtagtcaacagcttttctccaaaatggaatgaacaatacacttgggaggtttacgatccgtatacggtccttattatcggaattttcgataactgtcacctcaacggagagaaaggtccaaatccaaaagacccaagtattgggaagctaaggatccgattgtccaccctttcgactaatcgggtttacacctattcgtatcctctcatagcacttcaaccaagtggagttaaaaagatgggagaaattcagttggctttgagatttacatccccatcttatacaagtttactagcagcttatgcacgacctttatttcccaaaatgcactacattcacccattgtcggtataccagctcgatagtttgaggcaacaagccattggcattctatgttcaaggttgagcagcgccgaaccgccgttaaggacagaggttaccgggttcatgttggatgctggttaccaattgtggagtccccgaaaggccaaagccaacaccgaaagactaatggatgcagtccatgtaatcacggaggcatggaaatggtttgatacgataaagaagtggaacaatcctgcagcaaacgttttagtcatagtgttgtacttggttgtggtgttttatccaagtttggtactgcccacgttgcttatctactgctttctaattgggatttggcaataccggaagcggccgcgggatccaacgcacgtcgatatcaaactatcgctggccgattcgacgaatgccgacgaatgggacgaagaattcgacacattcccgtcatctaaacaaggtgaggtacttagaatgaggtatgatcgattgcgaagcatggcaggaaaggttatggtaatggttggggacttagcaactcaaggagagaggttgactgctttgtggagttggcaggacccggtagctagtgctatatttctagcgctttgtgtgatggctgccgtagttttttgcagcggactagttcctccgaggtgcatacttgtaatggtgggaatgtttgtgatgagacctccaagtttcggcattggcattccttgcgcaccccaaaacgtgttcggaagattgcccacaaaagcagattgcatgttataataagtattaaagtaattataagcagctggaagttacgttacgtaagtaggattctgaattatgtaagaaataattaaagaaaattctgttgattatgttttcttggcttggtagtgaattctctagaatataccattgccagcttgttttacatttgtttttggcttgatgatgaatatggaccaggtcaccgccagctgacagggcattgtggttggtattctatggagaaaagttaagcaataccataaacgttacagtcaacgtcaaaccataagaaaaagagaattacgatcggaaagctcaagaataaacagcttccagaagattcgacgaccgatctaccgcatttaggcaaaacaactccttcacgtgaaggtagtaggagagaaatgagacgtgactttgatttaatttaatttaagattaagaattaagaccaacaaagtctgggtgttttagtcatttcgctagtcaaaagtcgatttgtcttaacgtgtggcgccggcgcgtgttttcatatattcacatgcttgctttatttatgtaatacgcaaaataccctaacaaagctccaccgctaatccttcgataccgaaccatttgaagaacgaaaagcaatggcttcattcgagcaagcgccgcccggaaatgcgaaagctggggagaagatcttcaaaaccaagtgcgcgcagtgtcacaccgtagataaaggcgctggtcacaagcaagggccaaatttgaatgggcttttcgggaggcagtccggcacaactgcgggatactcttattccgctgctaacaaaaatatggctgtggtttggtcagagaacacattgtatgactacttgcttaatcctaagaagtatattcctgggacaaagatggttttccctggattgaagaagccgcaggatcgtgccgatctcattgcatatctcaaggaatcaactgcctgatgggtgtgctttatatcagctattttggaacaaatgaaagagtttttgatcaatgatttttttctttttgttacatgatataaaaactaggcgattcgcataataaaaggaaaacagctccaatataaattgggttttggagttgaaccgagtagtgtaagaccaatcacatgaaaagtgaggcatttcaaattttcatgatttatttaggctccaacagtttcactgttaggtgctgttaacttgtttatcttaattcttgatgggatttggatgatttgcttggtagtctggtaggtgtagtgcaaatattgatttgaactttgtttagggcattgaatatctcatccttttttcaagagtgaataactcttttaaattggttttcaggtttcttctattgctcaaataaaaatcaacacacttgtttttgtaa

SEQ ID NO: 2543 - DNA, 3618 bp, Ricinus communis
agttttataagatggggataaagatcaataaagttagagaaattgcaataaaatcaacggatccaaattgccgttgaaaaatcaaatctatgagaaaaatcaatccaaatttgcaaattttttaacgtaatacgtaaatttttaattattttagcatccatatgcatgtcacacggcagcgtttcttcagttgtgtgtattcccaaatatctttcattccacgaagagggaggcctcttttttagttccaagcactgcagtaactgaaacgcaagtgaagaagaagccatggctacgtgtttacgagcactaccaataactacctgctcaataccatcgtcatcatcttcagcttcttctaattctcaatcactcaaaagaagaaacctaagaatcaattgctcttcatccaaaataccaatgcccccaatcaaccctaaagacccatttctatcgaaactagcctctatagctgccaattcacccgactcacttctggaccgccctatcacttccgatacgcctccctttcttgacctgtttgactctcctaaactcatggccactcccgctcaggttgagagatcagtatcgtataatgagcacaggccaaggaagccaccaccggacttgccttctttgcttctccatggcaggattgtttatattggcatgcctttggtgcctgctgtcacagagcttgtagttgctgaattgatgtacctgcagtggatggatcccaaagaacctatttatttgtacattaattccacaggaaccactcgtgatgatggtgaaacagtgggaatggaaacagaaggttttgctatctatgattcaatgatgcagttaaaaaatgagatacatacagttgctgttggagctgctattggccaggcttgtctactactagctgcaggaacaaaaggcaaacggtttatgatgccacacgcaaaagccatgatccagcaaccgaaagtcccatcttcaggactgatggctgcaagtgatgttcttatccgtgcaaaagaggcagtaactaacagggacacccttgttgaacttctagccaagcacactgaaaattcagtggagactgtagccaacgcaatgaaaagaccattttatatggattctagaagagctaaagagtttggagtcattgacaaaattctgtggcgtggccaggaaaagataatggcagacgttgtcactccagaagaatgggacaagatggccggcattaaaattgcagatccattttagtgaggatttagaactagtggcaatacaggcttgatttcggcccccaggacaatagaggacaggatggctggcattgggggacaaacaattactcattaagtgttgttccttttctgtgatggtatagtgttttaattggaagaaccggttgcaatgctggaagtggcgcagtgagagttatcttgttaaacgaagatactgtggatgacttaaagaatctgtggaagttgtgatgcatgagggctggaaaatggtgtagtaagataatatatatatttactgcaagtttctgtacgattttactggtcaccttactttccaattacaagcaagtttgtccttttatgtttcagtgtactaacattaatctgtttcttttatttttttcttgtgattcgaacattaaattttagaggtagtaagttagtattattaaacatgaacaattttctttgacaaaattatattttcttcatgatttccatttgaaatattattttcttatactctttggacttttcaattaattcaaagtttggttctatctaattataggcaactaatataaaattaaatttagtcaatataaaattataaaataaaatctttaaatattaaaggttaatatgatacagaaattttaattatggtccaaaaaattatgtaaaagctaatcatatttatttcattgtctaatgatatgagatctataattaattttcaatattaaaaaataccatctcaattcttttcggtttatatttttgcatataataatattaattttattatagtggtaaaataaaataataattttttctttattataataaaaaaataaaattattatattattattttttaaaaagtaaaaacagtgattattcaatttattctattaatgtaaatttttgagaatgtaattaagccatcttgaaatttggatttcttgaactctgccggaaagatgattggcttattcttacttttgacttagaattactatataagtgaagggtattcctgtccttttagtgaagacgtgtggctactgtcagagaaacaccctaacaccacactcgtctttgtttctagaaatcacgaattcgcgatccctctcttcaagtctcagctatatttcacgcctagctaggcaatagtgaattaatcgagaggaaaattcaaaccctaaacagaaaaatggcgacatttgagcaagcaccaccaggcgaatcaaaagccggagagaagatctttaagactaagtgcgctcaatgccacaccgtcgacaaaggcgctggccataaacaaggacctaatttgaatgggctatttggaaggcaatctggtacaaccgctggatattcttattcttcagctaacaagaacatggctgttatttggagcgagaatactctttatgactacttgctcaaccctaagaagtatattcctggaacgaagatggtgttccctggattgaagaagccacaagagcgagcagacctcattgcatatcttaaggaagcaactgcttaatctactgccttgtcccctttttttgtattcgttagtagtattgggttacttctcttaaaggaagaatctggccttgttgcaataaaaccagtcagggttcgaaatgctctgtattttgagagtttagatgtgtagggaaaattggtttctggtgtattgagccctttttcatgaggcatttcatgaacaatgataattttttctttcgaagagctaagctcatgtatagtatctgtttgtaattgtggcttttgtcgttataccctgtccttcattgaagatttttaacattttgtttaagagtctggagagtagaatgaattggagtttctgcaccttcaaatgacgaggaacaagattccaaattttaggcaagccttttatcctccgtatgaaagaatattgaaagaagaaaatggatctgcttccaaagctctatggtgcatatcctccatatggaccatatcagatgcatttgtggtcattgatgcagtatcaggccatatctctatactccctgggagattttgtcaattgtagaggaggtcatttcaagtttgtgattgtagcaattctgtttttccttatgatggtgactcgcctaaaggagatccccaagcgagtcgtggacttgccgcaaagtaattggccattaactcgtctcactagtgtcacgggtttagtctttctaccaacgaatcgtgtgacactagctattttttccatgcagacaagtaagttagtcagctttatttctcgaatgttaggcaaaatactagctaagatggcaaaaagaacaaaagagagttaaag

SEQ ID NO: 2544 - DNA, 991 bp, Saccharum officinarum
ctcggcgagcccccgaccaaacccgagacgcgtcccacgaaatgccctagcacgtagcgccgccgtccccaatcgaacggggcgtggggcgcccacgcttcccgtgcacgcgccgcccacggcttccttattctccaagccacggaaaccttctcgaaccctcccctttccccattctactccttttccacccctcggccctccgctcttctcaggggcagttccgtacttccatgacctgacgacctccaagcctggtctatagaacagccgggtccctgcgaattcggcgcaagtccaagggcacaccagaagttgcggttggcttcctcctcttctcctccgtcggctcagactcagatctctgcttgcggcgatggcgtcgttctcggaggctccccccgggaaccccaaggcgggcgagaagatcttcaagaccaagtgcgcgcagtgccacacggtcgataagggcgccggccacaagcaaggtccaaacttgaatggtctttttgggaggcagtcgggtaccaccgcaggctactcctactctgcgggaaacaaaaacaaggctgtggtctgggaggagaacactttgtatgagtacctgcttaaccctaaaaagtcattcctggaaccaagatggtcttccctgggctgaagaagccgcaggagcgtgctgatctcatcgcgtacctgaaggaagcaactgcatagtgcaatgacatgcctttgccatgaagagataaattcgtttttgcagtttaataaagacattttagacaatttgggtcactctgtttgaacagggtgcaatccacgtctcactattttcgttcgtatggtgtcggtattgaatgcctaggtgtttagctgtgcacaaaaaacagttaaactttgacggctcctatttcaactgctggagaaatgccagtgccctatttttgaccaccagattgcggaactggaaatctggatggaatgcatccatttt

SEQ ID NO: 2545 - DNA, 948 bp, Aristolochia fimbriata
ggtaaagtataaataagaaagccgagacgtgagcgtcacgtacgatcgaccctggtttttgcggagaaaagaaaccctagaagcctcgcggcctttccttctgtaaaaaagcgagcgagagagagtttcgaagcttttgagtcgtggttgacgatggcatccttcgctgaggctcctcctggcaatgcgaaggccggggagaagatcttcaagacgaagtgcgctcagtgccatactgtagataaaggagcgggacacaagcaaggaccaaatctaaacggcctttttgggaggcaatcagggactactcctggttactcatattctgctgctaacaagaacatggctgtgatttggcaagagtctactttgtacgactatttgcttaacccaaagaagtacattcctggcacgaagatggtctttcctggcctcaagaaaccacaagaacgagctgatctgattgcatacttgaaggaaggcactgcagagccatgatgccttttgcaatctttgccggacccaatggatctttttttgagtgtaggacaatttttttggcaataagacctatgcaaaaaggtcaagcctaatgctctatttgtttcggtgcagaaacttggtctaaagcttaaaaactttcctccacaacgtttctgggagatgataaccaatgtataacattttattgattgttcaagtctttccgtgtgatatattaaagattgatccgcagagaggaggaggtaaaacattgtgaatctcagtttgcataattctgcactttatctcaagtatgtgcatgaggtttttgatagcttgaaactcgtcatggcccggctcccaggtggctagattgctttacttggagcgagagaccttgatgatttttgtctagtaaaatgtgtcctaatgacttaattcttttaataagaaattatatgtgtg

SEQ ID NO: 2546 - DNA, 892 bp, Brassica juncea
gaattctcattttgacaaagagccataaacaaaaaaaaaaagaaggtcaggccgcttgaagaaaccgtcaaaaagcccccgtttcgttcagacttttccattcacgatcacaaatggcgtcgttcgatgaagcacctcccgggaacccaaaggccggagagaagatcttcagaaccaagtgtgcgcagtgccacaccgtcgacaaaggtgccggtcacaaacaaggaccaaacttgaacggattgtttggaaggcaatctggaacgactccagggtattcgtactctgctgccaacaagaacatggccgtcatgtgggaggagaagactctctacgattacttgttgaaccccaagaagtacattcctgggacgaaaatggtgtttcctggattgaaaaagccacaagatcgtgccgatctcatagcttatttgaaggaaggtactgcatagactggcttactcggatataatggagcctctattccccgttcattttttttttctcacagatttaataaatcagaccaaaagtattctggtcatgaactggatttatgttttcttctttgtcaacgaggcgagttgcctcgtataaagtcgaatattcgtttttgatgtgaagaaacaatctccaccacgaaatttgaattagattttattgtctgattgcctacttttgttagaaagcagatactgtaacgatgaaaattgtttggtctacatgaagaatatatatcagcttataacggcgatcagatcattaaccaggaaaagaaagaaatattagaatgtatgacttgaattggtaaaattccatgtacatacgagaataagttggccccaggcatctacgatttgtgttcgacttcttgatttatataggctttatt

SEQ ID NO: 2547 - DNA, 836 bp, Brassica rapa
tggcctgtggcgcgctcacgcagccacctcctctttcttctcttcctagaaccttcttttataacaattctcattttcacacaacgaagaggcgaagagccattaacaaaaaaaaagtcaggcttgaagaaaccattaaaaaggcaccgttctctctgacttttccattttcgatcacaaaatggcgtcgttcgatgaagcacctcccggaaacccaaaggcaggagaaaagatcttcagaaccaagtgtgcgcagtgccacaccgtcgacaaaggtgccggtcacaaacaaggaccaaacttgaacgggttgtttggaaggcagtctggaacgactccagggtattcttactctgctgccaacaagaacatggccgtcatgtgggaggagaagactctctacgattacttgttgaaccccaagaagtacattcctgggacgaaaatggtgtttcctggattgaaaaagccacaagatcgtgccgatctcatcgcttatttgaaggaaggtactgcgtagactgggttgctcggatataaatgaagcctctattctccttgcattttttttctcacagaaaaaataaatcagaccaaaagtattatggtcgtgaactggttatatgttttctttcttttctttgttaatgaggcgagttgcctcttatagtcgaatattcgtttttgatgtgaagaccaatctccaccacgaaatttaattacgagattttattctactttcttaattttgtaagaaagcagatactgttacgacgaaaattgtttggtctacgtaaagaaatttatatcagcgtataacggtgataaaatgtatg

SEQ ID NO: 2548 - DNA, 2234 bp, Brassica rapa
gagaatgagacgcacaaccaattctcttagttgattaggttctcgtctttactcccttaccaaatttggatattttcttgtattagacaccgactcgtttaaaagaagtgatcacagcttccactagctgtaatctcttttgactgattgactattttacttttacatggatgattaactggagcccactgaaaagcccatttagttatcggcccattattttgatagttaagagagagctctctcgtctcgtgcgttgttgtcctaacagaaacaaaccctaaagagaagcgagttccgtcttaattttctccccagcgaaaatggcgtcgttcgatgaagcaccaccaggaaactccaaggccggtgaaaagatcttcagaaccaagtgcgctcagtgtcacaccgtcgacaaaggcgccggtcacaaacaaggaccgaacctaaacgggctgtttggaaggcagtctggaacaacagccggttactcttactctgcggctaacaagaacaaggctgttgaatgggaagagaagaccttgtacgattacttgctcaatcccaagaagtacattcctggaacaaagatggtcttccctgggctcaagaagccacaagatcgcgctgatctcatcgcctacttgaaggaagctactgcttagtgaaatctatcaaccaatggtggtgtgggaacatcatgaattattattcttttgacaaataaaatgtccaaaacttttgaattttttttttcacttttggaaattgtctcttcttcaaatacgttttggtgagtaccaaatgtactcgtgagtactttcattttctgaggctcatttatataaatgcatctatctataagcattttcttttctcacatattgctgtgtagagaacaataatcaaattatatcacttcagtgtcatccttaaaaaccaaaaattcaacttttggttccatagttctctgctaaggttttaccaatcctcgagtttatccaatggattcagatgcgtcgatgtgctgttccctctttagtttgcctatctctctactcctcatcaatgtccttgatagcatcctgcaacacccaacaattagatccaagtgtgtaagcaaaatatgggatcagacgctgagacttttctgtgcttatgctacccaaagcttggaaccaattggtctgagaaaaagatatagtagaatagagtaagagcaaaacagttggttacctttgcaagacgtgtcacatatgttgcagccagtgcagttaccaacaaacccaacccgagtgttaaaagctggccgtttcctccaggcaagccaacattagattcttcttgctgaacacaacatagataccagatttgcccatttgatgattatgagaatcacaaagtattaacagtttcaacacattcatggacgttacaaaacacagcttgatgatctataaccctttttaactccctcctttatattaacagaacatacaagaaaacaacttgcaatgattgctcgtccaaaagccccagcactgacataagcccaagaccctggaagcatacccaaccagctgcaaaaaaaaacactagtatgtaaactcagaattcacctttatcaagttttcttaaaaagaaatcttgaaaaaaagtaggactaacacagaccttccaaagacataaggcacaaacttgacagaagtcaagccgtagaggtaattgccaagagagaaaggaaggagagggcttagccgaaggagagtaacaaccctaaacccattttcaccaatggctttatcaatggcgaggaacttcttgttgccttcaactaacttaaggatacgctctctagcaaagtatcttgcaatcagaaaagcaacactagcagccatctaaacaaaagaaaaatttagacaactaaacatgggaatgttacttggtgaaacagttttgtgggagaacaacttacagttccactgatagaaactatgatagtaccaacaagagaaccgaagaggagaccagccgacatggtcaacgggagagcgggaatggctagtatctatctaaccagaagtcaaacaaaaaagagctttgaaactgagacttgtcaagataaaaacattgaagagagtgtcaagaagcttgcctcaagcccagcatttacggcaatgaacagtgcgtacccagcaggaccataacctgtgtttattggttccacaacacaacac

SEQ ID NO: 2549 - DNA, 747 bp, Musa acuminata
tcattaaagggtaatttaggcaactccttgcgaacgaatctatatggaggacccatcggcgcgtgggggaagcaagtccgaaaccctaacaccagctttgcatcgagagcgaggaactcgtcggagagcgatcgatggcgtcgttcgcggaagctcctccgggcgatcccaaggccggggagaagatcttcaagaccaagtgcgcccagtgccacaccgtcgacaagggcgccggccacaagcaaggacccaatttgaacggtcttttcgggaggcaatctggaacgacggcaggttactcctactctgctgcaaacaagaacatggctgtggtgtgggaggagacaactttgtatgattacttgcttaaccctaagaagtatattcctggtactaagatggtttttcctggtctgaagaaggcacaagagcgtgcagatcttatttcttatctcaaacaatcaacagcttgagggttctatttttcccttccatgctgaaacaaaattatttttctgccaataagaccataacattatccttcttctaactagcagtttcctatggtatattctttataagtttcttcagtctcattgcccaggcaatgaactctcgcctgagatgtctagttttgtccctagaagctcgcagccacatttctatgaatatgaatacttgagtttaacatgtgacattttcttggtgttgcggcccgttaactgcatttgttctcgctttttgtga

SEQ ID NO: 2550 - DNA, 734 bp, Fagus grandifolia
atgtgtagcgtagttgttgaaatactggtcggagcttattgaaaagtaaaaaccctaaccacccttggatcgtatcagatcagagagtcatcgaaattcaaaaatggcgaccttcgctgaagcaccaccgggcaatcccaaggccggcgagaaaatcttcaagaccaagtgcgctcagtgccacactgtcgacaaaggcgctggtcacaaacaaggacctaatctaaatggtctttttggaaggcagtctggcacaactcccgggtactcctattctgctgcaaataagaacaaggctgtggattgggaagagaagacgttgtatgactacttgcttaacccaaagaagtacattcctggaacgaagatggttttccctggattgaagaagccacaggaccgtgcagacctcattgcttacttgaaggaatcaactgcataatccttttacttaggttagcacctaatattttttcagaagttgaagagtttggctgatggtgggaatttggaaaaatttcattgaaatagaagaacattattttctattttaaataaaaccatcaggggtttagtatatttttcttggagaataggttacgagtcaaaaattttgtgcaagacccttctcatatggcatttcatgaacacttttgattgttttatttttgggggcctatggtatatgactgctgtttggcattttatgataatctgtgaaataatttcctccg

SEQ ID NO: 2551 - DNA, 727 bp, Linum usitatissimum
gaacaaaccctagcttacatctctctctctctctcgcttagtttcgtctccgataatccgagctttcgttcactgtaatggcgaccttcaacgaagctcctcccggtaaccccgatgccggagcaaagatcttcaagaccaagtgcgctcagtgccataccgtcgacaaaggcgctggtcacaaacaaggtcctaatttgaatggacttttcggaaggcagtctggaactaccccaggctactcatactctgctgccaacaagaacatggctgtgaactgggcagagaacacattgtacgactacttgcttaaccccaagaagtacatccctggaactaagatggtgttccctggactgaaaaagccgcaggagcgtgctgaccttattgcgtatctgaagcaatccaccgcctgatcatattgattttgacacagattcgtgttgccattaaatggtgtccctcccaaattggacttggtttttcatttttcatcttctgaaatagaagcagtaggcattccttgaaataaagaacaccgttttggattgggaagttccctatactatattcagttaggggaaggtataattgatgagctgagactcagttatgagttttgtctgtgaggccgtttgctggacctctaaattgattttcggaatagccatatatactattggaattttcttgcatctcttgtgttttcagttaacatctttaacgg

SEQ ID NO: 2552 - DNA, 936 bp, Gossypium raimondii
aaaactttaggttttttaacacacaatagttgtgttgtctttcacgtgtggtgtcggagcacgcttcgtgtgcccgcctagtgcctactattatattctactctcattaaataaatatttacatttttttatttaaaaaattgcttaatatattaatagtacgccaaaaccctaattaagcttcgccgttcttttttatataaaaaccaaaaaccatcaacgaaaaacaaaagctttgattttgaaaaaaaaaaaaaaaacccccaaaaaccctaattcggaaaaaaaatcaaaagcaatggcctcattcgagcaagcaccgcctggtgatgcgaaagctggggagaagatcttcaagaccaagtgtgctcagtgtcataccgtcgataaaggcgccggtcacaagcaagggccaaatttgaatgggcttttcgggaggcagtccgggacaacaccgggatactcgtactctgctgctaataaaaatatggctgtgatttggggagagaatactttgtatgactacttgcttaatcctaagaagtacattcccgggacaaagatggttttccccggattgaagaagcctcaagatcgtgccgacctgattgcatacctgaaggaatcaaccgcctgattcgtctctggttttattaatttcacctatattttggaactgtgacaaaatgaagaattttgatcaatgatgtatttttattacatggaaaaaaaaaccattcttgaaataaagttaaaccttgaaaacaactccaaagataattggagttgaaaatgatttttgttaagactaaaatctcttgatgatgaggaatttgattattacatgctggtttatttgaagatgttcaagccttcccacttggtctttggaatgttgatttaagatttagtcttttatttttatattttcaagaa

SEQ ID NO: 2553 - DNA, 619 bp, Carpinus betulus
tctgagagagtggaaattccattacatttcatttgaagagaaaatggcaagcttcgatcaagctccacccggtgatcccaaggtcggagagaagatcttcaagaccaagtgcgcccagtgccacaccgtcgacaaaggcgctggtcacaaacaaggtcctaatctgaatggtcttttcggaaggcagtctggcacaactcctgggtactcctattctaccgcaaacaagaacatggccgttaattgggaagagaagacgttgtatgattacttgcttaacccaaagaagtacattcctggaacaaagatggttttccctggattgaagaagccacaggagcgtgccgacctcattgcttatctgaagcaagcgactgcctgattcttttgcttaggtcatctagtattttgtcagaatttgaagagtttggctagtggtgccaatttgaaaatttttattgaaaagaagaaaatactttcttgtttaaataatatcttcaggcatttaacacgctctctttgttggagaaataggctacatgtccaaaaaaattttgtttagtcccttcttatatggcatttcctgaacaacagatgattttataagatctgatatgcg

SEQ ID NO: 2554 - DNA, 612 bp, Carpinus betulus
tctgagagagtggaaattccattacatttcatttgaagagaaaatggcaagcttcgatcaagctccacccggtgatcccaaggtcggagagaagatcttcaagaccaagtgcgcccagtgccacaccgtcgacaaaggcgctggtcacaaacaaggtcctaatctaaatggtcttttcggaaggcagtctggcacaactcctgggtactcctattctaccgcaaacaagaacatggccgttaattgggaagagaagacattgtatgattacttgcttaacccaaagaagtacattcctggaacaaagatggttttccctggattgaagaagccacaggagcgtgccgacctcattgcttatctgaagcaagcgactgcctgattcttttgcttaggccatctagtattttgtttgaatttgaagagtttggctagtggtgccaatttgaaaatttttattgaaaagaagaaaatactttcttgtttaaataagatcttcaggcatttaacatgctctctttgttggagaaataggctacctgtccaaaaaaattttgttagtccttcttatatggcatttcctgaacaacagatgattttataagatctgat

SEQ ID NO: 2555 - DNA, 839 bp, Elaeis guineensis
ctatcggtctttgccgcgtgaagggaagcgaagcaaaccctaaccctagatctcgaatggcgtcgttcgcggaggctcctcccggcaatgcgaaggccggggagaagatcttcaagacgaagtgcgcccagtgccacacggtcgagaagggggccggacacaagcaaggacctaatttgaatggactttttggaaggcaatctggtaccacacctggttattcgtactctgctgcaaacaagaacatggctgtgacatgggaggagtcaacattgtatgattacttgcttaatcctaaaaagtacattcctggtaccaagatggttttccctggactgaagaagccacaggagcgtgcggaccttattgcttatctcaaagagtccacagcaccttaaatccgtaacaacctattataccgcggacaaattttttgggcaaataagatttgaagggtcatcctgcttttttcaaagcggtggagccataaaaacatttattctttgacgagttcctcttaaattgtttccatctaccaagggattgtttccctgagataaatttattttggctgtaaaatttagctctgcaacatttccaggaataccagtaattgtgagatcatttgtgacatccagcagatgccccaaaattaacaaataaccattattcaggacaatcttttagtgctttggatgtggtgcgcaggaggttgtttgtggtcagtcttgtttgctatgatttttgaggattggatagagggatggggattcattgtaatctctttctttacgcgaacaggatcatcagatggtcaggtggctggcctttgcgaaaaa

SEQ ID NO: 2556 - DNA, 592 bp, Papaver somniferum
gaaagctccttttttggggacgaagaacgaagttttgttaaccctagttctttttctctctaaacttgtagatcgagaaatggcttcattcgaacaagctccaccaggagatgctaaggccggggagaagatcttcaagactaaatgcgctcagtgccatactgtcgacaaaggagccggtcacaagcaaggacccaatctgaatggtctcttcggaaggcagtctggtacaactgctggatactcctactcctctgccaacaagaacatggctgtgaactgggaagagaagacattatatgattacttgctaaacccaaagaagtacattcctggaacaaagatggttttcccaggtctgaagaagccacaggaaagggctgacctcatcgcttatctgaagcaatccactgcctaattcttctattgcgctctcggattatttgcagaaccttgaggtgtttgttacaggggtgatcggataggacacaattttttcaaataaaaccttattaaactatttcaactgcagtttcttttgaatgagttttagagagtagggaaagtgactctcttatgaaaggcaaaaacc

SEQ ID NO: 2557 - DNA, 868 bp, Secale cereale
gggggttttgttctcgtaatctcgcggcacccgctttaaaacaggcagagccagaacagaccagaacgagcccgatcaccattccccgcccgcctccagcctcctgcgactcggatcgcccagggatccccaaccctacctagtccggcaaccgtccgcgcgggatcggcggcagcggcgatggcgtcgttctcggaggcgccccccgggaaccccgcgtccggcgagaagatcttcaagaccaagtgcgcccagtgccacaccgtcgacaagggcgccggccacaagcaagggcctaacctgaatggtctgtttgggaggcagtctggcacaactcctggatattcttactctacggccaacaagctcatggctgtgaattgggaggagaaaacactgtatgactacctgcttaatccaaagaagtacatccctggaactaagatggtgttccctggactgaagaagccccaggagcgtgctgatctcattgcatacctgaagggtgccacagcatgaaagggccttgttttactgccatggttctaaaacagttaataaatatagacattgcgacggtgtcactcttgtttgaccgggtgcatcaccgagacatctaaagagtttggtactagcatttctccttacggtgtttttcttttcttcagcaaaatgcactgctgtaatggccgtttctcaggcctgttgtgaacctgttgttgttgttgttgctgacgatgatcagttgtttgggcagtacatctcaagcataaccaaaaaaaaaaaaaagaaaaaaaaaaaataaaatactgcgtgtatacacgcgtgtcttgagacgtcgcaacgagacaacaggagagtggggggg

SEQ ID NO: 2558 - DNA, 685 bp, Secale cereale
gactcggatcgcccagggatccccaaccctacctagtccggcaaccgtccgcgcgggatcggcggcagcggcgatggcgtcgttctcggaggcgccccccgggaaccccgcgtccggcgagaagatcttcaagaccaagtgcgcccagtgccacaccgtcgacaagggcgccggccacaagcaagggcctaacctgaatggtctgtttgggaggcagtctggcacaactcctggatattcttactctacggccaacaagctcatggctgtgaattgggaggagaaaacactgtatgactacctgcttaatccaaagaagtacatccctggaactaagatggtgttccctggactgaagaagccccaggagcgtgctgatctcattgcatacctgaagggtgccacagcatgaaagggccttgttttactgccatggttctaaaacagttaataaatatagacattgcgacggtgtcactcttgtttgaccgggtgcatcaccgagacatctaaagagtttggtactagcatttctccttacggtgtttttcttttcttcagcaaaatgcactgctgtaatggccgtttctcaggcctgttgtgaacctgttgttgttgttgttgctgacgatgatcagttgtttgggcagtacatctcaagcatactataaacttatttcttcgg

SEQ ID NO: 2559 - DNA, 724 bp, Secale cereale
cccgatcaccattccccgccgcctccagcctcctgcgacccggatcgccttccgttcctccagccgagggatccccaaccctacctagcccggcaaccgtccgcgcgggatcagcggcagcgacgatggcgtcgttctcggaggcgcccccggggaacccggcgtccggcgagaagatcttcaagaccaagtgcgcccagtgccacaccgtcgacaagggcgccggccacaagcaagggcctaacctgaatggtctgtttgggaggcagtctggcacaactcctggatattcttactctacggccaacaagctcatggctgtgaattgggaggagaaaacactgtatgactacctgcttaatccaaagaagtacatccctggaactaagatggtgttccctggactgaagaagccccaggagcgtgctgatctcatcgcatacctgaagggtgccacggcttgaaagggctttgctttgctgccatggccctaaagtgaataaaaatagacattgccacggtgtcactctggtttgacggggtaaattgccgagacatttaaagagtttggtactagcatttctccttacgatggtttctttccttcagcaaaatgcactgctgtaatggccgtttctcaggcctgttgtgaacctgttgttgttgctgacgatgatcagttgtttgggcagtagatctcaagcatactataaacttatttctt

SEQ ID NO: 2560 - DNA, 1105 bp, Secale cereale
ccacgacgacgagtacgatggggagcccgatcacccattccccgccgcctccagcctcctgcgacccggatcgccttccgttcctccagccgagggatccccaaccctacctagtccggcaaccgtccgcgcgggatcagcggcagcggcgatggcgtcgttctcggaggcgcccccggggaacccggcgtccggcgagaagatcttcaagaccaagtgcgcccagtgccacaccgtcgacaagggcgccggccacaagcaagggcctaacctgaatggtctgtttgggaggcagtctggcacaactcctggatattcttactcgacggccaacaagctcatggctgtgaattgggaggagaaaacactgtatgactacctgcttaatccaaagaagtacatccctggaactaagatggtgttccctggactgaagaagccccaggagcgtgctgatctcatcgcatacctgaagggtgccacggcttgaaagggctttgctttgctgccatggccctaaagtgaataaaaatagacattgccacggtgtcactctggtttgacggggtaaattgccgagacatttaaaagagtttggtactagcatttctccttacgatggtttctttccttcagcaaaatgcactgctgtaatggccgtttctcaggcctgttgtgaacctgttgttgttgctgacgatgatcagttgtttgggcagtagatctcaagcatactataaactttatttcttgggcacggattatggtctgaacacgcatgctagctcgtactaggaacgcactaactcagacaatgagatgtcagatggtggatggggtaaatttaagaccctgcacaactggacagtacctagctagcaggggcagtgatgtggtgttgatgcgttcctggctgaagtttccaattctggtgtaagtttcagcccatagccacccccatcacgccatgtgagtgcaggggtaggcagagaaagaaccagcgcaatattgcagaggtcaccatacgtacgtccctgtgtcgtagggtccggaaaccacagaccgtcttacgggactgccgaacgagacacaagggtacgagggt

SEQ ID NO: 2561 - DNA, 611 bp, Secale cereale
cgttcctccagccgagggatccccaaccctacctagcccggcaaccgtccgcgcgggatcagcggcagcgacgatggcgtcgttctcggaggcgcccccggggaacccggcgtccggcgagaagatcttcaagaccaagtgcgcccagtgccacaccgtcgacaagggcgccggccacaagcaagggcctaacctgaatggtctgtttgggaggcagtctggcacaactcctggatattcttactctacggccaacaagctcatggctgtgaattgggaggagaaaacactgtatgactacctgcttaatccaaagaagtacatccctggaactaagatggtgttccctggactgaagaagccccaggagcgtgctgatctcattgcatacctgaagggtgccacagcatgaaagggccttgttttactgccatggttctaaaacagttaataaatatagacattgcgacggtgtcactcttgttttaccgggtgcatcaccgagacatctaaagagtttggtactagcatttctccttacggttgtttttcttttctttcagacaaaatgcactgctgtaatggtccgtttctcaggcctgttgtgaacc

SEQ ID NO: 2562 - DNA, 767 bp, Eutrema halophilum
tggcctgtggctcgctcacgccgccacctcctcttcttcttcttcctcgaagcttctttttgaacaattcccgttttcacatacggaagagtctttcaaaaaaaagaaaccgtcaaaaagccaccgtttgttctgatttttcgtcctcgatcaaatggcgtcgttcgatgaagcacctcctggaaaccctaaggccggagagaagatcttcagaaccaagtgtgcgcagtgccacaccgtcgataaaggtgccggtcacaaacaaggaccaaacttgaatggattgtttgggaggcaatctggaacaactccgggatattcttactctgctgctaacaaaaacatggctgttatgtgggaggagaagactctctacgattacttgttgaaccccaagaagtacattcctgggacgaaaatggtgtttcctggactgaaaaagccacaagatcgtgctgatctcatcgcttatttgaaggaaggtactgcatagacaagacaacgctcgctcggacatacatgcagcctctattcccgttcatttttttaaacagataaaataaatcagacccgaaaaatattgtggtcatgaactggttttctatatgctcttttttttacacttggttgatgaggcgagttgcctcttataaagtcgaatattcgtttttgatgtgcagaacccaatctccaccacgaatatttatgagaattttatccaacttgcctacttttgtttacaaagcagattctagaagacaaaaatt

SEQ ID NO: 2563 - DNA, 814 bp, Citrullus lanatus
gggccctatccggtgcattggtatataacgaagcaaaatacaaagaatagcttctccatccttctacaaacaccgcgaaccctagccttcagatctgaacgccacctaattcctacgccatggcgagctttgacgaagcccctcccggcaattccaaagctggagagaagatcttcaagaccaaatgcgctcagtgccacactgtcgacaaaggggctggtcataagcaaggtcccaatttgaatgggctatttggacggcagtctggtacaactcctggatactcttactctgctgccaacaagaatatggccgtgatatgggaagaaaagacgttgtatgattacttgcttaaccccaagaagtacattcccggaacaaagatggttttcccagggctgaagaaaccgcaggatcgtgccgaccttattgcttatctgaaggaatcaactgcttaaatgagatatatatgatgcgtctgccaatctagaattttttgagactcttttcccccctcattaaataagaacattgaggaaaattagatgaaaatttggaggtaacatacgaagtaattccgtgtcagaaagacttggtcttgtgaaaaccacaagaattccttttcttttcattaatttcttattttgcagagttaatccaatttgtagctttacattgttattgtgtgaacataactgctacaattttttttggccaagccggttatggcaatttatttttcataataaatatcacacttgttacagctttaccaatttgtaaatgcttacctaagaataatagggtttattaa

SEQ ID NO: 2564 - DNA, 910 bp, Brassica oleracea
gagaatgagacgcacaaccaattctcttagttgattagattaggtttctcgtctttactcccttaccaaattttggagattttcttgtattagacaccgactcgtttaaaagaagtgatcacagcttctattagctcaaaaaaaaaagcttctattagctgtaatctcttttgactgattgattattttctacagttatttataccatacttttacatggatgattaactggagcccactgaaaagcccatttagttatcggcccattattttgatagttaagagagctctctcgtctcgtgcgttgtcctcacagaaacaaaccctaaagagaagcgagttccgtcttaattttctcccccagcgaaaatggcgtcgttcgatgaagcaccaccaggaaactccaaggccggtgagaagatcttcaggaccaagtgcgctcagtgtcacaccgtcgacaaaggcgccggtcacaaacaaggaccgaacctaaacggtctgtttggaaggcagtctggaacaacagccggttactcttactctgcggctaacaagaacaaagctgttgaatgggaagagaagaccttgtacgattacttgctcaaccccaagaagtacattcctggaacaaagatggtcttccctgggctcaagaagccacaagatcgcgctgatctcatcgcctacttgaaggaagctactgcttagtcaatctatcaaccaatggtgttctgggtcatcattaattattattcttttgacaaataaaatctccaaaacttttgaaactttttttttacttttggatattgtgtcttcttcaaatatgttttggtgagtaccaaatgtactcatgagtactttcattttctgaggctcatttatataaatgcatctatctataaactgg

SEQ ID NO: 2565 - DNA, 640 bp, Brassica rapa
gagccattaacaaaaaaaaagtcaggcttgaagaaaccattaaaaaggcaccgttctctctgacttttccattttcgatcacaaaatggcgtcgttcgatgaagcacctcccggaaacccaaaggcaggagaaaagatcttcagaaccaagtgtgcgcagtgccacaccgtcgacaaaggtgccggtcacaaacaaggaccaaacttgaacgggttgtttggaaggcagtctggaacgactccagggtattcttactctgctgccaacaagaacatggccgtcatgtgggaggagaagactctctacgattacttgttgaaccccaagaagtacattcctgggacgaaaatggtgtttcctggattgaaaaagccacaagatcgtgccgatctcatcgcttatttgaaggaaggtactgcgtagactgggttgctcggatataaatgaagcctctattctccttgcattttttttctcacagaaaaaataaatcagaccaaaagtattatggtcgtgaactggttatatgttttctttcttttctttgttaatgaggcgagttgcctcttatagtcgaatattcgtttttgatgtgaagaccaatctccaccacgaaatttaattacgagattttattct

SEQ ID NO: 2566 - DNA, 849 bp, Phaseolus vulgaris
actactgtattcgagaaaggggttaggtgggaagtgaaaagtgaggttttaaaaagattttatgtgaccgccttgtggtgtagtgtggtggcgtggtgctataatctcatttcaacttcatttggtttcatttgcatttcatttggcgttttgcttctcgaagcttctgtagcacagatccatggcgtctttcgatgaagctcctcccggaaactccaagaacggcgagaagatcttcaagactaagtgtgctcagtgccacaccgtcgataagggtgccggtcacaaacaaggacccaatctgaatggtttgtttggaaggcaatctggcacaaccgctggatattcctattcttctgctaacaaaaacagggctgtgacttgggaggaaaataccttgtatgattacttgctcaatcccaaaaagtacattccagggacgaagatggtatttcctggtcttaagaaacctcaggatcgtgcagatcttattgcttatcttaaggaatccactgcgtaatgattaaactttcatacatacaacgcactgttcattcgaagtttccgagatttaaattttcagacatttaattacgtggtgcagtgagtactgtatcaacaaataaagtagacttgattggtttgcaatgctattttgttcattttgcattgcttcttaagaagttgcaatatatgggctaatgccctattgatgtagcagttgaaagtttaaacattgttgttgatatttaatttgccagaaccataatttggtctacctttgctggacaagcaaattttcaaatcttataatttcttactttggtttgcttagctgaatgcaacgca

SEQ ID NO: 2567 - DNA, 751 bp, Phaseolus vulgaris
ggaggttttaaaaagattttatgtgaccgccttgtggggtagtgtggtggcgtggtgctataatctcatttcaacttcatttggtttcatttgcatttcatttggcgttttgcttctcgaagcttctgtagcacagatccatggcgtctttcgatgaagctcctcccggaaactccaagaacggcgagaagatcttcaagactaagtgtgctcagtgccacaccgtcgataaaggtgccggtcacaaacaaggacccaatctgaatggtttgtttggaaggcaatctggcacaaccgctggatattcctattcttctgctaacaaaaacagggctgtgacttgggaggaaaataccttgtatgattacttgctcaatcccaaaaagtacattccagggacgaagatggtatttcctggtcttaagaaacctcaggatcgtgcagatcttattgcttatcttaaagaatccactgcgtaatgattaaactttcatacatacaacgcactgttcatttgaagtttccgagatttaaattttcagacatttaattacgtggtgcagtactactgtatcaacaaataaagtagacttgattggtttgcaatgctattttgttcattttgcattgcttcttaagaagttgcaatatatgggctaatgcccattgatgtagcagttgaaagtttaaacattgttgttgatatttaatttgccagaaccataatttggtctacctttgctggacaagc

SEQ ID NO: 2568 - DNA, 1350 bp, Theobroma cacao
aaatttaattaaaagggtattgtggacattaattgaacggctaaaaattcgccacgtgtaagtatcggaggggttgttgctgttgtcgagctgtggcaagccacgctccttccttcccttacttttcttctctctggaatattcgcagaaagctctcgaaaaggacgtttcgctttgcttacccgcccttctcttctcttgtcttctttcttaacaattccgaagcttttaaccctagagaaaaaccaaacaacatcaacgaaaaatggcgtcgttcgaggaggcaccgcctggtaattcaaaggccggagagaagattttcaagaccaagtgcgcccagtgccacaccgtcgagaaaggtgccggtcacaagcaagggcccaatctcaacggtctgtttggaaggcaatcgggtacaactccagggtactcatactccgctgctaacaagaacatggctgtgaattgggaggagaaaactctgtatgattacctcctcaatcctaagaagtacatccctggaacaaaaatggttttccctggattgaagaagccacaggaacgtgctgacctcattgcatatttgaaggaatctacagcaccctaaatggttttgcacagtcttggtttacctactccattttgcagtcattggagattgtttctcacagcaaggatataataaattcgaccttgttggtcagccatgctctttgtagaatgagcattcttagtaattgtttatttgagaagaggttgccattgctgtcataagtaaggcatattcaatttagacttcatgaatttctggtgaattaccagcatgcaaatgagaatttttttcatactgttaaccaaattccactgcttctcatttcaagttttatttggcggaatgtttaaacgtaatgatgctattttccagctcaaacctcaatactctattctaggcagtttatgtgggtatgtcagtgttagggtgcatgttttggttgtgtgtgctctcccatcttcatgaagaaatgttccttttatggttttatggaagcaattgacatgagacattgcttttcctagcatctgtaggaagatgctgatgatatgttgacaagaagctgtggaatgctagttgacatactgagtgattgccttgccttggcttaggctatctttaattgttcggtaactgtttcatgaaaaaggcacagaaaagctcattaagaggcaaaatgttattatccatgaccgtgagccagatgtgcttttgtgttggatgtgttgttagtacgtttacggattttacatttgtaaaagatggagatagatcttgaatatataacctaacctaaa

SEQ ID NO: 2569 - DNA, 604 bp, Brassica napus
caggcttgaagaaaccattaaaaaggcaccgttctctctgacttttccattttcgatcacaaaatggcgtcgttcgatgaagcacctcccggaaacccaaaggcaggagaaaagatcttcagaaccaagtgtgcgcagtgccacaccgtcgacaaaggtgccggtcacaaacaaggaccaaacttgaacgggttgtttggaaggcagtctggaacgactccagggtattcttactctgctgccaacaagaacatggccgtcatgtgggaggagaagactctctacgattacttgttgaaccccaagaagtacattcctgggacgaaaatggtgtttcctggattgaaaaagccacaagatcgtgccgatctcatcgcttatttgaaggaaggtactgcgtagactgggttgctcggatataaatgaagcctctattctccttgcattttttttctcacagaaaaaataaatcagaccaaaagtattatggtcgtgaactggttatatgttttctttcttttctttgttaatgaggcgagttgcctcttatagtcgaatattcgtttttgatgtgaagaccaatctccaccacgaaatttaatta

SEQ ID NO: 2570 - DNA, 684 bp, Brassica napus
cgaagagccattaacaaaaaaaaagtcaggcttgaagaaaccattaaaaaggcaccgttctctctgacttttccattttcgatcacaaaatggcgtcgttcgatgaagcacctcccggaaacccaaaggcaggagaaaagatcttcagaaccaagtgtgcgcagtgccacaccgtcgacaaaggtgccggtcacaaacaaggaccaaacttgaacgggttgtttggaaggcagtctggaacgactccagggtattcttactctgctgccaacaagaacatggccgtcatgtgggaggagaagactctctacgattacttgttgaaccccaagaagtacattcctgggacgaaaatggtgtttcctggattgaaaaagccacaagatcgtgccgatctcatcgcttatttgaaggaaggtactgcgtagactgggttgctcggatataaatgaagcctctattctccttgcattttttttctcacagaaaaaataaatcagaccaaaagtattatggtcgtgaactggttatatgttttctttcttttctttgttaatgaggcgagttgcctcttatagtcgaatattcgtttttgatgtgaagaccaatctccaccacgaaatttaattacgagattttattctactttcttaattttgtaagaaagcagatactgttacgacg

SEQ ID NO: 2571 - DNA, 627 bp, Brassica napus
agcagtcctattaaagcagagtacgcgggggtcctaacagaaacaaaccctaaagagaagcgagttccgtcttaattttctgcgaaaatggcgtcgttcgatgaagcaccaccaggaaactccaaggccggtgagaaaatcttcagaaccaagtgcgctcagtgtcacaccgtcgacaaaggcgccggtcacaaacaaggaccgaacctaaacgggctgtttggaaggcagtctggaacaacagccggttactcttactctgcggctaacaagaacaaggctgttgaatgggaagagaagaccttgtacgattacttgctcaaccccaagaagtacattcctggaacaaagatggtcttccctgggctcaagaagccacaagatcgcgctgatctcatcgcctacttgaaggaagctactgcttagtgaaatctatcaaccaatggtggtgtgggaacatcatgaattattattcttttgacaaataaaatctccaaaacttttgaatttttttttcacttttggaaattgtgtcttcttcaaatacgttttggtgagtaccaaatgtactcatgagtacttccattttccgaggctcatttatataaatgcatccatctataagca

SEQ ID NO: 2572 - DNA, 590 bp, Brassica napus
acagaaacaaaccctaaagagaagcgagttccgtcttaattttctgcgaaaatggcgtcgttcgatgaagcaccaccaggaaactccaaggccggtgagaagatcttcagaaccaagtgcgctcagtgtcacaccgtcgacaaaggcgccggtcacaaacaaggaccgaacctaaacggtctgtttggaaggcagtctggaacaacagccggttactcttactctgcggctaacaagaacaaagctgttgaatgggaagagaagaccttgtacgattacttgctcaaccccaagaagtacattcctggaacaaagatggtcttccctgggctcaagaagccacaagatcgcgctgatctcatcgcctacttgaaggaagctactgcttagtcaatctatcaaccaatggtgttctgggtcatcattaattattattcttttgacaaataaaatctccaaaacttttgaaactttttttttacttttggatattgtgtcttcttcaaatatgttttggtgagtaccaaatgtactcatgagtactttcattttctgaggctcatttatataaatgcatctatctataagca

SEQ ID NO: 2573 - DNA, 599 bp, Brassica napus
aaacaaaccctaaagagaagcgagttccgtcttaattttctcttgttgtctctccagcgaaaatggcgtcgttcgatgaagcaccaccaggaaactccaaggccggtgagaagatcttcagaaccaagtgcgctcagtgtcacaccgtcgacaaaggcgccggtcacaaacaaggaccgaacctaaacggtctgtttggaaggcagtctggaacaacagccggttactcttactctgcggctaacaagaacaaagctgttgaatgggaagagaagaccttgtacgattacttgctcaaccccaagaagtacattcctggaacaaagatggtcttccctgggctcaagaagccacaagatcgcgctgatctcatcgcctacttgaaggaagctactgcttagtcaatctatcaaccaatggtgttctgggtcatcattaattattattcttttgacaaataaatctccaaaacttttgaaactttttttttacttttggatattgtgtcttcttcaaatatgttttggtgagtaccaaatgtactcatgagtactttcattttctgaggctcatttatataaatgcatctatctataagc

SEQ ID NO: 2574 - DNA, 733 bp, Ricinus communis
cccctacctctccctctctctctattagcggtctgcgctctcctttttaagttatcacggacaaatcgaaaccctagctaatccattcgcctctgtgatctcgtgtgaagttctactgaaatggcgtcattcgatcaagcaccacctggcgatgtaaaagccggagagaaaatcttcaaaactaagtgcgctcagtgccacaccgtcgagaaaggcgctggccacaaacaaggaccgaacttgaatgggctgtttgggagacaatcaggaacaactgcaggatattcatactctgcggctaataagaatatggctgttcaatggggagagaatacgctttatgactacttgcttaaccctaagaagtacatccctggaactaagatggtcttccctggattgaagaagccacaggaccgtgcagacctcattgcctatctgaagcaagctactgcctgatccccttgattaatagggctatttttaccaaatgatttgtgacattcattggttgtcccaaacaattttttttttttttcagataaactgtccacttgaaataacacagcttaaggcttaaaggtgctctttcctttgatagttgagatgattagagaaaaatttctgttattttcatgaggcatttcatgaaacccgattattttttgtagctcatactgtctattgataaatttgttttcatgaattattaatcatatgttttgtttttctg

SEQ ID NO: 2575 - DNA, 1968 bp, Ricinus communis
cgtgccaccccccgaagtagccgtattttttcttttcctcccctacctctccctctctctctattagcggtctgcgctctcctttttaagttatcacggacaaatcgaaaccctagctaatccattcgcctctgtgatctcgtgtgaagttctactgaaatggcgtcattcgatcaagcaccacctggcgatgtaaaagccggagagaaaatcttcaaaactaagtgcgctcagtgccacaccgtcgagaaaggcgctggccacaaacaaggaccgaacttgaatgggctgtttgggagacaatcaggaacaactgcaggatattcatactctgcggctaataagaatatggctgttcaatggggagagaatacgctttatgactacttgcttaaccctaagaagtacatccctggaactaagatggtcttccctggattgaagaagccacaggaccgtgcagacctcattgcctatctgaagcaagctactgcctgatccccttgattaatagggctatttttaccaaatgatttgtgacattcattggttgtcccaaacaattttttttttttttcagataaactgtccacttgaaataacacagcttaaggcttaaaggtgctctttcctttgatagttgagatgattagagaaaaatttctgttattttcatgaggcatttcatgaaacccgattattttttgtagctcatactgtctattgataaatttgttttcatgaattattaatcatatgttttgtttttctgaattgatcctgttattagagtcatattctttgttgcacttgccaacaaagttattaatatatcttcttatggctgcatatagtgcaaagtatgttttggagattgaattatgattttggcctgataggtgcttttgtgtatctttcagctagttgactaacaagtatttggttcttttcatgctgaggtccttctatggtggattcattttcaacagatgtgaatgatccttggtcatggctcttccattcttgattattaaagtgttacaagctgtgtccttttatgttccttctgcttaatgtggggatatgattgtttgcttgattttcaataattatattaatatccggaaaagtctagtgaagttttaggggatggtaaaagttgttgagccttatgcgtacaaggcaaaccaggacttaatggtgcttgctatattctagactaataatcactgggttcttcggtgttagtggttggcctccaattcttcgagatcgttcttggaaggctgtgtagtttggaattaatgtcacattgaagtttctagtaggttgtttgacatgcatatttagatggctaaacaaggaaaaggattgtcccaacttaaagcgagttaaatggtgatgagatgtaatcttatacattgtgttgaaaggcaatatcattgtgaagaaggctacgttttggacatgtatcatgtagatggacctgaaggagagcaggatggtttctttttattatattaaactacgctagagagtagagtcttgagtcttggtagaaggttactgtgttgatttgacagttttatggagtctgttttatgttccctgaggctttactggtaggagtagggagtccatgcaagattactctctataataggatgcagtttccttcaacttcaatagttagttttataaatttactgggtatagtaagatgtaactttttccatcgggacataggactaggagtgtgcccgtgtatctttaatccagccagccttattatggaccatgttagtgacttgattaatttgtactttctatgtttgagtttgatttgacagagcctttgatttggaatctactttatttgattttataagcttcacaggactttaccatttttcatttaaatttaaggtgcaattgatgtctctttttttttttttacttaattttcca

SEQ ID NO: 2576 - DNA, 582 bp, Cleome spinosa
tccctcattccttctctctccccctctctacccctctctttctgtgtagcgtttgatctcttggagaagatggcgtcgttcgacgaagcaccgcctgggaactccaaggcaggagagaagatctttaggaccaagtgtgcgcagtgccacaccgttgaaaaaggcgccggtcataagcaaggaccgaacttgaacgggttgttcggaaggcaatctgggacaactccaggatactcatactccgcggctaacaagaacatggctgtgatctgggaggagaagactctatacgattacctgttgaaccctaagaagtacattccgggaacgaagatggtgtttcctgggctgaagaagccgcaagaacgtgctgatctcattgcgtatttgaaggaagccactgcttgaattggagcttcggcattctggtagtgaaggtcattactcccctcgattcttttcgccaataaattaaatcacaccgtctctggtcacgatcggcattttgttttgctttttgccttgcaaaagaggcgagttgctctgcctccgataatttcaatgttttatgctacgatatag

SEQ ID NO: 2577 - DNA, 723 bp, Cucurbita pepo
gcgaaccctagctctcagatctgaacgcaacctcattccaacgccatggcgagctttgacgaagcccctcccggcaattccaaagctggagagaagatcttcaagaccaaatgcgctcagtgccacactgtcgacaaaggagctggtcataagcaaggtcccaatttgaatgggctatttggacggcaatctggtacaactcctggatactcttactccgctgccaacaagaatatggctgtgatatgggaagagaagacattgtatgattacttgcttaaccccaagaagtatatacccggaacgaagatggttttcccagggctgaagaaaccgcaggatcgtgccgaccttattgcttatctgaaggaatcaactgcttaatgatacggtgcttccgcctgtctagaatttgttcacaccctttttactcccttcattaaataagaacattgaggttagatggaaatttggaggtcacgtacaaagtaattctctgtcagacagatttgtcttgtgaaaatcacaagagttccctttttttattaaattcttatttcccttcgctattatacatcatttgcagagttcatccatttgtagcttacgtgttggtttgtgacataactgctaaacttttggaaagccggttatggcaatcttttttcataataatagcacgcttgtaagaacctgtcaattcattcatcaatgcttatagaa

SEQ ID NO: 2578 - DNA, 753 bp, Cynodon dactylon
gggggacccagccagaaaagcgcgttccaaaagttgcagttggcctcctcctccggcggctcagatctctctgcttgcagcggcggcggcgatggcgtccttctccgaagccccccccgggaaccccaaggcgggagagaagatcttcaagaccaagtgcgcgcagtgccacaccgtcgacaagggcgccggccacaagcaaggtccgaacttgaatggtctttttggcaggcagtcgggtaccacccccggttactcctactctgcagcaaacaagaacagggccgtgatctgggaggagaacactttgtacgactacctgctcaatcctaagaagtacattcctggaaccaagatggtcttccctgggttgaagaagcctcaggagcgtgttgatctcatcgcctacctgaaggaagccacatcgtcttaaaacaaatgggctgccagtttttatcctgaggagacaattcgttttttacttaataaagaggtttagactatttggggtattcaggttgaacggggttcaatccacgagacaagttatccttttctttcttatggtgtctttcgaatgtctaggtgttctagtggagcaaaacagtgaataactttgatcgctcttgttccaacagctggaaaattccagcgagcatatttttgaccaccgggtggtggaactggaatgcacccattttgtgattagatcgaccaagttgatccatgtttttgagcgctgttgatattatc

SEQ ID NO: 2579 - DNA, 457 bp, Euonymus alatus
aacagtcgccgcctgaaaccaaaatcaacaaaaaaacagagagcagagccacaaaaggggaaggaagaaatggcgtcgttcgatgaagctcctcctggaaatccaaagtctggagagaagatcttcaagactaagtgcgctcagtgccataccgtcgacaaaggtgccggtcataagcaaggacccaatctgaatggtctgtttggaagacagtctggcacaacccctgggtattcttattctgctgctaacaagaacatggctgttaattgggaggaaaagacgttgtatgattatttgctgaaccccaagaagtacatacctggaacaaagatggtattccctggattgaagaagccacaggaccgtgctgaccttattgcatatttgaaggaatctactgcctcttgaaacaccgcatatttgaaggaatctactgcctctcgaaacaccgcaa

SEQ ID NO: 2580 - DNA, 815 bp, Euonymus alatus
tttctgatatctatttcgttccactcaaattttgtctcccccttacctaaaccctagccacctctctcacaatgccacccttatgtgatccctctctcgcacagccaccctcaagtaaatcccagatctcgcatggccactggtattcgcttcaagcctcgccgtcttaaaccgaaaacaacacaaacagaaatcagagacacaaaagtagaaggaagaaatggcgtcgttcgatgaagctcctcctggtaatccaaagtctggagagaagatcttcaagactaagtgcgctcagtgccacaccgtcgacaaaggtgccggtcataagcaaggacccaatctgaatggcctgtttggaaggcagtctggcacaacccccgggtattcttattctgccgctaacaagaacatggccgttaactgggaggaaaagacattgtacgattatttgctgaaccccaagaagtatatacctggaacaaagatggtattccctggtttgaagaagccacaggatcgagctgaccttattgcatatttgaaggaatccactgcatcttgaggcaccattttttgtccattccatattgcagcatttggcggttgtctcgtgcattgcgagttaagaatctataatttgtttttaatccaataaatttagaccatgctccttgtacaaggaggagcataggtgggtaccattttgtactcatatttcggtgctgcctccacttttttatttgtcaatcgttatgctctcaagttttctatatatgtttagtggtgttgtgtcaattcagtgattcgacaccaaa

SEQ ID NO: 2581 - DNA, 641 bp, Linum usitatissimum
cgataatccgagctttcgttcactgtaatggcgaccttcaacgaagctcctcccggtaatcccgacgccggagctaagatcttcaagaccaagtgcgcccagtgccataccgtcgacaaaggcgctggtcacaaacaaggtcctaatttgaatggacttttcggaaggcagtctggaactaccccaggctactcatactctgccgccaataagaatatggctgtgaactgggcagagaacacattgtacgactacttgcttaaccccaagaagtatatccctggaactaagatggtgttccctggactgaagaagccacaggagcgtgcagaccttattgcgtatctgaagcaatccactgcctgatcatattgattttgacacagattcgtgttgccattaaatggtatctgtcccaaattggacatggtttttcttttttcaatcttctgaaattgaagcagtaggcattccttaaaataaagaacgccgttttggatttgaaagttccctatactatattcagttagggaaggtatattggttgagcttgcgactcagtcatgagttttctctgtgaggccgtttgctggacctctaaattgatttccagaatagccatatatatatatactattgga

SEQ ID NO: 2582 - DNA, 746 bp, Linum usitatissimum
tacccacgcgtccggaacaaacccaagcgtacatctccctctcttcgtctccgataatccgagctttcgttcactgtaatggcgaccttcaacgaagctcctcccggtaatcccgacgccggagctaagatcttcaagaccaagtgcgcccagtgccataccgtcgacaaaggcgctggtcacaaacaaggtcctaatttgaatggacttttcggaaggcagtctggaactaccccaggctactcatactctgctgccaataagaatatggctgtgaactgggcagagaacacattgtacgactacttgcttaaccccaagaagtatatccctggaactaagatggtgttccctggactgaagaagccacaggagcgtgcagaccttattgcgtatctgaagcaatccactgcctgatcatattgattttgacacagattcgtgttgccattaaatggtatctgtcccaaattggacatggtttttcttttttcaatcttctgaaattgaagcagtaggcattccttaaaataaagaacgccgttttggatttgaaagttccctatactatattcagttagggaaggtatattggttgagcttgcgactcagtcatgagttttctctgtgaggccgtttgctggacctctaaattgatttccagaatagccatatatatatatactattggatttttcttgtttctcttgtgttttcagttaatatcccttaacgttctatttacc

SEQ ID NO: 2583 - DNA, 916 bp, Vitis vinifera
tggaaatttgctgtagaaagttctcgttcgttcctcagcgtattacaaattatataaccctaagccgctgtttttgtttccctagaaaatctcgaggttttagaaatggcgtcgtttgatgaagcacctcctggcaatcccgctgctggagagaagatcttcaagaccaagtgcgctcagtgccacaccgtcgacaaaggcgctggtcacaagcaaggacccaatctgaatggccttttcggtaggcagtctggcacaactcccggttactcatactctgctgctaacaagaacatggctgttatttgggaggaaaagacattgtatgactacttgctgaacccaaagaagtacattcctggaacaaagatggtgttccctggactaaagaagcctcaggatcgggccgacttgattgcatatttgaagcaagccactgcttaatttgaaactaaacgtttgaagagagtccattttgcagttgctagaggtaccggaaccagatggcagtaccattcttttccaaataaaatagacttatgttggtaggtctggcataatgagagtgtgtagttattgctacttttgctaagagattgccttggcaaacattcaattggattcagttacctgtttgtgactatctgatgaatatttggtgaaacatcaatttactactatgaatgcctgggctagtctttatatgattagcaatatcagaagattggtttatggttaaattcttttttctttctttggttctttctttttaacccaagctgatgacatacgaggttgcggttgatgctgttagcgtgagcagagcagcatcattgtcttttagccgtgttggaaacattatgaaataacatttgcaaggacttggtcatctcatctgaaaaccaattaagtggtg

SEQ ID NO: 2584 - DNA, 896 bp, Vitis vinifera
gctgtagaaagttctcgttcgttcctcagcgtattacaaattatataaccctaagccgctgtttttgtttccctagaaaatctcgaggttttagaaatggcgtcgtttgatgaagcacctcctggcaatcccgctgctggagagaagatcttcaagaccaagtgcgctcagtgccacaccgtcgacaaaggcgctggtcacaagcaaggacccaatctgaatggccttttcggtaggcagtctggcacaactcccggttactcatactctgctgctaacaagaacatggctgttatttgggaggagaagacattgtatgactacttgctgaacccaaagaagtacattcctggaacaaagatggtgttccctggactaaagaagcctcaggatcgggccgacttgattgcatatttgaagcaagccactgcttaatttgaaactaaacgtttgaagagagtccattttgcagttgctagaggtaccagaaccagatggcagtactattcttttccaaataaaatagacttatgttggtaggtctggcataatgagagttgaagttattgctacttttgctaagagattgccttggcaaacattcaattggattcagttacctgtttgtgactatctgatgaatatttggtgaaacatcaatttactactatgaatgcctggactagtctttatatgattagcaatatcagaagattggtttatggttaaattcttttttctttctttggttctttctttttaacccaagctgatgacatacgaggttgcggttgatgctgttagcgtgagcagagcagcatcattgtcttttagccgtgttggaaacattatgaaataacatttgcaaggacttggtcatctcatctgaaaaccaa

SEQ ID NO: 2585 - DNA, 613 bp, Ipomoea nil
tagttccacacctcctttccccgttgtactattccttctagaaacacccaaaaataacaaacaaacaaagaaggtaaagaaatggcgtcgttcgcagaggcaccgccgggagacgtgaaagccggggagaagatcttcaggaccaaatgcgctcagtgccacaccgtcgacaaaggcgccggccacaaacaagggccgaatttgaatggtctttttggtaggcagtctggaactactcctggttactcctactctgctgctaacaagaacatggctgttatttggcaagaaaagacgctgtatgactatttgcttaacccaaagaagtatatccccggaacaaagatggtttttccaggattgaagaagccacaagagcgtgctgacctcattgcatatcttaaagagtcaacagcttaatgaatgattttgcctaagctaagctaagttgaccagttacccattattctttgtaataaagagacctttttctggtatcctgtgctaattgtttcatagagctcttgttttgcctctttgcatgagaggttttattgcacttgccaaacgttaaaagtaaaaacacacattcaattcaatccaaaataacgag

SEQ ID NO: 2586 - DNA, 513 bp, Jatropha curcas
caacaaaattatattttctctcgtgatcttttatttctagacaggagaagaaagaaatggcaactttcgagcaggcaccaccaggcgatgtaaaagccggagagaaaatcttcaagactaagtgcgcgcagtgccacaccgtcgagaagggcgccggtcacaagcaaggacccaatttgaatggccttttcggtaggcaatctggtacgacagctgggtattcctactctgcagctaataagaacatggctgtgatctggggagagaatactttatatgattacttgcttaatcctaagaagtacattcctggaactaagatggtcttccctggattgaagaagccacaggatcgtgcagacctcattgcctatttgaaggaagcaactgcttgatttagtatggttatttagccttgattgtgacataattgatgtctaagccattttttttccaaaggaagaaaactattccttcttcaataagctgaattaaagctcacagatgagtaga

SEQ ID NO: 2587 - DNA, 674 bp, Lactuca sativa
aaaaccacatctattctccgccctttgaaacccccaattgttctcgctctttctccgtcgctctttctctcacgacttttacgaaatctaccatcggtgattcgatctatacagattgatggcgtcgttcgcggaggctccagccggaaacgccaccgctggcgagaagatcttcaagactaaatgcgctcaatgtcacaccgtcgagaaaggcgccggacacaaacaaggacccaatcttaatggactatttggaaggcagtctggaaccactgctggatactcttattcagctgctaacaagaacaaggctgtcaattgggaggaaaatacattgtatgactacctgctgaaccccaagaagtacattcccggaacaaagatggttttcccaggactgaaaaagccacaggagcgcgcagatcttattgcatacctcaaggcatcgactgcgtaattttttcttttatgttttaacaccattttaaagtttttttcttgatgatttgaggtggttggttataaggggataaatttggattatcttttctgtgaagaataaggggagaggacattcatcatctttcattgctccttaaaattttgagcactgctttattcatttggcaagagattgccttattcatcatcattctatataatgtttgttaact

SEQ ID NO: 2588 - DNA, 697 bp, Lotus japonicus
gccacatttctacgcacgcgaaccttcccttcccttccattattctctctcgctttctcgaaacccctgaaatcagcgccgttcagcaatggcgtcgttcgatgaggctcctcccggcaactccaagagcggtgagaagatcttcaagttgaagtgcgctcagtgccacaccgttgagaaaggcgccggtcacaaacaaggacccaatctgaacggtttgtttggaaggcagtcaggaactactgctggatattcctactctgcagctaacaagaacatggctgtgaattgggaggagaagactttgtacgattacttgcttaaccctaaaaagtatattccagggacaaagatggtatttcctggtcttaagaagccccaagaacgtgctgatcttattgcgtacctgaaagaagccacagcacagtgatttaatatttcatacattcaattttgcagtgtgcttttaaagttctgaagatttaattttcagacatttaatcatgccgtacagtaagttctgtatctttggcaaataaaataggctacattggtctgcaatgctattttgttaattttgcattgcttctcaaaactcagctgaatattggctggagtatcgctcaatcaaattatctgttgaaatctgaacattcttatcaatttggttaattgggaacacaatttggcgcagtgc

SEQ ID NO: 2589 - DNA, 697 bp, Cucumis melo
atccttctacaaacactgtgaaccctagccttcagatccgatcgccacctcatttcgccatggcaagctttgacgaagcacctcccggcaattccaaaactggagagaagatcttcaagaccaaatgcgctcagtgccacactgttgacaaaggggctggccacaagcaaggtcccaatttgaatgggttatttggacgtcaatctggtacaactcctggatactcttactctgctgccaacaagaatatggctgtgatatgggaagaaaagacgttgtatgattacttgcttaaccccaagaagtatatccctggaacgaaaatggttttcccagggttgaagaaaccgcaggaacgtgccgaccttattgcttatctgaaggaatcaactgcttaaatgagatatatatgatgcgtttacccatctagaaattttttagacgttccccctcattaaataagaacattgaggaaaatttagatgaaacatacagagtaatcatcctgtggcaaaaagagtcgtcttgtgaaaaccacaagagttccttttcttttcattaatctcttattttgaagagttaatccatttgtagcttacattattgtttggtgtgatgaacactgctacaatttttttttggccaagctggttatggcaatttatttttcataataaatatcacacttgttacagtc

SEQ ID NO: 2590 - DNA, 724 bp, Carica papaya
gtgtcgtatgaaaaagtaaaaaccctaaacgtccttccctttcctgcgcatttctctgcagcttgcaccctacactccatagatcaatcgcttctgattccccacctttgggattaaacagcaggatatggcatcgtttgagcaagcaccaccaggcgatgcaaaagctggagagaagatctttaagacaaagtgcgctcagtgccacaccgtcgataagggcgctggtcataagcaaggtcctaacttgaatggattgtttgggaggcaatctggtacaactcctgggtactcttattctgctgctaacaagaatatggctgtgatctggggagagaacacattgtacgactacttgcttaaccctaagaagtatattcctgggacaaagatggttttccctggattgaagaaaccacaagatcgtgcggacctcattgcctatctgaagggagccactgcataatcgttttgcatggtgtagggtattttgcagtaaaccaaagagtttagagaccaattcggaattctttttgaaaggaaaagaaactaatatttatggaaataaaagaaatattaatggctacaatcgttgagacctcctacatgagaaatgtcttgaatttaatgattttttattcaaatatatgagctggtgggcttgtcgtgttcaattttttcgggtgtaatggttgtttttggcagttgtatctcatatttgttc

SEQ ID NO: 2591 - DNA, 678 bp, Lippia dulcis
gaaaaccctagacagagatttcttcttcggcggatcgagggagtgttcgttgttggagataacaatggcgtcgttcggcgaggcacctccaggggatgtcaaatccggggagaaaatcttcaagacaaagtgcgctcagtgccacactgtcgacaagggcgccggacacaaacaaggtcccaacttgaatggtcttcttggaaggcaatctggtaccacccctggttattcttactctgctgccaacaagaacatggctgtacaatggggagagaatacactgtatgattacttgcttaatcctaagaagtacataccaggaactaagatggtcttccctggtctgaagaaacctaaggaacgtgcagatctaattgcttatctgaaggaggcaactgcttgaagattgattggaagagacctcattttctgacattttggagatatttgattattgatccgtttgaaattccttttcaaagtaaaatgagcttagctaactcgatcaaataagagcatcatgtttctatgctgtgctgttccatgccagcagtagagaatttttgttgtcggtgatgactcttgattaatgtttctacggtacttggtcatttttcctaaacaaattgttgattatgtgccattgcagataatagattacgtataactaatcaattt

SEQ ID NO: 2592 - DNA, 695 bp, Lippia dulcis
cgttacggagaccacttgaaaaccctagacagagatttcttcttcggcggatcgagggagtgttcgttgttggagataacaatggcgtcgttcggcgaggcacctccaggggatgtcaaatccggggagaaaatcttcaagacaaagtgcgctcagtgccacactgtcgacaagggcgccggacacaaacaaggtcccaacttgaatggtcttcttggaaggcaatctggtaccacccctggttattcttactctgctgccaacaagaacatggctgtacaatggggagagaatacactgtatgattacttgcttaatcctaagaagtacataccaggaactaagatggtcttccctggtctgaagaaacctaaggaacgtgcagatctaattgcttatctgaaggaggcaactgcttgaagattgattggaagagacctcattttctgacattttggagatatttgattattgatccgtttgaaattccttttcaaagtaaaatgagcttagctaactcgatcaaataagagcatcatgtttctatgctgtgctgttccatgccagcagtagagaatttttgttgtcggtgatgactcttgattaatgtttctacggtacttggtcatttttcctaaacaaattgttgattatgtgccattgcagataatagattacgtataactaatcaattt

SEQ ID NO: 2593 - DNA, 478 bp, Cajanus cajan
tatcagcatattctcatttcattttcatttgcatttgcatttgcatttgcatttggtttggcgctttgtttctggaagcttcctcagcgatggcgtcgttcgatgaagctcctcccggaaaccctaaggccggcgagaagatcttcagaaccaagtgcgctcagtgccacaccgtcgacaaaggtgccggccacaaacaaggacccaatctgaatggtttatttggaaggcaatccggcacaactcctggatattcctattctgctgctaacaaaaacatggctgtgatatgggaggaaaagaccttgtatgattacttgctcaaccccaaaaagtatattccagggacgaagatggtatttcctggtcttaagaaacctcaggatcgtgcagatcttattgcatatcttaaagaatccactgcataatgattaagttttcattacatacagttacgcaactgtgcttttgaaattct

SEQ ID NO: 2594 - DNA, 820 bp, Cajanus cajan
gtggcaagtatttaaccagtgtggggtttaaggcttaaggtgatagaggtatcagcatattctcatttcattttcatttgcatttgcatttgcatttgcatttggtttggcgctttgtttctggaagcttcctcagcgatggcgtcgttcgatgaagctcctcccggaaaccctaaggccggcgagaagatcttcagaaccaagtgcgctcagtgccacaccgtcgacaaaggtgccggccacaaacaaggacccaatctgaatggtttatttggaaggcaatccggcacaactcctggatattcctattctgctgctaacaaaaacatggctgtgatatgggaggaaaagaccttgtatgattacttgctcaaccccaaaaagtatattccagggacgaagatggtatttcctggtcttaagaaacctcaggatcgtgcagatcttattgcatatcttaaagaatccactgcataatgattaagttttcatacatacagttacgcactgtgcttttgaaattctggagatttaattttcagacatttaattctgtggtgcagtaaattctgtatcaacaaataaagtagacttgattggtttgcaatgctattttgttcattttgcattgcttctttagaggttcccatatattggcgaatgcttaatttagctgttgaaatttgaaatgttattgatatttactatttagttagctggaagcacaatttagtgtttatttgctggataagtgatttatcaaatcttgcaattcttttttgtttgcatggccgaatgcaatgcataccgtatttttatt

SEQ ID NO: 2595 - DNA, 746 bp, Ananas comosus
ccgacgacgaggcggagcgaaaccctagccctagcctagccgtaaccctagccctaacccttatttctcgatcgttctaatggcgacgttcgcggaggccccccccgggaatccaaaggccggggagaagatcttcaagaccaaatgcgcgcagtgccacaccgtggagaagggagccgggcacaagcaaggaccaaatctgaatggactttttgggaggcaatctggtaccacccctggttattcctactccacagcaaataagaacatggccgtgatttgggaggagaatactttgtacgagtacttgcttaatcccaagaagtacattcctggcacgaagatggtattccccggtctaaagaagccccaggagcgtgcagatctcattgcatatctgaaagaagccacaaaaccctaaaccccttcatcccactgcacatttgagatgttcttctttttttctttttttcttcttttcttctttttaaggccaaataagaccttttgaggatccctctgcttgtagcaaggagtggagccttgagaaacaatttcattttctttctttttgttgcaacgcacggtttgattggtagcacttccttgagatcgtcttcatttgtggtggtgaactttggtatactacggaaattttggtatccaatgacgtataaaatttacaactcttgacgtctatttccagaagattgtataaacagttgtgctatttgaagctgcagtac

SEQ ID NO: 2596 - DNA, 792 bp, Primula obconica
ctctctctttttaaataatggcgtctttcgcagaggccccagccggagacccgaagaccggagagaagatattcaggactaagtgtgctcagtgccatactgtcgataaaggcgctggtcacaaacagggacctaacttgaatggccttttcggaaggcagtctggaaccactgctgggtactcctactcgtctgcaaacaagaacagggctgtgacctggggagaaaacaccttgtatgattatttgttgaaccctaagaagtacatacctggaactaagatggttttcccaggattgaagaagccacaggagcgtgcagatctcattgcttatctgaaggcatcaactgcatagaactgttttttcttgttatcatatccatctttttttatattctggaggtattatctgttccgagaggaacgtaactcaatttttttttcttgaattacgaagcatatgcctatattggtcagttattgccaattctttttagaactcgttctgtggaaatcgccaatccgaagaggtcaatgcattttgcagtagacaacatcaagtgaatcatctagcattctgaacaactataagaattttgttgaaaataaatttacttctgttatttgtgcaattataaatgttaaaatcattgaatttgtgttctatgagaatactttttaagttgctggaatgcccattacggccgaaaagctctctctctctctcgtctctctctctctcgtctactctactactacgttataatattaattatattattagtagttag

SEQ ID NO: 2597 - DNA, 629 bp, Raphanus sativus
ggggtcacacacctaacagaaacccttagaagctccagcgaagcgagttccgtctttgttttctcctcgtattctccaggcgaaaaatggcgtcgtttgatgaagcaccaccaggaaactccaaggccggagagaagatcttcaggaccaagtgtgctcagtgtcacaccgtcgacaaaggcgctggtcacaaacaaggaccgaacctaaacggtctgtttggaagacaatctgggacaacagctggttactcttactctgctgctaacaagaacaaagctgtcgaatgggaagagaagaccttgtacgattacttgctcaaccccaagaagtacattcctggaacgaagatggtcttccctgggctcaagaagccacaagaacgtgctgatctcattacctacttgaaggaagctactgcttagttggacatgatcatgacttttttagtctctctgatcagatattcttttgacaaataaaatctccaaacttttgtttttggttttcggaaatgctctcatcttcaatttacgttttggtgggggaaacttggctgtttgagttccaaatgtactcgagtcctttcattttctgaggctcattcatataaatgcatctatctagaa

SEQ ID NO: 2598 - DNA, 682 bp, Raphanus sativus
  misc_feature (29)..(29): n is a, c, g, or t
  misc_feature (575)..(575): n is a, c, g, or t
ggattctaattttcacacgggaaagaggnaaaagagccataaaccaaaaaaaaaaaaggtcaggcttaaagaaaccgtcaaaaagccaccgttcgttcagacttttccatttctcgatcacaaatggcgtcgttcgatgaagcacctcctggaaaccctaaggccggagagaagatcttcagaaccaagtgtgcgcagtgccacaccgtcgacaaaggtgccggtcacaaacaaggaccaaacttgaacggattgtttggaaggcaatctggaacgactccagggtattcttactctgctgccaacaagaacatggccgtcatgtgggaggagaagactctctacgattacttgttgaaccccaagaagtacattcctgggacgaaaatggtgtttcctggattgaaaaagccacaagaccgtgccgatctcattgcttatttgaaggaaggtactgcatagagtggctcgctcggttataatgaagcctttaattccccgtgcatttttttttctcacagaaaaaaataaaatcagaccagaagtattgtggtcatgaactggttatatgtttnctttcttttctttgtcaatgaggcgagttgcctcgtaaaaagtcgaatattcgtttttgatgtgaagaacctatctctaccacgaaatttgattagattttatttta

SEQ ID NO: 2599 - DNA, 424 bp, Rhizophora mangle
ggaattgacatctgtagagcggtaggcgactgattgagaatggcgtcgtttcaggaagcaccgcccggcaacgaaaaggccggagagaagatcttcaagactaagtgcgctcagtgccacaccgtcgagaaaggcgccggccacaaacaaggacccaatttgaatggtctctttggaaggcaatctggtacaactgctggttattcctattccgctgctaacaagaacatggctgtgacttgggaagaaaacacattgtataactatttgctcaacccaaaaaagtatattcctggaactaagatggtgttccctggattgaagaagccacaggagcgagcggatctcattgcatatctcaaacaatcaactgcctgatcctcttgattttactaggtttccttccagttatgcccaaaatgaa

SEQ ID NO: 2600 - DNA, 741 bp, Salvia sclarea
ccttggctgtcactcaaaaaccctagaaacttctcttccagagattctcgctctctctaccctctaaaatctaggcaaaaatattttcttgcggaaaaatctgaatcgagatggcgtcgtttgcggaagcgccgcctggaaacaaggccgtcggagaaaagattttcaagactaagtgtgctcagtgccacaccgtcgacaaaggagctggccataaacaaggacctaacctgaatggtctcttcggaaggcagtctggaactacagctggttattcgtactctgctgctaataagaacatggctgtcatttgggaagagaagactctgtatgattacttgttgaatccaaagaagtatatccccggaacaaagatggttttcccaggattgaagaagcctcaggaccgtgcagatctcatcgcatacctgaaggagtccacagcttaagtccgcggcatttgttaccgttcttttgtcattttgcaattgagaggcatactttacattttgagtagcaaaaaacacatgctctctaataaataattctttggattactttttattattcacctaagtccctagcttgaatttcctctttaaagaggcaatagtttttgtcagagggaaataaattggagtacatcatgttttatgcttatctagttattaaggttcaaagcatgtttgcttgaacattctttttaatgatagcccctattctgctctgtaaaagttctag

SEQ ID NO: 2601 - DNA, 715 bp, Glycine max
gtggcaagtaattgggggttttaaaagagatttatgtgaccgtggagttgtctgtggtatccatccgcgcatattctcatttcaatttgcatttgcatttgcgtttcatttggcgttttgtttctttctggaagcttcgttcgggcatcaatggcgtccttcgatgaagctcctcccggaaactccaagaacggcgagaagatcttcaaaaccaagtgcgctcagtgccacaccgtcgacaaaggtgccggccacaaacaaggacccaatctgaatggtttgtttggaagacaatctggtacaactcctggatattcctattctactgctaacaaaaacatggccgtgatttgggaggaaaagaccctctatgattacttgctcaaccccaaaaagtatattccaggaacgaagatggtatttcctggtcttaagaaacctcaggaacgtgcagatcttattgcatatcttaaagaatctactgcttaatgattaaattttcatacagttatgcactttgcttcaaagttctggagatttagttttcagacatttaattctgtggtgcagtaaatactgtatcaacaaataaagtagacttgattggtttgcaatgctattttgttcgttttgcattgcttcttaagaggctgccatatattggctactgttcaattaatttggttgttgaaagtttaaacattgttattgatat

SEQ ID NO: 2602 - DNA, 559 bp, Glycine max
gtggtatccgcgcatattctcatttcaatttgcatttgcatttcatttggcgttttgtttctttctggaagcttcacttcggcatccatggcgtcgttcgaagaagctcctcccggaaactccaagaacggcgagaagatcttcaagaccaagtgcgctcagtgccacaccgtggacaaaggtgccggtcacaaacaaggacccaatctgaatggtttgtttggaaggcaatctggcacaactcctggatattcctattctactgctaacaaaaacatggctgtgatttgggaggaaaagaccttgtatgattacttgctcaaccccaaaaagtatattccagggacaaagatggtgtttcccggtcttaagaaacctcaggaacgtgcagatcttattgcatatcttaaagaatccactgcataatgattaaattttcatacatgcagttatgcactttactttcaaagttctggatatttaattttcagacattttattctgtggtgcagtaaatactgtatcaacaaataaagtagacttgattggtttgcaatgc

SEQ ID NO: 2603 - DNA, 764 bp, Panicum virgatum
gatttcggcgcaagtccaaagggcaaaccagaagttgcagttcgcctcctcctcttctccgtcggctcggatctctctgcgcgcgcgcggcggcggcgatggcgtctttctcggaggctccccccggcaaccccaaggccggcgagaagatcttcaagaccaagtgcgcgcagtgccacaccgtcgagaagggcgccggccacaagcaaggtccaaacttgaatggtctctttgggaggcagtccggaaccactgctggctactcctactccgcaggaaacaagaacaaggctgtggtctgggaggagaacactttgtatgagtacctgcttaaccctaagaagtacattcctggaaccaagatggtcttccctgggctgaagaagccgcaggagcgtgctgatctcattgcgtatctcaaggaagctaccacatagaaatactcaaggaagctacagtttaataaagaggtttagacaattcgggtcactctggttgaacagggtgcaatctacgagacaattattgagtattttggttcatatgtttgtttcgaatgtctaggtgtttagctgaacaaaaacagtcaaaactttgacggctcttgttccaactgctggagaaatcccagcgccctatttttgaccaccgggtggtggaactggaaatctgaaatgcacccattttgaaggacctgagatgtgtaaagttgttatccttctgcctgcgtttgtgtttcaagtcatgctaaatcattactgccc

SEQ ID NO: 2604 - DNA, 655 bp, Tabernaemontana elegans
caaacgctctatcgttcaggttgaaccctacgtactcgtttgcttgaatcggtgagatggcaagcttcgaacaagcaccgcccggtgatgtcaaagccggagaaaagatcttcaagaccaagtgcgctcaatgtcacaccgtcgacaaaggcgccggacacaagcaaggccccaatttgaatggcttgtttggaaggcagtctggtacaactcctggctattcttactctgctgctaacaagaatatggctgtcatatggggagagaatacactgtatgattatttgcttaaccccaagaagtacattcctggaaccaagatggttttccctggattgaaaaagccacaggatcgggctgatctcattgcttaccttaaggagtcaacagcttgaagatttgcctcgtatgagcatgatagaaaattaagcacggattaaaagaattcttgtcattagtaacagtttaaaattctttttcgtgagaacttagtcatctacctcattgaataagaccaagaaggtcttcacattgttctctggttgagctaaggccagtcccggtgtagcaaggcagttttgtcgcactttgatctaatgattttttgaacacctcttgctcattttgtgccatcggataaactaattgtttggac

SEQ ID NO: 2605 - DNA, 555 bp, Thellungiella halophila
gcacgaggcgtttgttctgatttttcgtcctcgatcaaatggcgtcgttcgatgaagcacctcctggaaaccctaaggccggagagaagatcttcagaaccaagtgtgcgcagtgccacaccgtcgataaaggtgccggtcacaaacaaggaccaaacttgaatggattgtttgggaggcaatctggaacaactccgggatattcttactctgctgctaacaaaaacatggctgttatgtgggaggagaagactctctacgattacttgttgaaccccaagaagtacattcctgggacgaaaatggtgtttcctggactgaaaaagccacaagatcgtgctgatctcatcgcttatttgaaggaaggtactgcatagacaagacaacgctcgctcggacatacatgcagcctctattcccgttcatttttttaaacagataaaataaatcagacccgaaaaatattgtggtcatgaactggttttctatatgctcttttttttacacttggttgatgaggcgagttgcctcttataaagtcgaatattcgttttt

SEQ ID NO: 2606 - DNA, 851 bp, Nicotiana tabacum
cggggacccgaaggctctattcgttgaatcagaaagctctagaaacctcaaaaccctcacactttgaagaattccctttttatttcgcccgaacctcaaaactaaacttctcaatttgcttttgcttattggaaatcaggaaaaatggcaacgttcgaggaagcaccggcaggtaatcccaaagccggagagaaaatcttcaaaaccaagtgcgctcagtgtcacaccgtcgataaaggcgctggtcacaaacaaggacccaacttgaacggtctctttggaagacaatctggtacaactccaggttactcttactctgctgcaaacaagaacatggctgtgatctggggagagaatacgttatatgagtacttgctcaatcctaagaagtatattcctgggacgaagatggttttccctgggttgaagaagccacaggatcgcgcagatctaatagcttatctgaaggaatcaactgcatgaagatctctttggaaaatcattatatttttgctagtgttacacattttatatttttaaagtcatccttttgccgatcaaataacaccacatactttatcatgccattcttctggttgtgcaagccagtcttgaggaatttggtcaagagtttgtcatttgaagtcttttcaaatctttacgaaatcatgaatgtgtttggtgtttggagccagttcgttgtgaacagctttcatatcggtcatcggttgtaccttaattgcaaggaggggagtataaacttatcataagggggtgtggtgttaaacacgaatatactgcaacgaatccgattatcggttttcaataatgaaatccattttcttctgtaa

SEQ ID NO: 2607 - DNA, 546 bp, Nicotiana tabacum
  misc_feature (33)..(33): n is a, c, g, or t
  misc_feature (61)..(61): n is a, c, g, or t
aatggcaacgttcgaggaagcaccagcaggtantcccaaagccggagagaaaatcttcaanaccaagtgcgctcagtgtcacaccgtcgataaaggcgctggtcacaaacaagggccaaacttgaacgggctctttggaagacaatctggtacaactccaggttactcttactctgctgcaaataagaatatggctgtgatctggggagagaacacattatatgaatacttgctcaatccgaagaagtatattcctgggacgaaaatggtcttccctgggttgaagaagccacaggagcgtgcagatcttatagcttatctgaaggaatcaactgcatgaagatctctttggaaaatcatgatacttttgctagtggcctagagttgtatccaatggtagccttacacattttatatttttaaagtcatcctttagccgatcaaataacaccacatactttatcatgtcattcttctggttgagcaagccagtcttgaggaattttgtcaagagtttgttatttgaagtcttttcaaatctttacg

SEQ ID NO: 2608 - DNA, 669 bp, Rosa hybrid cultivar
tctctctctctctctctagctttctctctctaacctcctcgtcaatggcgtcgttcgctgaagctccacccggagatgccaaggccggagagaagatcttcaagaccaagtgcgctcagtgccacaccgtcgacaaaggcgccggccacaagcagggacccaatttgaatggcctgtttgggaggcagtctggaacaacccctggatactcctattctgctgctaacaagaacatggctgttaattgggaggagaagacattgtatgactatttgcttaatcccaagaagtacattcctggaaccaagatggtcttccctggattgaagaagccaaaggaacgtgctgacctcattgcctatttgaaggaatcaactgcatcttaaactgcctttgttcgacttttcacattttgcagtcatcggaggtttatacaaacggatgagtactattttttgttgccaataaattaggccatctaggtctgcaattctcgtttgcatgtcgagcttgcttttgcttttctaggaagaggttgctgtaattggcagcgcaacattcacattcagttagctgttgtgactagatttcaaggagttggtgaaataccagttcaactaatgatataaaaattcattgtgacattttctatatattcttgtggtgcaa

SEQ ID NO: 2609 - DNA, 640 bp, Phalaenopsis aphrodite
gaaccgagcgacaagtagaggcgacaggtagaggaatggcttcgttctcggaagctccgcccggcgatccgaaggccggagagaagatcttcaaaacgaagtgcgctcagtgccacacggtagagaaaggagccggacacaaacaaggtcctaatctgaatggcctgtttgggagacagtctggtactactgctggatactcatactctactgctaacaaaacatggctgtgatatgggaggagtcaactttgtatgattacttgctcaatcccaaaaagtacattcccggcacaaagatggttttccctggtctgaagaaaccccaagagcgagcagatcttatcgcctatctcaaggagtctacggctccttgatttcttggaagcaaagcagtgcatgcatatagattgaccatgattttttataataaagatctcaataaaattaattagaggccccattctttataaaactggtgcggcttgaacttcattctactattttgacttcatgctatattgttgtcataattcattttcaatgtacttcaattttgagtttggaagttgggaacttatgtgctgtattttttctgtttattgattctcctgcttctacgcccaaaaaaaaaaaaaaac

SEQ ID NO: 2610 - DNA, 1877 bp, Brassica juncea
atgatgtctgtgagaacaatcttaccaccggcagttctgctgatcctcatcgccgcatcgacagcagagaatatcgaattcgatgagtcaaacccgatccgtatggtctccgaccgtctccgggaggtagagcaatccgttgtccagatcttaggacaatcccgccacgttctctccttcgctcgcttcactcacaggtacgggaaaaggtacgagagcgcggaggagatgaagctcaggttctcgatattcaaggagaatctggatttgatcagatccactaataagaaaggcttgtcttacaaactcggtctcaatcagtttgctgatatgacgtggcaagagtttcaaaggaccaagcttggtgctgctcaaaactgctctgccactctaaagggcagccacaaactcacaggagaagctcttccggaaactaaagactggagagaagatggtattgttagcccagtcaaagaccaggggggttgtggttcttgctggacattcagtactactggagcgcttgaggcagcttatcaccaagcatttggaaaaggaatatccctctctgagcagcagcttgtggattgtgctggagctttcaataactatggctgcaatggtggccttccttcccaagcctttgaatacatcaaatccaacggcggcctcgacacagaggaagcttatccttacaccggtgaagatggaacctgcaagtattctgctgagaacgtcggtgtacaagtccttgactcagtcaacatcactctgggtgctgaagatgaactgaagcatgcggttggattggtacgaccagtgagcatagcattcgaggttatacactcgttccggctttacaagagtggagtttacagtgatagtcactgtggacagactccaatggacgtgaaccacgcggttttggcggttggttatggaattgaagacggtgttccatattggcttataaagaactcatggggagcggattggggtgacaaaggttacttcaagatggagatggggaagaacatgtgtggtatcgcgacatgtgcatcgtacccggttgtggcctaagatgatcagcgaatgtcagtctctcagtgatcagattacaatcatgttcgcatatatattggatttaagacattacttgaaaatcacttgggagtgcatagtgttttattatgcttgttgtaacataaggtctgttcatatgtacaaaatgatgcatacactacagacgatcaactttataatgtatccatgttaaatttaaggacataaatttatttggaccttagtagcttttttttttttgacaataaaatctaattcaaatttcgtggtggagattgtttcttcacatcaaaaacgaatattcgactttatacgaggcaactcgcctcattaacaaagaagaaaacatataaccagttcatgaccagaatacttttggtctgatttattaaatctgtgagaaaaaaaaaatgaacggggaatagaggctccattatatccgagtaagccagtctatgcagtaccttccttcaaataagctatgagatcggcacgatcttgtggctttttcaatccaggaaacaccattttcgtcccaggaatgtacttcttggggttcaacaagtaatcgtagagagtcttctcctcccacatgacggccatgttcttgttggcagcagagtacgaataccctggagtcgttccagattgccttccaaacaatccgttcaagtttggtccttgtttgtgaccggcacctttgtcgacggtgtggcactgcgcacacttggttctgaagatcttctctccggcctttgggtttccgggaggtgcttcatcgaacgacgccattt

SEQ ID NO: 2611 - DNA, 742 bp, Brassica napus
ttaaggaaagtgtgtacgccgacagtaaccggtccgaattaccagggtcgacccacgggtccgcccacgcgtccgcacacgcgtacgcaagaaatctcaaaagcaaccgtcattcagattgtcgatcagaaatggcgtcgttcgatgaagcacctcccggaaacccaaaggccggagagaagatattcagaaccaagtgtgcgcagtgccacaccgtcgataaaggtgccggtcacaaacaaggaccaaacttgaacggattgtttgggaggcaaatcaggaacaacgccagggtattcctactctgctgctaacaaaaacatggccgtcatgtgggaggagaagactctctacgattacctcttgaaccccaagaagtacatacctgggacgaaaatggtgtttcctggattgaaaaagccacaagatcgtgccgacctcattgcttatttgaaggaaggtactgcatacacagacgctcggttataatggagcctctgttccccctccattttttttctcatagataaaaataagaccaacgtatatggtggtcataaacttgctttgtatatctttatttttttcaatggggcgagttacctcgtacgaagaagaagaagaagaagaagcaatcttctccaccacgaaattcaggagattttattccacttgcctagtttttgtttcaaatcagattcttcgacgacgaaagttgtatgtaccataccatgctgagttc

SEQ ID NO: 2612 - DNA, 624 bp, Raphanus sativus
  misc_feature (226)..(226): n is a, c, g, or t
  misc_feature (238)..(238): n is a, c, g, or t
  misc_feature (244)..(244): n is a, c, g, or t
  misc_feature (384)..(384): n is a, c, g, or t
  misc_feature (420)..(420): n is a, c, g, or t
  misc_feature (499)..(499): n is a, c, g, or t
  misc_feature (512)..(512): n is a, c, g, or t
  misc_feature (514)..(515): n is a, c, g, or t
  misc_feature (521)..(522): n is a, c, g, or t
  misc_feature (528)..(529): n is a, c, g, or t
  misc_feature (531)..(531): n is a, c, g, or t
  misc_feature (533)..(533): n is a, c, g, or t
  misc_feature (608)..(609): n is a, c, g, or t
acctaacagaaacccttacaaggctccagcgaagctagttccgtctttgttttctcctcgtattctcaggcgaaaaatggcgtcgtttgatgaagcaccaccaggaaactcaaaggccggagagaagatcttcaggaccaagtgtgctcagtgtcacaccgtggacaaaggcgccggtcacaaacaaggaccgaacctaaacggtctgtttggaagacagtctggnacaacagctggntactcntatctgctgctaacaagaacaaagctgtcgaatgggaagagaagaccttgtacgattacttgctcaaccccaagaagtacattcctggaacgaagatggtcttccctgggctcaagaagccacaagaacgtgctgatctnattgcctacttgaaggaagctactgcttagtggggncatgatcatgactttttagtcttctctgatcagatattcttttgacaaataaaatctccaaacttttgtttttggtttnggaaatgctctcntnntcttcnntttggnngngnaaacttggctgtttgagttccaaatgtactcgagtcctttcattttctgaggctcattcatataaatgcatctanntagaagcactttctt

SEQ ID NO: 2613 - DNA, 788 bp, Vaccinium corymbosum
ccgggattcaccaagcaaaaaaggagtcccacaaagacggaaagccctagaaacaaaagcctcccgttcatcttcttcttcgttttcggcttccaaaccctagaaatcgtctgtgctcttcgctgtttaggaaatggcgagtttcgatcaagctccacctggtgatgctaaatctggagagaagatcttcaggaccaagtgcgctcagtgccacaccgtcgacaaaggcgctggacacaaacaaggaccaaatttgaatggccttttcggaaggcagtctggcaccactcctgggtactcatactctgctgctaataagaacatggctgttaactggggagagaatacgctgtatgattacttgcttaaccccaagaagtacatccccggaaccaagatggttttccctggactgaagaagccgcaggagcgagctgacctcattgcatatctcaaggaggcaacgtcttcctaattcttttgcctctatctaggctttcatattttgcggcaggtggatgaggattttggttaccggtcacttgtttggaattctttttcctgaacattagctattactcctacattgaataaatgagaccattaaggtttctgctacactatttcactggaaacccaagccaatactcagaatttttgtcttgtttgttgaatccctgatgatatgtttgctctcgtaactgattgttcgccatgatttgtcctgtttgcattttaatgaatgtgatgggatttgctaatggcatcttttgatctcgcgattttgt

SEQ ID NO: 2614 - DNA, 885 bp, Elaeis guineensis
gcacgcaccatgctattccaagagttataaagggcattatagtaatttaagcagcgcacccgcatatatgggagcgtggctagcgcctccgaggaagctgtagtcgctcgttggaagtagccgccgaaggcagtcggtcatcgctgccgttgggaaaggacaagtgaatcaaaccctaaaccgagacctcggtcgaggtcgtcgatggcgtcgtttgcggaggctcctcctggcgaaccgaaggccggggagaagatcttcaagaccaagtgcgcgcagtgccacaccgtcgacaagggggccggacacaagcaaggacctaatctgaacggtctgattgggaggcaatctggtactacacctggttattcatactctgctgcaaacaagaacatggctgtgatatgggaggagtcgactttgtatgattacttgcttaatcctaaaaagtacattcctggtaccaagatggttttccccggactgaagaagccacaagaacgtgcggaccttattgcttatcttaaacagtccacagcaccttaattccattgcatcctattttattgcggacaattttttgggcttataagacctcgagggtcacctcgcttgttcaaagcagtggagccatgtaaacattttcttttctttttgagttcctctttaattgtttccttctattaagggattgtttcctctgagataaatctattttgactgtagaattagactgcccgggagtaccaatactctatatgatgagatcgttggtgatgtttgtcagatccccaagaacaaataaccgttattcaggacaatggattactgttttggatgttaacagctgtatgcgtgaacttgttttgtaataaaaaaaaaaaa

SEQ ID NO: 2615 - DNA, 798 bp, Elaeis guineensis
agtcgcagggcttctcggagaccgaatcgtgcttccgcgtctcttgtgaggaaggagaggaaaccctaaccctagatcgatcgatccagagtgctttctcgagggaaatggcgacgttttcggaggctcctcccggcaatcccaagtccggggagaagatcttcaagacgaagtgcgcccagtgccacaccgtccagaaaggagccggccacaagcaaggtcctaacttgaacggtctttttgggaggcaatctggtaccacccctggttattcttactctactgcaaacaagaacatggccgtgatatggggggaatcaactttatatgactacctacttaatcccaaaaagtatattcctggtacaaagatggttttccctggtctgaagaagcctcaagaacgtgcagatctgattgcgtatcttaaggaatccacagcatcataagtcatgttcagtcggcaattcctctcttttttttttttttgtctaataagatttccaataaaacctggaaaatggtttgcttgcttgaggttactaattttttttggcctcttctcagggcattgtttcctccaagatgcattcattttgctgtaaaatagttgctgtggtgccgttgcatgacaccctagcaacctttctaagatgatggtacgttgtgctgtgcttctaagctgatttatgtgtagatttttgtgaaatttcaaatggtctgaatctttgttatgatgctgctttaataacattgacggtagagagtggtaaaatatgactcaatcccaaaaaaaaa

SEQ ID NO: 2616 - DNA, 652 bp, Persea americana
caaaaaagaagagaagtagagaacggaggaggagagcaaagaaggcgaaaacagaagaaaccctcgagagctctctgattagggtttgtaaacgatggcgacatttgcagaagcaccagcaggaaatgaaaaatcaggagagaagatcttcaggaccaagtgcgcccaatgccacacggtcgacaaaggagccggacacaaacaaggacccaacttgaatggtctttttgggcgacagtctggcacaactgctggttactcttactcaactgctaacaagaacatggctgttatctggggagagtcaactttgtatgattatttgcttaatccgaagaagtatattcctggaactaagatggtattccccggtctgaagaagccccaagagcgtgcagacctcattgcttatctcaaggaagccacatcctcttgagacgttcatctctacatcctctattttgctgcaattggaggttgttttttagtcgactgatgagcttcttattcttctgtaataagacctggagaggtcatgaactcattaatcagtggtgggtggaatggccccctactcaattccttcaaaatgattgaaattgattgtctgcattggattcactcctgatatatatctacaccatcaattaat

SEQ ID NO: 2617 - DNA, 798 bp, Brachypodium distachyon
gcccgaagccagaaaggcgagcaaaacttccacttgacctctccccctcgagtctaccggcgagtctcttcgtgcggcggcggcgatggcttcgttctcggaggcacccccaggcaacccgaaggccggcgagaagatcttcaagaccaagtgcgcgcagtgccacactgttgataagggcgccggccacaagcaaggcccgaacttgaacggtctgtttgggaggcaatcgggtactacccctggttactcctactcctcggcaaacaagaatatggctgtgatctgggaggagaaaactctgtatgactatctgcttaatcctaagaagtacattcctggaaccaagatggtcttccctgggctgaagaagccacaggaccgtgctgatctcatttcgtacctgaaggaagcaacctcctcttgaaagtgcatgctgctataatcttgtcatatgagggaattcgttttacagtacaataaaaagattagacgctaaagccactctggtttaacggggtgtgatccacgagacagtttggtcttttgaatttcgttcttatggtatgggttccatatctctaggtttagctggatgagtgttcgacaatctttttattcagctgctggaaaatcccagtaacgcatattttgaccaccaggtggcggtgggactggatgcacccagatctttaatgttttgatattaagcttgaatgttaattctataaattgtcaaatctgagtttgatgttgatcctctgtctgactatgttttccttcgatattgattttgat

SEQ ID NO: 2618 - DNA, 946 bp, Brachypodium distachyon
aacacgagcccgacgaaatcgcccggggccagaaaggcgagcaaaacttccacttgacctctccccctcgagtctaccggcgagtctcttcgtgcggcggcggcgatggcttcgttctcggaggcacccccaggcaacccgaaggccggcgagaagatcttcaagaccaagtgcgcgcagtgccacactgttgataagggcgccggccacaagcaaggcccgaacttgaacggtctgtttgggaggcaatcgggtactacccctggttactcctactcctcggcaaacaagaatatggctgtgatctgggaggagaaaactctgtatgactatctgcttaatcctaagaagtacattcctggaaccaagatggtcttccctgggctgaagaagccacaggaccgtgctgatctcatttcgtacctgaaggaagcaacctcctcttgaaagtgcatgctgctataatcttgtcatatgagggaattcgttttacagtacaataaaaagattagacgctaaagccactctggtttaacggggtgtgatccacgagacagtttggtcttttgaatttcgttcttatggtatgggttccatatctctaggtttagctggatgagtgttcgacaatctttttattcagctgctggaaaatcccagtaacgcatattttgaccaccaggtggcggtgggactggatgcacccagatctttaatgttttgatattaagcttgaatgttaattctataaattgtcaaatctgagtttgatgttgatcctctgtctgactatgttttccttcgatattgattttgatatcttgtttaccaattgatagcgtccatactgcggcatggagttgaatcattttggcagctatctggctagtgcgcggtggcaagttgtggaatgttaataatcaatacatacagtagcttgaactcc

SEQ ID NO: 2619 - DNA, 1047 bp, Coffea canephora
cggccggggggaaaaccctagaaatttctcaaaacaggcactctcgctcaaagccggaaagaaacaaaaaaaagctagaaaaccctaaggtctcgttttttggttgcattcgggaaaatggcaacgttcgagcaagctcctcccggtgatcctaaaggcggagagaagatcttcaagaccaagtgcgctcagtgccacaccgttgacaaaggcgccggtcacaaacaaggacccaatttgaatggcctttttggacggcagtctggcacaactgctggttattcttactctgctgctaacaagaacatggctgtcatctggggagagaatacgctgtatgattatttgcttaaccctaagaagtacattcctggaacgaagatggtttttcctggattgaagaaaccacaggagcgtgcagatctcattgcctatctcaagcatgcaaccagcgcttgaagattcatttgagcatcatactgaactagtgatttataatgattttggttattagtgccagtttgaaattctttgtcctcgaaaacttttggtacttgccattaaataagcccacgaagttcttcactgctactgttttatctggttgattctgaggccaacagtaaagcatttttgttgcattagatgagtgtccgggcattttttgaactctcctatgtactgggatatctagagctaaagataaacgggcgtatatgaagtttatacgcttgaggccatgttcccatatttgcccctatggttggttgttgtttatcactgaaagtaatgataccgtgccacgagactcttaagaagccgtctgttcttcgtcgacatgaaacagtaatgttaattacggggtggagcatttgcggcagaccctttgtggtggggtgtaaataaatcaaatcaaaacactagttcaattatttaagcgagtttaaaattttgtttaaatttcatttgtttatttaacgaattgaatttgcgtgagcttttattgagctaaattcaagttgcatttgagtaaaaaaaaaaaaaaaa

SEQ ID NO: 2620 - DNA, 596 bp, Gossypium hirsutum
agtcgtggttgacgatggcatccttcgctgaggctcctcctggcaatgcgaaggccggggagaagatcttcaagacgaagtgcgctcagttccatactgtagataaaggagcgggacacaagcaaggaccaaatctaaacggcctttttgggaggcaatcagggactactcctggttactcatattctgctgctaacaagaacatggctgtgatttggcaagagtctactttgtacgactatttgcttaacccaaagaagtacattcctggcacgaagatggtctttcctggcctcaagaaaccacaagaacgagctgatctgattgcatacttgaaggaaggcactgcagagccatgatgccttttgcaatctttgccggacccaatggatctttttttgagtgtaggacaatttttttggcaataagacctatgcaaaaaggtcaagcctaatgctctatttgtttcggtgcagaaacttggtctaaagcttaaaaactttcctccacaacgtttctgggagatgataaccaatgtataacattttattgattgttcaagtctttccgtgtgatatattaaagattgatccgac

SEQ ID NO: 2621 - DNA, 594 bp, Gossypium hirsutum
agtcgtggttgacgatggcatccttcgctgaggctcctcctggcaatgcgaaggccggggagaagatcttcaagacgaagtgcgctcagttccatactgtagataaaggagcgggacacaagcaaggaccaaatctaaacggcctttttgggaggcaatcagggactactcctggttactcatattctgctgctaacaagaacatggctgtgatttggcaagagtctactttgtacgactatttgcttaacccaaagaagtacattcctggcacgaagatggtctttcctggcctcaagaaaccacaagaacgagctgatctgattgcatacttgaaggaaggcactgcagagccatgatgccttttgcaatctttgccggacccaatggatctttttttgagtgtaggacaatttttttggcaataagacctatgcaaaaaggtcaagcctaatgctctatttgtttcggtgcagaaacttggtctaaagcttaaaaactttcctccacaacgtttctgggagatgataaccaatgtataacattttattgattgttcaagtctttccgtgtgatatattaaagattgatccg

SEQ ID NO: 2622 - DNA, 911 bp, Eucalyptus grandis
tttctttttctcattcagggcgagagaaccctagaacaccacgcgagcgagaagcaagagagagagagcgacagagagaaagagagagagcggcgatggcgtccttcgctgaagctccaccgggcaatcccaaggtcggggagaagatcttcaagacgaagtgcgcccagtgccacaccgtcgagaaaggcgctggccacaagcaagggcccaacctaaatggactgttcggtaggcagtccggcacaaccgcaggatactcttattccgctgcaaataagaacatggctgtcaactgggaggagaagacattgtacgactacttgctaaaccccaagaagtacattcctggaactaagatggttttccctggactcaagaagccccaagatcgcgctgacctgattgcgtttttgaagcagtcaactgcatcttaagcgactaaatgtcatcccctgttccatttgattaatattgagattcctgttcagccagagagaatgaggcgttattcttttccctaataaagtagacactatgtaggtctttgcaaactcttggcttggcgagcattgccgagctgcattttgttgtttgccgtgagctgccaattgaaccatatactcctgaaaaccaggaatttttcaaggttttattataagatcatctctcgtatttatgctacatttcatatgcacagtggctcgataggtagggtcggtctcgtataaacgttggcttgattgagggaggcctagataatgcaatttacatttagtcgataaccaaaagacgccttaaatctttttgggggcattgtgtttggctgaaaagccaattgctagcctgattgcgaagtaattggccctctcgagatggcttcctctcggtactcaacatgagctgtgatg

SEQ ID NO: 2623 - DNA, 682 bp, Elaeis guineensis
  misc_feature (5)..(5): n is a, c, g, or t
  misc_feature (28)..(28): n is a, c, g, or t
  misc_feature (199)..(199): n is a, c, g, or t
  misc_feature (285)..(285): n is a, c, g, or t
tgcgnctatcggtctttgccgcgtgaanggaagcgaagcaaaccctaaccctagatctcgaatggcgtcgttcgcggaggctcctcccggcaatgcgaaggccggggagaagatcttcaagacgaagtgcgcccagtgccacacggtcgagaagggggccggacacaagcaaggacctaatttgaatggactttttggnaggcaatctggtaccacacctggttattcgtactctgctgcaaacaagaacatggctgtgacatgggaggagtcaacattgtatgnttacttgcttaatcctaaaaagtacattcctggtaccaagatggttttccctggactgaagaagccacaggagcgtgcggaccttattgcttatctcaaagagtccacagcaccttaaatccgttacaacctattataccgcggacaaattttttgggcaaataagacctgaagggtcatcctgcttttttcaaagcggtggagccataaaaacatttattctttgacgagttcctcttaaattgtttccatctaccaagggattgtttccctgagataaatttattttggctgtaaaatttagctctgcaacatttccaggaataccagtaattgtgagatcatttgtgacatccagcagatgccccaaaattaacaaataaccattattcaggac

SEQ ID NO: 2624 - DNA, 703 bp, Lippia dulcis
tctttataggacaagctgaatcgagatggcgtcgtttgcggaagcaccggctggaaacaaagctgcaggggagaagatattcaagaccaaatgtgctcagtgtcacaccgttgacaaaggcgctggccacaaacaaggacctaatctgaacggcctctttggaaggcagtccggaacaactcccggttattcctactccgctgctaacaagaacatggctgtcacgtgggaagaaaagactctttatgattacctgttgaaccccaagaagtacatacctggaacaaagatggttttcccgggattgaagaaacctcaagaacgtgctgaccttatagcatacctcaaggagtctacggcaaattgattaccctgtacttctttttctccattttgcagttgagagcagtagatttcgcccgtgtcgcggtaaaattgcacaaattttttgaataaatttttgggataacctttattggactcccaattattctttcctctttgaagaggccattgttcttgtcaattggaaatccaatttgaacttgagtacaatttgttacaagatgaatagttagtaacgttgtaacctgttttcttgaataaccttttcagtaggggaaaggagtttgatacagtgcttaaaagactttgtaagagtatgatctatagagtgaattcaatcaacatgcacttgagcaaa

SEQ ID NO: 2625 - DNA, 848 bp, Brassica juncea
cgcacaaccaattctcttagttgattaggttctcgtctttactcccttaccaaatttggatattttcttgtattagacaccgactcgtttaaaagaagtgatcacagcttccactagctgtaatctcttttgactgattgactattttacttttacatggatgattaactggagcccactgaaaagcccatttagttatcggcccattattttgaagagagctctctcgtctcgtgcgttgttgtcctaacagaaacaaaccctaaagagaagcgagttccgtcttaattttctccccagcgaaaatggcgtcgttcgatgaagcaccaccaggaaactccaaggccggtgaaaagatcttcagaaccaagtgcgctcagtgtcacaccgtcgacaaaggcgccggtcacaaacaaggaccgaacctaaacgggctgtttggaaggcagtctggaacaacagccggttactcttactctgcggctaacaagaacaaggctgttgaatgggaagagaagaccttgtacgattacttgctcaaccccaagaagtacattcctggaacgaagatggtcttccctgggctcaagaagcctcaagaccgtgctgatctcatcgcctacttgaaggaatctactgcttagtgaaccaatcattggtgtgggacacgatcatggcttttgagtctctcatatcagatattcttttgacaaataaaatctccaaacatttgtttttggttttttttattaatgctctctcatcttcaaatacgttttgggtgtgtttctgtcttttgagttccaaatgtactcgagtccttttctgaggctcactcatataaatgc

SEQ ID NO: 2626 - DNA, 2814 bp, Brassica rapa
tcccacagaaacccttagaagctccagagaggcgagttccgtgtttgttttctctttgttggctcctcctcctcgtgatatcaggcgaaaatggcgtcgtttgatgaagcaccaccaggaaactccaaggccggagagaagatcttcaggaccaagtgtgctcagtgtcacaccgtcgacaaaggcgccggtcacaaacaaggaccgaacctaaacggtctgtttggaagacagtctggaacaacagctggttactcttactctgctgctaacaagaacaaagctgtggaatgggaagagaagaccttgtacgattacttgctcaaccccaagaagtacattcctggaacgaagatggtcttccctgggctcaagaagcctcaagaccgtgctgatctcatcgcctacttgaaggaatctactgcttagtgaaccaatcattggtgtgggacacgatcatgacttttgagtctctcatatcagatattcttttgacaaataaaatctccaaacatttgtttttggttttttttttataatgctctctcatcttcaaatacgttttgggtgagattctgtcttttgagttccaaatgtactcttgagtccttttctgaggctccctcatataaatgcatctatctagaactagaagcattctttttcttatcaactaacatattgcagtgtgtagataacaaaaattcaaattatattaactatgaacaatgatgttggagcaagatcaatattaggattcgttctagatcattgtcattcatctatctagaactattttcctttcaacatatgtagagaacaaaaatggaactatattaatatcaactataaacaatgatggagaagtattaatgtcatcacatatttaacattcagcgtctgaaacatggttctccactaaggttttacaaatcctagagcctcatccaactgaatccgtctctgttctgttcctttctcttagtacccatatctccctactcatcatcaatatcctttatagcatcctgcaacaccaaacaaatgaattagatacgagtgtgtttataaccttgttcagatgggaaagagcacaacagtaactactagtattagttacctttgctaggccagttacatatgttgcagctaatgcagttaccaacagacccaacccgagcgttagaagctggccgtttcctcctggcaatccaacagctgattcttcttgctgaaacaacaacacagttagtaaacattgtcatctgatggtagttatgttgcttgctagagtgaccacgtatccacagttcagcacattcataaaccatatgtctccactgatccatcaaagatacaatttcttcaactcaagttaacatccataagtaagtatttgtctttcattctatatcagtctccttttacattatgtaaaaacagaaccttttttctgtgatcccacagcttgatgttctataactctcttttaataccctagctttcaatttagttcttctaccatacactaaagctgcccagcatggacctattgtacaccaacaacgtaaaagctcggtggatcctactgtaaccttacgcttgacatgataaaggcatatgttcaaagcatcgaggggtagctaatctagattaacagacaacaatacttacaatgattgctcgtccaaaagcaccagcgctgacataagcccaagatcctggaagcatacctaaccaactgcacaaaacagtatgatccacaaataagtatgtgtactcaaaatgtacatttatccagttgagatcttgttcataggggaatagtataaaaagtttccttttaacacagaccttccaagtacataaggcacaaacttgacagacgtcaagccgtagaggtaattgccaagagagaaaggaagcagagggcttagccgaaggagagtaacaaccctaaacccattctcaccaatggctttatcaatggcgaggaacttcttgttaccttcaactaacttaaggatccgctctctagcaaagtatctagcaattagaaaagcaacactagcagccatctaacagaaaaaaagaaaagcaaaaccaaaaagagaatcacacaaccaaacatatatatgaaacaagtggggaaagttagttgatgaaataacttacagttccactgatggaaacaatgatggtgccaacgagggaaccgaagagaagaccagccgacatggtcaacgggagagccggaatggctagtatctcaaggccagcgtacacagcaatgaacagcgcatacccagccggtccataaccttcgatgaaagtggagaactgagtgagaaaggtattgatctggtctctgtagacgtagccaacgccggcgaatccaccaacagtaccaatcaacaacactccggcaagaatcgtacccttgatagcagcatccccgcccgatccttcgtcgctctcagctttgggggacttagcatcgtcgtcgtcgctggatttgggattgaagaaccaccggagacttttgggaggaggggcggtggaaggaggcggagagcggcggagagactgttgctgcttcttcgtttgtttgagggaggaagaacatggcttgaggaaatggaagcgtttgtaggaggaggaggtgaaggtgaatgggagagaagaggatctgagagttagagtgaggctgcgcatcttcaagcagcgttggtgaagactgaattggagcagcttcttctgtgttccatccaaaactttttctcggtgtgggattgttggcgcggcatttctcct

SEQ ID NO: 2627 - DNA, 848 bp, Cannabis sativa
ctaatagccatctctctctccatcgcgtacgatccattagcagacgatcgacgacaggaaacggcaacaactcacgtatggcatccttcgacgaagctcctcccggaaattccaagacaggggagaaaattttcaggaccaagtgcgctcaatgccacactgttgataaaggggccggtcacaagcaaggacccaatttgaatgggttgtttggaaggcagtctggaacaactgctggatattcttactcagctgctaacaagaacatggctgtgacttgggaggaaaagactttgtatgattacttgctaaatcccaagaagtacattcctggaactaagatggtcttccctggactgaagaaaccacaggatcgtgctgaccttattgcatatttgaaggaatctactgcttgatattttcatccattgcctattccattttgtagttcaacaattattcacacatagcggaagaggaagaagttgctgtaatcggcacattaaacattcattttgcttacaattttatgaatattgtggtacaccattttacttatgggtggattgatcttttcatcttgatgttaatgctgttacaggttagtatcctgtttatttttatctacacaagattctgaatagcaacaatgcaattacctggctgaaaattgtgttttttttttttcttttgataactgaaatctttcattgaaagaaacccagaggaaggaataaacaaaacaaacaagggtagttcatggtagcagcaaagggtgtcacctccctagatagacgatggtaacttcgagttctctaaagaaataactcatattttatagacggata

SEQ ID NO: 2628 - DNA, 792 bp, Cannabis sativa
ctaatagccatctctctctccatcgcgtacgatccattcgcagacgatcgacgacagcaaacggcaacaactcacgtatggcatccttcgacgaagctcctcccggaaattccaagacaggggagaaaattttcaggaccaagtgcgctcaatgccacactgttgataaaggggccggtcacaagcaaggacccaatttgaatgggttgtttggaaggcagtctggaacaactgctggatattcttactcagctgctaacaagaacatggctgtgacttgggaggaaaagactttgtatgattacttgctaaatcccaagaagtacattcctggaactaagatggtgtttcctggactgaagaaaccacaggatcgtgctgaccttattgcatatttgaaggaatctactgcttgatattttcatccattgcctattccattttgtagttcaacaattattcacacatagcggtttgtatcctgtttatttttatctacacaagattctgaatagcaacaatgcaattaccgggctgaaaattgtgttttttttttcttttgataactgaaatctttcattgaaagaaacccagaggaaggaataaacaaaacaaacaagggtagttcatggtagcagcaaagggtgtcgacgatggtaacttcgagttctctaaagaaataactcatattttatagagacggaaaaatagtgtagcttgtcgaaaatatttattggttgattttgaagtattgatgatgatttatggttaaaatgactctagaagataatt

SEQ ID NO: 2629 - DNA, 674 bp, Cannabis sativa
ttatatctttgaaatgtgaagctatcttatcatattcaattcattactttatatacgtttttcagacctttaatcccacatcgactaaggagttagtcaaggagagcctaccacctataaaacccaaacttgttaggatgacgtggcagaatacatgcccgtgctgagtattttcttcctccagtttacaaaccctacacaaagctcaaaaaaaaaaaaaaaaaaaaaaatggcgtctttcgacgaagctcctcccggaaattcgaagacgggggagaaaattttcaggaccaagtgcgctcaatgccacactgttgataaaggggccggtcacaagcaaggacccaatttgaatgggttgtttggaaggcagtctggaacaactgctggatattcttactcagctgctaacaagaacatggctgtgacttgggaggaaaagactttgtatgattacttgctaaatcccaagaagtacattcctggaactaagatggtcttccctggactgaagaaaccacaggatcgtgccgaccttattgcatatttgaaggaatctactgcttgatattgcctattccattttgtagttcaacaattattcacacatagcggttcggaaccaattttttttcctttgatttactaataaaactcgagacttttaagggctg

SEQ ID NO: 2630 - DNA, 713 bp, Cirsium arvense
tctctaggtttcaaatccacaatcggcgatccgatctacaaacattgatggcgtcgttcgcggaggctcctgccggaaaccccaccgccggtgagaagatcttcaagactaaatgcgctcaatgccacaccgtcgagaaaggatccggccacaaacaaggacccaatcttaatggactatttggaaggcagtctggaacaactgctggatactcgtattctgctgctaacaagaacaaggctgttacatgggaggaaaatacattgtatgattacctgctcaaccccaagaagtacatccctggaacaaagatggttttcccaggactgaaaaagccacaggagcgtgcggatctgattgcatacctgaagtcatcgacagcttaattccattttgaagtgtttttactgatgattttgaggtatcaggagatggataaatttggattaatatttttccgtgaataagggaaggaggaccttcatcatatttcttttgctccttcatttttgagaaactggtttattcaattgccaaattacaggagttgtaatgcatttcaagtgttttctttaatcatcatacgttcattctatatgattgttgaattaccctgataatcatggaaacaaccatttaaatttgagataaaatactttcatgttgtgtactaacatataaatgttacaaaaagtttatctaccaaaaaagaa

SEQ ID NO: 2631 - DNA, 575 bp, Gossypium hirsutum
aaaaaaatcaaaagcaatggcctcattcgagcaagcaccgcctggtgatgcgaaagctggggagaagatcttcaagaccaagtgtgctcagtgtcataccgtcgataaaggcgccggtcacaagcaagggccaaatttgaatgggcttttcaggaggcagtccgggacaacaccgggatactcgtactctgctgctaataaaaatatggctgtgatttggggagagaatactttgtatgactacttgcttaatcctaagaagtacattcccgggacaaagatggttttccccggattgaagaagcctcaagatcgtgccgacctgattgcatacctgaaggaatcaaccgcctgattcgtctccggttttattaatatgacctatattttggaactgtgacaaaatgaagaattttgatcaatgatgtattttttttacatggaaaaagaaaccattcttgaaataaagttaaaccatgaaaacgactccaaagataattggagttgaaaatgatttttgttaagactaaaatctcttgatgatgaggaatttgattattacatgatggtttatt

SEQ ID NO: 2632 - DNA, 510 bp, Flaveria ramosissima
ctctaacgaaacaaccttcaatcggcgattcgatcctcacataacacacctcaatggcgtctttcgcggaggctcccgccggaaatcccgccgccggcgagaagatcttcaagaccaagtgcgctcagtgtcacaccgtcgagaaaggcgctggccataagcaaggacccaacttgaatggactgttcggaaggcaatctggaactaccgctggatattcctattctgctggtaacaagaacaaggcagttatatgggaggaaaataccttatatgactacttgttgaaccctaagaagtacatccctggaacaaagatggttttcccaggactgaaaaaaccacaggagcgtgccgacctcatcgcatacctgaaggcatccacagcgtaattttttttgtttcaacaccattttgaagttttcttgatgattcaaggtattaggagatgacttcggattatattttggttaataaggggaagacatatatcaaatttctttaccctct

SEQ ID NO: 2633 - DNA, 622 bp, Fraxinus spp
gacagacaatattgtaaagatctcgtttggttgagtaatttgcttgagagaaatatggcgtcattcaatgaagcacctcccggaaatgttaaatccggtgagaagatcttcaagaccaaatgcgctcagtgccacaccgttgagaaaggcgctggccacaaacaaggtcccaacttgagtggcctctttggaaggcaatctggcactacccctggttactcttactctgctgccaacaagaacatggctgtgatctggggagagaatgctctttatgattatttgcttaatcctaagaagtacattcctggaactaagatggttttccctggattgaagaagcctcaagatcgtgcagatctaatagcttatctcaaggaggcaactgcctgaagcttctagctttaaagaagctagttatttttactgaaacacgcttagattggtcattggtgtcgtttgggaatttttttagaggaaaaagaattagcaactgcaattctatttaataagagcatcacagttgtgcactgtgctatttctctgtttgagcttttacgccaacaattgcaaattttgttgcccctgcggctaatgattttttgaactgatatagttttca

SEQ ID NO: 2634 - DNA, 607 bp, Arabidopsis lyrata
agaaaccgtcaaaaagccaccgttgagattttcttcctccaatggcgtcgttcgatgaagcacctcccggaaaccccaaagccggtgaaaagatcttcagaaccaaatgcgctcagtgtcacaccgtcgaaaaaggcgccggtcacaaacaaggaccgaatttgaatggattgtttggaagacaatctggaacaacaccaggatattcttactctgctgctaacaaaagcatggctgtgaattgggaggagaagactctttacgattacttgttgaatcctaaaaagtacattcctggaacgaaaatggtgtttcctggactgaaaaagccgcaagatcgtgccgatctcatcgcttacttgaaggaaggtactgcataagacaggcacggctggatatttgaagctttgcatttttttttctcacagataaataaatcagaccaaaaatattatggtcatgaactggtttttgtatggtcttttcttcttagtttttttactttgtcgatgaggctagtagcctcttataaaagtaaacattcgttattgatgtgaagaatcaagaaacaatttccaccacgaaattcatgagatttttttaattc

SEQ ID NO: 2635 - DNA, 652 bp, Arabidopsis thaliana
acttctcataaaaaaggtcatttcaaaaaaaaatcagaaaccgtcaaaaagccaccgttgatatttcttccttgttgcttcttcaatggcgtcgttcgacgaagcacctcccggaaaccccaaagccggtgaaaagatcttcagaaccaagtgcgctcagtgtcacaccgtcgagaaaggtgccggtcacaaacaaggaccgaatttgaatggattgtttggaagacaatctggaacaactccaggatattcttactctgctgctaacaaaagcatggctgtgaattgggaggagaagactctttacgattacttgttgaatcctaagaagtacatccctggaacaaaaatggtgtttcctggactgaaaaaaccgcaagatcgtgccgatctcatcgcttatttgaaggaaggtactgcttagacaggctcgtccagatatatgaagctggcatttttttttctcacagctaaataaaatcagaccaaaaatattatggtcatgaactgctttttgtatggtcttttattctttctttctttttacgttgttgaagaggctagttgcctcttataaagtggaatattcgttattgatgtgaagagctaagaaccaatttccaccacgatagtcatgagattttcctaattc

SEQ ID NO: 2636 - DNA, 567 bp, Brassica juncea
ccagcgaaaatggcgtcgttcgatgaagcaccaccaggaaactccaaggccggtgaaaagatcttcagaaccaagtgcgctcagtgtcacaccgtcgacaaaggcgccggtcacaaacaaggaccgaacctaaacgggctgtttggaaggcagtctggaacaacagctggttactcttactctgctgctaacaagaacaaagctgttgaatgggaagagaagaccttgtacgattacttgctcaaccccaagaagtacattcctggaacgaagatggtcttccctgggctcaagaagccacaagaccgtgctgatctcatcgcctacttgaaggaatctactgcttagttaatcaatctatggtgttggacatggtcatgacttgaaaagtctctaagatcagatattcttttgacaaataaaatctccaaacttttgttttttttttttggtttttgaaatgctctcatcttcaaatacgttttggtgagattctgtctctttgagttccaaatgtactcttgagtcctttcattttgaggctcacaaatataaatgcatctatct

SEQ ID NO: 2637 - DNA, 652 bp, Brassica juncea
aacccttagaagctccagagaggcgagttccgtgtttgttttctctttgttggctcctcctcgtgatctcaggcgaaaatggcgtcgtttgatgaagcaccaccaggaaactccaaggccggagagaagatcttcaggaccaagtgtgctcagtgtcacaccgtcgacaaaggcgccggtcacaaacaaggaccgaacctaaacggtctgtttggaagacagtctggaacaacagctggttactcttactctgctgctaacaagaacaaagctgtggaatgggaagagaagaccttgtacgattacttgctcaaccccaagaagtacattcctggaacgaagatggtcttccctgggctcaagaagcctcaagaccgtgctgatctcatcgcctacttgaaggaatctactgcttagtgaaccaatcattggtgtgggacacgatcatggcttttgagtctctcatatcagatattcttttgacaaataaaatctccaaacatttgtttttgggtttttttttataatgctctctcatcttcaaatacgttttgggtgagtttctgtcttttgagttccaaatgtactcgagtccttttctgaggctcactcatataaatgcatctatctagaactagaagcattctttttc

SEQ ID NO: 2638 - DNA, 514 bp, Brassica juncea
cttagaagctccagagaggcgagttccgtgtttgttttctctttgttggctcctcctcgtgatctcaggcgaaaatggcgtcgtttgatgaagcaccaccaggaaactccaaggccggagagaagatcttcagaaccaagtgtgcgcagtgccacaccgtcgacaaaggtgccggtcacaaacaaggtccgaacctgaacggtctgtttggaagacagtctggaacaacggctggttactcttactctgctgctaacaagaacaaagctgttgaatgggaagagaagaccttgtacgattacttgctcaaccccaagaagtacattcctggaacgaagatggtcttccctgggctcaagaagcctcaagaccgtgctgatctcatcgcctacttgaaggaatctactgcttagtgataccaatcaatggtgtggggacacgatcatgccttttgagtctctcatcgcctacttgaaggaatctactgcttagtgataccaatcactaagcagta

SEQ ID NO: 2639 - DNA, 712 bp, Brassica rapa
  misc_feature (5)..(6): n is a, c, g, or t
  misc_feature (8)..(8): n is a, c, g, or t
  misc_feature (30)..(30): n is a, c, g, or t
  misc_feature (117)..(117): n is a, c, g, or t
ttttnngngccacgcctgctttccgggccncaattcccgggacagaaacccttagaagctccagagaggcgagttccgtgtttgttttctctttgttggctcctcctcctcgtgatntcaggcgaaaatggcgtcgtttgatgaagcaccaccaggaaactccaaggccggagagaagatcttcaggaccaagtgtgctcagtgtcacaccgtcgacaaaggcgccggtcacaaacaaggaccgaacctaaacggtctgtttggaagacagtctggaacaacagctggttactcttactctgctgctaacaagaacaaagctgtggaatgggaagagaagaccttgtacgattacttgctcaaccccaagaagtacattcctggaacgaagatggtcttccctgggctcaagaagcctcaagaccgtgctgatctcatcgcctacttgaaggaatctactgcttagtgaaccaatcattggtgtgggacacgatcatgacttttgagtctctcatatcagatattcttttgacaaataaaatctccaaacatttgtttttggttttttttttataatgctctctcatcttcaaatacgttttgggtgagattctgtcttttgagttccaaatgtactcttgagtccttttctgaggctccctcatataaatgcatctatctagaactagaagcattctttttcttaaaaaaa

SEQ ID NO: 2640 - DNA, 637 bp, Hordeum vulgare
cgatcaccattccccgccgcccccagccacctccagccgagggagcccctaaccctagcctctagtccggcaaccgttcgcgcgggatcatcggcggcggcgatggcgtcgttctcggaggcgcccccggggaaccccgcgtccggcgagaagatcttcaagaccaagtgcgcccagtgccacaccgtcgacaagggcgccggccacaagcaagggcctaacctgaatggtctgtttgggaggcagtctggaacaactcctggatactcttactctacggctaacaagaccatggctgtggtttgggaggagaaaacactctacgactacctgcttaacccgaagaagtacatccctggaactaagatggtgttccctggactgaagaagcctcaggagcgtgctgatctcatcgcatacctgaagagtgccacagcttgaaagggcttttgctctgctgccacgttcctgaagttaataaaaatagacattgccatggtgtcactctggtttgacggggtgcatcaccaagacggttagagattttggtagcatttctccttacgatggtttctttccttcagcaaaatgcactgctataatggccgtttctcaggtctgttatgaacctgttgtt

SEQ ID NO: 2641 - DNA, 758 bp, Hordeum vulgare
tttaaaacaggcagagacagaacgagcccgatcaccattccccgccgcccccagccacctccagccgagggagcccctaaccctagcctctagtccggcaaccgttcgcgcgggatcatcggcggcggcgatggcgtcgttctcggaggcgcccccggggaaccccgcgtccggcgagaagatcttcaagaccaagtgcgcccagtgccacaccgtcgacaagggcgccggccacaagcaagggcctaacctgaatggtctgtttgggaggcagtctggaacaactcctggatactcttactctacggctaacaagaccatggctgtggtttgggaggagaaaacactctacgactacctgcttaacccgaagaagtacatccctggaactaagatggtgttccctggactgaagaagcctcaggagcgtgctgatctcatcgcatacctgaagagtgccacagcttgaaagggcttttgctctgctgccacgttcctgaagttaataaaaatagacattgccatggtgtcactctggtttgacggggtgcatcaccaagacggttagagattttggtagcatttctccttacgatggtttctttccttcagcaaaatgcactgctataatggccgtttctcaggtctgttatgaacctgttgttgttgttgttgttgttgttgttgttgttgttgttattgatgatcacctgtttgtgcatttggttgggcagtagacctcctcaagtatcttgtgc

SEQ ID NO: 2642 - DNA, 1119 bp, Theobroma cacao
ggtcttacactactggcggcggcgcgtgcttcgcatgatttattcatgcagttttcttaaatagtacatttcaactttccttattatattaatatacgcaaaaaccctaacgaaagctctaccgttctttgaaccttggatccaaaaaccattgaagaggaaagcctttgatcaaataggcaaaacaaaatcctcaactgaaatcaaaagcaatggcctcgttcgatcaagcaccgcctggaaatgcgaaagccggggagaagatcttcaagacgaagtgcgcccagtgtcacaccgtcgagaaaggcgctggtcacaagcaagggccgaatttgaatgggctttttgggaggcagtccggcacaacttcaggatactcctactctgctgctaacaagaacatggctgtgatttgggaagagaacacattatatgactacttgcttaatcctaagaagtacatccctgggacaaagatggttttccctggattgaagaagccacaggaacgtgtcgacctcattgcttatctgaaggaatcaactgcctgatgcatctgccttataatcagctattttggaacaatatgaagagttttgatcaatgattctaggttctgaagttcttattttttttttcgtacatgaagaaaactgcgcgattcttgaaataaaaaaaaccattaatgggtccaagataatttgggttctggagttgtagcaaagtagtggaaagattttgtgcaagaccaatctcatgatggtgaggcattccacattttccatcaaacatttgatgatttatttaggctctgagcctattgacaattgcactgttttgctggctgttcacttgttatgatatcttgatggggataacattttttcctgacccttgacatatggctagtcaaacccaaatagtacttgttaactacttgagttaggcagaagcaaagattctgcgttcgtccgtttgtggcagagaaaaaaaagtagacatacgtgagcctgctcctgcctctctagattggccaggaatctgccgtccaattggaccaatatacattgctttcgtcgattgggatggtcgatggttaaatgaatttgggccgttgat

SEQ ID NO: 2643 - DNA, 625 bp, Brassica napus
acagaaacccttagaagctccagagaggcgagttccgtgtttgttttctctttgttggctcctcctcctcgtgatctcaggcgaaaatggcgtcgtttgatgaagcaccaccaggaaactcaaaggccggagagaagatcttcaggaccaagtgtgctcagtgtcacaccgttgacaaaggcgcaggtcacaaacaaggtccgaacctaaacgggctgtttggaaggcagtctggaacaacagctggttactcttactctgctgctaacaagaacaaagctgtggaatgggaagagaagaccttgtacgattacttgctcaaccccaagaagtacattcctggaacgaagatggtcttccctgggctcaagaagcctcaagaccgtgctgatctcatcgcctacttgaaggaatctactgcttagttaatcatgacttttgagtctctcagatcagatattcttttgacaaataaaatctccaaacatttgtttttgtcttttttcttttttaaatgctctcatcttcaaatacgttttgggtgagattctgtcttttgagttccaaatgtactcctgagtccttttctgaggctcactcatataaatgcatctatctagaacta

SEQ ID NO: 2644 - DNA, 649 bp, Brassica napus
ccgggattcggccttatggccggggacagaaacccttagaagctccagagaggcgagttccgtgtttgttttctctttgttggctcctcctcctcgtgatctcaggcgaaaatggcgtcgtttgatgaagcaccaccaggaaactccaaggccggagagaagatcttcaggaccaagtgtgctcagtgtcacaccgtcgacaaaggcgccggtcacaaacaaggaccgaacctaaacggtctgtttggaagacagtctggaacaacggctggttactcttactctgctgctaacaagaacaaagctgtggaatgggaagagaagaccttgtacgattacttgctcaaccccaagaagtacattcctggaacgaagatggtcttccctgggctcaagaagcctcaagaccgtgctgatctcatcgcctacttgaaggaatctactgcttagtgaatcatgacttttgagtctctcatatcagatattcttttgacaaataaaatctccaaacatttgtttttgggtttttttttataatgctctctcatcttcaaatacgttttgggtgagtttctgtcttttgagttccaaatgtactcttgagtccttttctgaggctcactcatataaatgcatctatctagaacta

SEQ ID NO: 2645 - DNA, 669 bp, Brassica napus
ggaaccttcttttataacaattctcattttcacacaacgaagagccattaacaaaaaaaagaggacaggcttgaagaaactatcaaaaaggcaccgttctgtctgacttttccattatcgatcacaaaatggcgacgttcgatgaagcacctcccggaaacccaaaggcaggagaaaagatcttcagaaccaagtgtgcgcagtgccacaccgtcgacaaaggtgccggtcacaaacaaggaccaaacttgaacggattgtttggaaggcaatcaggaacgactccagggtattcttactctgccgccaacaagaacatggccgtcatgtgggaggagaagactctctacgattacttgttgaaccccaagaagtacattcctgggacgaaaatggtgtttcctggattgaaaaagccacaagatcgtgccgatctcatcgcttatttgaaggaaggtactgcgtagactggggttgctcggatataatgaagcctctattctccttgcatttttttttctcacagaaaataaatcagaccaaaagcattgtggtcatgaactgattacgtgtttcttttttttttctttgttaatgaggcgagttgcctcttatagtcgaatattcgtttttgatgtgaagaccaatctccaccacgaaatttaatta

SEQ ID NO: 2646 - DNA, 695 bp, Brassica napus
ggaaccttcttttataacaattctcattttcacacaacgaagagccattaacaaaaaaaagaggacaggcttgaagaaactatcaaaaaggcaccgttctgtctgacttttccattatcgatcacaaaatggcgacgttcgatgaagcacctcccggaaacccaaaggcaggagaaaagatcttcagaaccaagtgtgcgcagtgccacaccgtcgacaaaggtgccggtcacaaacaaggaccaaacttgaacggattgtttggaaggcaatcaggaacgactccagggtattcttactctgccgccaacaagaacatggccgtcatgtgggaggagaagactctctacgattacttgttgaaccccaagaagtacattcctgggacgaaaatggtgtttcctggattgaaaaagccacaagatcgtgccgatctcatcgcttatttgaaggaaggtactgcgtagactggggttgctcggatataatgaagcctctattctccttgcatttttttttctcacagaaaataaatcagaccaaaagcattgtggtcatgaactgattacgtgtttctttttttttctttgttaatgaggcgagttgcctcttatagtcgaatattcgtttttgatgtgaagaccaatctccaccacgaaatttaattatatttaattctacttttgttggaaagc

SEQ ID NO: 2647 - DNA, 836 bp, Catharanthus roseus
ttgaggttccgcaagagagattggagagtctctcttgcggaacctcaagctctaacgcagtcctttgatcgattcgacgaaatggcaaccttcgaacaagcaccggccggtgatccaaaagccggagaaaagatcttcaagacaaagtgcgctcagtgccacaccgtcgataaaggcgctggtcacaagcaagggcctaatttgaatggccttttcggaaggcagtctggtacaacacctggttattcttactctgctgctaacaagaatatggctgtcatatggggagagaatacattgtacgattatttgctcaaccccaagaagtacattcctggaaccaagatggttttccctggattgaagaagccacaagaacgggcagatctcattgctttcctcaaggagtcgactgcatgaagtgtgttaccttcttagggcattgacactaaaattaaatgacagataaaagaatttttgttagtaacaatttgatattctttttcacgagaacagtaatcaaccaccattgaataagaccgagaaggggtctttaacattgtttttctcttgttgagctaaggccttgccttatgtggcaaggcagttttgtatctctatgatcaagtgattttttgaactcattttgctgtgtgttccgatggataaaaaaaattctaaactgcagaaatattcagtatctgaagcagctgaaattgatctgaatttgtgttgcttaaatattgtttcgtggaacgcgtgaatacttgttggacaggtagagggtttcacaattttttggagatgattcctctgacttgtagatgatcattcct

SEQ ID NO: 2648 - DNA, 830 bp, Centaurea maculosa
  misc_feature (680)..(680): n is a, c, g, or t
  misc_feature (801)..(801): n is a, c, g, or t
ggcgggggcctaaattctctttcatacgtaaaaagcttcccctttacgaaaacccccaaatcgctcttttcaattttcacccacctctctctctctctctagcaccttctcgaatcttcaatcggcgatcagatctacgaatatcgatggcgtcgttcgcggaggctcctgccggaaatcccaccgccggtgagaagatcttcaagaccaaatgcgctcaatgtcacaccgtcgagaaaggatccggccacaaacaaggacccaatcttaatggactatttggaaggcagtctggaacaactgctggatactcgtattctgctgctaacaagaacaaggctgtcacatgggaggaaaatactttgtatgattacctgctcaaccccaagaagtacatccctggaacaaagatggttttcccaggtctgaaaaagccacaggagcgtgcggatctgattgcatacctgaagtcctcgacagcttaattccattttgaagtgtttttactgatgatttgaggtataaggagatggataaatttggattaatatttttccgtgaataagggaaggaggaccttcatcatatttcttttgctccttcatttttgagaaactggtttattcaattgccaaattacaggaattgtaatgcatttcaagtcttttctttaatcatcntacgttcattctatatgattgtcgaattaccctgataatcatggaaacaaccatttttatttggtagtgtaaagaaccacatagattgtgtgtgcttttttcaaacatgttctcacatcanttgatctatttttaagataaacatggtac

SEQ ID NO: 2649 - DNA, 518 bp, Chelidonium majus
atgagaagggtggaaaagaaaccctagaaagctccttttttggggacgaagaacgaagttttgttaaccctagtttttttttcctctaaacttgtagatcgagaaatggcttcattcgaacaagctccaccaggagatgctaaggctggggagaagatcttcaagactaagtgcgctcagtgccatactgtcgacaaaggagccggtcacaagcaaggacccaatctgaatggtctcttcggaaggcagtctggtacaactgctggatactcctactcctctgctaacaagaacatggctgtgacctgggaagagaagacgttgtatgattacttgcttaacccaaagaagtacattcctggaacaaagatggttttcccaggtctgaagaagccacaggaaagggctgatctcatcgcttatctgaagcaatccactgcctaattcttctattgcgctctaggattatttgcagaaccttgaggtgtttgttacaggggtgatcggataggacacaa

SEQ ID NO: 2650 - DNA, 681 bp, Cichorium intybus
gcggggatatactgtgagtagggagaaaggtctggaaaggcttcgtcgtctctgtaaaagtcgaaaccctaagtcttgaagaatttgttggcggcgtttgtgtaaccggaaaatggcgtcatttgaacaagcaccgggaggcgatgctaaagtaggagagaagatattcaaaaccaagtgcgctcagtgccacaccgtcgaaaaaggggccggtcacaagcaagggccaaatttgaatggtctttttggaaggcagtctggtaccacagcagggtattcttattctgctgcaaacaagaacatggctgtgaattggggagagaacacactctatgactatttgctaaatcctaagaagtacattcctggaacaaagatggttttccctggattgaagaaaccacaagaacgtgctgatcttattgcttatttaaagcagtcaaccgcttgataaaattttattggttttattttcaatgggccttgttgatttgtggctttatttatatttttgttgcaaataactttgtcatgttgcatatggcttcatggacttgcatgtttctaggttcatatcataatttttgtgtggaacacatacttcgagaaacaagatttgtagactgttgagacctctaagccttatatgttttgttgattttgcaattcaaaaaaagaaaa

SEQ ID NO: 2651 - DNA, 695 bp, Citrus sinensis
caaaatcaaaaccctaagtaacttcctcctcaagaataaagaacgcaatcacagctctctctctctctctctgcgtcttctttctctctttggatctttcaaaacaccacaataatggcgtcgtttgatgaggcacctcccggcaatgcaaaggccggagagaagatcttcaagaccaagtgcgctcagtgccacaccgtcgagaaaggcgccggtcacaaacaaggtcctaatttgaacggattgtttggaaggcaatcggggactacacctgggtactcatactctgcggctaacaagaacatggctgtgaattgggaggaaaagactttgtatgattacttgctcaaccctaagaagtacattcctggaacaaagatggtattccctggattgaagaagcctcaggatcgtgctgaccttattgcatatttgaaacaatctactgcataagaacttgccgatagtcagtttacctattccattttgcagttgttgaagattgttttgcggtgcggatatagtactgttttttaccaataaattttaaacatttaaggttcagcaatgttctttgtaacttgagcattgctaatttgagaaaaggttgctgtcattggcaaacataatattcaattgaatttcctggttataatcatatttcatgaattttgggtgaaaaaaaaaaaaaaaaa

SEQ ID NO: 2652 - DNA, 887 bp, Citrus clementina
aaaccaacaaatcaaaatcaaaaccctaagtaacttcctcctcaagaataaagaacgcaatcacagctctctctctctctctctgcgtcttctttctctctttggatctttcaaaacaccacaataatggcgtcgtttgatgaggcacctcccggcaatgcaaaggccggagagaagatcttcaagaccaagtgcgctcagtgccacaccgtcgagaaaggcgccggtcacaaacaaggtcctaatttgaacggattgtttggaaggcaatcggggactacacctgggtactcatactctgcggctaacaagaacatggctgtgaattgggaggaaaagactttgtatgattacttgctcaaccctaagaagtacattcctggaacaaagatggtattccctggattgaagaagcctcaggatcgtgctgaccttattgcatatttgaaacaatctactgcataagaacttgccgatagtcagtttacctattccattttgcagttgttgaagattgttttgcggtgcggatatagtactgttttttaccaataaattttaaacatttaaggttcagcaatgttctttgtaacttgaccattgctaatttgagaaaaggttgctgtcattggcaaacataatattcaattgaatttcctggttataatcatatttcatgaattttaggtgaatattctattggcaaaagatttttcatttttatttttgggattatctatgataatggttatgactatcagtttacagctaccttttccttaactagtagttctttgtttattttgtcgctgctattcatatttgtctgctgctataaaaatgtcaatcaggttatgtgcaagctatgtaaggtgaatcattgactt

SEQ ID NO: 2653 - DNA, 1269 bp, Citrus clementina
aattcgattttaaccacaatcaaaatggcgtcgtttgaggaagctccacctggtaatccaaaggccggggagaaaatcttcaagaccaagtgcgctcagtgccacaccgtcgtgaaaggcgctggtcacaaacaaggaccaaatttgaatggacttttcgggagacagtccgggacaactcccgggtactcctattcagctgctaacaagggtatggctgttatttgggaagagaaaacattgtatgattacttgcttaaccccaagaagtatattcctggaacaaagatggtcttccctggattgaagaagcctcaggatcgtgcagacctcattgcctatttgaaggagtcaacagcctgatttttgcttagtgtgggctattttgcaaccatgggaagagtatggtccctgatgattcaataattttttgtttttggaagaaaaaatgttgttcaaatgagaatgttcaaaatgttttactctttgtagccatagacaattagataaaatgttcttccaaagaaacttttctttgagaggcatttcgcaaattttgatgatttctaagcgctatgtatcctaattttgccacttaatttgttataatggaattttaagttgcatattcttctttgagtggactttcttggattcaaagatgtcattacatttggatatgaaatttaagtttttttgtgtatctctgctcttttgaaatctatttttagcatggcatgtggactgaggtgggttgttgatgatgtatgaatcttgctatgtcagccatattgtcttttcctttctcagagtataagtcttaaagattttatgtaggaggactgcgttcagcacccaccaatttgccaaatatggtacctgctatgtttgtgtttacattgtgcttttttccttcccagagatgcaggagtttattcatatttgcagccttgttgatacagatctgtcataaagctggcaacgatgcattcgtccatgaaaggcaacaatcaagactagcttgaaagatcatattcgtgcacaaaccttcaagagccatgcacgtggacaagggtatcttcgattttttgcagttagatgttgaagaatggttatagacatgatatgcagaatgagagtattaaaagtacattacttaaatgttgctgtctgtagggatgtttatgccatccaagataaaaataggttaaagtttaggggctattttaacttcaactttttgatgttaagttagcaaaattttattgc

SEQ ID NO: 2654 - DNA, 623 bp, Cleome gynandra
cgcgttcgatctttcggagagtaaggaaaatggccacgttcgacgaagcaccgccgggtaaccctaaggccggcgagaagatcttcaagatcaagtgtgcgcagtgtcataccgtcgaaaaaggtgccggtcacaaacaaggaccgaacttgaacgggttgttcggaaggcaatctgggacaaccccgggatactcttattctgcggctaacaagaacatggccgtgatctgggaggagaagactctatacgattaccttttgaaccccaagaagtacattcctgggacgaaaatggtgttccctggtctgaaaaagccacaagaacgtgctgatctcatttcctatttgaaggaagccaccgcttgatatgggggttggtgttagcttttgccttctgatagtgaaaaagcttaattccccacaattctttcaccagtaaaataaatcaaagaccatctctggtcatgaactgagttttgtatgggcgtttttgccttttcctcccataattttttcctgaggtggtgaaccaataatttctcaccattactttcttaccctacttaatatgtataagttcaatattttctaagaccacatgttttttctatcagtacttta

SEQ ID NO: 2655 - DNA, 632 bp, Gossypium hirsutum
ccctcaaaagccctaattcggaaaaaaaaatcaaaagcaatggcctcattcgagcaagcaccgcctggtgatgcgaaagctggggagaagatcttcaagaccaagtgtgctcagtgtcataccgtcgataaaggcgccggtcacaagcaagggccaaatttgaatgggcttttcaggaggcagtccgggacaacaccgggatactcgtactctgctgctaataaaaatatggctgtgatttggggagagaatactttgtatgactacttgcttaatcctaagaagtacattcccgggacaaagatggttttccccggattgaagaagcctcaagatcgtgccgacctgattgcatacctgaaggaatcaaccgcctgattcgtctccggttttattaatatgacctatattttggaactgtgacaaaatgaagaattttgatcaatgatgtattttttttacatggaaaaagaaaccattcttgaaataaagttaaaccatgaaaacgactccaaagataattggagttgaaaatgatttttgttaagactaaaatctcttgatgatgaggaatttgattatttcatttatccccctgtagttgctgttgtggtatcttaattcctaacctg

SEQ ID NO: 2656 - DNA, 603 bp, Curcuma longa
gcggattgaatcccgcaaaccctaaccctaagcttcagatctacctctaagaaagaagaatacgatccatggcctctttcgctgaagctcctccaggtgatgccaaatctggagagaagatcttcaagaccaagtgtgcgcagtgccacaccgtcgagaagggagccggccacaagcaaggaccaaacttgaatggactttttgggagacaatctggtaccactgctggttactcgtactctactgccaacaagaatatggctgtcatttgggaggagtcaactttgtatgattacttgctgaaccctaagaagtacattcctggaactaagatggttttccctggtctgaagaagcctcaggagcgcgccgacctcatcgcctatctcaaatcatccacggcataatttatggtctttttgcctctagatctcagagatactctgctagtaataagcagctgaaacttgaaaaaattttcttgctcttagaaattaattgcctcttggaagattgttcctcgccataccccacatacttatattgtacctgcgaaactgctggttgaatataataaatacaaacttgaatttttatcaaaaa

SEQ ID NO: 2657 - DNA, 779 bp, Vitis vinifera
cccagggacagtctcgtcatttcatctctgccacagccacttccttcccccaagttagaaggagatcgaaaattctgaaacctaactgcgatcgtctctgagaattttagggctgacgtggcattgtgatctgagagatggcgacgttcgctgatgcaccggcgggtaatgctgccgcgggagagaagatcttcaggaccaagtgcgcccagtgccacactgtcgataaaggagctggtcacaagcaaggacctaatttgaatggtctttttgggaggcagtctggcacaactgctgggtactcctattctgctgctaacaagaacatggctgtggcttggggagagaatacattgtatgattacttgcttaacccaaagaagtacattcccggaacaaagatggttttcccgggattgaagaagccacaggatcgcgcagacctcattgcttatctgaaggaatcaactgcttgaaccacccccgcctacctttacacaacacgatcatgtttttctttcttgggcacaccggaagagtctgttcattgaactcaaattttttctcctgaaaaatgggaaacaatatttcttatttttcctgttcaaaataagaccatctaaggtctgcaatgtgctgtctgtttgaaacataagactagtaaatcatttttgtggaagaccgaagatcttttgcatcctggcttggatcgttcgtaggttggttctagcaaatgggtgctttctaataaaataatttaaatttaaaattttaaaaat

SEQ ID NO: 2658 - DNA, 677 bp, Vitis vinifera
ttcatctctgccacagccacttccttcccccaagttagaaggagatcgaaaattctgaaacctaactgcgatcgtctctgagaattttagggctgacgtggcattgtgatctgagaggatggcgacgttcgctgatgcaccggcgggtaatgctgccgcgggagagaagatcttcaggaccaagtgcgcccagtgccacactgtcgataaaggagctggtcacaagcaaggacctaatttgaatggtctttttgggaggcagtctggcacaactgctgggtactcctattctgctgctaacaagaacatggctgtggcttggggagagaatacattgtatgattacttgcttaacccaaagaagtacattcccggaacaaagatggttttcccgggattgaagaagccacaggatcgcgcagacctcattgcttatctgaaggaatcaactgcttgaaccacccccgcctacctttacacaacacgatcatgtttttctttcttgggcacaccggaagagtctgttcattgaactcaaattttttctcctgaaaaatgggaaacaatatttcttatttttcttgttcaaaataagaccatctaaggtctgcaatgtgctgtctgtttgaaacataagactagtaaatcatttttgtggaagaccgaagatcttttgc

SEQ ID NO: 2659 - DNA, 647 bp, Ipomoea batatas
actccctcgccgatctgcgtttttcgcttctcatttctccgataccaaactccgcaaatcctcctttggtttgtactcatggcctcctttgagcaagctccacccggcgatgccagagccggagagaagatcttcaaaatgaagtgcgctcagtgccacaccgttgacaaaggcgccggccacaagcaagggcctaacttgaatggactattcggcagacaatccggtacaactccaggttactcttactctgctgccaacaagaacatggctgtcatctggggagagaacacactatatgactacttgcttaaccccaagaagtatattcctggaaccaagatggttttccctggattgaagaagccacaggaacgtgcagatctcatagcatatctcaaggaatcaactgcctgaaatgcattttgtagttgaatgaggattttttgagtagtgatgattggaaaaatgaccactcgtccagttttctattcttttggtggatgtcaattttcttgccaataatattgtgaaccaaccgtaaaggttttattgctacttctgtactctggttgagataggccagtagtgggtgcacttttatgacattcttttagacttcaatatatcgaagtgcatacttgatc

SEQ ID NO: 2660 - DNA, 696 bp, Ipomoea nil
ctcttcaccaaactccctcgccgctcttcgtttctcgtttctcccgataccaaactccgcaaatcctcttttggttcgtactcatggcctccttcaatgaagctccgcccggcgatgccaaatccggagagaagatcttcaaaatgaagtgcgctcagtgccacaccgttgacaaaggcgccggccacaagcaagggcctaacttgaatggactattcggcagacaatccggtacaactccaggttactcttactctgctgccaacaagaacatggctgtcacctggggagagaacacactatatgactacttgcttaaccccaagaagtatattcctggaaccaagatggttttccctggattgaagaagccacaggaccgtgcagatctcatagcatatctcaaggaatcaactgcctgaaatgcattttgtagttgaatgaggattttttgagtagtgatgattggaaaaatgaccactcgtccagttttcaattcttttggtggatgtcaattttcttgccaataatattgtgaacccaaccgtaaaggttttattgctacttatctatactctggttgagataggccagtagtggctgtacttctatgacattcttttagacttcaatacatcgaagtgcatacttcccttttgtttaggctgattataattcattaataagacgtcaagt

SEQ ID NO: 2661 - DNA, 807 bp, Mimulus guttatus
attcccattcatttcatacgctcctccatcgtgaaaacccttgtgccccaaatccaaaattccacagtgaatcgggtcgatggcctcgttcgatgaagctcctcccggcgatgtcaaatccggcgacaagatcttcaggactaagtgcgctcagtgccacaccgtcgacaaaggcgccggccacaaacaaggtcccaacttgaatggtcttttcggaagacaatctggtactaccccgggttattcgtactcggctgccaacaagagcatggctgtcaactggggagagaatacactttacgactacttgcttaaccctaagaagtatattcctggaaccaagatggtcttccctggattgaagaaacctaaggagcgtgcagatctaattgcgtatctgaaggaggctactgcttgaagatatatttttacgaagagggtaattaaaattttctggtagttggagatatattttgtcattgttaccaacctcgaatttttttttctcaaatggaagtagttaaatgatactgccggtaaataagagcactgtatttctatgctgtgctattttgtctctttgaacaatgccagatgtagagttcttgcctttttgatggctcggattatttcgccccacttattgggcacttatcagttacggtataaacaaaattgtttaccatcgaatgaagcttttatgtagagataaattatcggtgagttctagatgttgcgtacgggttctgttcggtgtgaaaaaattcttgagagagccattgatgtttgtcaaaatatgtcttgtct

SEQ ID NO: 2662 - DNA, 868 bp, Tropaeolum majus
cggccgggggttattccataacgtaacatgaaactcgagttcaacaaagctcgaataaatggcaatcacgaacaggactcgtggccaccgaaagccctctaaccgtttcttctttctaccgaaacatccacgtgaaatataattccatttctcacaatcccattgtttctctctgcaattgcttttgattctccctttgttgatttcagggttgttaaccggacgattgcttctgtaaatttgttaagagtgaaagagtcatggcgtcatttaatgaagcgccaccaggtaattcctcagttggagagaagatcttcaagacaaagtgcgctcagtgccacactgttgagaaaggcgctggtcataagcaaggtcccaacttgaacgggctgttcgggaggcaatctggtaccactgctgggtactcttactctactgcaaacaagagtatggctgtaacctggggagagaacacattatatgactacttgcttaacccgaagaagtacattcctggaacaaagatggtttttcccggtttgaagaagccgcaagatcgagcggacctcattgcctatctgaaggaatcaactgcctaatcttttcttttccagtcaacgggttgactattttgtttattcaagaacttcagtgattggcagcttaattttatttttattttttcgtgaagaaaatagaaaacaaattatggtctttcggaaataagaaaattgataccatcagaatatatatgaccttcatgatgtaagatccccatgaagaacaagaaagtttgatgattttccccccaaaaactctctcatataataaagagaaattcatttgttgtctaaaaaaaaaaaaaaaa

SEQ ID NO: 2663 - DNA, 885 bp, Citrus sinensis
aaaccaacaaatcaaaatcaaaaccctaagtaacttcctcctcaagaataaagaacgcaatcacagctctctctctctctctgcgtcttctttctctctttggatatttcaaaacaccacaataatggcgtcgtttgatgaggcacctcccggcaatgcaaaggccggagagaagatcttcaagaccaagtgcgctcagtgccacaccgtcgagaaaggcgccggtcacaaacaaggtcctaatttgaacggattgtttggaaggcaatcggggactacacctgggtactcatactctgcggctaacaagaacatggctgtgaattgggaggaaaagactttgtatgattacttgctcaaccctaagaagtacattcctggaacaaagatggtattccctggattgaagaagcctcaggatcgtgccgaccttattgcatatttgaaacaatctactgcataagaacttgccgatagtcagtttacctattccattttgcagttgttgaagattgttttgcggtgcggatatagtactgttttttaccaataaattttaaacatttaaggttcagcaatgttctttgtaacttgagcattgctaatttgagaaaaggttgctgtcattggcaaacataatattcaattgaatttcctggttataatcatatttcatgaattttgggtgaatattctattggcaaaagatttttcatttttatttttgggattatctatgataacggttatgactatcagtttacagctagcttttccttaactagtagttctttgtttattttgtcgctgctattcatatttgtctgctgctataaaaatgtcaatcaggttatgtgcaagctatgtaaggtgaatcattgactt

SEQ ID NO: 2664 - DNA, 1269 bp, Citrus sinensis
aattcgattttaaccacaatcaaaatggcgtcgtttgaggaagctccacctggtaatccaaaggccggggagaaaatcttcaagaccaagtgcgctcagtgccacaccgtcgtgaaaggcgctggtcacaaacaaggaccaaatttgaatggacttttcgggagacagtccgggacaactcccgggtactcctattcagctgctaacaagggtatggctgttatttgggaagagaaaacattgtatgattacttgcttaaccccaagaagtatattcctggaacaaagatggtcttccctggattgaagaagcctcaggatcgtgcagacctcattgcctatttgaaggagtcaacagcctgatttttgcttagtgtgggctattttgcaaccatgggaagagtatggtccctgatgattcaataattttttgtttttggaagaaaaaatgttgttcaaatgagaatgttcaaaatgttttactctttttagccatagacaattggataaaatgttcttccaaagaaacttttctttgagaggcatttcgcaaattttgatgatttctaagcgctatgtatcctaattttgccacttaatttgttataatggaattttaagttgcatattcttctttgagtggactttcttggattcaaagatgtcattacatttggatatgaaatttaagtttttttgtgtatctctgttcttttgaaatctatttttagcatggcatgtggaatgtggtgggttgttgatgatgtatgaatcttgctatgtcagccatattgtcttttcctttctcagagtataagtcttaaagattttatgtaggaggactgcgttcagcacccaccaatttgccaaatatggtacctgctatgtttgtgtttacattgtgcttttttccttcccagagatgcaggagtttattcatatttgcagccttgttgatacagatctgtcataacgctggcaacgatgcattcgtccatgaaaggcaacaatcaagactagcttgaaagatcatattcgtgcacaaaccttcaagagccatgcacgtggacaagggtatctttgattttttgcagttagaggttgaagaatggttatagacatgatatgcagaatgagagtattaaaagtacattacttaaatgttgctgtctgtagggatgtttatgccatccaagataaaaataggttaaagtttaggggctattttaacttcaacttttttatattaagttagcaaaattttattgc

SEQ ID NO: 2665 - DNA, 812 bp, Primula obconica
tagttgtcgggccgggctcagaatgggcctctgttccaccaacctctccgttaaaaccgcgacacgtgtcaccgtcatgaaacgtcaagctttgtgtcgaccccatttattcattcattacttttcttgttaaaaaaaaaggaaatactaaaccctagcagcctctctttttttctctctctctctctatatataaatagatagatatagaaatatataagtttggtgtagacagcaatggcgtcgtacgcggaggctccggcgggaaatgagaagactggggagaagattttcaggacaaagtgtgctcagtgccacaccgtcgataaaggcgctggtcacaaacagggacccaacttgaatggccttttcggaaggcagtctggaactactgctgggtactcttactcttctgcaaacaagaacatggctgtgacctggggagagaatactttgtacgattatttactcaaccctaaaaagtacataccaggaactaagatggttttccctggattgaagaagccacaggatcgtgcagatctcatcgcttatctcaaggcatctacagcataatgtgcttgtttctgttcttgctaagtcgtaaccatttttgaatgtcgggagatattatttgttccgagagaatcggaaaacaattactttctttttttactgaattggagtttgaatcggcccatctgttgaaaaattgccttttgtgaaagaagttggtgcatttggcacaagaaaacatgaagtcgcattgacataatgaactactgtaagaatctttgatgacaataaatatc

SEQ ID NO: 2666 - DNA, 905 bp, Prunus persica
ccacgttccctccttgctcgttcgtctagagtattcttgtgccctaaaaataaataaattgagagttgcttcctagaaagctcgctgcggtgcgtctctcgcaaatcataactctgtcgtctgcaaaccctaaatctctccttctcacccttgctctctccagaaatggcgtcgtttgctgaagcaccacccggtgatgcaaaggccggggagaagatcttcaggacgaagtgcgctcagtgccacactgtcgataaaggcgccggtcacaagcagggacccaatctgaatggccttttcgggaggcagtctggtacaactcctggatactcctattctgctgctaacaaaaacatggctgtgaattgggaggaaaagacattgtatgattacttgctgaaccccaagaagtacatccccggtaccaagatggtgttccctggattgaagaagccacaagatcgtgctgacctcattgcatatttgaagcaatctactgcataagcagtttttcattttactagttccaccttttccattttgcagtaattggaggtcccttcaaacaaggcggatagtacttctctattttgttgccaataaattggaccgtctaggtctgcaattcttgtttgcatgtcgagcttgcttttgcctttctaggaagaggttgctgtaattggcaaacgtaaattcaattcaatttagtttctgtgactagatttcatgaatttggtgatataccatttttacaaatgataaatttactgctacgttattgtatgtagcaacttaaaattatgggttttaaacatttttctggtgatttgtgcagtgaaattttatgttttgattgctctggtgatgcttgtaaattgcatcagtgaataaatggtccatttttc

SEQ ID NO: 2667 - DNA, 653 bp, Nicotiana tabacum
  misc_feature (505)..(505): n is a, c, g, or t
  misc_feature (586)..(586): n is a, c, g, or t
  misc_feature (602)..(602): n is a, c, g, or t
  misc_feature (619)..(619): n is a, c, g, or t
gtacgccaccaaaaacctataagctttctccttcttcttgctttctactttcagaaaatcagaaaaagcctcaaattcaaaaaatggcatctttcgcagaggcaccaccaggtaacgaagcagcaggggcaaagatcttcaagaccaagtgtgctcaatgccatactgtggaacaaggtgctggtcataaacaaggacctaatttgaatggactttttggaaggcagtctggaactactgctggttactcctactctgctgccaataagaatatggctgtgatgtgggaagaaaagactttgtatgattatttgctcaaccccaagaagtacatacctggaacaaagatggttttccctggtttgaagaagccacaggagcgtgcagacctcattgcctacctgaaatctgctactgcctaaggaattaccgacagatattttctattttgtagtctgataggcatgttttgctgtgcggaggaagataaaccattgattttttnaagtaataagttgacctcttttggtctgactcatttgtttccagagcactggttcatacgaaattttttgttaccttctgnagaagaggtgaaaaanacttggcaaacaatgcnaattttaatatcattctcttatgattattatgtc

SEQ ID NO: 2668 - DNA, 733 bp, Triticum aestivum
cgttcctccagccgagggatccccaaccctagcccggcgaccgtccgcgcgggatcagcggcggcagcggcgatggcgtcgttctcggaggcgccccccgggaaccccgcggccggcgagaagatcttcaagaccaagtgcgcccagtgccacaccgtcgacaagggcgccggccacaagcaagggcctaacctgaatggtctgtttgggaggaagtctggcacaactactggatactcttactctacggccaacaagagcatggctgtggtttgggaggagaaaacactgtatgactacctgcttaatccgaagaagtacatccctggaactaagatggtgttccctggactgaagaagccccaggagcgtgctgacctcatcgcatacctgaagagtgccacagcttgaaagggccttgctttgctgccattgtcctaaaaagataataaatatagatatcgccacggtgtcactctggtttaacggggtgcatcgccgggacatttaaagactttggtactagcatttcttcttacgatggtttgttttcttcagcaaaatgcactgccataatggccgtttcccaggccttttgtgaacctgttgttgttgttgttgacgatgatcagttgtttgggcggtagatctcaagcatcttgtgcgccgcatactataaacttatttcttcggcatggattattgtttgaagtttgaacacgcacaacaaaaa

SEQ ID NO: 2669 - DNA, 599 bp, Brassica napus
gaacagaaacaaaccctaaagagaagcgagttccgtcttaattttctccccagcgaaaatggcgtcgttcgatgaagcaccaccaggaaactccaaggccggtgagaagatcttcagaaccaagtgcgctcagtgtcacaccgtcgacaaaggcgccggtcacaaacaaggaccgaacctaaacgggctgtttggaaggcagtctggaacaacagccggttactcttactctgcggctaacaagaacaaggctgttgaatgggaagagaagaccttgtacgattacttgctcaaccccaagaagtacattcctggaacgaagatggtcttccctgggctcaagaagccacaagatcgcgctgatctcatcgcctacttgaaggaatctactgcttagtgaaatctatcaaccaatggtggtgtgggaacatcatgaattattattcttttgacaaataaaatctccaaaacttttgaatttttttttcacttttggaaattgtgtcttcttcaaatacgttttggtgagtaccaaatgtactcatgagtacttccattttccgaggctcatttatataaatgcatctatctataagcaa

SEQ ID NO: 2670 - DNA, 705 bp, Brassica rapa
gaacaaaacaaaaacaaaaaatctcaaggccaccgttattcatattgtcgatcagaaatggcgtcgttcgatgaagcacctcccggaaacccaaaggccggagagaagatattcagaaccaagtgtgcgcagtgccacaccgtcgataaaggtgccggtcacaaacaaggaccaaacttgaacggattgtttgggaggcaataaggaacaacgccagggtattcctactctgctgctaacaaaaacatggccgtcatgtgggaggagaagactctctacgattacctattgaaccccaagaagtacatacctgggacgaaaatggtgtttcctggattgaaaaagccacaagatcgtgccgacctcattgcttatttgaaggaaggtactgcatagacagacgctcggttataatggagcctctgttcaccctccatttttttcgcatagataaaaaataagaccaacgtatatggtggtcataaacttgctttgtatatctttaattttttcaatggggaagaagaggcaatcttctccaccacgaaattcaggagattttattccacttgcctagtttttggtttcaaatcagattcttcgacgacgaaagttgtatgtaccattccatgctgaattctcgatgcccaatagacatatttagaaacatataactagggaaactaaaatcgcacttgaacagca

SEQ ID NO: 2671 - DNA, 2001 bp, Brassica napus
agaagaagctgctccaattcaatcttcaccaacgctgcttgaagatgcgcagcctcactctaactctcagatcctcttctctcccattcaccttcacctcctcctccttcagacgcttccatttcctcaagccatgttcttcctccctcaaacaaacgaagaagcagcaacagtctctccgccgctctccgcctccttccaccgcccctcctcccaaaagtctccgatggttcttcaatcccaaatccagcgacgacgacgacgctaagtcccccaaagctgagagcgacgaaggatcgggcggggatgctgctatcaagggtacgattcttgccggagtgttgttgattggtactgttggtggattcgccggcgttggctacgtctacagagaccagatcaatacctttctcactcagttctccactttcatcgaaggttatggtccggctgggtatgcgctgttcattgctgtgtacgctggccttgagatactagccattccggctctcccgttgaccatgtcggctggtcttctcttcggttccctcgttggcaccatcattgtttccatcagtggaactatggctgctagtgttgcttttctgattgctagatactttgctagagagcgtatccttaagttagttgaaggtaacaagaagttcctggccatagataaagccattggtgagaatgggtttagggttgttactctccttcggctaagccctctgcttcctttctctcttggcaattacctctacggcttgacgtctgtcaagtttgtgccttatgtacttggaagttggttaggtatgcttccaggatcttgggcttatgtcagcgctggagcttttggacgagcaatcattcaagaagaatcagctgttggattgccaggaggaaacggccagcttcttacgctcgggttgggtctgttggtaactgcattagctgcaacatatgtaactggcctagcaaaggatgctataaaggatattgatgatgagtagggagatatggatactaagagaagggagcagaacagtgtcggattcagttggatgaggctctaggatttgtaaaaccttagtggagaaccatgtttcagacgctgaatgttaaatatgtgatgacattaatacttctccatcattgtttatagttgatattaatatagttccatttttgttctctacatatgttgaaaggaaaatagttctagatagatgaatgacaatgatctagaacgaatcctaatattgatcttgctccaacatcattgttcatagttaatataatttgaatttttgttatctacacactgcaatatgttagttgataagaaaaagaatgcttctagttctagatagatgcatttatatgagtgagcctcagaaaaggactcaagagtacatttggaactcaaaagacagaaactcacccaaaacgtatttgaagatgagagagcattataaaaaaaaacccaaaaacaaatgtttggagattttatttgtcaaaagaatatctgatatgagagactcaaaagtcatgatcgtgtcccacaccaatgattggttcactaagcagtagattccttcaagtaggcgatgagatcagcacggtcttgaggcttcttgagcccagggaagaccatcttcgttccaggaatgtacttcttggggttgagcaagtaatcgtacaaggtcttctcttcccattccacagctttgttcttgttagcagcagagtaagagtaaccagctgttgttccagactgtcttccaaacagaccgtttaggttcggtccttgtttgtgaccggcgcctttgtcgacggtgtgacactgagcacacttggtcctgaagatcttctctccggccttggagtttcctggtggtgcttcatcaaacgacgccattttcgcctgagatcacgaggaggaggagccaacaaagagaaaacaaacacggaactcgcctctctggagcttctaag

SEQ ID NO: 2672 - DNA, 687 bp, Secale cereale
agcctcctgcgactcggatcgcccagggatccccaaccctacctagtccggcaaccgtccgcgcgggatcggcggcagcggcgatggcgtcgttctcggaggcgccccccgggaacccgcgtccggcgagaagatcttcaagaccaagtgcgcccagtgccacaccgtcgacaagggcgccggccacaagcaagggcctaacctgaatggtctgtttgggaggcagtctggcacaactcctggatattcttactctacggccaacaagctcatggctgtgaattgggaggagaaaacactgtatgactacctgcttaatccaaagaagtacatccctggaactaagatggtgttcctggactgaagaagccccaggagcgtgctgatctcattgcatacctgaagggtgccacagcatgaagggccttgttttactgccatggttctaaaacagttaataaatatagacattgcgacggtgtcactcttgtttgaccgggtgcatcaccgagacatctaaagagtttggtactagcatttctccttacggtgtttttcttttctttcagcaaaatgcactgctgtaatggccgtttctcaggcctgttgtgaacctgttgttgttgttgttgctgacgatgatcagttgtttgggcagtacatctcaagcatactataaacttattt

SEQ ID NO: 2673 - DNA, 1538 bp, Brassica juncea
cctctctatcgagccgctcttgaggttggccggtggggtttctctcgaggttaagtccgtgaggtacactcgcggaagcttcctctgccctggaggtcagccgttccctcaccgtaacttctctgaagaggtttctgtgctcgatgggcattttgccaagatgggtttaagcagtgttgcgtacttgatgggtgatgatgatgaaaccaagaagtggcatgtttactctgcttctgctcctgccaagaactctaacggcgacaacaatgtctacactctcgagatgtgtatgactggtctggataaagacaaggcatctgtgttcttcaagaacgagtcgagctctgctggctccatgacggataactctggtatcaggaagatacttcctcaatcccaaatctgcgactttgagttcgagccctgcggctactcgatgaacagcgtcgaaggtgacgccatctccaccatccatgtgacccctgaagatggattcagctacgctagctttgaggcagtggggtacgatttcacgaccatggacttgagccaactcgtctcaagggtgctaacttgcttcgagccgaagcaattctcagtagcggtgcactctagcgtcgcacagaagagctacgaccactctggtctctctgtggacctggaggattacggatgcagggagacaactgtggagtctctaggagaagagagaggaacagtgatgtatcagaggttcgagaagctgggaatgtactgtggttctccgagatcgactttgaaatgtgagtggagcagcaacagtagctgcactagcgaggacgagaaggaagagggaatctaagctcttttgtttagttttgttgtttcaaataataatgttgcctttgtgtttttttctccttaaaaaccagtaataattgtgtttggtctctgtgtattcagatgatcgaatattatgaaatatctatcaataagaccattttctagttctagatagatgcatttatatgagtgagcctcagaaaaggactcaagagtacatttggaactcaaaaacagaaactcacccaaaacgtatttgaagatgagagagcattataaaaaaaaaaacccaaaaacaaatgtttggagattttatttgtcaaaagaatatctgatatgagagactcaaaagccatgatcgtgtcccacaccaactaagcagtagattccttcaagtaggcgatgagatcagcacggtcttgaggcttcttgagcccagggaagaccatcttcgttccaggaatgtacttcttggggttgagcaagtaatcgtacaaggtcttctcttcccattcaacagctttgttcttgttagcagcagagtaagagtaaccagccgttgttccagactgtcttccaaacagaccgttcaggttcggaccttgtttgtgaccggcacctttgtcgacggtgtggcactgagcacacttggtcctaaagatcttctctccggccttggagtttccaggtggtgcttcatcaaacgacgccatttt

SEQ ID NO: 2674 - DNA, 1739 bp, Tabernaemontana elegans
gtttgctacagttcgcgcagcgcattttagcctccatcggacggtgaacggatcgttaactactccactccttctggtggtagtgtgcgaatttgtatgtggcttgatatataaggcgctgcggggagtgtgatttgagaatataatggccgcaccaccggcaagggctcgagcggactacgattaccttataaaacttctgcttatcggcgatagcggtgtgggtaagagttgccttcttttgcgcttctctgatggttccttcaccactagttttatcacaaccataggaattgatttcaagataagaacaattgagcttgatggcaaaagaatcaaactccaaatctgggatacagctggtcaagaacggtttcgaacaataaccactgcttattatcggggagccatgggtattttgttggtttacgatgttacagatgaatcgtcctttaataatattaggaactggattcgcaatatcgaacagcatgcttctgacaatgtgaataagattctggtaggaaataaagctgacatggatgaaagcaaaagggctgtacctacctccaagggtcaagcgctcgctgatgagtatggtatcaaatttttcgaaactagtgcaaaaacgaatctcaacgtggaggaagttttcttttcaattgggagggacataaagcaaaggctagctgatacggactccaagcctgaggcttcaacgatcaagcttaatcaacctgatgctgccactggaagtgcacaaattacccaaagacctacctgctgcggttcttaagttggatttatgagcgtggttacggttacggggtatatgttgatgagatatagcaaaatcaaatcaaagggtaattgtgctcactgtatctcagtgtgcatgtaatgttattatttatcattcttttaaaacagcatctcaattttccagctattataagaaccacaatggcagtctagaaaagttttaacattactgcatatccatatggatattcagcgtgcataatatgtgggacagttgacacaactgcagcttctgtttttcagggataaataacatataagcaaactgctgttaaccagagaagaccaaaaataccactttattatgaaagaaatggggactcatctttggcgcatgaatcagagcaccactctcaactgcaaaatggaaagaagactgaccagaagttcaagaaatcattttgatgtagctgccttcaaatatgcaataaggtctgcacgctcttgtggcttcttcagtcctgggaaaaccatcttcgttccggggatatacttcttgggattcagcaagtaatcataaagcgtcttttcctcccaaatgacagccatattcttgtttgctgcggaataggaataaccaggagtggttccagattgtctcccaaaaaggccattcaaattgggtccttgtttgtggccagctcctttatcaacagtgtggcactgagcacacttggtcttgaagattttctccccgacctttggatctcccggaggtgcctctgaaaaggatgccatttaacaatttgcaaatattagtattgtccttttccactgttcttattcttcttcttcttctacagaatcgaatgagaaagagaggagttcttgaggttgaaattaggctggtgggtttattgattggttacgcaaacagaagaagcgagatgcatgtgcgaagtttcccttggttccgt

SEQ ID NO: 2675 - DNA, 1714 bp, Brassica juncea
ggatggggatgctgctatcaagggtacgattcttgccggcgttttgttgattggtactgttggtggattcgccggcgttggctacgtctacagagaccagatcaatacctttctcactcagttctccactttcatcgaaggttatggtccggctgggtatgcgctgttcattgctgtgtacgctggccttgagatactagccattccggctctcccgttgaccatgtcggctggtcttctcttcggttccctcgttggcaccatcattgtttccatcagtggaactatggctgctagtgttgcttttctgattgctagatactttgctagagagcgtatccttaagttagttgaaggtaacaagaagttcctggccatagataaagccattggtgagaatgggtttagggttgttactctccttcggctaagccctctgcttcctttctctcttggcaattacctctacggcttgacgtctgtcaagtttgtgccttatgtacttggaagttggttaggtatgcttccaggatcttgggcttatgtcagcgctggagcttttggacgagcaatcattcaagaagaatcagctgttggattgccaggaggaaacggccagcttctaacgctcgggttgggtctgttggtaactgcattagctgcaacgtatgtaactggcctagcaaaggatgctataaaggatattgatgatgagtagggagatatggatactaagagaagcgaacagaacagtgacggattcagttggatgagttgtaggatttgtaaaaccttagtggagaaccatgtttcagacgctgaatgttaaatatgtgatgacattaatacttctccatcattgtttatagttgataatatagttccatttttgttctctacatatgttgaaaggaaaatggttctagatagatgaattaacaatgatctagaacgaatccagatattgatcttgctccaacatcattgttcagagttgatataatttgaatttttgttatctacacactgcaataggttagttgataagaaaaagaatgcttctagttctagatagatgcatttatatgagtgagcctcagaaaaggactcaagagtacatttggaactcaaaagacagaaactcacccaaaacgtatttgaagatgagagagcattataaataaaaaaaaccaaaaacaaatgtttggagattttatttgtcaaaagaatatctgatcttagagacttttcaagtcatgaccatgtccaacaccatagattgattattcactaagcagtagattccttcaagtaggcgatgagatcagcacggtcttgaggcttcttgagcccagggaagaccatcttcgttccaggaatgtacttcttggggttgagcaagtaatcgtacaaggtcttctcttcccattcaacagctttgttcttgttagcagcagagtaagagtaaccagctgttgttccagactgtcttccaaacagaccgtttaggttcggtccttgtttgtgaccggcgcctttgtcgacggtgtgacactgagcacacttggtcctgaagatcttctctccggccttggagtttcctggtggtgcttcatcaaacgacgccattttttcgcctgagaatacgaggaggagccaacaagagaaacacaaagacggaactcgcctctttggagcttgcaagggtttctgt

SEQ ID NO: 2676 - DNA, 769 bp, Secale cereale
gggggtttgtctcgtaatctcgcggcacccgctttaaaacaggcagagccagaacagaccagaacgagcccgatcaccattccccgcccgcctccagcctcctgcgactcggatcgcccagggatccccaaccctacctagtccggcaaccgtccgcgcgggatcggcggcgatggcgtcgttctcggaggcgccccccggaaccccgcgtccggcgagaagatcttcaagaccaagtgcgcccagtgccacaccgtcgacaagggcgccggccacaagcaagggcctaacctgaatggtctgtttgggaggcagtctggcacaactcctggatattcttactctacggccaacaagctcatggctgtgaattgggaggagaaaacactgtatgactacctgcttaatccaaagaagtacatccctggaactaagatggtgttccctggactgaagaagccccaggagcgtgctgatctcatcgcatacctgaagggtgccacggcttgaaagggctttgctttgctgccatggccctaaagtgaataaaaatagacattgccacggtgtcactctggtttgacggggtaaattgccgagacatttaaaagagtttggtactagcatttctccttacgatggtttctttccttcagcaaaatgcactgctgtaatggccgtttctcaggcctgttgtgaacctgttgttgttgctgacgatgatcagttgtttgggcagtagatctcaagcatactataaacttatttc

SEQ ID NO: 2677 - DNA, 727 bp, Momordica charantia
cggccgggggagaaactgcgaaccgaaccctagcccgccctcagatcttgaacacagacctcattccgacgccatggccagctttgacgaagctcctcccggcaatcccaaagccggagagaagatcttcaagaccaaatgcgctcagtgccacaccgtcgacaaaggagctggtcacaaacaaggtcctaatttgaatgggctatttggacgacaatcgggtacaactcctggatactcatattctgctgccaacaagaatatggccgtgatttgggaagaaaagacgttgtatgactacttgcttaaccctaagaagtatattcctggaacgaagatggttttcccggggctgaagaaaccgaatgaacgtgccgaccttattgcgtacctgaaggaatcaactgcgcttagtgagtgatgttctgcttctaccaatctagaaattttttgtctttaaataagaaacatacattgatgaggagtattagatgaaaatttggagatgccatacaaacaaagtaattctgtgttactcagacttgtcttgtgaaaccacaagacttcctttttcttcattgtattcttattcttcacgctgcacttgatatgatgatttgcagagttcatcccattagtaggttgtttgtgtgaacttatctgccacaattttttggccaagccggttatggcgatttattttgataataaaatcatacttgttagg

SEQ ID NO: 2678 - DNA, 766 bp, Musa acuminata
ggacgcgaagcaagaggaaacagtacgaaaccctagcgctcggattcagatcgagagagcggctctttggagggcgatcgatggcgtccttcgcggaagctccgccgggcgatcccaatgccggagagaagatcttcaagaccaagtgcgcccagtgccacaccgtcgataagggcgccggtcacaagcaaggacccaatttgaatggcctttttggaaggcaatccggtacgactccaggatactcctactctactgcaaacaagaacatggctgtggtatgggaggaatcaactttgtacgattacttgcttaaccctaagaagtatattcctggtactaagatggtttttcctggtctgaagaagccaaaagagcgtgcagatctgattgcttatctcaaacaatcaacggcttcctaagggttttgttcttttatcaaactgaaaacatttcttatttttggccagtagaaccacgactttagcttgcttgtgtccagcagttgagccatgtaaattctttagaactttctttgatcaattgccattgttatggttttcttgcctgagttatgtcgcctcgagattaatatggcattaaagacattgtgccaaactcatgtttactgtaatattcttgggtatagtcagtatggtgatgatttgtgatggttctggttcttgtgtgtttcacacatatggtaggttactaacttgttcaaacaattattttcctggtgatggatgtgtgctgcacatgtttt

SEQ ID NO: 2679 - DNA, 864 bp, Phalaenopsis aphrodite
cgaaaagaatctatcttcaatctagattcaggggagaggtcgcgtggaaggaagacgcccttttgaaacgtcgagctatattaatggcgtcgttctcggaagccccgccaggagatccgaaagctggagagaagatcttcaagacaaagtgcgcgcagtgccacacgccggagaaaggtgcaggacacaagcaaggtcctaatttgaatggcttgtttggaaggcaatctggtactactagtggatattcctactccacagcaaacaaaaatatggctgtaatttgggaagagtctactttatatgactatttgcttaatcctaagaagtacatccctggcacaaagatggtgttccctggtctaaagaagccgcaggaacgtgcagatcttattgcttatctcaaggaagctaccaattcttgaactctagaaagaatgagatatatacctcaacatgatttttttttacaatgctaataataagaacacactaaacgctcctgttagcattggagctgtaacttttttgtccatttcccattcagtagcaatttgtgacatgctaagttatattttgatgctactttttttttttttttttgtctaagttgtgacgctgagctgttggagaaaatataacgtctggtcaaccggacgtgcaggcgagggcatcaatcacacaacagcgtgcgtagggttgcatggtgcaatctactctatcgtctgtacgtttgtcgtccggacgtaatattttctcgagttcttggccctattaatgctataacttttttaatttccggttctgtagcaatttgtggcatactaagttatattgattatttggtgagtttttttaaaaaaa

SEQ ID NO: 2680 - DNA, 975 bp, Sesamum indicum
cgaaatggaaaaaggaaaaaggagcccgctagaaaaataatggcacaccaatagagaaacgcaagggggtattaggcagtaggcacaccacgttccatattcctcctttgccatccatttagctgccttcaccgtttgcacaaagccaactattttgttcgccaagaacgctcttctgaagtgaaatggcgtcgtttgcagaagcaccggctggaaacaaggctgcaggagagaaaatattcaagaccaagtgcgctcagtgtcacaccgttgagaaaggggctggccataaacaaggacctaacctgaatggcctctttggaaggcagtctggaactacacctggttattcctactctgctgctaacaagaacatggctgttatttgggaagaaaagactctgtatgattacctgctgaatcccaagaagtacatacctggaacgaagatggttttcccaggactgaagaagccacaagagcgtgctgaccttattgcatacctgaaggagtccacagcaaactgagtgcttggtctatgttctgtccatttctccattttgcaattgagaggcatagtttgcctgagcagggaaaaaacacgtattctttgtaataaattcttgggataactttgtaatttactagagatcccaatattatttcctcttgagagaggtcattcttcttgttactggaaattcaagttgagcttgagtacagtctgttagagcatgaccatttaagaaatattcaagcctgtgtgcttgaacaacctttgaggagcctgaagttttgcctctaaaagatccgaaagtatgaaatcagctgatatttttggtttgtatggttgcttaggttcataattggcgagtttaatactgtgatagggcaagctccgcaggacagattgtgaagagggtctggatggtaaacataggtgattggaatttcctcttgttgcagctagcacgc

SEQ ID NO: 2681 - DNA, 761 bp, Musa acuminata
ggaagcaagaggaaacagtacgaaaccctagcgctcggattcagatcgagagagcagctctttggagggcgatcgatggcgtcgttcgcggaagctccgccgggcgatcccaatgccggagagaagatcttcaagaccaagtgcgcccagtgccacaccgtcgataagggcgccggtcacaagcaaggacccaatttgaatggcctttttggaaggcaatctggtacgactccaggatactcctactctactgcaaacaagaacatggctgtggtatgggaggaatcaactttgtacgattacttgcttaaccctaagaagtatattcctggtacgaagatggtttttcctggtctgaagaagccaaaagagcgtgcagatcttattgcttatctcaaacaatcaacggcttcctaagggttttgttcttttatcaaaatgaaaacatttcttatttttggctagtagaaccacgactttggcttgcttgtgtccagcagttgagccatgtaaattctttagaactttctttgatcaattgccattgttatggttttcttgcctgagttatgtcccctcgagattaatatggcattaaatacattgtgccaaactcatgtttactgtaatcttcttgggtatagtcagtatggtgatgatttgtgatggttctggttcttgtgtgtttcacacatatggtaggttagtaacttgttcaaacaattattttcctggtgatggatgtgtgctgcacatgtttt

SEQ ID NO: 2682 - DNA, 491 bp, Bruguiera gymnorhiza
gataggtttggaaagccccggtaaacagaaggaaaaagagaaagggcgaaaagagagaaagagaaatggcgtcgttcgcagaagcaccgccgggggatacgaagtccggcgagaagatattcaggaccaagtgcgcccagtgccacaccgtcgacaaaggcgccggtcacaagcaaggacccaatctgaatgggctgtttgggaggcagtctgggacaacagctgggtactcctattctgctgctaacaagaacatggctgtgatttgggaagagaagactttgtatgactacttgctcaaccccaagaagtacattcctggaacaaagatggttttccctgggttgaagaagccgcaagagcgtgctgatctcattgcatatttgaagcagtccactgcatcctaaattccatgtcttttatagcttccccatttcaccattgttggaaattatctcaaacatagcagattatgttatttttaccaataa

SEQ ID NO: 2683 - DNA, 695 bp, Liriodendron tulipifera
ggagagttcgacaaaaccctagaaaacaacaacatttttctcatcctgattaacaaaagcagaaaccctaattcgaactagggtttgtgagggaaatggcgtcgttcgaggaggctccaccaggcgatccaaaggcaggagagaagatcttcaagacaaagtgcgctcaatgccatacggtcgataaaggagcaggacacaagcaaggacccaacttgaatggtctttttggacgacagtctggcacaactcccggttactcttattctgctgctaacaagaacatggctgtgatctgggaagagaaaactttatatgattacctgctcaatcccaagaagtatattcccggaacgaagatggttttcccaggtctgaagaagccaaaagagcgtgcagatctcattgcttatctcaaggaaggcacatcctcttaatggttctttgctgttgtttcctatcccctctattttgcggcaactggaggtgtcctgttgaagagtccgaaaagagactagttaattttttaatggaataagaccttagcagaggggtcccatgcaactcttgtttctcatgcattcaaatttggcaagtattgcatatgtttgtgacatatttctgcacttgatcaattcaaactggttatgattttggctcaattataactctcagtgtgaatgtcactgtttaat

SEQ ID NO: 2684 - DNA, 673 bp, Nuphar advena
tctctctctctctctctctctctctctctcttttgctcgatcggtcggtactgtcgggttggagatttagggtttttggctggggatggcgtcgtttggtgaagcacccccgggggatccgaagtcgggagagaagatcttcaggacaaagtgcgctcaatgccacaccgtcgataagggaggcggccacaagcaaggtccaaacttgaatggcctatttggaaggcagtctggtacaacccctggatattcttattctgccgctaacaagaatatggctgttaattggggagaatcatccttgtatgattacttgctcaacccaaagaagtacatccctgggacaaagatggttttccctggtctgaagaagccccaagaacgtgccgatctgatcgcgtacctcaaggaatcaactgcatcctgataaagcttttgttcattcccctgtccttatatgtgacgagcagagatctttggatgctgagagactattttttgcaataagacccctcgggtcatgcgtgctctcccaggtggttgggctgatccatctctgattaaagaacttctaaattgattcacacatttcttctatgcatttcaactcttctgttggtactttacatttcaaataacaacattcttctaaatcgtaagcttaagttacatt

SEQ ID NO: 2685 - DNA, 366 bp, Olea europaea
ccacaaaaagttgtagacgaaaatggcatcatttgcagaggcaccgcctggaaactcaaaggcaggagagaaaattttcaagaccaagtgtgcccagtgtcacactgttgaaaaaggcgccggccacaaacaaggtcccaatttgaatggtctctttggaaggcaatctggaacaacgcctggttattcctactctgctgctaacaaaaacatggctgttatttgggaggaaaagacactgtatgattacttgctgaaccccaagaagtatataccaggaacaaagatggttttcccaggactgaagaaaccacaagatcgtgctgacctcattgcttatctgaaagagtctacatctcaatgaat

SEQ ID NO: 2686 - DNA, 767 bp, Populus trichocarpa
ggtgcgtggctgtcacacaaccttttcctcgtttgctctcgaatattcttttttcttttctatttttcctttagaggaatagttcgccaagcaaaaaccctaagaactctctccctgctttctataaatcagacccaacaaactccccccctccctcgtcctcttctactagcagaaccagaagaaatggcgtcgttcgcagaagcaccacctggcgattctaaagccggagagaagatctttaggactaagtgtgctcagtgtcataccgtcgacaaaggtgccggtcacaagcaaggacccaatctgaatggcctctttggaaggcagtcaggaacaactactgggtactcatactctgctgctaacaagaacatggctgttatgtgggaggagaagactttgtatgattacttgctcaaccccaagaagtacatccctggaacaaagatggttttccctggattgaagaagccacaggagcgcgctgatctcattgcatacttgaagcagtccactgcgtcttaatcatttcacacttttggcctcctcattttccagttattggagattgcttctcacagagcagatgatattttttaccaataaagcagactatcatatacaatgaacattgctagtcattgcttttcagaaagttgccataattggcaagcttaacattcaattcatttagcttatctattttgcaaatgtttggtggattaccaataaacagtttgctaatgataatttttggtttgata

SEQ ID NO: 2687 - DNA, 784 bp, Populus trichocarpa
taaaaaaaaaacaaaaagcagtagcccgcaaaaacaaaaactctcccctttcctttctagtttccataaaacaagcccaaaactctccctctctaacgccttctacaaagcagaaagaaaaaagcaaagagaattcaaagagaagaaatggcttcgtttgcagaagcaccacctggcgattcaaaagtcggagagaaggtctttaagaccaagtgtgctcagtgtcataccgtcgacaagggtgccggtcataagcaaggacccaatctgaatggcttgtttggaaggcagtcaggaacaactgctggatactcttactctactgctaacaagaacatggctgtcacgtgggaggagaagactttgtatgattacttgctcaaccccaagaagtacatccctggaacgaagatggttttccctggattgaagaagccacaggagcgtgctgatctcattgcatacttgaagcagtccactgcatcttaagcatttcacacttccccattttgcagttgttggagataatttttttttttaccaataaagtaaccatcctatacaatgagcattgctagtcaatgctccttcgaagagttgccataattggcaaactaaacattcgattcatttagcttactgtgcctctattttgcgaatatttggtggattaccaataaacagtttgttaatgatagtttttggttttgatattgcatgaacatttccatagttgctattgtttgccttcaatatactctgatgcatagcaggtctacggtaa

SEQ ID NO: 2688 - DNA, 721 bp, Rosa hybrid cultivar
ggcgtctctcacttctcaagtctctaacaaaccctagaaatctctctctctctctctctctctagctttctttctctctctaacaaacgctcatcaatggggccgttcgctgaagctccaccgggagatgccaaggccggagagaagatcttcaagaccaagtgcgctcagtgccacaccgtcgacaaaggcgccggccacaagcagggacccaatttgaatggcctgtttgggaggcagtctggaacaacccctggatactcctattctgctgctaacaagaacatggctgttaattgggaggagaagacattgtatgactatttgcttaatcccaagaagtacattcctggaacaaagatggtcttccctggattgaagaagccaaaggaacgtgctgacctcattgcctatttgaaggaatcaactgcatcttaaactgcctttgttcgacttttcacattttgcagtcaccggaggtttatacaaacggatgagtactattttttgttgccaataaattaggccatctaggtctgcaattctcatttgcatgtggagcttgcttttgcttttctaggaagaggttgctgtaattggcagcgcaacattcacattcagttagctgttgtgactagatttcaaggagttggtgaaataccagttcaactaatgatataaaaattcattgtgacattttctatatattcttgtggtgcaa

SEQ ID NO: 2689 - DNA, 669 bp, Thalictrum flavum
atcgcctctcatacctgcgttggcttgcaattgaaaaaccctagaaagcttgaaacgacgaaggagaaaaattctctctaagaaatctagatctgcaagtgttgtttttcttgaaatcttggaatggcatcttttgatgaagctccacctggaaatcctaaagcaggagagaagatctttaagacgaagtgcgctcagtgccacaccgttgaaaaaggagccggtcataagcaaggacctaacctgaatggcctttttggaaggcagtctggtacaactcctggttactcctattctgctggtaataagaacaaggctgtgatgtgggaagagaagactttgtatgattacttgcttaaccctaagaagtacattcctggaacaaagatggttttccctggattgaagaagccgcaggaacgtgctgacctcattgcctatctgaaggaatccacagcagcttgattttaccctcaaaacttgttatttttgcagcatttggagattttctgtttacagatgcggataggaaactatattttttgaaataagaccccctaatagaggaggtccataatgtcttttcattttaaaattcaatgtagaggagaaacatggactacacaatgtcgttggtgtaatgtgttctaccttttgatactctgtttg

SEQ ID NO: 2690 - DNA, 864 bp, Musa acuminata
gttagtttcgacaactcgttgcccgcgggtcaatataaatagtcgtccgcaagcggagaattcggctttgcttgttggaaattgctcggaagcaacagggggaaatagagagaccctaaccctaggtttagatcgagagatctcgtttggacggcgttcgatggcgtcgttcgcggaagctccgccgggcgatcccaaggccggggagaagatcttcaagaccaagtgcgcgcagtgccacaccgtcgaccagggcgccggccacaagcaaggacctaatttgaatggcctttttggaagacaatctggtacggcatcgggttattcttactctgccgcaaacaagaataaggctgttgtatgggaggagtcaactttgtatgattacttgcttaaccctaagaagtatattcctggtactaagatggtatttcctggtttgaagaagccacaagagcgtgctgatcttattgcctatctcaaacagtcgacggcttgagtgttccgttatcatggctaaaacaatttttgttcaccaataagaccttttgttgccatgcttatgacaagcatttgagctacaaaacattctttgcaaattcttcaatcaattgcccatatgtttaattttgtctgcaatagctgacagctaaattttctttaaatataaactggagattattatgtgacagtaagtacattatgctatatatttcttcatgtggtacaattgggtatgataattgtgatggttctggtttcttatgggacagttatctttgctaaaggagtgcaacttatgacgatttgttccacatgttctttctaatgtttaggtgtcaagactgaatgtcttaatttggg

SEQ ID NO: 2691 - DNA, 579 bp, Cirsium arvense
cccttcggtaaacccaactcgctcttttctaattttgtccctaaactactctctctctctctccaacattttcacaaatctacaatcggcgattcgatctacatagattaatggcgtcgttcgcggaggctcctgccggaaatcccaccgtcggcgagaagatcttcaagactaaatgcgctcaatgccacaccgtcgagaaaggctccggccacaaacaaggacccaatcttaatggactatttggaaggcagtctggaaccactgctggatactcttattctgctgctaacaagaacaaggctgttcaatgggaggaaaatacattatatgactacctgctcaaccccaagaagtacatccctggaacaaagatggttttcccaggactgaaaaagccacaggagcgtgcggatctgattgcgtatctgaaggcatcaacagcttaattccattttgaaagtgttttttactgatgatttgaggtataaggatatttggataagtttggattattatttttccatgaataagggaaggaggacattcattcatcatcaatctttcttttgctccttc

SEQ ID NO: 2692 - DNA, 619 bp, Flaveria ramosissima
gccctaaatttctccatcaatacataaacaccatcgtcattcatccccttccagaaaaaccctaccaacgcacccccttcctctctaacgaaaccctcaatcggcgattcgatctactcacctcaatggcgtctttcgcggaggctcctgccggaaatcccgccgccggcgagaagatcttcaagaccaagtgcgctcagtgtcacaccgtcgagaaaggcgctggccataagcaaggacccaacttgaatggactctttggaaggcaatctggaactactgctggatactcctattctgctggtaacaagaacaaggcagttatatgggaggaaagtaccttatacgactacttgttgaaccctaagaagtacatccctggaacaaagatggttttcccaggactgaaaaaaccacaggagcgtgccgacctcattgcatacttgaaggcatccacagcgtaattttttatatttcaacaccattttgaagttttcttgatgattcaaggtattaggagatgacttcggattatattttggttaataaggggaagacatttatcaaatttctttaccctcttcatttttgttattctattggcaagagcctttttctt

SEQ ID NO: 2693 - DNA, 551 bp, Flaveria ramosissima
ctctaacgaaacaaccttcaatcggcgattcgatcctcacataacacacctcaatggcgtctttcgcggaggctcccgccggaaatcctgccgccggcgagaaaatcttcaagaccaagtgcgctcagtgccacaccgtcgagaaaggcgctggccataagcaaggacccaacttgaatggactgttcggaaggcaatctggaactactgctggatattcctattctgctggtaacaagaacaaggcagttatatgggaggaaaataccttatatgattacttgttgaaccctaagaagtacatccctggaacaaagatggttttcccagggctggaaaaaccacaggagcgtgccgatcttatcgcatacctgaaggcatccacagcgtaattttttttgtttcaacaccattttgaagttttcttgatgattcaaggtattaggagatgacttcggattatattttggttaataagggaagacatatatcaaatttctttaccctctacatttttgttattcaattggcaagagccgttttcttcagac

SEQ ID NO: 2694 - DNA, 474 bp, Flaveria ramosissima
ccactcccatcggaaaatgacgtcattcgaacaggcgccgcccggcgacgctaaagccggagaaaagatctttaaaaccaaatgcgctcaatgtcacaccgtcgacaaaggcgccggccacaaacaagggccgaatttaaacgggctttttggaaggcaatctggtactactgcagggtattcatactctgctgccaataagaacatggctgtgatctgggaagagaatacactctacgactacttgcttaacccgaagaagtacattcctgggacgaagatggtgtttcctggactgaaaaagccacaggatcgggctgatcttatcgcttacttgaagcaatcaaccgcttgagttcaagggcggtaatgactttgtatgcatcatttataaaagcaacaatgtttcgttacatttatatgaccattcattgttttgtaacctgagcgatttgttacgactgacataactct

SEQ ID NO: 2695 - DNA, 834 bp, Papaver somniferum
gagagtaatatccctactccctgtactatctgaaaagaaacaaaccctagaaaagttgagaaggttgttccttcttcttcttcctctcatcctccatacgttttctgtaaaaagaagtttgaaatggctactttccaagaagctccacctggtgatgttaaggctggggaaaagatcttcaagactaagtgcgctcagtgccatacggttgagaaaggatctggtcacaaacaagggcctaacctgaatggtctgttcggaaggcagtctggaacaactgctggttactcttactcagctgctaacaagaacaaggctgtgaactgggaagagaatacactttatgattacttgcttaaccccaaaaagtacattcctggaacaaagatggttttcccagggctgaagaagcctcaggagcgagccgaccttattgcttacctgaagcaatcaactgcctaatccttttactgcccttttgaattcattttggagacacttttgaggtgtgatatgatcggatagcaacaatttttctaaaaaacctttttagtttattgcttgtttcttttcaatcagaatagggagtagggatattgctctcttttgaaaagcaaaaacaccattttggggaacagaaattgtaacaaattttatggaggcatatttcattaacattggatgtgaaaaagcaccgtcattcttgactatatctgttggttcatatatttgatacatctgttgtttgttggaatttttgttttcttttccttagctagtagttctctttgaataaccatatgaagacctgtgctcttggagcacacaactccc

SEQ ID NO: 2696 - DNA, 614 bp, Utricularia gibba
agctgttagaaatttccgaggagaatggcgtccttcggcgaggcaccgccgggagatctcaagtccggcgagaagatcttcaagaccaagtgcgcacagtgccacactgtcgacaaaggcgcgggccataaacaaggtccaaacttgaatggcctttttgggaggcaatctggcaccacgccaggttactcttactctgctgcaaacaagaacatggctgtgatatgggaagagaaggcactctacgactacctgcttaatccaaagaagtacattccaggtactaagatggtgtttcccggactgaagaaacctcaagagcgtgcggatttgatcgcttatctcaagaatgccactgcttgaagcttccatgatcttcccacatcgaataagtacatccattttcaacaggatacggcatttccattgaaatgattcagacttgagtgccagtttcttaatcgttgaatcaattgtgtattgctgttagtttcaataagtccaaggaaacctgtttgtgtgtggattatagatgatcatgaacatgatcacacgttacttccatcatgttctttttgaacgcaaatattttgatgaaaccaaataaaaatcgg

SEQ ID NO: 2697 - DNA, 578 bp, Abies balsamea
caccgcaatcacatcttccatccatggcgacattctcagaggctcctcctggagacgcaaaggctggagagaagatctttaagaccaaatgtgcacagtgccacacagtcgacaagggcgccggacacaaacaagggccaaatctcaatgggttgtttgggagacaatccggcaccactgcgggttattcatattcttctgccaataaaaacaaggctgtgaattggggagaggacactttgtacgagtaccttctcaatcctaaaaagtatatacctggaactaaaatggtattccctggtctgaagaagccacaagagcgtgttgatctcattgcatatcttaagcaagctacatcctaggactaatcgaaataccttgtctaaataaattacttcagtttttcaatctatactcttgtttctaagatttttcatacgggagtgcaggttttgcaatatggacatcaggctgtcctattgttgaggatttaacattttttaaataaaaatgattcagttgtccctagaacgtgggggcttgaatgtagacaattaattgactgagaatattgaagg

SEQ ID NO: 2698 - DNA, 757 bp, Malus domestica
tttggtgcggtgcgcctccgtcaccaaatcaaaatctctcgtctgcaaaccctaaccctgatctctctcctctcctcttccctctctctctctttagatttctcgagaaatggcgtcgtttgccgaagctccacccggagatgccaagaccggagagaaaatcttcaagaccaagtgcgctcagtgccataccgtcgagaaaggcgccggtcacaagcagggacccaatctgaatggacttttcgggaggcagtctggtacgggtgctggatactcatactctgctgctaacaagaacaaggctgtgacatgggaggaaaataccttgtatgattacttgttgaaccccaagaagtacattcccggaaccaagatggtgttccctggattgaagaagccacaggagcgcgctgatctcattgcatatttgaagcagtctactgcataaacattttcatgtcccattttgcagtagttagaggtggtcacttgatacgaggcggacggtactatttttttgccaataaaatttaaaacggacgttcaatgtctgcaattcttgtttgcaatgtcgagcttgcttttgtttttataggaaggggttgctgtaattgctgtaattggcaaacacaacattcaattcaattaagaagctgtgactatatcttgtgaatttggcaaaaaatgccagtttttctgatgataaatttactgctacattcgtaaagtgtgtagcaacaacttataatgatcgcta

SEQ ID NO: 2699 - DNA, 649 bp, Manihot esculenta
agcgacgatctctcattgatattgtgtgcaagctttagaaaaagaaatggcgacattcgagcaagctccaccaggtgatcaaaaggctggagagaagatcttcaagactaagtgtgcccagtgccacaccgtcgaaaaaggcgccggccacaaacaagggcccaatttgaatgggcttttcggaaggcaatctgggactactgcagggtactcctactctgcagctaacaagaacatggctgtgatatgggaagaaaatactttgtatgattacttgcttaatcctaagaagtacattcctggaactaagatggtcttccctggattgaagaagccacaggatcgtacagatctcattgcctatctgaaggaagcaactgcttaatcttcaatcagtatggatattctcctaaacgatttattttttgagaggaagagaaaactgacctctccttgaaataagatggattagggcaaagatgctctttgttttgagattttgagatgagtgggggagttgaaggaccctttttcatgaggcatttcatgagctgtaataatttcttcatagtcattgattgaatctatcctgatgaaaattttttgtaacaaaattttatgacattccaacttcaggttgttgaaatcc

SEQ ID NO: 2700 - DNA, 880 bp, Cephalotaxus harringtonia
gtcagaggcagaggcagagacaaatggtttctcggagcgcaaggctgatttaagagtcccagtctgtaaaagagagtttgtcttctctattctttctctgtcacaaaagtacaggaatatggcatccttcacagaggcgcctcccggtgatgaaaaggccggagagaagattttcaagaccaaatgtgcacagtgtcatactgttgaaaagggcgctggtcacaaacaagggccaaatcttaatgggctgtttgggagacaatctggaaccacggctgggtattcatattccgctgccaataaaaacaaggctgtgacatggggagaggacaccctttatgattatcttcttaatcctaaaaagtacattcctggaactaagatggtgtttcctggtttgaagaagccacaagaccgtgctgatctgattgcgtatctcaagaaggccacatcctagttttgacaaaatcaatttgaaatatgttactggatggcattatttatagttacttatttctaagaattcattcgggagattaggttaatgttggacagcactatgccctattgttgaggttacaagttttttctaataaaggcaattcataagttcccaaaatgggtgctttctgtagtgcagaattcatctgataaggaagaaggtgacacaacttaggccttgcaagtttccataattataaagctgatcaaacccatgatatatcagttataatttcatttgtccatcgttatttttacctcttttggttgtttgtgtttcaaaagatcaagaagcttgggatgtacgccataacttagttgaagatgttgaagtggcggcttcattttgcaggcatttgtgtgaaatgcaagagttttt

SEQ ID NO: 2701 - DNA, 657 bp, Cichorium intybus
cgggggaacctcttgcatcgctctctctccgtctccctttctctccgtctttacgaaatctacaatcggcgattcgatctaaactgattgatggcgtcgttcgcggaggctccagccggaaacgccaccgctggcgagaagatcttcaagactaaatgcgctcaatgtcacaccgtcgagaaaggcgccggccacaaacaaggacccaatcttaatggactatttggaaggcagtctggaacgactgctggatactcttattctgctgctaacaaatccaaggcggttacatgggaggaaaatacattgtatgactacctgctcaaccccaagaagtacatccctggaacaaagatggttttcccaggactgaaaaagcctcaagagcgtgcagatcttattgcatacctcaagtcttcaaccgcttaaatactttctttttgaagttttgttgatgatttgaggttataaggggattaatttggattttatcttttccgtgaataaggggagaggacatgtatcatctttcattgctccctaaattttgagcctgctttattcaattggcaagagattgccttattcatccatcattttatataatgtttgcttaagtacagcttattctgcttattggcttttacatctttacaa

SEQ ID NO: 2702 - DNA, 886 bp, Citrus sinensis
  misc_feature (646)..(646): n is a, c, g, or t
  misc_feature (675)..(675): n is a, c, g, or t
  misc_feature (709)..(709): n is a, c, g, or t
  misc_feature (711)..(711): n is a, c, g, or t
  misc_feature (713)..(714): n is a, c, g, or t
  misc_feature (722)..(722): n is a, c, g, or t
  misc_feature (727)..(727): n is a, c, g, or t
  misc_feature (729)..(730): n is a, c, g, or t
  misc_feature (733)..(733): n is a, c, g, or t
  misc_feature (738)..(738): n is a, c, g, or t
  misc_feature (742)..(742): n is a, c, g, or t
  misc_feature (751)..(751): n is a, c, g, or t
  misc_feature (765)..(766): n is a, c, g, or t
  misc_feature (772)..(773): n is a, c, g, or t
  misc_feature (777)..(781): n is a, c, g, or t
  misc_feature (785)..(791): n is a, c, g, or t
  misc_feature (793)..(797): n is a, c, g, or t
  misc_feature (799)..(799): n is a, c, g, or t
  misc_feature (803)..(804): n is a, c, g, or t
  misc_feature (809)..(809): n is a, c, g, or t
  misc_feature (812)..(816): n is a, c, g, or t
  misc_feature (818)..(819): n is a, c, g, or t
  misc_feature (822)..(825): n is a, c, g, or t
  misc_feature (828)..(828): n is a, c, g, or t
  misc_feature (830)..(832): n is a, c, g, or t
  misc_feature (834)..(843): n is a, c, g, or t
  misc_feature (845)..(848): n is a, c, g, or t
  misc_feature (850)..(861): n is a, c, g, or t
  misc_feature (864)..(865): n is a, c, g, or t
  misc_feature (868)..(868): n is a, c, g, or t
ggggaattcgattttaaccacaatcaaaatggcgtcgtttgaggaagctccacctggtaatccaaaggccggggagaaaatcttcaagaccaagtgcgctcagtgccacaccgtcgtgaaaggcgctggtcacaaacaaggaccaaatttgaatggacttttcgggagacagtccgggacaactcccgggtactcctattcagctgctaacaagggtatggctgttatttgggaagagaaaacgttgtacaattacttgcttaaccccaagaagtatattcctggaacaaagatggtcttccctggattgaagaagcctcaggatcgtgcagacctcattgcctatttgaaggagtcaacagcctgatttttgcttagtgtgggctattttgcaaccatgggaagagtatggtccctgatgattcaataattttttgtttttggaagaaaaaatgttgttcaaatgagaatgttcaaaatgttttactctttgtagccatagacaattagataaaatgttcttccaaagaaacttttctttgagaggcatttcgcaaattttgatgatttctaagcgctatgtatcctaattttgccacttaatttgttataatggaattttaagttgcatattccttctttgagnggactttcttggattcaaagatgtcattnacatttggatatgaaatttaagttttttggggancncnngtcttttngaaancnnttnttacnatgngatggggantggggggggggtgnnaatgannaatnnnnncttnnnnnnntnnnnnanattnnctttntcnnnnncnnaannnntanannntnnnnnnnnnntnnnnannnnnnnnnnnncannccncctatctggctccaaaaa

SEQ ID NO: 2703 - DNA, 748 bp, Taraxacum officinale
gggagacctcgttgctctcgctctctctttctctctcacgtcttttcgcaatctacaatcggtgattcgatctacacaacttgatggcgtcgtttgcggaggctccagccggaaacgccaccgtcggcgagaagatcttcaagactaaatgcgctcaatgccacaccgtcgagaaaggcgccggccacaaacaaggacccaaccttaatggactatttggaaggcaatctggaaccactgctggatactcttattctgctgcaaacaagaacaaggctgtcaattgggaggaaaacactttatatgactaccttctaaaccccaagaagtacatcccaggaacaaagatggttttcccaggactgaaaaagccacaggaccgtgctgatcttattgcatacctcaaggcatcgactgcataatatgtgacttaggtttttcaagttcttgttggtgatttgatttgatttgatatgaggggataaatttggattatcttttccataaataaggggagaggacattcatcatctttcattgctccttaaaattttgagcactcgtttattcaattggcaagagattgccttattcatcatcattctatatactttgctttttgtgttttgacctttactaagagcatttatagtaagtgtgtttaaaaacaatgctgcataatctgattaagttgaacacacattatcgcaaaaattaatttctatataaccaagttttttgtagccca

SEQ ID NO: 2704 - DNA, 621 bp, Zingiber officinale
  misc_feature (46)..(46): n is a, c, g, or t
gcccttgtgctgattgaagaccacaaaacctaattctctgcttcanatctccctacagaaaagaggaatccgatccatggcatcttttacagaagcgcctcccggcgatgccaaggccggagaaaagatcttcaagaccaagtgctcgcagtgccacaccgtcgagaagggcgccggccacaagcaaggaccaaacttgaatggcctttttgggagacaatctggcaccactgctggttactcatactctgcagctaacaagaatatggctgtcatttgggaggagtctacgttatatgattacttgctgaaccctaagaagtacattcctggaaccaagatggttttccccggtctgaagaagccccaggagcgtgccgaccttatcgcttacctcaagtcgtccactgcataatttagttgtctttcctcttcgtgtgctctttttatcttcacgattagagctccgtatcattctgctgactggaacaggcagaaacatcaaaaattttcttaccccttcaaattcattgcttcgtggaggattgttcctcgagacacctacacatttattctgaacctgcaaattggtggtggaatttaataaatataattcaaatt

SEQ ID NO: 2705 - DNA, 688 bp, Zingiber officinale
tttgtttgataaattgccaataatattatttaactaagagatgtttaaattggtcaataaaaacacaactcttaggactgaaaatataaggaaatcctcgtgccgaattcggcacgagggaggaatccaatccatggcctcttttgcagaagcgcctccaggcgatgccaaggccggagagaagatctttaagaccaagtgcgcgcagtgccacaccgtcgagaagggtgccggccacaagcaaggaccaaacttgaatggcctttttgggagacaatctggtaccggtgctggttactcatactctgctgctaacaagaatatggctgtcatttgggaggagtctactttatatgattacttgctgaaccctaagaagtacattcctggaaccaagatggttttccccggtctgaagaagccccaggagcgtgccgacctaatcgcttttctcaagtcgtccactgcttaatatattgtctttcctcttcatgtgtggtttatttcttcactcttagagcttccgtatcattctgctggttggaaaaggcagaaacatcaaaaattttcttatcccctcaaattcattgcttcatggaggattgttccttgagatacttgcatattttttctgaacctgcaaattgatggtggaaatcaataaatataaatccaaatttatcttgac

SEQ ID NO: 2706 - DNA, 521 bp, Guizotia abyssinica
aaccctccgtttcttttcacaccctcaccaaacattcaatctacatagattaatggcgtctttcgcggaggctccagccggaaatgtgaccgccggcgagaagatcttcaagatgaagtgcgctcaatgtcacaccgtcgagaaaggcgctggccacaaacaaggacccaatctaaatggactatttggaagacagtctggaactactgctgggtattcttattctgctgctaacaagaacaaggctgtttcatgggaggaaaacactttatatgactacctgctgaaccctaagaagtacatccctggaacaaagatggttttcccaggattgaaaaagccacaggagcgtgcagatctgatcgcatatctcaaggcatcaaccgcgtaaacctttttatgaagtataagattaataatggctatgggagaacatgattatatctttactccatttttgagcaatgctttattcaattgtcaacacccttcttacatgcaagcattttgttttataccat

SEQ ID NO: 2707 - DNA, 457 bp, Hevea brasiliensis
gctagcgatcatcattctgtgtttgaattttttttttgtgtaccgagagagctcagaagaaacaaatggcgacattcgagcaagctccacccggtgatccaaaggccggagagaagatctttaagactaaatgcgcccagtgccacaccgtcgaaaaaggcgccggccacaaacaaggacccaatttgaatgggcttttcggaaggcaatctgggacaactgctgggtattcctactctgctgctaacaagaacatggctgtgatatgggaagagaaggctttgtacgattacttgctcaatccgaagaagtacattcctggaactaagatggtcttccctggattgaagaagccacaggagcgtgcagatctcattgcctatctgaaggatgcaactgcctgatcttctttattagtatggatatttagcaaatgatttgtgacattagttactgt

SEQ ID NO: 2708 - DNA, 641 bp, Tropaeolum majus
gccccgaaccagatattagcgccttcatctctaccctccatcaatccttctcttgtgtttcctgtcaccggattttttatttcagttctgaactaatggcaacatttgcggaagcaccagcagggaattcgaaagctggagagaagatcttcaagacaaagtgtgctcagtgccacacagccgagaaaggcgccggacataagcaaggtcctaacttgaatgggctgttcggtaggcagtctggtaccactccaggatattcttactctgctgctaacaagaatatggctgtgacctgggaagaaaacacattgtatgactacttgcttaacccaaagaagtacattcccgggacaaagatggtttttcctggtttgaagaagccacaggatcgcgctgatctcattgcgtatctaaaggacgcaactgcatgatctcctttgttttggtacagtcccaagtgatatgacgtgtccgatagttgagacatggtagcgtagaataattgttgaaggtgacattgatttacgctcgtaacaaggtttgtggcgttggaatggtggtgccaaagtgtagtcgaacttgaaagttttagtgtaagattgaattttgatattatataaagctatgatatataccga

SEQ ID NO: 2709 - DNA, 728 bp, Tropaeolum majus
aaccagatattagcgccttcatctctaccctccatcaatccttctcttgtgtttcctgtcaccggattttttatttcagttctgaactaatggcaacatttgcggaagcaccagcagggaattcgaaagctggagagaagatcttcaagacaaagtgtgctcagtgccacacagccgagaaaggcgccggacataagcaaggtcctaacttgaatgggctgttcggtaggcagtctggtaccactccaggatattcttactctgctgctaacaagaatatggctgtgacctgggaagaaaacacattgtatgactacttgcttaacccaaagaagtacattcccgggacaaagatggtttttcctggtttgaagaagccacaggatcgcgctgatctcattgcgtatctaaaggacgcaactgcatgatctcctttgttttggtacagtcccaagtgatatgacgtgtccgatagttgagacatggtagcgtagaataattgttgaaggtgacattgatttacgctcgtaacaaggtttgtggcgttggaatggtggtgccaaagtgtagtcgaacttgaaagttttagtgtaagattgaattttgatattatataaagctatgatatataccaatggtgggtgatgagttcttatttgctttatggaatgaagggttgtgtatttaaatgtaggtcggaatagggtagggatacaaccctttttttt

SEQ ID NO: 2710 - DNA, 428 bp, Olea europaea
gttggcaaatcaaaaaccctagaaagtttgccatttcgaccttttgttcttgaatttcatatttgttagggcgattaatggcgtcgttcaatgaaccacctcctggcaatgtcaaacccggagagaatatcttcaagaccaagtgcgctcagtgccacaccgttgagaaaggcgccggccacaaacaaggtcctaacttgagtggtctttttggaaggcaatctggcactacccctggttattcgtactctgctgccaacaagaacatggctgtaacctgggaagagaatactctttatgattatttgcttaatcctaagaagtacattcctggaactaagatggttttccctggactgaagaagcctcaagagcgtgcagatctaatagcctatctcaaggaggcaactgcttgaagcttctagctt

SEQ ID NO: 2711 - DNA, 652 bp, Orobanche aegyptiaca
tcagaatttctctccttttgttttgttctccttctcttcattcaccccttcgtctcccgcacagatctttatcagtctagttttagtttttgtttcgtctgtagggcgttcattcttcaatggcgtcatacacagaggctccggctggcagtgctcaagccggtgagaagatcttcaggacaaaatgtgcgcagtgtcacaccgtcgataagggtgccggccacaagcaaggcccaaatttgaatggcctttttggaagacaatccggtactacagctggttattcttactcagctgccaacaagaacaaggctgtggattggggagaggatacactttatgattacttgctaaatcctaagaagtacatacctggaacgaagatggtcttccccggattgaagaaacctcaggagcgtgccgatctaattgcgtatctcaaagaagctactgcttgaagaaaatattgccattttgttgacagaaatcacatttctgacatttggagaaatatttaggcgttggttctatttggtttttttttttttaagttgaagcagtttatgatgcttcaaatgaataagaatttatcatacttctataattctggttatgtctctttgatctgtgccagcattagttaattttttgg

SEQ ID NO: 2712 - DNA, 1073 bp, Lippia dulcis
gctaattccataataagtatatccaaagtagaatttcaccttatcttcgtagcagcaatctttcttcctcgttgagaaacaaaggagagggacaaagatagaaatacattttttgaataggttctttgaaatgcaaaaataaaaatacgaccaaaaattgacattttaaaaaaaatgtaaaccataaataaagacagaaaagtatgaatttgctatttagtgttttcgagcttaaatgacttgtttttctaataaaatactatatgagtctatgattagtagtaaatgtgtagtacaaataacacaataaactcgtaagttacaaagaagaaaaggaaacagacacaattccacgccgcccaaacaattcatacatatagataccttcgccttgtcgatcttcacaaaataaccctagaaatttctcttccagaattattcgatttttggtgctttccggaaaaatcttaatcgggatggcgtcgtttgaggaagcaccgccaggaaacaaggccgtcggagagaagattttcaagaccaagtgcgcccagtgccacaccgtcgataaaggagctggccacaaacaaggacctaacctgaacggtctcttcggaaggcagtctggaactacagcgggttactcatactctgctgctagcaagaacatggctgtcatttgggaagagaagactctgtatgattacttgttgaatcccaagaagtatatccccggcacgaagatggttttcccaggattgaagaagcctcaggatcgtgcagatctcattgcatacctgaaggagtccacagcttaatcgtgcagcacttatcacacttttgtcattttgcagttgagaggcacaatttacttttattgagtagcaaaaaagcacaataatctcaaataaataattctttggattactttttgatattcacctccatgtccctacttcggaccctcttgtaagatctaccactttttatcagatggaaatgaatctgagtacattatgttttatgcaaagctagtgttattaaaggttcaaagcaatgactgcttgaccattctt

SEQ ID NO: 2713 - DNA, 1376 bp, Lippia dulcis
gctaattccataataagtatatccaaagtagaatttcaccttatcttcgtagcagcaatctttcttcctcgttgagaaacaaaggagagggacaaagatagaaatacattttttgaataggttctttgaaatgcaaaaataaaaatacgaccaaaaattgacattttaaaaaaaatgtaaaccataaataaagacagaaaagtatgaatttgctatttagtgttttcgagcttaaatgacttgtttttctaataaaatactatatgagtctatgattagtagtaaatgtgtagtacaaataacacaataaactcgtaagttacaaagaagaaaaggaaacagacacaattccacgccgcccaaacaattcatacatatagataccttcgccttgtcgatcttcacaaaataaccctagaaatttctcttccagaattattcgatttttggtgctttccggaaaaatcttaatcgggatggcgtcgtttgaggaagcaccgccaggaaacaaggccgtcggagagaagattttcaagaccaagtgcgcccagtgccacaccgtcgataaaggagctggccacaaacaaggacctaacctgaacggtctcttcggaaggcagtctggaactacagcgggttactcatactctgctgctagcaagaacatggctgtcatttgggaagagaagactctgtatgattacttgttgaatcccaagaagtatatccccggcacgaagatggttttcccaggattgaagaagcctcaggatcgtgcagatctcattgcatacctgaaggagtccacagcttaatcgtgcagcacttatcacacttttgtcattttgcagttgagaggcacaatttacttttattgagtagcaaaaaagcacaataatctcaaataaataattctttggattactttttgatattcacctccatgtccctacttcggaccctcttgtaagatctaccactttttatcagatggaaatgaatctgagtacattatgttttatgcaaagctagtgttattaaaggttcaaagcaatgactgcttgaccattcttttcattagtagcctttattttggtctgtaaaagatcaacagtacattctctcttatgatttgaaatcatatatccaatttggaagtctgtattgtggtttcatgaatgtcttttctactgtaatagatcctcatagctgttttttgcaaatctgaacacttgatattgctgtctttcatcacttcaatgctcgacctttggttgtgatggaagggcaagttctggaatcacgacacaatgagtgtgatataaaagttgaggatcagattggacaaattcctgtgtggatctcctgtatggcat

SEQ ID NO: 2714 - DNA, 613 bp, Silene vulgaris
gaaaaactctgtaaacaacatccatcaatggcgtcattcggtgaagctccagctggtaaccctaaggccggtgaaaagatcttcagaactaaatgcgctcaatgtcacaccgttgaccaaggcgctggccataaacaaggtccaaacctaaatggtctcttcggaaggcagtcaggtactgctggtggttactcttactctgctgctaacaagaataaggctgtcaactgggcagaagatacactttacgattacttgctgaacccaaagaagtatattcctggtacaaagatggtcttcccgggtttgaagaagcctcaagagcgtgctgatctcattgcatacctgaaggaatccactgcctaagaattgcatttctgatccgtagtttatgtaggagaagacagaggacttcagttcctgatattgatttttgaggtatcattgataagtcacttctaatgttttgttgtcaaataagtccagactttttaaggggagttcgattttcatcctcttaaacactcattcttatgaccaggctactagggcttggttaactagctacaagttttatttttgcacaattagcatgctgtttttgcttcccttc

SEQ ID NO: 2715 - DNA, 688 bp, Helianthus annuus
gcttttcatcccattccgaaaaccctaaccctctctctctctctaacctctctacgcaaccttcaatcggcgattcaatctacacaccgtaatggcgtctttcgcggaggctcctgccggaaatccaaccaccggtgagaagatcttcaagacaaagtgcgctcaatgtcacaccgtcgagaaaggcgctggtcacaaacaaggacccaacctaaatggactgtttggaaggcagtctggaaccactgctggatattcttactctgctggtaacaagaacaaggcagttatctgggaggaaaacactttgtacgactacttgttgaacccgaagaagtacatccctggaacaaagatggttttcccaggactgaaaaagccacaggagcgtgcagatctcattgcatacttgaagacatccacagcgtaattttttcaattacgtattataacaccattttgaagttctcttggtgattcgtggtattaggagataactttggattatattttgataaataaggggaggacattcatcaaattttattactctcatcattttttgttattcaaatggcaagagcctttttgttcttcagacagaaattactatgcgtttgaagtgatttgttttacaccccatttatatgtttgttaattatgcttgatggctttctctgttacaccc

SEQ ID NO: 2716 - DNA, 641 bp, Helianthus annuus
gcttttcatcccattccgaaaaccctaaccctctctctctctctaacctctctacgcaaccttcaatcggcgattcaatctacacaccgtaatggcgtctttcgcggaggctcctgccggaaatccaaccaccggtgagaagatcttcaagacaaagtgcgctcaatgtcacaccgtcgagaaaggcgctggtcacaaacaaggacccaacctaaatggactgtttggaaggcagtctggaaccactgctggatattcttactctgctggtaacaagaacaaggcagttatctgggaggaaaacactttgtacgactacttgttgaacccgaagaagtacatccctggaacaaagatggttttcccaggactgaaaaagccacaggagcgtgcagatctcattgcatacttgaagacatccacagcgtaattttttcaattacgtattataacaccattttgaagttctcttggtgattcgtggtattaggagataactttggattatattttgataaataaggggaggacattcatcaaattttattactctcatcattttttgttattcaaatggcaagagcctttttgttcttcagacagaaattactatgcgtttgaagtgatttgttttacacccc

SEQ ID NO: 2717 - DNA, 693 bp, Tragopogon dubius
gtaagaaaggagatctgatcgtcttctctgtaaaagtcaaaccctaagtcttgaagaatcatagtcggcgtttaggtaaccaaaaaatggcgtcattcgaacaagcaccgggaggcgatgctaaagtcggagagaagatattcaaaaccaagtgtgctcagtgccacaccgtcgaaaaaggggccggccataagcaagggccaaatttgaatggtctttttggaaggcaatctggcacgacagcagggtactcttattctgctgctaataagaacatggctgtgaattggggagagaatacactctatgactacttgctaaaccctaagaagtatatccctggaacaaagatggttttccctggattgaagaaaccgcaagatcgggctgatcttattgcttatttgaagcagtcaaccgcttgatttcattggttttattttcaaagggctggcttcatttacatgaaaagtgagtttttttgttgcaaataactttgtcatgttgtacatggctataatcatggacctgcgtatgcctaggtttatggtgttctttatatgagtagaacaaataattttggaaacaaatttctgtcataaaaccttcttatttttttttttgtttttctaagtggtggtattgatttaaaaaagatcaagatgatgaaataaacatacagtattcatttat

SEQ ID NO: 2718 - DNA, 967 bp, Sarracenia psittacina
cctagaaatcacccgaatctagacgaaaggctccgtttctcttcgcgacagcaacgatggcgtctttcgatcaagctccggccggcgacgcaaaaacgggggagaagatcttcaggaccaagtgcgctcagtgccacaccgtcgataaaggcgctggccacaaacaaggaccaaatctgaatggccttttcggaaggcagtctggcaccactgctggatactcatactctgctgctaacaagaacatggctgttacctggggagagaatacgctatatgactacttgcttaacccaaagaagtatatcccggggacgaagatggttttccgggactgaagaaaccccaggagcgtgccgacctcatagcatatctgaaggaggcgacttcctaattcttttgccttcctatgagctttatatattttgcgagcagccggaagaagaattgaattttgtcaccggtggttagtttggaattctttgtccctgtactggagctattattactttgcaactaaattgtttgaataagaccattaaggtctctctgctatgctatatatctcttgaaagctgatcagatactgaggatttttgtcatttttcatgaaactcttgatgatagctagctagctagttagctacctctcatacctgatttgttcatcattatcaagtcttaaaaaagacattatttttttttcacggcctgaataatgatgataacgataaaaaataaataaacaaaaaatataatcgaatatcaaaaagaatgacaacgggttaaataaatgacaacaaaagaacaacaacaacaacgaaacgagaatgctgcccaccaaaagaaaagaaactatataaatgataatgcaaaaaaaagaaaagaagctgagatgaatgaagagagagcggaaaaaaaatcatacaaaataaaacttgtgtacaaaataaacgaaaagagaata

SEQ ID NO: 2719 - DNA, 596 bp, Setaria italica
ccccttcgtgctcggcggcgatggcgtctttctcagaggcgcccccggggaaccccgcggccggcgagaagatcttcaagaccaagtgcgcgcagtgccacaccgtcgacaagggcgccggccacaagcaagggcctaacttgaatggtctgtttgggtacaactcctggttactcttactcctcggctaacaagaacatggctgtgatttgggaggagaacactttgtatgactacctgcttaatcctaagaagtacattcctggaaccaagatggtgttccctggactgaaaaagccacaggaacgtgctgatctcattgcgtacctgaagaatgccaccgcttgacgagaggggactgatgtggccctaagatgaagtgcggcgattctttttgcagttaaaataatgatacaaatttactttaacttgacaggttgcgtgaatgagaaagttaaggactacaagtagttctaatggttttatttgttgggaaaaaaatcggaagagctttttattcagtggttgaaatgtcagaccaccataattcttttgacctgataatcattcaaacgccccatttgggaaggttaaag

SEQ ID NO: 2720 - DNA, 672 bp, Triphysaria pusilla
cctacaacaaaaacagtaattgtgaatcacaagcttgatcggactgaaacaagatggcttcatttgcggaggcgccaccgggaaacaaagctgccggagagaaaatattcaagactaagtgcgctcagtgtcacaccgttgagaaaggagctggccacaaacaaggcccgaatctgaacggcttattcggaaggcaatcgggaactacacctggttactcgtactctgctgcaaacaagaacatggctgttacttgggaagaaaagactctttatgaatacctatcaaccccaagaagtatataccggggacgaagatggtttttccgggactgaagaagccgcaagagcgtgctgaccttattgcgtacctcaaggagtctacggcaaactaagtgttcgtttattcgttttaaatacacgagaaggggaaatgagaaaggaaactagttgttttttaataaattcttgggatgactatatagatttttggagctttctgttttgtttttcattctctatcaggagtgtaggttatttttgttgtcaaatggaaataaatttaagttgattctttagtagttaattacttgttataatcattttatagcagtagctattgaagtttttaagttgtgtttgtattggaactcgaattttcggatttttgaat

SEQ ID NO: 2721 - DNA, 1602 bp, Medicago truncatula
ttttttccttacactctacttgcttttctctcaaatggagttgttcgaaccgacacttcccagaaaccgcgctgctggcgagaagatcttcaggagtgactgtgctcaatgccacagcaacataggagccgttcacaaacaaggacccaatctgaatggtttgtttggaagtcaatctggtacaactcctgaatattcatattgtgttgctaacaagaacatgtctatgaattgggaggaaaagatcatggatgattacttgcttaaccccaataagtatatcctcgatacgaagatggtatttcctgctcttaagaagccccaggaacgtgttgatcttattgatgcaattgaagtcaaatggtcaagttggggtgcacggagcgaaagggactggttcaaacgaacacaacgtctctctacacgttcccgcaataaactctttggcagttacactttccacgatttcgtaaccgccagagccaggtgtgccattacaacggctctgcagcactccacctctataaataggggactcacagcagtccccaaggtagaatctatctcttcctctaaaccctcactcttttatctctacttacttgagcgtcggagtgcctgtaggtacacacccccatccgctccaagaagcattttggctccacatagcgtagcgcatattctcatttcattcactttcctatacaattctttcgcaacacgctgctcgtttgcagaactttctcaaatggcgtccttcgatgaagctcctcccggaaaccccgccgccggcgagaagatcttcagaaccaagtgcgctcagtgccacaccgtcgacaaaggcgccggccacaaacaaggacccaatctgaacggtttgtttggaaggcaatctgggacaactcctggatattcctattctgcggccaacaagaacaaggctgtggattgggaggaaaagaccttgtatgattacttgctgaaccccaagaagtacatcccagggacaaagatggtttttcctggtcttaagaagcctcaagaacgtgctgatcttattgcatatctgaaagatgccacttcaaaagaatagaatttacatacattcttatgcagtatgcttttcaaacctggagttataattttcgtacatttgattatgtggtgcaatagccacttttcttggcaaataaagcaaacttgattagtttgcagtgctattttgttccttttgcattgcattgcttcttgagggtgcgtatattggctagactaatatttgaacacattggttgttgaaagttgaaacattcttatcaaattttacttacatcgaagcatattttagtctttatttgttttgttagttgattcaccagtcttgtgattttgtttacttcaattttgcttaaacgaatgcaatagatgctagttctttcctcctaatttctcaaattggagttctttgtatgtggattgagaggaggataggttgaatttgcttgtgctcaaacagtttgtctttctgttgtcatgttatgtaggagtaggattgaaatgaaatagaatttatgtttgtttaaactgacaatctggattgag

SEQ ID NO: 2722 - DNA, 951 bp, Cicer arietinum
aaaataaatgtgatttcggtggctggcgaaaggcggtgctggtttccattaacttttgggggtcctcctcagtcacactcacagacaccataccatctttcaataattagttacacgctttcttctccatctttctctaatggcgtccttcgacgaagcacctcccggtaaccccgaagccggtgagaagatcttcaggactaagtgcgctcagtgccacaccgtcgacaaaggcgccggccacaaacaaggacccaatttgaatggtttgtttggaaggcaatctgggacaactcctggatattcctattctgcggctaacaagaacatggctgtgaattgggaggaaaagaccttgtatgattacttgcttaaccccaagaagtacatcccagggacaaagatggtatttcctggtcttaagaagcccaaggaacgtgctgatcttattgcatatctgaaaaatgccacttcaaaagaataaatttttcattcattcttatgcagtatgcttttaaattctggaattttaattttcagacattggattttgtggtgcaataaccactgtttcttggcaaataaagcagacttgattagtatgcaatgctattttgtactgtttgcattgccttgctccttgaaggttgcgtatattggctgaactactatgtaaacacattagcttttgaaaatttaaacattcttatcaaagttacttaagtagaagcataaaagttgcgtatatttgttacataagtagattcaccagtattgtaattttactttgtgtgcttgaacgaatgcaaagcaatgcaatacaatacaatacaatttctttcctcctaataaagatccaaatttgtggaatgagagggtaggttgaatttgaggcgaagtatgttatgttgagattcagtcttttgtatgtcttttgattataatgttgtg

SEQ ID NO: 2723 - DNA, 1002 bp, Picea glauca
gggttagacaaacataggaggcagagatcaatatatacaatacaagcacggcggtgtgttttcccatcaacatttacgcgtttgtgaagcgattccccttcattcatcgcaatcacagtttccatccatggcgtcattctcagaggctcctcctggagacgcgaaggccggagaaaagatcttcaagaccaaatgtgcacagtgccacacagtcgataagggcgctggacacaaacaagggccaaatctcaatgggctctttgggagacaatccggcaccactgcgggttattcatattctgctgccaacaaaaacaaggccgtaaattggggtgaggacactttgtacgagtaccttctaaatcctaaaaagtatatacctggaactaaaatggtattccctggtttgaagaagccacaagagcgtgttgatctcattgcatatcttaagaaagctacatcctcggattaatcagaataccatgtttaaataatctgcttcagtttttcagtctaaactattgtttctaagatttttcatacgggagggcaggttttgcaatctggacatcaggctgccccattgttgaggttttaacattttttaaataaaaatgattcagttgtccctagaatgtgggggcttagatgtagacaattagttgacacagaacattgaaggggaaattaccaggtataacgttttgatatccgggaagtttatttgtgcacatgccaatgccagttcaatttcatttcataataacggttgttactttattatgttctgctgttgacttaaaaactataacttggttattttcattaggtaactttgaagttttagatgctattttgcatagatagaacatctttagtcaattctagatgttcttgactctttagtctccccttaacttcttttgaggtaaattagaatggatgtattttctggcgtattttgttggatatatcccacgtcttgtttggtgatactgtaac

SEQ ID NO: 2724 - DNA, 833 bp, Pinus taeda
taatatttacgcgtttgtgaagcgctccgcccttctttcatcacaatcacaggttccatcaatggcgacattctcagaggctcctcctggagacgcaaaggccggagagaagatcttcaagaccaaatgtgcacagtgccatacagtcgataagggcgctggacacaaacaagggccaaatctcaatgggctatttgggaggcaatctggcaccactgcgggttattcatactctgctgccaataagaacaaggctgtggattggggagaggacactttgtacgactacctcctcaatcctaaaaagtatatacctggaactaaaatggtattccctggtttgaagaagccacaagaacgcgctgatctcattgcatatcttaagcaagcaacatcctcgggctaatcggaataccatgtttaaataaattgcttcagtttttcagtctaaagtattgtttctaagatttttcatacgggagggcaggttttgcaatgtggacatcaggctgtcctattgttgaggtcttaacattttttaaataaaaatgattctgttgtccctagaatgtgggggcttaattgtagacaattaattgatacagaacatggaaggggaaattaccaggtattacgttttgatatccgggaagtttatttgtgcacatgccaatggcagttcaatttcatttcataataacatttgtcactttcctatgttatctttaaaaactagtttattttcaacagaacattgaagttttagattcattgtgcataagctttggtgaagatagagcatacatttgattctagaattcgtgtctttagtg

SEQ ID NO: 2725 - DNA, 1326 bp, Picea glauca
ggccttctagaatttgtatttgacgaggactctatacaccattaccggtcattggggttagacaaacataggaggcagagatcaatatatacaatacaagcacggcggtgtgttttcccatcaatatttacgcgtttgtgaagcgattccccttcattcatcgcaatcacagtttccatccatggcgtcattctcagaggctcctcctggagacgcgaaggccggagaaaagatcttcaagaccaaatgtgcacagtgccacacagtcgataagggcgctggacacaaacaagggccaaatctcaatgggctctttgggagacaatccggcaccactgcgggttattcatattctgctgccaacaaaaacaaggccgtaaattggggtgaggacactttgtacgagtaccttctaaatcctaaaaagtatatacctggaactaaaatggtattccctggtttgaagaagccacaagagcgtgttgatctcattgcatatcttaagaaagctacatcctcggattaatcagaataccatgtttaaataatctgcttcagtttttcagtctaaactattgtttctaagatttttcatacgggagggcaggttttgcaatctggacatcaggctgccctattgttgaggttttaacattttttaaataaaaatgattcagttgtccctagaatgtgggggcttagatgtagacaattagttgacacagaacattgaaggggaaattaccaggtataacgttttgatatccgggaagtttatttgtgcacatgccaatgccagttcaatttcatttcataataacggttgttactttattatgttctgctgttgtttaaaaactataacttggttattttcattaggaactttgaagttttagatgcattttgcatagatagaacacactttagtgaattctagaatgtgtcttgactctttagtgcccttaacctcttttgaggaattagaatggatgattttctggcgatttgtttggataatattgcccatggtatattttggttgcatgacatttacttgttcagtccgaagtgcactgtgggtatgtatggctaaataacattcatgccagtatatgcaccaatgtagagatggtagaaagtagtaattatagattttataccacttgtggcatgtagatgtatcattcaccttagctacatagatagcaaggtaagaaagggtggagctaattcctactgtttcgtgtatttctctgtgtagaagatgtgaaggttccttggtgcaatagaaatgtatgtgctagaggttgtattggtcagtca

SEQ ID NO: 2726 - DNA, 999 bp, Picea glauca
attggggttagacaacataggaggcagagatcaatatatacaatacaagcacggcggtgtgttttcccatcaatatttacgcgtttgtgaagcgattccccttcattcatcgcaatcacagtttccatccatggcgtcattctcagaggctcctcctggagacgcgaaggccggagaaaagatcttcaagaccaaatgtgcacagtgccacacagtcgataagggcgctggacacaaacaagggccaaatctcaatgggctctttgggagacaatccggcaccactgcgggttattcatattctgctgccaacaaaaacaaggccgtaaattggggtgaggacactttgtacgagtaccttctaaatcctaaaaagtatatacctggaactaaaatggtattccctggtttgaagaagccacaagagcgtgttgatctcattgcatatcttaagaaagctacatcctcggattaatcagaataccatgtttaaataatctgcttcagtttttcagtctaaactattgtttctaagatttttcatacgggagggcaggttttgcaatctggacatcaggctgccctattgttgaggttttaacattttttaaataaaaatgattcagttgtccctagaatgtgggggcttagatgtagacaattagttgacacagaacattgaaggggaaattaccaggtataacgttttgatatccgggaagtttatttgtgcacatgccaatgccagttcaatttcatttcataataacggttgttactttattatgttctgctgttgtttaaaaactataacttggttattttcattaggaactttgaagttttagatgcattttgcatagatagaacacactttagtgaattctagaatgtgtcttgactctttagtgcccttaacctcttttgaggaattagaatggatgattttctggcgatttgtttggataatattgcccatggtatatttaggttgcatga

SEQ ID NO: 2727 - DNA, 902 bp, Gossypium raimondii
ggcgtaatagcaaatctaatacgtgaggcataagcaaaccacgcttctcgattccctcaatatctggaatattcactgaagcctctcaaagttccgctttgcttcttattctcttttgtcttctccctcacatcttctttcgtttaaataaaaagaaaaacacaagctagcaaacatggcgtcgttcgagcaagctccgcctggtaatgcaaaagcgggggagaagattttcaagaccaagtgttcccagtgccacaccgttgacaagggtgccggtcacaagcaaggacccaaccttaatggtctgtttgggaggcagtcgggtacaactccagggtactcatattccgctgctaacaagaacatggctgtgatttgggaggaaaaaactttgtatgattatctgctcaaccctaagaagtacattcctggaacgaaaatggtattccctggattgaagaaaccacaagatcgagcagacctcattgcatatttgaaggagtctacggcatcctaaatgggctgggaacagtaataatttcagttttacgtattccattccattttgcagtcattggagattgtttctctgtttcaaagcaacaggatataataaaagaataaaattagaccttgttggtgtaggtcagccatgcttgttaatttgcacaatgagcattcatatccggtaactattctttctttgactagaggttgccgttgccggctattgtaaggcttattcaattagatagtgctgtatttgatgaatttctggtgtattacaagcacgagaaggataattgtttgttcagactgttattgcaggcttttaattttgtgtttggttggctggaatgttggaataaaaacagggatgtggcaggctggtatgtgttgta

SEQ ID NO: 2728 - DNA, 654 bp, Gossypium raimondii
gggcgtaatagcaaatctaatacgtgaggcataagcaaaccacgcttctcgattccctcaatatctggaatattcactgaagcctctcaaagttccgctttgcttcttattctcttttgtcttctccctcacatcttctttcgtttaaataaaaagaaaaacacaagctagcaaacatggcgtcgttcgagcaagctccgcctggtaatgcaaaagcgggggagaagattttcaagaccaagtgttcccagtgccacaccgttgacaagggtgccggtcacaagcaaggacccaaccttaatggtctgtttgggaggcagtcgggtacaactccagggtactcatattccgctgctaacaagaacatggctgtgatttgggaggaaaaaactttgtatgattatctgctcaaccctaagaagtacattcctggaacgaaaatggtattccctggattgaagaaaccacaagatcgagcagacctcattgcatatttgaaggagtctacggcatcctaaatgggctgggaacagtaataatttcagttttacgtattccattccattttgcagtcattggagattgtttctctgtttcaaagcaacaggatataataaaagaataaaattagaccttgttggtgtaggtcagcca

SEQ ID NO: 2729 - DNA, 653 bp, Elaeis guineensis
gggatagagggcttcctgaaatcggaatcgatcatctccctgtctgcgttagggaggagaggaaaccctaaccctagatcgatctatccggggctttcttgagagaaatggcgtcgttcgcggaggctccgccaggcgataagaaatccggggagaagatcttcaagacgaagtgcgctcagtgccacaccgtagagaaaggagccggccacaagcaaggtcctaacttgaatggtctttttgggaggcaatctggtaccacccctggttattcttactctgctgcaaacaagaacatggctgtgatatgggaggaatcgactttatatgtttatctacttaatcctaagaagtatattcctggtacaaagatggtttttcctggtctgaagaagcctcaagagcgtgcagatctgattgcttatcttaaggaatccacagcatcataaatcatgtttagtgggaaatctattggctaataagattgctgatatccaacctgagcggtaaagccagggaaatggtatatttttgttttactattatttgtgcctcttttcgaggcattgttttgtgcaagatgtactcctgtattacctttgtaatgacattctcggcaatatcttaactaattttttggtcgccaaaaaaaa

SEQ ID NO: 2730 - DNA, 1081 bp, Aristolochia fimbriata
gcctaagtgcgcgtcctttaccgtttcaacggcagccaccgacctcacacgtcgtctgaagcttgtgcctgcatcggagccatctctcgggcgtccagactcgggcgttctccacttcatcactttcgctcttcacctttcgtgtgtactgcactcgctgttgtctgactgaacgaagtgtccatggcgacattcgctgaggctccaccgggagacgagaaatcgggagagaagatcttcaagaccaaatgcgcacagtgtcacactgttgacaagggtgctggacacaaacaaggacccaacctgaatggtctctttggaaggcagtcgggcacgacacctggctattcttactcagctgcaaacaagaacatggctgttatatggggggagtgcacattgtatgattatctcttgaaccccaagaagtacattcctggaacaaagatggtcttccctggactcaagaagccccaggaacgagcggatttaattgcatatttgagagcttctacggcgtcttagatggtctggtaggcaagaacacgtaaccagatcaggattgagaaaattgacaagaatccctctttgtcttttttttttttttgttttgctttctcgaataaagcaatgtagtcaagcttgtgctgaaggtgctgatgtttggcgtgtatatactcacattcgttggactctctctgaagattgaactgtattttcttgattgaccaccgttgtggggccttgtggccttgcgagtgcttcgaggcctaaaacttcgctcagttaaggcgggcttgtgtaatgcaaatggcagaggctataggcaggcccaggtttctgctctaaacttctggattttctacttgtccatgacttggaaatggggcttatgaatgtgtaggtttagatctgcaggtttggtttttacaccgtaccctcttttacataagcacagttacatacattggaggtgagattcactcatttttattcagtactcaccccaaagcttccagggccaatttgagtcaaccagggcaaactgatccctagggttagtttgagagcacacatccta

SEQ ID NO: 2731 - DNA, 505 bp, Castanea mollissima
aaagagagagagagagagagagaaatggcgtcgttttctgaagctccacctggcgatccaaaggtcggagagaagatcttcaaaaccaagtgcgctcagtgccacaccgttgacaaaggcgctggtcacaagcaaggtcccaatctgaatggcttgttcggaaggcagtctggtacaactcctgggtactcctattcagctgctaacaagaacatggctgtgaattgggaggaaaagacattgtatgattacttgctgaaccccaaaaagtacattcctgggactaagatggtattccccgggctgaagaagccacaggatcgggctgacctcatttcatatttgaagcaatctactgcatcttaaatactcccagactttttagttccccaattccattttgcagttgttttagattcacacagtgcagataaaagcacaattttttaccaataaattagaccattcaggtctgcaatgctcttttgtttgttgagctttgcct

SEQ ID NO: 2732 - DNA, 781 bp, Gossypium hirsutum
gattccctcaatatctggaatattcactgaagcctctcaaagttccgctttgcttcttattctcttttgtcttctccctcacatcttctttcgtttaaataaaaagaaaaacacaagttgaacaaccctaagctagcaaacatggcgtcgttcgagcaagctccgcctggtaatgcaaaagccggggagaagattttcaagaccaagtgttcccagtgccacaccgttgacaagggtgccggtcacaagcaaggacccaaccttaatggtctgtttgggaggcagtcaggtacaactccagggtactcatattccgctgctaacaagaacatggctgtgatttgggaggaaaaaactttgtatgattatctgctcaaccctaagaagtacattcctggaacgaaaatggtattccctggattgaagaaaccacaagatcgagcagacctcattgcatatttgaaggagtctacggcatcctaaatgggctgggaacagtaataatttcagttttacgtattccattccattttgcagtcattggagattgtttctctgtttcaaagcaacaggatataataaaagaataaaattagaccttgttggtgtaggtcagccatgcttgttaatttgcacaatgagcattcatatccggtaactattctttctttgactagaggttgccattgctggctattgtaaggcttattcaattagatagtcgctgtatttgatgaatttctggtatattacaagcatgagaaggataattgtttgttca

SEQ ID NO: 2733 - DNA, 757 bp, Gossypium hirsutum
attccctcaatatctggaatattcactgaagcctctcaaagttccgctttgcttcttattctcttttgtcttctccctcacatcttctttcgtttaaataaaaagaaaaacacaagctagcaaacatggcgtcgttcgagcaagctccgcctggtaatgcaaaagcgggggagaagattttcaagaccaagtgttcccagtgccacaccgttgacaagggtgccggtcacaagcaaggacccaaccttaatggtctgtttgggaggcagtcgggtacaactccagggtactcatattccgctgctaacaagaacatggctgtgatttgggaggaaaaaactttgtatgattatctgctcaaccctaagaagtacattcctggaacgaaaatggtattccctggattgaagaaaccacaagatcgagcagacctcattgcatatttgaaggagtctacggcatcctaaatgggctgggaacagtaataatttcagttttacgtattccattccattttgcagtcattggagattgtttctctgtttcaaagcaacaggatataataaaagaataaaattagaccttgttggtgtaggtcagccatgcttgttaatttgcacaatgagcattcatatccggtaactattctttctttgactagaggttgccgttgccggctattgtaaggcttattcaattagatagtcgctgtatttgatgaatttctggtatattacaagcatgagaaggataattg

SEQ ID NO: 2734 - DNA, 740 bp, Festuca arundinacea
  misc_feature (619)..(619): n is a, c, g, or t
  misc_feature (644)..(644): n is a, c, g, or t
ggcacgagggtttcacttgccctctctctcccctcgagtccccctcctccggcgagtctctgcttccgtgcgtgcggcggcggcggcgatggcttccttctccgaggctccccccggcaacccggccgccggcgccaagatcttcaagaccaagtgcgcgcagtgccacaccgtcgagaagggcgccggccacaagcaaggtcctaacttgcatggtctgtttgggaggcagtcgggtaccaccgctggttactcctactccgcggcgaacaagaacaaggctgtggactgggaggagaacactctgtacgactacttgcttaaccctaagaagtacattcctggaaccaagatggtcttccctggactgaagaagccacaggaccgtgctgatctcattgcgtacctgaaggaagccacctcctcttaaaaggacatgctgctataatcttgtcgggatgagagaattcgttttacagttaataaaagattagacgttactagtcactctggtttaacagggtgcagtccacgagacaattatctttctgggcatcatgtttatgatatgggttccgtatcactaggtttagttgcaaaaaatctttgacaagctttngattcagttgctggaaaatcccagnacgcacattttgaccaccaggtggtggtggaactggaatgcacccatgttaatgaacatgagatctttaaagttgtgatgttaaagctttctgcct

SEQ ID NO: 2735 - DNA, 692 bp, Glycyrrhiza uralensis
gtgtctggttttttctctgctctctttctagcatattcccaattctttcggttcctttcttctggaagtttcggcgcggcggcttctccaatggcgtcgttcgatgaggcacctcccggaaaccctgccgccggcgagaagatcttcaagatgaagtgtgctcagtgccacaccgtcgacaaaggtgccggccacaaacaaggacccaatctgaatggtttgtttggaaggcaatctggcacgactcctggatattcttattctgcggctaacaagaacatggctgtgatctgggaggaaaagaccttgtatgattacttgcttaaccccaaaaagtatattccggggacaaagatggtgtttcctggtcttaagaagccccaggaccgtgctgatcttattgcgtatctgaaagatgccacttcaaaatgattgaattttcatatatttagttatgcattttgaagttatggagatttaattttcggacatttaattttgtggtgcaataagcactctatcttggaaaataaagcagacttggttggtttgcaatgctattttgttccttttgcattgcttgataggtgttttgcctatattggctggactaatgcttaaacacatcagctgttgaaagttgaaacatttttttatcaaatttactcaactggaatcatgatttagtcttt

SEQ ID NO: 2736 - DNA, 661 bp, Medicago truncatula
cattcattcattttctttgcggagaaaccaaatcaattcatcaatggcgtcgtttgaactagcacctcccggtgatgccaaatccggagataaaatctttcgaaccaaatgcgctcagtgccacactgtcgataagggcgctggtcacaaacaaggacccaatctgaatggtttgtttggaaggcaatcaggcactactcccggatattcctactcagcagctaacaagaacatggctgtgaattgggaggagaagactttatatgattatttgcttaaccccaaaaagtatattccagggaccaagatggtatttcccggtctaaagaaaccccaagaacgcgctgatcttattgcatatctgaaggaagccactgcacagtgattatatattttcatacattcattttgacagtgtgattttgaagttctggaggtttaacttcagacatttagttatgctgagcagttaacactgtatctttggcaaataaagtaggctacattggtttgcaatgctattttgttcattttgcattgcttctcaaaaagctgccaaatattggttgctcaaacaaattatttataaagagttggaaacattcttatcagaatttggttaattggaagcataatttaattatttgcttggcttcttcat

SEQ ID NO: 2737 - DNA, 769 bp, Medicago truncatula
ctcattcttccaaattttcattcgcttctaaactaaaaaccctaacattcattcattttctttgcggagaaaccaaatcaattcatcaatggcgtcgtttgaactagcacctcccggtgatgccaaatccggagataaaatctttcgaaccaaatgcgctcagtgccacactgtcgataagggcgctggtcacaaacaaggacccaatctgaatggtttgtttggaaggcaatcaggcactactcccggatattcctactcagcagctaacaagaacatggctgtgaattgggaggagaagactttatatgattatttgcttaaccccaaaaagtatattccagggaccaagatggtatttcccggtctaaagaaaccccaagaacgcgctgatcttattgcatatctgaaggaagccactgcacagtgattatatattttcatacattcattttgacagtgtgattttgaagttctggaggtttaacttcagacatttagttatgctgagcagttaacactgtatctttggcaaataaagtaggctacattggtttgcaatgctattttgttcattttgcattgcttctcaaaaagctgccaaatattggttgctcaaacaaattatttataaagagttggaaacattcttatcagaatttggttaattggaagcataatttaattatttgcttggcttcttcatatattttcttgtttatgaagtaatatttgttttacatttatttgcttgcttagctgaataagt

SEQ ID NO: 2738 - DNA, 1485 bp, Quercus alba
accacgctccttttctcagccacctcttctcgaatattcttctcttcctagaaatttcagcaaactctctttctctctctctctttttttaagctttgctcttaaaaacctctccttttcacttcaactttctcagcctctactagaagaaccgaaaaaagagaaagagagaaatggcgtcgttttctgaagctccacctggcgatccaaaggtcggagagaagatcttcaaaaccaagtgcgctcagtgccacaccgttgacaaaggcgctggtcacaagcaaggtcccaatctgaatggcttgttcggaaggcagtctggtacaactcctgggtactcctattcaactgctaacaagaacatggctgtgaattgggaggaaaagacattgtatgattacttgctgaaccccaaaaagtacattcctgggactaagatggtattccccgggctgaagaagccacaggatcgggctgacctcatttcatatttgaagcaatctactgcatcttaattactcccagacttttattttagttccccaattccattttgcagttgttggagattcacacagtgcggataaaagcactattttttaccaataaattagaccatttaggtctgcaatgctcttttgtttgttgagctttgcttggtcattgcgtcccaaggaagaggttgctgtaattggcaagcggaacattcatttcagttagttttttacgaatatttcccgaatatactgggctaatgataattttattttgattcttgataatgttcgtctgtgcttgaggattagtttctgatgtcatttcccttgaactgaaatgttggaactgaaagtgatgaaaagaatgaacatgtggttgggtgcttcttggtatcatgccctttttccaagaggccctacgatctagatgatgaaactttgccttgcacatatattcggcaaagtgggtgatatggttggagcgagcaaaactcgttcttgaggaatattttttatctctatttggataggtttagacaaaattctctctctttgtgctctctgttcatggttgtcaaattaatttatggataaccttagacaaaattttatcaatagtttttctatgctttcttactgtccatgataacaaagatggtaggaggaaacaaaaacttgaaattgaaatgatttcataagtttagaactttagatgatctaattaaaaaaattgcaaactaatctggatttttatatataatttatcgtttttttaaattaaaaagactatacacaaccacgcaaaacacacacatggtaatcgaataatcaacatgtataatattttttttatgtatccttaattcactagttataaataccctttaaaagtaagagtctaatcttgctaaagggttattgcaaattacaaatttacacaaacgaggtactactgggtcgttacttgagagttgagtaggatctaaat

SEQ ID NO: 2739 - DNA, 841 bp, Arachis hypogaea
gtgttctactttacttgtctcgccgtgttctggaaccttccttcattcattcattctcttctgctctgtatctcccacaatggcgtctttctcggaagctccccccggcgactccaaggccggcgagaagatcttcaagaccaagtgcgctcagtgccataccgtcgacaaaggcgccggccacaaacaaggaccgaatctgaacggtttgtttgggaggcagtctgggactacaccagggtactcttattccgccgctaacaagaacatggctgttatttgggaggagaacactctctatgattacttgcttaaccccaagaagtatattcctggaacaaagatggtcttccctggtcttaagaagcccaaggatcgtgctgatcttatcgcatatctgaaagaatccacttcgcaatgattaagctatcatatactcagttttgcaatgtgattttgaagtttcggacatttaaattcagcggtgcagtaagtactgtatctggcaaataaagtagacttaaatttgttttcgcaatgctattttattcggattgcattgcttctcaagaggctgcaaattagctattgaaagttgaaacaatattattaatatgttgtggtaattggtaaacttgaagagcacaattcatactttcttcttcagtacgagtgaattgattattcttgttactctcttgtggacttgtggctttggatttttaattgcttagttgtatgtacaaagtttagtcttggtttgtggaagtagaatttagggtttattttaggcacgcttttattttcagtgtttttggtgtttgaatatttagtgaaagat

SEQ ID NO: 2740 - DNA, 803 bp, Trigonella foenum-graecum
cttttgcctcaagctaacgctacttttgaagcgccaaaaacaatccacgtcaacgaaaaatattagggccagcttaaacccccgttgcgaccgcgttccattttcccactatataaatattctcattcctccaaattttcattcgcttcttaaaacctaaccttcattcattttcgttgcggagaaatcaatcaatggcgtcgtttgaacaagcacctcccggtgatgctaaatccggagataaaatctttcgaaccaaatgcgctcagtgccacaccgtcgataaaggtgccggtcacaagcaaggacccaatctaaatggtttgtttggaaggcaatcgggcactactcctggatattcctactcagcagctaacaagaacatggctgtgaattgggaggaaaagactttatatgattacttgcttaaccccaaaaagtatattccagggaccaagatggtatttccaggtcttaagaaaccccaagaacgtgctgatcttattgcatatctgaaggaagccactgcacaatgatcatatgttttcatacattcatttttacagtgtgattttgaagttctcgaggtttaatttcagacatttagttatgcttagcagttaacactgtatcttttggcaaataaagtaggccacattggtccccaatgctgttttgttcactttgcattgcttctcaaaaagctaccaaatgttggttggcttgagttaggctcaatcaaattatctatattgagttgaaacatccttatcggtatttgattaattggaagcataatttaa

SEQ ID NO: 2741 - DNA, 1225 bp, Cirsium arvense
aacaacatacacaaggccatcaccgtttagaaaggagaaaaaaggctgcttcttcttcttcttcgatttctgtaaaagtagaaaccctagtaaggctctaatggcgtcgtttgaacaagcaccaggaggcgatgccaaagttggagagaagatattcaaaaccaagtgtgctcaatgccacaccgttgaaaaaggggccggccacaagcaagggccaaatttgaatggtctttttggaaggcagtctggcaccacagcagggtattcttattctgctgccaacaagaacatggctgtgatctggggagagaatacactctatgactacttgctaaaccccaagaagtacatccctggaacaaagatggttttccctggactgaagaaaccacaggatcgggctgatcttattgcttatttgaagcaatcgactgcatgatttcatttgctcttttcgccagttttgattagtctagatcttaatgcaaaaacggaaaaccttatgccatgttgcacttgtattcatggaggttttatgcttaccatggtttttgagtgaacatcaacaaataatatgtaaacaagattcatgggcatttttttgcaaaaaagaaaaaagtaccgactacacatggaagtaggatttattcaataactataagcaacaaacaccaaaagcaagttctatgaaacaaactgattcaggctaagcttgaccagaagaccaatttgcttttaaagtttgctttttgttttacaaaataatgagtgtcgtccttcagcaatgatctctccggttgctttgttcttcagaataacaagagttccgttatacgccccttttccgcccaaaagctttgcactgatctccaaatcatcatggagtttagcagtagaaacgtaagaaatggacatatccacagaaacattcataggcacatccttctcatacaccatagtcgcaccaacctcatccactaagctcgcaatcgcccccaccgccaggtttccatttccatcagtaaggcgaggggggactgtaaaggagcaagagacataaccgggttggaatcggtcaactcggatgcctttgagggcgaactcttcatagaagctatggaaggcttcaggtcgttggggagggatactgagtccgatgactcggtcggaatcgtgctgagttgatcgtataaactcgatcgtcttatccaccgccattgatgac

SEQ ID NO: 2742 - DNA, 522 bp, Papaver somniferum
gagagcaatatccctactccctattcatctgaaaagaaacaaaccctggaaaagttgagaaggttgttccttcttcttcttcctctcatcctctatacgttttctgtaaaaagaagtttgaaatggctactttccaagaagctccacctggtgatgttaaggctggggaaaagatcttcaagactaagtgcgctcagtgccatactgttgagaaaggatctggtcacaaacaagggcctaacttgaatggtctgttcggtaggcagtctggaacaactgctggttactcttactcagctgctaacaagaacaaggctgtgaactgggaagagaatacactttatgattacttgcttaaccccaaaaagtacattcctggaacaaagatggttttcccagggctgaagaagcctcaggatcgagcagacctcattgcttacctgaagcaatcaactgcctaatctttttactgccccttggaattcattttggagacactgtgacatgatcggatagcaacaa

SEQ ID NO: 2743 - DNA, 760 bp, Eutrema parvulum
tggcctgtggttcgctcacgtcacgccgccacctcttcttcttcctcgaaccttctttttaaacaaatctcccgaaactctttcaacaacaacagaaagaatcacgctttgaagacaccgtccgttcagattttttcattctcgatcacaaatggcgtcgttcaatgaagctcctcccggaaactcaaagaccggagagaagatcttcagaaccaagtgtgcgcagtgccacaccgtcgaccaaggtgccggtcacaaacaaggaccaaacttgaatggtttgttcggaaggcaatctggaaccactccagggtattcttactctgctgccaacaaaaacatggccgtgatgtgggaggagaagactctttacgattacttgttgaacccaaagaagtacattcccgggacgaaaatggtgttccctggactgaaaaagccacaagatcgtgccgatctcatcgcttatttgaaggaaggtactgcatagacacataagcttgcttcgatttaagcagcctctgttccggtgcattttttttctttccacagataacaaaataaatcggacctaaatatatcatggtcatgaactcgtttttgtatggtttttgtttttcttttactttgttaatgaggcgagttgcctcgtataaagtcgaatattcgttattgatgtgaagaatcaatatccaccacgaaattcatttagattttattctaattgtctactttagtttacagagcagattctagacga

SEQ ID NO: 2744 - DNA, 566 bp, Arnica chamissonis
taggcgattcgatctacgtagcttaatggcgtctttcgcggaggctcctgccggaaatgccaccactggcgagaagatcttcaagacaaagtgcgctcaatgtcacaccgtcgagaaaggcgctggccacaaacaaggacccaatttgaatggactatttggaaggcaatctggaactactgctggatattcctattctgctggtaacaagaacaaggcagttatatgggaggaaaatacgttatatgactacttgctaaacccaaagaagtacatccctggaacaaagatggttttcccaggactgaaaaagccacaggagcgtgctgatcttattgcatacttgaaggcgtccaccgcgtaattttttcgattacgtttcaataccattttaagttctcttgatgattcaaggtattaggagataactccggatgatattttgattaataaggggaggacatttatcaaacttctttactcctttcatttttgtttaatcatttggcaagagcctctttattcatctgacagaacttgcaatgcattttaagaattttgttttg

SEQ ID NO: 2745 - DNA, 440 bp, Brachypodium distachyon
gatcgaacaccattcgccgccgcctcctccaacctcctcgactcagggagccctaaccctagcgatcagcatctcgttcgggcgggatcgatggcgtcgttctcggaggcgcccccgggaaaccaagcgacgggcgagaagatcttcaagaccaagtgcgcgcagtgccacaccgtcgagaaaggcgccggccacaagcaagggcctaacctgaatggtctgtttgggaggcagtctggtacaactcctggttactcttactcttcggctaacaagagtatggctgtgatttgggaggagaaaacattgtatgactacctgcttaatccaaagaagtacattcctggaactaagatggtattccctggactgaagaagcctcaggagcgtgctgatctcattgcatacctgaagagcgccacagcttgaaagggctcgct

SEQ ID NO: 2746 - DNA, 712 bp, Brachypodium distachyon
gatcgaacaccattcgccgccgcctcctccaacctcctcgactcagggagccctaaccctagcgatcagcatctcgttcgggcgggatcgatggcgtcgttctcggaggcgcccccgggaaaccaagcgacgggcgagaagatcttcaagaccaagtgcgcgcagtgccacaccgtcgagaaaggcgccggccacaagcaagggcctaacctgaatggtctgtttgggaggcagtctggtacaactcctggttactcttactcttcggctaacaagagtatggctgtgatttgggaggagaaaacattgtatgactacctgcttaatccaaagaagtacattcctggaactaagatggtattccctggactgaagaagcctcaggagcgtgctgatctcattgcatacctgaagagcgccacagcttgaaagggctcgctgccgtggtcagttaataaaatagatactgtcatgaggttactctggtttgacagggtaacaggatgcatcgaccagacagttaaagcggaatttgttgaaagtgcgtggtcgtatttctccttgtgatgtttttcttttatctgattagactaggaatatttcaaatatttgagctatatcatgttaagatattattttgtcgattcctaaagtgatctaacttaaggctaatgccttacctggttccttcagtgatctttggtttagtatt

SEQ ID NO: 2747 - DNA, 709 bp, Cynara scolymus
ggcgggatcctcttttattttcgcccccctctctctcacacatcttcccaaatctacaatcggcgatccgatctacatagattgatggcgtcgttcgcggaggctcctgccggaaatcccaccgtcggcgagaagatcttcaagactaaatgcgctcaatgccacaccgtagagaaaggctccggccacaaacaaggacccaatcttaatggactatttggaaggcagtctggaacgaccgctggatactcgtattctgctgctaacaagaacaaggctgttacatgggaggaaaatacactatatgactacctgctcaacccaaagaagtacatccctggaacaaagatggttttcccaggactgaaaaagccacaggaccgtgcagatctgattgcgtacctgaaggcatcgacagcttaattccattttaaagtgctttttctaatgacttgaggtataagggtatggataaatttggattattatttttccgtgaataagggaaggaggacattcatccatcgtctttctttttctccatttttgagaaactggtttgtccaattggcaaaaaaacctaaattgtgaccctggagcagatgaatgcatttcaagtgttttctttctttaaacatcattcattttatatgattgttgaacatctgatataaacatggaaacagatatataccttatttatttcgaa

SEQ ID NO: 2748 - DNA, 624 bp, Euphorbia peplus
aatggcatcattcgaacaagcacctcccggcgatgcgaaggccggagagaaaatcttcaagactaagtgcgctcaatgccacaccgtcgatcaaggcgccggtcacaaacagggacctaatttgcatgggcttttcggtaggcagtctgggactactgctggatattcttactctgctgcaaacaagaacaaggctgtggaatggggagaagacaccttgtatgattacttgctcaaccctaagaagtacattcccggaacaaagatggtcttccctggtttgaagaagccacaggatcgtgcggatctcattgcctatctgaagcaagcaactgcctaatctgcttgtttagtatgtggctatatagcaattcatgacattattaatatcctagacagtttattttttcaaagaagagaaaattgtccacttctttcaaataaaaagatggattaaggcgcaaaagatacttgaatattttgggaattgagattagggaaatactgtttgttgtaaactctttttcatgaatgatttcatgaaccccttattgattttttgaaagtcatattacctgtggatttacctactgctctgagattctaagttggtttgattctttt

SEQ ID NO: 2749 - DNA, 742 bp, Fagopyrum esculentum
aaattgagaaccggaaccctccagacccgtttttctctcttgccagttgccgctctcccataaacaaccttccagaaacctctcctctgtttcccatttgaacatccaaaccctagcgactaacgaccaccgcttaattccttcatccatggcaaccttcagcgaagctcctcccggcaacatcaaaagtggtgagaagatctttaagaccaagtgtgctcaatgccacaccgtcgagaaaggagctggtcacaagcaaggtcctaatctcaatggcctttttgggaggcaatcaggaactactgctggctactcctactctgctgctaacaaaaacaaggctgttacatggggagaggacaccttgtatgactacttgctgaatccaaagaagtacatccccggaacaaagatggttttcccaggattgaagaagccccaggaacgtgcagacctaattgcatacctcaaggattcaacacagtaacgttctctcttttgaaacaatgaaaatgcaggcttctgtttaggagaagtggccgagctctgttttgtttattagtcacaaatttgtctcgtaggagacctgagaaactattattatttttacctgtcaaataagattaaccctggtaagggagtggacaaacttgagaaaacattattttgctgagtgatttttattatagttttgtccgaggcatttctcggtatataatacacctctacaccttttgctggt

SEQ ID NO: 2750 - DNA, 588 bp, Gerbera hybrid cultivar
gatggcttcgttcgcggaggctccagccggaaatgccaccgccggcgagaagatcttcaagactaaatgtgctcaatgtcacaccgtcgagaaaggcgccggccacagacaaggacccaatcttaatggactatttggaaggcagtctggaacgactcctggatactcctattccgcggctaacaagaacaaggctgttacgtgggaggaaaatacattgtatgactacctgctcaaccccaagaagtacattcccggaacaaagatggttttcccaggactgaagaagccacaagagcgtgcagatctcatcgcgtacctcaagtcatccacagcttaaatttgaagatttcttcatgatttgagctagaaaggggataaattctgattattttttttaattaataagggagacttttcattttctatatgcctccatttttgagcactggtttattcaattggcaagtggttgccttgttcgcaaacagaaattgcaatgcagatgaatgcttttacgtattttgtttgaacatcattctgtaactttcttaaataactatatatagttgctccctcctacctaaa

SEQ ID NO: 2751 - DNA, 708 bp, Tropaeolum majus
ttcgcctcatttttctgtcgccgagcgccgctcccagcgttttcctaaatctccgatctctcgccgtactccgcttttccagtgaagagtaatggcatcgtttgaggaagctccagcaggtaactccaaagctggtgacaagatcttcaggacaaagtgtgctcagtgccacacagttgacaaaggcgccggtcataagcaaggtcccaacttgaatggactgtttggaaggcaatctggtacaactgctgggtactcgtactcagctgctaacaaaaacaaggctgtggtctgggatgagagcacactttacgactacttgcttaacccaaagaagtacattcctggaacaaagatggttttccctggattgaagaagcctcaagatcgtgctgatctcattgcctacctcaaggaatcaactgcttaagtgtcgtttggctcgggaggaagtctgcagccataacattctttttcaaagataaaaaaaaataatgagatttctggactagaagacattcataaacaatttcttaaattttgattgggggttttatgtacctaggttcagttattacgcccttacctcatccccgaggtttaatttatttccattacagaaggttatacctaatgatgcgtgcaaaggttaaatgtctattttttggattaaaataacttggtttttatgaatgatgtctttagtgg

SEQ ID NO: 2752 - DNA, 893 bp, Tropaeolum majus
cgtaattaattgacatttccacaattagcctctcattcccccaactttgacctttcctttctttgctggccggtggctaccacacactttctagaatcttcatgctataaaaacctccacgtgtcctaaacacgaatatatatttcccctaccttattgcaatcgctataccttcgcctcatttttctgtcgccgagcgccgctcccagcgttttcctaaatctccgatctctcgccgtactccgcttttccagtgaagagtaatggcatcgtttgaggaagctccagcaggtaactccaaagctggtgacaagatcttcaggacaaagtgtgctcagtgccacacagttgacaaaggcgccggtcataagcaaggtcccaacttgaatggactgtttggaaggcaatctggtacaactgctgggtactcgtactcagctgctaacaaaaacaaggctgtggtctgggatgagagcacactttacgactacttgcttaacccaaagaagtacattcctggaacaaagatggttttccctggattgaagaagcctcaagatcgtgctgatctcattgcctacctcaaggaatcaactgcttaagtgtcgtttggctcgggaggaagtctgcagccataacattctttttcaaagataaaaaaaaataatgagatttctggactagaagacattcataaacaatttcttaaattttgattggggttttatgtacctaggttcagttattacgcccttacctcatccccgaggtttaatttatttccattacagaaggttatacctaatgatgcgtgcaaaggttaaatgtctattttttggattaaaataacttggtttttatgaatgatgtctttagtggtcaaaaaaaaaaaa

SEQ ID NO: 2753 - DNA, 648 bp, Pisum sativum
cccaatccaaaacctaaacctaactttcgtcttctttgcggagaaatcaaccaatggcgtcgtttgaacaagcaccacccggtgattccaaagccggggataaaatctttagaaccaaatgcgctcagtgccacaccgtagaaaaaggcgccggccacaagcaaggacccaatctgaatggtctgtttggaaggcaatccggcactactcccgggtattcctactcggcagctaacaaggccatggctgtgaattgggaggaaaagactctatacgattacttgcttaatcccaaaaagtatattccagggactaagatggtatttcctggtcttaagaaaccccaagaacgtgctgatcttattgcatatctgaaggaagccactgcctagtgatttttatatttccatacattcaattttacagtgtgattttgaacttctggagatttaatttttcagatatttagttttgcggagcagttagtactgtattcttggcaaataatgtaggccacattggtttgcaatgctattttgttaattttgcattgcgtctctaaaagctgacattttggtttggctggagttcgctcaatcagtatttggttaattggaagcacaatttatttatgtgctaatctacatg

SEQ ID NO: 2754 - DNA, 539 bp, Lippia dulcis
caaaagaggagatgaatcaaaccacgttgtcaagtaatttcccacacattttcacacacgtataaatatagcttcccattcctggtctacacaaaccctagaaatttctcttccagagattatcgctctttctataatctctagcgaatagcattccattttcggacagttccggaaaaatctgaatcgagatggcgtcgttcgaggaagcgccgcctggaaacaaggccgccggagagaagattttcaagaccaagtgtgctcagtgccacacagtcgacaaaggagctggccacaaacaaggacctaacctaaatggtctcttcgggcgacagtctggaactaccccgggttactcgtactctgctggtaacaagaacaaggctgtgatttgggaagagaagaccctatacgactacttgttgaatcccaagaagtatatccctggcacgaagatggttttcccaggattgaagaagcctcaggaccgtgcagatctcatagcatacctgaaggaatccacagcttaagcacagaat

SEQ ID NO: 2755 - DNA, 654 bp, Lippia dulcis
ttccacgccgccagcaaagaaagcgcaaaagaggagatgaatcaaaccacgttgtcaagtaatttcccacacattttcacacacgtataaatatagcttcccattcctggtctacacaaaccctagaaatttctcttccagagattatcgctctttctataatctctagcgaatagcattccattttcggacagttccggaaaaatctgaatcgagatggcgtcgttcgaggaagcgccgcctggaaacaaggccgccggagagaagattttcaagaccaagtgtgctcagtgccacacagtcgacaaaggagctggccacaaacaaggacctaacctaaatggtctcttcgggcgacagtctggaactaccccgggttactcgtactctgctggtaacaagaacaaggctgtgatttgggaagagaagaccctatacgactacttgttgaatcccaagaagtatatccctggcacgaagatggttttcccaggattgaagaagcctcaggaccgtgcagatctcatagcatacctgaaggaatccacagcttaagcacagaatggttgtcttttttttgcagttgagagtcacaatttacctttttgagtagcaaaaaaacgacaaatactactttaattaaataattacttt

SEQ ID NO: 2756 - DNA, 529 bp, Papaver somniferum
tcatttaacaaaccctggaaaagttgagaaggttgttccttcttcttcctctcatccaccacacgttttctgtaaaaagaagtttgaaatggctactttccaagaagctccacctggtgatgttaaggctggggaaaagatcttcaagactaagtgcgctcagtgccatactgttgagaaaggatctggtcacaaacaagggcctaacttgaatggtctgttcggtaggcagtctggaacaactgctggttactcttactcagctgctaacaagaacaaggctgtgaactgggaagagaatacactttatgattacttgcttaaccccaaaaagtacattcctggaacaaagatggttttcccagggctgaagaagcctcaggatcgagcagacctcattgcttacctgaagcaatcaactgcctaatctttttactgccccttggaattcattttggagacactgtgacatgatcggatagcaacaaattttttcttaaataaaccctttttttaggtttttgttgct

SEQ ID NO: 2757 - DNA, 760 bp, Silene vulgaris
ggcgtcattcggcgaagcccccgctggaaacccaaaggcaggtgaaaagatcttcaagatgaagtgcgctcaatgtcataccgttgatcaaggcgctggccacaagcaaggtccaaacctaaatggccttttcgggaggcagtcggggactgctgctggttactcttactctgctgccaacaagaacaaggctgtccattggggagaagacacactgtatgactacttgctgaacccaaagaagtacattcccggtactaagatggtgttccccggtttgaagaagcctcaggaccgagcggacctcattgcatatctcaaggaatccactgcctaatcaatgcaacatcgattcatcttttgtgtagtagagatcaaaggaggactttgatccgaattttgtttcatgaacattcaaaatttgtttgtcaaataaattcaccatgtcaagaggcgattaaatggaactcttgattagatagcgattatttcagaacatatttgtgtacattgatcccttttgggaatcttcagcattttcaatttttgctggagtgaaatcgatgacttttgggttggatgtttttagttttgatgactgtgagcttcataacgtaattgtcagccttcaaattgcttacggagtattatgagtacttacaaatgcttgtataagtcgggttttgcacaaacatgtactcatttatgtaagatggcatgcagttgactgaagtatgcctaacaataatatgtcatgatt

SEQ ID NO: 2758 - DNA, 955 bp, Euphorbia esula
  misc_feature (483)..(483): n is a, c, g, or t
  misc_feature (610)..(610): n is a, c, g, or t
  misc_feature (615)..(615): n is a, c, g, or t
acagaagaagaacttgtagaacaaaggaatggcatcattcgaacaagcacctcccggcgatgcgaaggccggagagaaaatcttcaagactaagtgcgctcaatgccacaccgtcgatcaaggcgccggtcacaaacagggacctaatttgcatgggcttttcggtaggcagtctgggactactgctggatattcttactctgctgcaaacaagaacaaggctgtggaatggggagaagacaccttgtatgattacttgctcaaccctaagaagtacattcccggaacaaagatggtcttccctggtttgaagaagccacaggatcgtgcggatctcattgcctatctgaagcaagcaactgcctaatctgcttgtttagtatgtggctatatagcaattcatgacattattaatatcctagacagtttattttttcaaagaagagaaaattgtccacttctttcaaataaaaagatggattnaggcgcaaaagatacttgaatattttgggaattgagatttagggaaatactgtttgttgtaaactctttttcatgaatgatttcatgaaccccttattgattttttgaaagtcatattacctgtggntttanctactgctctgagattctaagttggtttgattttttcttgcttgttcttatttagctttggttttaagtgttcacttctgtttatgaattaccaaaaaactactgtagcagggtctgtagtgtttaaatatccttgctcatgctttgatcttgaattggttcatgggctgttttgtgtttggcttaggagtgtcatgagctagtcattggggtttggagaacagttaagttatatagaatcattttctcatctgcattagtttgatctgtttgttgtataagcaattgattttgctctatgaccttttatatttcagtattggagagaattatagagtgc

SEQ ID NO: 2759 - DNA, 849 bp, Fragaria vesca
gaccgacgtctctactactctctctctctctctctctctctctctctctctctctcaaacaaaccctagaataccgaattccctctcctctctttctctctctacaaatcaatggcgtcgttcgctgaagctcctcccggagatgccaaggtcggagagaagatcttcaggaccaagtgcgctcagtgccacaccgtcgacaaaggcgccggccacaagcagggacccaatttgaatggcctgtttgggaggcagtctggaacaacacctgggtactcttactccgctgctaacaagaacatggctgtgcagtgggaggagaagacattgtatgactatttgctgaatcccaagaagtacattcctggaaccaagatggtcttccctggattgaagaagccacaggaccgtgctgacctcattgcctatttgaagcaatcaactgcataggctgcctttgtcaacttctcacattttgcagtcattggaggtttatacaaacggatgggtactattttttgttgccaataaattaggccatctaggtctgcaattcttgtttgcatatcgagcttgcttttgcttttctaggaaagaggttgctgtaattggcagcacaacattcaaattcagttagctgttgtgactagatttcttgaagttggtgaagtaccatcaactaatgatataaaaattcattgcaacattttctatatatttctgtgatgcaatccggcacatccatggttcccaaatttgatttcatgcgtctattcttttggtcaatgtaatgttaaaaatcagtttgcacttaaatggcgacattcattagtcaatttttctgctcaa

SEQ ID NO: 2760 - DNA, 650 bp, Taxus baccata
atgattagtgagatttcgtggagcgcgaggttgcttcgagagagaatctgtgtaaaaaggtaaagggagtgtgtattgaggtgagtttttcttcttcgtacccaaatccaagcgaccatggcatcctttgcagaggctcctcccggcaatgaaaaggctggagagaagatcttcaagactaaatgtgcccagtgccataccgttgagaagggcgctggccacaaacaggggccaaatcttaatgggctgtttgggagacaatctggaaccactgctgggtattcatattctacggccaacaaaacaaaggctgtgacctggggagaagacgccctttatgagtatcttctcaatcctaaaaagtacattcctggaactaagatggtgtttcctggtttgaagaagccacaagatcgtgctgatctgattgcatatcttaaaaaggcgacatcttaatatatttaaaatatcttttaaaaacagatgatcagatggcattattcagtcacttgtttcgaagaattcattcgggagattagtttaatgttggacaacagtctgccctattgttgagttaacttattttaataatgacgactcttaagtgcccaaattgggtttctttttgtaatgcatatttttgtgataac

SEQ ID NO: 2761 - DNA, 847 bp, Flaveria ramosissima
agggtaaacaatcgtctagaactttctttctcgggccgtgccgataaagccacgaccctttatggctttatgtaaacatcatctttctttacagcacctttaacaaacgagaaatctctcgaaaagcttccatcgtaaagtagaaatcgaaaccccaagtctccggcgtctcataggcggcgagtgtgtgtgttaccggaaaatggcgtcattcgaacaggcaccaccaggcgatgctaaagcaggggagaagatcttcaaaaccaagtgtgctcagtgtcacaccgtcgagaaaggggccgggcacaagcaagggccaaatttgaatggtcttttcggaaggcagtctggcaccacagcaggatattcttattctgctgccaataagaacatggccgtcatctggggagagaatacgctctatgactacttgctaaacccaaagaagtacattcctggaacaagatggtattcctggactgaagaaaccacaagatcgggctgatcttattgcgtatttgaagcagtcaactgcttgatttcatcaagcttcttcaatggcccttactgcctcgtggttcaagtagacggtaaggtctgattttgttgcgaacaaccttaatggcatgttgcactcttcttcatggacatgcttgtacctctgttactgtacttaccatggttttcagtagagcaagtaatttgttaacaagattttcatgctgttattgatttaaataaatagtcacattatatctggataagctgatatgaactcgggacttgaggtaaatgatagttttctaaagaagcaccgtatgaaggtaaaacctagtgagatgaggta

SEQ ID NO: 2762 - DNA, 479 bp, Secale cereale
agcctcctgcgactcggatcgcccagggatccccaaccctacctagtccggcaaccgtccgcgcgggatcggcggcagcggcgatggcgtcgttctcggaggcgccccccgggaaccccgcgtccggcgagaagatcttcaagaccaagtgcgcccagtgccacaccgtcgacaagggcgccggccacaagcaagggcctaacctgaatggtctgtttgggaggcagtctggcacaactcctggatattcttactctacggccaacaagctcatggctgtgaattgggaggagaaaacactgtatgactacctgcttaatccaaagaagtacatccctggaactaagatggtgttccctgactgaagacgcccaggagcgtgctgatctcattgcactacctggaagggtgccacagcatggaaacgggcctttgttttactgccattggttactaaaaacagttaaataaatatagac

SEQ ID NO: 2763 - DNA, 568 bp, Vinca minor
gaaatccctaaatcggcccttttttggttagaatttgaatcggataaatggctaccttcgaacaagcaccgaccggtgattgcaaaatccggcgaaaagatcttcagaactaagtgcgctcaatgtcacaccgttcgacaaaggtgccggtcacaaacaaggccccaatttagaatggccttttttggaaggcagtctggtacaactcctggctattcttactctgctgctaacaagaatatggctgtcaattggggagaaaatacgctgtacgattatttgcttaatcccaagaagtacattcctggaaccaagatggttttccctggattgaagaagccacaggatcgagccgatctcattgcttacctcaaggagtcaactgcttgaaagctttttacttgtatgggcataatactaaaattttaagcaacgggaacataattttgtcatcagtaacaatttaaaattctttttacgtagaaccagtcatctatccgattgaataagacaagaaggtctttacgttgattttatcttgttgagctaaaggccagaaccagtgtaa

SEQ ID NO: 2764 - DNA, 536 bp, Silene vulgaris
tagaatggcgtcattcggcgaagcccccgctggaaacccaaagactggtgaaagatcttcaagactaagtgcgctcaatgtcacaccgttgatcaaggcgctggccacaagcaaggtccaaacctgaatggccttttcgggaggcagtcgggaactgctgctggttactcgtactctgctgccaacaagaacaaggctgtccactggggagaagacacactgtatgactacttgctgaacccaaagaagtacattcccggtactaagatggtgttccccggtttgaagaagcctcaggacagggcagacctcattgcatatctcaaggaatccactgcctaatttcattgcatatctcaaggaatgcacatcgattcatcttttgtgtagtagagatcaaaggaggactttgattgaattttgtttcatgaacattcaaaatttgttgtcaaataaattcaccatgtcaagaggcgattaaatggaactcttgattagatagcgattattgcagaaaacagttgtatacatttatc

SEQ ID NO: 2765 - DNA, 425 bp, Setaria italica
ggcgatggcgtctttctcagaggcgcccccggggaaccccgcggccggcgagaagatcttcaagaccaagtgcgcgcagtgccacaccgtcgacaagggcgccggccacaagcaaggtgagcaccagagttgaatggtctgtttgggaggcagtctggtacaactcctggttactcttactcctcggctaacaagaacatggctgtgatttgggaggagaacactttgtatgactacctgcttaatcctaagaaggtacggattcctggaaccaagatggtgttccctggactgaaaaagccacaggaacgtgctgatctcattgcgtacctgaagaatgccaccgcttgacgagaggggactgatgtggccctaagatgaagtgcggcgattctttttgcagttaaaataatgatacaaattta

SEQ ID NO: 2766 - DNA, 755 bp, Valeriana officinalis
aaaagctctttccctctctacgctcattttcccctctctctgtctagaatttgttgcagttcaaatcaattttgatcgatggcgtcgttcacagaagcacctcccggcaacgctgatgccggtgcgaagatcttcaaaactaagtgcgctcagtgccataccgtcgaacaaggtgccggtcacaaacaaggacctaatctgaatgggctattcggaaggcaatcaggaacaacagctggttactcttactctgctgctaacaaaaacatggctgtcaactgggaagaaaagaccttgtatgattacttgctcaaccctaagaagtacattcctggaacaaagatggttttccctggattgaagaagccgcaagaccgtgctgatctcattgcttatctcaagactgccacagcccccaaataattctttttttctatgttttgattctattttacagttgctagaggtaaaaaatattgtttgctttatgggattttgacatgaagagcaaaactacataattttttggagaataataaggttgtaaagaaccttggtttcatcatttatatgtgctccttttgtttaactgagcactcggttaccgaaatttaattacctcggtcggtagaggaagatttttacatatattttttactctcttttggttttatgtgcggttaaatatttttacttaattttgatcttgatacatgtacataataactgtatctgatgtctttttagttcaaaaa

SEQ ID NO: 2767 - DNA, 747 bp, Cucumis sativus
ggaatataaggaagcaaaataaaaagaggggttctccatccttctaccaacactgtaaaccctagcattcagatccgatcgccacctcatttcgccatggcaagctttgacgaagcacctcccggaaattctaaaactggagagaagatcttcaagaccaaatgcgctcagtgccacactgttgataaaggggctggccacaagcaaggtcccaatttgaatgggctatttggacggcagtctggtacaactcctggatactcttactctgctgccaacaagaatatggctgtgatatgggaagaaaagacgttatatgattacttgcttaaccccaagaagtatatccctggaacgaaaatggtcttcccagggttgaagaaaccgcaggaccgtgccgaccttattgcttatctgaaggaatcaaccaactctgcttaaatgagatttatatgatgcgtctgccaatctagaattttttgtgactttcccccctcattaaataagaacatcgaggaaaatttagatgaaacatacaaagcaatcattctgtgacaaaaagatttatcttgtgaaaactacaagaattccttttcgtttcattaatttcttattttgaagagttgatccatttgtagcttacattattgtttggtgtgaacataactgctacaattttttttggccaagccggttatggcaatttatttttcataataaatatcactcttgttacagtctatcaat

SEQ ID NO: 2768 - DNA, 819 bp, Medicago truncatula
atagcgtagcgcatattctcatttcattcactttcctatacaattctttcgcaacacgctgctcgtttgcagaactttctcaaatggcgtccttcgatgaagctcctcccggaaaccccgccgccggcgagaagatcttcagaaccaagtgcgctcagtgccacaccgtcgacaaaggcgccggccacaaacaaggacccaatctgaacggtttgtttggaaggcaatctgggacaactcctggatattcctattctgcggccaacaagaacaaggctgtggattgggaggaaaagaccttgtatgattacttgctgaaccccaagaagtacatcccagggacaaagatggtttttcctggtcttaagaagcctcaagaacgtgctgatcttattgcatatctgaaagatgccacttcaaaagaatagaatttacatacattcttatgcagtatgcttttcaaacctggagttataattttcgtacatttgattatgtggtgcaatagccacttttcttggcaaataaagcaaacttgattagtttgcagtgctattttgttccttttgcattgcattgcttcttgagggtgcgtatattggctagactaatatttgaacacattggttgttgaaagttgaaacattcttatcaaattttacttacatcgaagcatattttagtctttatttgttttgttagttgattcaccagtcttgtgattttgtttacttcaattttgcttaaacgaatgcaatagatgctagttctttcctcctaatttctcaaattggagttctttgtatgtggattgagagg

SEQ ID NO: 2769 - DNA, 643 bp, Fagus grandifolia
gcacgccacgccctctcagcccctcttcaggaatattcgcgtgttgcgtcctagaaatttcagcgttaattattgaaccacaccaaattctctcttacttctttgctctaaaaaaaacgttctattttgcctccaacactttctcagtttattgaaaagaaaaaacagaaaaaagcgaaacgcagagaaatggcgtcgtttgagcaagctcctcctggcgatccaaaggtcggagagaagatcttcaagaccaagtgcgctcagtgccacaccgtcgacaaaggcgctggtcacaagcaaggtcccaatctgaatggcctgttcggaaggcagtctggaacaactcctgggtactcctattctgctgctaacaagaacatggctgtgaattgggaggaaaagacattgtatgattacttgctgaaccctaagaagtacattcctgggactaagatggtttttcctggactgaagaagccgcaggatcgagctgacctcatttcatatttgaagcagtctactgcatcctaaatactcccatacttagagttccctaattccattttgcagttgttggagattgttacacagtgcggataaagcactattttttaccaataaattagaccctctaggtctgatg

SEQ ID NO: 2770 - DNA, 607 bp, Gossypium hirsutum
attctcaaaataaccacttttgaggtttgctgaaacaaacaacgtaacctaaaaacgaagcgaagatggcatcctttgctcaagcaccgcctggtgactcaaagtccggcgagaagattttcaagaccaagtgtgctcagtgccacaccgtcgaaaaagctgccggtcacaaacaaggacccaatctgaacggtctgttcggaaggcagtcgggtaccgctcctggttattcatactccgctgcaaacaagagcatggctgtcatttggggggagaatactttgtatgactaccttctcaaccccaagaagtacatccctggaacaaaaatggttttccctggattgaagaagccacaggaacgtgctgatctcattgcttatttgaaggaatctacggcttcgtaaatgggtttacaaaattcccattccattttgcagcctttagaggaatgattcttataataaagtagacatgcatgctctttctacaatgagcattccttcccttcctgccaaattgttacccttgagaagagttcgctatttctggcaaatctaaggctttttcattacttcctgaatttctggtgatttaccagcatgct

SEQ ID NO: 2771 - DNA, 793 bp, Avena sativa
tttcccttggcctctcccctcgagtcccctgcggcgagtctctgcttgcgtgcggcggcgacgatggcttcgttctccgaggctcccccaggcaacccggccgccggcgcgaagatcttcaagaccaagtgcgcgcagtgccacaccgtcgagcagggcgccggccacaagcaaggtcctaacttgcatggtctgtttgggaggcagtcgggtaccactgctggttactcctactccgcggcaaacaagaacaaggctgtggactgggaggagaacactctgtatgactacctgcttaatcctaagaagtacattcctggaaccaagatggtcttccctggactgaagaagccgcaggaccgtgctgatctcatcgcgtacctgaaggaggccacctcctcttaaaaggaaatgctgccatgatcttgtcaggatgagagaattcgttttacagttaataaaaagattagacggtactagtcactctggtttaacggggtgcagtccacgagacaattatcttttgaatattatttttatggtatggattccatatcactaggcttagttgcaaaaatctttgacaagcttttgattctgtcactggaaaatcccagtacgcacattttgaccaccaggtggcggtcgttctggaatgcacccatgtcaatgaacttgatatcttcaaagttgtgatggctttctctctatgctattgagtcattgatgtcagtacggtatatgttttgatgtcgggtcatgtgttttaagtgtgtattttgattgtttctgt

SEQ ID NO: 2772 - DNA, 805 bp, Avena sativa
ggcgagcaaaagtttcccttggcctctcccctcgagtcccctgcggcgagtctctgcttgcgtgcggcggcggcggcggcgatggcttcgttctccgaggctcccccaggcaacccggccgccggcgcgaagatcttcaagaccaagtgcgctcagtgccacaccgtcgagaagggcgccggccacaagcaaggtcctaacttgcatggtctgtttgggaggcagtcgggtaccactcatggttactcctactccgcggcaaacaagaacaaggctgtggactgggaggagaacactctgtatgactacttgcttaatcctaagaagtacattcctggaaccaagatggtcttccctggactgaagaagcctcaggaccgtgctgatctcatcgcgtacctgaaggaagccacctcctcttaaaaggaaatgctgccataatcttgtcaggatgagagaattcgttttacagttaataaaaagattagacggtactagtcactctggtttaacggggtgcagtccacgagacaattatcttttgaatattatttttatggtatggattccatatcactagatttagttgcaaaaatctttgacaagcttttgattctgtcgctggaaaatcccagtatgcacattttgaccaccaggtggcggtcgttctggaacgcacccttgtcaatgaacttgaaatcttcaaagttgtgatggctttctctctatgctatcgagtcattgatgtcagtactgtatgttttgatgtcgggtcatgtgttttaattgcgattttgatgtttct

SEQ ID NO: 2773 - DNA, 611 bp, Phalaenopsis aphrodite
cggaaacggtcgttaccctaattcctggttccattattaacagcttcagaagcgttttacaagcggaggaatggcgtcgttttcggaagctccaccaggcgactcgaaggccggcgagaagatcttcaagactaagtgcgctcaatgccacacggtggagaaaggcgcagggcacaagcaaggtcctaatttgaatggtctattcggaaggcaatcaggcactactcctggttattcttactcgacggctaataaaaatatggcggtgatctgggaggagtcaactttgtatgactatttgcttaatcccaagaagtacatacccggcacaaagatggtgtttccgggcctcaagaagccacaggagcgtgcagatcttattgcttttctcaaagagtctacctcatcctgaactcctgaaaggagccacagtgattcttacaagaccattaaagatatgagaagtggagctaagcttgcatttcagtttcgtcttgtttgtccattgtggtaactagaatggcttattttgtatttttttttttgttcggttcttacattttttggcacatctttcgagccaaaataacttataatattgtaacaattgc

SEQ ID NO: 2774 - DNA, 755 bp, Secale cereale
gcaaaagtttcacttggccttccccctcgagtcctccggcgagtctctgcttgcgcgcgtgcggcggcggcgatggcttccttctccgaggctccccccggcaaccccgacgccggcgccaagatcttcaagaccaagtgcgcgcagtgccacaccgtcgacgccggcgccggccacaagcaaggtccaaacttgcatggtctgtttgggaggcagtctggtaccaccgctggttactcctactctgcggcaaacaagaacaaggctgtggagtgggaggagaacactctgtatgactacttgcttaatcctaagaagtacattcctggaaccaagatggtcttccctgggctgaagaagccacaggaccgtgctgatctcattgcgtacctgaagaaagccacctcctcttgaaagggcatgatgatggcgagtgatcttgtcatggcgcgtgaattcattttgcagtaaaataagaagattagacattaatagtcactctggtttgatggggtgtgatccacgagacaattatcttgcgaatttcgttttcatgatatggctttcatatcactaggtttagttggaaatctttgtcaatcttttgattccgttgctggaaaaccccagtgcgcacattttgaccaccaggtggcggtgggactggaatgcacacccatgttgatgaacatgagatctttaaagttgatataaagctttgtgcccttgttatggagtcgtacaaaaaaaaaaaa

SEQ ID NO: 2775 - DNA, 823 bp, Secale cereale
aaaggcgagcaaaagtttcacttggccttccccctcgagtcctccggcgagtctctgcttgcgcgtgtgcggcggcggcggcgatggcttccttctccgaggctccccccggcaaccccgacgccggcgccaagatcttcaagaccaagtgcgcgcagtgccacaccgtcgacgccggcgccggccacaagcaaggtccaaacttgcatggtctgtttgggaggcagtccggtaccaccgctggttactcctactctgcggcaaacaagaacaaggctgtggagtgggaggagaacactctgtatgactacttgcttaatcctaagaagtacattcctggaaccaagatggtcttccctgggctgaagaagccacaggaccgtgctgatctcattgcgtacctgaagaaagccacctcctcttgaaagggcatgatgatgctatcatcttgtcatggcgagtgaattcattttgcagtaaaataagaagattagacattaatagtcactctggtttgatggggtgtgatccacgagacaattatcttgcgaatttcgttttcatgatatggctttcatatcactagtttagttggaagtctttgtcaatcttttgattcagttgctggaaaacaccagtgcgcacattttgaccaccaggtggcggtgggactggaatgcacacccatgttgatgaacatgagatctttaaagttgatataaagctttgtgcccttgttatggagtcgtcaaatctgcctcttttgttccgccatgttgcttgtcctatgtgtatgtccagtcgtgacttctatatcatttat

SEQ ID NO: 2776 - DNA, 601 bp, Secale cereale
agccagaaaggcgagcaaaagtttcacttggcctccccccctcgagtcctccggcgagtctctgcttctgcggcggcggcggcgatggcttccttctccgaggctccccccggcaaccccgacgccggcgccaagatcttcaagaccaagtgcgcgcagtgccacaccgtcgacgccggcgccggccacaagcaaggtccaaacttgcatggtctgtttgggaggcagtccggtaccaccgctggttactcctactctgcggcaaacaagaacaaggctgtggagtgggaggagaacactctgtatgactacttgcttaatcctaagaagtacattcctggaaccaagatggtcttccctgggctgaagaagccacaggaccgtgctgatctcattgcgtacctgaagaaagccacctcctcttgaaagggcatgatgatgctatcatcttgtcatggcgagtgaattcattttgcagtaaaataagaagattagacattaatagtcactctggtttgagtggggtgtgatccacgagacaattatcttgcgaatttcgttttcatgatatggctttcatatcactagtttagttggaagt

SEQ ID NO: 2777 - DNA, 710 bp, Acacia harpophylla
gtctctctctagttccgtccaccacccgaccttcctcaattcgcttctggcatattctattctcttattcctctttcctccctccatttttctccaactttcaccgtcctttccttggcttctctatcgtgttcaccaccaaacagctccagctatggcgtctttcgatgaggcacctcccggcaatcctcagtctggcgcgaaaatcttcaagaccaagtgcgctcagtgccatactgtggaaaaaagtgctggccacaagcaaggacccaatctaaatggtttgtttggaagacaatctggcactactcctggatattcctattctgcggcaaacaagaacatggctgtgatctgggaggaaaagactttatatgattacttgctcaaccccaaaaagtacattccaggaacaaagatggtgtttccgggtctcaagaagcctcaggaacgtgcggaccttattgcatacttgaaagaagccacttcacaatgatttagaaaacttgataccattagtcatatatgcattgtgtttttggagttccagagattgaattttcaaacttttagctcttctacaagtactatgtcttggaaaataaagtagactagatagattcacaatgctttttttgtctgtttggcattgccactcattgttatcccaatagggtttcttgactcaattttatcaaatattggaactg

SEQ ID NO: 2778 - DNA, 878 bp, Amsonia hubrichtii
cgtaaaaagccctaggaaggattctccaaacgctctctcgtggaagctgaagccccctaagtggttgtttggtgttgaatcggtgaaatggccagcttcgaacaagcaccacctggtgatgccaaagtcggagaaaagatcttcaagaccaagtgcgctcaatgtcacaccgtcgtcaaaggatctggtcacaagcaagggcccaatctgaatggccttttcggaaggcagtctggtacaactcctggctattcttactctgctgcaaacaagaacatggctgtcacatggggagagaatacgctctatgattatttgcttaaccccaagaagtacattcctggaaccaagatggtttttcctggattgaagaagccacaggaccgggcagatctcattgcttacctcaaggagtcaactgctgcttgaatgaagacttgcgtcatttgagcatgatacaaaaatagcaacggataaaagatttttgtcattagtaacagtttgaaattctttttcccgagaaacttagtcatctacccgattgaataagaccaagaaggtcttcacattgcttttctctggttgagctaaaggtcagggccagtagtaaagcattttggttgcacttgatctaatgattttttgaactcctttgctcgttatgcaccttcggagaaactaattatttggattgcaattattccatacttgagtttcttaaattggctgatcccttaatttcaaattccggatcacacggagacacgacacatgcacgtatctgtgggttgtgcaactttacatgcttgtgtattatgtgcacaagacattctggggacttccaccctttggattgttcaacgtttgacatatgtgga

SEQ ID NO: 2779 - DNA, 710 bp, Hordeum vulgare
aaaagtttcacttggcctccccccctcgagtcctccggcgagtctctgcggcggcggcggcgatggcttccttctccgaggctccccccgggaaccccgacgccggcgccaagatcttcaagaccaagtgcgcgcagtgccacaccgtcgacgcgggcgcgggccacaagcaaggtccaaacttgcatggtctgtttgggaggcagtcgggcaccaccgctggttactcctactctgcggcaaacaagaacaaggctgtggagtgggaggagaacactctgtatgactacttgcttaatcccaagaagtacattcctggaaccaagatggtcttccctggtctgaagaagccacaggaccgtgctgatctcattgcgtacctgaagaaagccacctcctcttgaaagggcatgatgctgtgatcatgtcattacgagtgaattcattttgcagtaaaataataagattagacattaatagtcactctggtttaatggggtgggtgatccacgagacaattatcttgcgaatttcgtttttatgatatgggtttcatatctctaggtttagttggtaaaatcttcgtcaatcttttgattcagttgctggaaaatcccagaacgcatgttttgaccaccaggtggcggtgggactggaatgcacacccatgttgatgaacatgagatctttaaaattgatatataaagctt

SEQ ID NO: 2780 - DNA, 1000 bp, Hordeum vulgare
aaacgcccccgcccacgtgcccgatgcacccgagacctcaggggcagtcttgtacttccgcaccgttagaccggtctatacaacacatcccccacgaaatcgcccgcagccagaaaggcgagcaaaagtttcacttggcctccccccctcgagtcctccggcgagtctctgcggcggcggcggcggcgatggcttccttctccgaggctccccccgggaaccccgacgccggcgccaagatcttcaagaccaagtgcgcgcagtgccacaccgtcgacgcgggcgcgggccacaagcaaggtccaaacttgcatggtctgtttgggaggcagtcgggcaccaccgctggttactcctactctgcggcaaacaagaacaaggctgtggagtgggaggagaacactctgtatgactacttgcttaatcccaagaagtacattcctggaaccaagatggtcttccctggtctgaagaagccacaggaccgtgctgatctcattgcgtacctgaagaaagccacctcctcttgaaagggcatgatgctgtgatcatgtcattacgagtgaattcattttgcagtaaaataataagattagacattaatagtcactctggtttaatggggtgggtgatccacgagacaattatcttgcgaatttcgtttttatgatatgggtttcatatctctaggtttagttggtaaaatcttcgtcaatcttttgattcagttgctggaaaatcccaggacgcatgttttgaccaccaggtggcggtgggactggaatgcacacccatgttgatgaacatgagatctttaaaattgatatataaagctttctgcctgtgttatggaattgtcaaatctggttctctattctgccatgttgctcgtcctatgtgtatttccagtcgtgactcttaccattggctgatggtgagtatatgtcttttgctatttaaacttccattttgtggtagtttgagggcgcttgtttgggct

SEQ ID NO: 2781 - DNA, 692 bp, Secale cereale
gaaaagttcacttggccttccccctcgagtcctccggcgagtctctgcttgcgcgcgtgcggcggcggcgatggcttccttctccgaggctccccccggcaaccccgacgccggcgccaagatcttcaagaccaagtgcgcgcagtgccacaccgtcgacgccggcgccggccacaagcaaggtccaaacttgcatggtctgtttgggaggcagtctggtaccaccgctggttactcctactctgcggcaaacaagaacaaggctgtggagtgggaggagaacactctgtatgactacttgcttaatcctaagaagtacattcctggaaccaagatggtcttccctgggctgaagaagccacaggaccgtgctgatctcattgcgtacctgaagaaagccacctcctcttgaaagggcatgatgatggcgagtgatcttgtcatggcgcgtgaattcattttgcagtaaaataagaagattagacattaatagtcactctggtttgatggggtgtgatccacgagacaattatcttgcgaatttcgttttcatgatatggctttcatatcactaggtttagttggaaatctttgtcaatcttttgattccgttgctggaaaaccccagtgcgcacattttgaccaccaggtggcggtgggactggaaagcacacccatgttgatgaacatga

SEQ ID NO: 2782 - DNA, 879 bp, Triticum aestivum
tagtccagaaaggcgagcaaaagtttcacttggcctccccaacctcgtgtcctccggcgagtctctgcggcggcggcggcgatggcttccttctccgaggctccccccggcaaccccgacgccggcgccaagatcttcaagaccaagtgcgcgcagtgccacaccgtcgacgcgggcgccggccacaagcaaggtccaaacttgcatggtctgtttgggaggcagtcgggtaccaccgctggttactcctactctgcggcaaacaagaacaaggctgtggagtgggaggagaacactctgtatgactacttgcttaatcctaagaagtacattcctggaaccaagatggtcttccctgggctgaagaagccacaggaccgtgctgatctcattgcgtacctgaagaaagccacctcctcttgaaagggcatgatgatgctatgatcttgtcatggcgagtgaattcattttgcagtaaaataagaagattagacattaatagtcactctggtttgatggggtgtgatccacgagacaattatcttgcgaatttcgttttcatgatatgggtttcatatcactaggtttagttggaaatcttcgtcaatcttttgattcagttgctggaaaaccccagtacgcatgttttgaccaccaggtggcggtgggactggaatgcacacccatgttgatgaacatgagatctttaaaattgatataaagctttctgcctgtgttatggagtcgtcaaatctgaccctttattctgccatgttgcttgtcctatgtgtatttccagttgtgacttttaccatgtagactttcattcatatgtcctgtgggcgtttccgtatctgtactctcgaaaatttcaagtat

SEQ ID NO: 2783 - DNA, 981 bp, Triticum aestivum
acagccagaaaggcgagcaaaagtttcacttggcctcccccctcgagtcctccggcgggtctctgcttgcgtgcgtgcggcggcggcgatggcttccttctccgaggctccccccggcaaccccgacgccggcgccaagatcttcaagaccaagtgcgcgcagtgccacaccgtcgacgcgggcgccggccacaagcaaggtccaaacttgcatggtctgtttgggaggcagtcgggtaccaccgctggttactcctactctgcggcaaacaagaacaaggctgtggagtgggaggagaacactctgtatgactacttgcttaatcctaagaagtacattcctggaaccaagatggtcttccctgggctgaagaagccacaggaccgtgctgatctcattgcgtacctgaagaaagccacctcctcttgaaagggcatgatgatgctatgatcttgtcatggcgagtgaattcattttgcagtaaaataagaagattagacattaatagtcactctggtttgatggggtgtgatccacgagacaattatcttgcgaatttcgttttcatgatatgggtttcatatcactaggtttagttggaaatcttcgtcaatcttttgattcagttgctggaaaaccccagtacgcatgttttgaccaccaggtggcggtgggactggaatgcacacccatgttgatgaacatgagatctttaaaattgatataaagctttctgcctgtgttatggagtcgtcaaatctgaccctttattctgccatgttgcttgtcctatgtgtatttccagttgtgacttttaccatgtagactttcattcatatgtcctgtgggcgtttccgtatctgtactctcgaaaatttcaagtataaatgtgagaatcgaagtaaccagtgctcatcactacccaccaaacattgtatggaattaccatgataaactctagctagtacttcctccgttcc

SEQ ID NO: 2784 - DNA, 596 bp, Cicer arietinum
cctaaccttcgttttctttgcggagaaatcaaccaatggcttcgtttgaacaagcacctgccggtgatgccaaagccggagacaaaatctttagaaccaaatgtgctcagtgccacaccgttgacaaaggtgctggccacaaacaagggcccaatctgaatggtttgtttggaaggcaatcaggtaccactcccggatattcctactcagcagctaacaagagcatggctgtgacctgggaggaaaagaccttgtatgattacttgcttaaccccaaaaagtatattccagggaccaagatggtatttcctggtcttaagaagccccaagaacgtgctgaccttattgcatatctgaaggaagccacagcatagtgattatatactttcatacattcaatttttacagtgattttgaagttctggaggtttaattttcagaattttagtaatgctgagcagttagtactgtatctttggcaaataaagtaggttatattggttcgcaatgctattttgctgattgtgcattgcttgtcaaaaagcccccaaatattggctggctggagctacactcaagcaaattttttattgaat

SEQ ID NO: 2785 - DNA, 376 bp, Flaveria ramosissima
ggcggcgagtgtgtgtgttacctgaaaatggcgtcattcgatcaagcaccaccaggcgatgctaaagcaggggagaagatattcaaaaccaagtgcgctcagtgtcacaccgtcgagaaaggggccggacacaagcaagggccaaatttgaatggtctttttggaaggcagtctggcaccacagcaggatattcttattctgctgccaataagaatatggctgtgatctgggaagaaaatacactctatgactacttgctaaacccaaagaagtacattcctggaacaaagatggtattttctggactgaagaaaccacaggatcgggctaatcttattgcgtatttgaagcagtctactgcttgagttcatcaag

SEQ ID NO: 2786 - DNA, 581 bp, Allium cepa
ctacgaaaaagaatggcctcattttctgaagctccgcctggaaacgagaaatcaggagagaagatcttcaaaactaagtgcgctcaatgtcactctgtcgaaaaaggggctggccataaacaaggtcctaatttgaatggattgtttggaaggcagtctggaacagctgctggatattcgtattctgctgcgaacaagaacaaggctgtggtttgggaggaaaatacattgtacgagtacttgcttaatccaaaaaagtatatccctggaacaaagatggtgttccctggtctgaagaagccacaggaccgtgcagatctgattgcatacctcaaaaaggctacagcttgattttctgaatcaactttgtaatctgtttgtagctaatgaggcctctaggattcgctatgatcgtaaacaagctaaagacttcgccttgatagcatttatttattttgcgattcatgttgtaaaagagtggtgtatctttatgtttgtattgtgtatttgaaaagtttcattacttgttgaacattcatgtgattatgttatatgcttgtacgattatgtttaactgcggc

SEQ ID NO: 2787 - DNA, 629 bp, Allium cepa
aacaaataaatacttgtaacccaagggctctgatttgatcggaaatggcgtctttcgctgaggctcctcctggaaacaagactgctggggagaagatcttcaagactaagtgcgctcaatgtcatactgttgaacaaggcgctggacataagcaagggccaaatttgaacggtctttttggaaggcagtctggaacagcagctggttattcatactctgctgcgaacaaaaccaaagctgtggtttgggaagagagtactttgtatgattacttgttgaatcccaagaagtatattcctggaacaaagatggttttccctggtctgaagaaacctcaggatcgtgcggatctaattgcatatctcaaggaatctacagcttaaactttgtcttcttaatcatttaccattgatttttgcgtaataagatcacttagtttctcctcctttgctttgaatgccgagcgttggagatgaaaggaaaaaagaaaacaattcattttttatgttatcactagcaaatgtctagagagattctaatgaggattgtatctttactcattttgtccgttataacttgcctggattatgatggcagatacactattttttgctgataccgtgttatga

SEQ ID NO: 2788 - DNA, 603 bp, Allium cepa
cctacgaaaaagaatggcctcattttctgaagctccgcctggaaacgagaaatcaggagagaagatcttcaaaactaagtgcgctcaatgtcactctgtcgaaaaaggggctggccataaacaaggtcctaatttgaatggattgtttggaaggcagtctggaacagctgctggatattcgtattctgctgcgaacaagaacaaggctgtggtttgggaggaaaatacattgtacgagtacttgcttaatccaaaaaagtatatccctggaacaaagatggtgttccctggtctgaagaagccacaggaccgtgcagatctgattgcatacctcaaaaaggctacagcttgattttctgaatcaactttgtaatctgtttgtagctaatgaggcctctaggattcgctatgatcgtaaacaagctaaagacttcgccttgatagcatttatttattttgcgattcatgttgtaaaagagtggtgtatctttatgtttgtattgtgtatttgaaaagtttcattacttgttgaacattcatgtgattatgttatatgcttgtacgattatgtttaactgcggcagggttttagcacttggtcaa

SEQ ID NO: 2789 - DNA, 673 bp, Allium cepa
tacgggggtatttgaaaaataagctgtatacaaacaaataaatacttgtaacccaagggctctgatttgatcggaaatggcgtctttcgctgaggctcctcctggaaacaagactgctggggagaagatcttcaagactaagtgcgctcaatgtcatactgttgaacaaggcgctggacataagcaagggccaaatttgaacggtctttttggaaggcagtctggaacagcagctggttattcatactctgctgcgaacaaaaccaaagctgtggtttgggaagagagtactttgtatgattacttgttgaatcccaagaagtatattcctggaacaaagatggttttccctggtctgaagaaacctcaggatcgtgcggatctaattgcatatctcaaggaatctacagcttaaactttgtcttcttaatcatttaccattgattttttgcgtaataagatcacttagtttctcctcctttgctttgaatgccgagcgttggagatgaaaggaaaaaagaaacattcattttttatgttatcactagcaaatgtctagagagattctaatgaggattgtatctttactcattttgtccgttataacttgcctggattatgatggcagatacactattttttgctgataccgtgttatgataattgttatttt

SEQ ID NO: 2790 - DNA, 639 bp, Allium cepa
ccgcgaccgcataataaggaagaggtgagttaaaaggcagagaaagaaaactaaagaaagccctacgaaaaagaatggcctcattttctgaagctccgcctggaaacgagaaatcaggagagaagatcttcaaaactaagtgcgctcaatgtcactctgtcgaaaaaggggctggccataaacaaggtcctaatttgaatggattgtttggaaggcagtctggaacagctgctggatattcgtattctgctgcgaacaagaacaaggctgtggtttgggaggaaaatacattgtacgagtacttgcttaatccaaaaaagtatatccctggaacaaagatggtgttccctggtctgaagaagccacaggaccgtgcagatctgattgcatacctcaaaaaggctacagcttgattttctgaatcaactttgtaatctgtttgtagctaatgaggcctctaggattcgctatgatcgtaaacaagctaaagacttcgccttgatagcatttatttattttgcgattcatgttgtaaaagagtggtgtatctttatgtttgtattgtgtatttgaaaagtttcattacttgttgaacattcatgtgattatgttacatgcttgtacgattatgtttaactg

SEQ ID NO: 2791 - DNA, 628 bp, Eutrema halophilum
cacacaaaccctaaagaatctttccaaattcctaaaagctccaaagaagcgagatccgtgttcattttctcttgttgtttcccgttccgttgccggcgaaaatggcgtcgtttgacgaagcaccaccagggaaccccacggccggtgataagatcttcaggctcaagtgtgctcagtgccacaccgtcgaaaaaggcgccggtcacaaacaaggaccgaatctaaacggtctctttggaagacaatcgggcacaaccgctggttactcttactctgctgctaacaagaacaaagctgtggaatgggaagagaagaccttgtacgattacttgcttaaccctaagaagtacattcccggaacgaagatggtcttccctgggctgaagaagccacaagaccgcgctgatctcatcgcctacttgaagaatgctactgcctagtgaatcaatggtgtgggacgtgacgatttcgattcccgaagattggatattcttttgacaaataaaaatctcaaaacttttgtttttgtttttttggaaatgccctcatcttcaattacgttttggtgagaatttggctgtcgagttccaaacgcactcgagtacttccgtttttatttgaaaccatt

SEQ ID NO: 2792 - DNA, 699 bp, Arnica chamissonis
gaaatcacaaaatggcgtcattcgaacaggcaccggccggcgatgctaaatccggagagaagattttcagaaccaagtgcgctcagtgccataccgttgataaaggcgctggccacaaacaagggccgaatttgaacggtctttttggaagacagtctggtactactgcagggtattcttattctgctgccaataagaacatggctgtgatatggggagagaatacactctatgactacttgcttaaccctaagaagtatattcctggaacaaagatggtttttcctggactgaaaaaaccacaggaccgggctgatctcattgcttacctgaagcaatcaacctcttgatttttggggcggtaacaagtttggtaacgagtttactttcatcgtttacaaaaacaacaatgttttgttacattcatatgaccattcattgttttgaacccgaacgatttgttacgcttgacattacccgtgtcactctttctaggagatgattgttatgttttcaaataaaatgtgaagtctttgattttggcttcttgtatctttcttatttgtattcatattgggttctgctgctgggtacgcggagctatatattttaaaaggaggacattaggttaggaggatccatgtgttctgaggagggtcaggtctggaccaaaccattgtaagttctaaaatgaaagat

SEQ ID NO: 2793 - DNA, 782 bp, Ocimum basilicum
catttcggactcttctgcgggaaaatctgaatcgagatggcttcgttcgaggaagcaccgcctggaaacaaagacgccggagcgaagattttcaagaccaagtgcgctcagtgccataccgtggagaaaggagctggccataagcaaggacccaacctaaatggcctctttggaaggcagtctggaaccacacccggttattcctactctgctgctaacaagagcatggctgttatttgggaagaaaagaccctctacgattacttgttgaatcccaagaagtatattccaggaacaaagatggttttcccgggattgaagaaacctcaagatcgtgcagatcttattgcttatctgaaggagtcgacggcttgagtgtgtgcatttgttttgaacttctatcattttgcagatgaggctacatttcctacggggagcaaaaaaaacatattctcttcaataaattccttttaactagtttcaaatcctcttctaagaggtcctggtttttgtcggatggaaataatcttccagttgaatcagtacattctattgtttagtacattctagagttaaaactcttggtgattacatgaatggatctctttcagtccttcggggaaacttgttcaaattgagcatgctttgactgcagttggatccggccaaacatccttaggaattaaagctgctaacggcgttgttattgcaactgagaagaaactgccttctattttatttgatgaaatatctgtgcagaagattccagcttttggacacaa

SEQ ID NO: 2794 - DNA, 531 bp, Bruguiera gymnorhiza
ggactgattcattaatacaaattacaaaccctagaaaaagcccaaagaaaggttaatcgatatccgcagagagagaggtgggcaattaattgagaatggcgtcgtttcaggaagcaccacccggcgacgtaaaggccggagagaagatcttcaggactaagtgcgctcagtgccacaccgccgaaaagggcgccggccacaaacaaggacccaatttgaatggtctttttggaaggcaatctggcacaactgctggttattcctattccgctgctaacaagaacagggctgtgatttgggaagagaacacattgtatgactatttgctgaacccgaaaaagtatattcctggaactaagatggtgttccctggattgaagaagccaaaggagcggacagatctcattgcttatctcaaggaatcaactgcctgatattcttgattttactaggattccttccaattatgcccaaaatggattttcctttttgaaagtaagatgaatctttccttgtttaaaataacacctg

SEQ ID NO: 2795 - DNA, 646 bp, Cicer arietinum
tgcaggattcgaatcccaaacctaaacctaaccttcgttttttttgcggagaaatcaaccaatggcttcgtttgaacaagcacctgccggtgatgccaaagccggagacaaaatctttagaaccaaatgtgctcagtgccacaccgttgacaaaggtgctggccacaaacaagggcccaatctgaatggtttgtttggaaggcaatcaggtaccactcccggatattcctactcagcagctaacaagagcatggctgtgacctgggaggaaaagaccttgtatgattacttgcttaaccccaaaaagtatattccagggaccaagatggtatttcctggtcttaagaagccccaagaacgtgctgaccttattgcatatctgaaggaagccacagcatagtgattatatactttcatacattcaatttttacagtgattttgaagttctggaggtttaattttcagaattttagtaatgctgagcagttagtactgtatctttggcaaataaagtaggttatattggttcgcaatgctattttgctgattgtgcattgcttgtcaaaaagcccccaaatattggctggctggagctacactcaagcaaattttttattgaattaaaaaaaaagaattcgaatcctg

SEQ ID NO: 2796 - DNA, 576 bp, Cryptomeria japonica
gatagaaagtggctgattagggttcggcgcatagcgcagcgcagggatggcatccttcgcagaggctccccctggcaatgaaaaggcaggagagaagattttcaagaccaaatgtgcacagtgtcatacagttgacaagggcgctggtcacaagcaagggccaaatcttaatgggctgtttggaagacaatctggaaccactgctggctattcctattcggctgccaacaaaagcaaggcagtgatctggggagaggacgccctttacgagtatctcctcaatcctaaaaagtacattcctggaactaagatggtgtttcctggtttgaagaagccacaagaccgagttgatcttattgcatatctcaagaagtctaccgactagttgaatcgaaaatctttttgaaatatattacctgatatggcattattttcatttgggaaattaggctaatgctgaacagcaggttgctgtatgatgaggtgatacacattcgtttttttttagttaaaatgataatgagttcccaaaatgggtgtttttttctatttatgtgacgaggaagaatttaatgg

SEQ ID NO: 2797 - DNA, 692 bp, Taraxacum officinale
ggtaaagaacgagaaggtctcgaaagctttcgtgctctctgtaaaagtcgaaaccctaactctcgaagcttccatcggcggcgtttgtgtgaccggaaaatggcgtcattcgaacaagcaccaggaggcgatgctaaagtaggagagaagatattcaaaaccaagtgcgctcaatgccacaccgtcgaaaaaggagctggccacaagcaaggcccaaatttgaacggtctttttggaaggcagtctggcaccacagcagggtattcttattctgctgccaacaaaaacagggctgtggtttgggaggaaaatacactctatgactacttgctaaaccctaagaagtacatccctggaacaaagatggttttccctggattaaagaaaccacaagaacgggcggatcttattgcatatttgaagcagtcaaccgcttaatttcttttttttcggcctctgattattggggcttaaagtcatagtaaggtttggaccttcttatttacatgaatagtgaattttgtttcaaatggctttgtgatgttgctgacatggcttcatgggcatttatattcctaggtttcgggtatttgttttgtgagtggacttatcgtaagaaatactttgcgaaaaacatgatttgtggggtattggaatttagaaccactagaaattaaatattttggtagaaa

SEQ ID NO: 2798 - DNA, 675 bp, Fagopyrum esculentum
agcgtgtggctgcggcacgagcgggcacatgatatagatgcgcgtttgacaactcggagcacaagtttgtatcccttttcaaacatctgcttgtccaaaccctagactttcagaaatcgcatccatggcatccttcagcgaagctcctcccggtgacctcaaatctggagagaagatcttcaagatgaagtgtgcccaatgccacacagttgaaaaaggcgctggtcacaaacaaggtcctaatcttaacggtcttttcgggaggcagtcaggaacaactgcagggtactcatactctgctgctaacaagaacaaggctgttacttggggagaggacacattgtatgattacttgttgaatcctaagaagtacatccctggaacgaagatggttttcccagggttgaagaagcctcaggagcgcgcagaccttattgcatatctgaaggactcaacacagtaaatttcttgtttaacaaatatgatactgtggtttttatttaggtgaagtagacgaatttcccttataatacccaacatttacgtctcaaagagacaggagagaaactattttttgctgtcaaataaatgtactgccgttaccctagtttgcggttgacaaactagccaaacattatttggaagagcgatttatgatacattggtggaggcttt

SEQ ID NO: 2799 - DNA, 729 bp, Lactuca sativa
gataaaacacctgtaaaagaaagaagaaagttctcgaaaggcggtgtcgtctctgtaaaagtcgaaaccctaactcttgaagattcttattggcggcgtttatttcaccggaaaatggcgtcattcgaacaagcaccaggaggcgatgctaaagtcggagagaagatattcaaaaccaagtgcgctcagtgccacaccgtcgaaaaaggagccggtcacaagcaagggccaaatctgaatggtctttttggaaggcaatctggcaccacagcagggtattcttattctgctgccaacaagaacatggctgtgacctggggagagaatacactctatgactacttactaaaccctaagaagtatatccctggaacaaagatggttttccctggattgaagaaaccacaagatcgagctgatcttattgcttatttgaagcaatcaacttcttgaatgataagatttcattccttttattttcaatgggacttaactacatcacatactgacttttgttgcaaataacttcatgtcatgttggacatggcttcatggacatacatgcatgttcctaggtttcaggtttcccttttatgaggcacttattgtagtttttgtgtcgaattagaacaaatactttgggaaacaagatttatatcttttgtttggtggcaaatggcaatggcatgttgggtttaatataaattggtaagaatgcaacatctgcga

SEQ ID NO: 2800 - DNA, 1043 bp, Lactuca sativa
tttgaagtgagggcataaatgtctcatggcgtgtgccgcgtcaataaagccacgatcctttatgtaaacgccataaaacacctgtaaaagaaagaagaaagttctcgaaaggcggtgtcgtctctgtaaaagtcgaaaccctaactctttaagattcttattggcggcgtttatttcaccggaaaatggcgtcattcgagcaagcaccaggaggcgatgctaaagtcggagagaagatattcaaaaccaagtgcgctcagtgccacaccgtcgaaaaaggagccggtcacaagcaagggccaaatctgaatggtctttttggaaggcaatctggcaccacagcagggtattcttattctgctgccaacaagaatatggctgtgacctggggagagaatacactctatgactacttactaaaccctaagaagtatatccctggaacaaagatggttttccctggattgaagaaaccacaagatcgagctgatcttattgcttatttgaagcaatcaacttcttgaatgataagatttcattccttttattttcaatgggacttaactacatcacatactgacttttgttgcaaataacttcatgtcatgttggacatggcttcatggacatacatgcatgttcctaggtttcaggtttcccttttatgaggcacttattgtagtttttgtgtcgaattagaacaaatactttgggaaacaagatttatatcttttgtttggtggcaaatggcaatggcatgttgggtttaatataaattggtaagaatgcaacatctgcgtattatatggtgacaccttatgataatggttaaaaggctaatggaaatatgaggttagaaatgataggacacaaaatgatgtgtgtcacccgtttgaaattcactatgaatgttattggtgtgggtgctttaatacataatatagtcaatgactaaaatatagttatatttgatgcaaataatgattcctacagaacatattgctccatgttaacatccgctataataataatgataaagacaa

SEQ ID NO: 2801 - DNA, 596 bp, Sciadopitys verticillata
gtttattgtgtttgtgtttgatagcgttgtgtaagcaataagcaaacatggccacattctcggaggctcctcctggcgatgaaaagtccggagagaagatcttcaagaccaaatgcgcgcagtgtcatacggtcgacaagggcgccggccataaacaagggccgaatctgaatgggctgtttgggagacaatctggaaccacggctgggtattcatattctgccgccaacaagaacaaggctgtgaactgggaagaagaaacactatatgagtatcttctcaatcctaaaaagtacattcccggaactaagatggtatttcctggtttgaagaagccaaaagagcgtgctgatctgattgcatatctcaagcaggccacatcctagtttagtcaaaaatatcattttaaaatatatttctggatggtatcatccatagctacttgtttcgaagaattcattcgggagattaggttaataatgaacaacactatgcactattgttgaggttaacattttttaataaattgagtcatgagtacctagaatgggcacttttttcaatgcattatttatgtgataacaaatgacaatacc

SEQ ID NO: 2802 - DNA, 714 bp, Camellia sinensis
tcaatctccttcttccgcgttgttgaagaaaccctagcaaatcatcttcgaatttgaatcgagagtgctctactttctctctcttgcttctgcgtcgacaatggcgtctttcgatcaagctcctcctggcgactccaaatctggagagaagatcttcaggaccaagtgcgctcagtgccacaccgtcgaaaaaggcgctggccacaaacaaggaccaaatttgaatggccttttcggaaggcagtctggcaccactcctgggtattcatactctaatgctaacaagagcatggctgttaattgggaagagaaaacactgtatgattacttgcttaacccaaagaagtacatccctggaaccaagatggttttccctggactgaagaagccacaggagcgtgctgacctcatagcatatctgaagcaggcaacttcctgattcttttgcctcatatattaaggcatttatattttgcggcagttggaaagagtttggtaactcgtcgctagtttggaattctttttcctgaactttagatactacctatttgtttaaataagactgttaaggtctctgctatgctattcttcggttatctgatccgatattgagaaatttttttgtcaatttacatgttcctcagatgattagatctcatacctaatttctttgtcacgataaaggaatgaaaagacatggttccattttatgcg

SEQ ID NO: 2803 - DNA, 487 bp, Allium cepa
aaaataagctgtatacaaacaaataaatacttgtaacccaagggctctgatttgatcggaaatggcgtctttcgctgaggctcctcctggaaacaagactgctggggagaagatcttcaagactaagtgcgctcaatgtcatactgttgaacaaggcgctggacataagcaagggccaaatttgaacggtctttttggaaggcagtctggaacagcagctggttattcatactctgctgcgaacaaaccaaagctgtggtttgggaagagagtactttgtatgattacttgttgaatcccaagaagtatattcctggaacaaagatggttttccctggtctgaagaaacctcaggatcgtgcggatctaattgcatatctcaaggaatctacagcttaaactttgtcttcttaatcatttaccattgattttttgcgtaaataagatcacttagtttctcctcctttgctttgaatgccgagcgttg

SEQ ID NO: 2804 - DNA, 345 bp, Sequoia sempervirens
gaaaaatggcgtcgttttctgaagctccacctggcgatccaaaggtcggagagaagatcttcaaaaccaagtgcgctcagtgccacaccgtcgacaaaggcgctggtcacaagcaaggtcccaatctgaatggcttgttcggaaggcagtctggtacaactcctgggtactcctattcaactgctaacaagaacatggctgtgaattgggaggaaaagacattgtatgattacttgctgaaccccaaaagtacattcctgggactaagatggtattccccggctgaagaagccacaggatcgggctgacctcatttcatatttgaagcaatctactgcatcttaa

SEQ ID NO: 2805 - DNA, 453 bp, Triticum aestivum
agcagaagttgcggttgtacttttcttcctccgccgtcggctcagatctctgcgtgcgggctagcgatggcgtcgttctcggaggctcccccagggaacccaaaggcgggcgagaagatcttcaagaccaagtgcgcgcagtgccacacagtcgagaagggcgccggccacaagcaaggtccaaacttgaatggtctttttgggaggcagtcgggtaccaccacaggctactcctattccgcgggaaacaaaaacaaggctgtggtctgggaggagaacactctgtatgactacctgcttaaccctaagaatacattcctggaaccaagatggtgttccctgggctgaagaaccgcaagaacgtgctgatctcattgcgtacctgaaggaacaactgcgtagtataatgacatcctttgccatgaagagaaacgttttgcaatttaataatga

SEQ ID NO: 2806 - DNA, 476 bp, Triticum aestivum
agcagaagttgcggttgtacttttcttcctccgccgtcggctcagatctctgcgtgcgggctagcgatggcgtcgttctcggaggctcccccagggaacccaaaggcgggcgagaagatcttcaagaccaagtgcgcgcagtgccacacagtcgagaagggcgccggccacaagcaaggtccaaacttgaatggtctttttgggaggcagtcgggtaccaccacaggctactcctattccgcgggaaacaaaaacaaggctgtggtctgggaggagaacactctgtatgactacctgcttaaccctaagaatacattcctggaaccaagatggtgttccctgggctgaagaaccgcaagaacgtgctgatctcattgcgtacctgaaggaacaactgcgtagtataatgacatcctttgccatgaagagaaacgttttgcagtttaataatgaacattttagacaattgggtcacc

SEQ ID NO: 2807 - DNA, 917 bp, Amsonia hubrichtii
cgataaagccagcctgacatttcttctgtcaaataataccgcaaaatcaagaactcctctcattctcatttgattctgtagaagaagaagagtagaaaaggacgatactagattattagcgaattactaaaatggcatcttttccaggcactccaggaaatcaaaaacggggagaaaatcttcaagaccaagtgtgctcaatgtcatactgttgataaaggagctggccataaacaaggacccaatttgaatggcctttttggaagacaatcaggaactactcctggttactcctattccgctgcaaacaagaatatggccgtcatttgggaggaaaagacactctatgattacttgctgaatccgaagaaatatatccctggaacaaagatggttttccccggactaaaaaagccacaggatcgtgcagacctcattgcatatttgaaggaagctacatcaaaatgatttcttgaacttctgttccatctcctttccatttttctgttgagagtggtgctacggttcatgcagaaaagacggatgaatcctcattttttcataataaagtggcattttaggtcttctttggttattgtagtttgctctttcagtttatgttgttatcccaggaaaacacaagcagcactggaatgaactgctccacatactatggacacaaatatatacatggacatgattggttatgttaaacttttcttagatgtcagtccttataatctttggagaaactgagatggtaggagcatagttgtcccttttgcttcctttcaacacgaggctagtttcgttgaaaggaacgcaacctctgctctgtgctagagtagcagacattcattctgttaaggagattgctcccatgctcagccatgtctttcgactaactggggaagttc

SEQ ID NO: 2808 - DNA, 685 bp, Cycas rumphii
gtggatccaaagtttttagtggcattgagtttcggggaacacggaggagcagagatcttgatatcattcatacaacgccgcaagaagttttgttaactctgaggaaatttagcgtgcatctgaagccatggcatcattctcagaggctcctcctggagatccagaggccggggaaaagatctttaagaccaaatgtgcgcaatgtcataccgtcgagaagggtgctggccacaaacaaggaccaaatctgaatggactattcgggaggcagtccggtacgactgcggggtattcgtattcagcaggcaacaaaaataaggctgtgatttggggagaggaaaccctgtacgagtaccttctcaatcctaagaagtatatacctggaactaagatggtatttccgggtttgaagaagccacaagagcgtgctgatctgattgcgtatctcaagcaagccacatcaccggattagtattatgctatagaataattaatggctgactatttatgatcttatctatatgatttttaattcgggagactcagtttgacaatatgggacagcagtctgccctattgttgaggtattgatattttttaataaatatgtttcagaggtgccctgaatgtggcccttttttatgtaggatttggtataaggagaatcatgatgatgtgagtaccc

SEQ ID NO: 2809 - DNA, 922 bp, Pinus pinaster
aaccgatgaatttggacacacgatactggtcatcggggttaatatggagtttagacaagaatacaagtgaggcagagatcaatatatatattacaagcgggcggtgcgtcttcccattaatatttacgagtttgtgaagcgctccgcccttctttcatcacaatcacaggttccatcaatggcgacattctcagaggctcctcctggagactcaaaggccggagagaagatcttcaagaccaaatgtgctcagtgccatacagtcgataagggcgctggacacaaacaagggccaaatctccatgggctatttgggaggcaatctggcaccactgcgggttattcatactctgctgccaataagaacaaggctgtggattggggagaggacactttgtacgagtaccttctcaatcctaaaaagtatatacctggaactaaaatggtattccctggtttgaagaagccacaagaacgtgctgatctcattgcatatcttaagaaagcgacatcctcggactaatcggaataccatgtttaaataaattgcttcagtttttcagtctaaagtattgtttctaagatttttcgtacgggagggcaggttttgcaatatggacatcaggctgtcctattgttgaggtcttaacattttttaaataaaaatgattctgttgtccctaaaatgtgggggcttaattgtagacaattaattgacacagaacatggaaggggaaattaccaggtatcacgttttgatatccgggaagtttatttgtgcacatgccaatggcagttcaatttcatttcataataacatttgtcactttcctatgttatgttgcttaaaaactaggttattttcaacggaacattgaagttagattcattttgcataagctttggtgaagatagagcatac

SEQ ID NO: 2810 - DNA, 610 bp, Eutrema parvulum
aattagaataaaatctaaatgaatttcgtggtggatattgattcttcacatcaataacgaatattcgactttatacgaggcaactcgcctcattaacaaagtaaaagaaaaacaaaaaccatacaaaaacgagttcatgaccatgatatatttaggtccgatttattttgttatctgtggaaagaaaaaaaatgcaccggaacagaggctgcttaaatcgaagcaagcttatgtgtctatgcagtaccttccttcaaataagcgatgagatcggcacgatcttgtggctttttcagtccagggaacaccattttcgtcccgggaatttaccttctttgggttcaacaagtaatcgtaaagagtcttctcctcccacatcacggccatgtttttgttggcagcagagtaagaataccctggagtggttccagattgccttccgaacaaaccattcaagtttgaacggaccttgtttgtgaccggcaccttggtcgacggtgtggcactgcgcacacttggttctgaagatcttctctccggtctttgagtttccgggaggagcttcattgaacgacgccatttgtgatcgagaatgaaaaaatctgaacgg

SEQ ID NO: 2811 - DNA, 789 bp, Amborella trichopoda
atttttgaacttcttttcgccttccttggcaataagcgcagagagctttcggctggtcttttctagggtttttaaagcgtccattgctagggtttcagatcctccgtttttaaggtttcctgcaaaaaatggccaccttcaatgaagctcctccaggcaatgataaggccggagagaagatcttcaagactaagtgcgctcagtgccacaccgtggataaaggagctggacacaaacaaggacccaacctgaatggtctctttgggaggcaatctggtacaactcctgggtattcttactcagctggaaacaagaacaaggctgtgatatgggaggagtcgactctctacgattacttgcttaacccaaagaagtatattccagggactaagatggtttttccaggtctgaagaagccgcaggagcgaactgatctcattgcttacctcaagggagccacatcctcctaagagaaagcatactgttttttcccatcattttctctcttcatttcaatatttttgcggctcccatggtgtggtttgaagcagagatactctactattttttcaacaataagtccttgttgggatctcaaattggctcttagaatcctagagagccatttctccttacattgtacatgtgaaactctactctctttttgtacccttataatttacattcgaactaggtgaatgtctactgtgaatgattgcatttaggaacgccattcctccattataaatctggattaatctctaattgattatcttagtcttcagaaag

SEQ ID NO: 2812 - DNA, 808 bp, Gossypium raimondii
ggggaggtatgaacttgataacaaaaaaatagatatattcttaggaagaataaagttaagaacgggtgctctaaaggaacggctactaatgcgccacatagaaaagggagggttgttggggttgccatttgcattggcattgttacgctactctttcaaatattattatattctcaaaataaccaattttgatttgctgaaacaaacaacgtaacccaaaaaagaagcgaagatggcatcctttgctcaagcaccgcgtggtgactcaaagtccggcgagaagattttcaagaccaagtgtgctcagtgccacaccgtcgaaaaagctgccggtcacaaacaaggacccaatctgaacggtctgttcggaaggcaatcgggtaccgctcctggttattcatactccgctgctaacaagagcatggctgtgatttggggggagaatactttgtatgactaccttctcaaccctaagaagtacatccctggaacaaaaatggttttccctggattgaagaagccacaggaacgtgctgatctcattgcatatttgaaggaatctacggcttcctaaatgggtttacaaaattcccattccattttgcagcctttagagaaatgattcttataataaagtagacatgcatgctctttctacaatgagcattccttcccttcctgccaaattgttacccttgagaagagtttgccatttctggcaaatctaaggctttttcattacttcctgaatttcttgtgatttaccagcatgctaattcatttttctttttttcattctcgaactttt

SEQ ID NO: 2813 - DNA, 853 bp, Avena sativa
aaggcgagcaaaagtttcccttggcctctcccctcgagtccacctgcggcgagtctctgcttgcgtccgtccggcggcggcgatggcttccttctccgaggctcccccaggcaacccggccgccggcgcgaagatcttcaagaccaagtgcgcgcagtgccacaccgtcgagcagggcgccggccacaagcaaggtcctaacttgcatggtctgtttgggaggcagtcgggtaccactgctgattactcctactccgctgcgaacaagaacaaggctgtggactgggaggagaacactctgtatgactacttgcttaatcctaagaagtacattcctggaaccaagatggtcttccctggactgaagaagccgcaggaccgtgctgatctcatcgcgtacctgaaggaagccacctcctcttaaaaggaaatgctgctatgatcttgccaggatgagagaattcgttttacagttaataaaaagattagaccgtactagtcactatggtttaacggggtgcagtccacgagacaattatcttttgaatattatttttacggtatggattccatatcactaggtttagttgcaaaaatctttgacaagcttttgattctgtcgctggaaaaccccagtacgcacattttgaccaccaggtggtggtcgttctggaatgcacccttgtcaatgaacttgagatcttcaaagttgtgatggctttctctctatgctattgagtcattgatgtcagtacggtatatgttttgatgtcgggtcatgtgttttaagtgtgattttgatgtttctgcttgagcagaatgatctatgtattacttgttggtttggtgcttg

SEQ ID NO: 2814 - DNA, 574 bp, Trifolium pratense
tctttcgatgaggcacctcccggaaaccctaccgccggtgacaagatcttcaggactaagtgcgctcagtgccacaccgtcgacaaaggcgccggccacaaacaaggacccaatctgaatggtttgtttggaaggcaatctgggacaactcctggatattcttattctgccgctaacaagaacaaggctgtggaatgggaggaaaagaccttgtatgattacttgcttaaccccaagaagtacatcccagggacaaagatggtatttccaggtctcaagaagccccaggaacgtgctgatcttattgcatatctgaaagaggccacttcaaaataatagaattttcatacatttttatgcagtatatgccgttagaacctggattttaattttcagacatttgattctgtggtgcaaataagcactttatcttggcaaataaagcagacttgaatagtttgcagtgctattttgtttcttttgcattgcattgcttcttgagggttgcgtatattgattggattaatattgaaacacattggcttttgagtgttgaaacattcttatcaaattt

SEQ ID NO: 2815 - DNA, 615 bp, Gossypium hirsutum
gccaattctcaaaataaccaattttgaggtttgctgaaacaaacaacgtaacccaaaaaagaagcgaagatggcatcctttgctcaagcaccgcgtggtgactcaaagtccggcgagaagattttcaagaccaagtgtgctcagtgccacaccgtcgaaaaagctgccggtcacaaacaaggacccaatctgaacggtctgttcggaaggcaatcgggtaccgctcctggttattcatactccgctgctaacaagagcatggctgtgatttggggggagaatactttgtatgactaccttctcaaccctaagaagtacatccctggaacaaaaatggttttccctggattgaagaagccacaggaacgtgctgatctcattgcatatttgaaggaatctacggcttcctaaatgggtttacaaaattcccattccattttgcagcctttagagaaatgattcttataataaagtagacatgcatgctctttctacaatgagcattccttcccttcctgccaaattgttacccttgagaagagttcgctatttctggcaaatctaaggctttttcattacttcctgaatttctggtgatttaccagcatgctaatt

SEQ ID NO: 2816 - DNA, 612 bp, Gossypium hirsutum
attctcaaaataaccaattttgatttgctgaaacaaacaacgtaacccaaaaaagaagcgaagatggcatcctttgctcaagcaccgcgtggtgactcaaagtccggcgagaagattttcaagaccaagtgtgctcagtgccacaccgtcgaaaaagctgccggtcacaaacaaggacccaatctgaacggtctgttcggaaggcaatcgggtaccgctcctggttattcatactccgctgctaacaagagcatggctgtgatttggggggagaatactttgtatgactaccttctcaaccctaagaagtacatccctggaacaaaaatggttttccctggattgaagaagccacaggaacgtgctgatctcattgcatatttgaaggaatctacggcttcctaaatgggtttacaaaattcccattccattttgcagcctttagagaaatgattcttataataaagtagacatgcatgctctttctacaatgagcattccttcccttcctgccaaattgttacccttgagaagagtttgccatttctggcaaatctaaggctttttcattacttcctgaatttcttgtgatttaccagcatgctaatttcg

SEQ ID NO: 2817 - DNA, 1038 bp, Lolium multiflorum
gagcaaaagtttcacttgccttctctctctctcccctcgagtcgagtcctcccggcgagtctctgcggcggcggcggcgatggcttccttctccgaggctccccccggcaacccggccgccggcgccaagatcttcaagaccaagtgcgcccagtgccacaccgtcgagcagggcgccggccacaagcaaggtcccaacttgcatggtctgtttgggaggcagtcgggtaccaccgctggttactcctactctgcggcaaacaagaacaaggctgtggagtgggaggagaacactctgtacgactacttgcttaaccctaagaagtacattcctggaaccaagatggtcttccctggactgaagaagccacaggaccgtgctgatctcattgcgtacctgaaggatgccacctcctcttaaaagaacatgctgccataatcttgtcggaatgagagaattcgttttacagttaataaaaagattagacgttactatccactctggttttacagggtgcagtccacgagacaattatcttttctgagcattcatgtttatgatatgggttccgtatcactaggtttagttgcaaaaatctttgacaagcttttgattcagctgctggaaaatccagtacacacattttgaccaccaggtggtggtggaactggaatgcacccatgttaatgaacatgagatctttaaagttgtgatgttaaagctttctgcctatgtgagtcttcgaagtctatgtttcgatgttgtgtcttgtgtttatttccagttgtggttttgatgtttctgcttgtgccaaatggtctgctgttacttgtttgaagtattgttgcattcccagtttatgctggttcgtaccaggctgttgacagtggacctctgagcagatcaagcttgacatgctcgtgctcaagaaccagatcttcttttgctgctgtcaagctgcttgttgcctcatgtggtaggctggagctccagcaactgcgtcaagcaggccacgagtggctgctttggcgatgtgt

SEQ ID NO: 2818 - DNA, 379 bp, Lotus japonicus
tttctgtgtcggcttctccaatggcgtcattcgatgaggcaccacccggagacaccaaggctggtgagaagatcttcaagatcaagtgcgcgcagtgccacaccgtcgaccaaggtgccggtcacaaacaaggacccaatctgaatggtttgtttggaaggcaatctggcacaactcctggatattcctattctgcagctaacaagaacatggctgtgatttgggaggagaagaccttgtatgattacttgcttaaccccaaaaagtacattccagggacgaagatggtgtttcctggtctcaagaagccacaggatcgtgctgatctgattgcatatctgaaacaatccactgcacaatgattgaatttccacacatt

SEQ ID NO: 2819 - DNA, 848 bp, Avena sativa
aaggcgagcaaaagtttcccttggcctctcccctcgagtcccctgcggcgagtctctgcttgcgtgcggcggcggcgatggcttcgttctccgaggctcccccaggcaacccggccgccggcgcgaagatcttcaagaccaagtgcgcgcagtgccacaccgtcgagcagggcgccggccacaagcaaggtcctaacttgcatggtctgtttgggaggcagtcgggtaccactcatggttactcctactccgcggcaaacaagaacaaggctgtggactgggaggagaacactctgtatgactacttgcttaatcctaagaagtacattcctggaaccaagatggtcttccctggactgaagaagcctcaggaccgtgctgatctcatcgcgtacctgaaggaagccacctcctcttaaaaggaaatgctgccataatcttgtcaggatgagagaattcgttttacagttaataaaaagattagacggtactagtcactctggtttaacggggtgcagtccacgagacaattatcttttgaatattatttttatggtatggattccatatcactaggcttagttgcaaaaatctttgacaagcttttgattctgtcactggaaaatcccagtacgcacattttgaccaccaggtggcggtcgttctggaatgcacccttgtcaatgaacttgatatcttcaaagttgtgatggctttctctctatgctattgagtcattgatgtcagtacggtatatgttttgatgtcgggtcatgtgttttaagtgtgattttgatgtttctgcttgagcagaatgatctatgtattacttgttggtttggtgcttg

SEQ ID NO: 2820 - DNA, 657 bp, Arachis hypogaea
tcttctgtgccattagtttagttttcacattctcattcccttttcccgagaaaacaaacgcagcattaatggcgtcttttgaccaggcacctcccggcgactccaagtccggcgagaaaatcttcaagaccaagtgcgctcagtgccacaccgtcgagaaaggtgccggccacaaacaaggacccaatctgaatggtttgtttggaaggcagtcaggcactactactggatactcctattctgctgctaacaagagcatggctgtgacttgggaggaaaagaccctatatgattacttgcttaatcccaaaaagtatattccagggacaaagatggtgtttccaggtcttaagaaaccccaggaacgcgctgatcttattgcatatctgaaagaatcaactgcacagtaaatttttgttaaaagttttatgagatttaatttttagacatttagttcagccggtgcagtgattactgtagaattggcgaataaagtagatcacattgtttgcaatgctattttgttcattttgcattgcttttataagaggctgccgtaatatggcgggtgtaacatttaatccaattatcagttcattattgaaacattcaaatcgatattcggttaccagaagcacaattagtcaattaccactc

SEQ ID NO: 2821 - DNA, 1193 bp, Cajanus cajan
gagtagacatattctcttctctctagttcctcgctcgcatgcacacataataataataaggacgttcacgcaaatcacacggctgccaaacttgacttttgcctcaagctaacgcaactgacccaaaaaggcaaaagaaaaattgtagcgccataaacggtccacgtcaacgaaaaaagttagggcaggcttagaggcccgtggcgaccgcgttccaatttcccaccctgccgcctcgccctagcttatatattctccattctgaatagtcacacattcattgccacttttccgcacatctctcccttctctttctccgcaaaaccttttcgtgtctgtgtcgctaacctaacaccgtctccgaatggcgtcgttcgatcaggcacctcccggcgatgtcaaatccggtgacaaaatcttcaggaccaagtgcgctcagtgccacaccgtcgaaaaaggtgccggtcataagcaaggacccaatctgaatggtttgtttggaaggcaatcaggcactactcctggatattcctactctgcagctaacaagaacatggctgtgacttgggaagaaaagacactatatgattacttgcttaaccccaaaaagtatattcctggaacaaagatggtatttcctggtcttaagaagccccaggaacgtgctgatctgattgcatatctgaaagaagccactgcacagtgatatcatgttttcaaacattcaattttgcagtgtactttcagagttctattgatttaattttcggtcgattagttctgccgtgcaggaagtgccgtatctttggcaaataatgtaggctacattggtctgcgatgctattttgttcattttgcattgcttctcagaaagcagctgattattggctggtgtaacaatttatctgttgaaaattaaaacattcttataaacatttgatttaattggaattacagctcagtactgtgttagctgtattctaatttttataatggtgggttgctaggcctagatcatatatccaacatcttgtttaaaatataaaatgtaataatattatgatagctaaagatgtttcagccatactttcttcaagactgcctcatcccaaaatcaaaatttgcatgaactttagcctacctctcactcttgattttgtaatttttaatgaatgagagaatatattaaaagt

SEQ ID NO: 2822 - DNA, 1603 bp, Cajanus cajan
tagaggaattaaatctaatttaaatattacttttaattttattttttttataaaaaaatcagttccaatagaaggaattgttgaaaaaccattaaaaccttttaaccttgttgaaatgatgagtatcaaaatgtcaatttaggtgactgttttaagctttaaattttttaagcttctttgatcgtctaaaaagaaaggaaaatgttaaagacactaattaaaaagtccaaaataaatttacatataattttcaataatactttctacacaaaaacacttgagcaaaactggacgtggcgttgtacatttgtgtaattccgattccgtgggtcttttgaacgttagagagagacatattctcttctctctagctcctcgctcgcatgcacacataataataataaggacgttcacgcaaatcacatggctgccaaacttgacttttgcctcaagctaacgcaactgacccaaaaaggcaaaaagaaaaattgtagcgccataaacggtccacgtcaacgaaaaaagttagggcaggcttagaggcccgtggcgaccgcgttccaatttcccaccctgccgcctcgccctagcttatatattctccattctgaatagtcacacattcattgccacttttccgcacatctctcccttctctttctccgcaaaaccttttcgtgtctgtgtcgctaacctaacaccgtctccgaatggcgtcgttcgatcaggcacctcccggcgatgtcaaatccggtgacaaaatcttcaggaccaagtgcgctcagtgccacaccgtcgaaaaaggtgccggtcataagcaaggacccaatctgaatggtttgtttggaaggcaatcaggcactactcctggatattcctactctgcagctaacaagaacatggctgtgacttgggaagaaaagacactatatgattacttgcttaaccccaaaaagtatattcctggaacaaagatggtatttcctggtcttaagaagccccaggaacgtgctgatctgattgcatatctgaaagaagccactgcacagtgatatcatgttttcaaacattcaattttgcagtgtactttcagagttctattgatttaattttcggtcgattagttctgccgtgcaggaagtgccgtatctttggcaaataatgtaggctacattggtctgcgatgctattttgttcattttgcattgcttctcagaaagcagctgattattggctggtgtaacaatttatctgttgaaaattaaaacattcttataaacatttgatttaattggaattacagctcagtactgtgttagctgtattctaatttttataatggtgggttgctaggcctagatcatatatccaacatcttgtttaaaatataaaatgtaataatattatgatagctaaagatgtttcagccatactttcttcaagactgcctcatcccaaaatcaaaatttgcatgaactttagcctacctctcactcttgattttgtaatttttaatgaatgagagaatatattaaaagtgtgatagattttgtaaaaaaaaatctgatcagaaataaaggaatctttactgagttgaaagaaa

SEQ ID NO: 2823 - DNA, 658 bp, Platanus occidentalis
aaaagtttgcgatctgtgcaacgaacggggggaaaccctaattctcttgtttgggtttgtgagaaatggcaacgttctccgaagctcctcctggcgatgctaagacaggagagaagatcttcaagactaagtgtgctcagtgccacaccgtcgataaaggggccgggcacaagcaaggtcccaatttgaatggcctttttggaagacagtctgggacaacgcctggatactcctactctgctgctaacaagaacatggctgtgatttgggaagagaaaacattgtatgattacttgcttaaccccaagaagtacatccccggaacaaagatggtcttcccaggtctgaagaagccacaggaacgtgcggacctcattgcctatctgaaggcatccacatcgtcttaaataatttcttttaaggtctcagttcttgtcattaattttgcggccaagtggagctgtcttgttgcggagttagataagacactattttttgttaaataagaccatcaaaggtctgccaagcgctctccttttaatggggtagagtggaaccatattgcttttttgggccatgaggctattgcgcctggcaacaaaacattcaaattgcttgtgtcgatttttaatttgtgggatttttatgggcataaata

SEQ ID NO: 2824 - DNA, 785 bp, Populus trichocarpa
atgaaaataaaaggcgtgggaaaactacagtactttcccacgccttttagagtattgttaataataataataataaaacaagcccaaaactctccccctccaactccttctagaaagcaaaaagcaaagagaattcaaagagatgaagaaatggcttcgtttgcagaagcaccacctggcgattcgaaagtcggagagaagatctttaagaccaagtgtgctcagtgtcataccgtcgacaagggtgccggtcataagcaaggacccaatctgaatggcttgtttggaaggcagtcaggaacaactgctggatactcttactctgctgctcacaagaacatggccgtcacgtgggaggagaagactttgtatgattacttgctcaaccccaagaagtacatccctggaacaaagaaggatttccctggattgaagaagccacaggagcgtgctgatgtcattgcatacttgaagcagtccactgcatcttaagcatttcacacttctggcctccccattttgcagttgttggagatattgttttttaccaataaataaccatcctatacaatgagcattgcgtcgaagctccttctaagagttgccataattagcaaacttaacattcgattcatttagcttactgtgcctctattttgcgaatatttggtggattaccaatgaacagtttgttaatgatagtttttggttttgatgatattgcatatgaacatttccatggttgctatcgcttgccttcaatatactctgatgcataacaggtc

SEQ ID NO: 2825 - DNA, 543 bp, Thalictrum flavum
ttcgatgaagctccacctggaaatcctaaagcaggagagaagatctttaagacgaagtgcgctcagtgccataccgttgaaaaaggagccggtcataagcaaggacctaacctgaatggcctttttggaaggcagtctggtacaactcctggttactcctattctgctggtaataagaacaaggctgttatttgggaagagaagactttgtatgattacttgcttaaccccaagaagtacattcctggaacaaagatggttttccctggattgaagaagccgcaggaacgtgctgacctcattgcctatctgaaggaatccacagcagcttgattttacccacaaaacttgttatttttgcagcatttggagatttctgtttacagatgcggataggaaactatatttttttgaaataatacccctaatagaggtccataatatgttttcattttaaaattcaatgtagagtagaaacatggactacacaatgtcattggtgtaatgtgttctaccttttgatactctatttgttcgtcaaca

SEQ ID NO: 2826 - DNA, 599 bp, Tripterygium wilfordii
gcgtcgttcgatcaagctcctcccggcgattcaaagtctggagagaagatcttcaagactaagtgcgctcagtgccacaccgtcgacaaaggtgccggtcataagcaaggacctaatctgaatggcctgtttggaaggcagtctggcacaacccccgggtattcttattctgctgctaacaaaaacatggctgttaactgggaggaaaagacgttgtatgattatttgctgaaccccaagaagtacatacctggaacaaagatggtattccctggattgaagaagccacaggaccgtgctgaccttattgcttatttgaaggaatccacttcaccttgaaacaaacctttttgcatattcgaaggtatcacttcaccctgaaacaaataaaggcaaaattagaccatctaggtcggccatgctctttgcactacgaggactcgctggtcattttttttggaagaggttactctttggggaatgtagcatttgatttaactagttacttgacctcatgcttgatgatatgttggtgaagcaccacttcttgccaatgataaattcttttttggatttttagtcgatgtttcgttttattg

SEQ ID NO: 2827 - DNA, 660 bp, Juglans hindsii x Juglans regia
  misc_feature (157)..(157): n is a, c, g, or t
ggggtctttcgctctgatttctctattcaactttctcggcctctttggaaggaaaaagaaaaggaaaaggcataaacggtagagaaatggcgtcgttcgatcaagctccgccaggcgatccaaaggtaggagagaagatcttcagaaccaagtgcgntcagtgccacaccgtggataaaggtgccggtcacaagcaaggacccaatctgaatggcctgtttggacgacagtctggtacaactgctgggtactcatactctactgctaacaagaacatggctgtgacatgggaagaaaagacgttatatgattacttgctgaaccctaagaagtacattcctggaactaagatggtattcccgggactgaagaagccacaggatcgtgcagaccttatttcatatttgaaggaatctactgcatcctaaatacttctccataaccttagtttcccagttccattttgcagttgttggagtttgtttcacacagtgcggatgaagtgctattttttaccaataaaatagaccaactaggtctgcaatatgatattttttgtaatttatcattgcatctcaagaggttgccgtaattggcaaatgcaacattagtaaggttcttatgaatacctggatgaaagaaacattttgcagttagtag

SEQ ID NO: 2828 - DNA, 653 bp, Juglans hindsii x Juglans regia
  misc_feature (577)..(577): n is a, c, g, or t
ggggaaagaaaattgagatcaaaggctgaaagctaatcggttgagatatggcgtcgttcgatcaagctccgccaggcgatcctaaggtaggggagaagatcttcaggaccaagtgcgctcagtgccacaccgtcgagaaaggcgctggccacaagcaagggcccaatctgaatggcctgtttggacggcagtctggtacaactgctgggtactcttactctactgccaacaagaacatggccgtgatttgggaggaaaagacgttatatgattacttgctgaaccccaagaagtacattcctgggactaagatggtattccccggactgaagaagccacaggaacgtgcagacctcatttcatatttgaaggcatcaactgcatcctaaatacttccccgactttagttggacagttccattttgcagttgttggagattgtttcacacagtgcggatgaagtaatatttttttaccaataaattagaccaactaggtctgcaatgatcttttgttaattgaccattgcatctcaagaggttgccgtaattttgcaaatgcaacagcaattcaattngctgttcgtgacaatatcatgaatatttggatggagaagcattttgctaaatgataattttgattggtttcttgag

SEQ ID NO: 2829 - DNA, 638 bp, Allium cepa
tgagttaaaaggcagagaaaagaaaaactaaagaaagccctacgaagaagaatggcctcattttctgaagctccgcctggaaacgagaaatcaggagagaagatcttcaaaactaagtgcgctcaatgtcactctgtcgaaaaaggggctggccataaacaaggtcctaatttgaatggattgtttggaaggcagtctggaacagctgctggatattcgtattctgctgcgaacaagaacaaggctgtggtttgggaggaaatacattgtacgagtacttgcttaatccaaaaaagtatatccctggaacaaagatggtgttccctggtctgaagaagccacaggaccgtgcagatctgattgcatacctacaaaaaggctacagcttgattttctgaatcaactttgtaatctgtttgtagctaatgaggcctctaggattcgctatgatcgtaaacaagctaaagacttcgccttgatagcatttatttattttgcgattcatgttgtaaaagagtggtgtatctttatgtttgtattgtgtatttgaaaagtttcattacttgttgaacattcatgtgattatgttatatgcttgtacgattatgtttaactgcggcagggttttagcacttggt

SEQ ID NO: 2830 - DNA, 417 bp, Secale cereale
cgacccggatcgccttccgttcctccagccgagggatccccaacctacctagtccggcaaccgtccgcgcgggatcagcggcagcggcgatggcgtcgttcgtcggacggccgcccgggaacccggcgtccggcgagaagatcttcaagaccaagtgcgcccagtgccacaccgtcgacaagggcgccggccacaagcaagggcctaacctgaatggtctgtttgggaggcagtctggcacaactcctggatattcttactctacggccaacaagctcatggctgtgaattgggaggagaaaacactgtatgactacctgcttaatccaaagaagtacatccctggaactaagatggtgttccctggactgaagaagccccaggagcgtgctgatctcatcgcatacctgaagggtg

SEQ ID NO: 2831 - DNA, 1501 bp, Artemisia annua
agcactgtagtttcctcctacaacatcaaattggatcattagctgactatttgattgatatactacttggcaattagtatgccacatagcaaaaatcaaaaaccaagatcattatgtgggtgggagaaagcatacatgttcaattataaaactaaaacatatagaacaacaaaattaacaaaatagttcaaatgcattcatctactttgcaatttgtgtttgtgatgaataaggcaaggcacacctcttgccaagtgataaaccagtgctcaaaaatttaggagcaaagaaacatcatgaatgtcctccccttattaatcaaaaaaataatccaaattttatcccttatatctcaaatcatcatgaagtcttcaaaatgatgttaaacgtaacacaaaattatgcagtagattgcttcaagtaagcaatgagatctgtacgatcctgtggcttcttgagtcctgggaaaaccatctttgttcctgggatgtacttcttggggttcaacaaatagtcatacaaagtgttttcctcccattgaacagccttgttcttgttagcagcagagtaagagtatccaggagttgttccagactgccttccaaaaagtccattaagattgggtccttgtttgtgaccagcgcctttctcaacggtatgacactgagcacatttcatcttgaagatcttctcaccggcttctggtttaccagcaggtgcctctgcgaatgacgccattgatgatgatgattgatctgattgaaggttttgttttgatttgattagagagagagagaactaattaaggttttgtttggcttgaagaacattgatgtttatgcttttggtgtgtacgccgatgaaagtgatattaagaactttttaaatgagaaatatgcgactctgtcaacaactgaacttaagaatgctaacgtcactcaagatttgatggaaagtgatgtaagtgttactgttagactacagatagtttatggaaaacttagcattcgttccgttcgcaatgcatttgaagattctgttggaacaagattaaagaaatttggaggatctgataacaaggagttacttcataagttcacttctcagtttagtgacgaatacaagattcctcgtggatcaatcataaacctctcgaaggaaaagggctacgtgctccggaccactattgatggcaaggaggtaggaagtgttcaaagccaactcttatgtcgatcaatcttggatctatatattggtgacgagccctttgattcaaaagcaaaagaagacattgacaataagctggtttccgccatcacagagtaaaactttatatggtcattggaataccatttattcaaatcatcatatccttataaggttttgtatcaaaagctaagtttcataccggtgatgaccaaaatacttgagtagatgagtgagtgaacgttgtatttgcaaatatgtatgttgatgtatgaataaaaaagatcaataaatt

SEQ ID NO: 2832 - DNA, 379 bp, Castanea mollissima
  misc_feature (1)..(1): n is a, c, g, or t
naaaaaccctaataacccttttgtatcagagagcgatcaaaacctgagcaccaaaaaaaaaaataggcgagcttcgcagaagcaccaccgggaaatcccaaggtcggcgagaaaatcttcaagaccaagtgcgctcaatgccacaccgtcgacaaaggcgctggtcacaaacaaggacctaatctaaatggtcttttcggaaggcagtctggcacaactcctgggtactcctattctgctgcaaataagaacatggctgtgaattgggaagagaatacgttgtatgactacttgcttaacccaaagaagtacattcctggaacgaagatggttttccctggtttgaagaagccacaagatcgtgcagacctcatttctt

SEQ ID NO: 2833 - DNA, 886 bp, Fagopyrum esculentum
gagaaccggaaccctccagacccgtttttctctctctcataattcataaacaaccttccagaaactctcctcagcttcccatttctacaccgaaaccctagcgactaacggccaccgcttaattccttcatccatggcaaccttcagcgaagcacctcccggcaacatcaaatctggtgagaagatctttaagaccaagtgtgctcaatgccacaccgtcgagaaaggagctggtcacaagcaaggtcctaatctcaatggcctttttgggaggcaatcaggaactactgctgggtactcctactctgctgctaacaaaacaaggctgttacatggggagaagacaccttgtacgagtacttgctgaatccaaagaagtacatccccggaacaaagatggttttcccaggattgaagaagccccaggaacgtgcagaccttattgcatacctcaaggattcaacacagtaatgttctttctcatttgaaacaatgaatgcaggcttctgtttaggagaagtgccgagctttgttttgtttattagtcacaaatttgtctcataggagacccgagaaagtattatttttataacctgtcaaataagattaaccctggtaagggagtggacaaacttgagaaaacattattttgagtgatttttattatagttttgtccgaggcatttctcggtatataatacacttctacaccttttgctggtaaagttgcacaaggatgatgctgctctagtgttggccttcttgcataatagttctgtttagttggatattaatttatcttgattttgtttatgttctaccatgaaacaacttgaaagtactctttttgttcctgctagactttgttcatgttgttccataaaac

SEQ ID NO: 2834 - DNA, 606 bp, Zingiber officinale
aacaaaccctaacccgaagcttcagatctacctctacgaaagaagaatacgatccatggcctctttcaccgaagctcctccaggtgatgccaagtctggagagaagatcttcaagaccaagtgctcgcagtgccacaccgtcgagaagggagccggccacaagcaaggaccaaacttgaatggactttttgggagacaatctggtaccactcccggttactcatactctactgccaacaagaatatggctgtcatttgggaggagtcaactttgtatgattacttgctgaaccctaagaagtacattcctggaactaagatggttttccctggtctgaagaagcctcaggagcgcagtgatctcatcgcatatctcaaatcatccacggcttaatttattgtcttttcttcatgtgagcttatggtttcacctctagatctcagatatactctgcttgtaattagcagcagaaacttgaaaaattttcttgcccttgcaaattaattgccacttggaggattgttcctccagatacctcccattagtattgtacctgctaaactgctggtggaatataataaatacaaacttgaatttttatcaaa

SEQ ID NO: 2835 - DNA, 701 bp, Actinidia deliciosa
  misc_feature (126)..(126): n is a, c, g, or t
aaccctagaaagctcggagttgttgttcggctttgaaaccctaaaaaccatctgaattttgaatttagggttcaatttctcttcgctgcatcggctatggcgactttcaacgaagcaccccctggngacgtcaaatcgggagacaagatcttcaggaccaagtgcgctcagtgccacaccgtcgaaaaaggcgctggccacaaacaaggaccaaacttgaatggccttttcggaaggcagtctggcaccacccctgggtactcgtactctgccgctaacaagaacatggctgttgcatggggagagaacacgctatacgactacttgcttaacccaaagaagtacatccctggaaccaagatggttttccctggactgaagaagccgcaggaccgtgctgacctcatagcatatctgaagcaggcgacttcctgattattttgccatgcgtaagctttgcattttgtggcggttgggagagttgtttgtccctggaattctttttcctgaactatagctactattaattttttaaataagaccataacggtctctgctgtgctctctttgaaaaggtgagcggatatttttgacatgtttcgtgaaactgtgtaatagccaggtatggtacccaatttgttcatcttgtcgaagtgttaaaggacatggttgcattttgtggatgtgatggtgtttcctat

SEQ ID NO: 2836 - DNA, 648 bp, Actinidia deliciosa
  misc_feature (88)..(88): n is a, c, g, or t
  misc_feature (170)..(170): n is a, c, g, or t
aaaccctagaaagctcggagttgttcttcggcgttgaaaccctagaaatcgtctgaatttgaatttagggttcaatttatcttcgctnatcggctatggcgactttcaatgaagcaccccccggagacgttaaatcgggagacaagatcttcaggaccaagtgcgctcantgccacaccgtcgaaaaaggcgctggccacaaacaaggaccaaacttgaatggcctttttggaaggcagtctggcaccacccctgggtactcgtactctgccgctaacaagaacatggctgttgcatggggagagaacacgctatacgactacttgcttaacccaaagaagtacatccctggaaccaagatggttttccccggactgaagaagccgcaggatcgtgctgacctcatagcatatctgaagcaggcgacttcttgattcttttgccttgtctaggcttttgcactttgtgacggttgggagagtttgtccctggaattctttttcctgaacctatagctacttttaattttttaaataagaccattacgtgtctgctatgctctctttgaaaggttgagctgatactgtgaatttttgacttgtttcatgaaactctggtaatagccagctatagtaccccatttgttca

SEQ ID NO: 2837 - DNA, 681 bp, Helianthus annuus
agctgtcacaagctacaacaatctagaagcaacaagatttccgtataaacttgaaacagtccctgtcttgtaatcggaaaatggcgtcattcgaacaggcaccggccggcgatgctaaagccggagaaaagattttcagaaccaagtgcgctcagtgtcataccgtcgataaaggcgctggccacaaacaagggccgaatttgaacgggctttttggaagacagtctggtacaactgcagggtattcatattctgctgccaataagaacatggctgtgatctgggaagagaagacactctatgactacttgcttaaccctaagaagtacattcctggaacgaagatggtgtttcctggactgaaaaaaccaaaggaccgagctgatctcattgcttacctgaagcaatcaaccgcttgattccaaaggcggtaacgagtttatttgcatcgtttactaaaaacagcgatgtttctttacatttatatgaccatattgttttgaacctgaacaatttgttacgctcgacataactctcatcttgaggactgctctttctaggagatgattgttatgttttcgaataaagtgttgcctttcaatttgtttttctgttgatattcatgttggtttggacatttagcaagggatcatgaaaatctttttacttgcttttaaaaaa

SEQ ID NO: 2838 - DNA, 548 bp, Thellungiella halophila
  misc_feature (119)..(119): n is a, c, g, or t
  misc_feature (121)..(121): n is a, c, g, or t
gcgagatccgtgttcattttctcttgttgtttcccgttccgttgccggcgaaaatggcgtcgtttgacgaagcaccaccagggaacccacggccggtgataagatcttcaggctcaagngngctcagtgccacaccgtcgaaaaaggcgccggtcacaaacaaggaccgaatctaaacggtctctttggaagacaatcgggcacaaccgctggttactcttactctgctgctaacaagaacaaagctgtggaatgggaagagaagaccttgtacgattacttgcttaaccctaagaagtacattcccggaacgaagatggtcttccctgggctgaagaagccacaagaccgcgctgatctcatcgcctacttgaagaatgctactgcctagtgaatcaatggtgtgggacgtgacgatttcgattcccgaagattggatattcttttgacaaataaaaatctcaaaacttttgtttttgtttttttggaaatgccctcatcttcaattacgttttggtgagaatttggctgtcgagttccaaacgcac

SEQ ID NO: 2839 - DNA, 593 bp, Pisum sativum
atattcccatttttcaattttttttctccacacgctgcctgcttctagaactttctccaatggcctcgttcgatgaagcacctcccggaaaccccaccgccggcgacaagatcttcagaactaagtgcgctcagtgccacaccgtcgacaaaggcgccggccacaaacaaggacccaatctgaatggtttgtttggaagacaatccgggacaactcctggatattcctattctgccgctaacaagaacaaggctgtgaattgggatgagaaaaccctgtatgattacttgcttaaccccaagaagtacatcccagggacaaagatggtgtttcctggtcttaagaagcctcaggatcgtgctgatcttattgcatatctgaaaaaggccacttcatcagacgaatagaattttcgtatggttttcaaacatggagacttaatttcattttcattcgcacatttgattgtggtgtaaaccacacttatcttggcaaataaagcagacttgattagtttgcagtgctattttgttccttttgcattgcattgctttgatagggttgcgtatattgggtgtggacttatattaaga

SEQ ID NO: 2840 - DNA, 715 bp, Arabidopsis lyrata
gaaaccctaagaaacttccgcaagctccaaagaaacgagagttccgtaatcattttctcttgttgttcctgatcgcgttgctcaagcgaaaaaatggcgtcgtttgatgaagcaccaccaggaaacgccaaagccggtgagaagatcttcaggaccaagtgtgctcagtgtcacaccgtcgaacaaggcgccggtcacaaacaaggaccaaatctaaacggtctctttggaagacaatctggtacaactgctggttactcttactctgctgctaacaagaacaaagctgtcgactgggaagagaagaccttgtatgattacttgctcaaccccaagaagtacataccaggtacaaagatggtgttccctgggctaaagaagccgcaagaccgcgctgatctcattgcgtacttgaaggaatctactgggcctaagtgattctaatggtggattctgagttgttgagtctctcagatgggtacttttttactttgctatattcttttgacaaataaaatctcaaactttcttttgttatcatcaattacgttcttggtgggaatttggctgtaatgtgtgctgagtctcacttttgagtacatttgattttctgaggctcactttcctttttctgtctagaagcattttctcacatattgcagcttaattttaaagaacaaaaaagattcaaaattatatatcaactatgaacaat

SEQ ID NO: 2841 - DNA, 729 bp, Arabidopsis thaliana
gtgaaaccctaaggaaacttcggcaagctccagagaaacgagagttccgtaatcattttctcttgttgttcctgatcgcgtagtcaagcgaaaaaaatggcgtcgtttgatgaagcaccaccaggaaacgccaaggccggtgagaagatcttcaggaccaagtgtgctcagtgtcacaccgtcgaagcaggcgccggtcacaaacaaggacccaatctaaacggtctatttggaagacaatctggtacaactgctggttactcttactctgctgctaacaagaacaaagctgtggaatgggaagagaaggccttgtacgattacttgctcaaccccaagaagtacataccaggtaccaagatggtgttccctgggctaaagaagccgcaagaccgtgctgatctcatcgcctacttgaaggaatctactgcgcctaagtgaatctgatggtggattgattctgagttgttaagtctctctcagatgaggcttttttactttgctatattcttttgccaaataaaatctcaaactttttttgtttatcatcaattacgttcttggtgggaatttggctgtaatgtgtgctgaggctcactttatcgagtacatttgattttctgaggctcattttccttttttttgtctagaaagcattttctcacttattattggtgcttaaatttgaaggacaaaaaagattcgaattatatatcaactattaacaat

SEQ ID NO: 2842 - DNA, 707 bp, Pseudotsuga menziesii
gaaagaagaggtatttattgcaagagtaggaggggaacactttttacgcttttcttgtggaggaagacagcggtgcgtgtgtttgtcgtgggctctctggcatcatgtgagagagaatcgatagatcgaataactcaaagtaagtatcagtcacatcaataatggcgtccttctcagaggctcctccaggcgatgccaaggctggagagaagatcttcaagacaaaatgcgcgcaatgccatacggttgacaagggtgctggacataaacaagggccaaatctgcatgggctctttggcaggcagtctggtacaactgcaggatattcgtattctgcaggcaacaaaaacaaggctgtcatttggggcgaggatactctgtatgaatatcttttaaatccaaagaagtacatacctggaaccaagatggtattccctggtctgaagaagcctaaagaacgggtggatctaattgcgtatctcaaggaggccacatcgtcagagtagttatgaagagaattatcctaagagaaatgaattaataattgatgggcggctagataacaatttcctagctaaatttttcttttgcgaagatagaattcgaatatgacccatcgccacactattaaacatcattttttgttaataaagacgaaagggataatgcctaagatgagggaaaaaatttcccatccaaagtttaaa

SEQ ID NO: 2843 - DNA, 583 bp, Antirrhinum majus
ttttgcagaagcgccaccaggtaacaaaactgcaggtgaaaaaatattcaagaccaagtgcgctcagtgtcacaccgttgataaaggagctggacataaacaaggacccaatttgaatggcctctttggaaggcagtcggggacgacacctggttattcgtactctgctgctaacaagagcatggccgtcatttgggaagagaagactctctatgattacttgctgaaccccaagaagtatatacctggaacaaagatggttttcccggggctgaagaaacctcaagatcgcgctgatctcattgcattcctgaaagaatccaccgcaaactgattgtctgacctttctatatcatttttgcagtagagaagtattattcgcttgtgagggagaaacaaatagttttgtacaaataaatttctggaaactgtaggctcagttttactggagctcccgatattcgttttcctcctgaggaaggccattgttgtcaaatggaaattcaagtcgaatttaagcatgttctactatgagaccaatagatgtttgagtactgaattcatattatgacattggtggcat

SEQ ID NO: 2844 - DNA, 664 bp, Persea americana
tagaaaagtctctgattagggttttggcggatagagcaacaagatggcgacgtttgaagaagctccaccaggcgatcccaagtcaggagagaagatcttcaggaccaagtgcgctcaatgccacacagttgagaaaggagctggacacaagcaaggacccaacttgcatggtctttttgggcgacagtctggcactactcctggttactcctactctactgctaacaagaacatggctgttaactgggaagagaagactttgtacgactacttgcttaatcccaagaagtatattccaggaacaaagatggttttcccaggtctgaagaagccgaaggaacgtgcagatctgattgcctatctcaaggaatccacatcatcttaagaattttctgtctgtgtcctcagttttgcggcaggtggatgtagttcgctgcagagtatgatgatgggactaattttttgcaataagacctagagaggtcctagactcttttaacagtagttgttggtggaacaacctctgctcattcctttgaaattactaaaattggtcttcatgtatttgatttggtagcatatctctttctattttcacgcattgcattttattggcagtatatatatctgtctctgacaagtctgtattggatcatctctcaca

SEQ ID NO: 2845 - DNA, 2924 bp, Gnetum gnemon
ctggattcttaaattatctaaataaagaaaaataccatgttatatatcagataacatttaaaaaacaaacaactattagctttcagttaggaatgaaattccttgaaaaatatggcaacaaaatgtgcaacaaatgactgtaaatttcccttccaggttcctgtggcctctagcagaagttcacttcagcagcacaatccacattcctgtatattaacgtctcggaaagaagacaaataatgtgatgccagaagagaacgaaatttctaaatcctatgagttgcttcaaagttagcacaaattctacagaatttcatagcctacaataatacacaactgtgacactgaaacctgagatggtttagctgggtggcacagttgattccctagctgtaccattgtcagtggatataagatcctgtggctttaaggcatcagtacttaaatcctgagcattggatggatgatctgctacttggccaccttgactaatagacttttgcccctctgggttgatctgagactcgggctgggaaggaactacaggctccgcactatcaccattctcataacctgcattgataccagttttcaagtcctcgtgagattcaactttcgcttcttcctttggctgattttcattcatgtctatactggcttccttgagttcttcgtccttaggcttttcatctttctcctgaacaaaaaagttttcagaagcctcctgcacatgagcttcctccttcggaactgggtcatcggttttgggttcgtgttgtatacccttgtcttcctctgcttttgcatcggcatcatcaacaacgttacctgcacctgctggcacttcagggatacctcctccatccttctcggaatcacctttcgcttcctcggtggatttatcgtctaaagccctgtcacatgttgcatctgcaaaatcttcagtgattttgtcttcggttctagtttcatcatctacattggttttattttctttgtccacgtcatcttcactgcctgccttgtcctcctcctcagccttttcttcctcttctacatctttcatctcctcatctttctcagccgaagcctcctcggactttttagacttctttgactgcttcgaatcttcagtatctccatcacccttcttgcctcgtttcggtgtccttttcttgacctcgctttcaggtgtttcagcttctgcctgtgccttctcacttaatctcgaagacctcctcggtgtatcaccagtactccagtgaaattctgatattggggggcctcctgggtgtgttcttagatacttgtccagttgagatcttgtcttaatctcttctcccgttggagctacaaatataatttcatgccttcttggagttcccttctttttagggaaatactgtttcttccatccttcaggcgctggcaaataaactacattcgactcggccgcgacctccttatcagggctatgcacttgaacctcctccgccattgctgaaaacctctccctctccctctccctctccctctgtgtttcggtctctctattctcccaagatatcgccgataaacccttcctcctcctccgtccttcctctcattttccttcttgttctttgcattccattccattccctcgatcgaattgtagcagaggcagaggcagaagcagcaagaatggcaacatttgcagaagcacctggcggagatgcaaaggtcggagaaaagatcttcaagactaagtgtgcgcagtgtcacactgtcgacaaaggcgccggccacaagcaagggcctaacctcaatggcctgtttgggaggcagtctggcacagctactggctattcttactcctctgccaacaaaaacaaggccgtcgtctggggcgaagaaaccctttacgagtaccttttgaaccctaaaaagtacattcctggtacaaagatggtgtttcctggtctgaagaaaccacaagagcgtgctgatcttatcgcatatctcaaaaaatccaccgcagagtaattaatctaaagattgtgttttcctttttcctcgaaattctgtttctggaggttaaacaattgacaacgggatgccttatattggcttcaaagtgcgtaaatttcttgcacaaagcgatgccgccaggttttatggcgaacgaaggccaggggacccgaaatacgagttcaaatagccacacatttagctttgattcgcctcggcttaatgacggttgtttttctaatcgcggaggcttcgatagcaatggctttatgttttcttcgatggggaaaacgttgttgaattctgagaatttagggttaggcagaagtacaagtaggaccagcgatggcgagtttaagtatggttgctttagttctacgaattcattttctgttgggaacacttcgtttgcaaaaaatacccatactggcaggtcgaagcctagactgaccaagcttagcaaaaatcctagcactttcaaaggcaagttccctgcggagaacagaggggaaagctctgggcttaatcccttgaagcaaacggtaggagctgagaagtttggggttttatcccagcctgaagaaactcagagctcaatttcgtctgggtcgtatgcctttcataataatgatcatcataaggccaagagttttgggaaggcaaacggtaccgttgaatctggaagttcagagtttgtttttaaacaggatgtggagtcaccttacgttgaatctgcacccaaacccatgttgttcccagtgtttcagctgcaaggttacaggagtgtccaaacagaatccagcaatggctggggttgtgtctgaagaacttgaagcatccttaaaaagtggtatggccgaggagactaatgggaataatgtacaaagcgttttaagctcaaaattcatgcctgt

SEQ ID NO: 2846 - DNA, 708 bp, Lotus japonicus
tttttctcacaaagggtttgaacaaaacattgtccgagctgtgtcggcttctccaatggcgacattcgatgaggcaccacccggagacaccaaggctggcgagaagatcttcaagatcaagtgcgctcagtgccacaccgtcgaccaaggtgccggccacaaacaaggacccaatctgaatggtttgtttggaaggcaatctggcacaactcctggatattcctattctgcagctaacaagaacatggctgtgatttgggaggagaagaccttgtatgattacttgcttaaccccaaaaagtacattccagggacgaagatggtgtttcctggtctcaagaagccacaggatcgtgctgatctgattgcatatctgaaacaatccactgcgcaatgattgaatttccacacattcagcttatcaatgtgcttttggagttctggagatttaattttctgacattggattttcggcaaataaaatagacttgattagttttcaatgctattttattcattttgcattacttcttcataggttgccacatatattttctggactaatgctcgaaagaattagctgttgaaagttgaaacaatcttataaagtttacttatctggatgcacatctagtcctgttatgctgagactggaattcaaatattcaattcagtattaagcagccctaaattgtctgaaattttctc

SEQ ID NO: 2847 - DNA, 1051 bp, Glycine max
cccaccctgccgtctcgcattcatatatatatgcatgtgttctgaatagtctattcttcattgcaagttttccgcacaactctttcacctcttgttttccccaatccttttcgcctttgtctgcgaatggcgtcgttcgatcaggcacctcccggcgatgtcaaatccggtgacaaaatcttcaggaccaagtgcgctcagtgccacaccgtcgaaaaaggtgccggtcacaagcaaggacccaatctgaatggtttgtttggaaggcaatctggcacaactcccggatattcctactcttcagctaacaagaacatggctgtgacttgggaagaaaagacactatacgattacttgcttaaccccaaaaagtatattccagggacaaagatggtatttcctggtcttaagaagcctcaggaacgtgctgatcttattgcatatctgaaagaatccactgcacagtgattatgcactttcatacattcaattttgcagcgtgctttcaaatttctggagatttaattttcggtcatttagttctgtcatgcaggaagtgctgtatctttggctaataatgtaggctacattggtctgcaatgctattttgttcattttgcattgcttctgaaaaaaaaacagccgaatattggctatatctcttgaaaattgaaacattcttatcagcatttgatttaattggaccacagttcattattatgcttagctgaattcatcattttcgttttactttggttttgcttagctgaatatgttaccgggagggatcgtatgaataataaacagtattgaagagaccttggctgaatcttgcacatttatttaatcttcatcatattcttgcattctatattttcaactgcaagatgttccatatatgacaggctttttagtcattttggcataattgtatcagaaataaagaagaaaccgatttttattgaactgagaaattttcaagttctcaagagacttgaattctccactatttccttttctctccttttattcccttctccttgtctctcca

SEQ ID NO: 2848 - DNA, 598 bp, Triphysaria pusilla
ttttctagggttttgtttcctccgtactaagtcgattctcaatggcgtcgttcactgaagctccgcctggcaacgccaaagccggtgagaagatcttcaagctcaagtgcgcgcagtgccacaccgtagaacagggcgccggtcacaaacaaggtcccaacttgaatggccttttcggaagacagtctggtaccactgctggttattcttactcagctgccaacaagaacaaggctgtggagtgggaagagggtgctctgtatgattacttgcttaatcctaagaagtacatacctggaaccaagatggtcttcccgggactgaagaaaccccaggatcgtgctgatctgattgcgtatctcaagggagctactagtgcttgaagatgaactttgtagacgtttcttacattttgtcagtcacgagatacatttgtcattggttctattttgtcatttttttaaagttgaagtagttgatcttacttcagtgaataagatgagcaacaattgggttataatttccgctattttttacaactcaaaccattaaagaagtatgatatgatttctcaccaagctagccttggtgcatttac

SEQ ID NO: 2849 - DNA, 597 bp, Rosa hybrid cultivar
ttcgctgaagctccaccgggagatgccaaggccggagagaagatcttcaagaccaagtgcgctcagtgccacaccgtcgacaaagccgccggccacaagcagggacccaatttgaatggcctgtttgggaggcagtctggaacaacccctggatactcctattctgctgctaacaagagcatggctgttaattgggaggagaagacattgtatgactatttgcttaatcccaagaagtacattcctggaacaaagatggtcttccctggattgaagaagccaaaggaacgtgctgacctcattgcctatttgaaggaatcaatgcatcttaaactgcctttgttcgacttgtcacattttgcagtcaccggaggtttatacaaactgatgagtactattttttgttgccaataaattaggccatctaggtctgcaattctcatttgcatgtggagcttgtttttgcttttctaggaagaggttgctgtaattggcagcgcaacattcatattcagttagctgttgtgactagatttcatggagttggtgaaataccagttcaactattgatataaaaattcattgcgacattttcta

SEQ ID NO: 2850 - DNA, 581 bp, Carthamus tinctorius
aggggccatcatcaccgtttagaaagcagaaaggtatctagaggcttcttcttcttcttcttcttcttcttcttcttcttcgtctgcagtcgaaaccctagggctctaatggcgtcgtttgaacaagcaccaggaggcgatgccaaagttggggagaagatattcaaaaccaagtgtgctcagtgccatcgttgaaaaaggctccggccacaagcaagggccaaatttgaatggcctttttggaaggcagtctggcaccacagcagggtattcttattctgctgccaacgagaacatggctgtgatctggggagagaatacactctatgactacttgctaaaccctaagaagtacatccctggaacaaagatggttttccctggactgaagaaaccacaggatcgggctgatcttattgcttatttgaagcaatcgactgcatgatttcattcgcttttttccgccagttttgattagtctagatcttaatgtaaaaaaggaaaaccttatgccatgttgcacttgtattcatggaggttttatagttaccatggtttttgaggagaacatcaacaaaaaa

SEQ ID NO: 2851 - DNA, 530 bp, Ambrosia trifida
tacgaaaccttcaatctaatggcgtcgttcgcggaggctcctgccggtaaccctaccgtcggcgagaagatcttcaagacgaagtgcgctcaatgtcacaccgccgagaaaggcgctggtcacaaacaaggacccaacctaaatggactatttggaaggcagtctggaaccactgctggatattcatactctgctggtaacaagaacaaggcagttatctgggaggaaaacacgttgtacgactacctgttgaaccctaagaagtacatccctggaacaaagatggttttcgcaggactgaaaaagccacaggatcgggcagatctcatttcatacttgaagcaatccacagcgtaattttttcaattacgtttgttaacaccattttgaagttctcttgatgattcatgttaggagatgactttggattatattttgatcaataaggggaggagatatatcaaattactttactctcttcattttttgtctattcaaatttcaaatggcaagagcctttttattcatac

SEQ ID NO: 2852 - DNA, 611 bp, Ambrosia trifida
acatatctctgtcacaaactagaacactctagaaacaaacccattattattaccgtattattattattattattactttaaacaaaccctgttttaatcggaaaatggcgtcattcgaagaagcaccggctggcgatgctaaagtaggagagaagattttcaaaaccaagtgcgctcagtgtcacaccgtcgttaaagccgccggtcacaaacaagggccgaatttgaacgggctttttgggagacagtctggtactactgctggatattcttattctgctgcgaataagaacatggctgtgatctgggaagagaagacactctatgaatacttgcttaaccctaagaagtacattcctggaacaaagatggtgtttcctggactgaagaaaccaaaggaccgagctgatctcattgcgtacctaaaggaatcaacagcttgattccaaaggcggtaacgagttttatttgcatcgtttactaaaacaacatatatgaccatattgttttgaacccaaaggatttgttacgctcgacgtgacttatcattaggggaactctttccaagagacggctgttatgttttcaaatgaagtgttgtctttgaattt

SEQ ID NO: 2853 - DNA, 686 bp, Helianthus annuus
atgccagctgtcacaagctacaacaatctagaagcaacaagatttccgtataaacttgaaacagtccctatcttgtaatcggaaaatggcgtcattcgaacaggcaccggccggcgatgctaaaacaggagaaaagattttcagaaccaagtgcgctcagtgtcataccgtcgataaaggcgctggccacaaacaagggccgaatttgaacgggctttttggaagacagtctggtacaactgcagggtattcatattctgctgccaataagaacatggctgtgatctgggaagagaagacactctatgactacttgcttaaccctaagaagtacattcctggaacgaagatggtgtttcctggactgaaaaaaccaaaggaccgagctgatctcattgcttacctgaagcaatcaaccgcttgattccaaaggcggtaacgagtttatttgcatcgtttactaaaaacagcgatgtttctttacatttatatgaccatattgttttgaacctgaacgatttgttacgctcgacataactctcatcttgaggactgctctttctaggagatgattgttatgttttcgaataaagtgttgcctttcaatttgtttttctgttgatattcatgttggtttggacatttagcaagggatcatgaaaatctttttacttgcttttaaaaaa

SEQ ID NO: 2854 - DNA, 385 bp, Arnica chamissonis
gtctcaggagtcttatcggcgacgtgtgtataaccggaaaatggcgtcatttgaacaagcaccggcaggcgatgctaaagttggggagaagatattcaaaactaagtgtgctcagtgccacaccgtcgagaaaggggccggccacaagcaagggccaaatttgaatggtctttttggaaggcagtctggcaccacagcaggatattcttattctgctgccaataagaacatggctgtggtctggggagagaatacactctatgactacttgctaaacccaaaaaagtacattcctggaacaaagatggttttccctggactaaagaaccaaaggatacgggctgatcttattgcgtatttgaagcagtcaactgcttgattcatc

SEQ ID NO: 2855 - DNA, 644 bp, Manihot esculenta
cactgatacaaacaatcgaaacccttgaatcttccatctccttttgaatttggtacgtagagagttcagaagaaagaaatggcgacattcgagcaagctcctcccggtgatgcaaagtccggagagaagatcttcaagactaagtgtgcccagtgccacaccgtcgataaaggcgccggccacaaacaaggacccaatttgaatgggcttttcggaaggcaatctgggacaactcctgggtattcttactctgcagctaacaagaacatggctgtgatatgggaagagagtactttgtacgagtacttactcaatcctaaaaagtacattcctggaactaagatggtcttccctggattaaagaagccacaggatcgtacagatcttattgcctatctgaaaaatgcaactgcctgatctttttcaatagtatggatttttagcaaatgatttgtgacattagatattgtcccaaacattttattttttcaaaggaagacaaactctttaaaataagatggactaaggctcaaagatgctctttgttttgagtgttcagatgagtagcgcgaaaaaaatctgttgtaagacccttttcatgaggaatttcatgagcctgtgataaattttttttagcccctatc

SEQ ID NO: 2856 - DNA, 760 bp, Vigna unguiculata
atcttctcatttcaacttcatttcgtttcatttgcatttcatttgacgttttctttctggaagcttcggcaagcagagatccatggcgtcgttcgatgaagctccccctggaaactccaagaacggcgagaagatcttcaagattaagtgcgctcagtgtcacgccgtcgaaaaaagtggcggtcacaaacaaggacccaatctgaatggtttgtttggaaggcaatctggcacaacccctggatattcctattctaccgctaacaaaaacatggcagtgatttgggaggaaaagaccttgtatgattacttgctcaatcccaaaaagtatattccagggacgaagatggtatttcctggtcttaagaaacctcaggatcgtgcagatcttattgcttatcttaaagaatccactgcctaaggattaaactttcatacatacagttacgcactgttcattcgaagttcctgagatttaaattttcagacatttaattatgtggtgcagcaagtactgtatcaacaaataaagtagacttgatttgtttgcaatgctattttgttcattttgcattgctttttaagaatttccaatatatgggctaatgcccaattaatttagcagttgaaagctgaaacattgttgctgatattaaatttgcagaagcacaatttggtctacctttgttgcccgagtgatttttaaagtcttataatttctgtagtttgcttagctgaatgaaatgcatactttaattac

SEQ ID NO: 2857 - DNA, 777 bp, Vigna unguiculata
gggtggcgtgtggtgctatcttctcatttcaacttcatttcgtttcatttgcatttcatttcacgttttctttctggaagcttcggcaagcagagatccatggcgtcgttcgatgaagctccccctggaaactccaagaacggcgagaagatcttcaagattaagtgcgctcagtgtcacgccgtcgaaaaaagtggcggtcacaaacaaggacccaatctgaatggtttgtttggaaggcaatctggcacaacccctggatattcctattctaccgctaacaaaaacatggcagtgatttgggaggaaaagaccttgtatgattacttgctcaatcccaaaaagtatattccagggacgaagatggtatttcctggtcttaagaaacctcaggatcgtgcagatcttattgcttatcttaaagaatccactgcctaaggattaaactttcatacatacagttacgcactgttcattcgaagttcctgagatttaaattttcagacatttaattatgtggtgcagcaagtactgtatcaacaaataaagtagacttgatttgtttgcaatgctattttgttcattttgcattgctttttaagaatttccaatatatgggctaatgcccaattaatttagcagttgaaagctgaaacattgttgctgatattaaatttgcagaagcacaatttggtctacctttgttgcccgagtgatttttaaagtcttataatttctgtagtttgcttagctgaatgaaatgcatactttaattac

SEQ ID NO: 2858 - DNA, 618 bp, Cryptomeria japonica
aataattgacgaagaaaaaacacaaggagaaggagaaggagaaggagaaggatcagcatggcaaccttcgaagaggctcctcctggcaatgaaaagtctggagagaaaattttcaagactaaatgtgcacagtgccatactgtagataagggtgctggccacaaacaagggccaaatcttaatgggttgtttggaagacaatctggaacaactgctggctattcatattctgctgctaacaagtcaaaggctgtgatatggggagaagacaccctttatgagtatctcctcaatccgaaaaagtacattcctggaactaagatggtgtttcctggtttgaagaagccacaagatcgtgttgatctgattgcttacctcaagcagtccacatcctagtttagttagtccttgtatcttttcaaaacatgctcattgagggcattattcatagttaattgtttccaccaattcattcgggagattaggttaatgttggacagaactctgccccattgttgaggtgataacttcttttaataaaatggttcataagtgcccaaaatgggttctcttttgtaacactgaatttatgttataagatgacagtatcgagcaatg

SEQ ID NO: 2859 - DNA, 582 bp, Sequoia sempervirens
tacgtttaagaatccccagcggcccaaatcgcaaaaagagaaagtggttgtttagggtttggcgcagagcgcagggatggcatccttctcagaggctccccctggcgatgaaaaggctggagagaagatcttcaagaccaaatgtgcacagtgtcatacagttgacaagggcgctggtcacaagcaagggccaaaccttaatggactgtttgggagacaatctggaaccacgactggctattcgtattctgccgccaacaaaagcaaggccgtgatatggggagaggacaccctttacgagtatctcctcaatcctaaaaagtacattcctggaactaagatggtgtttcctggtttgaagaagccacaagaccgagttgatcttattgcatatctcaagaagtccacctcctagtttaataatttttttttgaaatatattacctagtgtggcattatttgaagttagctgcttttgaaaattcatttgggagagattaggctaatgctgaacagcagttgctgtattgatgaggcgatccatattgttttttaaatatatatgattcatgagttcccaaa

SEQ ID NO: 2860 - DNA, 624 bp, Utricularia gibba
gtgtttacgcattcttgaaggtccgatggcgtcgttcgatgaagccccacctggcgatcagaaatctggcgagaagatcttcaagacaaagtgcgcgcaatgccatacagtcgacaaaggcgccggccacaaacaaggtcccaatttgaatggtctctttggaaggcagtctggtaccacaccaggatattcatattcagctgcaaacaagaacatggccgtgatctgggaagagaaaactctgtacgattacctgctgaatcctaagaagtacattcctggaaccaagatggtgttccctggactgaagaaacctcaggaacgtgctgatctaatctcttatctgaaggcagctactgctgatgcaggctcctcctagaactcaggaaagcattggcgagttggagttgttccagtcgacacttgaaggaataagaacatgatttttggcattcattggccatgcaaatggtccatatccatccacagtgtggggaagacatgttgtctttgtcttgttgctagtcaattggcatactcgagaggattttgccgttgatggctgattcatttccataatgatattgaacaactaatttatgtgccatttatagatggaattgc

SEQ ID NO: 2861 - DNA, 784 bp, Glycine max
aggcagaggcaaatcacataagggagtgccccaaacggtccaacgtcaactcaaaaagttagggctggctttggaggcccgtggcaaacgcgttccaatttcattgttattctcaaaagtgaaaagtatataaatatgaatgtgttctgaatagtcctttcttccttcctttcactctcaatccttttcgcctttgtctgcgaatggcgtcgttcgatcaggcacctcccggcgatgtcaaatccggtgacaaaatcttcaggaccaagtgtgctcagtgtcacaccgtcgaaaaaggtgccggtcacaagcaaggacccaatctgaatggtttgtttggaaggcaatcaggcactactcccggttattcttactcttcagctaacaagaacatggctgttacttgggaagaaaagacactatacgattacttgcttaaccccaaaaagtatattccagggaccaagatggtatttcctggtcttaagaagcctcaggaacgtgctgatcttattgcatatctgagagaatccactgcacagtgattatacattttcatacattcaatttttgcagtgtgctttcaaagttctggagatttaattttcggtcatttagttctgccatgcaggaagtgctgtatctttggcaaataatgtaggctacattggtctacaacgctattttgttcattttgcattgcctctaaaaaaaacagccgaatattggctggtgtaacaaattatctctttaaaattgaaacattcttatcagcatttgattt

SEQ ID NO: 2862 - DNA, 738 bp, Cephalotaxus harringtonia
gggcgatttaagagagattctgtacaaggcataggtattgcctctgtgattcatatctttaccctcctcacccaaacctgaacgaccatggcatccttcacagaggctcctcctggcgatgaaaaggccggagagaagatcttcaagactaaatgtgcacagtgccataccgctgagaaaggcgctggccataaacaagggccaaatcttaatgggctatttggaagacaatctggaaccactgctgggtattcatattctactgccaacaaaacaaaagctgtgacctggggagaagacaccctttatgagtatctcctcaatcctaaaaagtacattcctggaactaagatggtgtttcctggtttgaagaagccacaagatcgctctgatctggttgcatatctcaagaaggccacatcgtagtttagtcaatattttttgaaaacatagtagtagatgacatcattcatagtttactcatttctaagaattcattcggggaactgggagatttaagataatgttggacaagactccgccctattgttgaggtgataacttcttttaataaagatgattcataagtgcccaaaatgggttcttttttgtaatgcggaatttatgtgataaggaagaaggtgacatttttctggaattgcaaaaattgtggtatatattggctcaagagatgtcagtgaagtctcatttgacgatcatttttttaattccaattta

SEQ ID NO: 2863 - DNA, 602 bp, Unknown
  Sequence found in Organisms: Euphorbia peplus, Euphorbia esula
ttgctttacctgtaaagaataagattcgaatcgcagcaaaagaaatctgatggcgtccttcgatcaagcaccacccggcgattccaagtccggcgagaagatctttaggactaaatgcactcaatgccataccgtcgagcaaggcggcggccatgagcaaggacctaatttgaacgggctctttggaaggcagtctggtaccatgcctggatattcctattcttcggctaacaagaacatggccgtcggctggggcgagaatactttgtacgattatttgctcaatcctaagaagtacgtaccgggtaccaagatggtgttccctggactaaagaagccacaagagcgtgcagatctcattgcatatctgaaggaagctactgcttgatcactctgatcagcgagtagtttatcttgagtgactgaaaaatgctggttaatactccttaattttttgttctctaacatgagagggtaatgttcacttctttcaataaaactaggcgggacctaaaagctctgttgttagtttgagggttaaatatcttgtcatggacattccatgtaacacgattcttttttaaaattgaaaggcatttatt

SEQ ID NO: 2864 - DNA, 428 bp, Sequoia sempervirens
catccttcgaagaggctcctcctggcaatgaaaagactggcgagaaaattttcaagactaaatgtgcacagtgccatactgttgagaagggcgctggccataaacaagggccaaatcttactgggctgtttggaagacaatctggaaccactgctggctattcatattctgctgctaacaagtcaaaggctgtgatttggggagaagacaccctttatgagtatctcctcaatcctaaaaagtatattcctggaactaagatggtgtttcctggtttgaagaagccacaagatcgtgctgatctgattgcttacctcaagcaggccacatcctagtttagtcattatatcttttcaaaacatgctcattgatggcattattcatagttaattgtttccaccaattcattcgggagattaggttaaggt

SEQ ID NO: 2865 - DNA, 644 bp, Pinus pinaster
atgggacccacggcatggaggagggtttataattaaccatttagttgtttttctcgtggagaaagatagtggtgcgtgtgtttgccgtgcagaggatcgatagatcgactcaatcaatcaaagtatcaataacattaatcaatggcgaccttctcggaggctcctccaggcgacgctaaggtcggagagaaaatcttcaagacgaaatgcgcgcaatgccatacggttgacaagggtgcaggacacaaacaagggccaaatctgcatgggctctttggcaggcaatctggcacaactgcaggatattcttattctgcaggcaacaaaaacaaggctgtcatttggggcgaggatactctgtatgaatatcttttgaatccaaaaaagtacatacctggaaccaagatggtatttcctggtctgaagaagcctcaagaacgggcggatctaattgcgtatctcaagcaatccacatcgtcagggtagtttagaagagaattatcctcagagataattgttggccggctagattagaatatcctagctaaatttttatttgcgaggatagaatttcaagacgacacatcaccacattattaacaattttttaataaagacgagacagataatgcctaggacgaggc

SEQ ID NO: 2866 - DNA, 1156 bp, Pinus taeda
cggccggggggaaaaatcgacaagcgctaaatcagggaaagggaagatgcgagaagataccgtgggcatggaggagggtttataataaactttttatttgttttttctcgtggagaaagatagtggtgcgtgtttaccgtgcagaggatcgatagatcgactcaatcgatcaaagtatcaataacattaatcaatggcgaccttctcggaggctcctccaggcgacgctaaggccggagagaaaatcttcaagacgaaatgcgcgcaatgccatacggttgacaagggtgcaggacacaaacaagggccaaatctgcatgggctctttggcaggcaatctggcacaactgcaggatattcttattctgcaggcaacaaaaacaaggctgtcatttggggcgaggatactctgtatgagtatcttttgaatccaaagaagtacatacctggaaccaagatggtatttcctggtctgaagaagcctcaagaacgggcggatctaattgcgtatctcaagcaaatcgtcagggtagtttagaggagaattatcctcagagataattgttggccagctagattagaatatcctagctaaaatttttatttgcgaggatagaatttcaagacgacacatcaccacattattaaataacaattttttaataaagacgagacggataatgcctaggacgaggcaaaaattttcccatccaaggtttaaaatctgaaacaagatgtctggcgttgcagctaaatagaaaaaaatgtagatggcgtgtaacttgaagttgatacatttgatttttcttcaagaaagattcaccgatcgagatagatgtggatttcgttatgcaatgtttatttccttttgtaaggatgtaatcttcaaattatcagttttttatttgccttagcgtgaattagagaaaaggaagtcaatgcagtctgcctcccatataaaccctccccactcctgagagttgagacaataaagtgtgcccttttgcctatacacatttagaccatgtaccatgggcttacatgctgttaaatatagcgcagatcatttaaggctaggtaatgctctttggtcttgtgaagatatgctgcattatcttagtgcaacgattgcaaaatttgcaggtagactgatggt

SEQ ID NO: 2867 - DNA, 511 bp, Adiantum capillus-veneris
cttaaccctaacttccaattccatggccaccttcagcgaggctcccgctggtaaccctaaggccggagagaagatcttcaagaccaagtgttcgcagtgccatgttgtcgagaaaggcgccgggcacagacaaggtcccaacctgaatggccttttgggtaggcagtcaggtactaccgccggctactcttactctgcagccaacaagaacaaagctgttgtatggggagaagaaactctttacgagtacctcctcaaccccaagaagtatattcctggaacaaagatggttttcccagggctaaagaaacctcaagatcgagctgatttgattgcatatttgaaggaatcgacacaggagtaaagctgctctttttagcaaatttgtaggttttcagactttgaaccgcagtacattgctgctgagaaagtataattgttcggatcacagatattaaaggattttgctgggaaatataaataatgtatagcagattgcggccattgtttc

SEQ ID NO: 2868 - DNA, 1289 bp, Marchantia polymorpha
  misc_feature (534)..(534): n is a, c, g, or t
tgcggccttccgtcctggaatgagcaagcattttggcgatgttggcagattccacgatggccttcacgatggccttcactgtaggccagtattttgcgctcatgactcgtggttctccgcaatcgctcaagggctctgatggaactcgaggttcacaggtcccaaactttgaggaccggaaagggcacctgctctgttcgacagaaagaacctgcgggtgcacaagattccccactctgtgtggcgtggcgaggatctggatctggagcgagcgagcgagtgcctcgtgatgtgacgcgatgcgatgcgatgctcttctctgtagctgcacggtgcgccagcgatcttgcatctcgaagatgatgagcattgcggcccgaggaatgccggaattgatcctgtgcatgacgatgcgagtgaggcgtcggtgcgattaggagcgagcttggattatatcaggttctcgcattggacctgaaacgatcgacaagctttcgtttgccatcgagaagcagcaggtatcgtccggtatcnaaaccgagtcgatccgagacctcgatcagcacgcaccgtcaccatggccacattcgctgaagcgcccgcaggcaacgtcaaggccggcgagaagatcttcaagaccaagtgcgcccagtgccacgccgtggagaaggcggccggccacaagcagggcccgaatctgtcgggcctgctgggccgaacgtcgggcaccacggccggctactcgtactctgccgccaacaaaaacaaggccgtcgtgtggggcgacgagactctgtacgaatatctgctcaacccgaagaagtacattcctggcacgaagatggtgttcccgggcttgaagaagccccaagagcgagccgacctgatcgcctatctgaaggagaacgccaatgcctgaagcgcgtccacaattttgtctctcgtcgtccttagatccagacgatacattcccatctgcgttccttcgagtcgatcacgtctagcagcaagctcgagggaccactggtggatttcatacggtatagatttgacagatgcgggtttggaacagagcccattggtcgggtggtataggattattaagtggtcgttgcattatctctcccaccttgttcggagtgacgatatttgacactggcaggataaaaggaagagaccattgagtgagaccaacttttgaccttgcacaatctcgttctcccggattgggttggtttgattctcactctcgttttgctgcaagaggttgaattccatcgtctgtacgg

SEQ ID NO: 2869 - DNA, 691 bp, Phaseolus vulgaris
gcatgtcttctcaatagttcattcctttctacttttcccttcgattcctcaaacctattcgccttcctccgcgaatggcgtccttcgatctagctcctcccggcgatgtcaaatccggcgacaaaatcttcaggacgaagtgcgctcagtgtcacaccgtcgagaaaggtgccggtcacaagcaaggtcccaatctgaatggattgtttggaaggcaatcaggcactactcccggatattcctactcttcagctaacaagaacatggccgtgacttgggaagaaaagacactatacgattatttgcttaaccccaaaaagtatattccagggactaagatggtatttcctggtctgaagaagccccaggaacgttctgatcttattgcatttctgaaagaatccactgcacagtgattatacattttcgttcattcaatttttcagtgtgttttcatagttcaggatatataattttcggaaaacgtttagtttctgcaggaagtgccgtatctttggcaaataatgtaggctacattggtctgcaatgctattttgtttattttgcgttgcttctagaagagcagccgagcattagctggtgtaacaaattgtctcttgaaaattgaaacattcttttcatcagcattttatttaattcgaaccacagctccttattgtgcttcgctgaa

SEQ ID NO: 2870 - DNA, 694 bp, Bupleurum chinense
ttctctctctaaaaaaaaaaacaacaaatcaatggcgtcgttcgcagaggcaccaccaggcaacaaggattctggagccaagatctttaagactaagtgcgctcagtgtcatacagttgaacaaggtcaaggtcacaaacaaggacccaatcttaatgggttttttggaagacaatctggaacaactcctggatattcgtactctgctgctaacaagggcaaggctgtgatttgggaggaaaacacgctttatgattacttgctgaatcccaagaagtatattcctggaactaagatggttttcccaggactgaagaagccacaggatcgtacagatctcattgcatatctgaaagaggctaccagttaagctacttcttctattgggtgaagcagttgctaaaactacggaataggcaatggtgaagcagagaaacaactatttcttttgaaaataatttactttttgagctattctatgtagactcttttacatgaggtcgaatttgaccaccaaaacatttgattcggatgaaaccatagataatagctatatcatatgattatttgtcaaagcagtagtgatgttttgagacattatttttaaacttgtttgtgcaacttgcattttatttttttctcgaatagattggttggatgtcattccgacagcataatggttgcttgttggaca

SEQ ID NO: 2871 - DNA, 549 bp, Euphorbia peplus
tcccggcgacgcaaaagccggagagaagatcttcaagactaagtgcgctcaatgccacaccgtcgatcaaggcgccggtcacaaacaaggacctaatttgaatgggcttttcgggaggcaatcagggactactgctggatattcttactctgctgctaataagaataaggccgtggcttggggagaagataccttgtatgattaccttcttaaccctaagaagtacattcctggaactaagatggttttccctggtttgaaaaagccacaggatcgtgcggatctcattgcctatctgaagggagctactgcctaatctgcttgtttagtatgtgctatatagcaattcatgacattattaatatcctagacagtttattttttcaaagaagagaaaattgtccacttctttcaaataaaaagatggattgaggcgcaaatgatactcaaatattttgggaattgagattaggagaatactgttgttgtaaactctttttcatgaatgatttcatggatcccttattaattttttgatagtcataatac

SEQ ID NO: 2872 - DNA, 666 bp, Triticum aestivum
gaagacacgcagggccggcgaggaaggaaaggaagggatggcatcgttcggcgaggcgccggcaggcaacgccgcgagcggcgagaagatcttcaagaccaagtgcgcgcagtgccacacggtggagcgcggcggcgcccacaagcagggccccaacctcagcggcctcttcggccgccagtccggcaccaccgccggatatgcctactccaccgccaacaagagcatggccgtcgtctgggaggaaaacaccctctacgactacctcctcaaccctaagaagtacatccctgggaccaagatggtgttcccgggcctcaagaagccgcaggagcgcgccgacctcatcgcatacctcaagaaatccaccgcttaattattaccagcttgattcttcttccatcatctcaagtaccgcgcgcaaacaagaagaaactaacgtcaataagtttgccagacacatgcgtgtatatatatagctagctgtctgctgcatgcagtatatatgtttatgtacgatatattgattgattcatccatgtgtacgtacgtgtccatgtaattaaaatggtgatccattttatctacaaaaccgtgcatttcttgtctttttcccctcacatttatcaggattgggtttaaatgtccaaaaaaaaaaaaaaacga

SEQ ID NO: 2873 - DNA, 684 bp, Triticum aestivum
gaagacacgcagggccggcgaggaaggaaaggaagggatggcatcgttcggcgaggcgccggcaggcaacgccgcgagcggcgagaagatcttcaagaccaagtgcgcgcagtgccacacggtggagcgcggcggcgcccacaagcagggccccaacctcagcggcctcttcggccgccagtccggcaccaccgccggatatgcctactccaccgccaacaagagcatggccgtcgtctgggaggaaaacaccctctacgactacctcctcaaccctaagaagtacatccctgggaccaagatggtgttcccgggcctcaagaagccgcaggagcgcgccgacctcatcgcatacctcaagaaatccaccgcttaattattaccagcttgattcttcttccatcatctcaagtaccgcgcgcaaacaagaagaaactaacgtcaataagtttgccagacacatgcgtgtatatatatagctagctgtctgctgcatgcagtatatatgtttatgtacgatatattgattgattcatccatgtgtacgtacgtgtccatgtaattaaaatggtgatccattttatctacaaaaccgtgcatttcttgtctttttcccctcacatttatcaggattgggtttaaatgtccctttaatatgtagtgcattaaaaattaaatacagta

SEQ ID NO: 2874 - DNA, 630 bp, Utricularia gibba
cgtcgttcgatgaagctcctcctggtgatcagaaatctggcgagaagatcttcaagactaagtgcgcgcaatgccacaccgtcgacaaaggcgccggccacaaacaaggccccaacttgaatggtctctttggaaggcagtctggtaccacgcctggatactcctactcagctgccaacaagaacatggctgtgatctgggaagagaaaactctgtacgactacttgctgaatcccaagaagtatatacctggaaccaagatggtgttccctggactcaagaaacctcaggagcgtgctgatctaatctcgtatctgaaggcggctactgccgatgcaggcacatcctagaacaccgagaaaccattggcaggtaggcttctccatccagcctacacttgaaagaataagttataagaacatgatttttggcattcattggtcacactgtggggaggacttggtggttgttgttcccttactagtcatgtggcatccatacctaaacgtgccattgatggctgattcatttccatcatgagatggacataacatgtttctgcatcaccacttacacttgaatgcgtgtaggatagtaatttgtggaacaaaaaaaaaaaaaaaacacgcg

SEQ ID NO: 2875 - DNA, 680 bp, Cedrus atlantica
gcgttgcatgtgtttgtcgtgcgctctctcgcttagtgtgagagagaatcgatagattgaatcaatcaaactaccagtcgaatcgatcaaatggcgaccttctcggaggctcctccgggcgacagtaaggccggagagaagatctttaagacaaaatgtgcgcaatgccatacggctgaaaagggtgctggacacaaacaagggccaaatctgcatggcctttttggtaggcaatctggcacaactgcaggatattcttattctgcaggcaacaaaaacaaggctgtcgtttggggcgaggatactctgtatgaatatcttttaaatccaaagaagtacatacctggaaccaagatggtattccctggtctgaagaagcctcaggatcgagcagatctaattgcatatctcaagaaggccacatcgtcagagtagttcagaggagagttatcctccaagaaataaatgatgggcggctagtttgcaatatcttagctaaacttattgtttgcaaggatagacttccaatatgacacatcgcacctgattaaatggcattttttaaaatagagactaaataaatatgcctaggttgaggcaatttttttcccatccaggtttcaaaatctgaaacaagatgtccgacgttgaagctaaatagaaaaaaaggtagatggtgt

SEQ ID NO: 2876 - DNA, 742 bp, Podocarpus macrophillus
ggttgtcgaagttggaggaaagaagcgggtcacgtggagcactgtatcgatgatgctagaatgttgcgcttctcctgaataaagggttagggttttgggaagggaagagttttgtatgagcaaaaaggtctctctttgacttgaaatctctgatggcgaccttcgcggaggctcctcctggtgatcccaaggcaggagagaagatcttcaagactaaatgtgcccagtgccacactgtcgagaagggtgccggccataagcaaggaccaaacttgcatgggctattcggaaggcagtctggcacaactccaggatattcgtattctgcaggaaataaaaacaaggctgtcatctggaatgaggaaactctttatgaataccttctaaatcctaaaaagtatatacctggaactaagatggtattccctggcttgaagaagccaaaagagcgaacagatttaatagcatatctcaagcaggctacatcatcagaatagtttgaaagaagagttatccttggagaaataattaatgggcggcttatcttcaaaaggagagttattcttttccattatggagtattaatatttttggacataagacattgccaccttgttaggtcatgacgtttttctgtttatatggtgataatatttttttaataaagatgatttacatgaagctccgtttgtgtgtcagaattctccctcagcaaattaaaaatttaaaccgcattttatct

SEQ ID NO: 2877 - DNA, 862 bp, Picea glauca
acgaggccatggtggtaaacctgacgagcggtgatgaagggaagggaggatgcgagaagataccgtgggcgtggaggaggaggctttataaggaaggaacactttatttgctcttcttgtgagtaagacagcggtgcgtgtgtttgtcgtgcgctctctcgctcagtcagattgatcaatgtcgaccttctcggaggctcctccaggcgacaccaaggtcggcgagaagatcttcaagatgaaatgcgcgcaatgccatacggttgacaagggtgccggacacaaacaagggccaaatctgcatgggctctttggcaggcaatctggcacaacagcaggatattcttattctgcaggcaacaaaaacaaggctgtcgtttggggcgaggatactctgtatgaatatcttttaaatccaaagaagtacatacctggaaccaagatggtattccctggtctgaagaagcctcaagaacgggcggatctaattgcgtatctcaagcaggcctcatcgtcatagtagtttagaggagaattattcttggagaaataactgatgggtggttagattacaatatcctagctaaaattttcatttgcgaggatagattttcaatatgacacatcaccacattagtaaatagcattttttaataaagacgaaacagataatgcctaggacgaggcaaaatttttcccatccaggtttaaaatctgaaacaagatgtctggcgttgtagctaaatagaaaaaagtgtagatggcgtgtaccttgaagctgatttatttgatttttcttcaagaaagattcaccgactgagctaaatgtggatttcattatgcaatgtttatttgcttttgc

SEQ ID NO: 2878 - DNA, 644 bp, Abies balsamea
atcggtgcgtgtgtttgtcgtgcgctctctcgcttcgcgtgggagagaaatcgatagatcgaatcaattaatcaaaccatcagtcgtatcaattaatggcgaccttctcggaggctcctccgggcgatagcaaggccggagcgaagatcttcaagacaaaatgtgcgcaatgccatacggctgagaagggtgctggacacaaacaagggccaaatctgcatgggctctttggtaggcaatctggcacaaccgcaggatattcttattctgcaggcaacaaaaacaaggctgtcatttggggagaggatactctgtatgaataccttttaaatccaaagaagtatatacctggaaccaagatggtattccctggtctgaagaagcctcaagagcgggcagatctcattgcacatctcaagaaggccacatcggagtagtttagaggagaattatcctcagagaagtaattgatgggtggctagattacaatatcctagctaaatttttcgtttgtgaggatagaattccaatatgacacatcaccaccttattaaatagcattttttttaataaagacggaacaggtatgccttagatgaggcataaattttcccatccaagtttcaatatctgaaacaagatgt

SEQ ID NO: 2879 - DNA, 702 bp, Phaseolus vulgaris
ttcctattatggccgggggtcttctcaatagttcattcctttctacttttcccttcgattcctccaaacctattcgccttcctccgcgaatggcgtccttcgatctagctcctcccggcgatgtcaagtccggcgacaaaatcttcaggacgaagtgcgctcagtgtcacaccgtcgagaaaggtgccggtcacaagcaaggtcccaatctgaatggattgtttggaaggcaatcaggcactactcccggatattcctactcttcagctaacaagaacatggccgtgacttgggaagaaaagacactatacgattatttgcttaaccccaaaaagtatattccagggactaagatggtatttcctggtctgaagaagccccaggatcgttctgatcttattgcatttctgaaagaatccactgcacagtgattatacattttcgttcattcaaattttcagtgtgttttcatagttcaggatatataattatcggaaaacgtttagtttctgcaggaagtgccgtatctttggcaaataatgtaggctacattggtctgcaatgctattttgtttattttgcgttgcttctaaaaaagcagccgagcattagctgatgtaacaaattgtctcttgaaaattgaaacattcttttcatcagcattttatttaattcgaaccacagctccttattgtggttcgc

SEQ ID NO: 2880 - DNA, 871 bp, Picea glauca
gcgaacaacgaggccatggtggtaaacctgacgagcggtgatgaagggaagggaggatgcgagaagataccgtgggcgtggaggaggaggctttataaggaaggaacactttatttgctcttcttgtgagtaagacagcggtgcgtgtgtttgtcgtgcgctctctcgctcagtcagattgatcaatgtcgaccttctcggaggctcctccaggcgacaccaaggtcggcgagaagatcttcaagatgaaatgcgcgcaatgccatacggttgacaagggtgccggacacaaacaagggccaaatctgtatgggctctttggcaggcaatctggcacaacagcaggatattcttattctgcaggcaacaaaaacaaggctgtcgtttggggcgaggatactctgtatgaatatcttttaaatccaaagaagtacatacctggaaccaagatggtattccctggtctgaagaagcctcaagaacgggcggatctaattgcgtatctcaagcaggcctcatcgtcgtagtagtttagaggagaattattctcggagaaataactgatgggcggttagattacaatatcctagctaaaattttcatttgcgaggatagattttcaatatgacacatcaccacattagtaaatagcattttttaataaagacgaaacagataatgcctaggtcgaggcaaaatttttcccatccaaggtttaaaatctgaaacaagatgtctggcgttgcagctaaatagaaaaaagtgtagatggcgtgtaccttgaagctgatttatttgatttttcttcaagaaagattcaccgactgagctaaatgtggatttcattatgcaatgtttatttgcttttgca

SEQ ID NO: 2881 - DNA, 934 bp, Picea glauca
  misc_feature (923)..(923): n is a, c, g, or t
  misc_feature (926)..(926): n is a, c, g, or t
cacgcgaacaacgaggccatggtggtaaacctgacgagcggtgatgaagggaagggaggatgcgagaagataccgtgggcgtggaggaggaggctttataaggaaggaacactttatttgctcttcttgtgagtaagacagcggtgcgtgtgtttgtcgtgcgctctctcgctcagtcagattgatcaatgtcgaccttctcggaggctcctccaggcgacaccaaggtcggcgagaagatcttcaagatgaaatgcgcgcaatgccatacggttgacaagggtgccggacacaaacaagggccaaatctgtatgggctctttggcaggcaatctggcacaacagcaggatattcttattctgcaggcaacaaaaacaaggctgtcgtttggggcgaggatactctgtatgaatatcttttaaatccaaagaagtacatacctggaaccaagatggtattccctggtctgaagaagcctcaagaacgggcggatctaattgcgtatctcaagcaggcctcatcgtcgtagtagtttagaggagaattattctcggagaaataactgatgggcggttagattacaatatcctagctaaaattttcatttgcgaggatagattttcaatatgacacatcaccacattagtaaatagcattttttaataaagacgaaacagataatgcctaggtcgaggcaaaatttttcccatccaaggtttaaaatctgaaacaagatgtctggcgttgcagctaaatagaaaaaagtgtagatggcgtgtaccttgaagctgatttatttgatttttcttcaagaaagattcaccgactgagctaaatgtggatttcattatgcaatgtttatttgcttttgcattggatgtgctcttcaaattatctattctttatttatttgcttttgcanggnttaaaaaa

SEQ ID NO: 2882 - DNA, 647 bp, Lactuca sativa
tctccgcccatttggcaaccctctgattgccctcgccgtctcttagtggatatatgcttaaggagaaaataccgcctccggcccgattctcgatttacacagatcgatggcgtcgtatcgcggaagcgctccagcaggaaacgccaccgctgcgcgagaagatcttccagactaaatgcgctcaatgtcacaccgtccagaaaggcgccggccacaaacaaggacccagatcttaatggactatttggaaggcagtctggaacaactgctggatactcttattctgctgcaaacaagaccaaggctgtcaattgggaggaaaatactttgtatgactacttgttgaaccccaagaagtacatccccggaacaaagatggttttcccaggactgaaaaagccacaggagcgtgcggatcttattgcatacctcaagacatccacctcataattttttttcttcttgtttatgttttaacaccatttcgaagtttttttctttgatgatttgaggtggttggttataaggggataaatttggatttctttttcatgaagaataaggggagagtacattcaacatatttcattgctccttaaatttttgagcactgctttattcaattggcaagagattgtcttatgcaa

SEQ ID NO: 2883 - DNA, 397 bp, Hordeum vulgare
aagaagaaagagagacacaattagctagctagactagatcgagatggcatcgttcggcgaggccccggcggggaacgcggcgggcggcgagaagatcttcaagaccaagtgtgcgcagtgccacacggtggagcgcggcggcgcccacaagcaaggccccaacctcagcggcctcttaggccgccagtccggcaccaccgccggctacgcctattccaccgccaacaagaacatggccgtcgtctgggaggaaaaaaccctctacgactacctcctcaaccctaagaagtacatccctgggacgaagatggtgttcccgggcctcaagaagccgcaggagcgcgccgacctcattgcctacctcaagcaatccactgcttaattaccgcaaaaaaaa

SEQ ID NO: 2884 - DNA, 401 bp, Euphorbia peplus
tggcgtccttcgagcaagcaccggccggcgatgccaagtccggcgacaagatcttcaggactaaatgcgctcaatgccataccgtcgagcaaggtggcggccataagcaaggtcctaatttgaacggcctctttggaaggcagtcaggtactatgcctggatattcttattcttctgctaacaagaacatggccgtcggttggggcgaccatactttgtacgattatttgctcaatcctaagaagtacatacccggtaccaagatggtgttccctggactgaagaagcctcaggagcgtgcagatctcattgcatatctgaaggaagctactgcttgatcattctgatcagtgagtagtttatcgtgaatgacttacaatgctggttattagttcattttt

SEQ ID NO: 2885 - DNA, 578 bp, Podocarpus macrophillus
aacgatttagtgaggtcgggactctgttgtggttgtggttggggttgcagcttcacttgttgagattcaaagcggatcatggcagcgacattctcagaggctcctcctggtaacgagaaatcgggagagaaaattttcaagacaaaatgtgcacagtgtcatacagtcgaaaagggtcaaggccacaaacaagggccaaatctgaacgggctgttcgggagacagagtggaaccactgctggctattcatattctgctgccaacaaaaataaggctgtcatctggggagaggatacactctatgaatatcttctcaatcctaaaaagtacattcctggaacgaagatggtgtttcctggtttgaagaagccacaagaccgcactgatctgattgcgtatcttaagaaggccacatcctctgattgatcagaataccatttttatagcaatgctgaatagaatattcatagttgtttttttgttagaataccatttttatagcaatgctgaatagatattcatagttgttttttgttaaattctattcttggagattaggttaatattaacagtactcc

SEQ ID NO: 2886 - DNA, 540 bp, Setaria italica
gatccttagcttcttcaccaacgacgacgacggtatagtatggcttccttcgccgaggcccccgccggtgacgccggcagcggcgagaagatcttccgcaccaagtgcgcgcagtgccacacggtggagcgaggcggcgcgcacaagcagggccccaacctgcacggcctcttcggccgccagtccggcaccaccctcggctacgcctactccacggcgaacaagaacatggccgtcgtctggggagaaggcaccctctacgactacctgctcaaccccaagaagtacatcccgggcaccaagatggtcttcccggggctcaagaagcccaaggagcgcaccgatcttatcgcctacctcaaggaatccacggcttaatttgagcaccgatctcatcgcctacctcaagaaatccacggctaaatttgattgttaaattgtagatcttgtcgaatggtacaattttcacgtaaagtttatttttatccaaatctatatgtaaaatgtaaaagttatgaatttttgaatttccaagttcat

SEQ ID NO: 2887 - DNA, 1006 bp, Beta vulgaris
tgacttatgaggcccaacatttggttagtttcttcttccccaagtccaacctttcctttctttaaaagtttttctcataccctagaattctccctcaaaaaacagaagaatacgcaaatcagaggagagagaaaacataaaaaaacgcaaaaatggcgaccttcagcgaagctccagcaggaaacaaagatggcggagctaagatcttcaagatgaagtgcgctcaatgtcacactgttgaacaaggagctggccacaaacaaggtccaaatctaaatggcctctttgggaggcaatctgggacagctgctgggtactcttactctgctgctaacaagaacaaggctgttgtctggggggaagacactctatacgaatacttgctgaacccaaagaagtatatccccggtacaaagatggtgttccctggtttgaagaagccacaagatcgtgcggaccttattgcctatctgaaggaatctactcagtaattgcacaacatacttttcccatcttttgtgtaggagaagatcaaaggaggattttgatcgcgaaatgagatttttttgcttcttagtgaacttagaattcgtttttgttaaataagatttactatgctggggaaattataccctcgattcttactatatcttgctgctatagcttggtctattgacgattatttacagacgaatcatagacttgttttgctccatgaatggaaaaaggaaattggaaaattgttcgatctcttttgtaatagatgctggtttattgattacatatgtttcacactgtgatcagcgtaggctattattttttcatcttcaaatggagaagtggggctcgtcaactgggccaaaaagctctgctaggagaccatattcaacccactttttggtttgttctctgagccagccttacttatgggtaaattctctggcctttgtacatgcatatataggttaaagattgatatgtgttttaagtttattttagcctattg

SEQ ID NO: 2888 - DNA, 653 bp, Beta vulgaris
  misc_feature (38)..(38): n is a, c, g, or t
ggccggggccccaaaaaacagaagaatacgcaaatcanaggagagagaaaacataaaaaaacgcaaaaatggcgaccttcagcgaagctccagcaggaaacaaagatggcggagctaagatcttcaagatgaagtgcgctcaatgtcacactgttgaacaaggagctggccacaaacaaggtccaaatctaaatggcctctttgggaggcaatctgggacagctgctgggtactcttactctgctgctaacaagaacaaggctgttgtctggggggaagacactctatacgaatacttgctgaacccaaagaagtatatccccggtacaaagatggtgttccctggtttgaagaagccacaagatcgtgcggaccttattgcctatctgaaggaatctactcagtaattgcacaacatacttttcccatcttttgtgtaggagaagatcaaaggaggattttgatcgcgaaatgagatttttttgcttcttagtgaacttagaattcgtttttgttaaataagatttactatgctggggaaattataccctcgattcttactatatcttgctgctatagcttggtctattgacgattatttacagacgaatcatagacttgttttgctccatgaatggaaaaaggaaattgcg

SEQ ID NO: 2889 - DNA, 362 bp, Setaria italica
tatggcttccttcgccgaggcccccgccggtgacgccggcagcggcgagaagatcttccgcaccaagtgcgcgcagtgccacacggtggagcgaggcggcgcgcacaagcagggccccaacctgcacggcctcttcggccgccagtccggcaccaccctcggctacgcctactccacggcgaacaagaacatggccgtcgtctggggagaaggcaccctctacgactacctgctcaaccccaagaagtacatcccgggcaccaagatggtcttcccggggctcaagaagcccaaggagcgcaccgatcttatcgcctacctcaaggaatccacggcttaatttgagcaccgatctcatcgcc

SEQ ID NO: 2890 - DNA, 424 bp, Glycyrrhiza uralensis
ggctcgttttttcgtccaacccaacccaacccctcccttctaccttcattcattagttcgctttctccaatcctttgttgtccttgcagagaatccaatactggtcacgaatggcgtcgttcgatcaggcacctcccggcgatgtcaagtccggcgagaaaatcttcaagacaaagtgcgcgcagtgccacaccgttgaaaaaggtgctggtcacaagcaaggacccaatctgaatggtttgtttggaaggcaatcaggcactactcccggatattcctactctgcagccaacaagaatatggctgtgacttgggaggaaaagactttatatgattacttgcttaaccccaaaaagtatattccagggacaaagatggtatttcctggtcttaagaagccccaggaacgtgctgatcttattgc

SEQ ID NO: 2891 - DNA, 816 bp, Marchantia polymorpha
cgtcaatcgatcgtgtgttcggctcacgacgggaggctattagcaaacgatctctgcttgcagaagtactcgacgccacacgcctgcaacgcacgccaccacgccccggattgcgaggtttttcgaaattggctcgctgctctcgatctgagcggcgctagtcgtctgattcgagcggtatacgatggccaccttcggcgacgctcccgctggcaacgccaaggccggagagaagatcttcaagaccaagtgtgctcagtgtcacgccgttgagaagtccgccggccacaagcagggtcccaatctctctggactgcttgggcgaacgtctggtaccacagcagggtactcgtactctgctgccaacaagaacaaggctgttgtttggggagaggacactctttacgagtacttgttgaacccgaagaagtatattccgggaacgaaaatggtgttccccggtttgaagaaacctcaggaacgagccgacttgattgaatacttgaaagatgccacttaatcgagtagcaattcacatacatcccaggtacaaagatggtgtttcctggtttgaagaaaccacaagaacgagcagatctcattgcctatctgaaggagaacgactcgtagtgtggttctacaattttgtctcccggccggcaaaagctacatgctacatccaattcgatctacttgccgacgaagaagcacagggttacttaaaaaatgataagactttagggattctatgggagggaataagaaagaagcccactttcctgggtgtggacacaggatatcttgcaccatttttgt

SEQ ID NO: 2892 - DNA, 676 bp, Physcomitrella patens
tttcgtcgctgccgtgctcgctcgcctgctccttgcttccgctccaactcaagctgagctgaatttgttgggttttgacttcttccccccacgctcgtccaaagtcgctgttttgatccgtctctgctatggctaccttcgctgaggctcccaaaggtaacgagaaggctggggagaaaatcttcaagaccaagtgcgcgcaatgtcacgctgttgagaagtctgccgggcacaagcaaggtccaaacctgaatggattattcggaaggacttcagggaccaccgctggatatacttactccaaagcaaacaaggacaaagccgttgtgtgggacgaagagcagttgtacgagtatttgttgaacccaaagaagtacattcctgggacgaagatggtcttccccgggttgaaaaagccacaagagcgagcagaccttattgcttacttgaagagttcgacatcgagttgaagatctgcacacagttttgttgttagagcctagcagcctcttgcagagattagtaggggctacagtaggtatcatctacatgagggacacaggatcgcttggaatgtgtgtttcgatcaagtgatttttgcccaattctttccaatgcacggcagttttgttgagcacattgcaataaagccgtggaattctacttcctcttgtaa

SEQ ID NO: 2893 - DNA, 726 bp, Pteridium aquilinum
cagattcgctggatgcggggtttcagaaacgacatctgcctgtgtcgctgtagatcactttcattctgctgtgtcgtatctcttgtttgcgtgatcttgtgctttggactctggagcagccatggctaccttcgccgatgctccgcccggtgatgtcaaagccggagagaagatcttcaaaaccaagtgttcccaatgccatgtcgtcgagaagggagccggccacagacaaggcccaaaccttcatggcctgctgggaaggcagtctgggacaactccaggctactcctattccaatgccaacaagtccaaagcagttgtctggagtgaagaacatttgtatgagtatcttctcaacccaaagaagtatatcccagggacaaagatggtgtttccaggcttgaagaagccaaaagagagggctgatcttatcgcatacctgaaggaagctactgcagaatgaagtggcaatattttctctcctctcctcctggaaacctgaatagtttgatgttttgaggatgcagcacattgctgcagagactatgttgatcgcttctagacacttcgcaataagtttacagcaaggtaaataatcccgaacagatctcgagcaattcagatcatgtcgccaatctgccttaggtctgctgcctattttggttgcactcccaagttttgtattgccctagcttaggctgtactatgcgcaatgccctcttattc

SEQ ID NO: 2894 - DNA, 1083 bp, Zostera marina
gcctcttttttcctctctctctctctctctctctctgtgtgtgtgtgatcatctgtttgtggaggagagcggtgtgatctgtagatatggcatcattcgcagaagcgcctccaggggatgcagccaacggagccaagatcttcaagactaagtgcgcacagtgccacaccgtcgagaaaggtgctagccacaaacaaggtcccaacctaaatgggttattcgggcgacagtcaggtacagccccaggatactcgtattctgctgcaaacaagaataaagccgtgatttgggaagagaacactctgtatgattatctgctcaatcccaagaagtacattcctggaactaagatggtattcccagggttgaagaagccgcaagagcgtactaatctgattgcattcctcaaggattctacctcagcataaaatctaaattatgctcgttttgtgtaataagatagacacagacatagagagaccaattcaaggtctggtttttcttctatactctgtgtaaacagttaacagacccatttctcttttttacttgtctccttttgagatcatttttttacatttgtcttcgcaatttattatcattattacttatcagacgattatgaaataatagagtttaatattgaacatgtctgtttattatttaaattcatagttgtttatttaaaaagaaagcagattttaccgccgctcaacggaggaattatggctaactcatcgccgtgtttcaagagagtggattcatctgcatactcctcgttgatggccagcagcatggacttacaaatctcctgcaatcttgggaacatacacaggagcctttccatggtgcttccagcgctgctaccacaaggaatcttcagagacacgacactcttaccggttagatctctagctcttgcaaagaacaaaacgttcaccgaaaccgatttggtttcgtcgtcgtcatcatcatcatcatcatcgtcatatccttttcgcttttaggttcctccgcagccatcgatgacgtgggagcgaggagacagatgaagaaaggagattcagtgtacctatgtcaacg

SEQ ID NO: 2895 - DNA, 561 bp, Pteridium aquilinum
aaaggccggagagaagattttcaagaccaagtgcgcccagtgccacaccgtcgagaaaggtgccggtcacaagcaaggcccaatctcaacggtctgtttggaaggcaatcgggtacaactccagggtactcatactccgctgctaacaagaacatggctgtgaattgggaggagaaaactctgtatgattacctcctcaatcctaagaagtacatccctggaaaaaaatggttttccctggattgaagaagccacaggaacgtgctgacctcattgcatatttgaaggaatctacagcaccctaaatggttttgcacagtcttggtttacctactccattttgcagtcattggagattgtttctcacagcaaggatataataaattcgaccttgttggtcagccatgctctttgtagaatgagcattcttagtaattgtttatttgagaagaggttgccattgctgtcataagtagggcatattcaatttagacttcatgaatttctggtgaattaccagcatgcaaatgagaattttttcatactgttaaccaaaaagaa

SEQ ID NO: 2896 - DNA, 463 bp, Flaveria ramosissima
gaccattcaacgtgactccttcccttttgccctaaaacttctctttcaatacataacaacttccatcttcatcctccatcctctccaaacaccaacaccttcgcgaaaccttcaacaggcgatcgatcatcatacatcaatggcgtctttcgccgaggctcctgccggaaatgccaccgccggcgagaagatcttcaagaccaagtgcgctcaatgccacaccgtcgagaaaggcgctggccacaaacaaggacccaatctaaatggactttttggaaggcagtctggaactactgctggatattcttactccgctgctaacaagagcaaggctgttacatgggaggaaaacactttatatgactacctactcaaccctaagaagtacatccccgtaacaaagatggttttcccaggattgaaaaagccacaggagcgtgcagattgattgcatatctcaagg

SEQ ID NO: 2897 - DNA, 723 bp, Secale cereale
ccccgccgcctccagcctcctgcgacccggatcgccttccgttcctccagccgagggatccccaaccctacctagcccggcaaccgtccgcgcgggatcagcggcagcgacgatggcgtcgttctcggaggcgcccccggggaacccggcgtccggcgagaagatcttcaagaccaagtgcgcccagtgccacaccgtcgacaagggcgccggccacaagcaagggcctaacctgaatggtctgtttgggaggcagtctggcacaactcctggatattcttactctacggccaacaagctcatggctgtgaattgggaggagaaaacactgtatgactacctgcttaatccaaagaagtacatccctggaactaagatggtgttccctggactgaagaagcccaggagcgtgctgatctcatcgcatacctgaagggtgccacggcttgaaaggctttgctttgctgccatcggccctaaagtgaactaaaatgacattgccacggtgtcactctggttgacgggtaattgccgagacattaaaagggtttggtactagcatttctccttacgatcggtttctttccttcagctaaaatgcactgctagtaatcggccgttttctcaggccttgtttgcgaaccttgttacgtttgttgactgacgatgatctagttggtttgggcagtagatctacgagcatactattaacttgtttctagg

SEQ ID NO: 2898 - DNA, 394 bp, Secale cereale
agggatccccaaccctacctagtccggcaaccgtccgcgcgggatcggcggcagcggcgatggcgtcgttctcggaggcgcccccggggaacccggcgtccggcgagaagatcttcaagaccaagtgcgcccagtgccacaccgtcgacaagggcgccggccacaagcaagggcctaacctgaatggtctgtttgggaggcagtctggcacaactcctggatattcttactcgacggccaacaagctcatggctgtgaattgggaggagaaaacactgtatgactacctgcttaatccaaagaagtacatccctggaactaagatggtgttccctggactgaagaagcccaggagcgtgctgatctcatcgcatacctgaaggtgccacggctt

SEQ ID NO: 2899 - DNA, 1535 bp, Ceratodon purpureus
gtcctacataccaccactttcaggcccctcacggtttctaatatgcatcatactttcaaaccgttaccatctcctaaaccagaaacatgtactctcagtaatgattgtggtccaggtatgtaaccattgtgtagaggagagtggttattggtgcggtgacgggtattggactccacgcgctcgcgagtgtattcgagaggacttccaggtgagtggagtctgtttttctgcttccgttcgcgttattgttgctgtgtctagagcgcagacacctcgtggagccttagggtttcgtcttccttcgtgctagagcttgctctctcgtcttctgccgccatggccagcttcgctgaggcgcccaagggtaacgagaaggccggtgagaagattttcaagaccaagtgcgcgcagtgccacgtcgtcgagaagggtgccggacacaagcaaggtcccaacctacacggtttgtttggaaggacgtcaggtaccaccgctgggtacgcctactccaaggccaacaaggacaaggccgtggactggaatgaagagcacctgtacgagtacttgttgaacccgaagaagtttattcccggaaccaagatggttttccccggattgaagaagccacaagagagagccgaccttatttcctacttgaagaagtcgacttcagagtaaatagtactcgcaattttgttgctagagccaagtagcctcaggtagaatttagtgggggttgcaatggtgagcatttaattgagggacgtggcttttcctggagccatgtaatcccaataattgctgtctctcaattgtttagaccatgggttcataaatttttgtccagttctactgtcgatcacgacttcagcaatcatgatcttcgagatgagctgattgaaggaaacataattcctatacatctatttcatactactccatgggcatcttttgaatacttgttttctggtcaaattttctgttgcgcgtgaagccgtccggtttacatcatactccaggaagccttatataggtctagggtttagggtgtggtccttcgaattccgtactgtgaatccatcagtctgttgaggaacgatcatgtgatagtcatttcatgcggtctacctcatgtacgattgaaaatgacgcggtcaagactaggagaaccgtcagagatgacccacgtattcaataatggcaggagtttggatcatcggaagggtagttctagtcccgtctgtttctagcttattggactgataagctccttgagaagcaagtcgagctcatagtggggaatcatccaggggaccactgctctgctcatgctagaagccaatcgtagccccctttgcatgcatatgccataaagttctgaaccttcagaacactcgggagagctacatgtggcttttgacaaggccagcaaggcatttcaagcattatttatactgaacgccccacgttacaacagtagacagattgagagccaggcgaacaagcctattcccgaaattaggacaaaattagca

SEQ ID NO: 2900 - DNA, 783 bp, Physcomitrella patens
ccctcggccaagccagtccttcgccttcgccttagtttggttccataattggggctctccgactgtgttctgctgcgtctcgttgttgctgcggttgtctcgtgtttctgcggttgtcctgaatctctagtgtatgtgtgtgtgtgtgtctctgtgtttcttctagtccgccatggcctctttcgctgaggcccccaagggtaacgagaaggccggtgagaagatcttcaagaccaagtgcgcgcaatgtcacgctgttgagaagtccgctggccacaagcaaggacctaacttgcatggtttgttcgggaggacgtcgggaactacagctgggtacacttactcgaaagctaacagggacaaggctgttgattggaacgaggagcatctatacgagtacctattgaatcctaagaagtatattcctggtacgaagatggtattccctggtttgaaaaaacctcaagaacgtgcagatctaatcgcttatttaaagaaatcgacctcagagtagagacctggtgggactgtttcagaggtttcatggcctcttgtagagcgtcgtaggacttactgagggtgtcatttatttgaacgcgtatcgttcactagagtattcaaataattcagcaactgtgtcactttttcaaaatataaaatttgcctttattttcaaattaaaatacttcgtttttcaaatggtatagcattccaggggcatgactgtcttgtgactgaatgtaatatatataggggaataataaagagatccaaatttttact

SEQ ID NO: 2901 - DNA, 395 bp, Epimedium sagittatum
catcaaccacaaacaccacctgcatgctcttccccaaccacacctgagatcaaaagccggagagaagatcttcaagaccaagtgcgctcagcgtcacaccgtccaacaaggagccggccacaagcaaggtcctaatctcaatggcctttttggaaggcaatcgggtactactggtggctactcttactctgctgctaacaagaatatggctgtgatctgggaagagaagaccttatatgattacttgctcaaccccaagaagtatattcccggaacaaagatggtgttcccaggactgaagaagccacaagaccgtgctgacctcattgcttatctcaaggaggcaacatcatcttgattcttctcactacaagatcttatttttgcggcaagtg

SEQ ID NO: 2902 - DNA, 608 bp, Distylium racemosum
ggcgatcagaaagccggagagaagatcttcaagacaaaatgcgcacagtgccatacagttgacaagggcgctggccataaacaagggccaaaccttaatggactgtttgggagacaatctggaacaactgctgggtattcatattctgctgccaacaaaaacaaggctgtggtctggggagaagacactctttatgagtatcttctcaaccctaaaaagtacattcctggaactaagatggtgtttcctggtttgaagaagccacaagaccgtgcagatctcattgcatttctcaagaagtcgacgtctgaagagtaaaaagttgcttgatggcataattcatagtttagtttttctaagaattcattcgggagattagtttaatatttgatagtactctgccctattgttgaggtgataacattcttttaataaagatgactcagagatgactcagaagtgcccagaatgggtgtttttttaatgcggaatttatctgataagggaggtaacaataccctgacattgcaaattttcatcatctgaaaggttatcatgcccatgatatgtcagtacaatctcatttgacaatcattaatagtactgcc

SEQ ID NO: 2903 - DNA, 547 bp, Eschscholzia californica
gtgactatatagtagaagacgccaccacgacgagatagacgagctcgggagagaagattcttcaagacgaaatgtgctcagtgtcataccgttgagaaaggagccggtcacaaacaaggacccaatctgaatggtcttttcggacggcaatccggaacaactggcggttactcctactccactgccaacaagaacatggctgtggtttgggaggagaaaacgttgtacgattacttgctcaaccccaagaagtatataccagggacgaagatggttttcccaggactaaagaaaccacaagatcgagcagacctcattgcttatctcaaggaatcaactgcttagttctaatatttctgttcttgattttgtcattgtgcattttataaggtgatattttttggaaataaaactttttcttatcgaaaaggtggaccaagagtactcggggttgtaaggatgatttgatttacatcattactcggttcagtactcaggttgattccaatttgatgtctgttcttgattgcgattggttgtttactcg

SEQ ID NO: 2904 - DNA, 1000 bp, Oryza sativa
gatcgctggagagcacagcggagggagatcgaacaagagacgaatagccagcaaaataattaaagaggtagctggagagaaggagagagagagagagagagatcgacgagctagctagatggcttctttcggcgtggcccccgttggaaacgcggcgagcggcaagaagatcttccggaccaagtgcgcgcagtgccacacggtggagcgcgggggcgcgcacaagcagggtcccaaccttcatggcctcttcggccgccagtccggcaccacccccggctacgcctactccaccgccaacaagaacatggccgtcgtctgggaggaaggcaccctctacgactacctgctcaaccctaagaagtacattccgggcaccaagatggtgttccccggcctgaagaagccgcaggagcgcaccgacctcatcgcctacctcaaggaatctaccgcctaacccatccatccatctatccatcatctgcttgctgcaaaatatatatatatatatcgtatcattatgtttgtgtacccctatgttatactccttccgtattttaatgtatgacaccgttgatttttcgaccaacgtttgaccattcgttttattcaatttttttttgcaaatatgaaaatatttatgtcatgcttaaagaacatttgatgacgaatcaagttataataaaataaatgataattacataaattttttgaataagacgaatggtcaaacgttggataaaaagtcaacggcgtgatatattaaaatatggagggagtagtatatagcatctatctcaataagcatgcatgcatgcatctgtttaattatcgttccaaccatgcgtgcgtgcgtatttgaaattaagaagcatcgtatttatcctcttctactgtaaaagcatgcatggatatcatatcgagatcaagttaattaatagtagcaatgcaaagcatgcaggatcagaaatgtgagaacgaaacatttgatgtttccgag

SEQ ID NO: 2905 - DNA, 436 bp, Secale cereale
cgttcctccagccgagggatccccaaccctacctagcccggcaaccgtccgcgcgggatcagcggcagcgacgatggcgtcgttctcggaggcgccccgggaccggcgtccggcgagaagatcttcagaccaagtgcgcccacgtgccacaccgtcgacaaggcggccggccacaagcaagggcctaacctgaatggtctgtttgggaggcagtctggcacaactcctggatattcttactctacggccaacaagctcatggctgtgaattgggaggagaaaacactgtatgactacctgcttaatccaaagaagtacatccctggaactaagatggtgttccctggactgaagaagccccacgaggcgtgctgatctcatcgcatacctcgaagggtaggccaccggcgttgtaagggacgtttgtctttgtctg

SEQ ID NO: 2906 - DNA, 810 bp, Picea glauca
cgggggttatttgtaagggaaggaggatgcgagaagataccgtgggcgtggaggaggaggctttataaggaaggaacactttatttgctcttcttgtgagtaagacagcggtgcgtgtgtttgtcgtgcgctctctcgctcagtcagattgatcaatgtcgaccttctcggaggctcctccaggcgacaccaaggtcggcgagaagatcttcaagatgaaatgcgcgcaatgccatacggttgacaagggtgccggacacaaacaagggccaaatctgtatgggctctttggcaggcaatctggcacaacagcaggatattcttattctgcaggcaacaaaaacaaggctgtcgtttggggcgaggatactctgtatgaatatcttttaaatccaaagaagtacatacgtggaaacatgattgtaatccctggtctgaagaagcctcaagagcgagccgatctaattgcgtatctcaagcaggccacatcgtcatagtagtttaaaggagaattatcctcagagaaataattgatgggcggctagattacaatatcctagcaaaaattttcccattcaatgtttaaaatatgaaacaggatgtctggtgttgtttttaaatagaaaaaaaaatgtagatgctggtagtgtgacagtatgaaattaacttgacaaaatattcatttagaatattggtagtgtgccattttagcttttctgttattctttggtcttgttcagatgtactgcattatctcaatacagtatttggagtcgtttgagactaaaaattaacgggaagacataatat

SEQ ID NO: 2907 - DNA, 642 bp, Pennisetum glaucum
gttgtttcgattcgatcggagacgatccctaccgccaacgacgacggcatggctgcatccttcgccgaggcccccgccggcgacgccggcagcggcgagaagatcttccgcaccaagtgcgcacagtgccacacggtggagcggggcggggcgcacaaacaggggcccaacctgcacggcctcttcggccgccaatccggcaccaccctgggctacgcctactccacggcgaacaagaacatggccgtcgtctgggaagaagggaccctctacgactacctgctcaaccccaagaagtacatccccggcaccaagatggtcttcccggggctcaagaagcccaaggagcgcaccgacctcatcgcctacctcaaggaatccacggcttaattgattgttgatcatatcttatctacggagtatctcaatccaatccatcatcactaggcagctgctccattaattatccaccattctgttattgttccaagctggactgttgcatatattttctttgagctttgttacgttccttttaggcaatctcaatggatgtttcatagcattaaatatcaccaatttcgctaatgtaaccatgagagagaatatgatagtttcatggaatgtgtgggacatttcatc

SEQ ID NO: 2908 - DNA, 636 bp, Physcomitrella patens
gctccattagcagcattctccatctccttcttcagggctcgggttttggagctcaccgcggcgaagccctagggttttgcctgccttcgcctttctctgcatcctttcttcttcgccatggctaccttcgctgaggcgcccaagggcaatgataaggccggagagaagatcttcaagacgaagtgcgcacagtgccacgccgtcgagaaggccgccggccacaaacaaggtcctaacctgcatggtctattcggaaggacctcagggaccacccctggatatgcctactctaaagccaacaaagataaggccgtcgaatgggaagaagagaagctgtacgagtatttattgaacccaaagaagtatattcctggcaccaagatggttttccccggcttgaagaagccacaagagcgagcagatcttatcgcatatttgaagaagtcgacctcagagtaaattttactgacaattttggtgttgaaacccaacaacttctagtagaaattagcagaggtacacaggatcacttggaatgtgtccggaccaagtgatttgcccaattcttttcaacatggggcgattttgataagcacactgcaataaagctataggattctttctatcttgtgaact

SEQ ID NO: 2909 - DNA, 330 bp, Vinca minor
gggtaccactagatagattcatatcaaattgttattaataaaaaaatggcatcctttgcagaggcacctccgggaaatccaaaagccggagaaaaaatctttaagacaaagtgtgctcagtgccacactgttgataaaggagctggccataaacaaggacccaatttgaatggcctttttggaagacaatctggaactactagtggttactcctattccgccgcaaacaagaacatggctgttatttgggaggaaaagacactttatgattacttgctgaatcccaagaagtatatccctggaacaaagatggttttcccaggactaaag

SEQ ID NO: 2910 - DNA, 641 bp, Picea glauca
gtaagtaagacagcggtgcgtgtgtttgtcgtgcgctctctcgctcagtcagattgatcaatgtcgaccttctcggaggctcctccaggcgacaccaaggtcggcgagaagatcttcaagatgaaatgcgcgcaatgccatacggttgacaagggtgccggacacaaacaagggccaaatctgcatgggctctttggcagacaatctggcacaacagcaggatattcttattctgcaggcaacaaaaacaaggctgtcgtttggggcgaggatactctgtatgaatatcttttaaatccaaagaagtacatacgtggaaacatgattgtaatccctggtctgaagaagcctcaagagcgggcagatataattgcgtatctcaagcaggccacatcgtcatagtagtttagaggagaattatcctcagagaaataattgatgggtgactagattacaatatcctagcaaaatttttcccatccaatgtttaaaatctgaaataggatgtctggtgttgtttctaaataggaaaaaaaatgtagatgctggtagtgtgacagtatgaaattaacttgacaaaatattcatttggaatactggtagtgtgccattttagcttttctgttattctttggtcttgt

SEQ ID NO: 2911 - DNA, 1589 bp, Solanum phureja
atagataataattggctatggcttttcaaggttcattttgggcaattagccttttgatatttttggccaattttttgtctatgatagagttttctttggctgcaaatgcaaaagtgccaagccatactatttctaatccatttaatcgtactatattttcacctgattttctttttggagcttccacttcttcctatcagtatgaaggtgcatggaatgaagatggcaaagggccaagtattgtggatactttcgtccacactcatcctgaaaaaatattggaccgtagcaatggagacatagctctggacttttatcatcgttacaaggaggacgtgaaactagcaaaatttgaaggactggatgctttcaggatttctattgcatggacaagaattttaccagagggtcaggttaaaaaaggagtaaatcaagctggtattgaccactacaacagtctcataaatgagattgtagcccttggtattaaacctctagtgacactttttcattgggatcttcctcaagcccttgaagatgaatatcttggctttctaagccgtaagatcgtagatgattacgtagattttgtggagatttgtttcaaaaattttggtgatagagtgaagttgtgggcaacgatgaatgagccatggatttttacatcaacgggttatgattcgggttctttggcacctggacggtgttctgcgtggatgaacagtaactgcaccatcggaaactctggtactgagccttatatagccggacacaatatacttcttgctcatgctgctgcttccaaactatacagaaaaaaatacaagccaattcaaaagggtcaaataggaacaattgtagtgtcacattggttcgagcctgcctccaacaaaccacaggataaaaaagcatctataagggctcttgattttatgcttggatggtttatgcacccattgacttatggagattatccaataagtatgagaaaacttgttggcaagagattaccaaagtttaccccaaaagaatcaatgttggtgaaagactcatgtgattttataggattgaattattacacctctaattttgcagctcatatttctaatccaccaaatactgtcaatatcagttcaggaactgataatctagtcaatcaaaccacatcgcgaaacggaaagttgattggtgatccaactggtgtgagtatattctatgttgctccaaagggactttataagcttcttgtttatattaagaaattttacaagaatccaattgtttacatcacagaatgcggaatgggtgagtccaatattgatgatgttgcaaaaggtatcaatgatgctcagagggttgatttctaccaacgccatattaaggctctttatagggcttttagggagggagtacatgttaaggggttctttgcatggtcattttttgacaactttgaatggggatcaggatacacacagagatttggcatcaattttgtagattacaagaataacttaaagagataccccaagcgttctgctctttggatgaagaaatttcttctcaaataaaattattagtaatatcat

SEQ ID NO: 2912 - DNA, 1742 bp, Solanum tuberosum
gcttttcaaggttcattttgggcaattagccttttgatacttttggccaattttttgtctatgatagagttttctttggctgcaaatgcaaaagtgccaagccatactatttctaatccatttaatcgtaccatattttcacctgattttctttttggagcttccacttcttcctatcagtatgaaggtgcatggaatgaagatggcaaagggccaagtattgtggatactttcgtgcacactcatcctgaaaaaatattggaccgtagcaatggagacatagctctggacttttatcatcgttacaaggaggacgtgaaactagcaaaatttgaaggactggatgctttcaggatttctattgcatggacaagaattttaccaaagggtcaggttaaaaaaggagtaaatcaagctggtattgaccactacaacagtctcataaatgagattgtagcccttggtattaaacctctagtgacactttttcattgggatcttcctcaagcccttgaagatgaatatcttggctttctaagccctaagatcgtagatgattacgtagattttgtggagatttgtttcaaaaattttggtgatagagtgaagttgtgggcaacgatgaatgagccatggatttttacatcaacgggttatgattctggttctttagcacctggacggtgttctgcgtggaagaacaataactgcaccatcggaaactccggtactgagccttatatagccggacacaatatacttcttgctcatgctgctgcttccaaactatacaggaaaaaatacaagccaattcaaaagggtcaaataggaacaattgtagtgtcacattggttcgagcctgcctccaacaaaccacaggataaaaaagcatctataagggctcttgattttatgcttggatggtttatgcacccattgacttatggagattatccaataagtatgagaaaacttgttggcaagagattaccaaagtttaccccaaaagaatcaatgttggtgaaagactcatgtgatttaataggattgaattattacacctctaattttgcagctcatatttctaaaccaccaaatactgtcaatatcagttcaggaactgataatctagtcaatcaaaccacatcgcgaaatggaaagttgattggtgatccaactggtgtgagtatattctatgttgctccaaagggactttataagcttcttgtttatattaagaaattttacaagaatccaattgtttacatcacagaatgcggaatgggtgagtccaatattgatgatgttgcaaaaggtatcaatgatgctcagagggttgatttctaccaacgccatattaaggctctttatagggctttagggaaggagtacatgttaaggggttctttgcatggtcattttttgacaactttgaatggggatcaggatacacacagagatttggcatcaattttgtagattacaagaataacttaaagagataccccaagcgttctgctctttggatgaagaaatttcttctcaaataaaattattagtaatatcatgtatgtgtcatttagttatatcaaatcttgtacaacctaattaagtgtgtctattgcccttaattcagtattaatctgtttgttaggagtactatttatggaataattgaggggatgttctcttgtaataaaaggagaagaataaattctttgtaaccatattacaaaaaaaaa

SEQ ID NO: 2913 - DNA, 2921 bp, Capsicum annuum
gaaaataggagtattgctgacatgtccaatgtcatcctacctagaacaacaactcaacaaccgtttcagcctcttcaaatactgggaatcttcctccaagtcccagttctctactcacaacagtcactccatccgagctgttgtaggtaacgcattcgttggtgctgattctgacctcattaacgcattgccaaatttggaaatcgtatcatcttacagtgtaggtttggataagattgatttggcaaagtgcaaagagagaggaattagagttaccaacactcccgatgtgcttaccgatgatgtggctgatacagcgattggattgacattggctactctgaggaggatttgtgttgctgatgggtttgtgaaacatggcttgtggaaaaatggtgattttgagttgacaacgaagtggtaaattggttggcataattggattgggcagaattggttcagcaatagcaaagagagctgaagcttttggatgccccattagttaccactccagatccaagaaacctaacttaaactacaaatactactctactgtggtcgatttggctgcaaattctgaaatccttattgttgcatgcgctttgactgaagaaacccgagacattgtcaaccgcaaagtgcttgatgcattaggtccaaagggcatcttaatcaacataggacgaggtgcacatgtagatgaatctgaacttgtagctgcactgattgaaggtcgtatcaacggggctggttttgatgtttataagacagaaccagaggttcctgaacaactgttcggacttgagaatgttgttctattgtcccatgctgcaagtgatacagtagaaacttgcatggccatggcggaccttgttattgaaaacttggaagctcattttcttcacaaaccattgttgactcctgtggtctaaacactttcattcatcagtgcttgctgggcaatcagcaagttgaacactgaatatttccaaattctagagttgtattcttttctatttgatgataatggacttcaatgttgcatttatagattaactgtggtcaattggctatggcatctaaaggtccattcttggcagttggcctcttgatcttcttggccacatttttggccacagctgagttttctgtggctgcaaaagtgccaagccgtactatttctactccatttaatcgtaccattttcccttcttcttttctttttggagcttccacttcttcctatcagtatgaaggtgcatggaatgaagatggcaaagggccaagtattattgatactttcgtccatactcatcctgaaaaaatattggaccgtagcaacggcgacatagctttggacttttatcatcgttacaaggaggacgtcaaactagcaaaattcgaaggactggatgctttcaggttttctatcgcatggacaagaatattaccaaaggggaagctaagcaaaggagtaaatcaagctggtattgaccactacaacagtctcatcaatgagatagtagcccttggtattaaacctttagcgacactttttcattgggatgttcctcaagcccttgaggatgaataccttggctttctaagccctaagatcgtgggtgactacacagattttgtggagatatgtttcaaacattttggagacagggtgaagctgtggtcaaccatgaatgagccatggatttttacatcaacaggttatgattctggttcattggcacctggccgttgttctgcctggatgaacagcaactgttcagccggaaactcaggcactgagccttacatagcaggacacaacattcttcttgctcatgctgctgctgccaagctatacaggcaaaaatacaagccaattcaaaaaggtgaaataggaattatattggtttcacattggttcgagccattctccaacaaaccagaggataagagagcatctaaaagatctcttgattttatgcttggatggtatttgcacccattgacttatggagattatccaagaactatgaagaggctagtaggaaagagactaccaaaattcaccccaaaagaatcaaaattggtgaaagactcttttgatttcttaggattgaattattacacctcaaatttcgcagctcatctttctagcccaccaaatactgtgaatatcagctctggaactgataatcaagtcaatcaaacgattccgcgaaacggaaagtttattggtgatccgactggtgtcagtattttctatgttgctccaaagggactttataagattctagtttacatgaagaaatattacaacaatccacctgtttacgtcacagagtgtggaatgggtgagtccaatattgatgatgttgcaagaggtaccaatgatgttcagagagttgatttctacaaacgccatattacggctcttcataggtcttttagggagggagtaaatgttaaggcgttttttgcatggtcatttttcgacaattttgaatggggttcaggatacacgcagagatttggcatcaatttcatagattacaagaataacctaaaaagatacccgaaacgttctgctctttggatgaagagattccttctcaagtaaaagttatcaatatgatcatgatgcatgagtacgtgttgtttaattatatcaaatattgtagaacttaagtgctatcggccttgaattcattattatctatttgttgagcattattcatggaattaattaagggtgtgttctcttgtaataatgggagaaaaataaagttgtagtagcaatatagtttgtctgttacgtactacatgtaactcatggcgaagaacgagaacgtaattatgtatgtagcttccgttttctgaacggattgtcaaaaaagtttcgtcagtttaaatcctcgtgc

SEQ ID NO: 2914 - DNA, 1857 bp, Capsicum annuum
aagtggctatggcatctaaaggtccattcttggcagttggcctcttgatcttcttggccacatttttggccacagctgagttttctgtggctgcaaaagtgccaagccgtactatttctactccatttaatcgtaccattttcccttcttcttttctttttggagcttccacttcttcctatcagtatgaaggtgcatggaatgaagatggcaaagggccaagtattattgatactttcgtccatactcatcctgaaaaaatattggaccgtagcaacggcgacatagctttggacttttatcatcgttacaaggaggacgtcaaactagcaaaattcgaaggactggatgctttcaggttttctatcgcatggacaagaatattaccaaaggggaagctaagcaaaggagtaaatcaagctggtattgaccactacaacagtctcatcaatgagatagtagcccttggtattaaacctttagcgacactttttcattgggatgttcctcaagcccttgaggatgaataccttggctttctaagccctaagatcgtgggtgactacacagattttgtggagatatgtttcaaacattttggagacagggtgaagctgtggtcaaccatgaatgagccatggatttttacatcaacaggttatgattctggttcattggcacctggccgttgttctgcctggatgaacagcaactgttcagccggaaactcaggcactgagccttacatagcaggacacaacattcttcttgctcatgctgctgctgccaagctatacaggcaaaaatacaagccaattcaaaaaggtgaaataggaattatattggtttcacattggttcgagccattctccaacaaaccagaggataagagagcatctaaaagatctcttgattttatgcttggatggtatttgcacccattgacttatggagattatccaagaactatgaagaggctagtaggaaagagactaccaaaattcaccccaaaagaatcaaaattggtgaaagactcttttgatttcttaggattgaattattacacctcaaatttcgcagctcatctttctagcccaccaaatactgtgaatatcagctctggaactgataatcaagtcaatcaaacgattccgcgaaacggaaagtttattggtgatccgactggtgtcagtattttctatgttgctccaaagggactttataagattctagtttacatgaagaaatattacaacaatccacctgtttacgtcacagagtgtggaatgggtgagtccaatattgatgatgttgcaagaggtaccaatgatgttcagagagttgatttctacaaacgccatattacggctcttcataggtcttttagggagggagtaaatgttaaggcgttttttgcatggtcatttttcgacaattttgaatggggttcaggatacacgcagagatttggcatcaatttcatagattacaagaataacctaaaaagatacccgaaacgttctgctctttggatgaagagattccttctcaagtaaaagttatcaatatgatcatgatgcatgagtacgtgttgtttaattatatcaaatattgtagaacttaagtgctatcggccttgaattcattattatctatttgttgagcattattcatggaattaattaagggtgtgttctcttgtaataatgggagaaaaataaagttgtagtagcaatatagtttgtctgttacgtactacatgtaactcatggcgaagaacgagaacgtaattatgtatgtagcttccgttttctgaacggattgtcaaaaaagtttcgtcagtttaaatcctcgtgc

SEQ ID NO: 2915 - DNA, 659 bp, Solanum phureja
ctcaccactttttttcacaacgtattgctattcttaagaagtagaaaagatgggtttgaaaggtaaattgattgcttcaatggagatgaagtgtggagagggcttgttttttgatatttttcacaccagtactaatcaggtacccaatataagtcctaaaaatatcgtccattttgagattcatgaggtgaaatcgtaaagactggttcgattgttagttggaaatataacgaagctggacaagaaatgtatatgaaacacttaattgaagtcgtcgatcctcacaagaaattaatcaaatggaaagttattgaaggagatttattggagttgtataattattgtaattttacaacatcttgtgaacttcagtggactacttggacaattgaatacgaaaagaaaacagaagataccccagaacccctccttcacttgggtgttatccttgccatgaccaaggatatagaaaatcatcttctcaagaaataaagtgtgtttgtgtgatgaataatttgctagttctagctagtttgtggaatattaaataatgtaatgtcaatgtccatacacattataagtatgtgtgggttagtgtgatgaataattgactagttctagctaggatgtggaataaataatgttgtttttgatgaata

SEQ ID NO: 2916 - DNA, 546 bp, Solanum phureja
gctattcttaagaagtagaaaatatgggtttgaaaggtaaattgattgcttcaatggagatgaagtgtggagagggctcgttttttgatatttttcacaccagcactcatcaggtacccaatataagtactagaaatatcgttcattttgagattcatgaaggtgaaatcgtaaagactggttcgattgttagttggaaatataaccaagctggacaagaaatgtatatgaagcaattaattgaagctcacaagaaattgatcaaatggaaagttattgaaggagatttattagagttgtataattattgtaattttacaacatcttgtgaacgcgagtggactacttggacaattgaatacgaaaagaaaactgaagataccccagaacccctccttcacttaggtgttatccttgccatgaccatggatatagaaaatcaccttctcaagaaatagtgtgtgtttgtgtgatgaataattgacaagttctagctagcatgtggaataaataatgttatttttgatgaatatgttgcatatgtca

SEQ ID NO: 2917 - DNA, 727 bp, Solanum tuberosum
atcaggcagaggacgagacagaacgcagaaaaccacttttttcacaacgtattgatattcttaagaagtagaaaatatgggtttgaaaggtaagttaattgcttcaatggagatgaattgtggagggggctcgttttttgatatttttcacaccagtactcatcaggtacccaatataagtcctaggactatcgtccattttgagattcatgaaggtgaaaccgtaaaaactggttcgattgttagttggaaatatatcgaagctggacaagataagtatatgaagcacttaattgaagccatcgatcctcacaagaaattgatcaaatggaaagttattgaaggagatttattagagttgtataattactttgattatacaacatcttgtgaccaccagtggactacttggacaattgaatacgaaaagaaaactgaagacaccccagaacccctcattcacttcggtaatatccttgacatgaccaaggatatagagggtcaccttctccagaaatagtgtgtgtatatatatatatatatacacacacacaaacattagaagtaactgtgtttgtgtgatgaataatttgcaactagctagcatgtggaataataaataatataatgtcaatgtccatacacattataagcatgtgtgtgtaagtgtgatgaataattggctagttctagctagcatgtggaataaataatgttgtttttgatg

SEQ ID NO: 2918 - DNA, 899 bp, Solanum phureja
ttctttcttagtgaaaaaaaaaataagaaaaaaaaatgcagaatcaacaacagctacagacactgatgcaagctggtcagatttcagggagtttgagttttaatggtaatttaagtaaagaagatgaagaaatgtcaaaatctgcactttcaacttttaaagctaaggaagaagagattgaaaaaaagaaacttgaagttaaggagaaagttcaagctcagttgggtcgtattgaagaggaaactagacgtttggctattattcgtgaggaactagaagcattaggagatccaatgaagaaagaagtttcaactgtccgaaagaggattgatattgtcaacaaggagttaaaacccctgggccagacttgccagaagaaggagagagaatacaaagaagctctcgaggccttcaacgaaaaacacaaggaaaaagtacaacttataacaagattgatggagctggtgggcgaaagtgagaaaatgaggatgaagaagttggaggagttgagcaagagcgtagaaacgattcgttgaaagataaatcacctttaaaaagctcatcaatgacgactaattaggcttgtgtgatatatttaagatcgataattgaaatttctatttattatattgttgttttcgcgtttggtggggtgtattctttcttctatttttcgcgctttatgttgttctttgttcatttttaggcttttgaaggatgatgatctaattttaggtgtcaaaagggaaatacccttgtaaacatgtttgtaactaaaacaggtcttctctcaagctgtggattcttttgttcaattattctcttcttttatatctctgtattttttgatgtatcgtttagtttggttgaaattgtatcatgtgaagaaaagttagcga

SEQ ID NO: 2919 - DNA, 727 bp, Solanum melongena
tgcagaaccaacaacagcagcagcagctacagacactgatgcaagctggtcagatttcagggagtttgagttttaatggaaatttaagtaaagaagatgaagaaatgtcaaaatctgcactttcaacttttaaagctaaagaagaagagatcgaaaagaagaaacttgaagttaaggaaaaagttcaagctcagttgggtcgtattgaagaagaaacaaggcgtttggctattatccgtgaggaactagaagcattagcagatccaatgaagaaagaagtttcaactgtgcgaaagaggattgatattgtcaacaaggagttaaaacctctaggacagacttgccagaagaaggagagagaatacaaagaagctctcgaggccttcaacgataaacacaaggaaaaagtacaacttatatcaagattgatggagctggttggtgaaagcgagaaaatgaggatgaagaagctggaggagctgagcaagagtgtagaaacgattcattaaaaagctcatcagtgacgactaattaggcttgtgtgatatatttaagatgataatcgaagattatatatggttgttatcgcgtttggtgggtgtattctttcttctttttttcgcgctttcggttgttatttgttcatttttagccttttgaaggatgatgatctaattgtaggtgtcaaaacttgtaaacatgtttgtaactaaaacaggtttctctc

SEQ ID NO: 2920 - DNA, 792 bp, Petunia hybrida
aaagataaacaaggagtttatgcaaacacaagaaaatatgcagaatcaacagcagttacaaacactaatgcaaagtggtcaaatgtcggggagtttaagttttaatgggacaatgagtaaagaagatgaagaaatgtcaaaatcagcactatcaacattcaaagcaaaagaagaagaaattgagaaaaagaaacttgaagttaaggaaaaagttcaagctcagttgggtcgtattgaagaagaaactagacgtttagccattattcgcgaggaactagaaggattagcagatccaatgaagaaagaagtttcaacggtccgaaagaggattgatgcagtgaacaaggagctaaaacccctgggacagacatgccagaaaaaggagagagaatacaaagaatctcttgaggccttcaatgaaaaacataaggagaaagtacaacttatatcaagattgatggagctggtgggtgaaagcgagaaaatgaggatgaagaagttggaggagctgagcaagagtatagaaacgattcattgaacaaatatcttaaaagttcgatgactaattaggcttgtgtgatatatttaagaaagtcaaaatttctatttatatatggctgtttttgtggtttggtggatgtattctttgttcctgcttttgttgctcttttcattttaggctttgaaggatgatcagtttctaattttaggtctcaatgggaaataccctgtaaacaagtttgtaactaaaacaggtctctcaagctgtggattcttttctattctcttttc

SEQ ID NO: 2921 - DNA, 668 bp, Gerbera hybrid cultivar
tattggagagataaagagagaaatcggtggaagaattagggtttttcgctttttctggttgaagaaaaagaaagaggaagaagaaggagaaatgaccactcaaacacaagtacaaacacagaggcaaacaagtgaacagcttcaaacactgatgcaagctggtcaaatctctggtagcttaagcttcaatggcttgatgactaaagaagacgaagagatgtctaggtctgctctttctacgtttaaggctaaagaagaagagattgagaagaagaagttggaggttagggaaagggttcaagctcagttgggtcgtattgaagaagaaaccaggcgtttggctacaattcgcgaggaacttgaagcactaacggatccaatgaaaaaagaagtttcagttgttcgtaagaagattgattctgtgaacaaagagttgaagccactgggacagaactgccagaagaaggagagagagtacaaggaagccctggatgctttcaatgaaaagaacaaggaaaaagtacaactcattaccagatcctgatggagttggtggagcgaaagtgagaaaatgaggatgaagaagcttgaagagctgagcaagagcgtggaaacgatacaataaatcgatgataataacgtgatgacgatgacgatgacgatgggct

SEQ ID NO: 2922 - DNA, 844 bp, Coffea canephora
gaaaggggaaaaagacgaagaagaatagcagagaagataatactactaagaggaagaattgagggaagaagaagggtttgtttcttctttagcggctgctgtcttggaggaacaatgactcaaactcagaggcagggatctgagcagctgcaaacgctgatgcagtctggtcaaatttctgggagcctaagctttaatgggaccttgagcagagaagatgaggagatgtcaaagtctgctctctctactttcagggctaaggaggaggagattgagaagaagaagcttgaggtcaaggagaaggttcaagcccagcttggccgaattgaagaagagaccaagcgcttggccactatccgtgaggagctagaagcgctagcagatccaatgaagaaggaagtttccgtagttaggaagaagattgatgctgtcaacaaagagttaaaaccactgggccagacttgccagaagaaggagaaggaatacaaagaagctctggaggctttcaatgagaagaacaaggaaaaagtacagctgattagccgattgatggagctggtcggcgagagtgaaaagttgaggatgaagaagttggaagaattgagcaagagcatagaaacaatacgttaagatagtccaaggtcaagaactagttaatataggtttgtgtgatgtattctaaggaagacatttctgtttatgcacggttgcttggagtttggttgtattttctgctttcgtcgtctgtagttcttgatggacctttctgattgtaggacagggatatatacccaccccagtgaacaggtttgtgactaaaattgtaaaacaggtctctactttg

SEQ ID NO: 2923 - DNA, 973 bp, Solanum lycopersicum
aaccaaagccaaaaaaagcaaaaggagaacacagtgaagaaagaagaaaggtaaagtgaagaaattgttgttgaagaagaaggagaaggggttttgtttttggtttgaagaagatcgaagaaatgccgaatcaaaagcaaggaagtgaacagctacaaacactgatgcaatctgggcaaatttctgggtcttttagctttaatggaaccttatctaaagaagatgaagagatgtcaaggtctgcgctttctactttcaaagctaaggaagaagagattgagaaaaggaaaatggaagtaaaggaaagagttcaagctcaactgggtcgggttgaagaagaaacccgacgtttagccattattcgtgaggaactagaagcattagctgatccaatgaagaaagatgttcaaacggttcgtaagaggattgatgctgtcaacaaagagttgaaacccctgggacagacctgccagaagaaggaaaaagagtacaaagaagctcttgaggccttcaatgaaaaacacaaggaaaaagtccagctaatatcaagattgatggagctggtgggggaaagcgagaaaatgcggttgaagaagttggaggagctgagcaagagcattgaaacaatacagtgaataaccagtaaaatctcccctgactaattaggcttgtgtgatgtatttaagaaagttctttttctctatttatatatgcgtgtggcgtttgattgtatttccttttctcttttccgtgttgttgtctgatcattttagcttttggagggatgatcagtgtctaattttaggtctcttaagggaaaagacagaccctctaatacaggtttgtaactaaaacaagtctcagaacagtggattcttttactttttgtcttcacatctcaatctttttctttgtgttattgatgactgtgttgctcttaaccaatttgcatagataatagagagttggtttg

SEQ ID NO: 2924 - DNA, 1140 bp, Solanum lycopersicum
atttctcttaataaaatataaactttaatgtttcgtatataattttttgacgaagaatatttaacgggcgatactatacatggccctacccactgccttgtccctttgttcattctaataagcacaagcaacagtagaaaaaagggtccattgtccatttccatcataaccaaagccaaaaaaagcaaaaggagaacacagtgaagaaagaagaaaggtaaagtgaagaaattgttgttgaagaagaaggagaaggggttttgtttttggtttgaagaagatcgaagaaatgccgaatcaaaagcaaggaagtgaacagctacaaacactgatgcaatctgggcaaatttctgggtcttttagctttaatggaaccttatctaaagaagatgaagagatgtcaaggtctgcgctttctactttcaaagctaaggaagaagagattgagaaaaggaaaatggaagtaaaggaaagagttcaagctcaactgggtcgggttgaagaagaaacccgacgtttagccattattcgtgaggaactagaagcattagctgatccaatgaagaaagatgttcaaacggttcgtaagaggattgatgctgtcaacaaagagttgaaacccctgggacagacctgccagaagaaggaaaaagagtacaaagaagctcttgaggccttcaatgaaaaacacaaggaaaaagtccagctaatatcaagattgatggagctggtgggggaaagcgagaaaatgcggttgaagaagttggaggagctgagcaagagcattgaaacaatacagtgaataaccagtaaaatctcccctgactaattaggcttgtgtgatgtatttaagaaagttctttttctctatttatatatgcgtgtggcgtttgattgtatttccttttctcttttccgtgttgttgtctgatcattttagcttttggagggatgatcagtgtctaattttaggtctcttaagggaaaagacagaccctctaatacaggtttgtaactaaaacaagtctcagaacagtggattcttttactttttgtcttcacatctcaatctttttctttgtgttattgatgactgtgttgctcttaaccaatttgcatagataatagagagttggtttg

SEQ ID NO: 2925 - DNA, 830 bp, Solanum melongena
aaagcagaaaaagctcaaagaagaaaggcaaagtgaagaattgaagaagattgaagaaatgccgaatcaaaagcaaggaggaggtgaacagctacaaacactgatgcaatctgggcaaatttctgggacttttagctttaatggaagcttaagtaaagaagatgaagagatgtccaggtctgctctttctacttttaaggctaaggaagaagaaattgagaagaggaaaatggaagtcagagaaagagttcaagctcaactcggtcgggttgaagaagagacccgacgtttagctattattcgtgaggaactagaagcattagctgatccaatgaagaaagatgttcaaacagtcaggaagaagattgatgctgtcaacaaagagttaaaaccccttggacagacctgccagaagaaggaaagagagtataaagaagctcttgaggccttcaatgaaaaacacaaggaaaaagtccagctaataacaagattgatggagctggtgggcgaaagcgagaaactgcgattaaagaagttggaggagctgagcaagagcgttgaaacaatacactgaataaccagtaaaatctcccctgactaattaggcttgtgtgatgtatttaagaaagttctttttctctagttatatatttgtgtggtgtttgattgtatttcctttttccgcgttgttgtctgatcatcttagcttttgagggatgatcagtgtctaattttaggtctcgtaagggaaagacggaccctctaatacaggtttgtaactaaaagaagtctcagaacagtggattcttttacttttgtctttgcatctc

SEQ ID NO: 2926 - DNA, 1018 bp, Tabernaemontana elegans
tgagggaagaagaagggtttctgctatagctagaaaaagaaatggctcaaccacctcagaggcagcaatctgagcagctgcaaacgctcatgcagtcgggtcagatttctggtagtctgagctttaacgggaccctgagcaaagaggatgaggagatgtcaaagtctgctctctctactttcagggctaaggaggaggagattgagaagaagaagctcgaggtgaaggagaaagttcaagctcagttgggtcgtattgaggaagagactaagcgtttggctactattcgtgaggaactagaagcactagcggatccaatgaagaaggaagtttcactggtccgcaagaagattgatgcagtcaacaaagaattaaagccactgggacaaacctgccagaagaaggagagggaatacaaagaagctcttgaggctttcaatgaaaagaacaaagaaaaagtacagctaataacaagattgatggagctggtgagtgaaagtgaacggatgaggatgaagaagttggaagaattgagcaagagcatagaaaccatacgctaagataacctaatatcaataactaatttaggttgtgtgatgtatttaagaaagccatttctatttatgtatgggtgttttaagtttgcttgtatttctgcttttgtcatctgtttaattagtctttgatggaccattttctgattgtaggacagggaaatacccacccagtaaacaggtttgtaactaaacatgcaaaaaaggtctcactgtggattcttctcaatttgtaccttcatttttacctttgagttgcccgttccccatgctttagtaaatgtatttgtggaatgactcagaagtagtcatctctctttcctgtttctcttatccttgtaaagttttagagtctggctttcaattgcttgaaccgttagctatgtcgttaaactggcaaagcaaaccagtttatcatactgtatatgtttgttaggacatcactttcatattaattttctgtc

SEQ ID NO: 2927 - DNA, 923 bp, Solanum tuberosum
aaagaaaaaacagtgaagaaagaagaaaggtaaagtgaagaatttgttgaagaagaagaagaagggagaagggtattttttttttgctttgaagaagatcgaagaaatgccgaatcaaaagcaaggaagtgaacagctacaaacactgatgcaatctgggcaaatttctgggtcttttagctttaatggaaccttatctaaagaagatgaagagatgtccaggtctgctctttctactttcaaagctaaggaagaagaaattgagaaaaggaaaatggaagtcagggaaagagttcaagctcaactgggtcgggttgaagaagaaactcgacgtttagccattattcgtgaggaactagaaacattagctgatccaatgaagaaagatgtttcaacggttcgtaagaggattgatgttgtcaacaaagagttaaaaccccttggacagacctgccagaagaaggaaaaagagtacaaagaagctcttgaggccttcaatgaaaaacacaaggaaaaagtccagctaatatcaagattgatggagctggtgggtgaaagcgagaaaatgcggttgaagaagttggaggagctgagcaagagcattgaaacaatacaatgaataaccagtaaaatctcccctgactaattaggctttgtgtgatgtatttaagaaagttctttttctctatttatatatgcgtgtggcgtttgattgtatttccttttctttttccgcgttgttgtctgatcattttagcttttggagggatgatcagtgtctaattttaggtctcttaagggaaagacagaccctctaatacaggtttgtaactaaaacaagtctcagaacagtggattcttttacttttgtcttcacatctcaatctttttctatgttgttgatggaaaaaaaaaaaaaaaaa

SEQ ID NO: 2928 - DNA, 1028 bp, Solanum phureja
gttcatactattaagcacaagcaacagtagaaaaaaaggtccattttccatttccatcataaccaaaaccaaaaaagcaaaagaaaaaacagtgaagaaagaagaaaggtaaagtgaagaatttgttgaagaagaagaaggagaagggtatttttttttttgctttgaagaagatcgaagaaatgccgaatcaaaagcaaggaagtgaacagctacaaacactgatgcaatctgggcaaatttctgggtcttttagctttaatggaaccttatctaaagaagatgaagagatgtccaggtctgctctttctactttcaaagctaaggaagaagaaattgagaaaaggaaaatggaagtcagggaaagagttcaagctcaactgggtcgggttgaagaagaaacccgtcgtttagccattattcgtgaggaactagaaacattagctgatccaatgaagaaagatgtttcaacggttcgtaagaggattgatgttgtcaacaaagagttaaaaccccttggacagacctgccagaagaaggaaaaagagtacaaagaagctcttgaggccttcaatgaaaaacacaaggaaaaagtccagctaatatcaagattgatggagctggtgggtgaaagcgagaaaatgcggttgaagaagttggaggagctgagcaagagcattgaaacaatacaatgaataaccagtaaaatctcccctgactaattaggctttgtgtgatgtatttaagaaagttctttttctctatttatatatgcgtgtggcgtttgattgtatttccttttctttttccgcgttgttgtctgatcattttagcttttggagggatgatcagtgtctaattttaggtctcttaagggaaagacagaccctctaatacaggtttgtaactaaaacaagtctcagaacagtggattcttttacttttgtcttcacatctcaatctttttctgtgttgttgatgactgtgttgctctaaccaatttgcatagataatagagagttggtttg

SEQ ID NO: 2929 - DNA, 777 bp, Vinca minor
aacaacaaaaatggctactcaacaaccgccaccacaaccaccaccgccacagaggcaacaatctgagcagcttcaaacgctgatgcaatcgggtcagatttcgggtagttttagctttaatgggactatgactaaagaagatgaagagatgtctaggtctgctctttctagtttcaaagctaaagaagaagagattgagaagaagaaattggaagtgaaagagaaagttcaagctcagttgggtcggattgaagaagaaactaagcgtttggctactattagagaggaactagaatcactagcagatccaatgaagaaggaagtttcattggtccgcaagaagattgatgctgtcaacaaagaattaaaaccacttggacaaacctgtcagaagaaggagagggagtacaaagaatcactcgaggcattcaatgaaaagaacaaggagaaagtagcgctaataacaagattgatggagttggtgggtgaaagtgaacgaatgaggatgaagaagttggaagaattgagcaagagcgtagaaacagtacgctaagataactcaatataagtaactaatgtaggttgtgtgtgatgtatttaagaaaaaaatcatttctatttatgtatggttgttttgagtttggcttgtaattttgcgcttttttttttgtctgtttaattagtctttttatggacccttactctcagtaaacaggtttgtaactaaaaatgtaaaacaggtctcactgtggattcttcttaatttgtaccttcttt

SEQ ID NO: 2930 - DNA, 1215 bp, Amsonia hubrichtii
taaagagaagaattcagggaagaagaagggtttctgctatagctagaaagggaaatggctcaaccacctcagaggcagcaatctgagcagctgcagacgctcatgcagtcgggtcagatttctggtagcctgagctttaacgggaccttgaccaaagaggatgaagagatgtcaaagtctgctctctctactttcagggctaaggaggaggagattgagaagaagaagctcgaggtgaaggagaaagttcaagctcagttgggtcgtattgaggaagagactaagcgtttggctactattcgtgaggaactagaagcactagcagatccaatgaagaaggaagtttcaatggtccgcaagaagattgattcagtcaacaaagaattaaaaccactgggtcaaacctgccagaagaaggagagggagtacaaagaagctcttgaggctttcaatgaaaagaacaaagaaaaggtgcagctaataacaagattgatggagctggtgagtgaaagtgaacgaatgaggatgaagaagttggaagaattgagcaagagcatagaaacgatacgctaagattataacctgatatcaataactaatttaggttgtgtgatgtatttaaggaagttatttctatttatgtatgggtgctttgagtttgcttgtatttctgcttttttcgtctgtctaattagtctttgatggaccattttctgattgtaggacagggaaatacccaccagtaaacaggtttgtaactaaaaatgtaaaacaggtctcactgtggattcttctccaatttgtaccttcatctttattttgagttgctcgttcctcaagctctatagatgtattgtggaatgactcggaaatagtcatctttctttccctttttctcttatccttgtaaagttttgaagacctggcctttcgaattgcttgaactgttaagcttatgtctttaaactcggccaaggcaaactagtttatcatactctacatgtttgttagaacatcaccttcatattaatttgcatgtgtccaccagtttgacgtggtatgatcatcaagttgctcttctacctatttccttcatttgattggccgctcgccaactcttacgtttgtttcgcctcctaacaagtcctggttaggaaagtaactagtccttgtagcgtacttgattatgttgtcatgccataatatggacgtaga

SEQ ID NO: 2931 - DNA, 932 bp, Catharanthus roseus
cagaagcagataacaaagagaaaaaattagaaggaagaacaagggttttctgctgttgctggaaaagtgaaatggctcaaccacctcagaggcagcaatctgagcagctgcaaacgctaatgcaatcgggtcagatttcaggtagcctgagctttaatgggactttgagcaaagaagatgaggagatgtcaaggtctgctctctctactttcaaagctaaagaggaagagattgagaagaaaaaactcgaggtcaaggaaagagttcaagctcagttgggtcgtattgaggaagagactaagcgtttagctaatattcgtgaggaactagaagcactagcagatccaatgaagaaggaagtttcgctggtccgcaagaagattgattctgtcaacaaagaattaaaaccactggggcaaacctgccagaagaaggagagggaatacaaagaagctcttgaggctttcaatgaaaagaacagagaaaaagtacagctaataacaagattgatggagctggtgagtgaaagtgaacggatgaggatgaagaagttggaagaattgagcaagagcatagaaacgatacgctaagataacctaatatcttatatcagtaactaatttaggtttgtgtgatgtatttaagaaagtcatctctatttatgtatgggtgttttggagtttgcttgtatttcttactttttatcgtctgtttaattagtctttaatggtccgttttctgatcgtaggacagggaatacccgccgagtaaacaggtttgtaactaaaaatgtaaaacaggtctcactgtggattcttcttaatttgttaccttcattttatatttttgagttgccctttcctcagcttcaagttaatcaactttgtgagaatgactcaagatagtcattattttttactagaggcgtggtc

SEQ ID NO: 2932 - DNA, 1079 bp, Lactuca sativa
gatatacgttgtatacacgattttcatacactctgcccatctctctctctctctctctctctctctctctctcatctggtggggctacaagggttcataactttggcattaggcctgccttctctaatcaccactcttgaatacactatacacacacaacggaaagtaaaacgttaaagcaaaagaagaaaacaattggagagataaagagaggaattcgaggaagaaggagggttttttaccttttctggttgaagaaaaagagagaacaagaaatgactacacaaacacaggtacaaacacagaggcaatcaagcgaacagcttcagacactgatgcaagctggacaaatctccggcagtttaagcttcaatgggttgatgaccaaagaagacgaagagatgtctaggtctgctctttctacttttaaggctaaagaggaagagattgagaagaagaagttggaggttagggaaagggttcaagctcagttgggtcgaattgaagaagaaaccaggcgtttagccagtattcgtgaggaactcgaagccctaacagatccgatgaagaaagaagtttcagttgttcgtaaaaggattgatactgtcaacaaagaattgaagccacttggacaaacttgtcagaagaaggagagagagtacaaggaagccctcgacgcttttaatgaaaagaacaaagaaaaagtacaactcatcacaagattgatggagttggttagcgaaagtgagaagatgaggatgaagaaacttgaagaactgagcaaaagcgttgaaacaatacaataagtttaatgatgatgatgattatgatgatgtgatgatgatgatggtgatggggataatctaattagggtttgtgtgagattttattaaaaaaagaagacgttttatcttctttctttatttactacgtgttttatatattggtttggtttaaatttgtatgcgttttgttttttttttttttttgtcagtttgtattttgctgatctaggtttggaaatacatttgtaaaaacaggtctgtaactaaaatcatgtcaaagaacctcttttattt

SEQ ID NO: 2933 - DNA, 1064 bp, Lactuca sativa
tgcctctctctctctctctctatctggtggggctacaagggttcataactttggcattaggcctgccttctctaatcactactcttgaacacactatacacacaacggaaagtaaaacacacacacacacacacacacacacacacacacacacacacacccatccgttaaagcaaaagaagaaaacaattggagagataaagagaggatttcgaggaagaaggagggttttttaccttttctggttgaagaaaaagagagaacaagaaatgactactcaaacacaggtacaaacacagaggcaatctagcgaacagcttcagacactgatgcaagctggtcaaatctccgggagcttaagcttcaatgggttgatgactaaagaagacgaagagatgtccaggtctgctctttctacatttaaggctaaagaggaagagattgagaagaagaagttggaggttagggaaagggttcaagctcagttgggtcgtattgaagaagaaaccaggcgtttagccactattcgtgaggaactcgaagccttaacagatccaatgaagaaagaagtttcagttgttcgtaaaagaattgatactgttaacaaagaattgaagccactggggcaaacttgtcagaagaaggagagagagtacaaggaagctctcgacgcttttaacgaaaagaacaaagaaaaagtacaactcatcacaagattgatggagttggttagcgagagtgagaagatgaggatgaagaaacttgaagaactgagcaaaagcgttgaaacaatacaataagttaaatcatgatgttgatgtgatgatgatgatgatgatgtgatgatgatggggataatctaattagggtttgtgtgagattttattaaaaaaagaagacgttttatcttcttttatttactacgtgttttatatattggtttggcttttgttttgttttgcttttttattttgtttcagtttgtattttgctgatctaggtttggaatacatttgtaaaaacaggtctgtaactaaaatcatgtcaaagaacctcttttattt

SEQ ID NO: 2934 - DNA, 1107 bp, Helianthus annuus
tctctctcacacacattttctctctcacacacacatacatcatatatgtggggctcccatccttcataactttggcttcataatcaccatttctcaacagtctccccacggcaaaaaagaaacaaaagcatttcacacacactaaaaacacacacataaagcacaaaaaacaccacaccattggagagataatcagaccaccgtcttcctctaacattttcttctttttctggttcaagaaacccaaaaaaacccaacaacaaaacatgactactcaaacgacgtcgttacagacaacaacaaccacacagaggcaatcgagtgagcagcttcaaacgcttatgcaagccggtcaaatctccggcagcttgagcttcaacgggctgatgagtaaagaagatgaggagatgtctcggtctgcgttgtctactttcaaagcgaaagaggaggagattgagaagaagaaattggaggttagggaacgtgttcaggctcaattgggacgaattgaagaagaaaccaggcgtttggcgaccattcgtgaggaacttgaagcgttaaccgatccaatgaagaaagaagtttcggttgttcgtaagaagatcgattcggtcaacaaggagttgaagccattgggtcaaacatgtcagaagaaggaaagagagtacaaggaagcactagatgccttcaatgaaaagaacaaagagaaagtacaacttattaccagattgatggagctggtgagcgaaagcgagaagatgaggatgaagaagctggaggaactgagcaagagcgtcgaaacaatacaatagatctgatgataatctgatgatgatgatggtgacggttagacggggttaagctaattaagttttagtgtgatgtattaaaaagaagatattttcccttcttttgctatgttcttatatatgggtcgggtcgggtcgtctctgtttggttgagagatttcttctatgtcgttttccgtttgtttcagtttgatgattagttgttgttaatggtgcttgtattttgctgatcttaggtttggaaatacctttgtaaaaacagtctgtaactaaaatcttgtcaaaaaaaaaaaaaaaa

SEQ ID NO: 2935 - DNA, 1087 bp, Artemisia annua
aagcagtgggaccaacgcagtactccaacggggattccatcaaaacacacacacacacaattggagaaattatcaaatcaaccctaataaacttcttctactctttcttcaaaccatcttcaaaaaccatgacaacacaaatccaaaacacgaatccaaacaccacccgtcaatcaagtgaacaactacaaactttaatgcaagctggacaaatatccggaagcttaagcttcaacgggcttatgactaaagaagatgaggagatgtctaagtcagctttatcgacttttaaagctaaagaagaggagattgagaagaagaagctggaagtgcgggagcgtgtgcaagctcagcttggaaggattgaggaggagactaggcgtttggcttctattcgtgaggaactcgaagcgctaacagatccaatgaagaaagaagtttcagtcgttcgtaagaagatcgattctgtcaacaaagagttgaaacccctaggacagacctgtcagaagaaggagagggagtacaaggaagccttggatgctttcaatgaaaagaacaaagaaaaagtacagctcattacaagattgatggagctggtaagcgagagtgagaagatgaggatgaagaagttggatgagctgagcaagagtgttgaaacgatacaataagtttgacgataacctgatgatgctgatgggttaaagctaattaagttttagtgtgatgtgctaaaaagaagaccttttctcttcttttactatgttcttatatatgggtcagtctcggtttgggtgaaattatattatgcgtttttcatttctttaagtttgattagttgttaatggcgtttgtattttgctgatctaggtttggaaatacctttgtaaaaacaggtctgtaactaaaatcatgtcaaagaacctctttattttacgtcctctagggttcttgttttacattaccaaattgcgagcaatactgttgcagtaacttgctcaagattttgtaattacctttttgtttattctataattggagtttgatttgcatttggtgattttgagatggattacacttatatcgaaaa

SEQ ID NO: 2936 - DNA, 888 bp, Cichorium intybus
tcaggcattataactttgtcatttaggcctgccttctctaatcaccactcttgaaccactatactcgcagcaaaaagaggaaagtaaaacacacactcacacacccttccgttaaagcaaaagaagaaaacaattggagagataaagagaggaattcgaggaagaaggagggttttttactttttctggttgaagaaaaagagagcacaagaaatgactactcaaacacaggtacaaacacagaggcaatcaagcgaacagcttcaaacactgatgcaagctggtcaaatctccggtagcttaagcttcaatgggttgatgaccaaagaagacgaagagatgtccaggtctgctctttctacttttaaggctaaagaggaagagattgagaagaagaagttggaggttagggaaagggttcaagctcagttgggtcgaattgaagaagaaaccaggcgtttggctactattcgtgaggaacttgaagcattaacggatccaatgaaaaaagaagtttcagttgtccgtaaaaagatcgattctgtcaacaaagagttgaagccacttggacaaacctgtcagaagaaggagagggagtacaaggaagccctggacgcttttaatgaaaaaaacaaagaaaaagtacaactcatcacaagattgatggagctggtgagcgaaagtgagaagatgaggatgaagaaacttgaagaactgagcaaaagcgttgaaacaatacaataaatttgaagacgatgatgataacgtgatgttgatgggtttaagctaattagggtttgtgtgatgtattaaaaaaaaaagaagaaattttctcttctttttactacgtgttttatatattggtttggttttaaatttgtacgcgtt

SEQ ID NO: 2937 - DNA, 1059 bp, Cynara scolymus
  misc_feature (6)..(6): n is a, c, g, or t
  misc_feature (992)..(992): n is a, c, g, or t
  misc_feature (1022)..(1022): n is a, c, g, or t
tacatnccacttcaacagtctacagagagaaaaagaagaagaaagtgaaacacacccgttaccaacaataaagcaaaagaacgaaaatattggagagataaagagaggaatcagggcaagaaggagggtttttcgctttttctggttgaagaaaaagagggaagaacaagaaatgactacccaaacacagctacaaacacagaggcaatcaagtgaacagcttcaaacactgatgcaagctggtcaaatttcagggagcttgagcttcaatgggttgatgactaaagaagacgaagagatgtctaggtctgctctttctacttttaaagctaaagaagaagagattgagaagaaaaagttggaagttagggaaagggttcaagctcagttgggtcgtattgaagaagaaaccagacgtttggctaatatccgtgaggaactcgaagcgctaacagatccaatgaagaaagaagtttcagtcgttcgtaagaagattgattccgtaaacaaagagttgaagccactgggacagacctgtcagaaaaaggaaagggagtataaggaagccctggatgcattcaatgaaaagaacaaagagaaagtacaactcatcacaagattgatggagctggtgagcgaaagcgagaagatgaggatgaagaagctggaagagctgagcaagagcgttgaaacgatacaataagtgtgacgacaacctgatgatgatgggcttaagctaattaggtttgtgtgatgtatttaagaaagaagatcttttccccttcttttggctatgttcttattacatatgggtttggttgaaaaatttctgtcggtttttcgtttgttttaagtttgattagtcgtggtcgttaatgggtgtttgtattttgctgatctaggtttggaaatacctctgtaaaaacaggtctgtaactaaaatcatgtcaaaaacctctttgtttccatttctagacttcattttttactgntagtttgtcatttttactcttgaagatggnggatctgtatttgttatatatattgaagtcgattgca

SEQ ID NO: 2938 - DNA, 801 bp, Taraxacum officinale
  misc_feature (773)..(773): n is a, c, g, or t
tttctggttgaagaaaaagagagcacaagagatgactactcaaacacaggtacaaacacagaggcaatcaagcgaacaacttcagacactgatgcaagctggtcaaatctccggcagcttaagcttcaatgggttgatgaccaaagaagacgaagagatgtcaaggtctgctctttctacttttaaggctaaagaggaagaaattgagaagaagaagttggaggttagggaaagggttcaagctcagttgggtcgaattgaagaagaaaccaagcgtttagcttctattcgtgaggaactcgaagccctaacagatccaatgaagaaagaagtttcagtcgttcgtaaaaggatcgattctgtcaacaaagaattgaagccactgggacaaacttgtcagaagaaggagagagagtacaaggaagcccttgacgcgtttaacgaaaagaacaaagaaaaagtacaactcatcacaagattgatggagctggtgagcgaaagtgagaagatgaggatgaaaaagctggaagagttgagcaaaagcgttgaaacaatacaataagttttttaatggtgaaggggtttttttaatctaattagggtttgtgtgatgcattaaaaaaagaagatgttttctcttctttttgtttactacgtgttttatatattggtttgcgcgtttaaatttgttttttatttttatttttattttggtttgtattttgctgatctaggtttgggaatacatttgtaaaaacaggtctgtaactaanatcatgtcaaagaacctcttttgttttc

SEQ ID NO: 2939 - DNA, 1029 bp, Senecio madagascariensis
tacttttaaaaaaaccctaaaacctttatttttcttatctatacatacacacactctgtatctatatctctatatctagtgggacaccaacaaattctcctttctctcccaaaacacacactaaaacacacactgaaataacacacagtgaaagcaaaattggagaaaaaatcaaagttttcttctttttctggttcaaaaaatccaaaaaaaatcaagaaattccacaaattatgactactactcaatcgagtgagcagcttcaaacgttaatgcaagccggacaaatatccggcagtttgagtttcaacggattgatgacgaaagaagatgaagaaatgtccagatctgcactttctacgtttaaagctaaagaagaggagattgaaaagaagaaattggaagttagggaacgtgttcaagctcaattgggacgaattgaagaagaaacgagacgtttagctaccattcgtgaggaactcgaagcattaaccgacccaatgaagaaggaagtttcagtagttcgtaagaagatcgattctgttaacaaagagttgaagccacttggacaaacctgtcagaagaaagaacgagagtacaaggaagccctagacgctttcaatgaaaagaacaaagaaaaagtacaactcattacacgattgatggagctggtgagcgaaagtgagaagatgaggatgaagaaactcgaagaactcagcaagagtgtggaaacgatacaataagtttgatgctgatgatgaatgaagttaaaaaaaaagaagctaattaggttggtgtgatgtattaaaaaagaagaccttttcccttcttttactatctatgggtcgtcgtttttctgggtttggtttaaatttctatgcgttttttatttgttttcagtttgatttagtcgtcgagttaatcaatcagtcgtgtttgtattttgctgatctaggtttggaaatacctttgtaaaaacaagtctgtaactaaaatcatgtgtcaaagaacctctttcttttaaaagaa

SEQ ID NO: 2940 - DNA, 1030 bp, Tragopogon dubius
cgtacacaaatattcatacaatctacattctacacctctctctcatcatttgtggggctacaaggtttcataactttggcattaaggcctgccttctctaatcaccacgcttgaacacagcagaagaaaagaggaaagtaaaacacacagagacacccgttaaagcgaaagaagaaagccattggagagataaagagaggaattagaggaagaaggagggttttttaccttttctggttgaagaaaaagagacaacaagaaatgactactcaaacgcaggtacaaacacagaggcaatcgagcgaacagcttcaaacactgatgcaagctggtcaaatctccgggagcttaagctttaatgggttgatgaccaaggaagacgaagagatgtcaaggtctgctctttctacttttaaggctaaagaggaagaaattgagaagaagaagttggaggttagggaaagggttcaagctcagttgggtcgaattgaagaagaaaccagacgtttggctacaattcgtgaggaactcgaagcattaacagacccaatgaagaaagaagtttcagttgttcgtaaaaagattgattctgttaacaaagaattgaagccactgggacaaacctgtcagaagaaggagagagagtacaaggaagccctggatgcttttaatgaaaagaacaaagaaaaagtacaactaatcacaagattaatggagctggtgagcgaaagtgagaagatgaggatgaagaaactggaagaactgagcaagagtgttgaaacaatacaataagtttgatgatgataagctgatggggttaagctaattagggtttgtgtgatgtattaaaaagaagacctttgtgttttatatattgggtttggtttaaatttgtttggttttgttttgtttaagtttgattaattagtggttaatggtgtttgtattttgctgatctaggtttggaaaaatacctctgtaaaaacctgtctgtaactaaaatcatgtcaaagaacctctttatttacag

SEQ ID NO: 2941 - DNA, 901 bp, Sesamum indicum
ggggtagcggaagagataataaagagaagaaatcaagaaagaagaagggttttctgtgcaagaaatttgaagagcaatgatgcagactcaaaggacgctggaaaaccaacagtctctgatgcaatccggtcagatttctggcagtttgagtttcaacgggactttgtcgaaagaggacgaggagatgtcaaagtctgctctctctaccttcagggctaaggaggaagagattgagaagaagaagatggaagttaaggagaaagttcaggctcagctcggccggattgaagaagaaaccaagcgtttggccaccatccgtgaggaactagaagcccttgcggatcccatgaagaaagaagtctctctcgttcgcaagaaaatcgatgcagttaacaaagagttaaaaccactggggcagacttgccagaagaaggagagagaatacaaagaagcccttgaagctttcaatgaaaagaacaaggaaaaagtacaactcatcactagattgatggagctggtgagcgagagcgagaggttgaggctgaagaagttggaggagctgagcaagaacatagaaacgatacgatctgcctgatgttgtatcattgttgacgtctaattaggattgtgtgatgtatttaagaaatgcgttgttatttatataacgttggtgttttcgggtttggttgtattctacggttatcttgtttgatggattagcttttgatggtaaggagtttctaattttaggaaggggaaattctctccttaaaacaggtttgtaactaaaacatgtctcaaactatgtattcttgtaagtttctctttgtattttttactacatgtttcagtttcctattctggaattatgtaagtagtgcattgcaaggaaggtttggcc

SEQ ID NO: 2942 - DNA, 773 bp, Cynara scolymus
aaattaagagagggattagacgaagaaggagggttttttgctttttctggttgaagaaaaagaccgagaaagaaccagaaaaagtaatggctactcagacggagaagcaatcgagtgagcagcttcaaacactgatgcaggctggtcaaatttcagggagtttaagtttcagtgggttaatgtctaaagaagatgaagagatgtctaaatctgctctttctacttttaaggcgaaagaggaagagatcgagaagaaaaaattagaggttaaagaaagagttcaagctcagttgggtcgtattgaagaagaaaccagacgtttggcttctattcaagaggaacttgaagctctaacagatcccatgaaaaaagaagtttcagttgttcgtaagaagattgattccgtcaacaaagagttgaagccattgggacagacctgccagaagaaggaaagagagtataaggaagcactggatgctttcaatgaaaagaacaaggataaagtgcaattaattacaagattgatggagctggtgggcgagagcgagaagacgaggatgaagaaactggacgagctgagtaagagcatcgaaaccatacaataagttaataaaatggaaacagaaacaaaaaccgatggtgatggtgatctggtaagtaggttttgtgtgatgtggtttggttgttacatatggggtctgatatgagatccttttgctcttggtttgggttggatttgttatttttggttttggttgaatagttgtattttg

SEQ ID NO: 2943 - DNA, 1175 bp, Lactuca sativa
ggtaatttccacttcttccctggcagcaaaatatatacacgcccttgtatatatatgtatatatacgttgtatacacgattttcatacactctgcccatctctctctctctctctctctctctctctctctcatctggtggggctacaagggttcataactttggcattaggcctgccttctctaatcaccactcttgaatacactatacacacacaacggaaagtaaaacgttaaagcaaaagaagaaaacaattggagagataaagagaggaattcgaggaagaaggagggttttttaccttttctggttgaagaaaaagagagaacaagaaatgactacacaaacacaggtacaaacacagaggcaatcaagcgaacagcttcagacactgatgcaagctggacaaatctccggcagtttaagcttcaatgggttgatgaccaaagaagacgaagagatgtctaggtctgctctttctacttttaaggctaaagaggaagagattgagaagaagaagttggaggttagggaaagggttcaagctcagttgggtcgaattgaagaagaaaccaggcgtttagccagtattcgtgaggaactcgaagccctaacagatccgatgaagaaagaagtttcagttgttcgtaaaaggattgatactgtcaacaaagaattgaagccacttggacaaacttgtcagaagaaggagagagagtacaaggaagccctcgacgcttttaatgaaaagaacaaagaaaaagtacaactcatcacaagattgatggagttggttagcgaaagtgagaagatgaggatgaagaaacttgaagaactgagcaaaagcgttgaaacaatacaataagcttaatgatgatgatgattatgatgatgtgatgatgatgatggtgatggggataatctaattagggtttgtgtgagattttattaaaaaaagaagacgttttatcttctttctttatttactacgtgttttatatattggtttggtttaaatttgtatgcgtttttttttttttttttttttcctttttttatgtcagtttgtattttgctgatctaggtttggaaatacatttgtaaaaacaggtctgtaactaaaatcatgtcaaagaacctcttttatttcgattaaccttgtatgtctttttatt

SEQ ID NO: 2944 - DNA, 826 bp, Parthenium argentatum
gcaacacttctcctttctttttctttagtggggcaacaaagcttgcaactttaagcatcaaaaaatccaaccttaaccatccaaacaacccataaccaaaacggtggaaatcaaaacaagaaaaaattagagaaattaaaaaaggggttagaggaaggaggagggtgttttgttttttctggttgaagaaaaagagtgtaaaagaaccagaaaaacaacaaatggctactcaaaaccagcctcatgaacagcttcaaacactgatgcaagctggtcaaatgtcagggagtttaagtttcagtgggttgatgtctaaagaagatgaagagatgtctaaatctgctctttctactttcaaggctaaagaagaagagattgagaggaagaagttggaagttaaagaacgtgttcaagctcagttgggtcggattgaagaagaaaccagacgtttagcttctattcaagaggaactggacgcccttaccgatccaatgaagaaagaagtaacccttgttcgtaagaagattgatacagtcaacaaagagttgaagccactcggacacacctgccagaagaaggagagggagtataaggaagccctggatgcttttaatgaaaagaacaaggaaaaagtacaactaattacaagattaatggagctggttagcgaaagcgagaaggagaggatgaagaagctggaggagttgagcaagagcatcgaaacaatacaataagttaacgatgggggtttatcattaatctggtaattaggtttgtgtgatgatggtttggttgggatttgtgtgggtgtttagtgtaatccgtt

SEQ ID NO: 2945 - DNA, 934 bp, Nicotiana tabacum
  misc_feature (29)..(29): n is a, c, g, or t
  misc_feature (47)..(47): n is a, c, g, or t
  misc_feature (55)..(56): n is a, c, g, or t
  misc_feature (321)..(321): n is a, c, g, or t
ggccattacggccggggacctacaacagnaaacaaaagggtccattncattcatnncataataccaaagcaaaaaagcaaaagataaagtgaaaaattgaagaagaagaagaagaggcttttctttttgttgttgtgaagttgaagaaaacaagaagaaatgccaaatcaaaagcaaggaagtgaacagctacaaacactgatgcaatcagggcaaatttcagggtctttgagttttaatgggactttaactaaagaagatgaagagatgtcaaggtctgctctttctactttcaaagctaaagaagaagaaattgagaanaagaaaatggaagtcaaagaaagagttcaagctcagttgggtcgggtcgaagaagaaactcggcgtttagccattattcgtgaggagctagaagcattagctgatccaaagaagaaagatgttcaaatcgttcggaagaagattgatgctgtcaacaaagagttaaaacccctgggacagacctgccagaagaaggaaaaagagtacaaagaagctcttgaggcgttcaatgaaaagcacaaggaaaaagtacagctaataacaagattgatggagttggtgggtgaaagcgagaaactgcgactgaagaagttggagctgagcaagagcatagaaacaatacgctgaataaccagtaaaacttcccctgactaattaggcttgtgtgatatatcttaatattctaagaaagtgaaatttctatttatatatgggtgttggtgtttgattgtatttcatcttcttgttctttttctgcgtatgttgtctgatcatttttgtctctgagggatgatcattgtctaattttaggtcttaaagggaaaaaccctgtaaacaggtttgtaactataacaagtctcaaaaactgtggattcttttgcttttgtcttca

SEQ ID NO: 2946 - DNA, 763 bp, Arnica chamissonis
cggccgaaagcaaaacaaggaaaaattagagaaatcaagagaggaattagaggaagaaggagggttttttgctttttctggttgaagaaaaagagtgagaaagaaccagtaaaagaaatggctactcaaaatcaacctcatgagcagcttcaaacactgatgcaagcgggtcaaatttcagggagtttgagtttcagtgggttgatgtcgaaagaagatgaagatatgtctaaatctgctctttctgcttttaaggccaaagaagaagagatcgagaagaagaaattggaggttaaagaaagggttcaagctcagttgggtcgtattgaagaagaaaccagacgtttagctgctattcaagaggaactggaagcacttacagatccaatgaagaaagaagtaacagttgttcgtaagaagattgattcggtcaataaagagttgaagccactcgggcacaactgccagaaaaaggaacgagagtataaggaagcattggatgcgtttaatgaaaagaacaaggaaaaagtacaactaattacaagattaatggagcttgtgagcgaaagcgagaaggaagaggatgaagaagttggatgagctgagcaagagcattgaaaccgtaagataagttaataataataaatcaaaaactgatggtgtgatgatgtggtttaatctggtaattaggtttgtgtgatgatgtggttactggttttgttggtatgtgttgctgtttagtttaatccggtaaaacaggttg

SEQ ID NO: 2947 - DNA, 822 bp, Centaurea maculosa
ggggggcagcagcacatttctgctttctttttggtttgtggggcttgcaactttctttaaccattaaaattctgccttaagaaccattcgacgacccataatcaaatcaaaccggggagaagaagaaacgaaaacaagaaaaaattagagaaattaagagaggaaggaggagggttttttgctttttctggttgaggaagaagaagaggagcgaaaaagaaccagaaaagcaacaaatagctcagcctcacgagcagcttcaaacactgatgcaagctggtgaaatgtcaggtgggagtttgagtttcagtgggttgatgtccaaagaagatgaagagatgtctaaatctgctctttctactttcaaggccaaagaagaagagatcgagaagaagaagttggaggttaaagaacgggttcaagcccagttgggtcggattgaacaagaaaccagacgtttagcttccattcaagaggaactggatgctcttacagatccaatgaagaaagaagtaacacttgttcgtaagaagattgatacggtcaacaaagagttgaagccactcggacacacctgccagaaaaaggagagggagtataaggaagcgctggatgcttttaatgaaaagaacaaggaaaaagtacaactaattacaagattaatggagctggtgagtgaaagcgagaaggagaggatgaagaagctggaggagctgagcaagagcatcgaaaccatacaataagttaatgatggggtttgttaatctggtaattaggtttgtgtgatgaaggtttggttgggatttgtgtgggtgtttagtt

SEQ ID NO: 2948 - DNA, 895 bp, Ipomoea nil
aggtagcagctacggcggaagtggtagaacaagaagaagaagcaggaggaggaggagagacgatgcagaaccagagacaaggaggagagtcacagactcagcttcagacactgatgcagtctggccaaatttctgggagcttgagcttcaatggcaccatgactaaggaagacgaggagatgtctaggtctgctctctccaccttcaaggctaaagaagaggagattgagaagaagaagctcgaggtcagggagaaagtccaggctcagcttggccgtattgaagaagaaaccaggcgtttggctaccattctcgaggaactagaagcgctagcagatccaatgaagaaggaagtttctctcgttcgcaagaagattgatacggttaacaaggagttaaaaccattgggacagacttgccagaagaaggagagagagtacaaagaagctctcgaggccttcaatgagaagcacaaggaaaaagtacagctaatcacaaggttgacggagctggtgagtgaaagcgagaagttgaggatgaagaagttggaggagctgagcaagagcatagaaacgctacgctgaaatcttctgaagaagttggaggagctgagcaagagcatagaaacgctacgctgaaatcttctccccccgctaatcgaaagtctcgtgactaattaggccatgcgtgtgatgtatttaagtaaaaagacagtcttaattatatatgggtgttttttgtgtcgggttgtaagttttcttcttcttcttcttcttctttcttattccgcttttggttgtcttgctcttagcttttgatgtctgactttagatcccgagggacatacccctgtaaacaggtttgtaacaaaaaagcaggtctcaactctcagcta

SEQ ID NO: 2949 - DNA, 893 bp, Ambrosia trifida
cattggagagataataatcaaccaaaacccatctaagctttcttccttcttcatcttctggttcaacaaattaacaaaaagacaaaccatgacgactcaaacgacgtcgcaggctcaaacacagaggcaatcaagcgaacagcttcaaaccctgatgcaagctggtcaaatctctggaagcctaagctttaatgggttgatgagtaaagaagatgaagagatgtctaggtctgctttatccacgtttaaggctaaagaagaagagatcgagaagaagaaattggaggttaaggaacgtgttcaggcacaattgggacggattgaggaagaaacgagacgtttggctacgattcgtgaggaactcgaagcattaaccgacccgatgaagaaagaagtttcagttgttcgtaagaagattgattccgtcaacaaagagttgaagccgcttggtcagacatgtcagaagaaggaaagagagtacaaggaagcactagatgccttcaatgaaaagaacaaagagaaagtacaacttattaccagattgatggagctggtgagcgaaagtgagaagatgaggatgaagaagctggaagaactgagcaagagtgttgaaacaatacaatagatctgatgataatcttctgatgatgatgatgatggtgatggggttaagctaattaagttttagtgtgatgtgttaaaaaagaagatattttcccttcttttcgctatgttcttatatatgggtcagtctctgtttggttgagatttctatgtcgtttttcgtttgtttcagtttgattagtcgttaatggtgcttgtattttgctgatcttaggtttggaaatacctttgtaaaaacagtctgtaactaaaatcttgtcaaaaaagaa

SEQ ID NO: 2950 - DNA, 803 bp, Ambrosia trifida
cacaacacattgagaaataataatattcaccaaacccatctaagctttcctctttcttcttcttctggttcaacaaactaacaaaaaacaaaccatgacgactcaaacgacgtcgcaggctcaaacacagaggcaatcaagcgaacagctccaaaccctgatgcaagcaggccaaatctctggaagcctaagcttcaatgggttgatgagtaaagaagatgaggagatgtctaggtctgctttatccacgtttaaagctaaagaagaagagatcgagaagaagaaattggaggttaaggaacgtgtccaggcacaattgggacggattgaggaggaaaccagacgtttggctacgattcgtgaggaactcgaagcgttaaccgacccgatgaagaaagaagtttcagttgttcgtaagaagatcgattccgtcaacaaagagttgaagccacttggtcagacatgtcagaagaaggaaagagagtacaaggaagctctagatgccttcaatgaaaagaacaaagagaaagtacaacttattaccagattgatggagctggtgagcgaaagtgagaagatgaggatgaagaagctggaagaactgagcaagagtgttgaaacaatacaatagatctgatgataatcttctgatgatgatgatgatggtgatggggttaagctaattaagttttagtgtgatgtaattaaaaaagaagacattttcccttcttttcgctatgtttttatatatgggtcagtctctgtttggttgagtatttctatgttcgtttttcgtttgtttc

SEQ ID NO: 2951 - DNA, 969 bp, Cirsium arvense
tgggtaatttggtcatttcacttggcaaaacatatacatacatcctcatatatgtattacactcaatacaggctagcaagacttcttcctttccttttctttatctttctctatttctcttaagctcataactttaagcatcaaggtctgccttcttaacccattcagacgagaagaaaacaaagaaatcgaaaaacattgagggtggaaaagacaaaaaagaaaaattagagaaattaagagagggattagaggaagaaggagggttttttgctttttctggttgaagaaaaagactgagaaagaaccagaaaaagtaatggctactcaaacccagaagcaatcgactgaacagcttcagacactgatgcaggctggtcaaatttcagggagtttaagcttcagtggcttaatgtctaaagaagatgaagagatgtctaaatctgctctttctacttttaaggccaaagaggaagagatcgagaagaagaaattggaggttaaagaaagagttcaagctcagttgggtcgtattgaagaagaaactagacgtttagcttctattcaagaggaactcgaagctctaacagatccgatgaaaaaagaagtttcagttgttcgtaaaaagattgattccgtcaacaaagagttgaagccattgggacagacctgccaaaagaaggaaagagagtataaggaagcacttgatgctttcaatgaaaagaacaaggagaaagttcaactaattacaagattgatggagctgctgggtgagagcgagaaaacgaggatgaagaaactggacgagctgagtaagagtatcgaaaccgtacaataagttaataaaacaatgaaaacaaaaacgaaaaaaactgatggtgatgataatatggtaactaggttttgtgtgatgtggttgtttgtttgttatatatgggggtctgatctgagatccttttcttttctttg

SEQ ID NO: 2952 - DNA, 1072 bp, Cirsium arvense
gctcttcataacttcaccattaagacctcccctcccccttccttctctcctccataacccaaacaatcaccaccactcaaaaccccacacactactattcacatagaagaaaaaaaatacccaaaaaaaaaggtaggaaagaaaacacaccccttaccaaaccacataaagcaaaagaaagaaaagaaagaaaaagaaaccaccattagagagataaagagaggaatcagaccaagaacaagaagggtttttcacctttttttctggctaaagaaatccagaaaaaatcaagaaaaaaatcaagaaaacccacaaaatcaagaaaatcaagaaatgagtaccatacaaacagtacaaacacagaggcaatcaagtgagcagcttcagacactgatgcaagctgggcaaatctctggaagcttaagcttcaatgggttgatgactaaagaagatgaagagatgtcaaggtctgcactttcgacttttaaggcgaaagaggaagagatcgagaagaagaagttggaggttagggaaagggttcaagctcagcttgggaggattgaagaagaaacaagacgtcttgctaacattcgtgaggaactcgaagcgctaactgatccaatgaagaaagaagtttcggtcgtccgtaagaagatcgattccgtcaacaaagagttgaagccacttggacaaacttgtcagaaaaaggaaagggagtataaagaagccctagatgcattcaatgaaaagaacaaagagaaagtacaactcattacaagattgatggagctggtgagtgaaagcgagaagatgaggatgaagaagctggaagagctgagcaagagcgttgaaacgatacaataagttgtcagataacgatcgtgatgctgatgggcttaagctaattaggtttgtgtgatgtgttaagaaaaaagaagatcttttccccttcttttgctatgtttttaagtgcttattatatatgggtttggttgaaagaatttctattcgggtttttcttcgtttgttgtttcggtaagtttgattagttaaaaatggtgtttgtattttg

SEQ ID NO: 2953 - DNA, 1137 bp, Centaurea maculosa
  misc_feature (1090)..(1090): n is a, c, g, or t
  misc_feature (1092)..(1093): n is a, c, g, or t
  misc_feature (1099)..(1099): n is a, c, g, or t
  misc_feature (1101)..(1103): n is a, c, g, or t
  misc_feature (1108)..(1110): n is a, c, g, or t
  misc_feature (1112)..(1113): n is a, c, g, or t
  misc_feature (1118)..(1124): n is a, c, g, or t
  misc_feature (1127)..(1127): n is a, c, g, or t
  misc_feature (1129)..(1131): n is a, c, g, or t
  misc_feature (1134)..(1135): n is a, c, g, or t
ccaaaaatcaccaccacttcaaaacccccacacactactattcacatagaagaaaaaaaatcccaaaaaaaaaggtggaaagaaaacacaccccttaccaaaccacataaagcaaaagaaagaaaagaaagaaaaagaaaccaccattagagagataaagagaggaatcagaccaagaacaagaagggtttttcacctttttttctggctaaagaaaaccagaaaaaatcaagaaaaaattcaagaaaacccacaaaatcaagaaaatcaagaaatgagtaccatacaaacagtacaaacacagaggcaatcaagtgagcagcttcagacactgatgcaagctgggcaaatctctggaagcttaagcttcaatgggttgatgactaaagaagatgaagagatgtcaaggtctgcactttctacttttaaggcgaaagaggaagagatcgagaagaagaagttggaggttagggaaagggttcaagctcagcttgggaggattgaagaagaaacaagacgtcttgctaacattcgtgaggaactcgaagcgctaactgatccaatgaagaaagaagtttcggtcgtccgtaagaagatcgattccgtcaacaaagagttgaagccacttggacaaacttgtcagaaaaaggaaagggagtataaagaagccctagatgcattcaatgaaaagaacaaagagaaagtacaactcattacaagattgatggagctggtgagtgaaagcgagaagatgaggatgaagaagctggaagagctgagcaagagcgttgaaacgatacaataagttgtcagataacgatgtgatgctgatgggcttaagctaattaggtttgtgtgatgtgttaagaaaaaagaagatcttttccccttcttttgctatgtttttaagtgcttattatatatgggtttggttgaaagaatttctattcgggtttttcttcgtttgttgtttcggtaagtttgattagttcaaaatggtgtttgtattttgctgatctaggtttggaaatttacctctgtaaaaacaggtctgtaactaaaatcatgtcaaaaaacctctttgtttccntnnctgacncnnnatttnnnanntcgtnnnnnnntantnnngtnntg

SEQ ID NO: 2954 - DNA, 1095 bp, Taraxacum officinale
gcgggatgctcaggctagcaagatttctgctttctttttctttcctttcgtttgtggggcaactaagctgctaactttaagcatcaaagcctgcttttcttaaaccatcggagaaaaacaagaagaaatcgaaaaaatagcgggggaaaagtaaaacaagaaaaaattagagaaattaagagaggaattagaagaaggagggttttctgctttttctggttaaagaagaagagcgagaaagaaccagaaaaaagaatggctcaaccacagaagcaatctagtgagcagcttcaaacactgatgcaagctggtcaaatttcagggagtttgagtttcagtggtttaatgtcgaaagaagacgaagagatgtctaaatctgctctctcaagttttaaggcgaaggaagaagagatagagaagaaaaaactagaggttaaagaaagagttcaagctcagttgggtcgtattgaagaagaaaccagacgtttggcttctattcaagaggaactcgaatcactaacagatccaatgaagaaagaggtctcagttgttcgtaagaagattgattcagtcaacaaagagttgaagccacttggacagacctgccaaaagaaggagcgagaatacaaggaagctctggatgctttcaacgaaaagaacaaggaaaaagtacaactaattacgcgattaatggagctggtgagcgaaagtgagaagacaagaatgaagaagctggatgaactgagcaagagcatagaaaccatacaataagttataatttaccaaaaagaatgatggttgggttgatttgtattgtatgggtgtggtgtgttggtttgaatagttgtattttgggtgatgtagggtttgtaaaaccatgtttgttttgggttttatggtcttaatttttttttcttttttggataaagtaaatttagtaagtagtctttttattttatgacaatgaagatacaatgttttatgtggtggaaatagtgaagggtacaattttaattaaaaaaacacttattatgccggtatgtgtgcatttaggaatgattgtattatttatcataaatgtataaatttctatgg

SEQ ID NO: 2955 - DNA, 627 bp, Parthenium argentatum
gacgacgtctcagcagcaatcacaaacccagaggcaatcaagcgagcaacttcagaccctgatgcaggcgggtcaaatatcgggcagcttgagcttcaacgggctgatgagtaaagaagatgaggagatgtcgaggtctgcgttgtctacgtttaaagcaaaagaagaagagattgagaagaagaagttggaggttagagaacgagttcaggctcagttgggcaagattgaagaggagactagacgtttagctactattcgtgaggaactcgaagcattaaccgacccaatgaagaaagaagtttcagttgttcgtaagaagatcgattcggtcaacaaagagttgaagccactaggtcaaacatgtcagaagaaggaaagagagtacaaggaagcactagatgccttcaatgaaaagaacaaagaaaaagtacaacttattactagattgatggagctggtgagtgaaagtgagaagatgaggatgaagaagctggaagaactgagcaagagcgttgaaacaatacaataaatctgatggtgatggtgacggggttaagctaattaagttttagtgtgatgtattaaaaagaagacattttcccttcttttgctatgttcttatat

SEQ ID NO: 2956 - DNA, 785 bp, Petunia hybrida
acaagcacagcaactaaaaaaggggtccatatcatcataaccaaagctaaaaaagcaaaaaagagaaaaaaggggttagtggagagaaagaaagaaagaaaagataaagtgacaaaaatcgaaagaagagtgttttttcttttttctttctgttgtgaagaaaagcaagaagaagaagaagattttcaagaaaatgttgaatcaaaaacaacaaggaagcgaacaactacaaacactgatgcaatctgggcaaatttcagggtcatttagttttaatggaactttaacaaaagaagatgaagaaatgtcaaggtctgcactttctacttttaaagctaaagaagaagaaattgagaagaagaaaatggaagtcaaagaaagagttcaagctcagttgggtcgtattgaagaagaaactaagcgtttagccactattcgtgaggaactagaagcattagctgatccaatgaagaaagaggttcaagctgttcggaagaaggttgatgctgtcaacaaagagttgaaaccccttggacagacctgccagaagaaggaaagagagtacaaagaagctcttgaggccttcaatgagaagcacaaagaaaaagtacagctaataacaagattgatggagctggtgagcgaaagcgagaaacagcgattgaagaagttggaggagctgagcaagagcatagaaacaatacgctgaatggtcgtaaatcttccctgactaattaggcttgtgtgatatatttaagaaagctcgaattcctatttatatatcg

SEQ ID NO: 2957 - DNA, 875 bp, Valeriana officinalis
tcatttcaattcaaaagcaaacccacaccaaaactagagagataaaccaccgaaattcaaggaagaagaagaagaagaagaaaaacaagaagatgaccagtgagaatccacaaccacaacaaacactgatgcaagctgctcagatttctggaagcttaagcttcaatggaaaccttagtaaggaagaagaagagatgtctaaatcagctctctctactttcagagctaaagaagaagagatcgagaagaagaagcttgaggttaaggagcgtgttcttgctcagttaggccgtattgaagatgaaactcgacgcttggctggtattcgtgaggaacttgaaggtcttgctgatccaatgaaaaaggaagttgcacttgttcgcaagaaaatcgattctgtcaacaaagaattgaagccactcggtcagaactgccagaagaaggaaagggagtacaaagaagctcttgatgcatttaatgagaagaacaaggagaaagtacagcttatcaacaaattgatggagctggtgagcgaaagtgagaagttgaggatgaagaagctggaggagctaagtaagagcatagaacttatgcactgaaaatatgttcttaaccccaaaagaaaatcgtgtcgatgaactaaaaaaaactaggttggtgttatgtatttattattatcttagatttatatatgggttgtttttctttcttcttctttctttggttttcttctttaaggtttggttgtattctacggtttcgcttgcttgatttcggtaattaggttttgatgatgaatttactgatttagggtttggaaaaatgattacgttgtaaacaggtttgtaactaaacatgatgttagctttcttcga

SEQ ID NO: 2958 - DNA, 682 bp, Bupleurum chinense
caaagccaaaacacaaccaaaagcaaaagaggagagagaaaagcgcgcacacacacacaaagagggaaactgaagaagcaacaagggttttatttcaggaaatatatacatacatacatacaaaacaatatgatgcaaacacaacagcaagcactgatgcagtcgggtcaactctcaggaagtttaagcttcagtagtaatctgtctaaggaagatgaagagatgtcaaagtctgcgctttctactttcagggctaaagaagaagaaattgaaaaaaagaagcttgaggttagagagagagttcaggctcagcttggtcgtattgaagaagaaactaaacgtttggctaacattcgcgaggaacttgaaggattagcagatccaatgaagaaggaagttagtgttgtccgtaagaaaatagattcagttaataaagagttgaaaccgttgggacaaacctgccagaagaaggaaaaagagtataaagatgcccttgaagcttttaatgataagaacaaagagaaagtacagttgattactaggttgatggagttggtaagcgaaagcgagaaactaaggatgaagaagctggaggagcttagtaagagcatagaattgacacgctgaataactgtgaactctgattaataagttagggacgtgtgaatgtatttattaataa

SEQ ID NO: 2959 - DNA, 767 bp, Carthamus tinctorius
gggggcaccaaaactcaccctcataactttaagcatcaaaacctgccctcttaagtcttaaacaaactaacaaacacccaagaagttgaagaaaaatcatagctttttttgggggaaaaccaaaaaaccaggaaaaattagagaaattaagcgagggattagaggaagaaggagggttttctgctttttctggttgaagaaaaagagcgagaaagaaccagaaaaagtgatggcttcccagaaccagaagcagtcgtctgagcagcttcagacgctgatgcaggctggtcagatttcagggagcttaagcttcagtggcttaatgtctagagaagatgaagagatgtctaaatctgcgctttctacctttaaggccaaagaggaggagatcgagaagaagaagttggaggttaaagaacgagttcaagctcagttgggtcgtattgaagaagaaaccagacgtttggcttctattcaagaggagcccgaagctttaacggatccgatgaagaaagaagtttccgttgtccgtaagaagattgattctgtcaacaaagagttgaagcctttgggacagacctgccagaagaaggaaagagagtataaggaagcgctggatgctttcaacgaaaagaacaaggaaaaagtgcaactaattacaagattgatggagttggtcggtgagagcgagaagacgaggatgaagaagctggacgagctgagcaagagcatcgaaaccgtacaataagttaataataaagcaaaaa

SEQ ID NO: 2960 - DNA, 913 bp, Camellia sinensis
gaaaccatcattccaaagccacaaaagagagcgagaggagagagagagagagagagagagagagagggtggagataaagtgaggaattcaaggaagaagaagggtttcccagacagagaaagatagagagatagagagaagatgactcaaacacagaggcaggcaagtgaacagcaacaacaagcactgatgcaatcagggcaaatctctggaagcttgagcttcaatggaaccctaactaaagaagacgaagagatgtcgagatcggctctctctactttcagggctaaggaagaagagatcgagaagaagaaactcgaggtcaaagagaaagttcagcttcatctcggtcgcatcgaagaagaaaatcgacgattagctactattcgcgaggagctcgaggggctggcagatccgatgaaaaaagtagtctcagttgttcgtaaaaagattgatgctgtcaacaaggagttaaagccactgggtgtgacttgccagaagaaggagagagagtacaaagaagctctcgaggctttcaatgaaaaaaacaaagaaaaagtacagctgattacccgattgagggagctggttggtgaaagtgagagattgaggatgaagaagctggaggagctgagtaagagcatagaaacggtacgctaagattgataacctaatgcttgattgatagctaattaggttttgtgtggtgtatttatttaagagaagacttctatattgtctgtctgtatatgggtgtctttgggtttgtttgtattctatgattttcttgtttgcttaattagcttttgttggagcatttgctgatttaggaatgggaaatacccccacaaacaggtttgtaccaaacaggtctcaacttttcttcacatttttcttcttttacattcaactc

SEQ ID NO: 2961 - DNA, 669 bp, Flaveria ramosissima
ataaagcaaaagaagaccaccattggagagatcaacagaggaatcgaagcaccaacaagggttttcttctttttctggtttaagaaattgagaagacgacaacaacaacagcaagaagaagatatgacgacgactcaaacacaggtgcagacgcagaggcaatcgagtgagcagcttcagacgctgatgcaagcgggtcaaatctccgggagtttgagcttcaatgggttgattacgaaggaagatgaagagatgtcgaggtctgcgctttcgacttttaaggccaaagaggaagaaattgagaggaagaagttggaggttaaggaaagggttcaagctcaattgggtcgaattgaagaagaaacgaggcgtttggctacgattcgtgaggaactcgaagcattaaccgatccaatgaagaaggaagtttcacttgttcgtaagaagattgattcggtcaacaaagagttgaagccactaggtcaaacatgtcagaagaaggaaagagaatacaaagaagctctagatgctttcaatgagaagaacaaagaaaaagtacagcttattacaagattgatggagctggtgagcgaaagtgagaagatgaggatgaagaagctggaggaactgagcaagagtgttgaaacgatacaataagtctgatgataa

SEQ ID NO: 2962 - DNA, 907 bp, Flaveria ramosissima
tcacgataaagcaaaagaagaccaccattggagagatcaacagaggaaacgaagcaccaacaaggggtttcttctttttctggtttaagaaactgagaagacgacaacaacagcagcagccagaagaagatatgacgacgactcaaacacaggtgcagacgcagaggcaatcgagtgagcagcttcagacgctgatgcaagcgggccaaatctcggggagtttgagcttcaatgggttgattacgaaggaagatgaagagatgtcgaggtctgcgctttcgacttttaaggcgaaagaggaagagattgagaggaagaagttggaggttaaggaaagggttcaagctcaattgggtcgaattgaagaagaaacaaggcgtttggcgacgattcgtgaggaactcgaagcattaaccgatccaatgaagaaggaagtttcacttgttcgtaagaagatcgactcggtcaacaaagagttgaagccgctaggtcaaacatgtcagaagaaggaaagagaatacaaagaagctctagatgctttcaatgagaagaacaaagaaaaagtacagcttattacaagattgatggagctggtgagcgaaagtgagaagatgaggatgaagaagctggaggaactgagcaagagtgttgaaacgatacaataagtctgatgataacctgatgatgatggtggtggattaagctaattaagttttagtgtgatgtatcaaaaagagaccttttcccttcttttactatgttcttatatatgggtcgtctctgtttggttgagatttctatgtcgttttcgtttgtttcagtttgattagtcgttaatggtgtttgtcttttgctgatcttaggtttggaaatacctttgtaaaacagcgtctgtaactaaagtctt

SEQ ID NO: 2963 - DNA, 992 bp, Helianthus annuus
aaacaaaagcatttcacacacactaaaaacacacacacataaagcccaaaaaaacaccaccattggagagataatcaaaccaccatcttcctctagggttttcttctttttctggttcaaaaaacccaaaaaaacatgactactcaaacgacgtcgttacagacaacaacaacaacacagaggcaatcgagtgagcagcttcaaacgcttatgcaagccggtcaaatctccggcagcttgagcttcaacgggctgatgagtaaagaagatgaggagatgtctcggtctgcgttgtctactttcaaagcgcaagcggaggagattgagaagaagaaattggaggttagggaacgtgttcaggctcaattgggacggattgaagaagaaaccaggcgtttggcgaccattcgtgaggaacgtgaagcgttaaccgatccaatgaagaaagaagtttcggttgttcgtaagaagatcgattcggtcaacaaggagtggaagccattgggtcaaacatgtcagaagaaggaaagagagtacaaggaagcactagatgccttcaatgaaaagaacaaagagaaagtacaacttattaccagattgatggagctggtgagcgaaagcgagaagatgaggatgaagaagctggaggaactgagcaagagtgtcgaaacaatacaatagatctgatgataatctgatgatgatggtgacggtgacggggttaagctaattaagttttagtgtgatgtattaaaaagaagatattttccttcttttgctatgttcttatatatgggtcgggtcgtctctgtttggttgagagatttctatgtcgtttttccgtttgtttcagtttgatgattagttgttaatggtgcttgtattttgctgatcttaggtttggaaatacctttgtaaaaacagtctgtaactaaaatcttgtcaaaaacctctttgtttctgttataaaaaaaaaaaaaaatgttagagga

SEQ ID NO: 2964 - DNA, 715 bp, Ambrosia trifida
cattcattcagataaacaacaggctagcaaacatttctcctttctttttcattagtggggcaaccaagtttccaactttaagcatcaaaccaaatcagtggaatccaaaacaaagaaaaattagagaaattaagagaggggttagaggaaggaggagggtgttttgctttttctaggttgaaaaaaaagaccgtaaaagaaccagaaaaacagcaacagatggctactcaaaaccaacaacatgagcagcttcagacactgatgcaggctggtcaaatctcaggcagtctaagcttcagtgggctgatgtctaaagaagatgaagagatgtctaaatctgctctctctactttcaaggctaaagaagaagagattgagaggaagaagttggaggttaaagaacgtgttcaagctcagttgggaaagattgaagaagaaaccagacgtttagcttccattcaagaggaactggacgcccttacagatccaatgaagaaagaagtaacacttgttcgtaagaagattgatacagtcaacaaagagttgaagccactcggacatacctgccagaagaaggagagggagtataaggaagcactggatgctttcaatgaaaagaacaaggaaaaagtacaactaattacaagactaatggagctggtgagtgaaagcgagaaggagaggatgaagaagctggaggagctgagcaaaagca

SEQ ID NO: 2965 - DNA, 738 bp, Gerbera hybrid cultivar
ggattagaggaagaaggagggttttttgctttttctggttgaagaagaagaccgaaaaggaaccagaaaaagaaatggccgctcaaccacagagacaaaatagtgagcagcttcaaacgctgatgcaagctggtcagatgtcgaccagtgtgagtttcagtggtttaatgtcgaaagaagatgaagagatgtcgaaatcggctctttctacgtttaaggctaaagaggaagagatcgagaagaagaaattggaggttaaagaaagagttcaagctcagttgggtcgtattgaagaagaaaccaggcgtttggctactattcaagaggaacttgaggcattgactgatccaatgaagaaagaagtttcggttgttcgtaagaagatcgattccgtcaacaaagagttgaagccactcggacagacctgtcaaaagaaggaaagagaatataaggaagccatggatgcgtttaatgaaaagaacaaggaaaaagtacaactaattacccgattaatggagctggtgagtgaaagcgagaagacgaggatgaagaagctggaagagctgagcaagagcatcgaaaccacacaataagttaataaaaactaatcgtgatcatgatggggttttatcgttaatctggtaattaggtttgtgtgatttgttgttaattatatagaagacgtgtttgatcttgatttggtttggttggaatttgtatgggtgtttttgtttgttt

SEQ ID NO: 2966 - DNA, 835 bp, Capsicum annuum
gaagaagctcaagaacaacaacaagggtgtttatcctttttgaattttaggaagaaaatgccgaatcaaaagcaaggaggaggtagtgaacaactgcaaacactaatgcaatcagggcaaatttcaggttcatttagctttaatggttcattaagtaaagaagatgaagagatgtctaggtctgcactttcttcttttaaggctaaagaagaagaaattgagaaaaggaaaatggaagttagagaaagagttcaagctcaattgggtcgggtcgaagaagaaacccgacgtttagctattatccgtgaggaactagaagcattgtctgatccgatgaagaaagacgttcaagcagttcggaagaggatcgatactgtcaacaaagagttaaaacccctgggacagacctgccagaagaaggaaaaagagtacaaagaagctcttgaggcattcaatgagaaacaccaggaaaaagtacagctaataacaaaattgatggagcttgtgggtgaaagcgagaaactgcgattgaagaagttggaggagctgagcaagagcattgaaacaatacagtgaataaccagtaaaatcttccctgactaattaggcttgtgtgatgtatttaagaaagttcttttttatctatttatatatgtgtgtggtgtttggttgtatttcctttttctgctttgttgtctgatcattttagatttttgagggatgatcagtgtctaattttaggtctgttaagggaaaaaccctctaatacaggtttgtaactaaaacaagtctcagtaactatggattctttttaattttgtactttctcatcttt

SEQ ID NO: 2967 - DNA, 637 bp, Capsicum annuum
gcacgaggcaaaaagcaaaaaacccaaagctgaaaaaattgaagaagctcaagaacaacaacaagggtgtttatcctttttgaattttaggaagaaaatgccgaatcaaaagcaaggaggaggtagtgaacaactgcaaacactaatgcaatcagggcaaatttcaggttcatttagctttaatggttcattaagtaaagaagatgaagagatgtctaggtctgcactttcttcttttaaggctaaagaagaagaaattgagaaaaggaaaatggaagttagagaaagagttcaagctcaattgggtcgggtcgaagaagaaacccgacgtttagctattatccgtgaggaactagaagcattgtctgatccgatgaagaaagacgttcaagcagttcggaagaggatcgatactgtcaacaaagagttaaaacccctgggacagacctgccagaagaaggaaaaagagtacaaagaagctcttgaggcattcaatgagaaacaccaggaaaaagtacagctaataacaaaattgatggagcttgtgggtgaaagcgagaaactgcgattgaagaagttggaggagctgagcaagagcattgaaacaatacagtgaataaccagtaaaatcttccct

SEQ ID NO: 2968 - DNA, 1031 bp, Lippia dulcis
acaaagcagaagagatagagagtgataataaaaggaaataatcaagaaagaaggagggtttttactgtagaaagaagagcaatgatgcagactcagaaaacactagaaaaccaacaatctctgatgcaatcagggcagatttcggggactttgagtttcaacggtagcatgaccaaagaagaagaggagatgtccaaatctgcactcatgactttcagggccaaagaggaggagattgagaagaagaagcttgaagtcaaggagaaagttcaagcgcagcttggccggattgaagaagaaaccaagcgtttggccaatattcgtgaggaattggaagcactagcagatccaatgaagaaggaagtctctgtggtccgcaagaaaattgattcagttaacaaggagttaaaacccctggggcagacttgccagaagaaggagagggaatacaaagaagcccttgaagctttcaatgaaaagaacaaggagaaagtacaactcatcactagattgatggagctcgtgagcgaaagcgagaggctgaggctgaagaagctggaggagctgagcaagaacatagaaacgatacacattgcttaatgatcatcataaataataataatgctgttacttgttcatggtctaattttaggattgtgtgttgtatttaagtaaaggttttatttttcttatttatatatgttgggtgtttttttttgttttttgcgggtttggctgtattttaactgtgtttctttctttcgttggttgaattagtgatgatgtaagggtttctaattttaggaaaagggtatttctctccttttataaacaggtttgtaactaaaaacaggcactcaaaatctatttgtttttctatttcgttccttgtaatattctatctgctccttgtttcaacctgctgaagttgtgtaagactgtaatagtgcattgcaaggtaaggtaaacttagccttggattcccagtaacaatgcctttttcttatagctggggtatccaaggctgtgtt

SEQ ID NO: 2969 - DNA, 842 bp, Sarracenia psittacina
acaggaattcaaggtagaagaagggtttccgagaaaggagagagagagagagaaaatgattcaaacacagaggcaggcgagcgaacagcaacaagcgctgatgcaatcaggccaaatctctggaagcctgagcttcaatggctccctaactagagaagacgaagagatgtcaaattcagctctttctactttcagggcaaaggaagaagagatcgagaagaagaaacttgaggtcaaagagaaagttcagcttcagctcgggcgcatcgaagaagaaaccaaacgattatctaatattcgcgaggagctcgagggactttcagatccgatgaagaaagaagtctcacttgtccgtaagaagattgacgcagtcaataaggagttaaagccactgggccacacttgccagaagaaggagaaagagtacaaggaagctcttgaggctttcaatgagaagaacaaagagaaagtgcagctacttaacagattgatggagctggtgagcgaaagcgagaaaatgaggctgaagaagctggaggagctgagtaagtgcatagaaacgattcactaagatgatttgacaacccaatgctaataactgattaggtctgtgtgatgtatttaagtaattaagaagacttcagtttgtataggggattatctttggtttgttggattctatgatttttcttgtttgtttgattagctttgtccttggagaatttgctgatttaggaaagggaaatacctctcataaatacgtttgtcaccaaacatgtctcaactttgtattttcttcacattcttcttttccatttctttatgcattctcttgggttcta

SEQ ID NO: 2970 - DNA, 601 bp, Panax ginseng
tgcaggaattcgaattcggagagagaaaatgatgcaaactcatcaacaaacagtgatgcaatcggctcaaatttctgggagtttaagcttcaatggcagcctaaccaagaagaggaagagatgtcgaagtctgctctttctacgtttagggccaaagaggaagaaattgaaaagaagaagctggaggtgagagaaagagttcaggctcagctgggtcgcatagaagaagaaactaggcgtttggctaatattcgtgaggaactcgaagcactagctgatccaatgaagaaggaagttggagttgttcgtaagaagattgatgcggttaataaagagttaaagccgttgggacatacctgccagaagaaggagaaagagtacaaagatgctctggaggctttcaatgagaagaacaaggagaaagtacagttaattactaggttgatggagctggtgagcgagagtgagaaattgaggatgaagaagctggaggagctgagtaagagcatagaagtaaggcgctgaatcagaaatgctgatgactaattaattagggttggtgtggatgtatttattaagcagacgtgtcttttcttttcta

SEQ ID NO: 2971 - DNA, 1062 bp, Cirsium arvense
atcggtggtggggctacaaaggcttcataactttggcattaaggcctgccttctctcctccattcacaatcaccacttgaaaacagtatacagagagagagaagaaaaaaaagaaaaggaaacacacccgttaccaacaataaagcaaaagaaaagaaaatattggagagataaagataggaatcaaagcaaggaagagggtttttcgccttttctggtttgtgaagaaaaagagggaagaacaagaagaaggaaaaatgactactacacaaacacaggtacaaacacagaggcaatcaagtgaacagcttcaaacactgatgcaagctggtcaaatctcagggagcttaagcttcaatgggttgatgactaaagaagatgaagagatgtctaggtctgctctttctacttttaaggctaaagaagaagagattgagaagaagaagttggaagttagagaaagggttcaagctcagttgggtcgtattgaagaagaaactaagcgtttggctaatattcgcgaggaacttgaagcgctaacggatccaatgaaaaaagaagtttcagtcgttcgtaagaagattgattccgtcaacaaagagttgaagccacttggacagacctgtcagaaaaaggaaagggagtataaggaagcccttgatgcattcaatgaaaagaacaaagagaaagtacaactcattacaagattgatggagctggtgagcgaaagtgagaagatgaggatgaagaagctggaagagctgagcaaaagcgttgaaacgatacaataagtttgatgatatgatatgatgataacctgatgctgaatggcttaagctaattaggtctgtgtgatgttattaaaaaaagaagatcttttccccttctttttggctatgttcttatttacatatgggtttggttgaaatattttctatcgggtttttcgtttgtttttaagtttgattagtccgtcggtcgtcttaatggttgtttgtattttgctgatcttaggtttggaaatacctctgtaaaaacaggtctgtaactaaaaatacatgt

SEQ ID NO: 2972 - DNA, 897 bp, Flaveria ramosissima
ctctcacatacatacatacatacatcatctgtggggctacaaaggcttcataactttggcattaaggcctgctttctccttcataatcaccacttcaacacacagagcaaaaaagaggaaagtgtttcacacactaaacacacacacacacaataaagcaaaagaagaccaccattggagagatcaacagaggaatcgaagctcctacaagggttttcttctttttctggttcaagaaactgagaagacgacaacaacatcaacaacaacaggaagaagaagatatgacgacgactcaaacacaggtgcagacgcagaggcaatcgagtgaacagctgcagacgctgatgcaagcgggtcaaatctctgggagtttgagcttcaatgggttgattaccaaagaagatgaagagatgtcgaggtctgcgctttcgacttttaaggccaaagaggaagagattgagaggaagaagttggaggttaaagaaagggttcaagctcaattgggtcgaattgaagaggaaacgaggcgtttggcgacgattcgtgaggaactcgaggcattaaccgatccaatgaagaaggaagtttcacttgttcgtaaaaagattgattcggtcaacaaagagttgaagccactaggtcaaacatgtcagaagaaggaaagagaatacaaagaagctctagatgctttcaatgagaagaacaaagaaaaagtacagcttattacaagattgatggagctggtgagcgaaagtgagaagatgaggatgaagaagctggaggaactgagcaagagtgtggaaacggtacaataaatctgatgataacctgatgtgatggtggtgggttaagctaattaagttttagtgtgatgtatcaaaaagaagacctttt

SEQ ID NO: 2973 - DNA, 1025 bp, Flaveria ramosissima
cacacacaataaagcaaaagaagaccaccattggagagatcaacagaggaatcgaagctccaacaagggttttcttctttttctggtttaagaaactgagaagacgacaacaacatcaacaacaacaggaagaagaagaagatatgacgacgactcaaacacaggtgcagacgcagaggcaatcgagtgaacagcttcagacgctgatgcaagcgggtcaaatctctgggagtttgagcttcaatgggttgattaccaaagaagatgaagagatgtcgaggtctgcgctttcgacttttaaggccaaagaggaagagattgagaggaagaagttggaggttaaagaaagggttcaagctcaattgggtcgaattgaagaggaaacgaggcgtttggcgacgattcgtgaggaactcgaggcattaaccgatccaatgaagaaggaagtttcacttgttcgtaagaaaattgattcggtcaacaaagagttgaagccactaggtcaaacatgtcagaagaaggaaagagaatacaaagaagctctagatgctttcaatgagaagaacaaagaaaaagtacagcttattacaagattgatggagctggtgagcgaaagtgagaagatgaggatgaagaagctggaggaactgagcaagagcgttgaaacagtacaataaatctgatgataacctgatgatgatggtggtgggttaagctaattaagttttagtgtgatgtatcaaaaagaagaccttttcccttcttttactatgttcttatatatgggtcgtctctgtttggttgagatttctatgtcattttcgtttgtttcagtttgattagtcgttaatggtgtttgtctttgctgatcttaggttggaaatacctttgtaaaaacagcgtctgtaactaaagtcttgtcaaaaagctttctttatttcagtttcttttcctttacagtatcaagtcgcccgcgagcaagtttgttaacacaggctcgcgtggcgatttgttaattattcttt

SEQ ID NO: 2974 - DNA, 1207 bp, Flaveria ramosissima
agacaggggtagtcaacgacagagacatggaacgaacacacacacacacaacacacacacacacacactctctctctctctcacacacacacatacatcatctgtggggctacaaaggcttcataactttggcattaaggcctgctttctccttcattatcaccacttcaacacagagacaaaaaagaggaaagtgtttcacacactaaacacacacacacacactcacaataaagcaaaagaagaccaccattggagagatcaacagaggaaacgaagcaccaacaaggggtttcttctttttctggtttaagaaactgagaagacgacaacaacagcagcagccagaagaagatatgacgacgactcaaacacaggtgcagacgcagaggcaatcgagtgagcagcttcagacgctgatgcaagcgggccaaatctcggggagtttgagcttcaatggattgattacgaaggaagatgaagagatgtcgaggtctgcgctttcgacttttaaggcgaaagaggaagagattgagaggaagaagttggaggttaaggaaagggttcaagctcaaatgggtcgaattgaagaagaaacaaggcgtttggcgacgattcgtgaggaactcgaagcattaaccgatccaatgaagaaggaagtttcacttgttcgtaagaagatcgactcggtcaacaaagagttgaagccgctaggtcaaacatgtcagaagaaggaaagagaatacaaagaagctctagatgctttcaatgagaagaacaaagaaaaagtacagcttattacaagattgatggagctggtgagcgaaagtgagaagatgaggatgaagaagctggaggaactgagcaagagtgttgaaacgatacaataagtctgatgataacctgatgatgatggtggtggattaagctaattaagttttagtgtgatgtatcaaaagaagaccttttccttcttttactatgttcttatatatgggtcgtctctgtttggttgagatttctatgtcgttttcgtttgtttcagtttgattagtcgttaatggtgtttgtctttgctgatcttaggtttggaaatacctttgtaaaaactagcgtctgtaactaaagtcttgtcaaaaagctttctttatttcagtttctttcctttacagtatcaagtctcccgcgagcaagtttgttaacacag

SEQ ID NO: 2975 - DNA, 1065 bp, Flaveria ramosissima
ccactacacacacagagcaaaagaaggaagtagttctacacactaacacacacacacacaataaagcaaaagaagaccaccattggagagatcaacagaggaatcgaagctccaacaagggttttcttctttttctggtttaagaaactgagaagacgacagcaacatcaacaacaacaggaagaagaagaagatatgacgacgactcaaacacaggtgcagacgcagaggcaatcgagtgaacagcttcagacgctgatgcaagcgggtcaaatctctgggagtttgagcttcaatgggttgattaccaaagaagatgaagagatgtcgaggtctgcgctttcgacttttaaggctaaagaggaagagattgagaggaagaagttggaggttaaagaaagggttcaagctcaattgggtcgaattgaagaggaaacgaggcgtttggcgacgattcgtgaggaactcgaggcattaaccgatccaatgaagaaggaagtttcacttgttcgtaagaagattgattcggtcaacaaagagttgaagccactgggtcaaacatgtcagaagaaggaaagagaatacaaagaagctctagatgcttttaatgagaagaacaaagaaaaagtacagcttattacaagattgatggagctggtgagcgaaagtgagaagatgaggatgaagaagctggaggaactgagcaagagcgttgaaacggtacaataaatctgatgataacctgatgatgatggtggtgggttaagctaattaagttttagtgtgatgtatcaaaaagaagaccttttcccttcttttactatgttcttatatatgggtcatctctgtttggttgagatttctatgtcgttttcgtttgtttcagtttgattagtcgttaatggtgtttgtctttgctgatcttaggtttggaaatacctttagtaaaaacagcgtctgtaactaaagtcttgtacaaaaagtctttctttatttctagttttctttccttacagtatcaagtctcccgcgcgctaaggttgttaacacaggctcgctggctag

SEQ ID NO: 2976 - DNA, 767 bp, Lactuca sativa
gaaatcgaaaaattaaaggtgggaaaagcaaaacaagaaaaaattagagaaattaagagaggaatcagaggaagaaggagggatttttgctttttctggttgaagaacaagagcgagaaagagccagaaaaagaaatgtctactccaacacaaccacagcaagcaatctagcgagcagcttcaaacactgatgcaagctggtcaaatttcagggagtttgagtttcagtgggttaatgtcgaaagaagatgaagagatgtctaaatctgctctctcaacatttaaggcgaaagaggaagaaatagagaagaaaaagctcgaggttaaagaaagagttcaagctcagttgggtcgtattgaagaagaaaccaaacgtttggcttctattcaagaggaactcgaatcactaacagatccaatgaagaaagaggtttcagttgttcgtaagaagattgactcagtcaacaaagagttgaagccacttggacaaacctgccaaaagaaggagcgagagtacaaggaagcgttggatgctttcaatgaaaagaacaaggaaaaagtacaactaataacgcgattaatggagctggtgagcgaaagtgagaagacaaggatgaagaagttggatgaactgagcaagagcattgaaaccatacaataagttaagaatttaattaaaacaaaatgatggttgggttgattggtttgtttgtatgggtgtggtgttttggtttgaatagttgtattttgggtgatgtaggggttgt

SEQ ID NO: 2977 - DNA, 905 bp, Helianthus annuus
ataaatcacaaaaaacaccaccattggagagataatcaaaccaccatcttcctctagggttttcttctttttctggttcaagaaacccaaaaaaacccaacaacaaaacatgactactcaaacgacgtcgttacagacaacaacaacacagaggcaaccgagtgagcagcttcaaacgcttatgcaagccggtcaaatctccggcagcttgagcttcaacgggctgatgagtaaagaagatgaggagatgtctcggtctgcgttgtctactttcaaagcgaaagaggaggagattgagaagaagaaattggaggttagagaacgtgttcaggctcaattgggacgaattgaagaagaaaccaggcgtttggcgaccattcgtgaggaacttgaagcgttaaccgatccaatgaagaaagaagtttcagttgttcgtaagaagatcgattcggtcaacaaggagttgaagccattgggtcaaacatgtcagaagaaggaaagagagtacaaggaagcactagatgccttcaatgaaaagaacaaagagaaagtacaacttattaccagattgatggagctggtgagcgaaagtgagaagatgaggatgaagaagctggaggaactgagcaagagtgttgaaacaatacaatagatctgatgatgatggtgacggggttaagctaattaagttttagtgtgatgtattaaaaagaagatattttcccttcttttgctatgttcttatatatgggtcgggtcgtctctgtttggttgagatttctatgtcgttttccgtttgtttcagtttgatgattagttgttgttaatggtgcttgtattttgctgatcttaggtttggaaatacctttgtaaaacagtctgtaactaaaatcttgtcaaaaacc

SEQ ID NO: 2978 - DNA, 993 bp, Helianthus annuus
accatttctcaacagtctccccacggcaaaaaagaaaacaaaagcatttcacacacactaaaaacacacacacataaagcccaaaaaaaacaccaccattggagagataatcaaaccaccatcttcctctagggttttcttctttttctggttcaaaaaacccaaaaaaaccatgactactcaaacgacgtcgttacagacaacaaccacacagaggcaatcgagtgagcagcttcaaacgcttatgcaagccggtcaaatctccggcagcttgagcttcaacgggctgatgagtaaggaagatgaggagatgtctcggtctgcgttgtctactttcaaagcgaaagaggaggagattgagaagaagaaattggaggttagggaacgtgttcaggctcaattgggacggattgaagaagaaaccaggcgtttggcgaccattcgtgaggaacttgaagcgttaaccgatccaatgaagaaagaagtttcggttgttcgtaagaagatcgattcggtcaacaaggagttgaagccattgggtcaaacatgtcagaagaaggaaagagagtacaaggaagcactagatgccttcaatgaaaagaacaaagagaaagtacaacttattaccagattgatggagctggtgagcgaaagcgagaagatgaggatgaagaagctggaggaactgagcaagagcgtcgaaacaatacaatagatctgatgataatctgatgatgatggtgacggtgacggggttaagctaattaagttttagtgtgatgtattaaaaagaagatattttcccttcttttgctatgttcttatatatgggtcgggtcgtctctgtttggttgagagatttctatgtcgttttccgtttgtttcagtttgatgattagttgttaatggtgcttgtattttgctgatcttaggtttggaaatacctttgtaaaaacagtctgtaactaaaatcttgtcaaaaacctctttatt

SEQ ID NO: 2979 - DNA, 1170 bp, Centaurea maculosa
atataatcagtggtggggctcccaagctcttcataacttcaccattaagaccctcccccccttcccttctctcctccataacccaaatactctctccacttcaaaacccacacactattcacagagaagaaaaaaaaatcccaaaaaaaaaaggtgaaagaaaacacacccgttaccaaaccacataaagcaaaagaaagaaagaaagaaaaagaaaccaccattagagagataaagcgaggaatcagaccaagaacaagaagggtttttcacctttttttctggctaaagaaaaccagaaaaaatcaagaaaaaaaccaagaaaatcaagaaatgagtaccatacaaacaacacaggcagtacaaacacagaggcaatcaagtgaacagcttcagacactgatgcaagctggtcaaatctctggaagcttaagcttcaatgggttgatgactaaagaagatgaagagatgtcaaggtctgcactttcgacttttaaggctaaagaggaagagatcgagaagaagaagttggaggttagggaaagggttcaagctcagcttggtcggattgaagaagaaacaagacgtcttgctaatattcgtgaggaactcgaagcactaaccgatccaatgaagaaagaagtttccgtcgtccgtaagaagattgattccgtcaacaaagagttgaagccactcggacaaacttgtcagaaaaaggaaagggagtataaagaagcactagatgcattcaatgaaaagaacaaagagaaagtacaactcattacaagattgatggagctggtgagcgaaagcgagaagatgaggatgaagaagctggaagagctgagcaagagcgttgaaacgatacaataagttgtcagataacgatgatgtgatgctgatgggcttaagctaattaggtttgtgtgatgtgttaagaaaaaagaagatcttttccccttcttttgctatgtatttaagtgcttattatatatggggtttggttgaaagaatttctattcgggtttttcttcatttgttgtttcttcggtaagtttgattagttaaaaatggtgtttgtattttgctgatctaggtttgggaaatttacctctgtaaaaacaggtctgtaactaaaatcatgtcaaaaaacctctttgtttccatttc

SEQ ID NO: 2980 - DNA, 1101 bp, Carthamus tinctorius
acacatctatacatataatcagtggtggggctaacaagccttcataacttcaccattaagacctcctcccccttctctcctcctccataacccaaaaatcaccacttcaaaaccaccactattcacatagagaaaagaaaatcccctcccccctaaaaaaaaaggtgaaaacacacccgttaccaaaaccataaagcaaaagaaagagaagagaaaaagaaaccaccattagagagataaagcgaggaatcagagcaagaacaagggtttttcaccttttctggctaaagaagaacagaaaacaagaagaagaaaaacaaaaacaaaaacaagaagaagaagaaggaggaggagaaatgagtaccatacaaacaacacaggtggtacaaacacagaggcaatcaagcgagcagcttcagacgctgatgcaagctggtcaaatctcagggagcttaagcttcaatggattgatgaccaaagaagacgaagagatgtcaaggtctgcactttcgactttcaaggccaaagaggaagagatcgagaagaagaaattggaggttagggaaagggttcaagcccagctgggtcggattgaagaggaaacaagacgattggctaacattcgtgaggaactcgaagcgctaaccgatccaatgaagaaagaagtttcagtcgtccgtaagaagatcgattccgtcaacaaagagttgaagccacttggacaaacttgtcagaaaaaggaaagggagtataaagaagccctagatgcattcaatgaaaagaacaaagagaaagtacaactcattacaagattgatggagctggtgagtgaaagcgagaagatgaggatgaagaagctggaagagctgagcaagagcgttgaaacgatacaataagttggataacgatgatgctgatgggcttaagctaattaggtttgtgtgatgttaaaaaaaaagaagatcttttccccttcttttgctatgtttttaagtgcttattatatatgggtttggttgaaagaatttctattcggtttttcgtttgttgtttcggtaagtttgattagttaaatggtgtttgtattttgctgatctaggt

SEQ ID NO: 2981 - DNA, 891 bp, Centaurea maculosa
  misc_feature (129)..(129): n is a, c, g, or t
gacctcttctcctttccctttctttttgtatttgtgggggcacaactcaccacctcttaactttaagcatcaaaacctgcccttcttaacctcttaactcttaacccttcagaggagcaaaaaaaaganagaaaaaaatacagattcttttgggggaaatcaagaaaccagtaaaaattagagaaattaagcgagggattagaggaagaaggagggttttctgctttttctggttgaagaaaaagagcgataaagaaccagaaaaagtagcaatggcttcccagaatcctcagaagcaaacgtctgaacagcttcagacgctgatgcaggctggtcagatttcagggagtttaagcttcagtggcttaatgtctaaagaagatgaagagatgtctaaatctgcactttctacttttaaggcgaaagaagaagagatcgagaagaggaaattggaggttaaagaaagagttcaagctcagttgggtcgtattgaagaagaaaccagacgtttggcttctattcaagaggaactcgaagctttaacggatccgatgaagaaagaagtttcggttgttcgtaagaagatcgattccgtcaacaaagagttgaagcctctgggacagagctgccagaagaaggaaagagagtataaggaagcgctggatgctttcaacgaaaagaacaaggaaaaagtgcaactaattacaagattgatggagttgctcggtgagagcgagaagacgaggatgaagaagctggatgagctgagtaagagcatcgaaaccgtacaataagttaataataaaatgcaaaaggaaaaaaaaaactaaaactaatggtgatggtggtgatgttaatttggtaactaggttttgtgtgatgtggttgtta

SEQ ID NO: 2982 - DNA, 782 bp, Arnica chamissonis
ttctatctgatcgattaattggatggcacacatttaccaacaaataaagcaaaagaagagcgccattggagagataaagaaccgaatcgaacgaccaagaagagtttttaccttttctggttgaagaaattgaaaaaacagcaacaaatgacgactactcaaacgcaggttcaaacgcagaggcaatcaagtgagcagcttcaaacactgatgcaagctggtcaaatctcagggagtttgagcttcaatgggttgatgaacaaggaagacgaggagatgtcgaggtctgcgctttctacttttaaggcgaaagaggaggaaattgagaagaagaaattggaggttagggaaagggttcaagctcaattgggtcgaattgaagaagaaaccaagcgtttggctacgattcgtgaggaactcgaagcattaactgatccaatgaagaaagaagttacagttgttcgtaagaagatcgattcggtcaacaaagagttgaagccgctaggtcaaacatgtcagaagaaggaaagagagtacaaggaagccctagatgctttcaatgaaaagaacaaagaaaaagtacaacttataactaggctgatggagctggtgagcgaaagtgagaagatgaggatgaagaaactggaagaactgagcaagagcgttgaaacaatacaataagtctgatgatgacgacgatgatgatgatgggtttaagctaattaagttttagtgtgatgtatgaaaaagaatgacattttcccttcttttactatgttctt

SEQ ID NO: 2983 - DNA, 742 bp, Antirrhinum majus
  misc_feature (691)..(691): n is a, c, g, or t
cggcacgagcggcacgagcggcacgagggaaatagagactcaccatcatttcattccacaaaagcacaagcagaaaaaagaaaaagcaaaaaaagaaaaaaagcaaaaaaggagaaacaacgaacagaacagcaaaaaatatctcattcgttcgtacaaaaaaattcagctagggttttcgattttttgaagcagctatgagtcaaaaaacactcgagaatcagctctctctcactcaatcggagcaaatctcggggagtttgagcttcaacggcgctatggcgaaagaagacgaagagatgtccaaatctgcgctctcgacttttagggctaaagaggaggagatcgagaagaagaaattggaggttaaggagagagttcaagctcagttaggtcgaattgaggaggagactaggcgattggctactattcgtgaggaattagacggcctagcggatccaatgaagaaggaagtctccgttgttcgtaagaaaatcgatgcaattaacaaggatttaaaaccactggggcagacttgccagaagaaggaaaaagagtacaaagaagctcttgatgctttcaacgagaagaacagggaaaaagtacaactcatttctaggttgatggagctggtgggcgaaagtgaaaagttgaggatgaagaaattggaggagctgagcaagaacattgnaacgatacacatagcctaaaaggttgacgtctgattaggatcgtgtgatgt

SEQ ID NO: 2984 - DNA, 963 bp, Lippia dulcis
ctttaaacaaagaaagagagggcagggcaccctgttctgttcataaggcacctgtaaacgggaatcaaagagataaaatcttctctctcactcatcattccaaagcaaaagcaaaagtctgaattaaaagggcgcaacaaagcaggccgcaagagataataaaggggagaaattaagagagaagaaggttttcttgtgcgagaagagcaatgatgcagacgcagaggacccttgaaaaccagcaatctatgcagtcgggccagatttctgggagcctgagcttcaacggtactctcaccaaggaagatgaagagatgtccaaatccgctctctccactttcagggccaaggaagaggaaatcgagaagaagaagatggaagttaaggagaaagttcaagctcagctcggcagaattgaagaagaaaccaagcgtttggccgtcatccgtgaggaattagatgccctctcagatccaatgaagaaggaagtctcctttgttcgcaagaaaattgattctgtgaacaaagaattaaagccattggggcagacttgccagaagaaggaaagggaatacaaagaagctctagaagcattcaacgataagaacaaagagaaagtacaactaatcactaaattgatggagttggtgagtgaaagcgagcggatgaggctgaagaagctggaggagctgagcaagaacatagaaacgatacgcatcgcctaatgctaatgctggttgacctctctcatctctgatttggatcttgtgtgatgtatttaagataaaagtcatttcctatttaatattatttggtgtttcttgggtttggttgtattttaaagttttttaaaatctgtttgttgagttagctgttgatggaaggttgttctaattttaggaagggtaactccttaaaacaggtttgtaactaaaacaggtctgaaaaaccatgtattcttct

SEQ ID NO: 2985 - DNA, 956 bp, Lippia dulcis
ctttaaacaaagaaagagagggcagggcaccctgttctgttcataaggcacctgtaaacgggaatcaaagagataaaatcttctctctcactcatcattccaaagcaaaagcaaaagtctgaattaaaagggcgcaacaaagcaggccgcaagagataataaaggggagaaattaagagagaagaaggttttcttgtgcgagaagagcaatgatgcagacgcagaggacccttgaaaaccagcaatctatgcagtcgggccagatttctgggagcctgagcttcaacggtactctcaccaaggaagatgaagagatgtccaaatccgctctctccactttcagggccaaggaagaggaaatcgagaagaagaagatggaagttaaggagaaagttcaagctcagctcggcagaattgaagaagaaaccaagcgtttggccgtcatccgtgaggaattagatgccctctcagatccaatgaagaaggaagtctcctttgttcgcaagaaaattgattctgtgaacaaagaattaaagccattggggcagacttgccagaagaaggaaagggaatacaaagaagctctagaagcattcaacgataagaacaaagagaaagtacaactaatcactaaattgatggagttggtgagtgaaagcgagcggatgaggctgaagaagctggaggagctgagcaagaacatagaaacgatacgcatcgcctaatgctaatgctggttgacctctctcatctctgatttggatcttgtgtgatgtatttaagataaaagtcatttcctatttaatattattttggtgtttcttgggtttggttgtattttaaagttttttaaaatctgtttgttgagttagctgttgatggaaggttgttctaattttaggaagggtaactccttaaaacaggtttgtaactaaaacaggtctgaaaaaccatgt

SEQ ID NO: 2986 - DNA, 850 bp, Scabiosa columbaria
aagaagagagagatttttcaatttttgtgtttgtaatccttcgaaaaagaaagagagatatatattgaaatgatgcagacagagaagcaggcatgtgaacaacagcagcaaacactgatgcaagccgctcagatttctggaagcttaagcttcaatggaaacctaaccaaagaagaagaagagatgtctaaatctgctctttcgacttttagagctaaggaggaagagatcgagaagaagaaacttgaagtcaaagagcgcgttctcgctcagcttggtcgtattgaagatgaaaccaaacgattggctggtattcgtgaggaacttgaagcacttgcggatccgatgaaaaaggaagttgcacttgttcgcaagaagattgattctgtcaacaaggaattgaagccactcggtcaaacctgccaaaagaaggagaaagagtacaaagatgcccttgaagcgttcaacgaaaagaacaaggagaaagtgcagctcatcaatcgattaatggagctggtgagcgaaagtgagaagttgaggatgaagaagctggaggagctgagtaagagcgtcgaacttatgcgctgaaagactcgttttaacacaaagaatcatgttgatgactgaaactaggtttgtggtgatgtatttattcaagattacttgttgctatcttctatatatgggtgtttttcgggcttggttgtattttatggtttttgtggtttgtttatctaattagctgttgattaagaatttgctaatgatttaggttgggaattaatactttgtaaacaggtttgtaactaaaaacatgttagaattcggttttctttcttatttatgttcg

SEQ ID NO: 2987 - DNA, 912 bp, Sarracenia psittacina
agaggaattcaaagaagaaggtttctacagagagaagaagagagagagagaggggaggagagataaaatgatgcaaacacagagacagggaggcgagcaggaacaacaggcactgacgcaatttgggcaaatttcaggaaacctaagcttcaacggaaccctaacgaaagaagaagaagagatgtcaaaatcagttctctccacttttcgggcgaaagaagaagagatcgagaagaagaaacttgaggtcaaagaaagagttcaggctcagttgggtcgcatcgaagaagaaaccaaacgtttatctaatattcgcgaggagcttgaggcactagctgatccaatgaagaaagaagtctcacttgttcgtaagaagatcgatgccgtcaacaaggagttaaagcctctaggccatacttgccagaagaaggagagagagtacaaagaagctcttgaggctttcaccgagaagaacaaggagaaagtacagctaattactagattgatggagctggtgagcgaaagcgagagattgaggatgaagaaactggaagagctgagtaagagcgtagagacgatacgctaagatcgacaaagctgatgccgataacactggttaggtttgtctggttgtatttaagaaagaagactttctctgttttttttttacatatatgggtgttcttgggtttgtttgtcttttatggttttcattgcttgttttaattaatagattatttggttggagcatttgctgatttaggaaaagaggaaataccctacaaaaacaagtttgtaaccaaacaggtctcaacttttggattttcttctcattttttctcacttttacattcaactcagattattccccttgggtttggtgaaataaatagatgatggtgtcctttcaga

SEQ ID NO: 2988 - DNA, 1000 bp, Helianthus annuus
ccatttctcacagtctccccacggcaaaaaagaaacaaaagcatttcacacacactaaaaacacacacataaagcacaaaaaacaccaccattggagagataatcagaccaccgtcttcatctaacgttttcttctttttctggttcaagaaacccaaaaaaacccaacaacaaaacatgactactcaaacgacgtcgttacagacaacaacaacaactcagaggcaatcgagtgagcagcttcaaacgcttatgcaagcgggtcaaatctccggcagcttgagcttcaacgggctgatgagtaaagaagatgaggagatgtctcggtctgcgttgtctactttcaaagcgaaagaggaggagattgagaagaagaaattggaggttagggaacgtgttcaggctcaattgggacgaattgaagaagaaaccaggcgtttggcgaccattcgtgaggaacttgaagcgttaaccgatccaatgaagaaagaagtttcggttgttcgtaagaagatcgattcggtcaacaaggagttgaagccattgggtcaaacatgtcagaagaaggaaagagagtacaaggaagcactagatgccttcaatgaaaagaacaaagagaaagtacaacttattaccagattgatggagctggtgagcgaaagcgagaagatgaggatgaagaagctggaggaactgagcaagagcgtcgaaacaatacaatagatctgatgataatctgatgatgatggtgacggtgacggggttaagctaattaagttttagtgtgatgtattaaaaagaagatattttcccttcttttgctatgttcttcttatatatgggtcgggtcgtctctgtttggttgagagatttctatgtcgttttccgtttgtttcagtttgatgattagttgttgttaatggtgcttgtattttgctgatcttaggtttggaaatacctttgtaaaaacagtctgtaactaaaatcttgtcaaaaacct

SEQ ID NO: 2989 - DNA, 915 bp, Helianthus annuus
ccccaccattggagagataatcagaccaccgtcttcatctaacgttttcttctttttctggttcaagaaacccaaaaaaacccaacaacaaaacatgactactcaaacgacgtcgttacagacaacaacaacaactcagaggcaatcgagtgagcagcttcaaacgcttatgcaagccggtcaaatctccggcagcttgagcttcaacgggctgatgagtaaagaagatgaggagatgtctcggtctgcgttgtctactttcaaagcgaaagaggaggagattgagaagaagaaattggaggttagggaacgtgttcaggctcaattgggacggattgaagaagaaaccaggcgtttggcgaccattcgtgaggaacttgaagcgttaaccgatccaatgaagaaagaagtttcggttgttcgtaagaagatcgattcggtcaacaaggagttgaagccattgggtcaaacttgtcagaagaaggaaagagagtacaaggaagcactagatgccttcaatgaaaagaacaaagagaaagtacaacttattaccagattgatggagctggtgagcgaaagcgagaagatgaggatgaagaagctggaggaactgagcaagagcgtcgaaacaatacaatagatctgatgataatctgatgatgatggtgacggtgacggggttaagctaattaagttttagtgtgatgtattaaaaagaagatattttcccttcttttgctatgttcttatatatgggtcgggtcgggtcgtctctgtttggttgagagatttctatgtcgttttccgtttgtttcagtttgatgattagttgttgttaatggtgcttgtattttgctgatcttaggtttggaaatacctttgtaaaaacagtctgtaactaaaatcttgtcaaaa

SEQ ID NO: 2990 - DNA, 977 bp, Helianthus annuus
catataaacaaacaggctagcaacatttttgctttccttttggttttgtggggcaaccaagcttgcaactttaagcatcaaattctgccgtaaccattcgacccaggtgagaacaaaccaaaacaagaaaaaattagagaaattaagagacgacggaggagggttttttgctttttctggttgaagaagaggagcgtaaaagaaccagaaaaacaacaaatggcgactctaaatcagcctcacgagcagcttcaaacactgatgcaagctagtcaaatgtcagggagtttcagtttcagcgggttgatgtctaaagaagatgaagagatgtctcaatctgctctttctactttcaaggccaaagaagaagagatcgagaagaagaaattggaggttaaagaacgggttcaagctcagttgggtcggattgaagaagaaaccagacgtttagcttccattcaagaggaactggacgctcttacagatccaatgaagaaagaagtaacacttgttcgtaagaagattgatacggtcaacaaagagttgaagccactcggacacacctgccagaaaaaggagagggagtataaggaagcgctggatgcttttaatgaaaagaacaaggaaaaagtacaactaattacaagattaatggagctggtgagcgaaagcgagaaggagaggatgaagaagctggaggagctgagcaagagcatcgaaaccatacaataagttaatgatggggtttgttaatctggtaattaggtttgtatgatgaaggtttggttgggatttgtgtgggtgtttagtttaatctggttaaaacaggtttgtttttggtttctttatcctaattattattcttttttcttcatgtatcaagtaaagtagtagttatcttttacactgtgaatggaaaaataacatcatgtgtgggtttgagaattattggtcgattgaaccgttgtttttatttg

SEQ ID NO: 2991 - DNA, 988 bp, Helianthus annuus
aacaggctagcaacatttgtgctttctttttggttttgtggggcaaccaagcttgcaactttaagcatcaaattctgccgtaaccattcgacccaggtgagaacaaaccaaaacaagaaaaaattagagaaattaagagaggaaggaggagggttttttgctttttctggttgaagaagaggagcgtaaaagaaccagaaaaacaacaaatggcgactctaaatcagcctcacgagcagcttcaaacactgatgcaagctagtcaaatgtcagggagtttcagtttcagcgggttgatgtctaaagaagatgaagagatgtctcaatctgctctttctactttcaaggccaaagaagaagagatcgagaagaagaaattggaggttaaagaacgggttcaagctcagttgggtcggattgaagaagaaaccagacgtttagcttccattcaagaggaactggacgctcttacagatccaatgaagaaagaagtaacacttgttcgtaagaagattgatacggtcaacaaagagttgaagccactcggacacacctgccagaaaaaggagagggagtataaggaagcgctggatgcttttaatgaaaagaacaaggaaaaagtacaactaattacaagattaatggagctggtgagcgaaagcgagaaggagaggatgaagaagctggaggagctgagcaagagcatcgaaaccatacaataagttaatgatggggtttgttaatctggtaattaggtttgtatgatgaaggtttggttgggatttgtgtgggtgtttagtttaatctggttaaaacaggtttgtttttggtttctttatcctaattattattcttttttcttcatgtatcaagtaaagtagtagttatcttttacactgtgaatggaaaaataacatcatgtgtgggtttgagaattattggtcgattgaaccgttgtttttatttgggctaaatagcacttttcgtc

SEQ ID NO: 2992 - DNA, 732 bp, Lippia dulcis
ggtgaagagcaatgatgcaggggacgcttgagaaccagcaatctatgcagtcgggccagatttctgggagccttagcttcaacggcactctcactaaggaagacgaggagatgtccaaatccgctctctccactttcagggctaaggaggaggaaattgagaagaagaagatggaagttaaggagaaagttcaagctcagctcggcagaattgaagaagaaaccaagcgtttggccgtcatccgtgaggaattagatgccctctcagatccaatgaagaaggaagtttcgggtgttcgcaagaaaatcgactccattaacaaagaattaaagccactggggcagacatgccagaagaaggagagggagtacaaagaagctctagaagcattcaatgataagaacaaagagaaagtgcagctaatcactaaattgatggagctggtgagtgaaagcgagcgtatgaggctgaagaagctggaggagctgagcaagaacatagaaacaatacacatcgcctaatgcagtttgacctctctcatctctgatttggatcttgtgtgatatattttagataaaaggtctttcctatttaatatatcttggtgtttattgggtttggttgtattctaaaggtatttttaatcttgtttgttgatggaaggtgttctaattttagtaagggtaattccttaaacaggtttgtaactaaaacatgtctgaaaaactatgt

SEQ ID NO: 2993 - DNA, 984 bp, Cichorium intybus
cgggggatataaggcttgcaattttctgctttctttttctttctctttcgtttgtggggcaactaagctcttaactttaagcatatcaagcctgcttttcttaaaccatcggaggaaaaaggaggataaacaccaagtaatcgaaaaaatagagtgggaaaagcgaaaagaagaaaaaattagagaaattaagagaggaatcagaggaagaaggagggttttttgctttttctggttgaagaagaagagcgagaaagaaccagaaaaagaaatggccactcaaactcaacctcagaagcaatctagcgaacagcttcaaacactgatgcaagctggtcaaatttcgggaagtttgagtttcagtgggttaatgtcgaaagaagatgaagaaatgtctaaatctgctctttctacttttaaggcgaaagaggaagagattgagaagaagaaattggaggttaaagaaagagttcaagctcagttgggtcgtattgaagaagaaacgaaacgtttggcttctatacaagaggaactcgagtcattaacagatccaatgaagaaagaagtctcggttgttcgtaagaagattgattcagtcaacaaagagttaaagccactcggacagacttgccaaaagaaggagcgagagtataaagaagccctggatgctttcaacgaaaagaacaaggaaaaagtacaactaattacgcgattaatggagctggtgagcgaaagtgagaagacaaggatgaaaaagctggatgaactgagcaagagcattgaaaccgtacaataaataattataaattaaaaaagaaaatgttggtttttattttattgtatgggtgtggtgttttggtttgaatagttgtgtattttgggtgatgtagggtttgtaaaaacaggtttgttttgtttttttgcttttttgtttttttggattcattcttattctcgtatcaagtaaagtaagtaatcttttta

SEQ ID NO: 2994 - DNA, 1023 bp, Tragopogon dubius
atacaggctagcacgatttcttctttcttttcctttcactttcgtttgtggggcaactaagctcacaactttaagcatcaaggcctgcttttctcaaaaccatcggtggaaaaaaaggaggagaataaacaagaaatcgaaaaaatagagggggaaaaagcaaaagaagaaaaaattagagaaattaagagaggaatcagaggaagaaggagggttttttgctttttctggttgaagaagaagagcgagaaagaaccagaaaaagaaatggctactcaacctcaagcacagaagcagtctagtgagcagcttcaaacactgatgcaagctggtcaaatttcagggagtttgagtttcagtgggttaatgtcgaaagaagatgaagaaatgtctaaatctgctctctcgacttttaaggcgaaagaggaagagatagagaagaagaaaatggaggttaaagaaagagttcaagctcagttgggtcgtattgaagaagaaaccaaacgtttggcttctattcaagaggaactcgaagcactaacggatccaatgaagaaagaagtttcggttgttcggaagaagattgattcggtcaacaaagagttgaagccacttggacagacttgccagaagaaggagcgagagtataaggaagctttggatgctttcaacgataagaacaaggaaaaagtacaactaattactagattgatggagctagtgagtgaaagtgagaagacaaggatgaagaagctggatgagctgagcaagagcattgaaaccatacaataagttataataaaaagaaagtgatggttggtttttatgggtgtgttttggttttaaatagttgtaattttggtgatgtagggtttgttttgggtttttatcttaattctttcatcttagtaagtaatctttatgttgtctaaacggtgaagggtgtaatttaaaggtgtgattgtataaattggtaaatttttagtaacagattaagggcgtgaaactttgttttgtgattaa

SEQ ID NO: 2995 - DNA, 816 bp, Helianthus annuus
ccaccattggagagataatcaaaccaccatcttcctctagggttttcttcttcttcttccggttcaaaaaacccaaaaaaacccaacaacaaatcatgactactcaaacgacgtcgttacagacaacaacaacaaccacacagaggcaatcgagtgagcagcttcaaacgcttatgcaagccggtcaaatctccggcagcttgagcttcaacgggctgatgagtaaagaagatgaggagatgtctcggtctgcgttgtctactttcaaagcgaaagaggaggagattgagaagaagaaattggaggttagggaacgtgttcaggctcaattgggacggattgaagaagaaaccaggcgtttggcgaccattcgtgaggaacttgaagcgttaaccgatccaatgaagaaagaagtttcggttgttcgtaagaagatcgattcggtcaacaaggagttgaagccattgggtcaaacatgtcagaagaaggaaagagagtacaaggaagcactagatgccttcaatgaaaagaacaaagagaaagtacaacttattaccagattgatggagctggtgagcgaaagtgagaagatgaggatgaagaagctggaggaactgagcaagagcgtcgaaacaatacaatagatctgatgataatctgatgatgatggtgacggtgacggggttaagctaattaagttttagtgtgatgtattaaaaagaagatattttcccttcttttgctatgttcttatatatgggtcgggtcgtctctgtttggttgagagatttctatgtcgttttccgtttgtttcag

SEQ ID NO: 2996 - DNA, 890 bp, Helianthus annuus
caccattggagagataatcagaccaccgtcttcatctaacattttcttctttttctggttcaagaaacccaaaaaaacccaacaacaaaccatgactactcaaacgacgtcgttacagacaacaacaacaacaactcagaggcaatcgagtgagcagcttcaaacgcttatgcaagccggtcaaatctccggcagcttgagcttcaacgggctgatgagtaaagaagatgaggagatgtctcggtctgcgttgtctactttcaaagcgaaagaggaggagattgagaagaagaaattggaggttagggaacgtgttcaagctcaattgggacgaattgaagaagaaaccaggcgtttggcgaacattcgtgaggaacttgaagcgttaaccgatccaatgaagaaagaagtttcggttgttcgtaagaagatcgattcggtcaacaaggagttgaagccattgggtcaaacatgtcagaagaaggaaagagagtacaaggaagcactagatgccttcaatgaaaagaacaaagagaaagtacaacttattaccagattgatggagctggtgagcgaaagcgagaagatgaggatgaagaagctggaggaactgagcaagagcgttgaaacaatacaatagatctgatgatgatggtgacggtgacggggttaagctaattaagttttagtgtgatgtattaaaaagaagatattttcccttcttttgctatgttcttatatatgggtcgggtcgggtcgtctctgtttggttgagagatttctatgtcgttttccgtttgtttcagtttgatgattagttgttgttaatggtgcttgtattttgctgatcttaggtttggaaatacctttgtaaaaacagtctgtaacta

SEQ ID NO: 2997 - DNA, 919 bp, Helianthus annuus
gcacacacacataaagcccaaaaaacaccaccattggagagataatcaaaccaccgtcttcctctagggttttcttcttcttctggttcaaaaaacccaaaaaaacccaacaacaaaacatgactactcaaacgacgtcgttacagacaacaacaaccacacagaggcaatcgagtgagcagcttcaaacgcttatgcaagcgggtcaaatctccggcagcttgagcttcaacgggctgatgagtaaagaagatgaggagatgtctcggtctgcgttgtctactttcaaagcgaaagaggaggagattgagaagaagaaattggaagttagggaacgtgttcaggctcaattgggacgaattgaagaagaaaccaggcgtttggcgaccattcgtgaggaacttgaagcgttaaccgatccaatgaagaaagaagtttcagttgttcgtaagaagatcgattcggtcaacaaggagttgaagccattgggtcaaacatgtcagaagaaggaaagagagtacaaggaagcactagatgccttcaatgaaaagaacaaagagaaagtacaacctattaccagattgatggagctggtgagcgaaagcgagaagatgaggatgaagaagctggaggaactgagcaagagcgttgaaacaatacaatagatctgatgatgatggtgacggggttaagctaattaagttttagtgtgatgtattaaaaagaagatattttcccttcttttgctatgttcttatatatgggtcgggtcatctctgtttggttgagagatttctatgtcgttttccgtttgtttcagtttgatgattagtggtgcttgtattttgctgatcttaggtttggaaatacctttgtaaaaatagtctgtaactaaaatcttgtcaaaaacctctttatt

SEQ ID NO: 2998 - DNA, 1177 bp, Mimulus guttatus
tgataagtttaaagagagagagagagagagagagagagagagagcagcagcgcagcctcgttcacaagcacctgcaaacagcctctctctctctctcatcatcaccaccatttccaaaagcaaaagcaaaagcgaaaggagaaacaaagaaagaaagaaaccccccaaagagagttagagagagaaagagggaaagtctgagcatagagagagagagagagaaagaagaaaacaagagagaagaagaaagaagaagggggtttgaagaatggcaatgatgcagacgcagaaaacactggaaaaccagcagtcgctgatgcaagtcggtcagatttcgggcagcttgagtttcaacgggaccttgtccaaggaagacgaggagatgtccaaatctgcgctctcaacttttagggcaaaggaagaggagattgagaagaagaagatggaagttaaggagaaagttcaagctcagctcggccgtattgaggaagaaaccaagcgcttggccaccattcgcgaggaattggaaggattgtccgatccgatgaggaaggaagtctcggttgttcgtaagaagatcgattcggttaacaaggagttaaaaccacttggcctcacttgccagaagaaggagaaagaatacaaagatgctcttgaagctttcaatgacaagaacaaagaaaaagtacaactcatcactagattgatggagctggtgagcgaaagcgagaggttgaggatgaagaaactggaggagctgagcaagaacatagaaacgatacgcatgccataagttcttcgatttggaatcgtgtgatgtatttaagaaacaaaaaaaacgggcgtttctatttatatataatgggtgttttctttctttttttttttttttttcgggtttggttgtatttttcagtttgttgaattagcagttgatggaaggcttttctaattgtaggaagattaattatctctttaaaaacaggtttgtaactaaaacaggttctcaaagtatgtattcttccaagttattattattattattatttttatttaatttgttttttgtatgttagtgtttaccctttgtggaatttatttgtaagtaattgctttggattctgagagacaaaaactttttcattttaattgggaatccaaagctgtatgttcttgt

SEQ ID NO: 2999 - DNA, 850 bp, Utricularia gibba
tgggggacccatcggggaggaaaaacggggttctgctgtggagcaacgatgcagggtcagaagacgacagagagccagcaatcgctggtgcaatctggtcagctttcggggagtttgagtttcaatggggctgtcttgaaggaggatgaggaaatgtcgaaatctgcgcttttgacttttagggctaaggaagaggagatcgagaagaggaagctggaagttaaggagaaagttgtggctcagcttggccgaattgaagaggaaaccaagcgcctggctaccattcgcgaggagttggatgcattggcggatcccatgaagaaagaagtctctctggtccgaaagaagatcgatgcggtgaacaaggagttaaaaccgctgggacagacctgtcagaagaaggagaaggaatacaaagaagcccttgaagccttcaacgagaagaacaaagagaaggtgcaactaattaccagattgatggagttggtgggtgagagtgagcgcatgaggttgaagaaacttgaagaactgagcaagaatatagaaacaatgcgggtgaactaattacctagcgcgcttgacttgtgattagttatgaatcatccttgatatatgtattggtgtttctcagtttgcttgtatctttgggtctgtctgtgttcatccatggtgatgatctaggatctgtcacaagggttcttttatttgattttaggaatgggcattgtgtctgcccactcaagcaagcaggtttgtaactaaaactcgtgtcagtcagtgtctcttacaatggtttgtttctctctgatttgtgggttagttctgtaccattaaaggctgtccctcccaa

SEQ ID NO: 3000 - DNA, 719 bp, Panax ginseng
cccgggaaattcggccattacggccgggggaattgaagaagaaagattagggtttctgagagagaaatgacgcaaaatcagctacagacgttgatgcaatcgggtcaaatttcggggagtctaagcttcaatggaagcctctcacaagaagaggaagagatgtcaaagtcagctctctctacgtttagggctaaggaggaagagattgaaaagaagaagctggaggtgagagaaagagtccaggctcagatgggtcgcattgaagaagagactaaacgtttggctagtattcgtgaggaactagaagcacttgctgatccaatgaagaaggaaataggagttgttcgtaaaaagatcgatgtggttaataaagagttgaagccattgggacagacctgccagaagaaggagaaagaatacaaagatgctcttgatgctttcaatgagaagaacaaggagaaagtacagttaattactaggttgatggaggtaagcaatctggtaagtgaaagtgagagcttgaggatgaagaagctggatgagctgagtaagagcatagaaaccacgcattgagtaattgagtaaatgtatcgctgatgactaatcaagggttgtgtgaatgtatttcgctgaagacttttttcttttttcatttcggtttgattgtgtgtgattgagatatgccacagtaaagctgtaactcaagttcaagaactgca

SEQ ID NO: 3001 - DNA, 854 bp, Orobanche aegyptiaca
aacccaaaccccctctttcctgtcatcatcattttgaaaaaagcaaaagctaaagcaaagagaaaaaaaggaaaagaaaagcccaacggaaaaaagaaacagcactagagaaaataaagagaagaaatcagggaagaagaagaaagggtttgttttgtttttcgtagaggggaaaatgatgcagactcagaggacgctcgaaagccagcaatctgtggtgcaaccgggtcagatttcagggagcttgagcttcaacgggaaagaagacgaggagatgtcgaaatctgctctgtctacatttagggctaaggaagaggagattgagaagaagaagatggaggttaaggagaaagtacaagttcagctaggtcgaattgaagaagaaactaagcggttgtccagcattcgtgaggaattagaggcactctcagatccgatgaagaaagaagtctcagttgttcgtaagaaaatcgattccattaacaaggagttaaagccgcttgggcaaacttgtcagaagaaggaacgagagtacaaagaagcacttgaagctttcaatgaaaagaacaaagagaaagtacaattgatcacgagattgatggagttggtgagtgaaagtgagaggttgaggctgaagaaattggaggaactgagcaagaacatagagacgatacgcatggcttaataacgtcgtttgtgacatattctgatttcgttcgtgtaatgtatttaaggaaaaaagggtttctatttatatatttttggtgttcttttttatttcttttcagatttggttgtatttgatggttttattatgtttgctgatgaattagatgttgatgggaaggatttct

SEQ ID NO: 3002 - DNA, 967 bp, Triphysaria pusilla
ttatttcgtttctaattctaattcctagtccctagtacttcgtcttcccttctaagtttctaaccctagtaaattaaaagagcaacacaacacaaccactctctttctttccctatcatcatcatttcaaaagctaaagctaaagcaaagcaagccgaataaaagaaaaggagaaaaaaaagagctacagagagataataataacaaagagaagaaatcgaggaagaagtgatgcagacacagaagacattagaaaaccaacaatctctgatgcaagctggtcagatttctgggggcttgagtttcaacgggacgatgacgaaggaggacgaggagatgtcgaaatctgcgctgtcgacttttagggcgaaggaggaggaaattgagaagaagaagatggaggttaaggagaaggttcaaattcagctgggacgaattgaagaagaaactaagcgtttggccgttattcgtgaggaattagaggcgctggccgacccaatgaagaaagaggtatctgttgttcgtaagaaaatcgattcagttaacaaggagttaaagccgctcggtcagacttgccagaagaaggagagggagtacaaagaagctcttgaagctttcaatgaaaagtacaattgatcactagattgatggttggtgagtgaaagcgagaggatgaggctgaaaaaattggaggagctgagcaagaacatagagtcgatacgcatggcttaattgtcgttggcatattctggtttcgattgtgtgatgtatttaagaaaaaaggcatttctatttatatagtttggtgttttttttttaatgtttgggtttggttgtatttgatggtgatcatgtttgttgctgaattagctgttgattgaaggctttctaattttagggaaggtgaatctatcaccttgaaaacaggtttgtaactaaaacaggtctcaaactgttgtatttttct

SEQ ID NO: 3003 - DNA, 662 bp, Flaveria ramosissima
tagagaaatcaagagaggaatcagaggaaggaggagggttttctgctttttctggttgaagaaaaagagcgacaaagaagcagaaaaagcgatggctactcaaaatcaaacccatgagcagcttcagacactgatgcaagctggcgaggtttcagggaccttgagcttcagtggcttaatctccaaagaagacgaagatatgtctaaatccgctctttccgctttcaaggccaaagaagaagagatcgagaagaagaaattggaggttaaagaaagggttcaagctcacctgggtcgtattgaacaagaaaccagacgtttagctacgattcaagaggaactggaagcgcttacagatccaatgaagaaagaggtaacccttgttcgtaagaagattgattctgtcaacaaagagttgaagcccctcggacacaactgccagaagaaggagagagagtataaggaagcactggatgcttttaatgaaaagaacaaggaaaaagtacaactaattacaagattaagggagctggtgagcgaaagcgagaaggagaggatgaagaagctggatgagctgagcaagagcattgaaaccatacaataagttgacaataataataaatcaaacactgatggtgtgatcatgggattcaatctggtaa

SEQ ID NO: 3004 - DNA, 1055 bp, Centaurea maculosa
  misc_feature (104)..(104): n is a, c, g, or t
  misc_feature (815)..(816): n is a, c, g, or t
  misc_feature (824)..(824): n is a, c, g, or t
cggggagactcttcctttcctttccacatctcacctcttaactttaagcatcaaaacctcccttcttaactcttaactcttacctcttatccttcgaggagcanaaaaacaccacccaagaagttagaaaaaaaaatacagatttttgggggaaagcaaaaaaccagtaaaaattagagaaattaagagagggattagaggaagaaggagggttttttgctttttctggttgaagaaaaagagcgataaagaaccagaaaaagcaatggcttcttctcagaatcctcagaagcaaacgtctgaacagcttcagacgctgatgcagtctggtggtcagatttcagggagcttaagcttcagtggcttaatgtctaaagaagatgaagagatgtctaaatctgcactttctacttttaaggcgaaagaagaggagatcgagaagaagaaattggaggttaaagaacgagttcaagctcagttgggtcgaattgaagaagaaaccagacgtttggcttctattcaagaggaactcgaaactttaacggatccgatgaagaaagaagtttcggttgttcgtaagaagattgattccgtcaacaaagagttgaagccactgggacagagctgccagaagaaggaaagagagtataaggaagcgctggatgctttcaacgaaaagaacaaggaaaaagtgcaactaattacaagattgatggagttgctcggtgagagcgagaagacaaggatgaagaagctggacgagctgagtaagagcatcgaaaccgtacaataagttaataataaaacgaaaaggnnaaaaaaanaactaaaactaatggtgatagtgatggtggtgatgttaatttggtaactaggttttgtgtgatgtggttgttatatatgggtctgatctgagatccttttggttttcttggtttggttggaatttgtatttttgttttgggtttgaatagtttagttgtattttggtggtgatgtatgtaggatgtaaaaacaggtttggtttcgatattatcctaattattattctttcg

SEQ ID NO: 3005 - DNA, 830 bp, Guizotia abyssinica
actccaaaacacggcaaaaaagaggaaagcaaaacacacagttaccaacaataaagcaaaagcccaccaccattggagagataaagagcaaaatcgaacaaccaagaagggttttctactttttcaagctgagaaaaccacaacaacaaatgactactactcagacacaggtgccgatacagaagcaatcaagtgagcagcttcagacgctcatgcaagccggtcaaatctccggcagtctcagcttcaacggcctcatgaccaaggaagacgaggagatgtccaggtcggcgttgtccacgttcaaggctaaagaggaggagattgagaagaagaaattggaggtcagggagagggttcaggctcaattaggtcgaattgaagaggaaaccaggcgtttggctacgattcgtgaggaacttgaagcattaactgatccaatgaagaaagaggtttcggttgttcgtaagaagatcgattcggttaacaaagagttgaagccactaggtcaaacatgtcagaagaaggaaagagagtacaaggaagccctagatgctttcaatgaaaagaacaaagaaaaagtacaacttattaccagattgatggagctggtaagcgaaagtgagaagatgaagatgaagaagctcgaggaactcagcaagagcgtttgaacgattcaataagtgatgataatctgatgatgatgatgatgatgatggggttaagctaattaagttttagtgtgatgtatcaaaagaagacattttccttctttactatgttctatatatgggtcgtctctgttgggtgagattctaagttgtttcagt

SEQ ID NO: 3006 - DNA, 1135 bp, Flaveria ramosissima
gggctagcaaaagtttctcccatgctttccttttggtttgtggggcaaccaacctcgtagctttaagcatcaacgcctgcctgcctgcctgctgccttccttacttgctagatagatattattattattaatccatcggaagaacccacccataatccgaaagaaaaacctgagggcaaaccaaaattagaaaaaaattagagaaattaagagaggaatcagaggaaggaggagggttttctgctttttctggttgaagaaaaagagcgacaaagaaccagaaaaagccatggctactccaaatcaaacccacgagcagcttcaaacactcatgcaagctggtgaagtttcagggagcttgagtttcagtggcttaatctccaaagaggatgaagatatgtccaaatctgctctttctgctttcaaggccaaagaagaagagatcgagaagcagaaattggaggttaaagaaagggttcaagctcagttgggtcgtgttgaacaagaaaccagacgtttagctacgattcaagaggaactggaagcgcttacggatccaatgaagaaagaagtaacccttgtcgtaagaagattgattccgtcaacaaggagttgaagcccctcggacacaactgccagaagaaggagagagagtataaggaagcactggatgctttcaatgaaaagaacaaggaaaaagttcaactaattacaagattaatggagctggtgagcgagagcgagaaggagaggatgaagaagctggatgagctgagcaagagcattgaaaccatacaataagttgacataataataaatcaaacagtgatggtgtgatcatgggattcaatctggtaattaggtttgtgtggctgttggtttggatgggatttgtgtggctgtttaatctggtaattaggtgtaatcctgtaaaacaggttgttttggttttttttttctattctttatttattattctttctttttgttatttaagttaaattaatttcgtagattttactactgtggtatggtaaaactaacatgatgcgtgggtgtgacaatctattaattgtaactgttggttttattttctttcgtatttggttgtacctaagtcgattaatttatttaa

SEQ ID NO: 3007 - DNA, 762 bp, Vinca minor
accacctcagagggcagcaatctgagcagcttttaaacgctgatgcaatcgggtcaggtttcgggtagtttgagctttaatgggtctatgacgaaagaggatgaagagatgtctaggtctgctctctcttctttcaaggctaaggaagaagagattgagaagaagaaattggaggtgaaagagagagttcaagctcagttgggtcggattgaggaagaaactaagcgtttggctactattcgtgaggaactagaatcactagcagatccaatgaagaaggaagtttctttcatccggaagaaggttgatgcagtcaacaaagaattaaaaccactgggacaaacctgccagaagaaggagagggagtacaaagaagcacttgaaactttcaatgaaaagaacaaagaaaaagtacagctaataacaagattgatggagttggtgagtgaaagtgaacgaatgaggatgaagaagttggaagaattgagcaagagcatagaaacgatacgctaagataactcactgtcagtaactaatctaggttgtgtgatgtatttaatataaagtcatttctatttatgtatgggtgttttatgtttggcttgtaattttgcgcttttttcgtctgtttaattaattagtcttttctggaccattttctaatgttagtacagggagatactctatacccagtaaacaggtttgtaactaaaaatgtaaaacaggtctcactgtggattcctcttaatttgtaccttcatt

SEQ ID NO: 3008 - DNA, 916 bp, Cirsium arvense
gtatatttgtgggggcaacaactcacaccacctcttaaacttttaagcatcaaaacctcccttcttaagtcttaagtcttaactcttatcccttcagaggagcacaaaacaccaccaagaagttagaaaaaatacagatttttgggggaaagcaaaaaaccagtaaaaattagagaaattaagagagggattagaggaagaaggagggttttttgctttttctggttgaagaaaaagagtgataaagaaccagaaaaagcaatggcttcttctcagaatcctcagaagcaaacgtctgaacagcttcagacgctgatgcagggtggtggtcagatttcagggagcttaagcttcagtggcttaatgtctaaagaagatgaagagatgtctaaatctgcactttctacctttaaggcgaaagaggaagagatcgagaagaagaaattggaggttaaagaacgagttcaagctcagttgggtcgaattgaagaagaaaccagacgtttggcttctattcaagaggaactcgaaactttaacggatccgatgaagaaagaagtttcggttgttcgtaagaagattgattcggtcaacaaagagttgaagcctctgggacagagctgccagaagaaggaaagagagtataaggaagcgctggatgctttcaacgaaaagaacaaggaaaaagtgcaactaattacaagattgatggagttgctcggtgagagcgagaagacgaggatgaagaagctggacgagctgagtaagagcatcgaaaccgtacaataagttaataataaaacgaaaaggaaaaaaaaactaaaactaatggtgatggtggtgatgttaatttggtaactaggttttgtgtgatgtggttgttatatatgggtctgatctgagatccttttggttt

SEQ ID NO: 3009 - DNA, 1313 bp, Solanum phureja
aaaaatctcatcttgatctgtctactcggagatcagcaattttacttctgtttgtaagcttatctctgttgctgtgggaagaaaaccaagtgttttctgagttagtagtctgcgaggatgatgaatagcgaacgattagcaaatattgctttggcaggtttgagtttggccccactggttgtgaatgtggacccaaatttaaatgtcgtgctaacggcttgtctcactgtttttgtgggctgctaccgttctgttaagccaactccaccttcggagacaatgtctaaggaacatgcaatgagattccccttagttggaagtgcaatgctcttgtcgttgttcttgctttttaagttcctctcaaaagacctggttaatgctgtattgacgtgctacttctttgtacttggcattgctgctttttctgcaacactgttaccttctatcaaacgattcttgccggaaaagtggaatgaagatctcgtaatatggcacttcccatatttccgctctttggagtttgagttcacaaggtcccagattgttgctgcaattcctggaactatgttctgtgtatggtatgctaaacagaagcattggctggctaacaatgtattgggccttgcattttctattcaggggattgaaatgctttcacttggatcatttaagactggtgccatactattggctggactttttgtctatgacatcttctgggtcttttttacccccgtgatggttagtgttgctaagtcttttgatgctcctatcaagcttttgttccccacttcggatttgaaacgtcccttttcaatgttgggtctcggagatattgtaattcctggcatttttgtggctttggcactccgctttgatgtctccagagggaaggggcctcagtactttaaaagtgcattttcgggatatgcagttggtgtgatttcaaccattattgtgatgaactggtttcaagctgcacagcccgcgttgttgtatattgttccagctgtaattggatttttggccgtgcactgcatttggaatggggatgtgaagccgttgttggagttcgatgaatcgaaaacacagagcactgaagaagtcgccgcggaagagagcaagaaagtagagtgagggtttaagaagagtcacagtaggatatatgaccttccaactgcagatattgttggttaggaaaaaaactttttttgttttgtacttttagattattgttagtgaaatattgatgagattggcttcatatgttatttacccaaaaaattaacatttcaattgtcaatcttgatatt

SEQ ID NO: 3010 - DNA, 1146 bp, Solanum tuberosum
ggcaattttacttctgtttgtaagcttatctctgttgctgtgggaagaaaaccaagtgttttctgagtagtagtctgcgaggatgatgaatagcgaacgattagcaaatattgctttggcaggtttgagtttggccccactggttgtgaatgtggacccaaatttaaatgtcgtgctaacggcttgtctcactgtttttgtgggctgctaccgttctgttaagccaactccaccttcggagacaatgtctaaggaacatgcaatgagattccccttagttggaagtgcaatgctcttgtcgttgttcttgctttttaagttcctctcaaaagacctggttaatgctgtattgacgtgctacttttttgtacttggcattgctgctttttctgcaacactgttaccttctatcaaacgattcttgccggaaaagtggaatgaagatctcataatatggcacttcccatatttccgctctttggagtttgagttcacaaggtcccagattgttgctgcaattcctggaactatgttctgtgtatggtatgctaaacagaagcattggctggctaacaatgtattgggccttgcattttctattcaggggattgaaatgctttcacttggatcatttaagactggtgccatactattggctggactttttgtatatgacatcttctgggtcttttttaccccagtgatggttagtgttgctaagtcttttgatgctcctatcaagcttttgttccccacttcggatttgaaacgtcccttttcaatgttgggtctcggagatattgtaattcctggcatttttgtggctttggcactccgcttgatgtctccagagggaaggggcctcaatactttaaaagtgcattttcgggatatgcagttggtgtgatttcaaccattattgtgatgaactggtttcaagctgcacagcccgcgttgttgtatattgttccagctgtaattggatttttggccgtgcactgcatttggaatggggatgtgaagccgttgttggagttcgatgaatcgaaaacacagagcactgaaagaagtcggcgcggaagagaagcagaaaagtagagtgaggctttaagaaaaagtgttaccagtaggatatgtgaccttcca

SEQ ID NO: 3011 - DNA, 1297 bp, Capsicum annuum
agcttacctctgtttccgtgggacgaaaactgagtgtttctgagttggtagactgtgaggatgaagaatagcgaaagaatagcaaatgttgctttagcaggtttgagtttggccccactggttgtgaaagtggacccaaatataaatgttgtgcttacagcttgcctcactgtttttgtgggttgctgccgttctgttaagccaactccaccttcggagacaatgtcgaatgaacatgcaatgagattccccttagttggaagtgcaatgctcttgtcgttgttcttgctttttaagttcctctcaaaggacctggttaatgctgtattgacgtgctactttttcgtacttggcattgctgctttttctgcaacactgttaccttctatcaaaagattcttgccgaaaaagtggaatgaagatctcataatatggcacttcccatatttccgctctctggaggttgagtttacaaggtcccacatcgttgctgcaattcctggaactatcttctgtgcatggtatgctaaaaagaagcattggctagctaacaatgtattgggccttgcattctctattcagggaattgaaatgctttcacttggatcatttaagactggtgccatactattggctggactttttgtgtatgacattttctgggtcttttttactccagtgatggttagtgttgccaagtcttttgatgctcctatcaagcttttgttccccacagcggatttgaaacgtcccttttcgatgctgggtctcggggatattgtaattcctggcatttttgtggcattggcactccgctttgatgtctccagaggaaaggagcctcaatactttaaaagtgcatttttgggatatgcagttggtgtggtttcaaccattgttgttatgaactggtttcaagctgctcagcccgcattgttatatattgttccagctgtagttggatttttggccgtgcactgcatttggaatggtgatgtgaagccgttgttggagttcgatgagtcaaaaacgcagagcactgaagaagtcgcagcgaaagagagcaagaaagtagaatgaggctttaagaagatttacagtaggatatatgaccttccaactgcagatattgttggttaagaaaaggctcttttgtttgtactttttagattattgttagtgaaacattgatgagattggtttcatatgttatttacccaaatcaacatttcaattgtcaatcttaatatttttttttttaatctactccatgagatttgaaatggttaaaaaaaaa

SEQ ID NO: 3012 - DNA, 1340 bp, Capsicum annuum
aatttacttctaaagcttacctctgtttccgtgggacgaaaactgagtgtagcttacctctgtttccgtgggacgaaaactgagtgtttctgagttggtagactgtgaggatgaagaatagcgaaagaatagcaaatgttgctttagcaggtttgagtttggccccactggttgtgaaagtggacccaaatataaatgttgtgcttacagcttgcctcactgtttttgtgggttgctgccgttctgttaagccaactccaccttcggagacaatgtcgaatgaacatgcaatgagattccccttagttggaagtgcaatgctcttgtcgttgttcttgctttttaagttcctctcaaaggacctggttaatgctgtattgacgtgctactttttcgtacttggcattgctgctttttctgcaacactgttaccttctatcaaaagattcttgccgaaaaagtggaatgaagatctcataatatggcacttcccatatttccgctctctggaggttgagtttacaaggtcccacatcgttgctgcaattcctggaactatcttctgtgcatggtatgctaaaaagaagcattggctagctaacaatgtattgggccttgcattctctattcagggaattgaaatgctttcacttggatcatttaagactggtgccatactattggctggactttttgtgtatgacattttctgggtcttttttactccagtgatggttagtgttgccaagtcttttgatgctcctatcaagcttttgttccccacagcggatttgaaacgtcccttttcgatgctgggtctcggggatattgtaattcctggcatttttgtggcattggcactccgctttgatgtctccagaggaaaggagcctcaatactttaaaagtgcatttttgggatatgcagttggtgtggtttcaaccattgttgttatgaactggtttcaagctgctcagcccgcattgttatatattgttccagctgtagttggatttttggccgtgcactgcatttggaatggtgatgtgaagccgttgttggagttcgatgagtcaaaaacgcagagcactgaagaagtcgcagcgaaagagagcaagaaagtagaatgaggctttaagaagatttacagtaggatatatgaccttccaactgcagatattgttggttaagaaaaggctcttttgtttgtactttttagattattgttagtgaaacattgatgagattggtttcatatgttatttacccaaatcaacatttcaattgtcaatcttaatatttttttttttaaaaaaagactcgaaagggggaaaaaaaaa

SEQ ID NO: 3013 - DNA, 1418 bp, Solanum phureja
acagaaaagaaaaataaaaaccaataaaatgtttacatagcaaaattcccaaatccaaaaatctcgccgatctgtgtgctttgaagatcagcagagaaacgcacatcaaatttttttgttttcttgtaaggttcctcttgttggggagtctgaactggagtgaagttctgcattttaatacctttgaggatgaagaatatggagcgtatcgcgaatgttgctttgttaggtttgagtctggcaccactggtggtgaatgtggatccaaatgtaaatgtcattgtaacagcctgccttactgtctttgtgggttgctgccgttctgttaagcctactccaccttcggaaacaatgtctaatgaacatgcaatgaggtttcccttggttggaagtgcaatgctcttgtcattgttcttgctttttaaattcctgtcaaaagacctggttaatgctgtgttgacgtgctacttcttcgtacttggcattgctgcactttcggcaacattgttacctgctattaagcgttttttgccaaataagtggaatgatgatctcataatatggcacttcccatatttccgctctttggagattgagttcacaaggtctcagattgttgctgcaattcctggaaccattttctgtgtatggtatgctaaacagaagcattggctagctaacaacgttttgggccttgccttttgcattcagggtattgaaatgctttcacttggatcatttaagactggtgccatactattggcaggactttttgtgtatgacatcttctgggtcttttttaccccagtgatggtcagtgtagccaaatcttttgatgctcctatcaagcttttgtttcccacagcggatgctaaacgccccttctcaatgctgggtcttggagatatagttatcccaggcatttttgttgcattggcactccgttttgatgtttccagggggaaggagccccaatactttaagagtgcatttttaggatacacatttggtttggcacttacaatatttgttatgaactggttccaagctgcacagcctgctctgctatatattgttccagctgtaattggattcttggcggtacattgcatatggaacggggatgtgaagcctttgttggagtttgatgaaggaaagacgaaagacgcggaagaagctgaagccaaagaaagcaagaaggtagaatgagtcttaagtagacagactgacattaaagagacaatgaccctcaaattaggctatgtattgccgtggattaatagtcacacaaggtagcagagattgttggttaagcaacaaagtttgttgtattagatttttgagactgaccatcaatactactggccttttatgttatacgttaaaattgatattactaaatgtcaattttttctctt

SEQ ID NO: 3014 - DNA, 1448 bp, Solanum lycopersicum
agcacacaaaagaaaaacaaaaacgaaaaaaatgtttacatagcaaaattcccaaatccaaaaatctcgccgatccgtgtgctttgaagatcagcagagaaacgcacatcaaattcttttgtattcttgtaaggttcctcttgttgggggagtctgacctggagtgaagctctgcattttaatacctttgaggatgaagaatatggagcgtatcgcgaatgttgctttgttaggtttgagtctggcaccactggtggtgaatgtggatccaaatgtaaatgtcattgtaacagcctgccttactgtctttgtgggttgctgccgttctgttaagcctactccaccttcggaaacaatgtctaatgaacatgcaatgaggtttcccttggttggaagtgcaatgctcttgtcattgttcttgctttttaaattcctgtcaaaagacctggttaatgctgttttgacgtgctacttcttcgtacttggcattgctgcactttcggcaacattgttaccttctattaagcggtttttgccaaagaagtggaatgatgatctcattatatggcacttcccatatttccgctctttggagtttgagttcacaaggtctcagattgtttctgcaattcctggaaccattttctgtgtatggtatgctaaacaaaagcattggctagctaacaacgttttgggccttgccttttgcattcagggtattgaaatgctttcacttggatcatttaagactggtgccatactattgacaggactttttgtgtatgacatcttctgggtcttttttacccccgtgatggtcagtgtagccaaatcttttgatgctcctatcaagcttttgtttcccacagcggatgctaaacgccccttctcaatgctgggtcttggagatatagttataccaggcatttttgtcgcattggctctccgttttgatgtctccagggggaaggaaccccaatacttcaagagtgcatttttaggatacacatttggtttggcactcacaatatttgttatgaactggttccaagctgcacagcctgctttgctatatattgttccagctgtaattggattcttggcggtacattgcatatggaacggggatgtgaagcctttgttggagtttgacgaaggaaagacaaaggtcgcggaagaagctgaagccaaagaaagcaagaaggtagaatgagtgtttaagtagacaaactgacattaaagagacaatgaccctccaattaggctctatgtatcgccgtggatgaatagttacacaaggcagcagagactgttggttaagcaacaaagtttgttgtattagatttttgagactgaccatcaatactactggccttttatgttataccttaaaattgatattattaaatgtcaattttttctctttcatttcaagtcaaaaatataac

SEQ ID NO: 3015 - DNA, 1399 bp, Solanum lycopersicum
tgtttacatagcaaaattcccaaatccaaaaatctcgccgatccgtgtgctttgaagatcagcagagaaacgcacatcaaattcttttgtattcttgtaaggttcctcttgttgggggagtctgacctggagtgaaactctgcattttaatacctttgaggatgaagaatatggagcgtatcgcgaatgttgctttgttaggtttgagtctggcaccactggtggtgaatgtggatccaaatgtaaatgtcattgtaacagcctgccttactgtctttgtgggttgctgccgttctgttaagcctactccaccttcggaaacaatgtctaatgaacatgcaatgaggtttcccttggttggaagtgcaatgctcttgtcattgttcttgctttttaaattcctgtcaaaagacctggttaatgctgttttgacgtgctacttcttcgtacttggcgttgctgcactttcggcaacattgttaccttctattaagcggtttttgccaaagaagtggaatgatgatctcattatatggcacttcccatatttccgctctttggagtttgagttcacaaggtctcagattgtttctgcaattcctggaaccattttctgtgtatggtatgctaaacaaaagcattggctagctaacaacgttttgggccttgccttttgcattcagggtattgaaatgctttcacttggatcatttaagactggtgccatactattgacaggactttttgtgtatgacatcttctgggtcttttttacccccgtgatggtcagtgtagccaaatcttttgatgctcctatcaagcttttgtttcccacagcggatgctaaacgccccttctcaatgctgggtcttggagatatagttataccaggcatttttgtcgcattggctctccgttttgatgtctccagggggaaggaaccccaatacttcaagagtgcatttttaggatacacatttggtttggcactcacaatatttgttatgaactggttccaagctgcacagcctgctttgctatatattgttccagctgtaattggattcttggcggtacattgcatatggaacggggatgtgaagcctttgttggagtttgacgaaggaaagacaaaggtcgcggaagaagctgaagccaaagaaagcaagaaggtagaatgagtgtttaagtagacaaactgacattaaagagacaatgaccctccaattaggctctatgtatcgccgtggatgaatagtttcacaaggcagcagagactgttggttaagcaacaaagtttgttgtataagatttttgagactgaccatcaatactactggccttttatgttataccttaaaattgatattattaaatgtcaattttttctctttcattt

SEQ ID NO: 3016 - DNA, 1357 bp, Capsicum annuum
tgcgtgcttggagaaagacagagggggagggaagcgtacatcagtttttgttttccttgtaaggttcctcttgctgggggagtctgaaaccggagtggacttctgaattttagaacctttgagaatgaagaatatggaaagtctcgcaaatgttgctttattaggtttgagtatggcaccactagtggtgaatgtggatccaaatgtaaatgttatagtaacagcctgccttactgtctttgtgggttgctgccgttctgtcaagcctactccaccttcggaaacaatgtctaatgaacacgcaatgaggttccccttggttggaagtgcaatgctcttgtcattgttcttgctttttaaattcctgtcaaaagacctggttaatgctgtattgacgtgctacttcttcgtacttggcattgctgcactttcggcgacattgttaccttctattaaacgtttcttgccaaaaaagtggaatgacaatctcataatttggcacttcccatatttccgctctttggagattgagttcacaaggtctcagattattgctgcaattcccggaaccattttctgtgtgtggtatgctagacagaagcattggctagctaacaacgttttgggccttgccttttgcattcagggtattgagatgctttcacttggatcatttaagactggtgccatcttattgggaggactttttgtgtatgacatcttctgggtcttctttacaccagtgatggtcagtgtagccaaatcttttgatgctcctatcaagcttttgttccccacagcggatgctaaacgccccttctcaatgctgggtcttggagatatagttatcccaggaatttttgttgcattggccctccgttttgatgtctccagggggaaggagccccaatacttcaagagtgcatttttaggatacacatttggtttggcactcacaatatttgttatgaactggttccaagctgcacagcctgctttgctatatattgttccagctgttattggtttcttgtcagtacattgcatatggaacggggatgtgaagcctttgttggagtttgatgaaggaaagactaaaggcgctgaagaagcagaagccaaagaaagcaagaaggtagaatgaggccaagtagacagactgacattaaagagacgatgacctttcaattaggttatgtatcaccgtggattaatagtcacccgaggcaacagagattgttggttaagcaacaaagttggttgtattagaattttgagactgaccatcaatagtactggccttttatgttacaccttaaattgatattattaaatgtcaatttttactttcattttc

SEQ ID NO: 3017 - DNA, 1397 bp, Prunus persica
ctctgcaattgaatcaaaatctctctctccctatttctccgatctgtacggaaggaaaccgttgaaaatcatctgcgtcgcggcccactgggttttgttgcgaaggtggccgaattcagtttgatttgatcggaattttattcgaagcggtttcttttttcgagtgatataataacgatgaagaacgttgagcgtgttgccaatgtcgctttagcaggtttaacgttagcaccacttgttgtgaacgtagatccaaacctaaatgtaatcttaactgcatgtctcacagtttttgtgggttgctaccggtctgtgaagccaactccaccttcagagacgatgtctaatgaacatgccatgcgtttcccatttgtgggcagtgcaatgctgttatcactatttttactttttaagttcttatccaaagacttggttaatgctgtattgacgtgctatttctttgtgcttgggatcatcgctctctcggcaacactgttacctgctattgcacgttatttgccgcagagttggaataaggaccctatcatatggcattttccatatttccggtctttggagattgagttcacaagatctcagattgttgctgcaatccctggaacttttttctgtgcatggtatgcatcaaagaagcattggctggctaacaacatattggggcttgccttttgtatccagggaattgaaatgctttctcttgggtcttttaagactggtgctatccttttggctggactttttgtgtatgatattttctgggttttcttcactccagttatggtcagcgttgcaaaatcttttgatgctcctataaagctgttgttccccacagcagatgctacacgtccattttctatgcttggacttggtgatattgtaatccctggtatttttgttgctctggctttgcggtttgatgtatctagggggaaacagggccagtactttaagagtgcatttttgggatacacagttggtttggtcctgacaattgttgtaatgaactggtttcaggcagcacagcctgcactgttgtatattgtaccaactgttattgggtttctggctgctcactgcatatggaatggtgatgtcaaaccactattggaatttgacgagtcaaagactgtggaaacatctgaagaaggtagtgagactaaatctaacaagaaggtggagtaagttgaaattaggagaagccgccacagacaccagtgctttccaactcaaaaaagaaacactgtttttctcttggaggcaccaaacaccgttgtatcagatttttttgaatcgaggaagaaataatattttcagttccttataagatacaacaatacaaccatgttaggttaatacagaaattttttgctattttc

SEQ ID NO: 3018 - DNA, 1699 bp, Cicer arietinum
aagcaaaaacggttcactcttctcatctcattggcagtgacacaccaaaaaactcttctttccttcttaattatctaaattgatgattaataatagttaactaaacggtttgagtttacctctctcttttgacttttgactctctcggtaaaactctaaaccctaataaaatcatttttcccaaatcaatttctctttctttctttctttcttcgatctgctgcaattcagggattctcttctactcaatcggtcccgcaatttttctcttccgattgcagtggaggctattctcgcaacgtttgacttcagtagatccataatttttaaaacggattagaaagaatgaagaacacggagcgaattgcgaatttggctttggcaggtttatctttagcaccgcttgttgtgaaagtagatccaaatttaaatgttgttttgactgcttgcatcactgtatttgtgggatgttaccgatccgtcaaaccaaccccaccaactgagacaatgtccaatgaacatgctatgcgttttccctttgttgggagtgcaatgctattatcccttttcttactctttaagtttctatctaaggacttggtgaacactgtgttgacaggctacttctttgtacttgggattgttgcactttcggcaacattattgccatctattaagcgctttctaccgaagcattggaatgacgacctcatagtctggcgttttccatatttccgctcttttgaggttgagtttacaaggtcacagatcgttgctgcagtccccggcaccttttttgtgcctggtatgctttgcagaagcattggctggcaaataatatattgggtcttgctttctgtattcagggaattgaaatgctttctcttggctcattcaagactggtgcgattctcttggctggtctatttgtatatgacattttctgggttttcttcactcctgtgatggtcagcgttgcaaaatcatttgatgctccaattaagcttctgttccctacagcagattctgcaaggccattttcaatgcttggacttggtgatattgttatccctggtatttttgtggcattggctttgcggtttgatgtatctagaggaaaacagccccagtacttcaaaagcgcatttttaggatacacctttggcttggttcttacaattgtcgtgatgaactggtttcaggctgcacagcctgctcttttgtatattgtaccttctgtaatcggatttttggctgcccattgcatttggaatggtgatgtcaagcagttgttggagttcgatgagtcaaagactgccgattcatctcaagaagagagtgatgccaaatctagcaaaaaggttgaataagttgaagcatgcccaataccaatgcttatgattcacagaagaaatactgttatttccagggaacgcggtaacttaagctaacttattcagcagcagcacacctttgtaacagattgtgattaaaaagtaaatgttagtcttatttcttaaattggcattttgcttttactccttaactccccaatctgggtttccatagcaaagtttccaatggttttctccctctccctcctttctctcatagcacacaataggcgctcgcacacatgcaattttgttttcagtgcatataaatggttaaaatttatacaaatagtcatgattgctga

SEQ ID NO: 3019 - DNA, 1471 bp, Amsonia hubrichtii
tggcctggatcgatctcttcttcctcctcctgtttgcccctgtttgttgttgggttctctctcaaggttcctgtgcttggttttgggattcgttggtttatcttctacttttgtgtctcaagggagagaggagaagaagcacaggcagttgttgaggctttattctgtttttttttgtgtgtagaatttcaataaagcaacaatgaagaatagtgagcgtctagcgaatattgctttagcaggcttgactttggcaccacttgttgtgaaggtagatccaaatttgaatgtcattttaacagcttgccttacagtttatgttggttgctaccgctctgtcaagcctactccaccatctgagacaatgtccaacgaacatgccatgcgatttcctttagtagggagtgcaatgctcttgtcgctgttcttgctttttaagtttctatcaaaagacttggttaatgctgtgttgacttgctacttttttgtacttgggatcgttgctctttcagcgacattattacctgcaataaagcgctttctaccaaaccattggaatgaggatgtaattgtttggcgttttccattcatccgctctttggaggttgagtttacgaggtcccaagtttttgctgcaattcctgggaccttcttctgtgcttggtatgcttcaaagaagcattggctgtctaacaacatattggggcttgcattctgcattcagggggtcgaaatgctttcgcttggctcattcaagactggtgcaattcttttggctggactttttgtgtacgatatcttctgggtattttttacccctgtaatggttagtgtggctaagtcttttgatgcccctattaagcttttattcccaacttctgactctgcacgtccattttcaatgctgggacttggggatatagtaattcctggcatttttgttgcattggcattgcgatttgatgtgtccagaggaaagggcagccaatacttcaagagtgcttttctaggatacgctgttggtttgatcttaacaatcattgtcatgaactggtttcaagctgcacagcctgcactcctatatattgttccatcagtaattggatttttggctgtacatgtcatatggaatggggacatcaaaccattgttggagtttgacgagtcaaaatcttctgattctgaagatggcgatgaaaaatcaagcaagaaagtagagtaggtgataatctagtgaagaaaaagctaattcttgatgaggaaccacaacgaggagactgctgattcttggaatcgggttttaactttgctacagaaattgttgtaacagattttgcgacaggttaataaaactagcctgctcttaggcaatattatagaaattgcagaaagattctcggggccttttaggaaaacctgtatcaaacttgagtacgaggaagaaaatatagaattttgatttgacctaaac

SEQ ID NO: 3020 - DNA, 2362 bp, Theobroma cacao
ccactacgcaaaacccaagcatctccctccacgtgtaaagccagtttactcaaaataccccttctgcaaaattttccaaacacatctcctttcctattggcagtcacaatattcaaaatgacagcaccctcaactacaaatcaacaacagtgttaatacaaaattaacaccagctttgacctttagtaaatcctatctctgacagaaaaaaaaaaatcaatttctataaaatctcctgtcaatcgagaaaaaaagaaatctttttcctttcccccccccgcgccccccctctctctctctctctcttttcttagctctcatatccggcatctccgatctgtaaaactccatcgaccgtttgagagagaaagagagaaaatacgattaaaggttccaatccctaattttactgggaattcaattacatttaattttgattttgtttctttatttatttaataattcattgaattgtttcgatctattttaatatgtagtttctttttgtggctaaaaggacgctgttgtattagaataagcgacggcgacgacgatgaaaaacactgaaagactcgccaatttggctttagcagggttgacattggcaccacttgctgtgaaggtagaccccaacttaaatgttatcttgactgcatgcctcacagtatatgttggctgctatcgatctgtcaagccaactccaccatcggagacaatgtctaatgagcatgctatgcgttttccctttgttgggagtgcgatgctgttatcacttttcttactgttcaagttcttatcaaaagacttggttaatgcagtattgacatgttatttctttgtgcttggaatcatcgctctttcggcaacaatattacctgccataaaacgcttcttgccaaagcattggaatgaggaccttatcatttggcgttttccatactttcgctctttggagatcgacttcacaagatctcagattgtagctgcaatccctggaacttttttctgtgcatggtatgcttcacagaagcattggttggctaataacattctgggccttgcattctgcattcagggaattgagatgctttctcttgggtctttcaagactggtgccattctcttggctgggctttttgtatatgatattttctgggttttcttcactcctgtaatggttagtgttgcgaagtctttcgatgctcctataaagcttttgttcccaacagcagactctgcacgaccattttccatgcttggacttggtgacattgtgattcctggtatttttgtagcactagcactaagatttgatgtatctagggggaaagagagtcagtattttaagagtgcatttttgggatacacagtgggattggtcctcacgattgttgtcatgaactggtttcaagctgcacagcctgcacttttgtatattgtaccagctgtcattggattcttggctgctcactgtatatggaatggagaagtaacaccgttattggagtttgacgagtcgaagactggtgtttcatctcaggaaggtagcgatgacaaatctagcaaggtggaatgagttaaaatgcaccccacccagacacacaaactgttttggcttgagacggaaatagtgtttcttttaaggtccaatctttggctaacttgttctactactgcaaaaccattgttaacagattttggaattaagcaagaaataatacttagcctttaaagcaacatatcactttcataacacatttccgattttcgttttaatttttcttggatgttcacaatgaattgaaagaaaaaaaaactatataaacattcccttttttggaaaatttatgatttgcccctctttaattgttcacagcgaatacaaaaattgggtgacttgccagtctgcgccagccaggccagggctgattttgctggttagtgttgcgtggaaaggttcgattagtttcatgaaaaacgtgctcagctcaacaaactttcatgcagtcatctcgttcaaataatttcgttgcttgaggaatcagtgtcacctaacttaaatagcaaataataattttctcttaaacaaggagtaggaaagggaattcattgctactaaagtaagaaaaatgttaaaagatatttataaaaaataaatatatgtaatgaatttattatctattatttaatttatgtggcttgcgagtgatgggacgtacaaattttatgttgcattctatcaatgaagaggcccaatggcccatgatgaggtttgttgtgattataatctttgcttgtaaataaattagtagaggtagaaatagtatttgatttttctggggaagaaactggaggctaaaaa

SEQ ID NO: 3021 - DNA, 1563 bp, Citrus sinensis
ccacgcgtccgggccctcacattgtaaaggccagttgagtgaaaaatcaaaaccaaaaccctattagattttttctttttcaaaaaagcctcgagctttgtctccgatctgaacgtttagcgaccgttaagagagagaagggaaaaaaaaaaagaagagacttgactgacagatccttttttaatctttctcttcgtatcaggttgcgagggttttcggttctgtgaatttcgttgattcggccgctgaattgattgaataaagccagaaaaaaaaaacaatgaagaattgtgaacggatagcgaatttggctttagcaggtttaacattggcaccacttcttgtgaaggtagatccaaacttaaatgttatattgacagcatgtctcacagtttatgtgggctgctatcgatctgtcaaaccaactccaccatcagagacgatgtctaatgaacatgccatgcgctttccttttgttggaagtgctatgttgttatcactgttcttacttttcaagtttctatctaaagacctggtcaacgctgtattgacctgctacttcttcgttcttgggatcattgccctttcggcgactatcttaccagctgtgaaacgcttcttgccaaaccattggaatgaggacctaattatatggcatttcccttatttccgttctttggagattgagttcacaaggtctcagatcattgctgcaatccctgggacgtttttttgtgcatggtatgcttcacagaaacattggctagctaacaataccttgggccttgccttctgcattcagggaattgaaatgctttctcttggatctttcaagactggtgccattcttttggctggactttttgtatatgatattttctgggttttcttcactccagtaatggttagtgttgcaaaatcttttgacgctcctatcaagcttttgttcccaacgagagacactgcccgaccattttccatgcttggacttggcgacattgtaattcctggtatctttgtggcactagcattgcgatttgatgtgtccagagggaaaggaagccggtacttcaagagcgcttttctgggatatacagttggtttagtcctaacaatcattgtcatgaactggtttcaggctgcacagcctgcacttttgtatattgtgcctgctgtaattggattcttggccgctcactgcatatggaacggcgaagtcaaacagttgttggagtttgatgagtctaagactgccgcggttgtgtcacaagaaagtagcgatgccaaaactagcaagaaagtcgaataatttaaaatgccatctacaatggaccattttagcaaagaaatatcttttatttctccttttgaggatcaacgctgtgcaagctcaatccaagctaacttatgcaacctgcaaacaattgtaaaagattttggcattaagcaagaaataatattttagcctcttatagtgagacaactatagtgagacaactatttcagatatattttgtgatttttttctttatttaatttaattttttaaatgcattatactaa

SEQ ID NO: 3022 - DNA, 1862 bp, Vitis vinifera
tcgatttcctattggaccgtcacaagtgattgtcaccgctctaaatagtaactgccaccggcccatggacactgcccggtaaaaccctatccctgcaagagaacaaaattctttcatttctctctcttcacgacggcatctccgatccgtatggtcaacatacagtagagagagaaactgtgcgatcgtctgtctctctctctcctcagccatcaggtaggcggtgattggttgagtttttgctaagaaagaggcaattggaataggtacaatgaagaactgtgaacgtcttgccaatcttggtctagcaggtttaacattggcgccactggttatgaaggtagatccaaatttaaatgtcattttaacagcatgtctcacagtgtatgtaggttgctaccgctctgttaagccaactcccccttctgagacaatgtctaatgaacatgctatgcgctttccttttgttgggagtgcaatgctgttatcactattccttctcttcaagtttctatcaaaagacttggttaatgctgtactgacatgctacttctttgtgcttgggatcatcgctctttcggcaacattgctacctgcaattagacgttatttgccaaagcattggaatgatgaccctatcatctggcattttccatattttcgctctttggagattgagttcacaagatctcagatcgttgcagcaataccagggacctttttctgtgcatggtatgcttcccagaagcattggctagccaacaatatattgggcctcgctttctgcattcagggtattgaaatgctctcacttgggtcttttaaaactggtgccatccttttggcaggactttttgtttatgatattttctgggtcttcttcactccagtgatggtcagtgttgcaaagtccttcgatgctcctattaagcttttgttcccaacagctgattctgcccggccattttccatgcttggacttggtgacattgtaatccctggcatttttgtagcattggcattgcgatttgatgtgtccagagggaaagggaaccagtactttaagagtgcatttttgggatatacaaccggtttggttgtaacaattgttgtcatgaactggtttcaagctgcacagcctgcacttctttatattgtaccagcagttattggatttatggctgctcattgcatatggaatggcgaagttaaaccgttgttggagtttgatgaatctaagactgctagctcatcaaaagatgatggtgatgaaaaatcaagcaaaaaggtggagtaagttgaaaccctttccagctgaggaaagaaatagtgttgtttccatggaggatccaaaagcatttttagctaaaccatgggctaacttatgcaactgctcagaatgccattgcaacagattttggaattttatgcggctaataatataaagtagcatccaatgacaatacacccatgttatattttcatctgaactgctcattttagcatctgacagtgccattgccaatttttcctgatgtatcatgtgtttggaagactcaagacacttaaattcagttccagtataatactacatttacgacttttacaatgctctcatttacaagccattatatccagattcaaatcaaatagtcctactgtgattatggcaatttggtgttcaaggttttgcggacattttgttgaggagcaaaagggttagatttgtaaatgaagaagggtatttatgtattgagttttgatggtttgcttgggtaatgggcaaggaaatagggcttaaagttgcaagtgtttggctttgattccctttacactttgagaaatggattgccttggaaaac

SEQ ID NO: 3023 - DNA, 1515 bp, Vitis vinifera
aacaaaattctttcatttctctctcttcacgacggcatctccgatccgtatggtcaacatacagtagagagagaaactgtgcgatcgtctgtctctctctctcctcagccatcaggtaggcggtgattggttgagtttttgctaagaaagaggcaattggaataggtacaatgaagaactgtgaacgtcttgccaatcttggtctagcaggtttaacattggcgccactggttatgaaggtagatccaaatttaaatgtcattttaacagcatgtctcacagtgtatgtaggttgctaccgctctgttaagccaactcccccttctgagacaatgtctaatgaacatgctatgcgctttccttttgttgggagtgcaatgctgttatcactattccttctcttcaagtttctatcaaaagacttggttaatgctgtactgacatgctacttctttgtgcttgggatcatcgctctttcggcaacattgctacctgcaattagacgttatttgccaaagcattggaatgatgaccctatcatctggcattttccatattttcgctctttggagattgagttcacaagatctcagatcgttgcagcaataccagggacctttttctgtgcatggtatgcttcccagaagcattggctagccaacaatatattgggcctcgctttctgcattcagggtattgaaatgctctcacttgggtcttttaaaactggtgccatccttttggcaggactttttgtttatgatattttctgggtcttcttcactccagtgatggtcagtgttgcaaagtccttcgatgctcctattaagcttttgttcccaacagctgattctgcccggccattttccatgcttggacttggtgacattgtaatccctggcatttttgtagcattggcattgcgatttgatgtgtccagagggaaagggaaccagtactttaagagtgcatttttgggatatacaaccggtttggttgtaacaattgttgtcatgaactggtttcaagctgcacagcctgcacttctttatattgtaccagcagttattggatttatggctgctcattgcatatggaatggcgaagttaaaccgttgttggagtttgatgaatctaagactgctagctcatcaaaagatgatggtgatgaaaaatcaagcaaaaaggtggagtaagttgaaaccctttccagctgaggaaagaaatagtgttgtttccatggaggatccaaaagcatttttagctaaaccatgggctaacttatgcaactgctcagaatgccattgcaacagattttggaattttatgcggctaataatataaagtagcatccaatgacaatacacccatgttatattttcatctgaactgctcattttagcatctgacagtgccattgccaatttttcctgatgtatcatgtgtttggaagactcaagacacttaaattcagttccagtataatactacatttacgacttttacaatgctctc

SEQ ID NO: 3024 - DNA, 1621 bp, Lotus japonicus
cttcctctctcgtttgactctcaaacccgtaaaaaaaaaaagtaaaacttcaaaaccctaacccttcaaatccattttcccccaaatcaaatcaaatcaaatcctcttcaatttctccgatctgctgctactgcttcttcgcgttcttcttccctgcctgctcctgcaattctctctcgcgattccagttggggcaacgtgtgtgtgattccgccagatccatagtttttcagactcacattggggaagagtttcaggagaagaatgaagaacaccgagcgacttgcgaatttcgctttactaggtttaaccttggcaccgcttgttgtgaaagtggatccgaatttaaatgttattttgactgcctgcatcactgtgtttgtcggatgttatcgttctgtcaaaccaaccccaccaactgagacgatgtccaatgagcatgccatgcggtttccctttgttgggagtgcaatgttgctatcacttttcttactctttaagtttctctcaaaggacttggtgaacactgttttgacaggctacttctttgtacttgggattgttgcgctctcggcaacattattgccatccattaaacgctttctgccaaatcattggaatgacgacaacatagtctggcgttttccatattttcgttctttagaggttgagtttacaagatcacagatagttgctgcaatccctgggacatttttttgtgcttggtatgctttgcggaagcattggttggcaaataatatattgggtcttgctttctgtattcagggaattgaaatgctttctcttgggtctttcaagactggtgctattctcttggctggtctttttgtctatgacattttctgggttttcttcactcctgtgatggttagcgttgccaaatcattcgatgctccaattaagctattgttccctacagcagatgctgtgaggccattttcaatgcttgggcttggtgatattgttatccctggtatttttgtagcattggctttacggtttgatgtgtccagaggaaaacagccccagtatttcaaaagtgcatttttaggatacgctgttggtgtgatccttacaattgtagtgatgaattggtttcaggctgcacagcctgctcttttgtatattgtaccttctgtaattggatttttggctgctcattgcgtatggaatggtgaagtcaaacagttgttggagttcgatgagtcaaagactgccaattcatcccaagaagaagttgatgctaaagttaccaaaaaggatgaataagtcagcatccccaataccaaatacttctgagtcatagaagagacactgttatttttgttttttgggaacgccatgactttttgagctaacttatttagcagcacacctctgtaacagattgtgtttaaaagaaatatgttggtgttgcttttcagtttgcaattttgcctttactttttgacggcccaatcatcacatatatttccctcttcccttccgatctctcatctgtaaaatcatgcggatgactagatttctcaaaggattaatcatacagaaaggagtctcattagtcacggtgatacatccccatcataaagggaccatgttt

SEQ ID NO: 3025 - DNA, 1556 bp, Citrus sinensis
aaccactagcctcatggccctcacattgtaaaggccagttgagtgaaaaatcaaaaccaaaaccctattagattttttctttttcaaaaaagcctcgagctttgtctccgatctgaatgtttagcgaccgttaagagagagaagggaaaaaaaaaagaagagacttgactgacagatccttttttaatctttctcttcgtatcaggttgcgagggttttcggttctgtgaatttcgttgattcggccgctgaattgattgaataaagccagaaaaaaaaaacaatgaagaattgtgaacggatagcgaatttggctttagcaggtttaacattggcaccacttcttgtgaaggtagatccaaacttaaatgttatattgacagcatgtctcacagtttatgtgggctgctatcgatctgtcaaaccaactccaccatcagagacgatgtctaatgaacatgccatgcgctttccttttgttggaagtgctatgttgttatcactgttcttacttttcaagtttctatctaaagacctggtcaacgctgtattgacctgctactttttcgttcttgggatcattgccctttcggcaactatcttaccagctgtgaaacgcttcttgccaaaccattggaatgaggacctaattatatggcatttcccttatttccgttctttggagattgagttcacaaggtctcagatcattgctgcaatccctgggacgtttttttgtgcatggtatgcttcacagaaacattggctagctaacaataccttgggccttgccttctgcattcagggaattgaaatgctttctcttggatctttcaagactggtgccattcttttggctggactttttgtatatgatattttctgggttttcttcactccagtaatggttagtgttgcaaaatcttttgacgctcctatcaagcttttgttcccaacgagagacactgcccgaccattttccatgcttggacttggcgacattgtaattcctggtatctttgtggcactagcattgcgatttgatgtgtccagagggaaaggaagccgatacttcaagagcgcttttctgggatatacagttggtttagtcctaacaatcattgtcatgaactggtttcaggctgcacagcctgcacttttgtatattgtgcctgctgtaattggattcttggccgctcactgcatatggaacggcgaagtcaaacagttgttggagtttgatgagtctaagactgccgcggttgtatcacaagaaagtggcgatgccaaaactagcaagaaagtcgaataatttaaaatgccatctacaatggaccattttagcaagaaatatcttttatttctccttttgaggatcaacgctgtgcaagctcaattcaagctaacttatgcaacctgcaaacaattgtaaaagattttggcattaagcaagaaataatattttagcctcttatagtgagacaactatttcagatatattttgtgattttttctttatttatttaattttttaaatgcattcatacttaccgagg

SEQ ID NO: 3026 - DNA, 1324 bp, Fagus grandifolia
gtttgtgatcgcagaggaggtgatcttgggaaagattttggtttaatctgatcgaattttgcaatcgaagtttgtgattttagatagtgatgaagaacgttgagcgaattgcgaatgtagctttagcaggtttaactttagcaccacttgttgtgaaggtagatccaaacttaaatgttattttgactgctggcctcacagtttttgtgggttgctacagatctgtcaagccaactccaccttctgagacaatgtctaatgagcatgccatgcgtttcccttttgttgggagtgcgatgctgttatcactatttttgctttttaagtttctatcaaaggacttggttaatgctgtattgacatgctacttctttgtgcttgggatcgtcgctctctcggcaacgcttttacctgctattaaacgttatttaccaaagcattggaatgaggacgttattagctggcattttccatatttccgttctttggacattgagttcacaaggtctcagattattgctgcaatccctggaacctttttctgtgcatggtatgcttctcagaagcattggctagctaacaatatactgggactcgctttctgcattcagggaattgaaatgctgtctcttgggtctttcaagactggtgccattcttttggctggactttttgtgtatgatattttctgggttttcttcactccagtgatggttagtgttgcaaaatcttttgatgctcctataaagcttttgttccctacagcagatgctgctcgaccatactctatgcttggacttggtgacattgtaatccctggtatttttgtagcgttggctttgcgatttgatgtgtctagagggaaaggcagccagtattttaagagtgcatttctgggatacatgtttggtttggtggttacaattgttgtcatgaactggttccaggctgcacagcctgctctattgtatattgtaccggctgttattggatttttggcggctcattgcatatggaatggtgaagtcaaaccgttgttggagtttgacgagtccaagactgctaattcatccgaagaaagcagtgatgataattctagcaagaaggtggaataaactgaagagccttgggctctggagttttccacctcaaggaagaaaaactgctgttctctgaggccccaaaccgcatttaaagcttaattgtggctaacttatgcaactgtacaccgctgtaacagattttgggattaagccattaaggaagaaataatattttagccttttataaccatacagccgttttaagtctttctttactggct

SEQ ID NO: 3027 - DNA, 1626 bp, Gossypium hirsutum
ccaaacccatctttgattctgtttgcaataagagccaggcgtagcggaacactaaatctcccaactattctcaaatccttccctaaatcctcttctaagatttagaagtctgaataatcttcttcactcttcactttggctttaagttgctccataaaactttctacgcactcatcatcaacctgcagtttaagtcatggagatgcacatcaattctaaagtctaaacccaccaagaagaagcatgaaaagagatttgaacaaaacctttccatgttttgaagcagaagatatatttgcgtctccttcttccattattattgtattctttgtgttcgacttggctgccttcatctgttttttgggttgttctgtcactgtagaaagagggtcgattcttcgttgctgttatatttaaaaataaacgacgacgatgaagaacactgaaagactcgccaatttggctttagcagggttgacattggcaccacttgttgtgaaggtagatcctaatttgaatgttattttgactgcatgccttgcagtatatgtgggctgctatcgttctgtaaagccaactcccccatcagagacaatgtctaaggagcatgctatgcgttttccatttgttgggagtgcaatgttgttatcacttttcttgctgttcaagttcttatcgaaagacttggttaatgctgtcttgacatgctatttctttgtgcttggaatcattgctctttcggcaacaatattgcctgcattaaaacacttcttgccaaagcagtggaatgaggaccatatcatttggcgttttccattcttccgctcttttgagattgagttcacaagatctcagatcatagctgcaatccctggaacctttttctgtgcatggtatgcctcgcagaagcattggctggctaataatattctgggtcttgctttctgcattcagggaattgaaatgctttctcttggatcatttaagactggtgccattctcttggctgggctttttgtatatgatattttctgggtttttttcactcctgtgatggtcagtgtggcgaagtcttttgatgctcctataaagcttttgttcccaacagcagactctgcacgaccattttccatgcttggacttggtgacattgtaattcctggcatttttgtagccctagcattgagatttgatgtatctagagggaaagggagccaatattttaagagtgcatttttgggatacacagtaggattggtccttacaattgttgtcatgaactggtttcaagctgcacagcctgcacttttgtatattgtaccggctgttattggattcttggctgctcactgtatatggaatggagatgtcaaaccgttattggagtttgacgagttgaagactgcggttacgtctgaagatggtagtgatgacaaatccagcaagaaggttgaatgagttagaagcagaaacccttacactgaaaccattttattttagctttgagaaggatatagtgttcacttttaatgtcaatcttggctaactttttgttctactactaaacctttgtatcaggttttggaattaatcaagaaataataatacttaacctcttaaacaaaa

SEQ ID NO: 3028 - DNA, 1989 bp, Gossypium hirsutum
atggcttaaggtagaaaatcactaaaggagcagaccggtgctaagaggcttgcctctaaaatattcagcttcacgtagacaatcttcgaggacctccatattcccatctacattcttgagcttgagcatctcttcaccgcttttcccttccattgctatgaaaccaaaatatgcacgcgcaattttaaagaggtgctcaatggcaaaatccacattgaattgaaggttgagggcattgttaattgcatctcgccacaacaagaatttagtctcgttgacctggtctagttcgagatcatccatctctttgatggcagcacagaacagaatataggtaggctcagctgcaaagtcactctgtgaactgcctgaagtaatgtcaccaaaaccatcctcgattctgtttgcaataagagccaggcgtagcggaacactaaatctcccaaccattctcaaatccttccctaaatcctcttctaagatttggaagtctgaataatctacttcactcttcactttggctttaagttgctccataaaactttctacgcactcatcatcaacctgcagtttaagtcatggagatgcacatcaattctaaagtctaaacccaccaagaagaagcatgaaaagagatttgaacaaaacctttccatgttttgaagcagaagatatatttgcgtctccttcttccattattattgtattctttgtgttcgacttggctgccttcatctgttttttgggttgttctgtcactgtagaaagagggtcgattcttcgttgctgttatatttaaaaataaacgacgacgatgaagaacactgaaagactcgccaatttggctttagcagggttgacattggcaccacttgtcgtgaaggtagatcctaatttgaatgttattttgactgcatgccttgcagtatatgtgggctgctatcgttctgtcaagccaactcccccatcagagacaatgtctaaggagcatgctatgcgttttccatttgttgggagtgcaatgttgttatcacttttcttgctgttcaagttcttatcgaaagacttggttaatgctgtcttgacatgctatttctttgtgcttggaatcattgctctttcggcaacaatattgcctgcattaaaacacttcttgccaaagcagtggaatgaggaccatatcatttggcgttttccattcttccgctcttttgagattgagttcacaagatctcagatcatagctgcaatccctggaacctttttctgtgcatggtatgcctcgcagaagcattggctggctaataatattctgggtcttgctttctgcattcagggaattgaaatgctttctcttggatcatttaagactggtgccattctcttggctgggctttttgtatatgatattttctgggtttttttcactcctgtgatggtcagtgtggcgaagtcttttgatgctcctataaagcttttgttcccaacagcagactctgcacgaccattttccatgcttggacttggtgacattgtaattcctggcatttttgtagccctagcattgagatttgatgtatctagagggaaagggagccaatattttaagagtgcatttttgggatacacagtaggattggtccttacaattgttgtcatgaactggtttcaagctgcacagcctgcacttttgtatattgtaccggctgttattggattcttggctgctcactgtatatggaatggagatgtcaaaccgttattggagtttgacgagttgaagactgcggttacgtctgaagatggtagtgatgacaaatccagcaagaaggttgaatgagttagaagcagaaacccttacactgaaaccattttattttagctttgagaaggatatagtgttcacttttagtactactaattatgcatttggataatattattaatttctagtattaattgtggtttggaagctaattataattattc

SEQ ID NO: 3029 - DNA, 1163 bp, Ambrosia trifida
acaatgaagagtggtgagcgagctgcaaatattgcactagcaggtctaacgctagcgccattagttgtgaaggttgacccaaatataaatgttattttgactgcatgcctcacagtttttgtgggttgttaccgttctgtcaagcctacaccccctactgagacaatgtcgaatgcacatgccatgcgttttcctctggtaggcagtgcaatgttgttgtctttgttcttgctctttaagttcctgtcaaaagaccttgtcaatgccgtcttgacttgctatttctttgtgcttggcatccttgcactctcggcaacactcttacctgcaattaggcggtttttacctaccaagtggaacgaagatgttattcattggagtttcccgtatttcaaatcactagatgttgagttcacaaggtctcaagtcgttgcagcaattcctgggacctttttctgtgtgtggtatgttgcacagaagcattggcttgctaacaatgttctgggacttgcattctgcattcagggaattgaaatgctttctcttggctcattcacaactggtgccattcttttggctggactctttttctatgatatattctgggtcttttttaccccagttatggtcagcgtagccaaatcatttgatgcacctataaagcttctattcccaacaggagtcgctgcccgtccattttctatgcttggtttaggtgacattgtaattccaggcatttttgtagcattggcactgagatttgacgtatcaagagggagaaataaccaatacttcaagagtgctttcttgggatatgcagttggtgtggtgcttactattgttgtcatgaactggtttcaagctgcacagcctgctctattatatattgtaccagccgttattgggttcttggctgttcattgcatttggaatggggatgtcaaaccgctgttggagttcgatgagtctaaaacggctattgatggtgatgcagatgagaatacaagcaagaaagtagagtgatacatgaaaattagcgttacaaaatacagttaattgcagtaggagaactatggttttccttttcgtttttaaattaatagcattgtaaccctaatcttttggttaacttatgctatagacttttcaagctcaaaaaagaa

SEQ ID NO: 3030 - DNA, 2005 bp, Cannabis sativa
ctgaaagatattttgagttttcatagtatgatttggcacaatacaattggctaagaaacctcataagacgtggcttggttaaggggatccaactcgcgtcaatattctgactaatacggtgcggttgatcatagttggataaaaaattacagccacactaaacgtaacagctcattctcaaatcccagcgtcactaaccaataatataacgccacgttgtacagaccatgcctcagcttttactttcttgaggaaaaccgattttttattggcagttataaaccttacgtcaccgtcatgtcctcacgacttttaacctgctccagtgctcaataactcgaccatggcttccctcctccggtaaagccctaaagtttgcaaagttatcaaaatccccaaatatttctctatctctcgctctctctctcttcgggctacccttaccttctccgatctgcgagagggggaaatcgctgtaactgggttttgattgcggagaagggtcattttggataaagctttcgttttagagttttaactaaagatgaagaacgttgagcgtgtagcgaatttggctttagcaggtttaacattagcaccccttgttgtgaaggtagatcctaatttaaatgttgttttaactgcctgcctcactgtttttgtgggctgctatcgatcggtgaagccaacgccgcctactgagacaatgtcaaatgaacatgccatgcgcttcccttttgttgggagtgcgatgctgctatcgctatttttactctttaagttcttatccaaagacttggttaacgctgtattgacaagctacttctttgttcttgggatcattgctctctcggcaacattgttacctgctatcaaacgttatttacctaagcattggaatgaggaccttatagtatggcgctttccatatttccgctctttggagattgagttcacaagatctcaggttgttgctgcaatccccggaacctttttctgtgcatggtatgcttcacagaagcattggcttgctaataatatattaggcttggccttctgcattcagggaattgaaatgctttctctagggtctttcaagactggtgccatcctcttggctggactttttgtgtatgatattttctgggttttcttcaccccagttatggttagcgttgcgaagtctttcgatgctcctataaagcttttgtttcctacaggggattctacacgcccattttctatgcttggacttggtgacatagtgatccctggtatttttgtagccctggctttgcgatttgatgtttctagagggaaacaaggccagtattttaggagtgcgtttttgggttacacatttggcgtggttcttaccattgtagtaatgaactggtttcaggctgcacagcctgcgctgttatatattgtcccagctgttattggttttctggccgcacatgttatatttaatggcgaaatcaaaccgttgttggaatttgacgagtcaaaagcctctcaagaagatgaagatgacaaagttagcagcaagaaggaggaatagtttgagaagctcataacctaaaacttccctttttagatgaatacttttttttttttattatcaactttcttctttttcttatttccaaggtcccaaaacggccttagagaacgcattttggctaattcttatgctgctccacaccccatgtaacagatttgttaatgaaggaaataatatattttcagcttataataccctgctagctttatttatttactttattttataaaacgatgggatcggtttatttgcgtcattttgttgtgtttgtatcagtgcgattacaactcgagacagcaatggcaaatacgatacgttgtatcaattagaatgcactaatacaaataggaagagagatttcttacaactgaagtaaattcatcatctatagatgttcataattttgaacacaaacatcaacgaaacaaaaattggaac

SEQ ID NO: 3031 - DNA, 1492 bp, Gossypium raimondii
gaaaaaaaaaaatctaagattttcgtttcaatctgcgagaaagatttttacatttttttctcactctttctcttttgtttttctttcatttccggcatctccgatctgtaaagctacacccactgttaagagagacaaaaattaaagtttcttttttgctttaggtgacaagaggtttcgagttttattcgctgttttattagaaataaacgacgacaatgaagaacgctgaaagactcgccaatttggctttagcagggttgacaatggcaccactagttgtgaaggtagaccccaacttgaatgttgttttgactgcatgcctaacagtatatgtgggttgctataggtctgtcaaacctactccaccatcggagacaatgtctaatgagcatgctatgcgttttccatttgttgggagtgcgatgctgttatcacttttcttactgttcaagttcttatcaaaagacttggttaatgcagttttgacatgctatttctttgtgcttgggatcattgctctttcggcaacagtactgcctaccataaaacgcttcttgccaaagcattggaacgaagaccttatcatttggcattttccatttttccgctcttttgagattgagttcacaagatctcagatcatagctgcaatccctggaacttttttctgttcatggtatgctttgcaaaagcattggctggctaataatattctgggtctcgctttctgcattcagggaattgaaatgctttctcttggatcttttaagactggtgccattctattggctgggctttttgtatatgatattttctgggtctttttcactcctgtgatggttagtgtcgcgaagtctttcgatgctcctataaagcttttgttccctacagctgactctacccgaccattttccatgcttggacttggtgacattgtaattcctggtatttttgtagcactagcattaagatatgacgtatctagggggaaagagaggcagtattttaagagcgcatttttggggtacacggtggggttggtccttacaattgttgtcatgaactggtttcaagctgcacagcctgcacttttgtatattgtaccggctgttattggattcttggctgctcactgtatatggaacggagaagttggaccgttattggagtttgacgaatcaaagatggcggttgtagaaggcagtgaagacaaacctagcaagaaagtggaatgaggtatagaaggcaaggcagacagtgaaactacttttagcttgagaaggaattagtgtttacgttaaaaggtcaatctcttggctaacttgttttactgcaatgcctttgtaacagattttggaattaagcaagaaataatatttagcttcttaagcagagattttttattctttcttttttacacaattccaattttcatggatattcaccatgttttctgaaaattattcttccttttcatgaattttctttt

SEQ ID NO: 3032 - DNA, 1310 bp, Gossypium hirsutum
catctccgatctgtaaagctacacccactgttaagagagacaaaaattaaagtttcttttttgctttaggtgacaggaggtttcgagttttattcgctgttttattagaaataaacgacgacaatgaagaacgctgaaagactcgccaatttggctttagcagggttgacaatggcaccactagttgtgaaggtagaccccaacttgaatgttgttttgactgcatgcctaacagtatatgtgggttgctataggtctgtcaagcctactccaccatcggagacaatgtctaatgagcatgctatgcgttttccatttgttgggagtgcgatgctgttatcacttttcttactgttcaagttcttatcaaaagacttggttaatgcagttttgacatgctatttctttgtgcttgggatcattgctctttcggcaacaatactgccaaccataaaacgcttcttgccaaagcattggaacgaagaccttatcatttggcattttccatttttccgctcttttgagattgagttcacaagatctcagatcatagctgcaatccctggaacttttttctgttcatggtatgctttgcaaaagcattggctggctaataatattctgggtctcgctttctgcattcagggaattgaaatgctttctcttggatcttttaagactggtgccattctattggctgggctttttgtatatgatattttctgggtctttttcactcctgtgatggttagtgtcgcgaagtctttcgatgctcctataaagcttttgttccctacagctgactctacccgaccattttccatgcttggacttggtgacattgtaattcctggtatttttgtagcactagcattaagatatgacgtatctagggggaaagagaggcagtattttaagagcgcatttttggggtacacggtggggttggtccttacaattgttgtcatgaactggtttcaagctgcacagcctgcacttttgtatattgtaccggctgttattggattcttggctgctcactgtatatggaacggagaagttggaccgttattggagtttgacgaatcaaagatggcggttgtagaaggcagtgaagacaaacctagcaagaaagtggaatgaggtatagaaggcaaggcagacagtgaaactacttttagcttgagaaggaattagtgtttacgttaaaaggtcaatctcttggctaacttgttttactgcaatgcctttgtaacagattttggaattaagcaagaaataatatttagcttcttaagcagagatttttt

SEQ ID NO: 3033 - DNA, 1552 bp, Catharanthus roseus
tgacagttttgcctggatcgatcgatctcttcttcttactcctgttagcccctctttgttgttcgattctctctctcaaggttgcggtgctttgggtcgggaatccgcttgtttgtgtctcaagggagagagaaaaaggagcacagcagcaattgaggtcttttttcttgtttttgtgtgtagaagttcaacacagaaacaatgaagaataacgagcgtcttgcaaatattgctctagccggcttgtctttggcaccactttttgtgaaggtagatccaaatttgaatgtcattttgacagcttgccttacagtatatgttggttgctatcgctctgttaagcctactccaccttctgagacaatgtccaatgaacatgccatgcgatttcccttagttgggagtgcaatgctcttgtcactgttcctgctttttaagttcctatcaaaagacttggttaatgctgtgttgacttgctacttttttgtacttgggatcgtcgctctttcagcaacattattacctgcaataaagcgctttctaccgaaacattggaatgaggacgcaattgtatggcgttttccgttcattcgctctttggaggttgagttcacaaggtcccaagttgttgctgccatccctggcttctttttctgtgcttggtatgcttcaaagaagcattggctgtctaacaacatattggggcttgcattctgcattcagggcattgaaatgctttcacttggctcattcaaaactggcgcaattcttttggctggactttttgtttacgatatcttctgggtattttttacccctgtaatggttagtgtggccaagtcttttgacgctcctattaagcttttgttcccaactgctgactctgcacgtccattttcgatgctgggacttggagatattgtcattcctggcatttttgtcgcattggcattgcgatttgatgtgtcaagaggaaagggagccaatacttcaagagtgcttttctagggtacactgtcggtttggtcttaacaatcatcgtcatgaactggtttcaagctgcacagcctgcactcctatatattgttccatctgttattggatttttggctgtacacgtcatctggaacggagatatcaaaccattgttggaatttgacgagtctaaatcttcggaatctgaagatggaaaagaaaaatcaagcaagaatgaggatgaaacatctacaaagaaagcagagtaggggtggctgattttagcaaagaaaactgttttaaccctggatggatatggactcaaaggaaaaggaaagaagaaatggtgaattcttaagttaggagggttgttaactttgcagctgctgctgctgctgctacacaaatttgttgtaccagattttgttactttaataaaactagtttttttttttttaatcttcttgctctctcaaatattaactattccatagaaagattcatagcaaaacttgtatcaaacttgaagaatatgaggaacaattgataggggaaaagttcttgagttttttacctt

SEQ ID NO: 3034 - DNA, 1183 bp, Ambrosia trifida
atttagttttgacgatgaagagtggtgagcgagccgcaaatattgcactagcaggtctaacgctagcgccgttagttgtgaaggttgacccaaatataaatgttattttgactgcatgcctcacagtttttgtgggttgttaccgttctgtcaagccaacacctcctactgagacaatgtctaatgcacatgccatgcgttttcctctagtaggcagtgcaatgttgttgtctttgttcttgctctttaagttcctgtcaaaagaccttgtcaatgccgtcttgacttgctacttctttgtgcttggcatccttgcactctcggcaacactcttacctgcaattaggcggtttttacctaacaagtggaacgaagatgttattcattggagtttcccgtatttcaaatcactagatgttgagttcacaaggtctcaagtcgttgcagcaattcccgggacctttttctgtgtgtggtatgtcgcacagaagcattggcttgctaacaatgttctgggacttgcattctgcattcagggaattgaaatgctttctcttggctcattcacaactggtgccattcttttggctggactctttttctatgatatattctgggtcttttttaccccagttatggtcagcgtagccaaatcatttgatgcacctataaagcttctattcccaacaggagtcactgcccgtccattttctatgcttggtttaggtgacattgtaattccaggcatttttgtagccttggcactgagatttgacgtatcaagagggagaaataaccaatacttcaagagtgctttcttgggatatgcagttggtgtggtgcttactattgttgtcatgaactggtttcaagctgcacagcctgctctgttatatattgtaccagctgttattgggttcttggctgttcattgcatttggaatggggatgtcaaaccgttgatggagttcgacgagtctaaaacagctattagtagtgatggtgatgcagatgagaatacaagcaagaaagtagagtgatacatgaaaattagctttacaaaatacagttaattgcagtaggagaaactatgtttttcctttttcgtttttaaattaatagcattgtaaccctaatctttttggttaacttatgctatagacttttcaagctcatgtttttt

SEQ ID NO: 3035 - DNA, 1710 bp, Gossypium raimondii
cagcaatgcaccaatgacactaccaaatccaatcatatcgcgccacgtgtcgatctaatacccgcaaaatcccatttttcaaaatttcaagccacatcttcattttccattggctgtcacaacattcaaaatgacagcaccatggaatttagcaacaaatttactccagctttgagtgaaaaataaaaagactcacctttataaaagaaaaaagaaaaaaaatctataaagatttcttctgagagaaagaattaagacaaatatatttttttctccgatctgtaaaactccatcgaccgttagagagagaaagaaaggagaataagatcaaaggtagaaagagggtcgattcttcgttgctgttatatttaaaaataaacgacgacgatgaagaacactgaaagactcgccaatttggctttagcagggttgacattggcaccacttgtcgtgaaggtagatcctaatttgaatgttattttgactgcatgccttgcagtatatgtgggctgctatcgttctgtaaagccaactcccccatcagagacaatgtctaaggagcatgctatgcgttttccatttgttgggagtgcaatgttgttatcacttttcttgctgttcaagttcttatcgaaagacttggttaatgctgtcttgacatgctatttctttgtgcttggaatcattgctctttcggcaacaatattgcctgcattaaaacacttcttgccaaagcattggaatgaggaccatatcatttggcgttttccattcttccgctcttttgagattgagttcacaagatctcagatcatagctgcaatccctggaacctttttctgtgcatggtatgcctcgcagaagcattggctggctaataatattctgggtcttgctttctgcattcagggaattgaaatgctttctcttggatcctttaagactggtgccattctcttggctgggctttttgtatatgacattttctgggtttttttcactcctgtgatggtcagtgtggcgaagtcttttgatgctcctataaagcttttgttcccaacagcagactctgcacgaccattttccatgcttggacttggtgacattgtaattcctggcatttttgtagccctagcattaagatttgatgtatctagagggaaagggagccaatattttaagagtgcatttttgggatacacagtaggattggtccttacaattgttgtcatgaactggtttcaagctgcacagcctgcacttttgtatattgtaccggctgttattggattcttggctgctcactgtgtatggaatggagatgtcaaaccgttattggagtttgacgagttgaagactgcggttacgtctgaagacggtagtgatgacaaatccagcaagaaggttgaatgagttagaagcagaaacccttacactgaaaccattttattttagctttgagaaggatatagtgttcacttttaaggtcaatcttggctaactttttgttctactgctaaacctttgtatcaggttttggaattaagcaagaaataataatacttaacctcttaaacaaactactttcatttgacacaaatcacaatgtatttggaactataaacattgcttttggaaattaattattttactctcttttttcctccattttttcatagctattaaaaattggatcatatgcatttctca

SEQ ID NO: 3036 - DNA, 1548 bp, Ricinus communis
atgacagacatgtatgagtgcaatctgtgtagccattaaaattctacttgcaggataactgactttcatttgggtaaaaccctatctctctcctctctcaaaaaattttcaaatctaaaaatctctggcattttctttttctcttccgatctgtttgtgcagtgaagagagagaaaggaggggacacgtctcagttgtaggttgttgatcgctaaattattgagctgtggaaagtcttggagttaattactggagtaatttgactgcgactataattacgattatatagtaagctcaattttaatctaattgaaaagaataatgaagaacggtgaacgtcttgccaatattgcgttagcaggtttgacattggcgccgcttgttgtgaaggtagatccaaacttaaatgtcatcttgactgcatgtcttgcagtttatgttgggtgttaccgatctgtcaagccaaccccacctgcagagacgatgtctaatgaacatgcaatgcgctttccctttgttgggagtgcaatgttattgtcgctattcttactcttcaagtttctttcaaaagacttggttaatgctgttttgacatgctactttttcgtgcttggaatcatcgctctttcggcgacattgttaccagctattaagcgttatttgccaaagcattggaatgatgatgttattacctggcattttccatattttcgctctttggagattgagttcaccagatctcaggtagttgcctcgattcctggaacattcttttgtgcatggtatgcttcccagaagcattggctggctaacaatattttgggcttggccttctgtattcagggaattgaaatgctttcccttgggtcttttaagactggcgccatcctcttggccggactttttgtatatgatattttctgggttttcttcactcctgtgatggttagtgtagcaaaatcttttgatgctcctataaagcttttgttcccaacagcagatgctgcacggccattttcgatgcttgggcttggtgacattgttatccctggtatttttgtagctctggcattgagatttgatgtctctagaggaaaagacagccagtattttaagagtgcttttctaggatacacagctggtgtggtccttacaattgttgtcatgaactggttccaagctgcccagcctgcacttctatacatcgtacctgctgtaataggattcttagcagctcatgttatatggaacggtgaagttaaaccgttgatggagttcgatgaatctaagactgctgcatcgactcaagaaagtagcgaaagcaactctgccaaaaaggtggagtgagtgaaaaaaactgttgttgaaatgggatagaagaatttgttgtttccttttttgaggacccaaaaagcctcttagattaatcttggctaacttgtgcaacttgcacatcagtgtaactgattttggaattaaacaaggaaaaaaaaatgaagaagaataatataaatttagcctcttatagcaggaccacatttggtgtcc

SEQ ID NO: 3037 - DNA, 1573 bp, Ricinus communis
tggctgtcattcgaccttgcatgacagacatgtatgagtgcaatctgtgtagccattaaaattctacttgcaggataactgactttcatttgggtaaaaccctatctctctcctctctcaaaaaattttcaaatctaaaaatctctggcattttctttttctcttccgatctgtttgtgcagtgaagagagagaaaggaggggacacgtctcagttgtaggttgttgatcgctaaattattgagctgtggaaagtcttggagttaattactggagtaatttgactgcgactataattacgattatatagtaagctcaattttaatctaattgaaaagaataatgaagaacggtgaacgtcttgccaatattgcgttagcaggtttgacattggcgccgcttgttgtgaaggtagatccaaacttaaatgtcatcttgactgcatgtcttgcagtttatgttgggtgttaccgatctgtcaagccaaccccacctgcagagacgatgtctaatgaacatgcaatgcgctttccctttgttgggagtgcaatgttattgtcgctattcttactcttcaagtttctttcaaaagacttggttaatgctgttttgacatgctactttttcgtgcttggaatcatcgctctttcggcgacattgttaccagctattaagcgttatttgccaaagcattggaatgatgatgttattacctggcattttccatattttcgctctttggagattgagttcaccagatctcaggtagttgcctcgattcctggaacattcttttgtgcatggtatgcttcccagaagcattggctggctaacaatattttgggcttggccttctgtattcagggaattgaaatgctttcccttgggtcttttaagactggcgccatcctcttggccggactttttgtatatgatattttctgggttttcttcactcctgtgatggttagtgtagcaaaatcttttgatgctcctataaagcttttgttcccaacagcagatgctgcacggccattttcgatgcttgggcttggtgacattgttatccctggtatttttgtagctctggcattgagatttgatgtctctagaggaaaagacagccagtattttaagagtgcttttctaggatacacagctggtgtggtccttacaattgttgtcatgaactggttccaagctgcccagcctgcacttctatacatcgtacctgctgtaataggattcttagcagctcatgttatatggaacggtgaagttaaaccgttgatggagttcgatgaatctaagactgctgcatcgactcaagaaagtagcgaaagcaactctgccaaaaaggtggagtgagtgaaaaaaactgttgttgaaatgggatagaagaatttgttgtttccttttttgaggacccaaaaagcctcttagattaatcttggctaacttgtgcaacttgcacatcagtgtaactgattttggaattaaacaaggaaaaaaaaatgaagaagaataatataaatttagcctcttatagcaggaccacatttggtgtccctaat

SEQ ID NO: 3038 - DNA, 1827 bp, Gossypium hirsutum
atggctttaggtagaaaattactaacggagcagaccggtgctaagaggcttgccgctaaaatattcagcttcacgtagacaatcttcggggacctccagattcccatctacattcttgagcttgagcatctcttcaccgcttttcccttccattactttgaaaccaaaatatgcacgcgcaattttaaagaggtgcttaatggcgaaatccacattgaattgaaggttgagggcattgttaattgcatctcgccacaacaataatttagtcttgttgacctggtctagtttgagatcatccatctctttgattgcagcacagaagagaagataggtaggcttagctgcacagtcactttgtgaactgtgtgaagtaatatcaccaaacccatctttgattctctttgcaatatgttccaggcgtagcggaacactaaatctcccaaccgttctcaaatccttccctaaatcctcttctaagatttggaagtctgaataatctacttcactcttcactttggctttaagttgctccataaaactttctacgcactcatcatcaacctttccatgttttgaagcagaagatatatttgcgtctccttcttccagtattattgtattctttgtgttcgattcggccgccttcatctgttttttgggctgttctgtcactgtagaaagagggtcgattcttcgttgctgttatatttaaaaataaacgacaacgatgaagaacactgaaagactcgccaatttggctttagcagggttgacattggcaccacttgtcgtgaaggtagatcctaatttgaatgttattttgactgcatgccttgcagtatatgtgggctgctatcgttctgtcaagccaactcccccatcagagacaatgtctaaggagcatgctatgcgttttccatttgttgggagtgcaatgttgttatcacttttcttgctgttcaagttcttatcgaaagacttggttaatgctgtcttgacatgctatttctttgtgcttggaatcattgctctttcggcaacaatattgcctgcattaaaacacttcttgccaaagcattggaatgaggaccatatcatttggcgttttccattcttccgctcttttgagattgagttcacaagatctcagatcatagctgcaatccctggaacctttttctgtgcatggtatgcctcgcagaagcattggctggctaataatattctgggtcttgctttctgcattcagggaattgaaatgctttctcttggatcctttaagactggtgccattctcttggctgggctttttgtatatgacattttctgggtttttttcactcctgtgatggtcagtgtggcgaagtcttttgatgctcctataaagcttttgttcccaacagcagactctgcacgaccattttccatgcttggacttggtgacattgtaattcctggcatttttgtagccctagcattaagatttgatgtatctagagggaaagggagccaatattttaagagtgcatttttgggatacacagtaggattggtccttacaattgttgtcatgaactggtttcaagctgcacagcctgcacttttgtatattgtaccggctgttattggattcttggctgctcactgtgtatggaatggagatgtcaaaccgctattggagtttgacgagttgaagactgcggttacgtctgaagatggtagtgatgacaaatccagcaagaaggttgaatgagttagaagcagaaacccttacactgaaaccattttattttagctttgagaaggatatagtgttcactttta

SEQ ID NO: 3039 - DNA, 1447 bp, Trigonella foenum-graecum
gttaattcacagcttgccacgttggcataaacggttcatccttctcatctcattggcatgcactcacactgtgacacaccttcttctttctacggtttgaggagtttacccttctctttgacctttgactctctcgcggagtacattctcgcaacgtttaacttatctagatccataatttttgtaacgcattcggtgaaatgaagaacacggaacgaattgcgaatttggctttattaggtttaaccttagcaccacttgttgtgaaagtagatccaaatttaaatgttgttttgactgcttgcatcactgtgttcgttggatgttaccgatccgtcaaaccaaccgcaccaactgagacaatgtccaaagaacacgctatgcgttttccctttgttgggagtgcaatgctattatcacttttcttgctctttaagtttctatctaaggacttagtgaacactgtgttgacaggctacttctttgtacttggaatcgttgcactttcggcaacattattgccatctattaaacgctttctgccaaagcattggaatgatgaactcatagtctggcgttttccatattttcgctccgttgagattgagtttacaaggtcacagatcgttgctgcagtccccggcacttttttttgtgcctggtatgctttgcggaagcattggctggcaaataatatattgggtcttgctttctgtatccagggaatcgaaatgctttctcttggctccttcaaaactggtgctattctcttggctggtctttttgtatatgacattttctgggttttcttcactcccgtgatggtcagcgttgcaaaatcatttgatgctccaattaagcttctgttccccacagcagattctgcaaggccgttttcaatgcttggacttggtgacattgttatccccggtatttttgtggcattggctttgcggtttgatgtgtctagaggaagaaagccccagtatttcaagagtgcatttttaggatacacttttggtgtggtccttacaattgttgtgatgaattggtttcaggccgcacagcctgctcttttgtatattgtacctgctgtaattggatttttggctgctcattgcatctggaatggtgatgtcaaacagttgttggagttcgacgagtctaagactgccaattcatctcaagaagagagtgatgccaagtctagcaaaaaggttgaataagttaaaaacttgcccaataccgatgcttctgattcacagaaaaatactgttattttcccaaaaaaacgcggttacttgagctaacttattcagcagcacacctctgtaacagactctgattaaaaaaatatatgttaatcttgttgtcttttataatcacggtaacgtggtttcgtgttgcactggtgcagatgctatcttagtgtcatgatattttttcc

SEQ ID NO: 3040 - DNA, 1377 bp, Platanus occidentalis
gattctcgctttccttctcaggatcgtgatctgaagggataaaagaaagaatttcagtttgatcgttgaaggtgttttggtatttcaatcttgtgcatttactaacaaccgattgcagtttctgcgtatgctacttcgtcaaacaaagtgcgtattgcttctttccgtattcgtaaatccgttatatagataataatgaagaacagtgaacgtcttgcgaatttggcgctagcaggtttaactttggcacccttgttgtgaaggtagatccaaatttaaatgttattttgacagcatgcctgacagtttacgtgggatgctatcgatcggtcaagccaacaccaccttcagagacaatgtcgaaggaacatgctatgcgcttccccttggttgggagtgcgatgctcttatcactgttcttactctttaagtttctgtcaaaagacttggttaatgctgttctgacatgctacttctttgtgcttggaattgttgcacttgctgccacattgttacctgcaattagacggtttcttccaagaaattggaacgagaaacttattgtctggcatcttccttatttccgttctgtggaggttgagttcacgatgtctcagattattgcagcaattcctggaacgtttttctgtgcatggtatgctaaacagaagcattggttggccaataatatattgggacttgccttctgcattcagggaattgaaatgctttctcttggatctttcaaaactggtgccattcttttggctggactttttgtttatgatatcttttgggtcttctttactccagtgatggttagtgttgcaaaatcttttgatgctcctataaagcttttgttcccaacagcagattctgcacgaccattttccatgcttggacttggtgacattgtaattcccggaatttttgttgcattggcattacgttttgatgtgtcaagagggaaagagaatcggtatttcagaagtgccttttttggatacacggttggtttagtccttacaattattgtgatgaactggtttcaagctgcacagcctgcacttctgtatattgtgcccgctgttattggatttctggctgttcactgcatatggaatggggaagtgaaaccgctgctggagttcgacgaatctaagactgctgctgcctcttcaactcaagatggggattcaagtagtggtgatgccaaatccagcaagaaagtggaataggggtgaagcccttgggactcggagcttttttaattgggtaagacgtacaattgtttacaatgaggaccctgatacattggacgctacaaccactaaactaacttacggaatgggaataaggaatgccattgtatcagta

SEQ ID NO: 3041 - DNA, 1278 bp, Gossypium hirsutum
cggcatctccgatctgtaaagctacacccactgttaagagagacaaaaattaaaggtgacaagaggtttcgagttttattcgctgttttattagaaataaacgacgacaatgaagaacgctgaaagactcgccaatttggctttagcagggttgacaatggcaccactagttgtgaaggtagaccccaacttgaatgttgttttgactgcatgcctaacagtatatgtgggttgctataggtctgtcaaacctactccaccattggagacaatgtctaatgagcatgctatgcgttttccatttgttgggagtgcaatgctgttatcacttttcttactgttcaagttcttatcaaaagacttggttaatgcagttttgacatgctatttctttgtgcttgggatcattgctctttcggcaacagtactgcctaccataaaacgcttcttgccaaagcattggaacgaagaccttatcatttggcattttccatttttcctctcttttgagattgagttcacaagatctcagatcatagctgcaatccctggaacttttttctgttcatggtatgctttgcagaagcattggctggctaataatattctgggtctcgctttctgcattcagggaattgaaatgctttctcttggatcttttaagactggtgccattttattggctgggctttttgtatatgatattttctgggtctttttcactcctgtgatggttagtgttgcgaagtctttcgatgctcctataaagcttttgttccctacagctgactctacccgaccattttccatgcttggacttggtgacattgtaattcctggtatttttgtagcactagcattaagatatgacgtatctagggggaaagagaggcagtattttaagagcgcatttttggggtacacggtggggttggtccttacaattgttgtcatgaactggtttcaagctgcacagcctgcacttttgtatattgtaccggctgttattggattcttggctgctcactgtatatggaacggagaagttggaccgttattggagtttgacgaatcaaagatggcggttgtagaaggcagtgaagacaaacctagcaagaaagtggaatgaggtatagaaggcaaggcagacagtgaaactacttttagcttgagaaggaattagtgtttacgttaaaaggtcaatctcttggctaacttgttttactgcaatgcctttgtaacagattttggaattaagcaagaaataatatttagctt

SEQ ID NO: 3042 - DNA, 1405 bp, Gossypium hirsutum
aaagaattaagacaaatatatttttttctccgatctgtaaaactccaccgaccgttagagagagaaagaaaggagaacaagatcgaaggtagaaagagggtcgattcttcgttgctgttatatttaaaaataaacgacaacgatgaagaacactgaaagactcgccaatttggctttagcagggttgacattggcaccacttgtcgtgaaggtagatcctaatttgaatgttattttgactgcatgccttgcagtatatgtgggctgctatcgttctgtcaagccgactcccccatcagagacaatgtctaaggagcatgctatgcgttttccatttgttgggagtgcaatgttgttatcacttttcttgctgttcaagttcttatcgaaagacttggttaatgctgtcttgacatgctatttctttgtgcttggaatcattgctctttcggcaacaatattgcctgcattaaaacacttcttgccaaagcattggaatgaggaccatatcatttggcgttttccattcttccgctcttttgagattgagttcacaagatctcagatcatagctgcaatccctggaacctttttctgtgcatggtatgcctcgcagaagcattggctggctaataatattctgggtcttgctttctgcattcagggaattgaaatgctttctcttggatcctttaagactggtgccattctcttggctgggctttttgtatatgacattttctgggtttttttcactcctgtgatggtcagtgtggcgaagtcttttgatgctcctataaagcttttgttcccaacagcagactctgcacgaccattttccatgcttggacttggtgacattgtaattcctggcatttttgtagccctagcattaagatttgatgtatctagagggaaagggagccaatattttaagagtgcatttttgggatacacagtaggattggtccttacaattgttgtcatgaactggtttcaagctgcacagcctgcacttttgtatattgtaccggcagttattggattcttggctgctcactgtgtatggaatggagatgtcaaaccgttattggagtttgacgagttgaagactgcggttacgtcttcagacggtagtgatgacaaatccagcaagaaggttgaatgagttagaagcagaaacccttacactgaaaccattttattttagctttgagaaggatatagtgttcacttttaaggtcaatcttggctaactttttgttctactactaaacctttgtatcaggttttggaattaagcaagaaataataatacttaacctcttaaacaaaactactttcattttgcaccaatcacaatgtatttggaactataaacattgcttttggaaattaattattt

SEQ ID NO: 3043 - DNA, 1384 bp, Flaveria ramosissima
atatgcttcaaagctttgactaccgaagacacaacgtagacgtgaacaacactgcaaaaacctccgccggcgaactctccggccaccgtcgatcttcaacttcctccgccgtctacggcgacggaacgactaacggacgtcgatccatcgatcgatcgatcgattcggtgtggttaactgatctgcttatcttctggttctgctttcagctagcttgcaaaaaactgtgagtttgtctggttgtctcttgaacctacctagctttgacaatgaagagtggtgagcgagctgcaaatattgcactagcaggtctaacactagcacccctagttgtgaaggttgatccaaatataaatgtcattttgactgcatgcctcacagtttttgtgggttgttatcgttctgtcaagccaacacctccttctgagactatgtctaatgcccatgccatgcgttttcctttagttggcagtgcaatgttgttgtctttgttcttgctcttcaagttcttgtcaaaagatctggtcaatgctgtcttgacttgctacttctttgtgcttggcatccttgcactctcggcgactctcttacctgcaattaggcggtttttacctaccaagtggaatgaagatgttattcattggagttttccttattttaaatctttagatgttgaattcacaaggtctcaagtcgttgcagcaatccctgggacctttttttgtgtgtggtatgttgcacagaagcattggcttgctaacaatattttgggacttgcattctgcattcagggaatcgaaatgctttctcttggctcatttaaaactggtgcgattctgttggctgggctctttttctatgatatattctgggtctttttcaccccagttatggtcagtgttgccaaatcatttgatgcacccataaagcttctattccctacaggagtcgctgcacgtccattttctatgcttggtttaggtgacattgtaattccaggcatttttgttgcattggcgctgagatttgatgtctcaagagggagaaacaaccaatacttcaagagtgctttcttgggatatgcagttggtgtggtgtttactattgttgtcatgaactggtttcaagctgcacagcctgctctcttatatattgtaccggctgttatcgggttcttggctgctcattgtgtttggaatggggatgtcaaaccgttattggagtttgacgagtctaaaacagctattagcagtgacggtgatgcaggcgagaatacaagcaagaaagtagagtgagaaatgaaagtctggtttacaaaatacagtgatttgcagtaggagaaactatgctttttctttttgttttatatacttgttttaatgac

SEQ ID NO: 3044 - DNA, 1534 bp, Gossypium raimondii
ttcaagttcaacgtcatttccattcaatctgaaaaaaaagaagaagaaagagaatgaaatcaaatctttagatttattcatttaattttctctcttttgctctcatttcctgcaactccgatctataaaattccatcgtttgttggaaagagcaagagaggaaaattaaatcaaagataaaacgattattagcaataaaggacgacaatgaagaactgtgaaagactcgctaatttagctttagcagggttgacattggcaccacttgttgtgaaggtggaccctaacttgaatgttattttgactgcatgcctcgcagtatatgtgggctgctatcgttctgtcaagccaactccaccattggagacaatgtctaaagagcatgctatgcgttttccgttcattgggagtgcgatgctgttatcacttttcttactgttcaagttcttatcaaaagacttggttaatgcagtattgacatgctatttctttgtgctaggaactgttgccctttcggcaacaatattgcctgccatgaaacgcttcttgccaaagcattggaatgaggaccttatcatttggcgttttccatacttccgatctttggagattgagttcacaaggtctcagatcatagctgcaattcctggatcctttttctgtgcatggtacgcttcacagaagcattggctggctaataatattctgggtctcgctttctgcattcagggaattgaaatgctttctcttggatcttttaagactggcgccattctcttgactgggctttttgtatatgatatattctgggtttttttcactcccgtgatggttagtgttgcaaagtcttttgatgctcctataaagcttttgttcccaacagcagactctgcacgaccgttttccatgcttggacttggtgacattgtaattcctggtatttttgtagcgctagctttaagatttgatgcatctagggggaaagggagccagtattttaagagtgcattttctggatacacagtgggattggtccttacaattatcgtcatgaattggtttcaagctgcacagcctgcacttttgtatattgtaccagctgttatgggattcttggctcttcactgtatatggaacagagaagtcaaaccgttattggaatttgatgaatcaaatactgaaattaaatctcaagaaggcagcactgacgaatatagcaagaaggttgaatgaagttatagaaaggcaagccaaaccactctgaaactatatatatacacatatatatatatatagcttgaaaaggaaatagtgttttatttcttactgcaaaaccagattttggaattaaacaatattgttttcattttacaaaaattccaatttgcatagatgtttacgtagtataacatttttgttttcgaaaaaattatttatttaccttttttttttttttttcatttttctcagctatccaaaagtatgcttaaacttaaatgtttgaatagcagatagatttgacaatttctttatg

SEQ ID NO: 3045 - DNA, 1319 bp, Helianthus annuus
tccgcctgtttcaagctttgactagacgaagaagacatacacgcatcaacacaacgaagaaatttgctaaaacctctgaagataaccaccatcgccggcgaacaactctccggcgaccgtcgattcgcagtctcttacgccgtctacggtgattctgcgttcagctagcttgcaaaaaaaagaaataaataaataactgtcagtttgtcttgttctctaccaaaatcacttagttttgacaatgaagagtggagagcgagctgcaaatatcgcactagcaggtctaacgctagcaccattagttatgaaggttgacccaaatataaatgtcattttgactgcatgcctcacagtttttgtgggttgttaccgttctgtcaagccaacacctcctactgaaacaatgtctaatgcacatgccatgcgttttcctctagttggcagtgcaatgttgttgtctttgttcttactctttaagttcctgtcaaaggacctggtcaatgccgtcttgacttgctacttctttgtgcttggcatcctcgcactctcggcgacactcttacctgcaatcaggcggtttttacctaccaagtggaacgaagatgttattcattggagtttcccgtattttaaatctctagatgttgagtttacaaggtctcaagtcgttgcagcaattcctgggacctttttctgtgtgtggtatgttgcacagaagcattggcttgctaacaatgttttgggacttgcattctgcattcagggaattgaaatgctttctcttggttcatttacaactggtgccattcttttggctggactctttttctatgatatattctgggtcttttttaccccagttatggttagcgtagccaaatcatttgatgcacctataaagcttctattcccaacaggagtcactgcacgtccattttctatgctcggtttaggtgacattgtaattccaggcatttttgtagcattggcactgagatttgacgtgtcaagagggagaactaaccaatacttcaagagtgccttcttgggatatgcagttggtgtggtgcttactattgttgtcatgaactggtttcaagctgcacagcctgctctgttatatattgtaccagctgttattgggttcttggctgctcattgcatttggaatggggaggtcaaaccgttgttggagttcgacgagtctaaaacggctagtagtagtgatggcgatgcagatgagaatacaagcaagaaagtagaatgagatatgaaaattaggtttacaaaatacagttggagaaactatgttttccttt

SEQ ID NO: 3046 - DNA, 1392 bp, Valeriana officinalis
aatcaatctctccgatcttcacattcgaaaaaaaatctctccgatctgtatatctagagagagaaaaacagtcaatccgagtatatcgcaagattttgccgttactgctactggatcctgtgagtttgataattcgtcattgttataatgaagaatggcgagcgtcttgcgaatattgctttagcaggtttaactctagcacctctagttgtgaaggtagatccaaatctaaatgtgattttgactgcttgcctctctgtctatgtgggttgctaccgctctgttaaatcgactccacctacagagacaatgtctaatgaacatgcaatgcgattcccattagttgggagtgcgatgctgttatctctattcttactttttaaatttctatcaaaggacttggtcaatgcggtactaaccagctatttcgttgtacttggaatcgtcgccctttcggcgacattgttacctgcaattaggcgttttcttccaaataaatggaatgacgaacttatagtctggcatttaccctattaccgctctgtggaaattgaattcacgagatctcaagttgttgcttcaatccctggaacgtttttctgtgcatggtatgtttcgcaaaagcactggctggctaacaacattttgggtcttgctttctgcattcagggaattgaaatgctttcacttggctcattcaaaacaggcgcaattctcttggcagggctttttgtgtatgatatattctgggtatttttcaccccagtaatggtcagtgttgccaaatctttcgatgctcctataaagcttttattccccacagcagatgcagcacgacctttttcaatgcttggacttggtgatattgttatcccaggtatatttgtagcattggcactgagattcgacgtttcgagagggaaacagtgccaatattttaagagcgcttttctaggatatgcagtcggtgttattcttactattatcgtcatgaactggtttcaagctgcacagcctgcactattatatatcgtgccatgtgtcatcggctttttggcagttcactgcttttggaacggagaagtgaaaccgttgttggagttcgacgaatctaaaactgcaacagcctccgaagatgataaagaatcagcttcaagcaaaaaagacgagtgatatattaaaattgtagcagcaaaatgaaaccatttcgatttggttttagcgtaaaatacacattttattcttctttttgtttcttctaatgagaactcaacagccccgttttgcaaaaaatagtgatatcttttaacatcggcggctgctaactttgtttggctgctaactttgttttgccaccggtgctgttgtactagatttcggccaagttaatta

SEQ ID NO: 3047 - DNA, 1872 bp, Malus domestica
atggttggctgctcgacgtcaacctatgcgcctcacttaaacaaatcggtcatcaaatttatgaccgataaaacgatccacattgcagatacgaacgcacgttccttaaacaaccgccaatcacctcccgccacgaggccgtttggaaatcgtctgcgtcgcggcccactggtactgtcaattccttctcttacaagagcgttcgaagcgggttcttttcgcgtgattacattaacgatgaagaacgttgagcggattgccaatatcgcattagcaggtttaacgttagcaccacttgttgtgaaggtagatccaaacctaaatgtagttttaactgcgtgtctcacagtttttgtgggttgctaccggtctgtgaagccaactccaccttcagagacaatgtctaatgaacatgccatgagattcccatttgtggggagtgcaatgctgttatcgctatttttactttttaagttcttatccaaagacttggtcaatgctgtattgacgtgctatttctttgttcttgggatcatcgctctctcggcaacacttttacctgctattgcacgatatttgccagagagttggaataaggaccctatcgtctggcgttttccttatttccggtctttggagattgagttcacaaaatctcagattgtttctgcaatccctggaacctttttctgtgcatggtatgcttcaaagaagcattggctggctaacaatatattggggctcgccttctgtattcagggaattgaaatgctttctcttgggtcttttaagactggtgctatccttttggctggactttttgtgtatgatattttctgggttttcttcactccagttatggtcagtgttgccaaatcttttgatgcgcctataaagctgttgttccccacagcagatgctgcacgtccattttctatgcttggacttggtgatattgttatccctggtattttcgtggcgttggctttgcggtttgatgtatctagggggggaaagggccagtacttcaagagtgcatttttgggatacacagttggtttggtcctcacaattgttgtaatgaactggtttcaggcagcgcagcctgcactgttgtatattgtaccatctgttattggatttttggctgctcactgcatatggaatggtgacgtcaaaccgctgttggcgttcgatgagtcgaagagtgcggtgatatctgaagaagaaagtgatcccaaaaccatcaagaaggtggagtaagttgaaatacagagaagccacagaaaagaagactttccaacgcaaaaaaacaaacgctgttttgctcttggctagttttgcaactgcacgccgttgtaacagttttttcgaatcgaggacgaaataatatttcagttccttttacaagttgcaacgattacagcaatgttaggttaatacagaaacctttccttatctttttctatctaactttcatagaaattttaagtcattcatttatcttgctgatagattcatcgcacacttcaatgttcagggaatgagttgacctgtattaggctagttggttagggcaatgtgtctatcctcccgccccaaaattcgaatctccgtctccgtaagtttgaggagttcgtcttgtcaaaaaatgtaggtcgcatggaggtaagtattacagatcgaagtctatgcaagggaagaggtgggttccatgaatgtgagtgtaatcaatgaatgtggtccaaataacagcacttgtaataaactagtaacagttgtcgacgtgcaattcatttattgactgttgttcgggatatgcagaattttagtagttgtcatctatttgattaacggatgtattatgaaaaa

SEQ ID NO: 3048 - DNA, 1442 bp, Populus trichocarpa
ctctctctatttctttctgcaaatattaaaaaaatctcattttcatctctccccctctctatgcccccccgatctgtatctctagtaaccgttagagagagagcctcttcagggttttttttatggtaaagaggcaataggttctcaattgatcgttgaagtgtagtagattagcttaataatctttctccaaagtgcttggttagaatacgaacatgaagaactgtgaacgagttgcaaatttggctttagcaggtttaacattggcaccactctttgtgaaagtagatcccaacttaaatgtgatcttgactgcatgcctgacagtttatgttggctgctatcgatctgtcaagcctacgccaccttcagaaaccatgtctaatgaacatgcaatgcgctttccctttgtcgggagtgctatgctgttatcattattcttactcttcaaatttctttcaaaagatttggttaatgctgtactgacctgttactttttcgtgcttggaattgtcgcgctttcggcaacactattaccagctataaaacgttatttgcctaagcattggaatgatgatgtcatttcctggcattttccttatttccgctctttggagattgagttcacaagatctcaaattgttgcggcaattcctggaacattcttctgtgcttggtatgcttcccagaagcattggcttgctaacaatatcctgggcttggctttttgcattcaggggattgaaatgctttcccttggttcttttaagactggcgccatcctcttggctggactttttgtatatgacattttctgggttttcttcactcccgttatggttagcgttgcaaaatcttttgatgctcctataaagcttttgttccccacagctgatacggcaagaccattttccatgcttggacttggtgacattgtgattcctggtatttttgtagctctggcactgcgatttgatgtgtctagaggaaaagaaagccagtattttaagagtgcttttcttggatatacagctggtgtggtccttacgattattgtcatgaactggttccaagctgcccagcctgcacttttgtatattgtaccagctgctataggattcttagccgctcacgtcgtatggaatggtgaagtcaagccgttaatggagtttgacgagtccaagactgctgcatcatctcaagaagatagtgaaaccagctctagcaaaaaggtggaatgatcggaaaaaacatcagatgctgaaactcttgtagagccagggaagaaatatgttggttttcagtcaggacacaaaatcctgtagctgtcaacctttttgctaacttatgcaagctgcacaccagtgtaacagattttggaattaagcgaaaaaaattaataacatcatatttatcctctttacagtaggaccattttagac

SEQ ID NO: 3049 - DNA, 1473 bp, Fragaria vesca
aaaatcaaaatccaaaaaatcccaaatctctctccgatctgtccggaacgaaacccggttgaaatttcaattgcatcgcggcccactggttcggggtttcgtcgcggaggggaatacattcagtgggattcgattcgatctgaatttttgttcttatagtgaaaaacgatgaagaacgtcgagcgttttgccaatatcgccttagcaggtttaacgttagcaccacttgttgtgaaggtagatccaaatctaaatgtagttttgactgcatgtctcacagtttttgtgggctgctaccggtctgtgaagccaactccccccacagagacaatgtctaatgaacatgctatgcgttttccatttgttgggagtgcgatgctgttatcactctttttactcttcaagttcttatccaaagacttggttaatgctgtcttgacgtgctatttctttgttcttgggatcatcgctctttcggcgacgttgttacctgctattgcacgttatttgccagagcgttggaataaggaccttatcgtctggcatcttccttatttccgttctgttgagattgagttcacaaggtctcagatctttgctgcaatccctgggttctttttctgtgcttggtacgcttcaaagaagcattggctggctaacaacatattggggcttgccttctgtattcagggtatagaaatgctctctcttgggtccttcaagacaggagccattcttttggcgggactttttgtctacgatatattttgggttttcttcactccagttatggtcagtgttgcaaaatctttcgatgctcctattaagttgttgtttcctacagccgatattgcgcgtccattttcaatgcttggacttggtgatattgtgatccctggtatttttgtggcactggctttgagattcgatgtatctagaggaaaagaaggccagtatttcaagagtgcatttttgggatacacaatgggtttggtgcttacaattgttgtaatgaactggtttcaagcagcacagcctgcactgttgtatattgtaccagctgtaattggatttttggctacccattgcatctggaatggagatgtcaaaccgttattggcgtttgatgagtcaaagaccaccacaaaatctgaagcggataatgatgacaagcttaacaagaaggtggagtaagttgaaatacagagaagacacagacacaccaaaactgtcctgctaagaaaaaacctgtttctcgcaaggcccccaagtgcctttaaagcctatcttggtaatttatgaacctgcgcacctttgtaacagatttttgaattgaggaggaagaaataatataattttcagtttcttacaattgataacaacacagccatgtttaggattatacagaaaccatgtttcaacttgttccatctaatttttatagaatttgaaaggcatttatcttgattattg

SEQ ID NO: 3050 - DNA, 1403 bp, Helianthus annuus
tcacgcctgtttcaaagctttgactagacgaagacatacacgcatcaacacaacgaagaaatttgctaaaacctttgaactttgaagataaccaccatcgccggcgaacaactctccggcgaccgtcgattcgcagtttcttccgctctctacggtgattctgcgttcagctagcttgctaaaaaaggaaataaataaataactgtcagtttgtcttgttctctaccaaactcacttagttttgacaatgaagagtggagagcgagctgcaaatatcgcactagcaggtctaacgctagcaccattagttatgaaggttgacccaaatataaatgtcattttgactgcgtgcctcacagtttttgtgggttgttaccgttctgtcaagccaacacctcctactgaaacaatgtctaatgcacatgccatgcgttttcctctagttggcagtgcaatgttgttgtctttgttcttactctttaagttcctgtcaaaggacctggtcaatgccgtcttgacttgctacttctttgtgcttggcatcctcgcactctcggcgacactcttacctgcaatcaggcggtttttacctaccaagtggaacgaagatgttattcattggagtttcccgtattttaaatctctagatgttgagtttacaaggtctcaagtcgttgcagcaattcctgggacctttttctgtgtgtggtatgttgcacagaagcattggcttgctaacaatgttttgggacttgcattctgcattcagggaattgaaatgctttctcttggttcatttacaactggtgccattcttttggctggactctttttctatgatatattctgggtcttttttaccccagttatggttagcgtagccaaatcatttgatgcacctataaagcttctattcccaacaggagtcactgcacgtccattttctatgctcggtttaggtgacattgtaattccaggcatttttgtagcattggcactgagatttgacgtgtcaagagggagaactaaccaatacttcaagagtgccttcttgggatatgcagttggtgtggtgcttactattgttgtcatgaactggtttcaagctgcacagcctgctctgttatatattgtaccagctgttattgggttcttggctgctcattgcatttggaatggggaggtcaaaccgttgttggagttcgacgagtctaaaacggctagtagtagtgatggcgatgcagatgagaatacaagcaagaaagtagaatgagatatgaaaattaggtttacaaaatacagttggagaaactatgtttttcctttttcttttttaaatacttttttttaatagcattgtaaccctaatctttttggttaacttatgctagacttttcaagtt

SEQ ID NO: 3051 - DNA, 1282 bp, Ambrosia trifida
actacaccaagacatcaatcatcaaacaaattcacagtttcgtctgattctgcgttcagctagctagaaaaaaaaatctgttagttttctgggtttttactaaagccacttagttttgacaatgaagagtggtgagcgagctgcaaatattgcactagcaggtctaacgctagcgccattagttgtgaaggttgacccaaatataaatgttattttgaccgcatgcctcacagttttttgtgggttgttaccgttctgtcaagccaacacctcctactgagacaatgtctaatgcacatgccatgcgttttcctctagtaggcagtgcaatgttgttgtctttgttcttgctctttaagttcctgtcaaaagaccttgtcaacgccgtcttgacttgctacttctttgtgcttggcatccttgcactctcggcaacactcttacctgcaattaggcggtttttacctaccaagtggaatgacgatgttattcattggagtttcccgtatttcaaatcactagatgttgagttcacaaggtctcaagtcgttgcagcaattcctgggacctttttctgtgtgtggtatgttgcacagaagcattggcttgctaacaatgttctgggacttgcattctgcattcagggaattgaaatgctttctcttggctcattcacaactggtgccattcttttggctggactctttttctatgatatattctgggtcttttttaccccagttatggtcagcgtagccaaatcatttgatgcacctataaagcttctattcccaacaggagtcactgctcgtccattttctatgcttggtttaggtgacatcgtaattccaggcatttttgtagcattggcactgagatttgacgtatcaagagggagaaataaccaatacttcaagagtgctttcttgggatatgcagttggtgtggtgcttactattgttgtcatgaactggtttcaagctgcacagcctgctctattatatattgtaccagctgttattgggttcttggctgttcattgcatttggaatggggatgtcaaaccgttgatggagttcgacgagtctaaaacagctattagtagtgatggtgatgcagatgagaatacaagcaagaaagtagagtgatacatgaaaattagcgttacaaaatacagttaattgcagtaggagaaactatggttttcctttttcgtttttaaattaatagcattgtaaccctaatcttttggttaacttatgctatagacttttcaagctca

SEQ ID NO: 3052 - DNA, 1104 bp, Ambrosia trifida
aaaaaaatactgttagttttctggtttttccttaaaccactagtttgacaatgaagagtggtgagcgagccgcaaatattgcactagcaggtctaacgctagcgccattagttgtgaaggttgtacccaaatataaatgttattttgactgcatgcctctcagtttttgtgggttgttaccgttctgtcaagccaacacctcctactgagacaatgtctaatgcacatgccatgcgttttcctctagtaggcagtgcaatgttgttgtctttgttcttgctctttaagttcctgtcaaaagaccttgtcaatgccgtcttgacttgctacttctttgtgcttggcatccttgcactctcggcaacactcttacctgcaattaggcggtttttacctaacaagtggaatgaagatgttattcattggagtttcccgtatttcaaatcactagatgttgagttcacaaggtctcaagtcgttgcagcaattcctgggacctttttctgtgtgtggtatgttgcacagaagcattggcttgctaacaatgttctcggacttgcattctgcattcagggaattgaaatgctttctcttggctcattcacaactggtgccattcttttggctggactctttttctatgatatattctgggtcttttttaccccagttatggtcagcgtagccaaatcatttgatgcacctataaagcttctattcccaacaggagttactgcccgtccattttctatgcttggtttaggtgacattgtaattccaggcatttttgtagcattggcgctgagatttgacgtatcaagagggagaaataaccaatacttcaagagtgctttcttgggatacgcagttggtgtggtgcttactattgttgtcatgaactggtttcaagctgcacagcctgctctattatatattgtaccagccgttattgggttcttggctgttcattgcatttggaatggggatgtcaaaccgttgttggagttcgatgagtctaaaacggctattggtagtgatggtgatgcagatgagaatacaagcaagaaagtagagtgatacatagaaaattagactttaacaaaa

SEQ ID NO: 3053 - DNA, 1547 bp, Eucalyptus grandis
gaccagggaacgactttccccaaaggttaaaccctatcgcgactctgcaaatatcgaattccccctctctctctctctctctcgccggcgggattcgtcgccgatctgcgcccgcacggatttgcagagggaacgcgatacggggatctctctcgccttcctcgttcgcatcggagcttttcgcggtgcgagaggctatctttgatcgttttcaactaggagctttaggataaagccagccgtcagcgtggtgcggatttgcgtgaattttgactgtcagcgtggtgtttggagaaggagatgaagaactgtgagcgcatcgcgaatgtagctttagcaggcttaactttggcacctcttgttgtcaaggtgaatccaaacttaaatgtcatcttgactgcatgcctcacagtttatgtgggttgctatcgatctgtcaagcctaccccaccttctgaaacaatgtccaatgaacatgccatgcgctttccatttgttggaagtgcaatgttgttgtcacttttcttgctgttcaagtttctttcaaaggatttggttaatgctgtattgacctcctacttttttgttctcgggatcgttgcactatcggcgacacttctacctgctattaaaagatacttgcctgaccactggaatgaggatgtcatcacatggcgttttccatattttcgctctttggagattgagttcactaggtctcaaattgttgctgcaattcctgggactttcttctgtgcttggtatgcttctaagaagcactggttggctaacaatatcctgggccttgcattttgcattcaggggattgagatgctttctcttggatctttcaaaacaggtgctatcctgctggctgggctttttgtctatgatatattttgggttttcttcactccagtgatggttagtgtagcaaaatcttttgatgctccgataaagcttttgttcccaacagctgatgctactcggccgttttccatgcttggtcttggtgacattgtaattcctggtatctttgttgcattagcattacgatttgatgtttctagagggaaagagagccagtactttaagagtgcattttttggatacatctctggcgtggtactgaccattattgtcatgaattggtttcaagccgctcagccagcattgctgtacattgtgcctgcggttataggatctttggctgctcattgcttatggaatggtgatgtgaaacagttgctggagtttgacgagtccaagacgtcggcatcgtcgcaagaagacgtggatgcaaaatctgggaaggcggaatgagggtaaacttgtttccagactctgtctggatagagaaggcatacaagttgtctttgtagagaacacagatgcctctttagctttattttggctaacttattcagccgcgcagcaagtgtaacagattttgaaattaaaggagaaataatattttagcatctcacagaaattcacagcttcttcattactttaaatctaaggattatgacatattttgtcagcga

SEQ ID NO: 3054 - DNA, 1350 bp, Flaveria ramosissima
acatatgcttcaaagctttgactaccgaagacacaacgtagacgtgaacaacactgcaaaaacctccgccggcgaactctccggccaccgtcgatcttctacttcctccgccgtctacggcgtcggaacgagtaacggacgtcgatccatcgatcgatcgatcgattcggtgtggttaactgatctgctcatcttctgattctgctttcagctagtttgcaataactgtgagtttgtctggttgtctcttgaacctacctagctttgacaatgaagagtggtgagcgagctgcaaatattgcactagcaggtctaacactagcacccctagttgtgaaggttgatccaaatataaatgtcattttgaccgcatgcctcacagtttttgtgggttgttatcgttctgtcaagccaacacctccttctgagacaatgtctaatgcccatgccatgcgtttccctttagttggcagtgcaatgttgttgtctttgttcttgctctttaagttcttgtctaaagatctggtcaatgctgtcttgacttgctacttctttgtgcttggcatccttgcactctcggcgacactcttacctgcaattaggcggtttttacctaccaagtggaatgaagatgttattcattggagtttcccgtattttaaatctttagatgttgaatttacaaggtctcaagtcgttgcagcaatccctgggacctttttttgtgtgtggtatgttgcacagaagcattggcttgctaacaatattttgggacttgcattctgcattcagggaattgaaatgctttctcttggctcattcaagactggtgccattctgttggctgggctctttttctatgatatattctgggtctttttcaccccagttatggtcagtgttgccaaatcatttgatgcacccataaagcttctattccctacaggagtcgctgcacgtccattttctatgcttggtttaggtgacattgtaattccaggcatttttgtagcattggcgctgagatttgatgtgtcaagagggagaaacaaccaatacttcaagagtgctttcttgggatatgcagttggtgtggtgcttactattgttgtcatgaactggtttcaagctgcacagcctgctctcttgtacattgtaccggctgttatcgggttcttggctgctcattgcatttggaatggggaggtcaaaccgttattggagtttgacgagtctaaaacggctattagcggtgatgctgatgcagatgagaatacaagcaagaaagtagagtgagatatgaaagtgtggtttaacaaaatacagtgatttgcagtaggagaaactatg

SEQ ID NO: 3055 - DNA, 1431 bp, Helianthus annuus
gactagacgaagacatacacgcatcaacacaacgaagaaatttgctaaaacctttgaactttgaagataaccaccatcgccggcgaacaactctccggcgaccgtcgattcgcagtttcttccgctctctacggtgattctgcgttcagctagcttgctaaaaaagaaagaaataaataaataactgtcagtttgtcttgttctctaccaaactcacttagttttgacaatgaagagtggagagcgagctgcaaatatcgcactagcaggtctaacgctagcaccattagttatgaaggttgacccaaatataaatgtcattttgactgcgtgcctcacagtttttgtgggttgttaccgttctgtcaagccaacacctcctactgaaacaatgtctaatgcacatgccatgcgttttcctctagttggcagtgcaatgttgttgtctttgttcttactctttaagttcctgtcaaaggacctggtcaatgccgtcttgacttgctacttctttgtgcttggcatcctcgcactctcggcgacactcttacctgcaatcaggcggtttttacctaccaagtggaacgaagatgttattcattggagtttcccgtattttaaatctctagatgttgagtttacaaggtctcaagtcgttgcagcaattcctgggacctttttctgtgtgtggtatgttgcacagaagcattggcttgctaacaatgttttgggacttgcattctgcattcagggaattgaaatgctttctcttggttcatttacaactggtgccattcttttggctggactctttttctatgatatattctgggtcttttttaccccagttatggttagcgtagccaaatcatttgatgcacctataaagcttctattcccaacaggagtcactgcacgtccattttctatgctcggtttaggtgacattgtaattccaggcatttttgtagcattggcactgagatttgacgtgtcaagaggaagaaataaccaatacttcacgagtgccttcttgggatatgcagttggtgtggtgcttactattgttgtcatgaactggtttcaagctgcacagcctgctctgttatatattgtaccagctgttattgggttcttggctgctcattgcatttggaatggggaggtcaaaccgttgttggagttcgacgagtctaaaacggctgttagtagtgatggcgatgcagatgagaatacaagcaagaaagtagaatgagatatgaaaattaggtttacaaaatacagttggagaaactatgtttttcctttttcttttttaaatgcttttttttaatagcattgtaaccctaatctttttggttaacttatgctagacttttcaagttcatgtttttctggcattgtaactctaatctttttggttaacttatg

SEQ ID NO: 3056 - DNA, 1277 bp, Manihot esculenta
aacaatgaagaacaatgaacgtctcgccaattttgctctggcaggtttaacattggcaccacttcttgtgaaggtagacccaaacttaaatgtcattttgactgcatgccttgcggtatatgttgggtgctaccgatcagtcaagccaactccaccttcagagacgatgtctaatgaacatgcaatgcgctttccctttgttggcagtgcaatgctattatcattgttcttactcttcaagtttctttcaaaagacttggttaatgctgtattgacctgctacttttttgtgcttggaatcattgctctttcggcaacattgttaccagccattaagcgatatttgccaaagcattggaatgatgatctgattacctggcattttccatattttcgttctttggagattgagttcacaagatctcagattgttgctgcaattccaggaacctttttttgtgcatggtatgcttctcagaagcattggctagctaacaatattttgggcttggctttctgtattcagggtattgaaatgctttcccttgggtcttttaagactggtgtcattctcctggctggactttttgtatatgatattttctgggttttcttcactcctgttatggttagtgttgcaaaatcatttgatgctcctataaagctgttgttcccaacagcagatgctaaacgtccattttccatgcttgggcttggtgatattgtaattcctggtattttcgtagctctggcattgcggtttgatgtgtccagaggaaaagacagccagtattttaagagtgcttttctaggatatacagttggtttggtccttactattgttgtcatgaactggttccaggctgcacagcctgcacttctctatattgtaccagctgtaataggattcttagcagctcatgtcatatggaatggtgaagtccaaccgttgttggaattcaacgaatcgaagagtgcttcatcatctcaagatagtagcgaaatcgactctgcaaaaaaggttgagtgaataaacatttgtagcgcatgatagaaatattgttgttttttcctatgaggttgaaatcctggctaacttaacttgtgcaacttgcacacagttgtaactgattttggaattaaggggaaaaaaaatataaatttgtagcttcttatagaagtatcgtattgggtttttggattttattttattttatttttattcttaaaaggcttcatgatttgcttaatgaagtctaaaaagcttattttgagag

SEQ ID NO: 3057 - DNA, 1383 bp, Gossypium hirsutum
atggggattcaatctgaaaaaaagaagaagaaagagaatgaaatcaaatctttagatttattcatttaattttctctcttttgctctcatttcctgcaactccgatctataaaattccatcgtttgttggaaagagcaagagaggaaaattaaatcaaagataaaacgattattagcaataaaggacgacaatgaagaactgtgaaagactcgctaatttagctttagcagggttgacattggcaccacttgttgtgaaggtggaccctaacttgaatgttattttgactgcatgcctagcagtatatgtgggctgctatcgttctgtcaagccaactccaccattggagacaatgtctaaagagcatgctatgcgttttccgttcattgggagtgcgatgctgttatcacttttcttactgttcaaattcttatcaaaagacttggttaatgcagtattgacatgctatttctttgtgctaggaactgttgccctttcggcaacaatattgcctgccatgaaacgcttcttgccaaagcattggaatgaggaccttatcatttggcgttttccatacttccgatctttggagattgagttcacaaggtctcagatcatagctgcaattcctggatcctttttctgtgcatggtacgcttcacagaagcattggctggctaataatattctgggtctcgctttctgcattcagggaattgaaatgctttctcttggatcttttaagactggcgccattctcttgactgggctttttgtatacgatatattatgggtttttttcactcccgtgatggttagtgttgcaaagtcttttgatgctcctataaagcttttgttcccaacagcagactctgcacgaccgttttccatgcttggacttggtgacattgtaattcctggtatttttgtagcgctagctttaagatttgatgcatctagggggaaagggagccagtattttaagagtgcattttctggatacacagtgggattggtccttacaattatcgtcatgaattggtttcaagctgcacagcctgcacttttgtatattgtaccagctgttatgggattcttggctcttcactgtatatggaacagagaagtcaaaccgttattggaatttgatgaatcaaatactgaaattaaatctcaagaaggcagcactgacgaatatagcaagaaggttgaatgaagttatagaaaggcaagccaaaccactctgaaactatatatatacacatatatatatagcttgaaaaggaaatagtgttttatttcttactgcaaaaccagattttggaattaaacaatattgttttcattttacaaaaattccaatttgcatagatgtttacgta

SEQ ID NO: 3058 - DNA, 1339 bp, Gossypium hirsutum
atttatttatttaatttttcttctcttttgtctctcatttcctgcatctccgatctataaaattccatcgtttgttggaaagagcaagagaggaaaattaaatcaaagataaaacgattattagcaataaaggacgacaatgaagaactgtgaaagactcgctaatttagctttagcagggttgacattggcaccacttgttgtgaaggtggaccctaacttgaatgttattttgactgcatgcctagcagtatatgtgggctgctatcgttctgtcaagccaactccaccatcggagacaatgtctaaagagcatgctatgcgttttccgttcattgggagtgcgatgctgttatcacttttcttactgttcaagttcttatcaaaagacttggttaatgcagtattgacatgctatttctttgtgctaggaactgttgccctttcggcaacaatattgcctgccatgaaacgcttcttgccaaagcattggaatgaggaccttatcatttggcgttttccatacttccgatctttggagattgagttcacaaggtctcagatcatagctgcaattcctggatcctttttctgtgcatggtacgcttcacagaagcattggctggctaataatattctgggtctcgctttctgcattcagggaattgaaatgctttctcttggatcttttaagattggtgccattctcttgactgggctttttgtatatgatatattctgggtttttttcactcccgtgatggttagtgttgcaaagtcttttgatgctcctataaagcttttgttcccaacaacagactctgcacgaccgttttccatgcttggacttggtgacattgtaattcctggtatttttgtagcgctagctttaagatttgatgcatctagggggaaagggagccagtattttaagagtgcattttctggatacacagtgggattggtccttacaattatcgtcatgaattggtttcaagctgcacagcctgcacttttgtatattgtaccagctgttatgggattcttggctcttcactgtatatggaatggagaagtcaaaccgttattggaatttgatgaatcaaatactgaagttaaatctcaagaaggcagcactgacgaatatagcaagaaggttgaatgaagttatagaaaggcaagccaaaccactctgaaactatatatatacacatatatatatagcttgaaaaggaaatagtgttttatttcttactgcaaaaccagattttggaattaaacaatattgttttcattttacaaaaattccaatttgcatagatgtttacgtattataaca

SEQ ID NO: 3059 - DNA, 1265 bp, Cucumis sativus
cctttccattcgtcgagttaaaccctaaatctgaaaattttgtgaaaaaaaataataataattccttctctttcttcggcgagctctccgatctgcgtggtcaaatccactcgaagtcttcgagccgccgatgattgagggagcaattgcgagacagttatcttagtttttttgccgattgatagtgttggttgaaaggtgtttaattaagaactgcccaacatgaagaacgccgagcgcattgcgaattttgctctagcgggattgacattagctccacttgttatgaaggttgatcccaatgtgaacgttgtgctgactgcttgtctaactgtctatgtgggctgttatcggtctgtgaaacccactccaccttcagagacaatgtccagtgaacacgccatgcgttttccctttgttgggagtgcaatgcttttatctcttttcttgcttttcaagtttctatcgaaggacttggttaatgcagtcttgacatgctacttttttgtgcttgggatccttgctctttcagcgactctgttgcctgctattaagcgatatctgccagaccattggaatgaagatgctatttcgtggcgttttccatatttccggtctttggagatcgagttcaccaggtcccaggttgttgcagcaattcccggaaccttcttttgtgcatggtatgctcttaagaaacactggctggctaacaatatcttgggccttgccttttgtatccagggaattgaaatgctctctcttggttcttttaagactggtgccatacttttggctggactgtttgtatacgatatcttctgggttttctttactcccgtgatggttagtgttgcaaaatcgtttgatgcacccataaagcttttgttccccaccgcagatgctgccagaccattttccatgcttggactaggtgacattgtcattcctggcatctttgttgcactggctcttcgatttgatgcatccaggggaaaagatggtcaatattttaagagtgcttttttgggatactcagttggtttggtccttaccataatagttatgaattggtttcaagctgctcagcctgcacttctgtatattgtgcctgctgtcattggatttttggctgctcatgtgatatggaatggagatgtgaaaccgttgttagagtttgacgaatcgaagacgggtattgcatctgaagatgggggtgaagatgataaaggaagcaagaaggaatgaatatggaaaaagatgga

SEQ ID NO: 3060 - DNA, 1634 bp, Glycine max
atttcttctttttttttattttctttttcccaaatcaatttctctctctctctctctctcgctctctgatctgttttgtttcaggagccacccgctcctgcagttttcttttgcggttggagtggaaggccattctcgcaacgtttgagttcagcagatccagaatttttcagaaaacaggtttaggagaatgaagaatacggaacgaattgccaatttggctttagcaggtttaaccttagcgcctcttgttgtgaaagtagatccgaatttaaatgttattttgactgcttccctcactgtgtttgtgggctgttaccgctccgttaaaccaaccccaccaactgagacaatgtccaatgaacatgccatgcgttttccctttgttgggagtgcaatgttattgtcactcttcttactcttcaagtttctatccaaggacttggtgaacactgtattgacaggctacttctttgtacttgggattgttgccctttcggcaacattattaccatttattaaacgttttctgccaaagcattggaatgaggacctcatagtctggcgttttccatatttccgttcattggagattgagtttacaaagtcacaggtcgttgctggaatccctgggacatttttttgtgcctggtatgctttgcagaagcattggctagcaaataatatattgggtcttgctttctgtattcagggaattgaaatgctttctcttgggtctttcaagactggtgctattctcttggctggtctatttgtgtatgacattttctgggttttcttcaccccagtgatggtcagcgttgcaaaatcatttgatgctccaataaagcttttgttccccacagcagattcagcaaggccattttcaatgcttggccttggtgatattgttatccctggtatttttgtagcattggctttgcgatttgatgtatctagaggaaaacagccccagtatttcaagagtgcatttgtaggatacactgttggcttggtccttacaattgttgtgatgaactggtttcaggctgcacagcctgctcttttgtatattgtaccttctgtaattggatttttggctgctcattgcttatggaatggtgatgtcaaacagttgttggagttcgatgagtcaaagactgccaattcacctcaagagagtgctgacgacaagtctagcaaaaaggttgaataagttgaagcatgcccaataccaatacttccgagtcacagaacaaatactgcttttttctgagaaaaccgtttcttttaaagctaacttatttcagcagcacacctctgtaactgattgtgattaaaaaaaaatgtattacttatttttcaaattggcgttttgcttttactggctgactgccccagtctgggtttccatagcaaactttctaagaattttcttctctcttgccagcactcgcagatgcacacacatgcaatttttttgtgctagtattactagttatgcctatgatgcttcttctggaagacttatgctctgcctgagtgagtgtaatactctttggaaaagacaaaaactaatgtatatctatgttgaaattgcatcaaatacaataataatcagccttagagaatga

SEQ ID NO: 3061 - DNA, 1375 bp, Cicer arietinum
tcatcctaatttctttcttgccttctccgatctgcaatcaacctcagcatttttctattgctaacaggaggttgaggcaagatttttgctttgagttctgaaagatgaaaaacaccgagagaattgcgaatttggctttagcaggtttaaccttagcacctcttgttgtgaaaatagatccaaatgtaaatgttatcttgactgcttgcgtcactgtgtttgtgggatgttaccgttctgtcaaaccaactccgcctgctgagacaatgtccaatgaacatgctatgcgttttccctttgttgggagcgcaatgttgttatcacttttcttgctcttcaagtttctatctaaggacttggtcaacactgtcttgactctctacttctttgtactggggattgttgccttgtcggcaacattactaccatctatcaaacgatttttgccaaagcattggaatgaggacctcatagtctggcactttccatatttccgctctttggagattgagtttacaaagtcacagatcgtcgctgcaatccctggaaccttttttgtggatggtatgctttacagaagcattggctggcaaataacatcttgggtcttgctttctgtatacagggaattgaaatgctctctcttgggtctttcaagactggtgctattctgttggttgggctctttttttacgacattttctgggttttcttcacgccagtgatggttagcgttgcaaaatcatttgatgctccaataaagcttttgttccccacatcagattctgcaaggccattttcgatgcttggacttggtgacattgtcatccctggtatctttgtagcattggccttgcgttttgatgtttctagaggaaaacagccccaatatttcaagagtgcatttttaggatacacttttggcttggccctcacaatagttgtgatgaactggtttcaggcagctcagcccgctcttttatatattgtacccgctgttattggatttttggctgctcattgcatatggaatggtgatgtcaaacagttattggagttcgacgaggcgaagacagccaaatcatctgaagaagagagtgacaaatctagcaaaaaggttgaatgaagtaatctcaataccaatacttttgagacatataacagtgttatacccctttacctgtaatactaaattattcagcaccaaacaatgtaatagatagattttgttattgagaaaaatattagtcttattttcagctcttgactaaggtttgttttagggtgaatgtttgtttctttacaaaatatgttgaaagcaacaaaattctataaaaaatttaaacaccccaggcttatagaggaagccatctct

SEQ ID NO: 3062 - DNA, 1453 bp, Cirsium arvense
ttaccatcagagacgagcagccggagaaaagggggaaaaattgctttggaaccaccgccggccgccggaactccgatttatctattgctttctctccgttgaaggtgcgagagaggaacagatcgtgaggattttggatcgatcgatcgatttgaggtctgtcagtcagtcgattaacagcagcttgatttgttgtgtttcgttttagtttgaggccgtaggttccgcttccaactagtgagcaaagacacttgttatctggattttttctgaatcattgatttgtagttgtgacgatgaagaatggtgagcgtgccgcaaacattgctctagcaggtctaacactggcgccattatttgtgaaggtggatacaaatataaatgttgtattgacggcatgcctcactgtttttgtgggttgctaccgctctgtcaagccaacacctcctactgagacaatgtctaatgaacatgccatgcgttttcccttggttggcagtgcaatgttattgtccttgttcttgctctttaagttcctatcgaaagatctggttaatgcagtattgacgtgctacttctttatacttgggatcatcgctctttcggctacacttttaccagcaattgggcggtttctacctaaaaagtggaatgaagacgttataatatggcgattcccatacttccgctctttggaggttgagttcacaaggtctcaagttgttgctgccattcctggtacctttttttgtgcatggtatgctgcacagaagcattggctggctaacaatatattgggccttgcattctgcattcagggaatcgaaatgctgtctcttggctctttcaagactggtgccattctgttgtctggactttttgtatatgatatattctgggtctttttcacaccagtgatggtcagcgttgctaaatcctttgatgcacctatcaagcttctattcccatcaagaattgaaacacgccccttttccatgcttggtctaggagacattgtcattccaggcatttttgtagctttggctcttcgattcgatgtgtcaagagggaaagagagccactacttcaaaagtgcttttatgggatacacagctggcttggtccttacaattgttgtcatgaactggtttcaagctgcacagccggctctactatacatcgtgccaggggttattgggttcttggctgttcattgcctatggaacggagaggtcaaaccgttactggagtttgatgagtcaaaaacagcagtagcagaagaggaaacaagcagcagcaagaaattggagtgaaaaggaaggaggatataatagttgtttactttagggtgaagttttgatcatcttttaacttatgcaaagatatttactagattttgctatcatcattttagacattttaatattttaacttctcatgcttttacttcaca

SEQ ID NO: 3063 - DNA, 1455 bp, Phaseolus vulgaris
gccaagataccttgattttggttctgacctctgtaacttctctctcccattctcacggtaaatcttaaaaccctaacccttctgcaatacttttttatttccatttcccagatcaatttctctgtctatctttcttcgatctgctttggtactggggccaaccgctcctgcaattcccttttgcgattggagtggaggccattatcgcaacatctgagttcattagatccaaaattgttcagaaaagaggtcaaggaggatgaagaaaaccgaacgaattgcgaatttggctttaacaggtttaaccttagcaccgcttgttgtgaaagtagatccgaatttaaatgttattctgactgcttgcctcactgtgttcgtgggatgttaccgctctgtcaaaccaaccccaccaactgagacaatgtcgaatgaacatgccatgcgttttccctttgttgggagtgcgatgttattgtcacttttcttactcttcaagtttctatccaaggacttggtgaacactgtattgacaggctacttctttgtacttgggattgttgcgctttcggcaacaatattaccgtttattaaacgttttctgccaaagaattggaatgaggacaccatagtctggcgatttccatatttccgatctttggagattgagtttacaaggtcacaggtcgttgctggaatccctgggacatttttttgtgcttggtatgctttgcggaagcattggctggcaaataatatattgggtcttgctttctgtattcagggaattgaaatgctttctcttgggtctttcaagactggtgctattctcttggctggtctatttgtatatgacatattctgggttttcttcacgccagttatggtcagcgttgcaaaatcatttgatgctccaataaagcttttgttccccacagcagattctgtaaggccattttcaatgcttggacttggtgatattgttatccctggtatttttgtagcactggctttgcggtttgatgtgtccagaggcaaacagccccaatatttcaagagtgcatttgtaggatacactgttggcttggtccttacaattattgtgatgaactggtttcaggctgcacagcctgctcttttgtatattgtaccttctgtaattggattcttggctgctcattgcatatggaatggtgatgtcaaacagttgttggagttcgatgagtcaaaggctgccaattcacctgaagaggatgacaagtctagcaaaaaggttgaataagttgaagcttaccaatacttcctagtcagagaagaaatactgttttttttttcttctgaaaacaccgttacattaaaagctaacttattcagcagcacccctctgtaactgattgtgattttaaaaaaatatattagttttatttttcaaattggtattttgcttctgttctcggt

SEQ ID NO: 3064 - DNA, 1302 bp, Phaseolus vulgaris
gtctatctttcttcgatctgctttggtactggggccaaccgctcctgcaattcccttttgcgattggagtggaggccattatcgcaacatctgagttcattagatccaaaattgttcagaaaagaggtcaaggaggatgaagaaaaccgaacgaattgcgaatttggctttaacaggtttaaccttagcaccgcttgttgtgaaagtagatccgaatttaaatgttattctgactgcttgcctcactgtgttcgtgggatgttaccgctctgtcaaaccaaccccaccaactgagacaatgtcgaatgaacatgccatgcgttttccctttgttgggagtgcgatgttattgtcacttttcttactcttcaagtttctatccaaggacttggtgaacactgtattgacaggctacttctttgtacttgggattgttgcgctttcggcaacaatattaccgtttattaaacgttttctgccaaagaattggaatgaggacaccatagtctggcgatttccatatttccgatctttggagattgagtttacaaggtcacaggtcgttgctggaatccctgggacatttttttgtgcttggtatgctttgcggaagcattggctggcaaataatatattgggtcttgctttctgtattcagggaattgaaatgctttctcttgggtctttcaagactggtgctattctcttggctggtctatttgtatatgacatattctgggttttcttcacgccagttatggtcagcgttgcaaaatcatttgatgctccaataaagcttttgttccccacagcagattctgtaaggccattttcaatgcttggacttggtgatattgttatccctggtatttttgtagcactggctttgcggtttgatgtgtccagaggcaaacagccccaatatttcaagagtgcatttgtaggatacactgttggcttggtccttacaattattgtgatgaactggtttcaggctgcacagcctgctcttttgtatattgtaccttctgtaattggattcttggctgctcattgcatatggaatggtgatgtcaaacagttgttggagttcgatgagtcaaaggctgccaattcacctgaagaggatgacaagtctagcaaaaaggttgaataagttgaagcttaccaatacttcctagtcagagaagaaatactgttttttttttcttctgaaaacaccgttacattaaaagctaacttattcagcagcacccctctgtaactgattgtgattttaaaaaaatatattagttttatttt

SEQ ID NO: 3065 - DNA, 1265 bp, Taraxacum officinale
cggagacgtacaggagaaaggaggaaatttgctaaaacctccgcaaccaccatcgccggcctaccctcggcgatcggcgattttcaatttcttctgtggtcggaggaaagagaaataaacttcgagagggtcgtcgatcgatcaatcgatctagtccatctatcctatctactagccgtttctggtgatactgttaatttcggaacttaattttgacaatgaagaatgccgagcgagctgcaaatattgctctagcaggtttaacacttgcaccactggttgtgaaggtagacccaaatgtaaatgtcatcttgactgcctgcctcacagtttttgtgggttgttaccgatctgtcaagccaacacctccttctgagacaatgtctaatgaacatgcgatgaggttccctttagttggcagtgcaatgctgttatctttgttcttgctctttaagttcctgtcaaaagacttggtcaatgctgtcctcacttgctacttctttgttcttggcatcatcgccctttcggcaacactcttaccagcaatcaggcggtttttgccaactaaatggaatgaagatgttataacttggcaatttccctatttccgctctttggatgttgagttcacaaggtctcaagtgattgctggaattcccgggacctttttttgtgtgtggtatgttgcacagaagcattggctggctaacaatattttgggacttgctttctgcattcagggaattgagatgctttcacttggctcatttaagactggtgctattcttttggctggactgttcttttatgatatattttgggtcttttttacccctgtgatggttagcgttgccaaatcatttgatgcacctataaagcttctatttccaacaagagatgctgtacgcccattttctatgcttggtttaggtgacattgtaattccaggtatatttgtagcattggcactgagatttgatgtgtcaagagggcaaaagagtcaatacttcaagagtgctttcttgggatatgcagttggtgtggttcttacaattgttgtcatgaactggtttcaagctgcacagcccgctttgttatacattgtaccatcagttatcggattcttgggtgctcattgcatatggaatggggaggttaaaccgttattggaatttgacgaatcaaaaacagttgatggtgatggtgaagttgatgaaaaaaacagcaagaaaatagagtgagagtgagagattagagtctggttt

SEQ ID NO: 3066 - DNA, 1510 bp, Tropaeolum majus
acaaatatcaaaatctgattcaaacttctttctctctctagaaaaaaaacaatcgattcactggtcaaaattgtttatctgttttcttgttcatgatctgtgtgttgaacagctgttagtgagagaaaaaggagaaagatctcctctttcgccttcctcttttaggtttttcgtttgcaagttgggccgttttgaggaacacttggtggaaattttcacttcaaattggccgcagcattattgcttgattctgttggcgttaaggtggatagggaacaatgaaaaactacgagaggattgcgaattttgctttagctggtttatcattggcaccactagttgttaacgtaaacccaaacttaaatgttattctgacagcatgtctcacagtctttgttggttgctaccgatctgttaagccaactccaccatctgagactatgtctaatgaacatgctatgcgcttcccctttgttggaagtgcaatgctattatcacttttcttactgttcaagtttctatctaaagacttggttaatgctgtacttaccagttacttcttcgtgcttgggatcatagctttttcggcaaccttgttaccttctattaaagattcttgccaaatcattggaacgatgaggctgtcgtatggcgcttcccttatttccgttctgtggagatcgagttcacaaggtctcagcttgttgcagcaatcccagggacctttttctgtgcatggtatgcttggaagaagcattggttggctaataacattttgggccttgctttctgtattcagggaattgaaatgctttcacttggttcttttaaaactggtgccattcttttgggtggactttttgtgtatgatattttctgggtttttttcactcctgtgatggttagtgttgcaaagtcttttgatgctccaatcaagctattgtttccaacagcagatgctgcacgaccgttttctatgctgggacttggtgacattgtgatccctggtatattcgtcgcattagcattgcgatttgatgtttcgagaggaaaagaagatggccagtatttcaagagtgcgtttttgggttacggatttggtgtagtcctcacaatagttgtcatgaactggtttcaagcagcacagcctgcactgttgtatatcgtaccagctgtgatcgggttattggccgctcattgtttctggaatggagatgtcaagccgttgttggaattcgacgagtcgaagactgccggtacatcggaagaaagtaacgatgagaaaacgagcaagaaggaggaatgagttgaaagagaagcagtagtaggatacatgactattataactgaaggtgaaaagcaaagaaaaagcacacttttttttagcgaaggtatttgccgaaatgatttaaacttgaattttggcgtaacgcagtgcaacggatacaagtgtaactttttaattgagttgagcataatgtaccactagtcactcttttataatgatatt

SEQ ID NO: 3067 - DNA, 1518 bp, Medicago truncatula
gagtttagtttaccattctctttgacctttgactctctcgctagtaaaaattcaaaaccctaatttaatcatattcccccaattctatctttctccgatctgctgcaattcttctcccgcgattgcagcggaggccaatctcgcacactagatccatcatttttgtaacgcgaaatgaagaacacggaacgaattgctaatttggctttattaggattaaccttagcaccgcttgttttgaaagtagatccaaatttaaatgttgttttaactgcttgcatcactgtgtttgtcggatgttaccgatccgttaaaccaaccgcaccaacggagacaatgtccaaggaacatgctatgcgttttccctttgttggaagtgcaatgctattatcacttttcttactatttaagtttctatctaaggacttggtgaacactgtcttgacaggctacttctttgtactcggcattgttgcactttcggcaacattattgccatctattaaacgctttctgccaaaccattggaatgatgatctcatagtctggcgttttccatattttcgatccgtcgagattgagtttacaaggtcacagatcgttgctgcagtccctggcacttttttttgtgcctggtatgctctgcgcaagcattggctggcaaataatatattgggtcttgctttctgtatccagggaattgaaatgctttcccttggctccttcaagactggtgccattctcttggctggtctttttgtatatgacattttctgggttttcttcactcctgtgatggtcagcgttgcaaaatcatttgatgctccaattaagcttttgttccccacagcagattctgcaaggccattttcaatgcttgggcttggtgatattgttatcccaggtatttttgtggcattggctttgcggtttgatgtgtctagaggaagaaagccccagtatttcaagagtgcatttttaggatacacgtttggcttggttcttacaattgttgtgatgaactggtttcaggctgcacagcctgctcttttgtatattgtacctgcggtaattggatttttggcggcccattgcatctggaatggtgaagttaaacagttgttggagttcgacgagtcaaagactgccgattcatctcaagaagagagtgatgccaagtctagcaaaaaggatgaatgagttgaagcatgtccaataccgatgcttctgattcactgaagaaatactgttactttctgagaattcggatacttaagctaacttattcagcagcacacctctgtaacagactgtgattagtgaaaaaaaatagtcttatttttcatattggcaatttgcttttgctcgttgactgcccgatctgggtttccatagcaaacttttctaatggttttctcaccacccccctctctcggtactatacgtgcttgcacataaatacgtgcttgcacataaatggttatttttacacaatattgacatggttggttagtattg

SEQ ID NO: 3068 - DNA, 1772 bp, Cucumis melo
gtgaaaaaaataaaataattccttctctttcttcggcgagctctccgatctgcgtggtcaaatccactcgaagtcttcgagccgccgatgattgagggagcaattgcgagacaattatcttagttattttgcggattgatagtgctggttgaaaggtgtttaattaagaactgcccaacatgaagaacgccgagcgcattgcgaattttgctctagcgggattgactctagctccacttgttatgaaggttgatcctaatgtgaacgttgttctgactgcttgtctaactgtctatgtgggctgttatcggtctgtgaaacccactccaccttccgagacaatgtccagtgaacacgccatgcgttttccctttgttgggagtgcaatgcttttatctcttttcttgcttttcaagtttctatcgaaggacttggttaatgcagtcttgacatgctacttttttgtgcttgggatccttgctctttcagcgactctgttgcctgctattaagcgatatctgccagaccattggaatgaagatgctattgtgtggcgttttccatatttccgggctttggagatcgagttcaccaggtcccaggttgttgcagcaattcctggaaccttcttttgtgcatggtatgctctgaagaaacactggctggctaacaatatcttgggccttgccttttgtatccagggaattgaaatgctctctcttggttcttttaagactggtgccatacttttggctggactgtttgtatacgatatcttctgggttttctttactccagtgatggttagtgttgcaaaatcgtttgatgcacccataaagcttttgttccccaccgcagatgccgccagaccattttccatgcttggactaggtgacattgtcattcctggcatctttgttgcactggctcttcgatttgatgcatccagaggaaaagatggtcaatattttaagagtgcatttttgggatactcagttggtttggtcctcacaataatagtgatgaattggtttcaagctgctcagcctgcacttctgtacattgtgcctgctgttattggatttttggctgctcatgtcatatggaatggggatgtgaaaccgttgttagagtttgacgagtcgaagacgggtattgcatctgaaggtgggggtgaagatgataaaggaagcaagaaggaatgaatatggaaaaaggtggatggggtggtggggaggcataattttccaggtgatgaggccaagcaaatgtgcgttgtttgtatgagagataccaagatcatcatcattcatcttatccccaattctcatccctcttttaagttaaagaaaaaaaattgggctaatttatgtgcaaaaactttgcctacagttgtatccaaacaaacaaacagattttgaaatgaggtagcaccaagtcaagtcctgtccctgtcctctttttagctctcttagttttcacctcatcagaagcttttatttcaactttgccccatttgcttggggtttttatagcaaatttaaatattttataaaggccctccatcgtctttccttcttcagcttctatttttttgatcattcatgtttagtcgcgacatttttatttcttttgttatattaaatgggagtttggacccacaactacaaaactatagataggttactaatattcattgttcagtcatattttaattctaactactgataatgctcggcaatttgaaatgatcgaaactatgtcttgtgagg

SEQ ID NO: 3069 - DNA, 1589 bp, Populus trichocarpa
ttttatttctctctctctaaaaaaacccctctctctctaggcatctccgatctgtatctctagtaaccgttagaaagagagcctcttcaggtttttttttatggtaaagaggcaataggtttttttcaattgatcgctgaagtgttgtaattagcttataatctgtctccaattagaatacaaacatgaagaattgcgaaagaattgccaattttgctttagcaggtttaacattggcaccactttttgtgaaggtagatccaaacttaaatgtgatcttgactgcatgcctggcagtttatgtcggttgctatcgatctgtcaagcctaccccaccttcagagaccatgtctaatgaacatgcaatgcgctttccctttgtcggaagtgctatgctgttatcattattcttactcttcaagtttctttcaaaagatttggttaatgctgttctgacttgttacttttttgtgcttggaatcgtcgcactttcggcaacacttttaccagctataaaacgttatttgcctaagcattggaatgatgatgtcatttcttggaattttccatacttccgttctttggatattgagttcacaagatctcaaattgttgcggctattcctggaacattcttttgtgcttggtatgcttcccaaaagcattggctggccaacaatattttgggcttggctttctgtatccaggggattgaaatgctttcccttggttcttttaagactggtgccatcctcttggctggactttttgtatatgacattttctgggttttcttcactcctgtgatggttagcgtggcaaaatcttttgatgcacctattaagcttttgttccccacagctgatgctgcgagaccattttccatgcttggacttggtgacattgtgattcctggtatttttgtagctctggcattgcgatttgatgtgtccaggggaaaagacagccagtactttaagagtgcttttcttggatatgcagctggtttggtccttacaattattgtcatgaactggttccaagctgctcagcctgcgcttttgtatattgtaccagctgttataggattcttagctgctcacgtcctatggaatggggaagtcaagccattaatggagtttgatgagtccaagactgctgtgtcatctcaagaagatagtggaaccagctctagcaaaaaggtggaatgatgggaaaaagaaaacctcagatactgaaacttagtgtcagggaagaaatatgtttattttcattgaggacatagaatgctacaactctcaacctttttgccaacttatgcaacttgcacaccagtgtaacaggttttggaattttagccaaaaaaaaaaaaaattagtctcacatcaggaccattttagaccgtcagttttttttttttttttttaattcttaagcctccatgattttacttgagaagtcttcttgcgaggaaaggcttgtgtggtgatcagataaacccctctgaaatgagatatcatcttggtagtgtggaccaaatggtttcaccgctagctcatcaagtgaattgggaatgtgattaatttgtc

SEQ ID NO: 3070 - DNA, 1556 bp, Glycine max
cacatcatcgattaaaattcaggtaaaaagtaaaaattaaaaatctggatgtgttagaaaacaaaaccctaacacgttcaattctgaaaaaaaaataaatcacaatccctttcttttcctctctgatctgcaaacacatttcaagagaacgtttttgttgttgcgcccaatcggtgttgcatttttcttttgcagagaggaggggaagtctttatttgtgagatttttcttaggaagatgaaaaacacggagaggattgcaaatttggccgtagcaggtttaactttagccccgcttattgtgaaagtagattcaaatgtaaatgttatcttgactgcttgcctcaccgtgtatgtgggatgttatcgttctgtcaaaccaacaccacctactgagacaatgtccaatgaacatgcaatgcgtttcccctttgttgggagtgcaatgttattatcacttttcttgctcttcaagtttctatctaaggatttggtcaatgctgtgttgactggttacttctttttactagggattgtcgctctatcggcaacattattatcatctgtcaaacgttttttgccaaagcattggaatgaggaccccatagtctggcgttttccatattttcgttctttggagattgagtttacaaagtcgcagatcgttgctgcaatccctggaacctttttttgtgcgtggtatgccttgcggaagcattggctagcaaataatatattgggtcttgctttctgtatacagggaattgaaatgctctctcttgggtctttcaagactggtgctattctcttggctggactctttgtttatgacattttctgggttttcttcactccagtgatggtcagcgttgcaaaatcatttgatgctccaataaagcttttgttccccaccgcagattctgcaaggccattttcaatgcttggacttggtgacattgttatccctggtatctttgtagctttggccttgcggtttgatgtttctagaggaaaacagccccagtatttcaagagtgcatttttaggatacactgttggcttggtccttacaatcattgtgatgaactggttccaagctgctcagcctgcccttctatacattgtaccttctgttattgggtttttagctgctcattgcatatggaatggtgacgtcaaacagttattggagtttgacgagtccaagactgccaaatcatctcaagaggagggtgatgccaaatctagcaaaaaggttgaataagtcgaagccagttcaataccaatacttttgagtcatagaagaaacatttggttttctaggaacccccattacctgtaatgctatgttattcagcggcaacgtctgtaaagattttgattaagaaaactaactagccttattttcagtgtaggattttgcttttacttctgaagtttgtttttatggcaaactattttggcattttaaaaaaagaaaaatttcactgccgtgtaacatggtatgtgggactaatttaaataagtttgcagaggaaggcatgcttgtttggttca

SEQ ID NO: 3071 - DNA, 1277 bp, Trigonella foenum-graecum
tttctacgttgtcttctccgatctgtaacaatcgtttgggcatttttgttttgcgaaaagggtgaagcaagatgaaaaacattgagaggattgcgaatttggctttagctggtttaaccttagcacctcttgttgtgaagatagatccaaatgtaaatgttatcttgactgcttgcatcactgtgtttgtgggatgctatcgttccgtcaaaccaactcctcctactgagacaatgtccaacgaacatgccatgcgttttccctttgttgggagcgcaatgttattatcacttttcttgctcttcaagtttctatctaaggacttggtcaacactgtcttgacactatacttctttgtactggggattgttgccttgtcggcaacattactaccatctatcaaacgatttttgccaaagccttggaatgatgatctcatagtctggcgttttccatattttcgttctttggagattgagtttacaaagtcacagatcattgctgcaatccctggaacctttttttgtggatggtatgctttacagaagcattggttggcaaataatatattgggtcttgctttctgtattcagggaattgaaatgctctctcttgggtctttcaagactggtgctattctgttggttggactctttttttatgacattttctgggttttcttcacaccagtgatggttagcgttgcaaaatcatttgatgctccaataaagcttttgttccccacagcagatgctaaaaggccattttcgatgcttggacttggtgatattgttatccctggtatctttgtagcattggccttgcgttttgatgtttctagaggaaggcaaccccaatatttcaagagtgcatttttaggatacactgttggcttggccctcacaatagttgtgatgaactggtttaaggctgctcagcccgcacttttatatattgtacctgctgttattggatttttggctgttcactgcatctggaacggtgacgtcaaacagttattggagtttgatgagtcgaagacggctaaatcatctgaagaagagagcgatggcaaatctagcgaaaaggttgaatcaactggagaagagagtgatgccaaatctagcaaaaaggatgagtaaagccctttcaatacaaatacttttttgagtcatagaatacctcattacctgtaatagtaataacttattcagcaccaaatactgtgatagattttgttattgagaaaaattattagtcttattttcggcacttga

SEQ ID NO: 3072 - DNA, 1427 bp, Cirsium arvense
aaccaccgccgccggcgaactctccggcgactgtcgaattctcatcgtcttccgccattgaaggaggaaatagaaggagaattggagaagttcgtggatcgattaatcgatcaatcgatctagttcattcaacgattctaatcgtattgaagtctgatttgtggtgtttcagtgaaattaagattctgcttctaactagcgagcagaacatcgtgagtttgtttggatcttactgaaatcacctagttgacaatgaagagtggtgagagagctgcaaatatcgctctagcaggtctaacgctagcaccgctagttttgaaggtagacccaaatataaatgtcatcttgactgcatgcctcacggtttttgtgggttgttaccgctctgtcaagccaacacctccttctgagacaatgtctaatgaacatgccatgcgtttccctctagttggcagtgcgatgctcttgtctttgttcttgctctttaagttcctgtcaaaagacttggttaatgctgtcctgacagcctatttctttgtgcttggcatccttgccctttcggcgacactcttacctgcaataacgcggtttttacctaccaagtggaatgaagatgttataacttggcatttcccgcgttttcgctctttggacgtcgagttcacaaggtcgcaagttgttgctgcgattcctgggacctttttttgtgtttggtatgttgcacaaaagcattggctggctaacaatattttgggacttgcattttgcattcagggaattgaaatgctttctcttggttcattcaagaccggtgctattctgttgactggactttttgtgtatgatatattctgggtcttttttaccccagtgatggtcagcgttgccaaatcttttgatgcacctataaagcttctattcccgacaagggatgccgtacgtccattttctatgcttggtttaggtgacattgtaattccaggcatttttgtagccttggcactgagatttgacgtatcaagaggaagaacgagccactacttcaagagcgctttcttgggttatgcagttggcgtaatccttacaattatcgtcatgaactggttccaagctgcacagccggctttgttatacatcgtaccagcggtaattgggttcttggctgctcattgcatatggaatggggaggtcaaaccgttattggagtttgacgaatctaaatcggctattgccgataccgatgtagacgagaaaacgagcaagatagagtaagatcaagagatagaaagtctggtttagatgttcacaatagaggaaatacggtttcgtttgtttttcgttcatacttgttctcctgtgacgttttcgctcccatcttggtaacttatggcgatagatgttccaaatcgattctacattcaaaaaga

SEQ ID NO: 3073 - DNA, 1475 bp, Orobanche aegyptiaca
tgaattctgcagtgtgcaaatcctaaaacccttgctcttgctgtgtgtgcaaattacacacactgagggtgttactgatctgcgtgttctacactgaggattggcgtacggtgagaggaaaaagggaaggccatcgatttcttctcgcttgaaggaattttgagttcaatttcagaaataccaggatttagaatgaagaacaatgagcgtcttgctaatttggctctggcaggtttgtccctggccccacttgttgtgaaggtagacccaaatttgaatgtcattttgacggcttgtctaactgtctatgtgggttgctatcgttctgttaagccaactccaccatcagagacaatgtccaatgaacatgccatgcgatttccttttgttggaagcgctatgttgatgtcactgtttttgcttttcaaattcgtatcaaaagacttggttaatgctgttttaacgtgctactttttcgttcttgggattgccgccctttcggcaacattgctacccgcaattaaacgattcttgcccataccatggaatgataatctcattatatggcgtttcccatacttccggtctttggaggtcgagtttacgaagtcacaaatcgttgctgctattcctggaaccttcttttgtgtttggtatgctttacagaagcactggctagctaacaatatcttgggtctggctttctgtattcagggaattgaaatgctttcactcggttcattcaagactggtgctattctcttgtcggggctttttgtatatgacatattctgggtttttttcactccagttatggttagcgttgctaaatcttttgatgctccaataaagcttttattccctacagcaaatgctgcacgtccattctctatgttgggacttggtgatatagtgattcccggaatctttgtagcattggcactaagatttgatgtcgccagagggaaagagagtcaatattttaagagcgcttttgtaggatatacagttggtttagccgcgacaatcgtcgtcatgaactggtttaaagctgcacagcctgcgctgttatatatcgtgcccggtgttattgggtttttggctgcacattgcatttggaatggagaagtcaaatctctactggcgttcaacgaatctaaaacaagtagttctgaagaaactgatgcagactcgaacacgaaagcagattgaaattaattcgtatattgagccgaataattacaatttacatgcaaaaaaaaaatgttgaggacatcaaaaaaggctttattagtcacaaattgttgtaccagattttggtcattagtaaaaaagaattattagcctttttaccaagctgatgtttaggttttctgaaattgatactcgtaatcagatgattgatgtgattcctacttggtttcagaacatacgtcactcattttgctaatgttaatagtagtattaatttaaac

SEQ ID NO: 3074 - DNA, 2335 bp, Lippia dulcis
ataaactaaaaccctttctctctgtatgtgtgtggaaattacacacattataggtgctcccgatccgtgaattcaatattgaagattggtgtacggggagggataagacgcagtcccgtcagtttcttcttgtttgaagtttccttggattaaaaaatcaaggagagttccaattagaagatttagaatgaagaataatgagcgtctcgccaatttggccctagcaggtttgaccctagccccacttgttgtgaaagtagacccaaatttaaatgtcattttgacagcatgtttgactgtctatgttgggtgccatcgctctgttaagccaactccaccatcggagacgatgtccaacgaacatgccatgcgatttccattggttgggagcgccatgttgctgtcgctgtttttgcttttcaaatttctatcaaaagacttggttaatgctgtattgacgtgctacttttttgtactcgggatctttgctctttcggcaacattgcttcctgcaatcaaaaggttcttgcctgatacatggaatgataacctcattatatggcgtttcccatatttccgatctttagaggtggagtttacaaaatcacagattattgcttcaattcctgggaccttcttttgtgtgtggtatgcttcaaaaaaacattggctggctaataatatactgggacttgcattctgcattcagggaattgaaatgctttcacttggctcatttaagactggtgctattctgttggctgggctttttgtatatgacatattctgggtcttttttaccccagttatggttagtgtagctaaatcttttgatgctccaataaagcttttgttcccaacagcagattctgcacggccattttcgatgttaggacttggtgatatagtaattcctggaattttcgttgcactggcactaagatttgatgtttccagagggaaagagagccattattttaagagtgcttttgtaggatatacagctggtttggttgccacaatcattgtaatgaactggttccaagctgcacagcctgctctgctgtatatcgtgcctggtgtcattggatttttggctgcacattgcctatggaatggggaagtcaagcctttattagcatttgatgaggctaaaactagcagctctgaagcaactgaagcagcagactcgaacaagaaagcagactgagacctttgatttggtagattgaagcaaagtagtcaaatttacttagaaatatgaaaagctgtttttagcagttgactaacttgtgcaccacagattgttgtaccagattttggtgattatcgaaaacaatattattggtttctgcagatgaagccattatcataacatagtaatgtcgcagattcttcagtttcgactcgtttcgtgtaatgaaagaaaaacatatatagtttcaagaaatgtttattacattcaaatttcatgaatttcctaagctgttgctgcttcaaccaggactttatacagctcggaaggagtggagaagaaagggctgtgatcgctttccagagccacgacttttgatggcctccactgctctatcatgttatcatggctctcctgtgtcatgaaatcgtccttcatagtccttacataaatacgttttatggtatcaactttagaattttcactgaaatgcgagccgaacatcatcgcccaaattgggtgcggtcgcaacagcatcgaagccagtgtcgaatcctcaacgggggtcaaattatacaaaagctttctctgacattcaggttttattatcaggcttgccggaatcgggatcagtcccaaatgctgccagaagaacttgtagcagtcgaggtggggtattatctgtttttcctgatactcatagctctcttgtcgagaaagcccgatcccgatgccattcctcaacataattgctgcaatgtaaacagctgactggattttgtcggggaacctgtgcaagatgtccgtaatgttgagtcctccagcgctgtgtcccaccaatattaccttctcgtcggcaggaagatgagagaagaaggaaataaggggctcgttgaaatccggcaaactgaaaatggtgtttggaccagtgagattgatgccctgacctttaaggtcgatgcaagtaactttctgtccatctttttccaacagacttcttatcttgtaccagcaccaagaaccatggccggcgcctgcaacgaacacgaagtgatgattcgccattgaagttgttatttattgatcttttctttctcaggcttagatattatattgtgtatgaattatgatcgacatata

SEQ ID NO: 3075 - DNA, 2342 bp, Lippia dulcis
aagaagaataaactaaaaccctttctctctgtatgtgtgtggaaattacacacattataggtgctcccgatccgtgaattcaatattgaagattggtgtacggggagggataagacgcagtcccgtcagtttcttcttgtttgaagtttccttggattaaaaaatcaaggagagttccaattagaagatttagaatgaagaataatgagcgtctcgccaatttggccctagcaggtttgaccctagccccacttgttgtgaaagtagacccaaatttaaatgtcattttgacagcatgtttgactgtctatgttgggtgccatcgctctgttaagccaactccaccatcggagacgatgtccaacgaacatgccatgcgatttccattggttgggagcgccatgttgctgtcgctgtttttgcttttcaaatttctatcaaaagacttggttaatgctgtattgacgtgctacttttttgtactcgggatctttgctctttcggcaacattgcttcctgcaatcaaaaggttcttgcctgatacatggaatgataacctcattatatggcgtttcccatatttccgatctttagaggtggagtttacaaaatcacagattattgcttcaattcctgggaccttcttttgtgtgtggtatgcttcaaaaaaacattggctggctaataatatactgggacttgcattctgcattcagggaattgaaatgctttcacttggctcatttaagactggtgctattctgttggctgggctttttgtatatgacatattctgggtcttttttaccccagttatggttagtgtagctaaatcttttgatgctccaataaagcttttgttcccaacagcagattctgcacggccattttcgatgttaggacttggtgatatagtaattcctggaattttcgttgcactggcactaagatttgatgtttccagagggaaagagagccattattttaagagtgcttttgtaggatatacagctggtttggttgccacaatcattgtaatgaactggttccaagctgcacagcctgctctgctgtatatcgtgcctggtgtcattggatttttggctgcacattgcctatggaatggggaagtcaagcctttattagcatttgatgaggctaaaactagcagctctgaagcaactgaagcagcagactcgaacaagaaagcagactgagacctttgatttggtagattgaagcaaagtagtcaaatttacttagaaatatgaaaagctgtttttagcagttgactaacttgtgcaccacagattgttgtaccagattttggtgattatcgaaaacaatattattggtttctgcagatgaagccattatcataacatagtaatgtcgcagattcttcagtttcgactcgtttcgtgtaatgaaagaaaaacatatatagtttcaagaaatgtttattacattcaaatttcatgaatttcctaagctgttgctgcttcaaccaggactttatacagctcggaaggagtggagaagaaagggctgtgatcgctttccagagccacgacttttgatggcctccactgctctatcatgttatcatggctctcctgtgtcatgaaatcgtccttcatagtccttacataaatacgttttatggtatcaactttagaattttcactgaaatgcgagccgaacatcatcgcccaaattgggtgcggtcgcaacagcatcgaagccagtgtcgaatcctcaacgggggtcaaattatacaaaagctttctctgacattcaggttttattatcaggcttgccggaatcgggatcagtcccaaatgctgccagaagaacttgtagcagtcgaggtggggtattatctgtttttcctgatactcatagctctcttgtcgagaaagcccgatcccgatgccattcctcaacataattgctgcaatgtaaacagctgactggattttgtcggggaacctgtgcaagatgtccgtaatgttgagtcctccagcgctgtgtcccaccaatattaccttctcgtcggcaggaagatgagagaagaaggaaataaggggctcgttgaaatccggcaaactgaaaatggtgtttggaccagtgagattgatgccctgacctttaaggtcgatgcaagtaactttctgtccatctttttccaacagacttcttatcttgtaccagcaccaagaaccatggccggcgcctgcaacgaacacgaagtgatgattcgccattgaagttgttatttattgatcttttctttctcaggcttagatattatattgtgtatgaattatgatcgacatata

SEQ ID NO: 3076 - DNA, 1369 bp, Primula obconica
accagatccagaaggtcaattggtggtgcaacaagaagacaaaagtgaactttgttgttggatataatatttacacaatgaagaattgcgaacgtgctgcaaatattgccctagcaggtttagctttggcaccactagttataaaggttgatccaaatttaaatgttgttttgactgcttgcctcacggtttacgtgggttgctatcgctcagtcaagccgactcccccttcggagacgatgtctaatgagcatgctatgcgctttcctttggttggaagtgcgatgctgttgtcactgtttttactctttaaattcctgtcaaaagacttggttaatgctgtcttgacgagctacttctttgtcttgggaatcgtcgctctttcggcaacggtgttaccttcaatacagcggtttcttccaaagaagtggaatgaggatgttataagctggcatttcccgtatttccgttatttggaggttgagttcacaaggtctcaagtggttgcagcaattcctggaacctttttctgtgcatggtatgcttcacaaaagcactggttggctaataacacgctgggccttgcattttgcatacaggggattgaaatgttgtcactcggatcgtttaaaactggttgcatccttctgtctggactttttgtgtacgatatcttctgggtattttttacgccagtgatggttagtgttgcaaaatcttttgatgctccaataaagcttttgtttccgacaggagattcttctcgtcccttttcgatgcttggacttggagatatagttattccaggaatttttgtagcattggcgttgcgttttgatgtgtccagagggaaagggtcccagtattttaagagtgcttttctggggtatactgccggtttggtccttactattgtcgtcatgaattggtttcaagctgcgcagcctgctctactctatatagtgccagccgttattggatctttggcaactcattgcatatggaatggcgatgtcaagcagttgttggagtttgacgagtccaagactgcctcagaagacgatgataagtcgagcaagaaagacgagtgaggggaaaaccccgtgttacaatatggaacaaatttcagctggaagataaacattaaagattaattagttttctttctagtgcagttgcaccaaagcttattgtatcagttttgaatttcacattatggagtagcattttataacaaaaaaatgaccttttccagatacatgcgcagatgcgctccctttggtgtataattttatgcagcataaatttttatcctcaatttcctggtagtcctggacttttcctcttcaatggtcttgtaaatattagt

SEQ ID NO: 3077 - DNA, 1340 bp, Vinca minor
tgcccgggtcgatctctttttcttcctcctgtaagcctctttttgttgttcgattccatcgaaggtttatttgctgggttttggaattcatacggttgtgtctcaagaatttcagtagagcaacaatgaagaatcatgagcgtcttgcgaatattgctttagcaggcttgtctttggcgccactttttgtgaaggtagatccaaatgtaaatgtcattttaacagcttgccttacagtttatgtcggttgctaccgctctgtcaagtctactccgccttcggagacaatgtccaatgaacatgccatgcgatttcccttagtagggagtgctatgctcttgtcactgttcttgctctttaagttcctatcaaaagacttggttaacgctgtgttgacttgctacttttttgtacttgggatcgtcgctctttcagcaacactattacctgcaataaagcgctttctaccgaaacattggaatgaggatgtaatcacatggcgttttccaatcatccgctctttggaggttgagttcacaaggtcccaagttgttgctgcaattcctgggaccttcttctgtgcttggtatgctgcaaagaagcattggctgtctaacaacatattggggcttgcattctgcattcagggggttgaaatgctttcacttggttcattcaagactggcggcattcttttggctggactttttgtctacgatattttctgggtattttttacccctgtaatggttagtgtggccaagtcttttgatgcccctattaagcttttgttcccaactgctgactcttcacgtccattttcgatgctgggacttggggatattgtgattcctggcatttttgttgcattggcattgagatttgacgtgtcaagaggaaaggggatccaatacttcaagagtgcttttctaggatatgcttttggtttgatcttaacaatcattgtcatgaattggtttcaagctgcacagcctgcacttttatacatcgttccgtctgtaattggatttttggctgtacatgtcatatggaacggggacatcaaaccatttttggagtttgacgagtccaaatcttccgattctcaagatggcgatgaaaaatcaaccaagaacgaagatgagaaatcaaagaatgacgatgaaaaatcaaccgaaaatggtggtgaaacatcagacaagaaagtagattagataatatagtctagcaaagaaaacttaaccccagatgaggaactacaacgagaactggtgattcgtagttgggttgttaattttgctacaaaaaattgttgtataagatttcgttacttattaact

SEQ ID NO: 3078 - DNA, 1289 bp, Flaveria ramosissima
acaacgtagacgtgaacaacactgcaaaaacctccgccggcgaactctccggccaccgtcgatcttctacttcctccgccgtctacagcgacggaacgagtaacggacgtcgatccatcgatcgatcgatcgattcggtgtgtttaactgatctgctcatcttctgattctgctttcagctagtttgcaataactgtgagtttgtctggttgtctcttgaacctacctagctttgacaatgaagagtggtgagcgagctgcaaatattgcactagcaggtctaacactagcacccctagttgtgaaggttgatccaaatataaatgtcattttgactgcatgcctcacagtttttgtgggttgttatcgttccgtcaagccaacacctccttctgagactatgtctaatgcccatgccatgcgtttccctttagttggcagtgcaatgttgttgtctttgttcttgctctttaagttcttgtcaaaagatctggtcaatgctgtcttgacttgctacttctttgtgcttggcatccttgcactctcggcgactctcttacctgcgattaggcggtttttacctaccaagtggaatgaagatgttattcattggagtttcccgtattttaaatctttagatgttgaattcacaaggtctcaagtcgttgcagcagtccctgggtaccttttttgtgtgtggtatgttgcacagaagcattggcttgctaacaatattttgggacttgcattctgcattcagggaattgaaatgctttctcttggctcattcaagactggtgccattctgttggctgggctctttttctatgatatattctgggtctttttcaccccagttatggtcagtgttgccaaatcatttgatgcacccataaagcttctattccctactggagtcgccgcacgtccattttctatgcttggtttaggtgacattgtaattccaggcatttttgtagcattggcgctgagatttgatgtgtcaagagggagaaacaaccaatacttcaagagtgctttcttgggatatgcagttggtgtggtgcttactattgttgtcatgaactggtttcaagctgcacagcctgctctcttatatattgtaccggctgttatcgggttcttggctgctcattgcatatggaatggggaggtcaaaccgttattggagtttgacgagtctaaaacagctattaacagtgacggtgatgcagacgagaatacaagcaagaaagtagagtgagatatgaaagtctaggtttacaaaa

SEQ ID NO: 3079 - DNA, 1378 bp, Flaveria ramosissima
gcaaaaacctccgccggcgaactctccggcgaccgtcgatcttcaacttcctccgccggctacggtgacggaaagagaaacagacgtcgatccatcgatcgattgatcgattcagtctggttaactgatttctttatcttctgattctgctttcatttagcttgcaaaaaactgtgagtttgtttggttgtctcttgaacctatctagctttgacaatgaagagtggtgagcgagctgcaaatattgcactagcaggtctaacactagcacccctagttttgaaggttgatccaaatataaatgtcattttgactgcatgccttacagtttttgtgggttgttatcgttccgtcaagccaacacctccttctgagactatgtctaatgcccatgccatgcgtttccctttagttggcagtgcaatgttgttgtctttgttcttgctctttaagttcttgtcaaaagatctggtcaatgctgtcttgacttgctacttctttgtgcttggcatccttgcactctcggctactctcttacctgcaattaggcggttttacctaccaagtggaatgaagatgttattcattggagtttcccatattttaaatctttagatgttgaattcacaaggtctcaagtcgttgcagcaatccctgggacctttttttgtgtgtggtatgttgcacagaagcattggcttgctaacaatattttgggacttgcattctgcattcagggaatcgaaatgctttctcttggctcattcaagactggtgccattctgttggctgggctctttttctatgatatattttgggtctttttcaccccagttatggtcagtgttgccaaatcatttgatgcaccaataaagcttctattccctacaggagtcgctgcacgtccattttctatgcttggtttaggtgacattgtaattccaggcatttttgtagcattggcgctgagatttgatgtgtcaagagggagaaacaaccaatacttcaagagtgctttcttgggatatgcagttggtgtggtgcttactattgttgtcatgaactggtttcaagctgcacagcctgctctcttgtacattgtaccggctgttatcgggttcttggctgctcattgcatttggaatggggaggtcaaaccgttattggagtttgacgagtctaaaacggctattagcggttgatgctgatgcagatgagaatacaagcaagaaagtagagtgagatatgaaagtgtggtttacaaaatcagtgatttgcagtaggagtaactatgtcttttccttttgtttttacattacttcttttagtgacattgtaacctaacctttttggttataacttatgttatagatttttg

SEQ ID NO: 3080 - DNA, 1607 bp, Lactuca sativa
cgcaattaatgaaagttaaccgagaattcgataactgtaattataaagcgtcgacatctgaagcatacgcgctctcctctgctgtgtatacccatcgatcgaagtacaaccggagacgtgccgaagaaaaggaactgctttggaaccaccacagccggcgatagtcgattctcgattccttttcccctgaaggtacgagacatgaacaaatcgttttggatctagccatctctccatcagtctatttacggcagattgatttcttgttttccatctttttgcggccaaagattcggtttcttcctaccaagcaagcttcacttattatcaagatttctcctgaaatcactgatttgtagttcagtagttgtgaaaatgaagaacgctgagcgtgctgcaaatattgctctagcaggtttaacattagccccattagttgtgaaagtagatacaaatttaaatgttgtattaaccgcatgcctcactgtttttgtgggttgctatcgctctgtcaagccaacacctccttctgaaacaatgtctaatgaacatgcaatgcgttttcccttagttggtagtgcaatgttgttatctttgttcttgctctttaagttcctatcaaaagacttggtcaatgcagtgttgactggatacttctttatactcgggatcatcgctctttcggctacactcttacctgcaattgatcggtttctaccaaacaagtggaatgatgatgtgatcatatggcgtctcccgtatttccggtctttggatgttacttttgagttcacaaggtctcaagttgttgctgctattcctggtacctttttttgtgcatggtatgctgcacaaaaacattggctggctaacaacattttgggtcttgcattctgcattcagggaattgaaatgctttcactcggctctttcaagactggtgccattctgttggctggactttttgtatatgatatattttgggtgtttttcacaccagttatggtcagtgttgctaaatcatttgatgcacctatcaagcttttatttccatcaagaattgctgcacgccccttttccatgcttggtttaggtgacattgtgattccagggatttttgtagcattagcactgagattcgatgtgtcaagaggaagagagagccactattttaaaagtgcttttctgggatacacagttgggttggtccttacaattgttgtcatgaattggtttcaagctgcacagccggctctattgtacattgtaccaggggttattgggtttttggctgctcattgtctatggaatggagaggttaaaccgttactggagtttgatgagtcaaaaacagcaggagaggaagaagcaattagcagcaagaaagtggaatgagatatgtgaaacaagagtttatagttgttttggattaactactagttgaggatgaagttttgctttaacttatggaatttttcatacaccttttttatctagataaattgcttttccagttctcatgcatttacatgtttggactttttattattgcaaattgacatggatgattttgaatatatggtaaacaaaagaatacagcttaatgg

SEQ ID NO: 3081 - DNA, 1633 bp, Citrullus lanatus
gtcatttttaatttctagttttaccctttcattcccattttcatttttttttccttacattcgtcgagttaaaccctaaatctgaaaattctgtgaaataaaattccttctctttcttcggcgagctctccgatctgcgtggtcaaatccactcgaagtcttcgagccgccgatgattgagggagcaattgcgagacaattatcttaattttgcggatcagttttggtgaaaggtttttaattgagagctgcccaacatgaagaacgctgagcgcattgcaaattttgctctagcgggattgacattagctccacttgttatgaaggttgatcctaatgtgaatgtcgtcctgactgcttgtctaactgtctacgtgggttgttatcggtctgtgaaacccactccaccttcagagacaatgtccagtgaacatgccatgcgttttccctttgttgggagtgcaatgcttttatcacttttcttgcttttcaagtttctatcaaaggacttggttaatgcagtcttgacgtgctacttttttgtgcttgggatccttgctctttcagcgactctgttgcctgctattaagcgatttctgccagaccattggaatcaagatgctattgtatggcgttttccatatttccgtgctttggagattgagttcaccaggtctcaggttgttgcagcaattcctggaacctttttttgtgcatggtatgctctgaagaaacactggctggctaacaatatattgggccttgccttctgtatccagggaattgaaatgctttctcttggttcctttaagactggtgccatacttttggctggactgtttgtatacgatatcttctgggttttctttactccagtgatggttagtgttgcaaaatcctttgatgcacctatcaagcttttgttccccactgcagatgctgctagaccattttccatgcttggactaggtgacattgtcattcccggcatctttgttgcattggctcttcgatttgatgcatccaggggaaaagacggtcaatactttaacagtgcttttgtgggatacacagttggtttggtcctcacgataattgtcatgaattggtttcaagctgctcagcctgcacttctctacattgtgcctgctgttattggatttttggctgctcatgtcatatggaatggggatgtgaaaccgttgttagaatttgacgagtcgaagatggggatttcatctgaagatggtggtgaagacgataaaggaagcaagaaggaatgaatttggagaaaaggtggatggatgggaggcataatttttccatgtgatgagcaagcaatgtggcgtagttgaatgagatcatctgaccccatcctgtaagtttgaatgctttttaacattgggctaatttatgtgcaaaactttgcctacagttgtatccaaacaaacagattttgaaatgaggtagcaccaagtcctgtcctgtcctgtcctgttctctttttagctctcttagttttcacatcatcagaagaagaaagcttttattgcaactttgccccatttggttggggtttctatagcaaatttaaatattttataaagggttcccatcgtctttccttttccca

SEQ ID NO: 3082 - DNA, 1512 bp, Glycine max
attttcattttcccaaatcaatttctctctctttctccgatctgttttgcttctggggctacccgctcctgcaatttgcttttgcgattggagtggaaggccattctcgcaacgtttgagttcagcagatccagaatttttcagaaaccaggttaaggagaatgaagaatacggaacgaattgccaatttggctttagcaggtttaaccttagcgccgcttgttgtgaaagtagatccgaatttgaatgttattttgactgcttgcctcactgtgtttgtgggatgttaccgctccgttaaaccaaccccaccaactgagacaatgtccaatgaacatgccatgcgttttccctttgttgggagtgcaatgttattgtcacttttcttactcttcaagtttttatctaaggacttggtgaacactgtattgacaggctacttctttgtacttgggattgttgcactttcggcaacattattaccatttattaaacgttttctgccaaagcattggaacgatgacgttatagtctggcattttccatatttccgttctttggagattgagtttacaaagtcacaggtcgttgctggaatccctgggacttttttttgtgcatggtatgctttgcggaagcattggctagcaaataatatattgggtcttgccttctgtattcagggaattgaaatgctttctcttgggtctttcaagactggtgctattctcttggctggtctatttgtgtatgacattttctgggttttcttcactccagtgatggttagcgttgcaaaatcatttgatgctccaataaagcttttattccccacagcagattcagcaaggccattttcaatgcttggccttggtgatattgttatccctggtatttttgtagcattggctttgcgatttgatgtgtccagaggaaaacagccccagtatttcaagagtgcatttgtaggatacactgttggcttggtccttacaattgttgtgatgaactggtttcaggctgcacagccggctcttttgtatattgtaccttctgtaattgggtttttggctgctcattgcttatggaatggtgatgtcaaacagttgttggagttcgatgagtcaaagactgccaattcacctcaagagagtgatgacgacaagtctagcaaaaaggttgaataagttgaagcgtgcccaataccaatactttcgagtcacagaaaaccgttacttttaaagctaacttattcagcagcacacctatgtaactgattttgattttaaaaaaatgtattacttatttttcaaattggcattttgcttttactgcctgactgcccgcccaatctgggtttccatagcaaacttttcaagaattttcttctcttttctctcgagcgcactcgcacatgcaattatgctctgcctaagataatgaaaatgacacattttcagcggtgttctgtgaataattctgaaatctagtcactagttaatattctgtagc

SEQ ID NO: 3083 - DNA, 1503 bp, Cirsium arvense
ctctctctctcttgtgttcagacccatcgaagtagacgagccggagaaagggaattgccttggaaccaccgccggcggtagtcgattctagatttcgtttgccgttcacggtacgagacaggaacagatcgtgaggcgtttggatcgatcgatcgatcctgtctgtcagtctaataaccgcagcttgatttgttgtatttcgtttagttgaggccacaggttcggcttctaactagtgagcaaaggttcgcttgttatctggatttattctgaatcactgattcgtagttgtgacgatgaagaatggtgagcgtgccgcaaacattgctctagcaggtctaacactggcgccattatttgtgaaggtggatacaaatataaatgtcgtattgactgcatgcctaactgtttttgtgggttgctaccggtctgtcaagccaacgcctccttctgagacaatgtccaatgaacatgccatgcgttttcccttggttggaagtgcaatgttgttgtctttgttcttgctctttaagttcctctcaaaagacctggttaatgcagttctgacatgctacttctttatacttgggatcatcgctctttcggctacgcttttaccagcaattgggcggtttctaccaaaaaaatggaatgacaacgtcataatatggcgattcccatactttcgctctttggagtttgagttcacaaggtctcaggttgttgctgctattcctggtacctttttttgtgcatggtatgctgcacagaagcattggctggctaacaatatattgggtcttgcattctgcattcagggaatcgaaatgctctctcttggctctttcaagactggtgccattctgttggctggactttttgtatatgatatattctgggtttttttcacaccagtgatggtcagcgttgctaaatcctttgatgcacctatcaagcttcttttcccatcaagaattgacacacgccccttctccatgcttggtctaggagacattgtaattccaggcatttttgtagctttggctcttcgattcgatgtgtcaagagggaaagagagccactacttcaaaagtgcttttctgggatacacagccggcttggtcgttacaattgttgttatgaactggtttcaagctgcacagccggctttattatacattgtgccaggggttattgggttcttggctgttcattgtctatggaatggagaggtcaaaccgctactggagtttgatgaatcaaaaacagcagcagtaggagaggaaacaagcagcagcaagaaattggagtgaaaaggaaggaaggaggatataatagttgtttacattagggtgaatttttgatcatcttctttttgctttttctttaacttatgcaagagattttgctatcatcattttagacatttaaatattttaacttttcatgcttttacttcacaggaatcacttttatttaaatataaatttatttaagtctacc

SEQ ID NO: 3084 - DNA, 1634 bp, Cajanus cajan
gtaaatcttaaaaccctaactcttcaatttatttatttatatattttcatttccccaaatcaatttctctctctctgtttctccgatctgctttgttgctggggctgtgttgtgcccaaccggtcctgcaattctcctttgcgattggagtggaggccattctcgcaacgtttgagttcagtagatccataatttttcaggaaagaggttaaggagaatgaagaaaacggaacgaattgcgaatttggctttagcaggtttaaccttagcgccgcttgttgtgaaagtagatccgaatgtaaatgttattttgactgcttccatcaccgtgtttgtgggctgttaccgttctgtcaaaccaaccccaccaactgagacaatgtccaatgaacatgccatgcgttttccctttgttgggagtgcgatgttattgtcacttttcttactcttcaagtttctatccaaggacttggtgaacactgtattgacagcctacttctttgtactcgggattgttgcactttcggcaacgttattaccgtttatcagacgttttctgccaaagcattggaatgaggatgtcatagtctggcgatttccatttttccgttctttggagattgagtttacaaggtcacagatcgttgctggaatccctggtacttttttctgtgcctggtatgcttcgcataagcattggctggcaaataatatattgggccttgctttctgtattcagggaattgaaatgctttctcttgggtctttcaagactggtgctattctcttggcaggtctatttgtatatgacattttctgggttttctttactccagtgatggttagcgtcgcaaaatcatttgatgctccaataaagcttttgttccccacatctgattctgcaaggccgttttcaatgcttggacttggagatattgttatccctggtatttttgtggcattggctttgaggtatgacgtgtctagaggaaaacagcctcagtatttcaaaagtgcatttctaggatacacatttggcttagtccttacaattattgtgatgaactggtttcaggctgcacagcctgctcttttgtatattgtaccttctgtaattggatttttagctgctcattgcatatggaatggtgatgtcaaacagttgttggagtttgatgagtcaaagactgctaattcatctgaagagagtgatgccaaatctagcaaaaaggttgaataagttgaagcatgcccaataccccaatagtcacagaagacatactgcaattttctaagaacaccggttacttttaaagctaacttattcagcagcaacaccccctctgtaacagattgtgattaaaaaaaatgtattagtcttacttttcaagttggcattttgcttttactgcctgactgcccattctgggtttccatagcaaactttcaagttaaggggctgtttggtatgcctgttttttgttttcattttcactgaaaatgaaaaatggtgatgaaaatgtgtatgttttaactttagaatttttttttaaatatttccacaaaaaaaaaggttaaaaattgaaaatgaaaaaattttgatttcggtgttttctatgaaaatgaaaatagaa

SEQ ID NO: 3085 - DNA, 1320 bp, Cephalotaxus harringtonia
agaagggctctgagcattttgggctccactttctttcggattgctttactcctgattgcttaagtgggggcagcgttttcattcacacacacccagccatgaagaccaccgaaaaactagcgaatcttgctctagcaggcttatcattagctcctctggttgtaaaggtgaatccaaatttgaatgttgtcttgacagcatgtcttactgtgtacattggttgccatcgttcagtcaagcctgcaccgccttcagagaccatgtcaaaggagcatgccatgcgttttcctttgattggaagcgttgtactggtttcgctgttcttgttattcaagtttttatcaaaagacttggtcaatgctatactcacttgttacttttttgtgcttggcataatcgcattctcggccacattgttacctgctattgatcggtttcttccaagggagtggaatgaaacaacaataaattggcatcttccatatttcaaatctgtagaggtcgaattcaccaaatcacaggttgtggctgctataccgggaacatttttctgtacgtggtatgcattgaaaaagcactggttagcaaacaacattttgggattggcattttgtattcagggtatcgagatgttgtctcttggatccttcaaaaccggcgcaatcctcttggcaggactctttgtatatgatattttttgggtctttttcactcctgtgatggttagtgtggccaagtcctttgatgctccaatcaagcttttgtttcctacagcagatttggcgcgaccctattctatgcttgggcttggtgatattgttattccaggtatttttgtggctttggctttgcgttttgatgtctcaagaggaaagggagagcgatattttaggagtgcattctttggttattcagtaggtgtgattgtaacaatcattgtgatgaactggtttcaagcagcacaacctgctcttctatatattgttcctggtgtaattggatttttagcggtacattgcatttggaatggggaagtcaagcctttgttggagtttgatgagtctaagacatctgcagaatcaagttcagttgactcctctaaacaagatagagattcagctcttgtggatggcaagccagatcataagtcagattagcaagatgagaaaggatgtgattagtcatggaagtttgctcagtgcttggaactggagcagtttctttcttgacatcatatcgaatattccttaatcagtgcacgtcaaactgtgctgctggtatttccatttcaaaaaacatggtgtagaaactggaaacttc

SEQ ID NO: 3086 - DNA, 1218 bp, Primula obconica
tggtctgtttcaggatcgaggtgtggtgtgatacgaagccaaagcaatttttgctggatataatcaaatcaatactcaatgaggaattccgaacgtgctgcaaacatcgctctagcaggtttatctttggcaccactggttataaaagttgatccaaatttaaatgtcattttgactgcttgcctcactgtttttgtgggttgttatcgctcagtcaagccaactcctccttcggaaacgatgtctaatgagcacgctatgcgttttccttttgttggaagtgcggtgctgctgtcactgtttttactatttaaattcctgtcgaaagacttggttaatgctgtcttgacgagctacttctttgtacttggaaccatcgctctttcggcaacagtcttacctgcgatacaacgatttcttcctaagcagtggaatgaagatgttataaagtggcatttcccatatttcagttctttggatgttgagttcacaagatctcaagtagttgcagcgattcctggattctttttctgtgcgtggtatgcttcacaaaagcattggttggctaacaacgtattaggccttgcattctgcattcagggaattgaaatgttatcactcggatcatttaaaactggcgtcatccttctgtcaggactttttgtgtatgatgtcttctgggtcttttttacgccagtgatggttagtgttgcaaaatcgtttgatgctccaatcaagtcttttgtttccgactgcaaattcttctcgtccattttcgatgcttggacttggagatatagttattccaggaatctttgtagcattggcattgcgttttgatgtgtctagggagaaacaatcgcattattttaagagtgcttttctggggtatactgttggtttggtccttactattatcgtcatgaattggtttcaagccgcgcagcctgctctactctatatagtgcctgcggttattgggtttttggcagctcattgcatatggaatggtgatgtcaaacagttgttggagtttgacgagtccaagactggttctgaagacgaggatgccaagtccaccaagaaagtggagtgatcgtaaaaacccttaggacataatgaatcaagatctgttgctagacaaaagcgttaatgcttactcagttttcttctatcttgtgtaattgcactgatgctgttgtaacagacttgataaat

SEQ ID NO: 3087 - DNA, 1327 bp, Castanea mollissima
ctaatctccgcattttatttcatcaaaatctgaatctctctctctctctcctcggtggtctcttcgatctgagagaaaaagcaaaacgctagaagatatctgagctgccgacgacgacgaaacagttttgtgatcgcagaggaaaggttttggtttgttaatctgatcggaattttcagtcaaattttgcgattctagaataagataacgatgaaaagcgttgagcgaattgcgaatgtagctttagcaggtttaactttagcacctcttgttatgaaggtagatccaaacttaaatgttattttgactgcatccctcacagtttttgtgggttgctacagatctgtcaagccaactccgccttctgagacaatgtctaatgagcatgccatgcgtttcccttttgttgggagtgcgatgctgttatcactatttttgctttttaagtttctatcaaaggacttggtcaatgccgtcttgacatgctacttctttgtgcttgggatcgttgctctttcggcaacacttttacctgctattaaacgttatttaccgacgcattggaatcaggacgttattagctggcattttccttacttccgttctttggacgttgagttcacaaggtctcagattgttgctgcaatccctggaacctttttctgtgcatggtatgcttcacagaagcattggctagctaacaatatactgggactttccttctgcattcagggaattgagatgctttctcttgggtctttcaagactggtgccattctattggctggactttttgtgtatgatatcttctgggttttcttcactccagtgatggttagtgttgcaaaatcttttgatgctcctattaagcttttgttccctacagcagatactgctcgaccatattctatgcttggacttggtgacattgtaatccctggtatttttgtagcgttggctttgcgatttgatgtgtctagagggaaacacagccagtactttaggagtgcatttctgggatattctgttggtttggtgcttacaattgttgtcatgaactggttccaggctgcacagcctgctctattgtatattgtaccttctgtcattggatttttggcggctcactgcatatggaatggtgaagtcaaaccgttgttggcatttgacgagtctaaggctgctaattcatccgaagaaagtattgacagcgatgctaattctagcaagaagttggaataagttgcagagccctggactctggactcttccacctcaaggaaagaaatacttctcttctctcttctctgaggcccccaaacacatt

SEQ ID NO: 3088 - DNA, 1489 bp, Mimulus guttatus
cccttttcttctgagcgtaataactaaaacccttttctctctctccctctctctctctctctctctctgaaagtgtgtgagaaattacacacactgaaggtgtccccgatctgtgagttcggaattgaagattgggatacgggcagagaggaaaaggaaccctattagtttcttctcgcttgaagtttctttggagaaaaatcaaggacgcttcagaatcttttaaaattcagaatgaagaatcacgagcgtctcgctaatttggctcttgcagctttgacctttgccccactcgtcgtgaaggtggacccaaatctaaatgttatcttgacggcttgtctaactgtatatgttggttgctatcgctcggttaaggcaactccacctactgagactatgtccaatgaacatgccatgcggtttccattggttgggagcgcaatgttgctgtcattgtttttgcttttcaaatttttatcaaaagacttggttaatgctgtattaacgtgttactttttcgtacttgggattgctgctctttcggcaacattgctacctgcaattaaacgattcctgcccaacccatggaatgataacgtcattgtatggcgtttcccatattttcggtctttggaggttgagtttacaaaatcacaaatcattgctgcaattcctgggacctttttttgtgtttggtacgcttcaaagaagcattggctagctaacaatatcttgggacttgcattctgcattcagggaattgaaatgctttcactcggctcatttaagactggtgctattctcttggccgggctttttgtatatgacatattctgggtcttctttacgcctgttatggttagcgttgccaagtcttttgatgctccaataaagcttttgttcccaacatcagatgctgcacgtccattttcaatgttgggacttggtgatatagtgattcctggaatttttgtagcactggcactaagatttgatgtttcgagagggaaagagagccaatattttaagagcgcttttgtaggatataccgctggtttggttgccacaatcattgtcatgaactggtttcaagctgcacagcctgcgttgttgtatatcgtgcccggtgttatcggatttttggctgcacattgtttatggaatggagaagtcaaacctttgttggcgtttgacgagtcaaagacggaagaaactagctctgaagaaactagtgaggcagattcaaacaagaaagcagactgagagagatttgttgagaagaagaaattgaaaatttacttacaaagaagaggataatatgtgaaggggttttaggactaacttaattaatgcaccagagtttgttttaccagatttttggtcattattagtaaaattactactactagtaatatttctcatttgtgaacccatattatataatactctctcatatatgtcaatgttacaaaatgggttaaatttgcag

SEQ ID NO: 3089 - DNA, 1455 bp, Arachis hypogaea
ggggggggagtgaaacttgaaagtatctctaatccaccgtttcattgaaagtggcttgccctctctaaaatatctaaatttctcaattaaccctcttttttcttcatttctctttgttttactactttaaaccctaatccttccctttctccgatccgctactctattttgtgcctcaccgattcaagggtagtcccattctcgctacggttgacttcactagatctagaattgttaaagagaaatttaacaatatgaagaacacggagcgggttgcgtttttggctttagcagggttaaccttagcaccgcttgctgtgaaagtagatccgaatttgaatgtcattttgactgcttgcctcactgtgtttgtgggctgttaccgttctgtcaaaccgactcctccaactgagacaatgtccaatgaacatgcgatgcgatttccttttgttgggagtgcaatgttactgtcccttttcttactcttcaagtttctttccaaggacttggtgaacgctgtattgacagcctactttattgtgctcgggattgttgcattatcggcaacactattaccatctatcaaacggtatctgccaaagaagtggaacgaggatgtcatagtctggcgcttcccatattttcgatctctggagattgagtttacaagatcacagattgttgctgctatccctggcacgttcttttgtgtgtggtatgctttgaggaagcattggctggcaaataatatactgggtcttgctttctgtattcagggaattgaaatgttatctctaggatctttcaaaactggtgctattctcttggccggtctatttgtatatgacatcttctgggttttcttcactcctgttatggtcagcgttgcaaaatcttttgatgctccaataaagcttctgttccccacagcagattctgcaaggccgttttcaatgctcgggcttggtgatatcgttatccctggtatttttgttgcattggctttgcggtttgatgtgtctagaggaaaacagccccagtatttcaagagtgcatttttaggatacaccactggcttggtccttacaatcgttgtgatgaattggtttcaggctgcacagcctgctcttctgtacattgttccttgtgtaattggatttttggccgcacattgcttatggaatggtgaagtcaaacagttgttggatttcaatgagtcaaagagtgctgattcatcatcacaggaggggactgatgccaaagctagcaagaaggtagaataggttgaggagcttctattcccaatacccaaatacttctgaagctaactgattcagcagcaccacacctctgtaacagattgtaattcacaaggaaaagaaaattagtctcttttagtttcccatttagcttttacttcttgactgcccccagttttgggtttctatagcaaac

SEQ ID NO: 3090 - DNA, 1405 bp, Medicago truncatula
atttgtgattgcagggtgaatcaagatgaaaaacgttgagaggattgcgaatttggctttggcagctttaaccttagcacctcttgttgtgaagataaatccaaatctaaatgttatcttgactgcttgcatcactgtgtttgtgggatgctatcgttccgtcaaaccaactcctccttctgagacaatgtccaacgaacatgccatgcgttttccctttgttgggagtgcaatgttattatcacttttcttgctcttcaagtttctatctaaggacttggtcaacactgtcttgacactctacttctttgtactggggatcgttgccttatcggcaacattactaccatatatcaaacgatttttgccaaagccttggaatgatgatctcatagtctggcactttccatattttcgttctttggagattgagtttacaaagtcacagatcatcgctgcaatccctggaacctttttttgcggatggtatgctttaaagaagcattggctggcaaataatatactgggtcttgctttctgtattcagggaattgaaatgctctctcttgggtctttcaagactggtgctattctgttggttggactctttttttacgacattttctgggttttcttcacgccggtgatggttagcgttgcaaaatcatttgatgctccaataaagctcttgttccccacagcagattctaaaaggccattttcgatgcttggacttggtgatattgttatccctggaatctttgtagcattagccttgcgttttgatgtttctagaggaaagcaaccccaatattttaagagtgcatttttaggatacactttcggcattggcctcacaatatttgtgatgaactggtttcaagctgcccagcctgctcttttatatattgtacctgctgttattggatttttggctgctcactgtatctggaacggtgatgtcaaacagttattggagttcgatgagtcgaagacggccaaatcatctgaagaagagagtgatgccgccaaatctagcgaaaagattgaaccatctggagaagagagtgatgccaaatctagcaaaaaagatgaataaaacagtttcaatacaaatacttgagtcatagaatacctcattacatgtaatagtaataacttattcagcaccaaacactaatagattttgttatcgagaaaaattattagtcttattttcggcacttgattaaggtttgtttcgtgttattgtttctcaatactattttcatttttcttgataaatcaattttagctactgattggataaacaacttatttgcagcttataacaagagttatgataaacacttatgtgtaagctatttttatagtgaaagataaaataaaactaaattgtttttgt

SEQ ID NO: 3091 - DNA, 1433 bp, Flaveria ramosissima
cgcttcaaagctttgactaccgaagacacaacgtagacgtgaacaacactgcaaaaacctccgccggcgaactctccggccaccgtcgatcttcaacttcctccgccgtctacggtgacggaacgagtaacggacgtcgatccatcgatcgatcgatccattcggtgtggttaactgatctgcttatcttctgattctgctttcagctagcttgcaaaaaactgtgagtttgtctggttgtctcttgaacctacctacctttgacaatgaagagcggtgagcgagctgcaaatattgcactagcaggtctaacactagcacccctagttttgaaggttgatccaaatataaatgtcattttgactgcatgccttacagtttttgtgggttgttatcgttccgtcaagccaacacctccttctgagactatgtctaatgcccatgccatgcgtttccctttagttggcagtgcaatgttgttgtctttgttcttgctctttaagttcttgtcaaaagatctggttaatgctgtcttgacttgctgcttctttgtgcttggcatccttgcactctcggcgactctcttacctgcgattaggcggtttttacctaccaagtggaatgaagatgttattcattggagtttcccgtattttaaatctttagatgttgaattcacaaggtctcaagtcgttgcagcagtccctgggacctttttttgtgtgtggtatgttgcacagaagcattggcttgctaacaatattttgggacttgcattctgcattcagggaattgaaatgctttctcttggctcattcaagactggtgccattctgttggctgggctctttttctatgatatattctgggtctttttcaccccagttatggtcagtgttgccaaatcatttgatgcacccataaagcttctattccctacaggagtcgctgcacgtccattttctatgcttggtttaggtgacattgtaattccaggcatttttgtagcattggcgctgagatttgatgtgtcaagagggagaaacaaccaatacttcaagagtgctttcttgggatatgcagttggtgtggtgcttactattgttgtcatgaactggtttcaagctgcacagcctgctctcttatatattgtaccggctgttatcgggttcttggctgctcattgcatttggaatggggaggtcaaaccgttattggagtttgacgagtctaaaacagctattagcagtgatggcgatgcagacgagaatacaagcaagaaagtagagtgagatatgaaagtctggtttacaagatacagttatttgtagtaggagaaactatgcttttcctttttgtttttattatacttcttttaatgacattgttacctaacctttttggtttaacttatgttatagatttttgtactc

SEQ ID NO: 3092 - DNA, 1357 bp, Manihot esculenta
gtgtctctcccgaatatcaaaatataaaaatctctctctgggcgagacctatctacgatctgtttgtgcagcaacagttagagagagaaagggaataaatctcaggttctggatcctgaagtgaacctcttcattagttcaatcttctattggaagtgtgattagttaggaaactatgaagaacaacgaacgtcttgccaattttgctttagcaggtttaacattggcaccactgcttgtgaaggtagatccaaacttaaatgttgtcttgactgcatgcctcacagtctatgttgggtgctaccgatcagtcaagccaactccaccttcagagacaatgtctaatgaacatgcaatgcgctttccctttgttggcagtgcaatgctattatcgctattcttactcttcaagttcctttcaaaggacttggttaatgctgtattgacatgctacttttttgcacttggaatcattgcactatcggcaacattattaccagctatcaaacgttatttaccaaatcattggaatgatgaccttattacctggcattttccatttttccattctttggagattgagttcacaagatctcagattgttgctgcaattcctggaacatttttttgtgcatggtatgcttctcagaagcattggctcgctaacaatattttgggcttggctttctctattcagggaattgaaatgctttcccttgggtcttttaagactggtgccatcctcctggctggactttttgtatatgatattttctgggttttcttcactcctgtcatggttagtgttgcaaaatcattcgatgctcctataaagctattgtttccaacaagagatgctgcaaggccattttccatgcttgggcttggtgatattgtaatccctggcatttttgtagctctggcattgcggtttgatgtgtctagaggaaaaggcagccagtattttaagagtgcttttctgggatatacagttggtttggtccttacaattgttgttatgaactggttccaagctgcacagcctgcacttctgtatattgtaccatctgtaatcggattcttagctgctcatgtcatatggaatagtgaagtaaaacagttgatggaatttgacgaatccaagagtgccgcatcatctaaagatagtagcgaaaccaaggctggcaaaaaggtcgagtgaatcatgaacttagtagcgcggagggaaatattgttgtttttttaggacttataagcctcttagcatcaaattgcacatcgctgtaacagattttggaattgagcaaagataatttaaattttagcttcttatagcaatatcatattggatgttttc

SEQ ID NO: 3093 - DNA, 1390 bp, Artemisia annua
atcaatcaatcgaactaccatcccgccggcggtattccgattgcaattgacggccacagatccggctttcgtcttggggtcaaagattcacttgttatctggatttcttctgaagttacttattagtagctgtgacaatgaaaaatgttgagcgtgcggcaaacattgctctagcaggtctaacactagcgccactggttgtgaaggtagatacaaatttaaatgttatattgacagcatgcctcactgtttttgtgggttgctaccgctctgtcaagccgacacctccttctgagacaatgtccaaagaacatgcaatgcgttttcccttggttggcagtgcaatgttgttgtcattgtttttactcttcaagttcctatcaaaagacttggttaatgcagtgctgacaggctacttctttatacttggaatcatcgctctttcggctacacttttacctgcaattgcacagtatctcccaaacaagtggaatgatgatgccatcgtatggcagttcccatattatcgttctttggaggttgagtttacaaggtcccaagtcgttgctgctattcctggtacattcttttgtgcatggtatgctgcacagaagcattggttggctaacaacatattgggtcttgctttctgcattcagggaattgaaatgctctcacttggctcctttaagactggtgccattcttttggctggactttttgtgtatgacatattttgggtctttttcacaccagtgatggtcagcgttgcaaaatcattcgatgcacctattaagcttttattcccatcagggatggtcgcacgccccttttctatgcttggtctaggagacattgtgattccaggtatttttgtagctttggcactgcgatatgatgtgtcaaaagggaaagacagccactacttcaaaagtgctttcctgggttatacagtcggtttggtggctacaattatagtcatgaactggtttcaagcagcacagccggctttattgtacattgtaccaggggtcattgggttcttggctactcattgcttatggaatggagatgtcaaaccgttattggagtttgatgagtcaaaaacagctagttcagaagaggaaacaagcagcaagaaaatggaatgagatgtggaaaggatatagttgttttacattagtgtttttctctaacttttgcaattttcttcatagacaagttactagattttgcagtcatcctttggaacattcaaacattttcaactttcctggatttacttgactatcaaaggaatgactttgaacaatattgttttacttttcattgcaatttgtaaaccaagaaaaaggcttaaagctaccattcaaattcaaatcttctggaa

SEQ ID NO: 3094 - DNA, 1317 bp, Vigna unguiculata
ctctcttcgatctgctttgcttctggggccaaccgctcctgcaattcccttttgcgattggagtggaggccattctcgcaacgtgagtttattagatccaaaattgttcagaaaagaggtcaaggaggatgaagaaaaccgaacgaattgcgaatttggctttaacaggtttaaccttagcaccgcttgttgtgaaagtagatccgaatttaaatgttattttgactgcttgtctcactgtgttcgtgggatgttaccgctctgtcaaaccaaccccgccaactgagacaatgtcgaatgaacatgccatgcgtttcccctttgttggaagtgcgatgttattgtcactgttcttactcttcaagtttctatccaaggacttggtgaacactgtattgacaggctacttctttgtactcgggattgttgcgctttcggcaacattattaccgtttattaaacgttttctgccaaagcattggaatgaggacgtcatagtctggcgacttccatatttccgatctgtggagattgagtttacaaggtcacaggtcgttgctggaatccctgggacattcttttgtgcttggtatgctttgcggaagcattggctggcaaataatatattgggtcttgctttctgtattcagggaattgaaatgctttctcttgggtctttcaagactggtgctattctcttggctggtctatttgtatatgacatattctgggttttcttcactccagtaatggtcagcgttgcaaaatcatttgatgctccaataaagcttttgttccccacagcagatgctgtaaggccattttcaatgcttggacttggtgatattgttatccctggtatttttgtagcattggctttacgatttgatgtatccagaggaaaacagccccaatatttcaagagtgcatttgtaggatacactgttggcttggtccttacaattgttgtgatgaactggtttcaggctgcacagcctgctcttttgtatattgtaccttctgtaattggattcttggctgctcattgcatatggaatggtgatgtcaaacagttgttggagttcgatgagtcaaagactgccaattcacctcaagagcaggacaagtccagcaaaaaggttgtataagttaatgcatgcccaataccaatacttcctagtcagagaagaaatactgtttttttgttcttctgaaaacaccgttacatttaaagctaacttattcagcagcacccctgtaactgattgtgattttaaaaaaatgtattagttttatctttcaaaaaaaaaaaaaaaa

SEQ ID NO: 3095 - DNA, 1356 bp, Vigna unguiculata
gatttccattttctacaatcaatttctctctcccaaaacaatttctctctctatctctcttcgatctgctttgcttctggggccaaccgctcctgcaattcccttttgcgattggagtggaggccattctcgcaacgtgagtttattagatccaaaattgttcagaaaagaggtcaaggaggatgaagaaaaccgaacgaattgcgaatttggctttaacaggtttaaccttagcaccgcttgttgtgaaagtagatccgaatttaaatgttattttgactgcttgtctcactgtgttcgtgggatgttaccgctctgtcaaaccaaccccgccaactgagacaatgtcgaatgaacatgccatgcgtttcccctttgttggaagtgcgatgttattgtcactgttcttactcttcaagtttctatccaaggacttggtgaacactgtattgacaggctacttctttgtactcgggattgttgcgctttcggcaacattattaccgtttattaaacgttttctgccaaagcattggaatgaggacgtcatagtctggcgacttccatatttccgatctgtggagattgagtttacaaggtcacaggtcgttgctggaatccctgggacattcttttgtgcttggtatgctttgcggaagcattggctggcaaataatatattgggtcttgctttctgtattcagggaattgaaatgctttctcttgggtctttcaagactggtgctattctcttggctggtctatttgtatatgacatattctgggttttcttcactccagtaatggtcagcgttgcaaaatcatttgatgctccaataaagcttttgttccccacagcagatgctgtaaggccattttcaatgcttggacttggtgatattgttatccctggtatttttgtagcattggctttacgatttgatgtatccagaggaaaacagccccaatatttcaagagtgcatttgtaggatacactgttggcttggtccttacaattgttgtgatgaactggtttcaggctgcacagcctgctcttttgtatattgtaccttctgtaattggattcttggctgctcattgcatatggaatggtgatgtcaaacagttgttggagttcgatgagtcaaagactgccaattcacctcaagagcaggacaagtccagcaaaaaggttgtataagttaatgcatgcccaataccaatacttcctagtcagagaagaaatactgtttttttgttcttctgaaaacaccgttacatttaaagctaacttattcagcagcacccctgtaactgattgtgattttaaaaaaatgtattagttttatctttca

SEQ ID NO: 3096 - DNA, 1269 bp, Olea europaea
cacactgtaaggttgttctccgatatgcgtgtattaactattaactgaagattagttcagggacggagaaagaccaacacatcgctctcaagcgtttctttgaagtggatcgaaggattaaaatttcaataattctttataatgaagaatcatgagcgtctggctaatcttgccttagcaggtttgacttttgccccattgattgtgaaggtagacccgaacttgaacgttgttttgacagcatgcctagctgtatatgtaggttgctaccgttctgtcaagcctactccaccttcagagaccatgtccaatgagcatgccatgcggttccccttggttgggagtgcagtactgttgtcattgttcttactctttaaatttctgtcaaaagacttggtcaatgcagtattaacatgctactttatcttacttgggattgtcgctctctcggcaacattgttacccgcaattaaacgtttcttgccaaaaccttggaatgataatgttatacactggcagtttccatattttcgatctgtggaggttgagttcacaagatcgcagattgttgcagcaattcctggaaccttcttttgtgcatggtatgcttcaaagaagcattggttggctaacaatattttgggccttgctttctgcattcagggaattgaaatgctttcacttggctcatttaagactggtgccatcctcttggctgggcttttcatatatgacatattctgggtttttttctactccagtaatggttagcgtggctaaatcttttgatgctcctataaagctattgtttcctacatcagattctgcacgtcctttttcaatgcttggtcttggagatatagtgattcctggcatctttgtggcactggcactacgatttgatgtttccagagggaaagaaagccaatacttcaagagtgcttttctaggatacacatttggtttggtgctcacaattgttgtcatgaactggtttcaagctgcacagcctgcactattgtatattgtaccagctgttattggatttttggctgtgcattgcatatgtaacggtgaagtcatacctttgttggagttcgacgagtctaaaactactagctctgaagaagctgatgctttaaaatcgagcaagaaagaagagtgatattgacacctttgatgagaagaaaattttagattcatttacaagaaacacctaggattcatgaaccttatgaacgagcatactgttgtactagtattttgtac

SEQ ID NO: 3097 - DNA, 1320 bp, Vinca minor
ctggatcgattgatctcttcgttgttcgcttctacctttcaaaggtttctgtgcttgattttgggtttcatttgtttatctttgacgtttctgtctcaagtaagcaaaaatgaagaatcacgagcgtcttgcaaatattgctttagcaggcttgacttttgcgcctctatttgtgaaggtagatccaaatgtgaatgtcattttaacagcttgccttacagtttatgttggctgctaccgttctgtcaagtctactccacctacagagacaatgtccaatgaacatgccatgagatttcccttagtagggagtgcaatgctcttgtcactgtttttactttttaagttcctgtcaaaagacttggttaacgctgtgttgacttgctacttttttgtacttgggatcgtcgctctttcagcaacactattacctgcaataaagcgctttctacccaaacattggaatgaggatgtaatcacatggcgttttccactcatccactctttggaggttgagtttacaaggtcccaagttgttgctgcaattcctggggccttttttctgtgcttggtacgcttacaaagaagcattggctgtctaacaacatattggggcttgcattctccattcagggggttgaaatgctttcactaggctcattcaagactggaggaattcttttggctggactttttgtgtacgatattttctgggtattttttacccctgttatggttagtgtcgccaagtcttttgatgctcctattaagcttttgttcccaactgctgactcttcacgtccattttctatgctgggactcggggatattgtaattcccggcattttcgttgcattggcattgagatttgatgtgtcaagaggaaaggggatccaatacttcaagagtgcttttctaggatacgcttttggtttgatcttaacaatcatcgtcatgaactggtttcaagctgcacagcctgcacttctatacatcgttccggctgtaattgggtttttggctgtgcatgtcatatggaatggggacatcaaacctctgttggagtttgacgagtctaaatcttctgatcctcaagatgtcgatgaaaaatcaaccaagaacgacgatgagaaatcaaccgaaaatggcggtgaaacatcaaacaagaaagtagattaggtgatagtctagcagagaaaacttaaccccaaacgaagaactacaacgaggactggtcattcttagttggcttgttagctttgctacaatgaattgttgtatcagattttgttacttaaaaacttaactaaactaatattc

SEQ ID NO: 3098 - DNA, 1295 bp, Citrus clementina
tattaatatgattcatggctgcaggtttaacattggcaccacttcttgtgaaggtagatccaaacttaaatgttatattgacagcatgtctcacagtttatgtgggctgctatcgatctgtcaaaccaactccaccatcagagacgatgtctaatgaacatgccatgcgctttccttttgttggaagtgctatgttgttatcactgttcttacttttcaagtttctatctaaagacctggtcaacgctgtattgacctgctactttttcgttcttgggatcattgccctttcggcaactatcttaccagctgtgaaacgcttcttgccaaaccattggaatgaggacctaattatatggcatttcccttatttccgttctttggagattgagttcacaaggtctcagatcattgctgcaatccctgggacgtttttttgtgcatggtatgcttcacagaaacattggctagctaacaataccttgggccttgccttctgcattcagggaattgaaatgctttctcttggatctttcaagactggtgccattcttttggctggactttttgtatatgatattttctgggttttcttcactccagtaatggttagtgttgcaaaatcttttgacgctcctatcaagcttttgttcccaacgagagacactgcccgaccattttccatgcttggacttggcgacattgtaattcctggtatctttgtggcactagcattgcgatttgatgtgtccagagggaaaggaagccggtacttcaagagcgcttttctgggatatacagttggtttagtcctaacaatcattgtcatgaactggtttcaggctgcacagcctgcacttttgtatattgtgcctgctgtaattggattcttggccgctcactgcatatggaacggcgaagtcaaacagttgttggagtttgatgagtctaagactgccgcggttgtgtcacaagaaagtagcgatgccaaaactagcaagaaagtcgaataatttaaaatgccatctacaatggaccattttagcaaagaaatatcttttatttctccttttgaggatcaacgctgtgcaagctcaatccaagctaacttatgcaacctgcaaacaattgtaaaagattttggcattaagcaagaaataatattttagcctcttatagtgagacaactatagtgagacaactatttcagatatattttgtgatttttttctttatttaatttaattttttaaatgcattatacttactgaggagaaagttgttctgtttcccgg

SEQ ID NO: 3099 - DNA, 1349 bp, Euonymus alatus
aaaatatcctctgttagtttagtcacagtctctcgcgtttcgacagcctctccgatctgtttgtaaacaatcgctagagagtaagagagagaaagatcatctgcttctctctctcctcctcaggcaccatctttaaagatgaagaactttgaacgtattgcgaatttcgccctagcaggtttgacattggctccactagttatgaaggtagacccaaatttaaatgtcattttgactgcttgcctgactgtatatgttggctgttaccgatctgtaaagccaactccgccttcagaaaccatgtctaatgaacatgccatgcgattcccctttgtcggaagtgcgatgctgttatcactgttcttactcttcaagtttctgtcaaaagacttggttaatgctgtactgacatgttatttcttcgtgcttggaatcgctgctctttcggcaacattgttaccatctataaaacgtttcctgccaaaccattggaacaataactctattgtctggcattttccctatattcgtgctttggagattgagttcacaatatctcagataatcgctgcgatccctggaacattcttctgtgcgtggtatgcttatcagaagcactggttggcaaacaatacattgggcctagcattctgtattcagggaattgaaatgctttctcttgggtcctttaagactggtgccattctattggctggactttttatatatgatatattctgggttttcttcactccagtgatggttagtgttgcaaaatcatttgatgcccccataaagcttcttttccccacggcggattctgctcgaccattttccatgcttggacttggtgacattgtaatccccggtatttttgtggcacttgctctgcgctttgatgtatctaggggaagagagagccagtattttaagagtgcttttctgggatacacagttggtttggtccttacaattgtcgtcatgaactggtttcaagctgcacagcctgcactcttgtatattgtcccttgtgtcattggattcttggctgctcattgcatatggaatggcgaagtaaaacagttgttggagtttgacgaatcaaaggcggctgcatcctcgtctgaagaagttagtgatgccaaatctagtaaggtggaatgagatgaggaaaacccctcagatataaaaacccataatttttagattcagagatacgcgttgttttcttttttgagtactcaaaacccttcaaaagaagatcgatctttttgctgacttttgcaacttacacactgctgtaaaaaaggttttgaaatttagcaaggagtaaccttctagcccccctc

SEQ ID NO: 3100 - DNA, 1301 bp, Centaurea maculosa
  misc_feature (18)..(18): n is a, c, g, or t
  misc_feature (206)..(207): n is a, c, g, or t
  misc_feature (240)..(240): n is a, c, g, or t
  misc_feature (352)..(352): n is a, c, g, or t
  misc_feature (393)..(393): n is a, c, g, or t
  misc_feature (423)..(423): n is a, c, g, or t
  misc_feature (447)..(447): n is a, c, g, or t
  misc_feature (495)..(495): n is a, c, g, or t
cgggggaatgtttcaccntttctagttgaagaataacggagacgaaccgaagaaagggggaaatctgctgaaaccaccgccgccggcgaactctccggcgactgtcgaattctcatcgtcttccgccattgaaggaggaaatagaagaagaattggagaagttcgtggatcgattaatcgatcaattgatctagttcattcaacgnntctaatcgtattcaagtctgatttgtggtgttncagtgaaattacgattctgcttctaactagcgagcagaacttcgtgagtttgtttggattttactgaattcacctagtttgacaatgaagagtggtgaacgagctgcaaatntcgctctagcaggtctaacgctggcaccgctagttttgaangtagacccaaatataaatgtcatcttgacngcatgcctcacggtttttgtgggntgttaccgctctgtcaagccaacacctccttctgagacaatgtctaangaacacgccatgcgtttcccgctagttggcagtgcgatgctcttgtctttgttcttgctctttaagttcctgtcaaaagacttggttaatgctgtcctgacagcctatttctttgtgcttggcatccttgccctttcggcgacactcttacctgcaataaggcggtttttacctaccaagtggaatgaagatgttataacttggcatttcccgcgttttcgctctttggacgttgagttcacaaggtcgcaagttgttgctgcgattcctgggacctttttttgtgtatggtatgttgcacagaagcattggctggctaacaatattttgggacttgcattttgcattcagggaattgaaatgctttctcttggttcattcaagactggtgctattctgttgactggactttttgtgtatgatatattctgggtcttttttaccccagtgatggtcagcgttgccaaatcttttgatgcacctataaagcttctattcccaacaagggatgcagtacgtccattttctatgcttggtttaggtgacattgtaattccaggcatttttgtagccttggcgctgagatttgacgtatcaagaggaagaactagccactacttcaagagcgctttcttgggttatgccgttggcgttatccttacaattattgtcatgaactggttccaagctgcacagccggctctgttatacatcgtaccagcggtaattgggttcttggctgctcattgcatatggaatgggggaggtcaaaccgttattggagtttgacgagtctaaatcggcta

SEQ ID NO: 3101 - DNA, 1494 bp, Cucurbita pepo
acgtccagttaagccctaaatctgaaaatttgtgaaaaaaatcccttctctttcttcggcgagctctccgatctgcgtggtcaaatccactcgaagtcctcgagccgccgatgattgagggagcaattgcgggacacgtttttccggattgacagtgttggtgaaaggtgtttaattgagaactgttcaagatgaagaacgccgagcgtattgcgaattttgctttagcgggattgacattagctccacttgtcatgaaggttgatcctaatgtgaatgtcgtcctcactgcctgtctaactgtttatgttggttgttatcggtctgtgaaacccactccaccttcagagaccatgtcgagtgaacatgctatgcgttttccctttgttgggagtgcgatgcttttgtctcttttttgcttttcaagtttctatctaaggacttggttaatgcagtcttgacaatctacttctttgtgcttgggatccttgctctttctgcgactctgttgcctgctatcaaacgatatttgccagaccgttggaatcaagatgctattgtatggcgttttccatatttccgtgctttggagatcgagttcaccaggtctcaagttgttgcagcaattcctggaactttcttttgtgcatggtatgctctgaagaaacattggctggctaacaatatcttgggccttgccttttgtatccagggaattgaaatgctttctcttggttcctttaagactggtgctatacttttggctggacttttcgtatatgatatcttctgggttttctttactccagtgatggttagtgttgcaaaatcgtttgacgcacctataaagcttttgttccccactgcagacgctgttagaccattttccatgcttggacttggtgacattgtcattcctggcatctttgttgctttggctcttcgatttgatgcatccaggggaaaaacggtcaatattttacgagtgcttttgcgggatacacatttggtttggtcctcactataatagtcatgaattggtttcaagctgctcagcctgcacttctgtacattgtgcctgctgttattggatttttggctgctcatgtcatatggaatggggatgtgaagccgctgttagagtttgacgagtcgaaaactgttagttcatccgaagatgacggtgaatgtgataaaggaagcaagatggaatgaatttggagaaaggtggatgggcggaaggcataatttttccatgtgatgagcgagttgtatgagatcatccatcccccgtcctgtaagctacaacaacccttttacattgagctaatttatgtgcaaaactttgtatccgaaaaaacagattttgaaatgaggttagcatgtcctgtcctgtcctgtcttgtcttgttttcagctctcttagttttcacctcatcggaaagcaagcttttactgcaactgtgccccccattttgttggggtttctatagc

SEQ ID NO: 3102 - DNA, 1662 bp, Cajanus cajan
tctggatatgttacaaaacttaaaaccctaacccattcaattcaatgcaattctaaaaattttcacaatccctttctatttattttctctccgatcttcaacgagattttaagggaacactcgtgttgttgagcctcgccggtcctgcatttttcttttgtagagaggagggggaggccatattcgtgagatttttgttagaaagatgaaaaacacggagagaattgcgaatttggctttggcgggtttaaccttagcacctcttgttgtgaaagtagactcaaatgtaaatgttatcttgactgcttgcctcactgtgtatgtgggatgttatcgttccgtcaaaccaactccatttactgagacgatgtccaatgaacatgccatgcgatttccctttgttgggagtgcaatgttattatcacttttcttgctcttcaagtttctatctaaggacttggtcaatactgtattgacaggctacttctttttactcggaattttttctctgtcggcaacattattaccatctatcaaacgttttttgcccaagccttggaatgaagacctcatagtctggcgttttccatattttcgttctttggagattgagtttacaaagtcacagattgttgctgcaatccctggaacctttttttgtgtgtggtatgcttggtggaaacattggttggcaaataatatattgggtcttgctttttgtatacagggaattgaaatgctctctcttggttctttcaagactggtgctattctcctggctggactctttgtttatgacattttctgggttttcttcactccagtgatggtcagcgttgcaaaatcatttgatgctccaataaagcttttgttccccacagcagattctgcaagaccattttcaatgcttggacttggtgacattgttattcctggtatctttgtagcattggccttgcgctttgatgtttctagaggaaaacagccgcaatatttcaagagtgcatttttaggatacactgctggcttggcccttacaatcgttgtgatgaactggtttcaagctgctcagcctgctcttttatatattgtaccttgtgtaattggatttttggctgctcattgcatatggaatgctgatgtcaaacagttattggattttgatgagtcgaagagtgccaaatcgtctcaagaggatagtgatgacacatctagcaaaaaggttgaataagttgaagcccttgcaataccaatactgagtcatagaagaaatacttgactttctaggtacccattaccctgtaatgctaagttattcagctgcaacctctgtaaagatttttattgaggaaagtaactagtcttattttcagtgtaggattttgcattcacttctgaagtttgtttttgtggcaaactatttttgccattttaaaaaaaagttttcttactgctgtataacttggtacatgggcctaattttgataagcttccagaggaaggcatggttgtttgattcatgtaatgcctcttaaatcagttcttctggaatatttctgcctagtgtcattcatacatttattaataatatattgaggaaaaatgtttgaaatattttattatcagcatgaatatattatattattttaaagcaaggaaact

SEQ ID NO: 3103 - DNA, 1287 bp, Tripterygium wilfordii
gatactgtttagtagacaatctccagagagtaagagagatcatcggcttctctctcctcctcaggcagcatctttaaagatgaagaactgtgaacgtattgcgaatttcgccctagcaggtttgacattggctccactaattatgaaagtagacccaaatttaaatgtcattttgacagcttgcctgactgtatatgttggctgttaccgatctgtaaagccaactccaccttcagaaaccatgtctaatgaacacgccatgcgattcccctttgttggaagtgcaatgctgttatcactgttcttactcttcaagtttctgtcaaaagacttggttaatgctgtgctgacgtgttatttcttcgtgcttggaatcgttgctctttcggcaacattattaccatctataaaacgttttctgccaaaacattggaatgatgacgctatcgtgtggcgctttccctatattcgtgctttggagattgagttcacaagatctcagataattgctgcaatccctggaacattcttctgtgcatggtatgcttcccagaagcactggttggcaaacaatacattaggcctagctttctgtattcagggaattgaaatgctttctcttggatcctttaagactggtgccattctattggctggactttttgtatatgatatattctgggttttcttcactccagtgatggttagtgttgcaaaatcatttgatgcccccataaagcttcttttccccacagcggattctgctcgaccatattccatgcttggactcggtgacattgtaatccctggtatttttgtcgcacttgctctgcgctttgatgtatctagaggaaaagagagccagtattttaagagtgcttttctgggatacacagctgggttggtccttacaattgtcgtcatgaactggtttcaagctgcacagcctgcactcttgtatattgtcccttgtgtcattggattcttggctgctcattgcatatggaatggcgaagtaaaacagttgttggagtttgacgaatcaaaagcagctgcatcgtcgtctgaagaagttagtgatgccaaatctagtaaggtggaatgagatgggaaaccccccagatataaaaacccataatttagctaacttactgcaatttgacttctcaaaacccttcaaaagcagatcaatctttttgctaacttactgcaatttgcaccctgctgtaaaaggttttggaatttcgcaaggaataaccttcgagacaccctcatcacaatataatg

SEQ ID NO: 3104 - DNA, 1480 bp, Triphysaria pusilla
aattcctcttctagctgtgtgaaaatcctaaaaccctttctctctccgtgtgtgcaaatcacacactgagggtattgccgatctgcgaaattgacgtttggtgacggtgagaggaaagggagccatcaatttcttcttcgcctgaagttttttataaggaaaattgagggacagttcagaaatctcagaatttagaatgaagaaccatgagcgtcttgctaatttggccctggcaggtttgaccttggccccacttgttgtgaaggtagacccaaatttaaatgtcattttgacggcatgtctaactgtctatgtgggttgctatcgttctgttaaggcaaccccaccaacggagacaatgtccaacgaacatgccatgcgttttcctttggttgggagcgcgatgttgctgtcactgtttttgctattcaaattcctatcaaaagacttggttaatgctgtattaacgtgctactttttcgtactagggattgctgctctttcggcaacattgctacctgcgattaaacaataccttccgaaaccatggaatgataatgtcatcacatggcgtttcccgtacttcaagtctttggaggttgagtttacaaaatcacagatcattgctgcaattcctggaactttcttttgtgtgtggtatgcttcaaagaagcactggctagctaacaatatcttgggtcttgcattctgcattcagggaattgaaatgctttcgcttggctcatttaagactggtggtattctcttggttggactttttttttatgacatattctgggtcttttttactccagtcatggttagcgttgctaaatcttttgatgctccgataaagcttttattccctacggcagatgctgttcgtcctttttctatgttgggacttggtgatatagtgattcctggaatctttgtagcattggcactaaggtttgatgtttccagagggaaaggaagccaatattttaaaagcgcttttgtaggatatgcagttggtttagtcgccacaatcattgttatgaactggtttcaagctgcacagcctgcgctattgtatatcgtgcctggcgtcattgggtttttggccgcacataccttgtggaatggagaagtcaaacctttgttggcgtttgacgaatctaaaactgaagaaactgatgaggactctagcaagaaagcaaatgaaactgatgaggactctagcaagaaagcaaatgaaactgaaccagagtcggacaagaaaacggattgaagggttaatcggtagattgatgcaatgaatgttgagaacatgataatggcttttttgaagtagacagactaacttatgcaccacagattgttataccatattctggccattttagcaacacaaaaaacaaattttttttaccagtctgataatagatttctgaatctgatgtttggtaattcttatttggtacccaaaaaaaaaaaa

SEQ ID NO: 3105 - DNA, 1502 bp, Artemisia annua
gaaaataacagcatttactacccaaagacaaaacgtagactacataaacacccaacccacaccaaaacataaaaaccacttcaaaaccaccaccatcaccggaaaccttccggcaaactcaccggcgattcacaattctcacttcctccgtcaccaaagattctggtttcatttagctagcgaaagaccctgagtttgtctgtattactactgaaatcacttagtttcgacaatgatgaacggggagagggttgccaatattgccctagcaggtctaacgctagcgccactagttatgaaggttgaccccaatataaacgtcatcttgactgcatgcctcgctgtttttgtgggttgttaccgctctgttaaatcaacacctcctactgagacaatgtctaaggcacacgccatgcgtttccctctagttggcagtgcgatgctgttgtctttgttccttctctttaagttcctgtcaaaggacttggttaatgctgttctgacatcctacttctttgtgcttggcatcctcgcactttcggcgacactcttacctgcaattaggcggtttctacctaccaagtggaacgaggatgttatatctttgcatttcccttattttcggtcttatgcgcctttggatgttgagttcacaaggtctcaagttgttgctgctattcctgggaccttcttttgtgtgtggtatgttgcagagaagcattggctagctaacaacatattgggacttgcattctgcattcagggaattgaaatgctttctcttggctcattcaaaactggtggcattctattggttggactttttttctatgatatattctgggtgttttttaccccagtgatggtcagcgtcgccaaatcttttgatgctcctattaagcttcttttcccaacaagagttgttgcacgcccatattctatgcttggtttaggcgacattgtaattccaggaatttttgtagcattggcactgaggtttgatgtgtcaagagggagcaagagcaattactttaaaagtgctttctccggatatgcagttggtgtaacccttacaattgttgtcatgaactggtttcaagctgcacagcccgctctgttatacatagtaccagctgttatcgggttcttggctgctcattgcatatggaatggggatgtgaaaccgttattggagtttgacgagtctaaaacagttgcttccggtgatggggatgcagatgagactacaagcaagaaattagagtgagatgaaatttagcttacaaaatagagttagaaggaactatggttctaaggaaactatggttcttattgactttttacttcttataaccggctttataactccaaactttttggttaacatgctatagattttggagttaaatctttcttttggtgtcgtagagttaaactctaatccaagttggcaggttgaccacaagataggtcaaagtatacatcaatatctacttgagaat

SEQ ID NO: 3106 - DNA, 1369 bp, Eschscholzia californica
gattaggttaattgtggatttgaacaaaaattaggtgaagtgattaggttttcgtttaccctttcttgtgagaatctgctttagctaatacttgaatcatggtgactagtgaacgtgttgcgaatttggctcttgcgggtttaagtttggcaccacttgttgttaaggtagatccgaatctcaatgtcattttgactgcttgcttagcagtttatgtgggttgctaccgttctgtcaagccaacaccaccgactgagactatgtcaaaggagcacgcaatgcgctttcccttagttggaagtgcaatgttgttatctttatttctactgttcaagttcctatcgaaggacttggttaatgctgtactcacttgttatttctttgtactggggattatcgcacttggcgctacattgttacctgcaatcagtcgttttcttccaaaactttggaatgacgatctcattgtctggcatctaccctatttccgctctgtggaaattgagttcacgaggtctcagatagttgcagcaataccaggattctttttctgtgcatggtatgcaaaacagaaacattggttggctaacaatgtgttgggccttgcgttctgcattcagggaattgaaatgctttctcttggatccttcaaaacaggtggcattctcttggctggacttttcgtgtacgacatattctgggttttctttaccccggtgatggttagtgtagcaaaatcttttgatgctcctattaagcttttattcccaaccgcagatgctacaagaccgtattccatgcttggacttggcgatattgtgatccccggcatttttgttgcattagcacttcgatttgatgtttcgagggggaaaaacaaccgatatttcagaagcgcattttttggatacactctcggactagtacttactattgttgtgatgaactggttccaagctgcacagcccgcacttctctacatagttccagctgtgatcggatccgtagcagttcattgcatatggaatggggaagtaaaaccgttactggagtttgacgagtcgaagactgctactgatgctaccaaagatggagagtccagtaatagcagcgatgattcaaaatctagcaagaaagacgaatagtagaggtatcctcggagaagtctgaaaaaaccctaaatagtaaactctataattttgtaattcggttacattagttaaacacatgttttacttgacattgagagaactcgttgattgaggctacaaactaatttatgatgaaacaaacgaatgccattaaattcaacagattttagtatcaaaaaaaataatagaacaggactactctctactctctctctctc

SEQ ID NO: 3107 - DNA, 1400 bp, Cichorium intybus
ggggtatttaagcgtggacatctgaaaagacgcgctctcctctgctgtgcatacccatcaaagtacaaccggagacgagccgaagaaacggaactactctggaatcaccacagccggcggtggtcgattctcgattccttctttcctgaaggtacaagacagaaacagatcgtgagggttttggatcgatccatcctgtctatcaatctatccgatttcttgtcttccatttcgttgcggccatagattcggtttcttactaccaagaaaagcttcacttgttatctggatttcttctgaaatcaccgacttgtagttctcacaatgaagaacggtgagcgtgctgcaaacatcgctctagcaggtttaacattggccccattagttgtgaaagtagatacaaacttaaatgttatattaaccgcatgcctcacggttttcgtgggttgctaccgctctgtcaagccaacacctccttctgagacaatgtctaatgaacatgcaatgcgttttcccttagttggcagtgcaatgttgttatctttgttcttgctctttaagttcctatcaaaagacttggtcaacgcagtgttgaccggctacttctttatacttggaatcatcgctctttcggctacacttttacctgcaatcgcacggtttctaccaaacaagtggaatgatgatgtcataatatggagattaccatatttccgctctttggatgttacttttgagttcacaaggtctcaagcttttgctgctattcctggtacctttttttgtgcatggtatgctgcacaaaaacattggctggctaacaacattttgggtcttgcattttgcattcagggtattgaaatgctttcacttggctctttcaagactggtgccattttgttggctggactttttgtatatgatatattttgggtgtttttcaccccagtgatggtcagtgttgctaaatcatttgatgcaccaatcaagcttcttttcccatcaagaattgctgcgcgccccttttccatgcttggtctaggtgacattgttattccaggcatttttgtagcattagcacttcgatatgacgtgtcaagagggaaagagagccactacttcaaaagtgctttttgggatacacagttggcttagttgctacaattgttgtcatgaattggtttcaagctgcacagccggctctattatacattgtaccaggcgttattgggttcttggctgctcattgtctatggaatggagaggttaaaccgttattggagtttgatgagtcaaacacagctacttcagaagaggaacaaatagcaagaaagtggagtgaacaatttacaaagatatagttgttttacataaactaggatcaagtttgtttgtgtttc

SEQ ID NO: 3108 - DNA, 1465 bp, Momordica charantia
gacttttaccctctcaatcaattccacacatttttcattcgtctagttaaaccctaaatctgaaaatttgtgaaaaatcccttctcattcttcggcgagctctccgatctgcgtggtccaatccactcgaagtcttcgagccgccgatgattgagggagcaattgcgagacaattatcttagttttccggattggcagtgtaggtgaaaggtgtttaattgagaatcgcccaacatgaagaacgctgagcgcattgcgaattttgctttagcggggttgacattagctccacttgttatgaaggttgatcctaatttgaacgttgttttgactgcttgtctaactgtttacgtgggttgttatcgatctgtgaaacccactccaccttcagagacaatgtccagtgaacatgccatgcgttttccctttgttgggagtgcaatgcttttatctcttttcttgcttttcaagtttctatcaaaggacttggttaatgcagtcttgacgtgctacttttttgtgcttgggatccttgccctttcagccactctgttgcctgctattaagcgatatctgccagaccattggaaccaagatgctattgtatggcgttttccatatttccgtgctctggagatcgatttcaccaggtctcagattgttgcagcaattcctggaaccttcttttgtgcatggtatgctatgaagaaacactggctggctaacaatatcttgggccttgctttttgtattcagggaattgaaatgctttctcttggttccttcaagactggtgccatacttttggctggactgtttgtatacgatattttctgggttttctttactccagtgatggttagtgttgcgaaatcttttgacgcacctataaagcttttgttccccaccgcggatgctgctcgaccattttccatgcttggacttggtgatattgtcattcctggcatctttgtagcactggctcttcgatttgatgcattgaggggaagagatggtcaatattttaagagtgcttttctgggatacacagttggtttggtcctcacaattatagtcatgaattggtttcaagctgctcagcctgcacttttgtacattgtgcctgctgttattggatttttggctgctcatgtcatatggaatggggaagtgaaaccgttgttagagtttgacgagtcgaagagtggcgtttcatgtgaagaaggaggagatgatgacaaaggagggaagaaggaataaatataaataattatgatgtgatgagcaaacaatgagagagatcatcccatccatccccaccccatcatgtaagctaagccttttcttttaacattgggctctaattttatatcctaaacttcgcctacagttgtagtgtatcaaactcaaacacacacagattttgaaatatgaggtttagctctctccttttagttttccaaac

SEQ ID NO: 3109 - DNA, 1390 bp, Ambrosia trifida
tatatatcctgtaataattataaaagcgtgcagagctgccgtgcataccaccggaatacaggtagctgctgccctaccaccaccacctacggcggtcttaattttatcaggccatagatcctactttcagctagcagggtcagattcactttttatctaggtttcttcttaaattacttatttgtagtcgtgacaatgaagaatggtgagcgtgccgcaaacattgctctagcaggtctaacgcttgcgccattagttataaaagtagatacaaatgtaaatgtcatattgacagcatgtctcacagttttcgtgggttgctaccgttctgtcaagccgacacctcctactgagacaatgtctaatgagcatgcaatgcgatttcccttagttggcagtgcaatgttgttgtctttgttcttgctctttaaatttctatcaaaggacttggtcaatgcagttctgacaggctacttttttatacttgggatcatcgctctttcagcaacactcttacctgcaattgctcggtttctaccaaacaagtggaatgatgatgtcataacatggcgtttcccgtattttcgctctgtggagttcgaattcacaaggtctcaagttgttgctgctattcctggtacatttttttgtgcatggtatgctgcacagaagcattggctggctaacaacatattgggtcttgcattttgcattcagggaattgaaatgctctctcttggctctttcaagactggtgccattctgttgtctggactttttgtttatgatatattctgggtcttcttcacacctgtgatggtcagcgttgctaaatcatttgatgcacctatcaagcttctatttccatctagaattgccgcacgccctttttccatgcttggtttaggggatattgtgattccaggaatttttgtagctttggcactgcgatatgatgtgtcaagagggaaagaaagccactacttcaaaagtgcttttctgggatatacagctggtttagtctgtacaattgttgtcatgaactggtttcaagctgcacagccggctctgttatacattgtaccaggagttattgggttcttggctgttcattgcctatggaatggagaggtcaaaccgttactggagtttaatgagtcaaaagcagctagttcagaagaggaaacaagcagcaagaaattggagtgagttgtggaaaggatataggattttaccattaggttttgctctaacttatgcaattttcatagacatttacaagattttgcaatcatccttttgaatattaaatatttcaattttcatagacttttgaactgccttgtttcaattctattgcaatttaccatattttacaataaaaaagaaa

SEQ ID NO: 3110 - DNA, 1394 bp, Flaveria ramosissima
tacatgctgtaaataataattattataacgctctctgctgctgtgcatcatcggagcaccaccggaaaacagagagctgcatcggaaccaccgcacacggcggtttaactttcgccattgaaggtgcgaaatcaagagtgtttggatcgattgatagatcgtatttatcaatctgtttactggctgtttgatttctcgtgtttcgtatcagttgcggccacagatccagctttcatctagcaagcaaagattcacttttcatcgaggtttcttcattgtagctgtgatgatgaagaatggtgagcgtgcggcaaacattgctctagcaggtctgacactggcaccattagttgtaaaggtagatacaaatttaaatgtcatattgactgcatgcctcacggttttcgtgggttgctaccgttctgtcaagccgacacctccttctgagacgatgtccagtgagcatgcaatgcgttttcccttagttggcagtgccatgttgctgtctttgttcttgctttttaagtttctatcaaaagacttggtcaatgcagtgctgacaggctacttttttatacttgggatcatcgctctttcggctacactcttacctgcaattggacggtttctaccaaacaagtggaatgatgatgtcataatatggcgatttccatattttcgctctgtggaggtcgagttcacaaggtctcaagttgttgctgcaattcctggtacattcttttgtgcatggtatgctgcacaaaagcattggctggctaacaacatattgggtcttgcattctgcattcagggaatcgaaatgctctctcttggctctttcaagactggtgctattctgttgtctggactttttgtgtatgatatattctgggtcttcttcacaccagtgatggtcagtgttgctaaatcatttgatgcacctatcaagcttctatttccatctagaatagacacacgcccattttccatgcttggtttaggagacattgtaattccaggaatttttgtagctttggcactgcgatatgatgtgtcaagaggaaaagaaagccactacttcaaaagtgcttttctgggatataccgttggtttggtctgtacgattgttgtcatgaactggtttcaagctgcacagccggctctattatacattgtaccaggggttattggattcttggcggctcattgcctatggaatggagaggtcaaaccgctattggagtttaatgagtcaaaaacagttagttcaggagatgaaacaagcagcaagaaattggagtgagctgtggaaaggatataggatttttacattagagttttgctctaacttatgcaattttcagacatttactagattttgcaatcatcctttt

SEQ ID NO: 3111 - DNA, 1118 bp, Euphorbia peplus
aaaaatgaagaacggtgaacgcattgcgaatattgctttagcaggtttgacattagcaccacttgttgtaaaggtagatccaaatttaaatgtcatcttaactgcatgtctgtcagtttatgttggatgctaccgatctgtcaagccaactccacctacggagactatgtccaatgagcacgcaatgcgctttccgtttgttgggagtgcaatgctgttatctctattcctactcttcaagtttctttcaaaagacttggttaatgctgtactgacttcctacttcttcgtgcttggaatcatcgcgctttcggcaacattattaccagctatcaaacgatatttgccaaacagttggaatgatgaccttattatatggcgcttcccgtattttcgctctttggagattgagttcaccaaatctcaggtcatagctgcaattcctgggacgtttttctgtgcatggtatgcttccaagaagcattggctggctaacaatattctgggtttggctttctgtattcagggaattgaaatgctttctctcgggtcttttaagactggtgccatcttactggcaggacttttcgtatatgatattttctgggttttcttcactcctgtgatggttagtgttgcgaaatcttttgatgcccctattaagcttttattcccaacgggaaacgctgctagacccttttccatgcttggtcttggtgatattgtaatcccgggtatttttgtagctttagctttgcgattcgatgtgtctagaggaaaagagagccaatacttcaagagtgcctttttcggatacgcctttggcgtggtcctcaccattgttgtaatgaactggttccaagctgcacagcctgcacttttgtatattgttccagccgtaataggatgcttaggagctcatgtgttatggaatcgggaagtcaaaccgttgatggaattcgatgaatcaaagaccaaggatggtggcgaaaccaaccctgcaaaaaaggtggaatgagtgcaaacctttcatgtgattggatagaacgaaaaaattgctttatctttttgagatcagtcaactaactttgcactattgtgtaacagattttggaatt

SEQ ID NO: 3112 - DNA, 1357 bp, Mimulus guttatus
aacccagttttgattttgttagcgtctgtaaaaaccaaaaccctctctctctctctctctgtgtgtgaaaattacactcactgaaggtgataccgatctgcctgttagcgttcaggggagcaagacattggagccgcattagtcttctctttttttcgttgagaaatcgaaggacagtttagaattttaattagatacacgatgaagaaccacgagcgcatggctaatcttgctctagcaggcttggccctagccccacttgttgtgaagatagacccaaatttaaacgtcattttgacggcttctctaacagtctacgtgggctgctatcgttccgttaaggcaactccaccatccgagacaatgtctaacgaacacgcaatgcggttcccattggtcgggagtgcgatgttgttatctctgtttttgcttttcaaatttatgtcaaaagatttggttaatgctgtactcacgtcctatttttttgtcctcgggatcgccgctctatcagcaacattattaccggcaatcgcaagatttctccccaaaccgtggaatgataatctcattatttggcgtttcccgtatatccggtctttggaggttgaatttacaaaatcgcagataattgcggcgattcccggaaccttcttttgtgcatggtacgctacaaagaagcactggctagctaacaatatcttggggcttgctttctgcattcagggaatcgaaatgctttcacttggctccttcaagaccggtgcaattctcttgagcgggctttttgtatacgacatattttgggtcttttttacccctgtgatggttagcgttgctaaatcttttgatgctcctataaagcttttattccctacatcagattctgcacgcccgttttcgatgttaggacttggtgatatagtgattcccggaatatttgtagctttggcattaagatacgatgtttcgagagggaaagagagcggatattttaggagcgcctttttaggttacatagtcggtttggtcctcaccatttttgtaatgaactggtttcaagctgcacagcctgcactgctgtatatcgttccggcagttactggatttttggctgcacattgcttatggaatggggaagttaaacacttgttggagtttgacgaatctaaaacaactagctctgaagaaaccgtcgcagactcgagcaagaaagaagaatgagagactgattggtagataccttttatttatttatttaagaacatgtgaatttttttagtagtcaaactaacttattcaccacagatattgttgtaccagattttgttaattaattagaaaacatattattatgact

SEQ ID NO: 3113 - DNA, 1313 bp, Plantago ovata
cggccgggggctctcactctctcctcttggaaactgaaacccctctcctctcctttccgtttcttttgcctttcaagattgatcgacgatatacgtgaacgttgtaatttggtaccattccatgaagaacggtgagcgtctcgctaatttggtccttgcaggcttgacctttgccccacttgttgtgaaggtggacccaaacttaaatgtcgttttgacggcttgtctagcagtttatgtgggttgcttccgttctgttaagccaactccaccatctgagactatgtccaatgagcatgccatgagatttccgttggttggtagcgccatgttgctgtcactgtttttgcttttcaaattcgttccaaaagacttggtcaacacagtattaacgtgctatttcatcgtacttgggatagttgctctttcggcgacattgttaccttcgatcaaaagatttttgcctaatgagtggaatgataatctcattgtgtggcgtttcccatatatcaaggctttggaggtcgagttcacaaaatcacagatcgttgcagcaattcctgggactttcttttgtgtttggtatgctctaaaaaagcactggctagctaataacatcttgggacttgcattctgcattcagggaattgaaatgctttctcttggttccttcaaaactggagctattctcttgggtggacttttcatatatgacatattctgggtcttttttaccccagtaatggtcagcgttgcaaaatcatttgatgctccaataaagcttttgttccccacagcaaatgctgcacgtccattctccatgttaggactcggtgatatagtgatccccggaatttttgtagcattggcattgagatttgatgtttccagaggaaaagatggtcagtatttcaagagtgcatttgtaggatacgcagttggtataatcgccacaattattgtaatgaactggtttcaggctgcacagcctgcacttctgtacattgtgccttctgttatcggatttttggctacacattgcctgtggaatggggaagtcaaacctttgttggagtttgatgagtcgaagaaaagtagctctgaagaaactgatgcagattctactaagaaagaggagtaagattgactagcagagcaggcaaaggtgaaagtttttcatgacgaacagttatgacatgctaaaagcttagttagtggtcaaactaacttatgacctaaaatttgttgtatcggatgttttaagaacagcacaagaggaatgtgacctttgaaagattttaccaatacgaatt

SEQ ID NO: 3114 - DNA, 1277 bp, Plantago ovata
cggccgggggctctcactctctcctcttggaaactgaaacccctctcctctcctttccgtttcttttgcctttcaagattgatcgacgatatacgtgaacgttgtaatttgataccattccatgaagaacggtgagcgtctcgctaatttggtccttgcaggcttgacctttgccccacttgttgtgaaggtggacccaaacttaaatgtcgttttgacggcttgtctagcagtttatgtgggttgcttccgttctgttaagccaactccaccatctgagactatgtccaatgagcatgccatgagatttccgttggttggtagcgccatgttgctgtcactgtttttgcttttcaaattcgttccaaaagacttggtcaacacagtattaacgtgctatttcatcgtacttgggatagttgctctttcggcgacattgttaccttcgatcaagagatttttgcctaatgagtggaatgataatctcattgtgtggcgtttcccgtatatcaaggctttggaggttgagttcacaaaatcacagatcgttgcagcaattcctgggactttcttttgtgtttggtatgctctaaaaaagcactggctagctaataacatcttgggacttgcattctgcattcagggaattgaaatgctttctcttggttcctttaaaactggagctattctcttgggtggacttttcatatatgacatattctgggtcttttttaccccagtaatggtcagcgttgcaaaatcatttgatgctccaataaagcttttgttccccacagcaaatgctgcacgtccattctccatgttaggactcggtgatatagtgatccccggaatttttgtagcattggcattgagatttgatgtttccagaggaaaaaatggtcagtatttcaagagtgcatttgtaggatacgcagttggtataatcgccacaattatagtaatgaactggtttcaggctgcacagcctgcacttctgtacattgtgccttctgttattggatttttggctgcacattgcctgtggaatggggaagtcaaacctttgttggagtttgatgagtcgaagaaaagtagctctgaagaaactgatgcagattctactaagaaagaggagtaagattaactagcaggcaaaggcagtgaagacatgccaaaaaagcttagtcagtggtcaaatgacctaaaaatttgttgtatcggatgtttaagaaacagctcaagaggaatatgaccgttgaaagattttaccaata

SEQ ID NO: 3115 - DNA, 1479 bp, Helianthus annuus
cgcggggatctattataagctgtaagtaattataaagcgtgagcataccaccggaagaaagggaacgaccaccgccggcggttttactctcgccattcaacggtacgaatcgatagggttttggatccaccgatcgttcgatcgatcctgtgtatcaatctatttatcaaggccatagatccagctatcatctagcaagcaaagattcactttttatctagatttcttctgaaattacttatttgtagtcgtgacaatgaagaatggcgagcgtgccgcaaacattgctctagcaggtctaacattggcaccattagttataaaagtagatacaaatgtaaatgtcatattgactgcatgcctcacagttttcgtgggttgctaccgttctgtcaagcccacacctcctactgagacaatgtctaatgagcatgcaatgcgttttcccttagttggcagcgcaatgttgttgtctttgttcttgctctttaaatttctatcaaaagacttggtcaacgcagtgctgacaggctacttttttatactcgggatcatcgctctttcggctacactcttacctgcaattgctcggtttctaccaaacaagtggaatgatgatctcataacatggcgtttaccgtatttccgctctgttgagatcgagttcacaaggtctcaagttgttgctgctattcctggtacatttttttgtgcatggtatgctgcacagaagcattggctcgctaacaacatattgggtcttgcattttgcattcagggaatcgaaatgctctctcttggctctttcaagactggtgccattctgttgtctggactttttgtgtatgatatattctgggtcttcttcacacctgtgatggtcagcgttgctaaatcatttgatgcacctatcaagcttctatttccatctagaattgccgcacgccccttttccatgcttggtttaggggacattgtaattccaggaatttttgtagctttggcactgcgatatgacgtgtcaagagggaaagaaagccactacttcaaaagtgcttttctaggatacacagttggtttggtctgtacaattgttgtcatgaactggtttcaagccgcacagccggctctgttatacattgtaccgggagttatcgggtttttggctgctcattgcctgtggaatggagaggtcaaaccgttattggagtttaatgagtcaaaagcagctagttcagaagaggaaacaagcagcaagaaagtggagtgagttgtggaaaggatataggatttttacattaggttttcctctaacttatgcagttttcatagacatttactagatttttgcatcatccttttgaatcttaattttcatagacttttgaactgtcttgtttcatattccatcgcaatctacttattctttttgaaacataaccattttaacgtttaagacggtatatgattctctataaa

SEQ ID NO: 3116 - DNA, 1393 bp, Helianthus annuus
gagcataccaccggaagaaagggaacgaccaccgccggcggttttactctcgccattcaacggtacgaatcgatagggttttggatccatcgatcgttcgatcgatcctgtgtatcaatctatttatcaaggccatagatccagctatcatctagcaagcaaagattcactttttatctagatttcttctgaaattacttatttgtagtcgtgacaatgaagaatggcgagcgtgccgcaaacattgctctagcaggtctaacattggcaccattagttataaaagtagatacaaatgtaaatgtcatattgactgcatgcctcacagttttcgtgggttgctaccgttctgtcaagcccacacctcctactgagacaatgtctaatgagcatgcaatgcgttttcccttagttggcagcgcaatgttgttgtctttgttcttgctctttaaatttctatcaaaagacttggtcaacgcagtgctgacaggctacttttttatactcgggatcatcgctctttcggctacactcttacctgcaattgctcggtttctaccaaacaagtggaatgatgatctcataacatggcgtttaccgtatttccgctctgttgagatcgagttcacaaggtctcaagttgttgctgctattcctggtacatttttttgtgcatggtatgctgcacagaagcattggctcgctaacaacatattgggtcttgcattttgcattcagggaatcgaaatgctctctcttggctctttcaagactggcgccattctgttgtctggactttttgtgtatgatatattctgggtcttcttcacacctgtgatggtcagcgttgctaaatcatttgatgcacctatcaagcttctatttccatctagaattgccgcacgccccttttccatgcttggtttaggggacattgtaattccaggaatttttgtagctttggcactgcgatatgatgtgtcaagagggaaagaaagccactacttcaaaagtgcttttctaggatacaccgttggtttggtctgtacaattgttgtcatgaactggtttcaagccgcacagccggctctgttatacattgtaccgggagttatcgggtttttggctgctcattgcctgtggaatggagaggtcaaaccgttattggaatttaatgagtcaaaagcagctagttcagaagaggaaacaagcagcaagaaagtggagtgagttgtggaaaggatataggatttttacattaggttttcctctaacttatgcagttttcatagacatttactagatttttgcaatcatccttttgaatcttaattttcgtagacttttgaactgtcttgtttcatattccatcgcaatctacttattctttttg

SEQ ID NO: 3117 - DNA, 1428 bp, Tripterygium wilfordii
gatctgtttgtaaacaatcgccgcagagagtaagagagagaaagctcatctgcttctctctcctcctcagttttggattgtgatcggaagagtgaggccgtatcggagctgtttgtttcgtgttggctcggtggcaaaatatctaatttttggttgaattattttgaagacataaagatgaagaactgtgaacgtattgcaaatttcgctcttgcaggtttgacattggctccactagttctgaaagtagacccaaatttaaatgtcattttgactgcatgcctgacagtatatgtcggctgttaccgatctgtcaagccaactccaccttcagaaaccatgtctaatgaacatgccatgcgattcccctttgttggaagtgcgatgctgttatcactgttcttactcttcaagtttctgtcaaaagacttggttaatgctgtactgacgtgttatttctttgtccttggaatcgctgctctttcggcaacattgttaccatctataaaacgttttctgcctatgcattggaatgataatgctattgtttggcgttttccatatgttcgtgctttggagattgagttcacaagatctcagatagtagctgcgattcctggaacatttttctgtgcttggtatgcttcccagaagcactggttggccaacaatacattgggcctagctttctgtattcagggaattgaaatgctttctcttgggtcctttaagaccggtgtcattctcttggctggactttttgtgtacgatatattctgggttttcttcactccagtgatggttagtgttgcaaaatcatttgatgctcccataaagcttcttttccccacggcagattctgctcgaccattttccatgcttggacttggtgatattgtaatccctggtattttgtggcacttgctttgcgctttgatgtatctagaggaaaagagagccagtactttaagagtgcttttctgggatactcagttggcttggtccttacaatcgtcgtcatgaactggtttcaagctgcacagcctgcgctcttgtatattgtcccatgtgttattggattcttggctgctcattgcataatgaatggtgaagtaaaacagttgttggagtttgacgaatcaaaaactgctggatcgtcgtcggaaaaagttggggatgcgaaatcgtcgcctgaagaagttagcaagaaggtggaatgaccctccacctccagatacaaaacccataatttagattcagagataccgttttcttttttgagtattcgaaacctccaaaagcggctcaaccttctttgccaacttgcatacttgttgtaaaagattttggaatttggcagagtccagccccttccagggggggatatgagatgatgctatttagttttattttataattttcaaagac

SEQ ID NO: 3118 - DNA, 1500 bp, Tragopogon dubius
gcggggactagaagaagacataacggagacgtacaggagaaaggggaaatttgctaaaacctccgaaaccattatcgccggcgtacccccggcgattgtcgattctcaatttcttctgcgaaggaaagagaaggagacttcgagagggtcgtcgatcgatcaatcgatctagtccatctagtttatctactagccgtttctggtgctacagtttattctgattctgcttccaattaacgagcaaaaaacatcaacattatctaactctctactcaaatcactcacttttaacaatgaagagtggcgagcgagctgcaaatgttgctctagcatgtttaaccctcgcaccactggttgtgaaggtagacccaaacataaatgtcatcttgactgcatgcctctcagtttttgtgggttgttaccgctctgtcaaaccaacacctcctaccgaaacaatgtctaatgaacatgccatgcgtttccctctagttggcagtgcaatgctgttatctctgttcttgctctttaagtttctatcaaaagacttggtcaatgcagtcttgacttgctacttctttgttcttggcatcatcgctctttcggcgacactcttacctgcaatcagacggtttttaccaacaaagtggaatgaagatgttataacatggcgtttcccttactttcactctttggatgttgagttcacaaggtctcaagttattgctgcaattccgggtaccttttttgttgtgtggtatgttgcacaaaagcattggctggcaaacaatatcttgggacttgcattctgcattcaggggattgaaatgctttcacttggctcattcaagactggtgccattcttctggttggattatttttttatgatatattttgggtcttttttacccctgtgatggtcagtgttgccaaatcatttgatgctcctataaagcttttgttcccaacaagagatgctgcacgcccattttctatgcttggtttaggcgacattgtaattccagggatttttgtagcattggcactgagatttgatgtttcaagagggaataaaagcaattatttccagagtgctttcttgggatatgcagttggtgtgattcttacgattgttgtcatgaactggtttcaagctgcacagccggctttgttatacatcgtaccgtcagttatcgggttcttgggtgttcattgcatatggaatggggaggtcaaaccgttattggagtttgatgagtctaaaacagttgatggtgatggtgatggtaatggtaatggtaatgtagatgagaaaacaagcaagaaagtagagtgagagagattagaagtctggtttacaaaatacaaataggaggaattatggttttcttacatttttcctttatacttgctttttctggaattgtagcacccatcttttggttaagttatgcaatagacttactttgatgttattaagctcttgctcattgcatatgctg

SEQ ID NO: 3119 - DNA, 1853 bp, Pinus pinaster
ttgctgtttagtgtcgagatcgtcgcgttcgaaagcctcttctgcacacattatcttgttttgcatttttcatatcaaatccaattgaggtgaattttgaattgccgaggcctggtatcccgggtattcgatcagccatgaggatgaatgagaagctcgcaagtgccgctctggcagttttatcagtggcaccacttgttgtaaatgtgaatccaaacctgaatgtagtcttgacagcatgccttactgtgtatgttggttgctatcgttctgtcaagcctgcaccaccttcagagaccatgtcaaaggagcatgcaatgcgctttcctctgattggaagtgttgtgcttgtttcactattcttgctgttcaagttcttatcaaaagacttggtcaatgccattctcacaagttactttttcgttcttgggataattgcattatcagccacattgttacctgctattgagcgttttctgccaaagaagtggaatgagtcaccaataaacttccatcttccatattttaaatctgtggaagtagagttcaccaaatcacagcttgtggctgctattcctggaacatttttttgcacgtggtatgcattgaagaaacactggttagcaaacaacgttttgggattggcattttgtatacagggtattgagatgttatctcttggatccttcaaaactggggctatcctcttggcaggactctttgtatatgatattttttgggtattcttcactccagtgatggttagtgtagccaagtcctttgatgctcccattaagctgctatttcccacagcagatgcagcccggccttattctatgcttgggcttggtgatattgttattccaggaatttttgtggctttagctttacgatttgacgtctcaagagaaaaaggagaacgatactttaagagtgcattcattggctacgcagtaggagtgattgtcacaattattgtgatgaattggtttcaggcagctcaacctgcccttctgtatattgttcctggtgtaattggatttttagctgtgcattgcatttggaatggggaagtcaagccattgttggaatttgatgaatctaagacttctgctcaatcaagttcagccgacacatctcaatcagatggagatgcagtagttgcagatggaaagccagatcacaaatcagattaggaaaataaggaagtccataattttcatcgtgggtgctattacaagtgctcaaaactggggccttttcttcggcatcattatcatataattcataaatcagcagcaaatcaaatacgtgcttgctggtattttccatttcaaaaaagtgatctagaaactggactcgtattttcttcacttttacatgctttaaaaatttcctctgggcagttcagcatgagggcatgtcttccattttgtacggcatatttcatggatttcttatatttgagattagctctgatctaagaagatgggtggtaatttatcttgtgattactaagttcataatgccctctgataaaatatctaacattaaaattattgacagcaaagataaattctttcaggtgtcttatttagtgcaattgtacatgttagtggtttatacatgttgccacaacattttgggccagaggcgggatgcttaaattttttggcatcccaattgtattgttggaagcaattgcattcttagatgttaacttaaaattttgaaaatagacggtattttgaggagtagttgtttctctcattttgtactgatttgccacccttatgctattcttttggagccttacactttatgctctgctagaggttcaatgctacatctat

SEQ ID NO: 3120 - DNA, 1340 bp, Ambrosia trifida
tgaaataaataaacttgtgtatatcctgtaataattataaaagcgagcagagcagccctgcataccaccggaatacaggtagctgctgccctaccaccaccatcaacggcggtcttaattttgtctaggccatagatccaactttcatcgagcagggtgagattcactttttatctaggtgtcttcttattttagtcgtcacaatgaagaatggtgagcgtgccgcaaacattgctctagcaggtctaactctggcgccattagttataaaagtagatacaaatgtaaatgtcatattgactgcatgcctcacagttttcgtgggttgctaccggtctgtcaagccgacacctcctactgagacaatgtctaatgagcatgcaatgcgttttcccttagttggcagtgcaatgttgttgtctttgttcttgctctttaaatttctatcaaaagacttggtcaatgcagttctgacaggctacttttttatacttgggatcatcgctctttcagcaacactcttacctgcaattgctcggtttctaccaaacaagtggaatgatgatgtcataacatggcgtttcccgtattttcgctctgtggagttcgagttcacaaggtctcaagttgttgctgctatccctggtacatttttctgtgcatggtatgctgcacagaagcattggctggctaacaacatattgggtcttgcattttgcattcagggtattgaaatgctctctcttggctctttcaagactggtgccattctgttgtctggactttttgtttatgatatattctgggtcttcttcacacctgtgatggtcagcgttgctaaatcatttgatgcacctatcaagcttctatttccatctagaattgccgcacgccccttttccatgcttggtctaggtgacattgtaattccaggaatttttgtagctttggcactgcgatacgatgtgtcaagagggaaagaaagccactacttcaaaagtgcttttctgggatatacggccggtttggtctgtacaattgtcgtcatgaactggtttcaagctgcacagccggctctgttatacattgtaccaggagttattgggttcttggcggttcattgcctatggaatggagatgtcaaaccgttattggagtttaatgagtcaaaagcagcagctagttcagaagaggaaacaagcagcaagaaattggagtgagttgtggaaaggatataggatttttacattaggttttgctctaacttctgcaagtttcatagactatttactagtattttgcaatcattccttttgaatattaaatattcaattttcata

SEQ ID NO: 3121 - DNA, 1459 bp, Cirsium arvense
gttactagtcgaagacataacgtagacgaacagaagaaaatttgctaaaacctctgaaaccaccaccgccgcccgccggcgtagtctccggcgattagtcgattctcaatttctactgtcgtcaaagaaggggttgatcaatcgatctagttcatctaatccatctactcatttttcaagtctgatttctggtggtacagttaaattacgattctgcttctaattagcgagcaaaacatcgggagttcgtttggattttactgaaataacctagtttgacaatgaagagcggtgagcgagctgcaaatattgctctagcaggtctaacactggcaccgctagttctgaaggtagacccaaatataaatgtcatcttgactgcatgcctaacggtttttgtgggttgttatcgctctgttaagccaacacctccttctgagacaatgtctaatgaacatgccatgcgtttccctctagttggcagtgcaatgctgttgtctttgttcttgctctttaagtttttgtcaaaagacttggttaatgccgtcctgacatcctacttcttcgtgcttggcatccttgcactttcggcgacgctcttacctgcaataagacggtttttacctaccaagtggaatgaagatgttataacttggcgtttcccgcattttcattctttggacgttgagttcacaaggtctcaagctgttgctgcgattccggggacctttttttgtgtgtggtatgttgcacagaagcattggctggctaacaatattttgggacttgcgttttgcattcagggaattgaaatgctttcccttggctcattcaagaccggtgctattctgttggctggactttttttctatgatatattttgggtcttttttacccctgttatggtcagcgttgccaaatcttttgatgcacctataaagcttttattccccacgagggatgctgtacgtccgttttctatgattggtttaggtgatatcgtaattccaggcatttttgtagccttggccctgagatttgacgtatcaagagggagaaaaagccactacttcaagagctctttcttgggatatgccgttggtgttatccttacaattcttgtcatgaattggttccaagctgcacagcccgctctgttttacattgtacctgccgtaatcgggttcttggctgctcattgcatatggaacggggaggtcaaaccgttattggagtttgacgagtctaaatcagcaattgtcgattctgatatagatgagaaaacgaacaagatagagtagatcaagagatagaaaaagtctggtctagatgttcaaaatagaaggaaatatggtttcttttctttcatacttgtggcattttcgcgccaatttctcggtaacttatcgcgaatagatgttttctaatcgattaagcacttgatccaaaaaagaaaaaa

SEQ ID NO: 3122 - DNA, 1257 bp, Flaveria ramosissima
atttcttctttgtagtcgtgacaatgaagaatggtgagcgtgccgcaaacattgctctagcaggtctgacactggcaccattagtcgtaaaggtagacacaaatataaatgtcgtattgactgcatgccttacggttttcgtgggttgttaccgttctgtcaagccgacacctccttctgagacgatgtctagtgagcatgcaatgcgttttcccttagttggaagtgcaatgttgctgtctttgttcttgctttttaaatttctatcaaaagacttggtcaatgcagtgctgactggctacttttttatacttgggatcattgctctttcggctacactcttacctgcaattggacggtttctaccaaacaagtggaatgacgatgtcataatatggcgattcccatattttcgctctgtggaggtcgagttcacaaggtctcaagttgttgctgcaattcctggtacattcttttgtgcatggtatgctgcacagaggcattggttggctaacaacatattgggtcttgcattctgcattcagggaatcgagatgctctctcttggctctttcaagactggtgccattctgttgtctggactttttgtgtatgatatattctgggtcttcttcacaccagtgatggtcagcgttgctaaatcatttgatgcacctatcaagcttctatttccatctagaattgacacacgccctttttccatgcttggtttaggagacattgtaattccaggaatttttgtagctttggcactgcgatatgatgtgtcaagagggaaagaaagccactacttcaaaagtgctttcctgggatataccgttggtttagtctgtacaattgttgtcatgaactggtttcaagctgcacagccggctctattatacattgtaccaggggttattggattcttggctgctcattgcctatggaatggagaggtcaaaccgttattggagtttaatgagtcaaaaacagttagttcaggagacgaaacaagcagcaagaaattggagtgagttgtggaaaggatataggattattacattagagttttgctctctaacttacgcaattttcatagacaattactagattttgcaatcatccttttgaatattaaaaatatataaattctcatagacttctgaactgttttttttaaccttccattgtaatttgcaaaccaacacacacacttaatgatggtggttgtgtaagttcaagcgtcatgcgtag

SEQ ID NO: 3123 - DNA, 1297 bp, Flaveria ramosissima
aatattaataattataacgctctcagctgctgtgtatacttcggtgcaccaccggaaaaacagagagctgcatcggaaccaccgcacacggcggttcaactttcgccattgaaggtgcgaaatcgagagtgtttggatcgattgatagatcctgtttatcaatctgttcaccggtggtttgatttctcgtgtttcgtatcagttgcggccatagatccagcttccatctagcaagcgaagattcacttttcatctagatttcttctttgtagtcgtgacaatgaagaatggtgagcgtgctgcaaacattgctctagcaggtctgacactcgcaccattagtcgtaaaggtagatacaaatataaatgtcgtattgactgcatgcctcacggttttcgtgggttgctaccgttccgtcaagccgacacctccttctgagacgatgtctagtgagcatgcaatgcgttttcccttagttggaagtgcaatgttgctgtctttgttctttctttttaagtttctatcaaaagacttggtcaatgcagtgctgacaggctacttttttatacttgggatcattgctctttcggctacactcttacctgcaattggacggtttctaccaaacaagtggaatgatgatgtcataatatggcgattcccatattttcgctctgtggaggttgagttcacaaggtctcaagttgttgctgcaattcctggtacattcttttgtgcatggtatgctgcacagaagcattggttggctaacaacatattgggtcttgcattctgcattcagggaatcgagatgctctctcttggctctttcaagactggtgccattctgttgtctggactttttgtgtatgatatattctgggtcttcttcacaccagtgatggtcagcgttgctaaatcatttgatgcacctatcaagcttctatttccatctagaattgacacacgccccttttccatgcttggtttaggagacattgtaattccaggaatttttgtagctttggcactgcgatatgatgtgtcaagagggaaagaaagccactacttcaaaagtgctttcctgggatataccgttggtttagtctgtacaattgttgtcatgaactggtttcaagctgcacagccggctctattatacattgtaccaggcgttattggattcttggctgctcattgcctatggaatggagaggtcaaaccgttattggagtttaatgagtcaaaaacagttagttcaggagacgaaacaagcagcaagaaattggagtgagtt

SEQ ID NO: 3124 - DNA, 1466 bp, Lippia dulcis
ggtgacttgtacgttggactaatacgggaaaagcaccgcaacaatggtcaaaagtacaacacctttaagcgtctgaatgaagtttcaataaatgcaattatccaatctatgacaccccgatttctctgcgcataaaaactaaaacctctctctttctctctctagctttgccagaattacacacactgaaggtgactccgatctcttgttggaattggggagactgatattcggggagagagaaattagaaaccccaccagtttcgtcttctgtagaggatcttggaaggaaactgaggacagttcagataagatactgcaatgaagaatcatgagcgtgtggctaatctggcactagcaggtttgaccctggccccgctttttgtgaaggtagacccaaatttaaatgtcattttaaccgcttgtctagcagtctatgtgggttgctaccgttctgtcaagccaacaccaccatcagagacaatgtcgaatgaacatgcgatgcggttcccattgattgggagcgcgatgttgttgtcactgtttttgcttttcaaatttctatcaaaagacttggttaatgccgtactgacgtgctattttttcgtacttgggatcgttgctctttcggcaacattgttacctgcaatcaaaaaatttctacctaaagaatggaatgataatctcattatttggcggttcccatatatccggtctctggaggttgagtttacaaaatcccagatcattgcagcaattcctggattcttcttttgtgcttggtatgcttcgaagaagcattggctagcaaacaacattttgggtctcgctttctgcattcagggaattgaaatgctctcacttggctcgtttaagaccggtgctattctcttgactgggctttttttatacgacatattctgggtctttttcacccctgtgatggttagcgttgctaaatcttttgatgctcctatcaagcttctattcccgacatcaaattctgcacgtccattttccatgttaggacttggcgatattgtgatccctggaatttttgtagcattggcactaaggtttgatgtttccagaggaaaagacggtcaatattttaagagtgcttttgcaggatacacagttggtttggtgctgactatagttgtaatgaactggtttcaagctgcacagcctgcactgttgtatatcgtgccggctgttatcggattcttggctgcacattgcttatggaatggggaagttaaacccttattggaatttgatgagtctaaaacgacgggttctaaagaatctgaggccgagtcgaccaagaaagaagactgaaggttggactggtattccaatttactttgaatgccatgtgagagtttagtggtgaactaatgcttatgtagcacggaatgttgtaccagattttgttaatcagaaaagataacttttagttgaca

SEQ ID NO: 3125 - DNA, 1269 bp, Euonymus alatus
gactttcagatgacagcacctcctatctcaaaaatatcctctgttagtttagtcacagtctctcgcgtttcgacagcctctccgatctgtttgtaaacaatcgctagagagtaagagagagaaagatcatctgcttctctctctcctcctcaggcagcatctttaaagatgaagaactgtgaacgtattgcgaatttcgccctagcaggtttgacattggctccactagttatgaaggtagacccaaatttaaatgtcattttgactgcaagcctgactgtatatgttggctgttaccgatctgtaaagccaactccgccttcagaaaccatgtctaatgaacatgccatgcgattcccctttgtcggaagtgcaatgctgttatcactgttcttactcttcaagtttctgtcaaaagacttggttaatgctgtactgacgtgttatttcttcgtgcttggaatcgctgctctttcggcaacattgttaccatctataaaacgttttctgccaaaccattggaacaataactctattgtctggcgttttccctatattcgtgctttggagattgagttcacaaggtctcagataatcgctgcgatccctggaacattcttctgtgcgtggtatgcttatcagaagcactggttggcaaacaatacattaggcctagcattctgtattcagggaattgaaatgctttctcttgggtcctttaagactggtgccattctattggctggactttttatatatgatatattctgggttttcttcactccagtgatggttagtgttgcaaaatcatttgatgcccccataaagcttcttttccccacagcagattctgctcggccattttccatgctgggacttggtgatattgtaatccctggtatttttgtggcacttgctctgcgctttgatgtatctagaggaaaagagagccagtattttaagagtgcctttctgggatacacgattggtttggtccttacaattgttgttatgaactggtttcaagctgcacagcctgcgctcttgtatattgtcccatgtgttattggattcttggctgctcattgcatattgaatggtgaagtaaaacagttgttggcgttcgatgaatcaaaaactgctggatcgtcgtcagaagaagttagtgatgccaaatcgttgtcggaagaagttagcaagaaggtggaatgaccctcaagatacaatacccataatttagattcagagaatacggttttgtatcttttt

SEQ ID NO: 3126 - DNA, 1532 bp, Aquilegia formosa
tctctctctctctctctctcacttcgatctgttaaacccacgagagcgagagatcagatttcttcttctctcattttcttctcaaggcacatgcttcttcatcaaaacgagcaaaaatcactaattttcgctctattcaatcagatactatagttaataatactgtttattacgagtttaagaaagatgatttccagtgaacgtgttgcaaatttggctctagcaggtttgacattggccccactggtcgtaaatgtaaaccccaatctaaatgtaatattgacagcgtgcttgacagtatatgtcggttgctatcgttcagtcaagccaacacctccagcagagacaatgtcaaatgagcatgcaatgcgcttccccttgatagggagtgcaatgctgttatcattgtttttgctattcaagtttttgtcaaaagatttggttaatgctgtactcacatgttacttctttgttcttgggatcctagcactttccgcaacattgttacctgcaattgcgcgttttcttcctaagaaatggaatgataatcttatttcctggcgtcttccttattttcgctctgtagagattgagttcacaatatctcagtgtattgcggcaatccctggaacatttttctgtgcatggtatgcaaaacagaagcactggttggctaataatatattgggacttgcattctgcattcagggaattgaaatgctttcgcttggttctttcaaaactggtggcatcctcctggctggtctttttgtgtacgatatcttctgggtcttctttactcctgtgatggttagcgttgcaaaatcatttgatgctcctataaagcttttgttcccaactggagactctgcaaggccattttccatgcttggactgggtgacattgtaattcctggtatttttgttgcactggcattgcgtttcgatgtttcaagaggaaagaagaatagatatttcaggagcgcattttttggatatacagtcggcttagtccttacaattgttgtgatgaactggtttcaagctgcacagcccgcacttttgtatattgtaccagctgttattggatttttggcagttcattgcatagcaaatggagaagttaaaccgttgttggagtttgatgagtctaaaactgagggctccgaagatggagagtcaagtggcaaggatgaaaagtccagcaagaaagaggagtagtgaaccttagctctgcgttcttcttttctagttaattgggtaaggaatgaggtttacatttgaggatattgaacgcctttggtgcctagacacaaactaacttttggaactggacagagagccattgtagcagaccatcttactgggtcataaattatagagttcagtttacaggagtttttgttttttccttagacttcacctcaaagaggtttacatgttgggcactcttaaaattaccaataggacttttccattttgctttaacttcgctattatagtaactcttttgtatacctgattttgaaatt

SEQ ID NO: 3127 - DNA, 1325 bp, Abies balsamea
agggtcgaaagcgttgaatctgcttttattgacgagattcttttgcgcctgcctgcttcttctgcggacatcgtctgattttgtcttttcatatcaaaatccaattgaggtgaattctgaattttggattgctgaggagtcgactggtattctgggagtactgtcagccatgaggatcaatgagaagctggccagtgctgctctagcagttttatcactggcaccccttgttataaaggtgaatccaaacttgaatgtagtcttgacagcatgccttactgtgtatgttggttgctatcgttcagtcaagcctgcaccaccttcagagaccatgtcaaaggagcatgcaatgcgctttcctctgattggaagtgttgtgcttgtttcactatttttgctgttcaagttcttatcaaaagacttggtcaatgccattctgacaagttacttttttgttcttggaattattgcattatcagccacattgttacccgctattgagcgttttctgccaaagaagtggaatgagttgccaataaactggcatcttccatatttcaaatctgtggaggtagagttcaccaaatcacagcttgtggctgctattcctggaacatttttttgcacgtggtatgcattaaagaagcactggttagcaaacaacgttttgggattggcattttgtatacagggtattgagatgttatctcttggatccttcaaaactggtgctatcctcttggcaggactctttgtatatgatatattttgggtcttcttcactcctgtgatggttagtgtagccaagtcctttgacgctcccattaagctactatttcccacagcagatgcagcccggccttattctatgcttgggcttggtgatattgttattccaggcatttttgtggctttagctttacgatttgatgtctcaagagaaaaaggagagcgatactttaggagtgcattcattggctactcagtaggcgtgattgtcacaatcattgtgatgaattggtttcaggcagcgcaacctgcccttctgtatattgttcccggcgtaataggatttttagccgtgcattgcatttggaatggggaagtcaagccattgttggaatttgatgagtctaagacttcagctcaatcaagttcagctgacacatctcaatcagatggagatacagtagttgcagatggcaagccagatcacaaatcagattagaaatataaaaaatccatgattttcttgatgggagcttgtaattaagtgctcaaaactggagcatttttttggcatcgttatcatacattcataaatc

SEQ ID NO: 3128 - DNA, 1771 bp, Sciadopitys verticillata
cgaaccttcaaaggctttttcataaaactgaaatttcgaagtttctgtctttatcagttagatttttcaaatcatataaaaaactcgaaaggaaatctaccaatattattgacgtaatttgggagcagagattccattttcacagccatgaagacctctgataagctagcgaatctagctctagcaggtttatcattagcacctcttgttgtaaaggtgaatccaaatttgaatgttgtcatgacagcatgtcttactgtttacattggttgccatcgttcagtgaagcctgcaccaccttcagagaccatgtcaaaggagcatgccatgcgttttcctttcattggaagtgttgtactcttttcgttattcttgttattcaagttcttatcaaaagacttcgtcaatgccatactcacttgttatttttttgtgctcggcataatcgcattttcggccacattgttacctgctattgaacggtttctgccaagggggtggaatgaaatgccaataaattggcatcttccatatttcagatctgtagaggtagaattcaccaaatcacaggttgcggctgctataccgggaacatttttttgtacatggtatgcattgaagaagcactggttagcaaacaacatattggggctggctttttgtatacagggtatcgagatgttgtctcttggatccttcaaaactggcgcaatcctcttggcaggactttttgtatatgatattttttgggtctttttcactcctgtgatggttagtgtggccaagtcctttgacgctcccatcaagcttctgtttcccacggcagatatgacccggccatattctatgcttggtcttggtgatattgttattccaggcatttttgtggctttggctctgcgttttgatgtctctagaggcaagggagagcgatactttaggagtgcattctttggttatacagtaggtttgattgtcacaatcattgtgatgaactggtttcaggcagcgcaacctgcccttctatatattgttccgggcgtcatcggatttttagcagtgcattgcatttggaatggtgaagtcaagcctttgttggagttcgatgagtcgaagacatcttctgaatcaaattccgttgactcagctaaacaagaaacagattcagctcttgtggatggcaagccagaccataagtcagattaggaagatcaggaagaccatgatattcatcatggaagtttgctcagtgctcagaactggaggattttatttttaggcttgtatcgaatattactaaatcagaagcacatcaatttgtgctattggtattttccatttcaaaaaccatgatctgcaacctgtaaacttacaatttcttcaaattttggcttttacttcatgaaagcttcttggcagtttaaccagatggcatgcctttcattttgtatggcacgtggtaagtttgttattttgagagtcgacagtgagatatgattagacgagatggttcaggagctccatctttgctcatacatgtcctgatgaaacaaactgagtagtattattacagcaaagatgattccactcagaggccttagttcaggtaatgcacgttctcattgcagatgcttctacaaaaatgttgggcaggaggggggatgcattaagttttatcagcatcccatttgtattgatggaattaattgcatccctagatggtagactaggattttttgaaaatgtatcaaatggtaacatcgttactaac

SEQ ID NO: 3129 - DNA, 1268 bp, Ambrosia trifida
cataccaccgtaatacaggtagctgctgccctaccaccaccatcaacggcggtcttaattttgtcaggccatagatccaactttcatctagcagggtgagattcactttttatctaggtttcttcttaaattacttattgtagtcgtcacaatgaagaatggtgagcgtgccgcaaacattgctctagcaggtctaactctggcgccattagttataaaagtagatacaaatgtaaatgtcatattgactgcatgcctcacagtttttgtgggttgctaccgttctgtcaagccgacacctcctactgagacaatgtctaatgagcatgcaatgcgttttcccttagttggcagtgcaatgttgttgtctttgttcttgctctttaaatttctatcaaaagacttggtcaatgcagttctgacaggctacttttttatacttgggatcatcgctctttcagcaacactcttacctgcaattgctcggtttctaccaaacaagtggaatgatgatgtcataacatggcgtttcccgtattttcgctctgtggagttcgagttcacaaggtctcaagttgttgctgctatccctggtacatttttctgtgcatggtatgctgcacagaagcattggctggctaacaacatattgggtcttgcattttgcattcagggtattgaaatgctctctcttggctctttcaagactggtgccattctgttgtctggactttttgtttatgatatattctgggtcttcttcacacctgtgatggtcagcgttgctaaatcattcgatgcacctatcaagcttctatttccatctagaattgccgcacgccccttttccatgcttggtctaggtgacattgtaattccaggaatttttgtagctttggcactgcgatacgatgtgtcaagagggaaagaaagccactacttcaaaagtgcttttctgggatatacagcgggtttggtctgtacaattgtcgtcatgaactggtttcaagctgcacagccggctctgttatacattgtaccaggagttattgggttcttggctgctcattgcctatggaatggagatgtcaaaccgttattggagtttaatgagtcaaaagcagcagctagttcagaagaggaaacaagcagcaagaaattggagtgagttgtggaaaggatataggatttttacattaggttttgctctaacttctgcaattttcatagacatttactagattttgcaatcatccttttgaatatta

SEQ ID NO: 3130 - DNA, 1569 bp, Quercus alba
ggtaaaaccctaatctcttcgtttcatttcatcaaaatctgaatctctctctctctctctctcctcggtggtctctccgatctgcgagaaaaaatcaagacgctagaagatatctgagccgccgacgacgacgaaacagttttgtgatcgcagaggaaaggttttggttttttaatctgatcggaaatttcagtcaaatttttcgattttagaataagataacgatgaaaagcgttgagcgaattgcgaatgtagctttagcaggtttaactttagcaccacttgttatgaaggtagatccaaacttaaatgttattttgactgcgtccctcacagtttttgtgggttgctacagatctgtcaagccaactccaccttctgagacaatgtctaatgagcatgccatgcgtttcccttttgttgggagtgcgatgctgttatcactatttttgctttttaagtttctatcaaaggacttggtcaatgctgtcttgacatgctacttctttgtgcttgggatcgttgccctttcggcaacacttttacctgctattaaacgttatttaccgacgcattggaatcaggacgttattagctggcgttttccttacttccgttctttggacgttgagttcacaaggtctcagattgttgctgcaatccctggaacctttttctgtgcatggtatgcttcacagaagcattggctagctaacaatatactgggactttccttctgcattcagggacttgggtctttcaagactggcgccattcttttggctggactttttgtgtatgatattttctgggttttcttcactccagtgatggttagtgttgcaaaatcttttgatgctcctattaagcttttgttccctacagcagataccgctcgaccatattctatgcttggacttggtgacatcgtaatccctggtatttttgtagcattggctttgcgatttgatgtgtctagagggaaacacagccagtactttaggagtgcatttctgggatattctgttggtttggtgcttacaattgttgtcatgaactggttccaggctgcacagcctgctctattgtatattgtaccttgtgtcattggatttttggcggctcattgcatatggaatggtgaagtcaaaccgttgttggcgtttgacgagtctaaggctgctaattcatccgaagaaagtagtgacagcgatgctaattctagcaagaaggaggaataagttgcagagccctggacttaggagttttccacctcaaggaaagaaatacttctcttctcttatcttctctgaggcccccaaacgcatttaaagcttagtcatggctaacttattcaacttcacaccgctgtaacagattttgggattaagttctttaggaagaaataatattttagccttttataacctaatacagccgtttctttaagttctttcattaaggggcccaatacaactgttttttttcaataatatctttttctactgccccgtttgggggtcttaagagttaagagttaacatcacccaatttttattcgcatagaga

SEQ ID NO: 3131 - DNA, 1157 bp, Capsicum annuum
caaatgtaaatgttatagtaacagcctgccttactgtctttgtgggttgctgccgttctgtcaagcctactccaccttcggaaacaatgtctaatgaacacgcaatgaggttccccttggttggaagtgcaatgctcttgtcattgttcttgctttttaaattcctgtcaaaagacctggttaatgctgtattgacgtgctacttcttcgtacttggcattgctgcactttcggcgacattgttaccttctattaaacgtttcttgccaaaaaagtggaatgacaatctcataatttggcacttcccatatttccgctctttggagattgagttcacaaggtctcagattattgctgcaattcccggaaccattttctgtgtgtggtatgctagacagaagcattggctagctaacaacgttttgggccttgccttttgcattcagggtattgagatgctttcacttggatcatttaagactggtgccatcttattgggaggactttttgtgtatgacatcttctgggtcttctttacaccagtgatggtcagtgtagccaaatcttttgatgctcctatcaagcttttgttccccacagcggatgctaaacgccccttctcaatgctgggtcttggagatatagttatcccaggaatttttgttgcattggccctccgttttgatgtctccagggggaaggagccccaatacttcaagagtgcatttttaggatacacatttggtttggcactcacaatatttgttatgaactggttccaagctgcacagcctgctttgctatatattgttccagctgttattggtttcttgtcagtacattgcatatggaacggggatgtgaagcctttgttggagtttgatgaaggaaagactaaaggcgctgaagaagcagaagccaaagaaagcaagaaggtagaatgaggccaagtagacagactgacattaaagagacgatgacctttcaattaggttatgtatcaccgtggattaatagtcacccgaggcaacagagattgttggttaagcaacaaagttggttgtattagaattttgagactgaccatcaatagtactggccttttatgttacaccttaaattgatattattaaatgtcaatttttactttcattttc

SEQ ID NO: 3132 - DNA, 1519 bp, Eutrema halophilum
gtctgtcacataactaggtcacagccagtgatttttatagtcgtcgtgtatcttgattttctttcctaactctcctttcttcctcttctcaccacttttattttttttgtttttttaacagatctggtggaatttatctctttgaccccaccactggatctctctctctatacattcatcagagatacagagtaaaaacgaaacacgaagatcagttatgaagaattgtgagagattcgctaatctcgctctcgcaggtttgacattggcaccactcgttgtgagagtgaatcccaatttgaacgttattcttacggcatgtctcacagtttatgtgggttgctttcgttctgtgaaggattctcctccaacagagacgatgtccaaggaacatgccatgcgtttcccgttggttgggagtgctatgcttctctcactcttcttactgttcaagtttctctcaaaggacttggtcaatgctgttctaacagcttacttctttgttcttgggattgtcgctctttcagcgacattgttgcccgctatcagaagatttctgcctaatccttggaatgacaatcttattgtctggcgttttccttatttccgatctttggaggtagagttcacaaagtcccaagtcgttgcaggaatccctggaaccttcttctgcgcgtggtatgcttggaaaaaacactggctggctaacaatatccttggcctttccttctgcattcagggaattgagatgctctctcttggctcattcaagactggtgccatccttttggtaggactatttttctatgatattttctgggttttctttactccggtcatggttagtgttgccaaatcctttgatgctccgataaagcttttattccctactggcgatgctctaagaccctattccatgcttggacttggtgatattgtcattccgggtatatttgttgcactggctctaagatttgatgtgtcaagacgcagtcaaccacaatacttcacaagtgcatttgtgggatacattgccggagttgtcctaacgattgtagtcatgaactggtttcaagcagcacagcctgctttgttatacattgtcccagccgtcattgggttcttggcttctcactgcttttggaacggtgacatcaaaccgttgatggcgtttgatgaatcgaagactacagaggcggaagttaacaaaactcatgaagaatgaagacaatggagaaagaagggcagaggagaaatatttatacacacataaatgtgttttcatatatgaaaaaaaacgaaggaaaacagtttttgtttccagtgatcatcagtcccttcaaatggttcacctttttgtcttttttagattttcgaacatcttttggcaaagacttgtgtaagttataagttacaacaggttaccttttactttggagataactaggtttcctttgactttctttatggattttatgttgaattcgataggaggctaatgaagctataaatcatttcg

SEQ ID NO: 3133 - DNA, 1399 bp, Flaveria ramosissima
ccgctatggggatctacatgctgtaaataataattataacgctatcagctgctgtgcatacatcggagcaccaccggaaaaacagagagctacatcggaaccaccgcacacggcggttcaactttcgccattgaaggtgcgaaatcgagagtgtttggatcggttgatagatcgtgtttatcaatctgtttaccggtggtttgatttctcgtgtttcgtatcagttgcggccatagatccagcttccatctagcaagcgaagattcacttttcatctagatttcttctttgtagtcgtgacaatgaagaacggtgagcgtgctgcaaacattgctctagcaggtctgacactggcaccattagttgtaaaggtagatacaaatataaatgtcgtattgactgcatgcctcacggttttcgtgggttgctaccgttctgtcaagcctacacctccttctgagacgatgtctagtgagcatgcaatgcgttttcccttagttggcagtgcaatgttgctgtctttgttcttgcttttcaagtttctatcaaaagacttggtcaatgctgtgctgacaggctacttttttatacttgggatcatcgctctttcggcgacactcttacctgcaattggaaggtttctaccaaacaagtggaatgacgatgtcataatatggcgattaccatattttcgctctgtggaggttgagttcacaaggtctcaagttgttgctgcaattcctggtacattcttttgtgcatggtatgctgcacagaagcattggttggctaacaacatattgggtcttgcattctgcattcagggaatcgagatgctctctcttggctctttcaagactggtgccattctgttgtctggactttttgtgtatgatatattctgggtcttcttcacaccagtgatggtcagcgttgctaaatcatttgatgcacctatcaagcttctatttccatctagaattgacacacgccccttttccatgcttggtttaggagacattgtaattccaggaatttttgtagctttggcactacgatatgatgtgtcaagagggaaggaaagccactacttcaaaagtgcttttctgggatataccgttggcttggtctgtacaattgttgtcatgaactggtttcaagctgcacagcctgctctattatacatcgtaccaggggttattggattcttggctgctcattgcctatggaatggagaggtcaaaccgttattggagttcaacgagtcaaaagcagttagttcaggagatgaaacaaacatcaagaaattggagtgagtgttgtggaaaggatgtaggaattttacataagagttttgctctaacttatgcaattttcatagacgcttaatagattttgc

SEQ ID NO: 3134 - DNA, 1485 bp, Arnica chamissonis
agggtgctgctttggaaccaccaccgcctttttgccattgaaggaacgaaccgagagggttttggatcgatcgtatccatcaatctatttgccgcggtttgatttatcgtgtttcgtgcagctgcgatcatagatccagatttcactagcaaacaaagattcactttttatctagatttcttctgaaatcacttatttgtagccgtgaaaatgaagaatggtgagcgtgccgcaaacattgctctagcaggtctaacactggcgccattagttgtaaaggtagatacaaatataaatgtcatattgactgcatgcctcacagtttttgtgggttgctaccgttctgtcaagccgacacctccttctgagacaatgtctaatgagcatgcaatgcgttttcccttagtcggcagtgcgatgttgttgtctttgttcttgctcttcaagtttttatcaaaagacttggtcaacgcagtgcttacaggctacttttttattcttgggatcattgctctttcggctacactcttacctgcaatcggacggtttctaccaaacaagtggaatgaagatgtcataatatggcgattcccgtattttcgctctgtggaggtcgaattcacaaggtctcaagttgttgctgctattcctggtacatttttttgtgcatggtatgctgcgcagaagcattggctggctaacaacatattgggtcttgcattctgcattcagggaattgaaatgctctctcttggctctttcaagaccggtgccattctgttgtctggactctttgtgtatgatatattctgggtctttttcacaccagtgatggtcagcgttgctaaatcatttgatgcacccatcaagcttctatttccatctagaattgccacacgccccttttccatgcttggtttaggagacattgtaattccaggaatttttgtagctttggcactgagatatgatgtgtcacgagggaaagaaagccactacttcaaaagtgctttcctgggatatacagttggtttggtctgtacaattgttgtcatgaactggtttcaagctgcacagccggctctattatacattgtaccaggggttatcggattcctggctgctcattgcctgtggaatggagaggttaaaccgttattggagtttaacgagtcaaaaacagctggttcagaagatgagtccaaaacagctggttcagaagatgaaacaagcagcaagaaattggagtgagttgtggaaaggatataggatttttacattagggttttgctctaacttatgcaacttcatagacatttactagattttgcaatcatccttttgaatattaaaatattttaatttcatagacttttgaactgtcttgtactcttgtttcactttcgtttggaacttgcaaaccaacacaaccgcttaacgatggcaagcggcgtgtgagttgatataaacgcacttgatgctgat

SEQ ID NO: 3135 - DNA, 2822 bp, Brassica rapa
gctgagagatcttttcactgatgatacagataacagtggagttggatcagaagacactgtgtatcgttacctgtgccctgtgagaaaagctgggagcattatcggcaaaggcggcgagatcgctaagcagataaggtctgagacgaaggcaaacatgaggatcaacgaggctttactcggttgcgaggagcgtgttgtgactatatactcaactagtgaggagacgaattgtattggagatgatgaggagtttgcttgtcctgctttcgatgcgcttctcaaggttcatgatatggttgtggctggagaggtggacagttatggttattatgatgagtatagcgagaaacagagacaaactgttgctgcgaggatgcttgtggcttcggatcaaattggttgccttattgggaaaggtgggcaggtgattcagaaactgcgtgaggagaccaatgctcagattcgtgttattaacgatagtcttcctctttgtgctttggctttgagtcaagacgagcttcttcagataattggagagcctttagctgttagagaagctctttatcaagttgcttctttgctttatgataatccgtcgcggtttcagcactactttctgtcttcttcttcgagtagtctgcatcagcaacagtccggggggatgctaatgagtcctccgctaacgagctctcacaaaaactactctgcgtcaagagatgttgctgaggcaagagagttttctatctgcttcatctgtccagctgaaaacgttggaggtgtaataggaaaaggaggcagtttcataaatcagattaggcaagaatctggtgcagttgttaaagtcaatacctctgaaactgatgaagatgatgaatgtatcattttcatatcatcaaacgagttcttcgaagatcagtccccgacagtggatgcagcattacgcttacaaacgcggtgcagtgagaaagtagggaaagactcgacagattctgcaatatcaactcgtgttcttgttcctagttcacgagtagggtgtctcattgggaaaggtggagctattatatccgagatgaggagtgtcacgaaagccaatatccgcattgttcaaggggaagacgtaccacaaattgctcgtgaggacgaggagatggtccagataacaggaagtcgtgatgcagcaatcaaggcacttacgcaagtgatgctacgattaagagcaaatgtgttcgacatggatcgtggtcttgtcttgcttccaacgttctttccttatatatctcaagcgacagagacttctagcaagcctaagcagcagaggaaacgcgagaactattctcatggttccatggaaattggtagaaatgaagactatggcaaccaaatgaactcaaattcctatagaagaaaccatgtctattattgatcaccgaaccactttcaaaagagtaaaacgaaggatcagtcatgaagaattgtgagcgcatcgctaatctcgctctcgcaggattgacagtggcaccacttgttgtgagggtgaacccaaacttgaatgttgttcttacagcatgcctcactgtttacgtgggttgcttccgttccgttaaggattctcctccaactgagacgatgtcgaaagaacatgcaatgcgtttcccattggttgggagtgctatgcttctgtcccttttcttattgttcaagtttctctccaaggacttggtcaatgctgtcctcactgcttacttcttcgttcttgggatcgtcgctctttcggcgacattgttacctgcaatcagcaggtttcttccaaaaccttggaatgacaatcttatcgtctggcgttttccctacttcaaatctttggaggtagagttcacaaagtcccaagtcattgcaggaatccctggaaccttcttctgcgcgtggtatgcttggaagaaacattggctggctaacaatatccttggcctttccttctgcattcagggaattgagatgctctctcttggatcattcaagactggtgccatccttttggtaggactgtttttctatgatattttctgggttttctttactccagttatggttagtgttgccaaatcctttgatgctccgatcaagcttttgttccctacgggcgatgctctaagaccctactctatgcttgggcttggtgatatcgtcatccctggtatttttgttgcactggctctaaggtttgatgtgtcaagacgtagtaaaccacagtacttcacaagtgcatttgtgggatacgttgctggagttgtcctcaccattgttgtcatgaactggtttcaagctgcacagcctgctctgttgtacattgtccccgccgtcattgggttcttggcttctcattgcatttggaacggtgacattaaaccgttgatggctttcgatgaatccaagactactgagggagaggttgataaagcccatgaagaatgaagacagtggagaaagaagggcagaggagtaacatttatacacataaaatgtgtttttatatgtatggaagaaaaaaaaagagatggaaaacatttttttgtttccaatgatcatcagtcccttcaaaaatagttctcaccctttttttgttctttttagattttcaaacatcttcttgcaaagacttatgtaagttatacaagttacaacaggtttttctttaacttttaaagatactactactaggttttgtttccttttacttcatcacatgggtacagtacaatcttcttctttttctatggtttcatgccactagtgaatgcaacatacataatcttgttcgttga

SEQ ID NO: 3136 - DNA, 1140 bp, Brassica napus
gtcatgaagaattgtgagcgcatcgctaatctcgccctcgcaggattgacagtggcaccacttgttgtgagggtgaacccaaacttgaatgttgttcttacagcatgcctcactgtttacgtgggttgcttccgttccgttaaggattctcctccaactgagacgatgtcgaaagaacatgcaatgcgtttcccattggttgggagtgctatgcttctgtcccttttcttattgttcaagtttctctccaaggacttggtcaatgctgtcctcactgcttacttcttcgttcttgggatcgtcgctctttcggcgacattgttacctgcaatcagcaggtttcttccaaaaccttggaacgacaatcttatcgtctggcgttttccctacttcaaatctttggaggtagagttcacaaagtcccaagtcattgcgggaatccctggaaccttcttctgcgcttggtatgcttggaagaaacattggctggctaataacatccttggcctttccttctgcattcagggaattgagatgctctctcttggatcattcaagactggtgccatccttttggtaggactgtttttctatgacattttctgggttttctttactccggttatggttagtgttgccaaatcctttgatgctccgatcaagcttttgttccctacgggcgatgctctaagaccctactctatgcttgggcttggtgatatcgtcatccctggtatttttgttgcactggctctaaggtttgatgtgtcaagacgtagtaaaccacagtacttcacaagtgcatttgtgggatacgttgctggagttgtcctcaccattgttgtcatgaactggtttcaagctgcacagcctgctctgttgtacattgtccccgccgtcattgggttcttggcttctcattgcatttggaacggtgacattaaaccgttgatggctttcgatgaatccaagactactgagggagaggttgataaagcccatgaagaatgaagacagtggagaaagaagggcagaggagtaacatttatacacataaaatgtgtttttatatgtatggaagaaaaaaaagagatggaaaacatttttttgtttccaatgatcatcagtcccttcaaaaat

SEQ ID NO: 3137 - DNA, 1263 bp, Brassica napus
tcatcatcagttttacagagtaaaacgaaggtcagtcatgaagaattgtgagcgcatcgctaatctcgctctcgcaggattgacagtggcaccacttgttgtgagggtgaacccaaacttgaatgttgttcttacggcatgcctcactgtttacgtgggttgctttcgttccgtgaaggactctcctccaactgagacgatgtcgaaagaacatgcgatgcgtttcccattggttgggagtgctatgcttctgtcccttttcttattgttcaagtttctctccaaggacttggtcaatgctgtcctcactgcttacttcttcgttcttgggatcgtcgctctttcggcgacattgttacctgccatcagcaggtttcttccaaaaccttggaacgacaaccttatcgtctggcgttttccctacttcaaatctttggaggtagagttcacaaagtcccaagtcattgcgggaatccctggaaccttcttctgcgcttggtatgcttggaagaaacactggctggctaataacatccttggcctttccttctgcattcagggaattgagatgctctctcttggatcattcaagactggtgccatccttttggtaggactgtttttctatgacattttctgggtattctttactccagttatggttagtgttgccaaatcctttgatgctccgatcaagcttttgttccctacgggcgatgctctaagaccctactctatgcttgggcttggtgatatcgtcatccctggtatttttgttgcactggctctaaggtttgatgtgtcaagacgtagtaaaccacagtacttcacaagtgcatttttgggatacgttgctggagttgtcctcaccattgttgtcatgaactggtttcaagctgcacagcctgctctgttgtacattgtccccgccgtcattgggttcttggcttctcattgcatttggaacggtgacattaaaccgttgatggctttcgatgaatccaagactactgagggagaggttgataaagcccatgaagaatgaagacagtggagaaagaagggcagaggagtaacatttatacacataaaatgtgtttttatatgtatggaagaaaaaaaaagagatggaaaacatttttttgtttccaatgatcatcagtcccttcaaaaaaagaaatcaacccttttttggtcattttagattttcaaacatcatcatgcaaagacttatgtaagttatacaagttacaacaggttttt

SEQ ID NO: 3138 - DNA, 1304 bp, Chelidonium majus
tctctgcaagggttctgatctctgtggagaagagattcgaaggaagagtttgttactgagaagttattagatttggtgctgttaccctgtatatgcaacttcatcaaatcgatcgtaaatactgttgattttgaagttatcaacaatgaggactagtgaacgtgttgcaaatttggctcttgcaggtttaactttggcaccacttgttgtcaaggtagatccaaatttaaatgtcattttgacagcttcactagctgtttatgtgggttgctaccgttctgtcaagccaacacctccttctgagacgatgtcaaatgaacatgctatgcgctttcccttagttgggagtgcaatgctgttatcgttatttctactcttcaagttcctatcaaaagacttggttaatgctgtactgacatgctatttctttgtactggggattatcgcgctttcggctacgttggttcctgcaattagtcgttttcttccaaagaaatggaatgatgatcttattgtctggcatctaccctacttccgctctgtggaggttgagttcacgaggtctcagatagttgcagcaattccaggaacttttttctgcgcatggtatgttcagcagaagcattggttggctaacaatgtattgggccttgcgttctgcattcagggaattgaaatgctgtcccttggttcttttaaaaccggagccattctcttggctggactttttgtgtacgatatattctgggttttctttactcctgtgatggttagtgttgcaaaatcttttgacgctcctataaagcttttgtttccaacagcagatgctgcccgaccatattccatgcttggacttggcgatatcgtaatccctgggatctttgttgccttggcactgcgttttgatgtatcaagggggaaagacaatcggtatttcagaagtgcattctttgggtacatgctcggtttagtacttacaattgttgtgatgaactggtttcaagctgcacagcctgcactcctgtacatcgtacctgctgtaattggatgcatggcagttcattgcttatggaatggggaagtgaaaccgctactggagtttgacgagtccaagactgcagctgctgcttcatctcaagatggagagtcgagtagtagcggcgatgacgattccaaatcgagtaagaaagaagagtagtagaagagagatggtcaagttctcctggattacagatagagcttttctaattcgggtacgtttagaaatggtgtttactttttaaactattgaaaggacccccctc

SEQ ID NO: 3139 - DNA, 1445 bp, Brassica rapa
aattttattttaattagtatttttaacagatctggttgaatttttatcacttgaccccactggatctctcttgacagaaacaaaggattgaaccatgaagaattgtgagagaatcgccaatctcgctctcgcaggtttgacagtggcaccactcgttgtgaatgtgaacccgaacttgaacgttgttcttacggcatgtctcactgtttacgtgggttgctttcgttctgtgaaggattctcccccaacggagacgatgtcgaaagaacatgctatgcgtttcccgttggttgggagtgctatgcttctctcgcttttcttgttgttcaagtttctctctaaggacttggttaatgccgtgctcactgcttacttctttgttcttgggatcgtcgctctttcggcgacgttgttgcctgccatcagcaggtttctgccaaaaccatggaatgataatcttatcgtctggcgctttccttatttcaaatctgtggaggtagagttcacaaagtcacaagttattgcgggaatccctggaactttcttctgcgcatggtatgcttggaaaaaacattggctggctaacaatatcctcggcctttccttctgcattcagggaattgagatgctctctcttggatcattcaagactggtgccatccttttggtaggactgtttttctatgatattttctgggttttctttaccccagtgatggttagtgttgccaaatcctttgatgctccgataaagcttttattccctacgggtgatgctctaagaccctactctatgcttggacttggtgatattgtcattcctggtattttcgttgcactggctctgagatttgatgtgtcaagacgcagcaaaccacagtacttcacaagtgcatttgtgggatacgttgctggagttgtcctcaccattgtagtcatgaactggtttcaagcagcacagcctgctttgttatacattgtcccagccgtcattgggttcttagcttctcactgcatttggaacggtgacatcaaaccgttgatggcgtttgatgaatcatcgaagagtactgaggaggaatcgaagagtagtgagggagaggttaataaaagtcatgcagaatgaagaaatggtggagaaagaaggggcagcgaggagaaaagtatttatacacatgaatgtgtgttttatatgtatggaaacggaaggaaaacagtttttgtttccagttatcatcagtcccttcaagatagttcacccttcttttttttgttctatttagattttcaaatatattttcgcaaagactaatgtaagttaatacaagttacaacaggtttccttttgacttgtttcttttttcgtccaatgttaattttgttgataggaagctgttaaatcttcaacgtgaacttatgccagaagaagtgcataggcaacttcc

SEQ ID NO: 3140 - DNA, 1335 bp, Brassica napus
ctctctctacacattcatcgaatttacagagacacaggattcaatcatgaagaattgtgagagaatcgccaatctcgctctcgcaggtttgacagtggcaccacttgttgtgaatgtgaacccgaacttgaacgttgttcttacggcgtgtcttacagtttacgtgggttgcttccgttctgtgaaggattctcccccaacggagacgatgtccaaagaacatgctatgcgtttcccattggttgggagtgctatgcttctctctcttttcttgttgttcaagtttctctcaaaggacttggttaatgccgtgctcactgcttacttctttgttcttgggatcgtcgctctttcggcgacactgttacctgccatcagcaggtttctgccaaaaccatggaatgacaatcttatcgtctggcgctttccttatttcaaatctgtggaggtagagttcacaaagtcccaagttattgcgggaatccctggaactttcttctgcgcatggtatgcttggaaaaaacattggctggctaacaatatcctcggcctttccttctgcattcagggaattgagatgctctctcttggatctttcaagactggtgccatccttttggtaggactgtttttctatgatattttctgggttttctttaccccagtgatggttagtgttgccaaatcctttgatgctccgataaagcttttattccctacgggtgatgctctaagaccctactctatgcttggacttggtgatattgtcattcctggtatttttgttgcactggctctgagatttgatgtgtcaagacgcagcaaaccacagtacttcacaagtgcatttgtgggatacgttgctggagttgtcctcaccattgtagtcatgaactggtttcaagcagcacagcctgctttgttatacattgtcccagccgtcattgggttcttggcttctcactgcatttggaacggcgacatcaaaccgttgatggcgtttgatgaatcatcgaagagtactgaggaagaatcgaagagtagtgagggagaggttaataaaagtcatgcagaatgaagaaatggtggagaaagaaggggcagagaggagaaatatttatacacatgaatgtgtattttatatgttatatggaaacagaaggaaaacagtttttgtttccagttatcatcagtcccttcaagatggttcaccctttttttgttctatttagattttcaaatatattttcgcaaagactaatgtaagttaatacaagttacaacaggtttccttttgacttgtttctttgttcgtcctatgttaattttgtttat

SEQ ID NO: 3141 - DNA, 1483 bp, Brassica napus
ggacccactggatctctctctctctacacattcatcgaatttacagagacacaggattcaatcatgaagaattgtgagagaatcgccaatctcgctctcgcaggtttgacagtggcaccacttgttgtgaatgtgaacccgaacttgaacgttgttcttacggcgtgtcttacagtttacgtgggttgcttccgttctgtgaaggattctcccccaacggagacgatgtcgaaagagcatgctatgcgtttcccattggttgggagtgctatgcttctctctctttttttgttgttcaagtttctctcaaaggacttggttaatgccgtgctcactgcttacttctttgttcttgggatcgtcgctctttcggcgacactgttacctgccatcagcaggtttctgccaaaaccatggaatgacaatcttatcgtctggcgctttccttatttcaaatctgtggaggtagagttcacaaagtcccaagttattgcgggaatccctggaactttcttctgcgcatggtatgcttggaaaaaacattggctggctaacaatatcctcggcctttccttctgcattcagggaattgagatgctctctcttggatctttcaagactggtgccatccttttggtaggactgtttttctatgatattttctgggttttctttaccccagtgatggttagtgttgccaaatcctttgatgctccgataaagcttttattccctacgggtgatgctctaagaccctactctatgcttggacttggtgatattgtcattcctggtatttttgttgcgttggctttaagatttgatgtgtcaagacgcagtaagccacaatacttcacaagtgcatttgtgggatacgttgctggagttgtcctcaccattgtagtcatgaactggtttcaagcagcacagcctgctttgttatacattgtcccagccgtcattgggttcttggcttctcactgcatttggaacggtgacatcaaaccgttgatggcgtttgatgaatcatcgaagagtactgaggaggaatcgaagagtagtgagggagaggttaataaaagtcatgaagaatgaagaaatggtggagaacgaaggggcagagaggagaaaagtatttatacacatgaatgtgtgttttatatgtatggaaacggaaggaaaacagtttttgtttccagttatcatcagtccctttcaagatggttcactcttttttttgttctatttagattttcaaatatattttcgcaaagactattgtaagttaatacaagctacaacaggtttccttttcacttgtttctttgctcgtcctatgttaattttgttgataggaagctgttaaatcttcaacgtgaacttgtgccagaagaagtgcatatgcaacttccgtatctctagtttcatgatgatgccaagttgatgaaagattaccatccaatagcatgctgtaacactttgt

SEQ ID NO: 3142 - DNA, 1296 bp, Brassica rapa
gaatttttatcacttgaccccactggatctctcttgacagaaacaaaggattgaaccatgaagaattgtgagagaatcgccaatctcgctctcgcaggtttgacagtggcaccactcgttgtgaatgtgaacccgaacttgaacgttgttcttacggcatgtctcactgtttacgtgggatgctttcgttccgtgaaggattctcccccaacggagacgatgtcgaaagaacatgctatgcgtttcccattggttgggagtgctatgcttctctcgcttttcttgttgttcaagtttctctctaaggacttggttaatgctgtgctcacagcttacttctttgttcttgggatcgtcgctctttcggcgacgttgttgcctgccatcagcaggtttctgccaaaaccatggaatgataatcttatcgtctggcgctttccttatttcaaatctgtggaggtagagttcacaaagtcacaagttattgcgggaatccctggaactttcttctgcgcatggtatgcttggaaaaaacattggctggctaacaatatcctcggcctttccttctgcattcagggaattgagatgctctctcttggatcattcaagactggtgccatccttttggtaggactgtttttctatgatattttctgggttttctttaccccagtgatggttagtgttgccaaatcctttgatgctccgataaagcttttattccctacgggtgatgctctaagaccctactctatgcttggacttggtgatattgtcattcctggtattttcgttgcactggctctgagatttgatgtgtcaagacgcagcaaaccacagtacttcacaagtgcatttgtgggatacgttgctggagttgtcctcaccattgtagtcatgaactggtttcaagcagcacagcctgctttgttatacattgtcccagccgtcattgggttcttagcttctcactgcatttggaacggtgacatcaaaccgttgatggcgtttgatgaatcatcgaagagtactgaggaggaatcgaagagtagtgagggagaggttaataaaagtcatgcagaatgaagaaatggtggagaaagaaggggcagcgaggagaaaagtatttatacacatgaatgtgtgttttatatgtatggaaacggaaggaaaacagtttttgtttccagttatcatcagtcccttcaagatagttcacccttctttttttttttttatatagattttcaaatatcattttcgcaaagacttgtgtaagttactataaagtac

SEQ ID NO: 3143 - DNA, 1347 bp, Utricularia gibba
tgggaataaaatcagtcaaaagaacccgtctttccctgctagaaattgcgccaatcgaaggcccgatctgctggatataggaatatctttctcatattcaagtgttgtttgtttggcgggtggagaagcgatacgggagcttgtaattcataatgaagaatcatgagcgtcttgcgaatctagccctagcaggtttagcgctggctccacttgctgttaaggtagatccgaatgtaaatgttattcttacagcatgtcttactgtctacgtgggttgctatcggtctgtcaagccaactccgccagcggaagcaatgtccaatgcacacgcgatgcggtttccatttgtcgggagtgcaatgttgttgtcgctgtttttactttttaagtttctgtcaaaagatttggttaatgccgtgttgacatgttacttctttgtgcttggagtagctgctctctcagcaacacttctacctgcaattaaaaagtttcttccacaaccatggaatgacaatgttatcatgtggcgtttcccttttgttaaatcattcgatgttgagtttaccatctcacagattgtctctgctattcctggaaccgcattttgtgtttggtatgcttcaaagaagcactggttggccaacaatattctagggcttgcattttgcattcagggaatcgaaatgctttcactgggctcattcaagaccggtgctatactattagctggacttttcttttatgacatattttgggtgtttttcactcctgtcatggtcagcgttgccaagtcctttgatgctccaataaagcttttgttcccaacatcagattccacacgcccattttctatgttagggctaggagatattgtgattccaggcattttcgtggcattagctttgaggttcgacgtttcgagagggaaagagagccaatatttcaagagtgcttttgtgggctatacagctggcttgggattaacaattttcgtgatgaattggtttcaagccgcacagcctgcacttttgtacattgttcctgcggtgattggattcctagctgcacattgcatttggaatggagatgtgaaacccttgttagctttcgatgagacgaagacggctgagagccaagaagaggcagaaaccagcgaggtggacaagaaaacagagtaagagcaggaattccatcaccaactttgtgggcagcagactgttgtaatgcaatttccagccttttgagaaagaaaaacagagcggagtcaaaggcgcatcttttagcactattttctatgtagcacgtttttcaatgagttcttatataagcttagatttcagagacact

SEQ ID NO: 3144 - DNA, 1441 bp, Arabidopsis lyrata
tcttcttcttcttcttcatccttttttgtttttaacagatctggtggaaattttatcttttgaccccaccactggatctctctcctctctctctctatacattcatctgagtacagagtaaaaacgaaacccaagaagcaattatgaagaattgtgagagattcgctaatctcgctctcgcaggtttgacattggcaccactcgttgtgagagtaaatccaaatttgaatgttattctcacagcatgtatcactgtttatgtcggttgctttcgttcggtcaaggatactcctccaacggagacgatgtctaaagagcatgccatgcgtttcccattggttgggagtgctatgcttctctcacttttcttattgttcaagtttctctcaaaggatttggtcaatgctgttctaacagcttacttctttgttcttgggattgtcgctctttcggcgacattgttaccagccatcagaagatttttgccaaatccttggaatgacaatcttattgtctggcgttttccttatttcaaatctttggaggtagagttcacaaagtcccaagttgttgcgggaatccctggaaccttcttctgtgcgtggtatgcgtggaaaaaacattggctagctaacaatattctcggcctttccttctgcattcagggaattgagatgctctctcttggatcattcaagactggtgccatccttttggctggactatttttctatgatatcttctgggttttctttactccagttatggttagtgtcgccaaatccttcgatgctccaataaagcttttattccctacgggtgatgctctaagaccctattctatgcttggtcttggtgacattgtcattccgggaatttttgttgcactagctctaagattcgatgtgtcaagacgtagacaaccacaatacttcacaagtgcatttatcggatacgctgttggtgttatcctcacgattgtagtcatgaactggtttcaagcagcccagcctgctttgttatacattgtcccagctgtaattgggttcttggcttctcactgcatttggaacggtgacatcaaaccgttgttggcgtttgatgaatcaaagacagaggaaccaaagactgatgaatcaaagactagtgaggagggtaataaagctcatgacgaatgaggaaaaatcgagaaagaagggcagaggagaaatatatacacataaatgtgttttaaaatatggaacaagaaggaaaacaattttgtttccaatgatgatcaatcagtcccttctaacccttttttgttttttttagattttcaaactttcttttggcaaagactcgtgtaagttactataagttacaacaggttttctttgacttttcttgatgtgttttatgttaaattcgataggaggctaaagttatatatcatttcgaa

SEQ ID NO: 3145 - DNA, 1441 bp, Arabidopsis thaliana
ctcttcttcttcttcttcatctttttttttttaacagatctggtggaaattttatcttttgaccccaccactggatctctctatatacacattcatctgagtaatagagtaaaaacgaaacacaagaagcaattatgaagaattgtgagagatttgctaatctcgctctcgcaggtttgacattggcaccactcgttgtgagagtaaatccaaatttgaatgttattctcacagcatgtatcactgtttatgtgggttgctttcgttcggtcaaggatactcctccaacggagacgatgtcaaaagaacatgccatgcgtttcccattggttgggagtgctatgcttctctcacttttcttattgttcaagtttctctcaaaggacttggttaatgctgtgctaacagcttacttctttgttcttgggattgtcgctctttcagcgacattgttaccagccatcagaagatttttaccaaatccttggaatgacaatcttatcgtctggcgttttccttatttcaagtctttggaggtagagttcacaaagtcccaagttgttgcgggaatccctggaacattcttctgtgcgtggtatgcgtggaaaaaacattggctggctaacaatatcctcggcctttccttctgcattcagggaattgagatgctctctctcggatcattcaagactggtgccatccttttggcaggactatttttctatgatatcttctgggttttctttactccagttatggttagtgttgccaaatccttcgatgctccaattaagctcttattccctacgggtgatgctctaagaccctattctatgcttggtcttggtgacattgtcattccgggtattttcgttgcactagctctaagatttgatgtgtcaagacgtagacaaccacaatacttcacaagtgcatttatcggatacgctgttggtgtgatcctcacgattgtagtcatgaactggtttcaagcagcacagcctgctttgttatacattgtcccagccgtaattgggttcttggcttctcactgcatttggaacggtgacatcaaaccgttgttggcgtttgatgaatcaaagacagaggaagcaacgactgatgaatcaaagactagtgaggaggttaataaagctcatgatgaatgaggaaaaatcgagaaagaagggcagaggagaaatatatacacataaatgtgtcttaatatatggaacaagaaggaaaacaattttgtttccaaatgatcatcaatcagtcccttctaaccccttttttgtttttttagattttcaaactttcttttggccaagacttgtgtaagttactataagttacaacaaattttctttgacttttctttctgttttatgttaaattcgttaggagactggaagttatatatcatttcgaacagaattcg

SEQ ID NO: 3146 - DNA, 1710 bp, Fagopyrum esculentum
acagcactagcataaaaaatctctcagtttcacccgttgaacgtttcgatctacaggcgactaatctcggccggcggggagagaagaaggcagagaagccagatccagctcgttcggtttggaacattgcaagaagtataagaactttcgtttgcatttgcgtttgatcttacaagttagagggaattcgcggttccggcttgagtagacgacttagaattttggctttgagtcgctcgcttaggaaatgaagaattgcgaacgtatgcaaatctcgcgctagcagggttgagtttggcaccccttgttgtaaatgtcaatcccaatgttaatgtgatattgactgcttgcctctcagtttatgtggggtgttaccggtctgtgaagccaactccaccttctgaaactatgtcaaatgagcatgctatgaggtttcccttggtcgggagtgcaatgctgttgtcactgtttttgctcttcaaattcttgtccaaagacttggttaatgctgtgctgacttgctacttctttatccttgggatacttgccctttcagccacactgctgcctgcaataaagcggttcctaccagatcactggaatgataatgttatcgaatggcgtttttcgtacatcaagcgcctggcatttgaaatcgaatttaccagatcacaagttgtcgctgcgattcccggaaccttcttttgtgcttggtatgcttcaaagaagcattggctggctaacaatgtactgggcctctccttttgcattcagggaattgaaatgctttctctcgggtctttcaagactggtgccattctcttgggcggtctgtttttctatgatatcttctgggtcttcttcactcctgtgatggtcagtgttgctaaatcctttgacgcaccaataaagcttttgttcccaacaggagatgcagcaagaccattttccatgcttggattgggtgacattgttatccctggtatattcgtagcattggcattgcgttttgatgtgtccagggggaaagaaagtcagtacttcaagagtgcttttctgggttattttgctggtttggccctgacaatctttgtcatgaattggtttcaagctgcacaacctgctcttctatatattgtgcctgctgtcattggatttttggctgtacacgtcctatggaacggtgacgttaaagcgttgttggcattcgacgagtcaaagacagaagaaggagcatcttccgaagaaaacagtgatgatgccaagttgagtaagaaggtagaatagtaagcttatggacttgctaggaaggtaacatagagcactcttctcgtttagtgccctcgactctacatgggtatgccctttctgacttgcgtgtcactggttgctcgtgtagctgcgggaaactcgtatgaagaagagcatagcaaattttacctttacaatcttcagttctagtttacaactctcacaaacttttacatcccaattcccaactcattctccttgatacaaatgttggttttcttgaagagtattcaatactttatgtttctcatttcgaacaggacttttgccttcattttgtatctgtttatgcctgtgctcatttagacgttgagcatgccgcagtacgcggtagccatagaggtcgatgccattcgaatttcgaagcaccaaaatgctaaactctacctgtcacttttt

SEQ ID NO: 3147 - DNA, 1377 bp, Amorphophallus konjac
tccgcggtcgtgatcacgcggtagatcctcttccggaatcgaacgagtcgcggtttcccagattgggtttccttgttggagactttttctttccatttgatcgatccgggggaggaggaaccggattccgaggtcaaagctcggatcttcctctgcctccaagcgaactttcgagggactttttgaattccaagtactgaggtcacttggaagttttatcgcctcccttcagtggtgtaacctgggcatcatctgtcaagtgttattgccgactcaaacctatctcatatctttcatgatcaaggatttacagtcgtagttattggatttgagcttctgacaatgaagacccatgaacgtgctgctaatatagctcttgcaggtctaactttggctccactcgttgtgaagatagaccctaatttgaatgtaattttaatggcatgcctgactgtttacgtaggatgctaccgttctgtcaagccgacacccccatcagaaacaatgtcaaacgagcatgcaatgcgctttccaatagtggggagtgcaatgttgttgtcactgtttttgctcttcaaatttctctcgaaagatctagttaatgcagtgttaacatgctacttctttgtcctagggatcatagctctctccgctacattgttaccagccattaaacgttttcttccaaaaaactggaatgaagacctcattgtttggcatcttccatattttccctctgtatcagtggagttcacgaagtctcagattgttgcatcaattccaggaacatgtttttgcatctggtatgcttcaaagaagcattggttggcgaacaacattttggggattgcattctgcattcagggaatagaaatgctctctcttggatcattcaaaactggtgcaattctgttgggagggctttttatctatgatattttctgggtatttttcacacctgtgatggttagtgttgcaaaatcttttgatgccccaataaagcttttatttccaacttcagatgctgcacgaccattctctatgcttggtcttggtgatattgtaatacctggtatttttgtagcattggcattacgttttgatgtctctagaggaaaggagaatcgttatttcaggagtgcatttcttggttacacagttggtttgatccttacaattgttgtaatgaattggtttcaagctgcacagcctgcacttttatacattgtgcctggtgtcgttggatttgttgctgttcactgcctgtggaatggggaagtgaagccgctgttggaatacgacgagtcaaagatggcagctgatcctagttgtagtgaagagaaacctgagaagaaagtggactaacaggcgcgcgcc

SEQ ID NO: 3148 - DNA, 1458 bp, Brassica napus
ttttttaaatttattaacagatctggtggaatttaatctcttgaccccaccagaccactgaatctctctctataaacattcatcagtttcacaaagtaaccgaaacccacaggatcgaatcaatcatgaagaattgtgagcgaatcgctaatctcgctctcgcaggtttgacagtggcaccgcttgttgtgagggtgaacccgaacttgaatgttgttcttacggcatgtctcacggtttacgtgggttgctttcgttctgtgaaggattctccgccaactgagaccatgtctaaagagcatgcaatgcgtttcccgttggttgggagtgctatgcttctctcacttttcttgttgttcaagtttctctcaaaggacttggttaatgctgtgctcacagcttacttctttgttcttgggatcgtcgctctttcggcgacattgttacctgccatcagtagatttctaccaaaaccatggaatgacaatcttatcgtctggcgttttccttatttcaaatcattggaggtagagttcacaaagtcccaagttgtagcgggaatccctggaaccttcttctgcgcgtggtatgcttggaagaaacattggctggctaacaacatccttggcctttccttctgcattcagggaattgagatgctctctcttggatcgttcaagactggcgccatccttttggttggactgtttttctatgatattttctgggttttctttactcctgttatggtcagtgttgccaaatcctttgatgctccgataaagcttttgttccctacgggagatgctctaagaccctattctatgcttgggcttggtgatattgtcattccgggtatttttgttgcactggctctacgatttgatgtgtcaaagcgtagtcagccaaaatacttcacaagtgcatttgtgggatacgttgttggagttgtcctcactattgtagtcatgaactggtttcaagcagcacagcctgctttgttatacattgtcccagccgttattgggttcttggcttctcactgcgtttggaacggtgacatcaaaccgttgttggcgtttgatgagtcatctaagagtactgaggaagaggttagtaagactcatgaagaatgaagagaaagtggagaacgaagggctgaagagtaacattttatacacatagatgtgtttttatatatgtatggaaacaaaaaatggaaaacaatttttgtttccagtgatcatcggtctcttcaaaatggttcacccttttttgttctttttagataatttcaaacatcgttttcgcagagacttgtgtaagttacttatgaagttacaacaggtttcgtattttactactgaagatactagtcaggtttcctttgacttgtttctatgtatattttgataggaggctgttaaaatctccgggatgcagttatgagttagttcg

SEQ ID NO: 3149 - DNA, 1265 bp, Brassica napus
gaagaattgtgagcgcatcgctaatctcgctctcgcaggattgacagtggcaccacttgttgtgagggtgaacccaaacttgaatgttgttcttacggcatgcctcactgtttacgtgggttgctttcgttccgtgaaggactctcctccaactgagacgatgtcgaaagaacatgcgatgcgtttcccattggttgggagtgctatgcttctgtcccttttcttattgttcaagtttctctccaaggacttggtcaatgctgtcctcactgcttacttcttcgttcttgggatcgtcgctctttcggcgacattgttacctgccatcagcaggtttcttccaaaaccttggaacgacaaccttatcgtctggcgttttccctacttcaaatctttggaggtagagttcacaaagtcccaagtcattgcgggaatccctggaaccttcttctgcgcttggtatgcttggaagaaacactggctggctaataacatccttggcctttccttctgcattcagggaattgagatgctctctcttggatcattcaagactggtgccatccttttggtaggactgtttttctatgacattttctgggtattctttactccagttatggttagtgttgccaaatcctttgatgctccgatcaagcttttgttccctacgggcgatgctctaagaccctactctatgcttgggcttggtgatatcgtcatccctggtatttttgttgcactggctctaaggtttgatgtgtcaagacgtagtaaaccacagtacttcacaagtgcatttttgggatacgttgctggagttgtcctcaccattgttgtcatgaactggtttcaagctgcacagcctgctctgttgtacattgtccccgccgtcattgggttcttggcttctcattgcatttggaacggtgacattaaaccgttgatggctttcgatgaatccaagactactgagggagaggttgataaagcccatgaagaatgaagacagtggagaaagaagggcagaggagtaacatttatacacataaaatgtgtttttatatgtatggaagaaaaaaaaagagatggaaaacatttttttgtttccaatgatcatcagtcccttcaaaaatagttctcaccctttttttgttctttttagattttcaaacatcatcttgcaaagacttatgtaagttatacaagttacaacaggtttttctttaacttttgaagatactactactaggttttgtttacct

SEQ ID NO: 3150 - DNA, 995 bp, Solanum tuberosum
gatcaatttaacttcaatttcaaaaaaaatctttagaaattgattaaaaatggtgaaacccaattcaaaagatacagaattttcaccttcatcgtcatcgtcatctttgtatcggggagtaaggaagaggaaatgggggaaatgggtatcggaaattagattacctaatagtagagaaagaatttggttgggttcttatgatacgccggaaaaagctgctaaagcattcgacgccgcacttttttgtttgcggggtaaaggggctaatttcaatttcccggaaaatccgccggagattatgaacggaaggtcgatgactccgtcggagattcaatcggcggcggcacagtttgcgaataatacagaacccgagcttatccgggtcggaccgagggagaattcggatctttcttcttcctcatcggaaatattccgggcggaatcgccgtcggtgtcagtttccgatagagtagaaagtgaaaagacggaaataaccttgggtaatgattttatcaatatgtatcgggtggagtctccggtttccgggagagtagaaagtgaaaagacggaaatgtccttggataatggatttatggacatgttttcatcgttggggacggttaatgatatgtccgatttcggaatttttccggggttcgatgatttatcgggtgaattttttataccaccaccgtcaccacaaccatcgcaaatgcctaatttggaatcattagaagaagagaattatttgaactacgatggatttcaatcacaagggacttcatttctttggaatttttgaaggatctaaaaattgttacattatattcattaatggttaatattataagtataaaaattagaaatagtactttatttgttgattttgtggacacttctagacatttttttggttgctagaattgttacaacatatgtgattttctatacataagaggatgtacttttttgactaatcgatatgaaaatcactt

SEQ ID NO: 3151 - DNA, 1016 bp, Solanum phureja
atcaattttcatcaatttaacttcaatttcaaaaaaaaaactttaaaaattgattaaaaatggtgaaacccaattcaaaagatactgaattttcaccttcatcgtcatcgtcatctttgtatcggggagtaaggaagaggaaatgggggaaatgggtatcggaaattagattacctaatagtagagaaagaatttggttgggttcttatgatacgccggaaaaagctgctaaagcattcgacgccgcacttttttgtttgcggggtaaaggggctaatttcaatttcccggaaaatccaccggagattatgaacggaaggtcgatgactccgtcggagattcaatcggcggcggcacagtttgcgaataatacagaacccgagcttatccgggtcggaccgagggagaattcggatctttcttcttcctcatcggaaatattcctggcggaatcgccgtcggtgtcagtttccgatagagtagaaagtgaaaagacggaaataaccttgggtaatgattttatcaatatgtatcgggtggagtcaccggtttccgggagggtagaaagtgaaaagacggaaatgtccttggataatggatttatggacatgttttcatcgttggggacggttaatgatatgtccgatttcggaatttttccggggttcgatgatttatcgggtgaattttttataccaccaccgtcaccacaaccatcgcaaatgcctaatttggaatcattagaagaagagaattatttgaactacgatggatttcaatcacaagggacttcatttctttggaatttttgaaggatctaaaaattgttacattatattcattaatggttaatattataagtataaaaattagaaatagtactttatttgttgattttgtggacacttctagacatttttttggttgctagaattgttacaacatatgtgattttctatacataagaggatgtacttttttgactaatcgatatgaaaatcactttttattagtaa

SEQ ID NO: 3152 - DNA, 728 bp, Solanum phureja
tgcactaaatgagtcggtattcatcggggcgggtcataacctatgaatgtcaaacaggttcgaagaggagatcgtcactgtagagattcaatttttatggtagcagagaaaaaatggctgctcaagaagaagtaaaacaactgtcagagtgctcagtctccaatgctctggggacatgggttttttctgtagctggtgcactgcttgcgattccggtgggtattaaacggaaatctttggcaccccttgtattctttggcacaactggtacgatgctagatataattatgggtatcagtgcttgtgaaagggagcatgcagaacggcaaatgaagcttttggaagaagcacaaggatctgcagctgttgataccttggctgatacagcaactgaacattgatggcattcgggtcgctctggattttgtcttcaactaatagctgaggattcatgacttcatgtagcattttgagtactgtttgccttcagtttccgctttacttggcttgtaactaggatattatcattagaagaaaagaaggcaaataatgtgtggggtgattgcacttgagatgtggcttcagaactatcttttttccgcttcttaaaaagctttctattagttaccatgtagagaagtccataataactccatcatggcctgatggttttttaacactttcataccttgagtttgtttttacgttcttgtgcttatgaaagaggt

SEQ ID NO: 3153 - DNA, 625 bp, Solanum tuberosum
tgcagagaaaaaatggctgctcaagaagaagtaaaacaactgtcagagtgctcagtctccaatgctctggggacatgggttttttctgtagctggtgcactgcttgcgattccggtgggtattaaacggaaatctttggcaccccttgtattctttggcacaactggtacgatgctagatataattatgggtatcagtgcttgtgaaagggagcatgcagaacggcaaatgaaacttttggaagaagcacaaggacctgcagctgttgataccttggctgatgaagcaactgaacattaatggcattcaggtcgctctggattttgtcttcaactaatagctgagggttcatgacttcatgtagcattttgagtactgttggccttcagtttccgctttacttggcttgtaacctggatattatcattagaagaaaagaaggcaaataatgtgtgcggtgattgaacatgtgatgtagcttcagaactatcttttttcttcttaaaaaacgttctattagtaaccatgtagagaagtccaaaataactctccatcatggcctgatggtttttaacactttcataccttgagtttgtttttacgttcttgtacttataaaagaggt

SEQ ID NO: 3154 - DNA, 518 bp, Capsicum annuum
aacaggttgaaagaggcgatcgcccttgtagcgctaccgtagaggttcaaaaatggctggtcaagaggaagtaaaacaactatcagagtgttcagtctccaacgctctggggacatgggttttctctgtagctggtgcactgcttgcaattccagtgggtataaaacggaaatctttggcacccctcgtattctttggcacaactggtacgatgctggatataattatgggtatcagtgcttgtgaaagagaacatgcagagcggcaaaagcttttggaagaagcacaaagatctgcagctgttgataccttggctgatgcagctactgaacattgatggcattcaggtagttctggactttggcttcaactaatagctgaggttcatgtagaattttaagttctgttggtcttcagtttccggttacctggcttgtatcttggatactatcagtagcacaaaagaaggcaaataatgtaaggggtgattgcacttgtgttgtggcttcccaactatc

SEQ ID NO: 3155 - DNA, 523 bp, Capsicum annuum
gtcaaacaggttgaaagaggcgatcgcccttgtagcgctaccgtagaggttcaaaaatggctggtcaagaggaagtaaaacaactatcagagtgttcagtctccaacgctctggggacatgggttttctctgtagctggtgcactgcttgcaattccagtgggtataaaacggaaatctttggcacccctcgtattctttggcacaactggtacgatgctggatataattatgggtatcagtgcttgtgaaagagaacatgcagagcggccaaaagcttttggaagaagcacaaagatctgcagctgttgataccttggctgatgcacctactgaacattgatggcattcaggtagttctggactttggcttcaactaatagctgaggttcatgtagaattttaagttctgttggtcttcactttccggttacctggcttgtatcttggatactatcagtagcacaaaagaaggcaaataatgtaaggggtgattgcacttgtgttgtggcttcccaactatc

SEQ ID NO: 3156 - DNA, 627 bp, Solanum melongena
agaaaaaatggctgctgaagaggaagtaaaacaactggcagagtgctcagtctccaatgctctggggacatgggttttctctgtagctggtgccctgcttgcaattccagtgggtataaaacggaaatctttggcacccctcgtattctttggcacaactggtacaatgcttgatataattatgggcatcagtgcttgtgaaagagaacatgctgaacggcaaatgaagcttatggaagaagcacaaagatcttcatctgttgataccttcactgatgcaacaactgaacattgatggcagtcaggtcgttttagattttggctccaactaatagcggaggttcatgtagcattttgagtgctgttggccttcagtttctggtttccttggcttgtaatttggatattatcgctagcagaaaagaaggcaaataatgcgtggggtgactgcacttgtgaatgtggcttcttcttaaaaagctttctattagtaaccatgtagaaactgaaattactccatcatgatctgatgattttttaacattttcatgcctcgagtttgttttacattcttgtacttgtgaaagaactcacaaacatttgaaataacccgtgctcatcccttcc

SEQ ID NO: 3157 - DNA, 536 bp, Nicotiana tabacum
  misc_feature (203)..(203): n is a, c, g, or t
  misc_feature (213)..(213): n is a, c, g, or t
  misc_feature (419)..(419): n is a, c, g, or t
  misc_feature (494)..(494): n is a, c, g, or t
  misc_feature (506)..(506): n is a, c, g, or t
cggagaataatggcagctggagaggaagtaaaacaactggaagattgcacagtcgccaatgctctgggtacatgggttttctctgtagctagtgcattgcttgcaattccagtgggcataaaacggaaatctttgggaccccttgtattctttggaacaactggtacgatgctagatataattatgggaatcaatgcctgtgnaagagaacangcagaacaccaaatgaaacttttggaagaagcacaaagatctgcagctgttgatcccttggctgatgatgcaaccgaacattgatggcatttaggtcgtttggactttggcttcaacgaatagctgagacttcgtgtagcattttgagtactgttggccatcagtttacggtttacctggcttgtaacttccatattctcatttgncgaaaagaggtcaaataatgtattgtgatgtggctacagaacttttttctcttacaaagatttctattagtaccntgtagaagtccngagaacacttcatcagcggccgcatgaggg

SEQ ID NO: 3158 - DNA, 749 bp, Theobroma cacao
ggagctgaaaaaccccggctttgtctgtggtcgttgcatccttgggaaggggaaagcaaagcagtcctctgatcaacattttctcaaagtgatcagtattcttatcagataacgaggggtttttttccccctttttggtttacgtgcaagatcaaataagctaggagaggaagaaatggctggccaagaggttaagcagcttgaggaatgctcagtttccaatgcattgggcacatgggtattttcagtagcaggggctttgctagcaattccagtggggataaagaggaaatctttagcaccccttgtgttctttggcacaactggtacaatgcttgatatcattatgggaatcagtgcttgtgaaagagagcacgcggaacgccaaatgaagctattagaagcccaaaattctgcagctgatgattcttcggtttcagagtcttagatggtgtagattcacccctttggatgtgctttaatctgcctttcaaacttgcttgggcggtacaagagacctagcgaattattgtttataagttgggttactttttccttctcttagttgcatgtccccccctctatggctttggtgaatgagaaattggcacttttttcttccaggaatgtcttggctctataaagagcttctaacttttacttcaattttcagaatcgccttaacttctcccaatatgcaaagagatccattatgctgctatttgttatcacttgaacaaggcttcagg

SEQ ID NO: 3159 - DNA, 921 bp, Citrus sinensis
  misc_feature (5)..(5): n is a, c, g, or t
  misc_feature (446)..(446): n is a, c, g, or t
  misc_feature (483)..(483): n is a, c, g, or t
  misc_feature (492)..(492): n is a, c, g, or t
  misc_feature (514)..(514): n is a, c, g, or t
  misc_feature (518)..(518): n is a, c, g, or t
  misc_feature (535)..(536): n is a, c, g, or t
  misc_feature (555)..(555): n is a, c, g, or t
ccggnattcaccgctccgacccacgcgtccggtggcgctgtgttattcctctaggctcaatcttcgatcagataactgaggctagtcaagcacaagcagttaaaagagtgaggacaatggctagtcaggagacagtgaagcaacttgaagattgctcagtttccaatgcattggggacatgggtattctcagtagccggagctttgcttgcaattccggttgggataaaacgcaaatctttagcgccccttgtatttttcggcacaactggtactatgcttgacatcattatgggggtcagtgcttgtgaaagagaacatgcagaacgccaaatgaagctattggaagcccaaaatgctgcagccgatgcttctttaactgagacaggaactgagacttgaactaaagtctagatgaccatgtatctctgtatgagggtgctctgngttcgtttttcttgctgtaggagactcgctcatttanaatatcagntctctttgccttgattttccgntcgncttttcattgcacgatnnatgactttgatgttgttcnggcatactgaaacatcgcggaagaatactgcgactggtcgccccaaaagcaacctgcctttgcgtaaagacacaaaaccggcgggcccccccgctcgaccaacacttacacacccccgctcagccacatctgccgtccagacccacgccccacaagacacaccgcccgccacccccatgcccccaccgaagcccgaaaccactgccgccatcccccgacgcagcgccgactcccgcccatttcaatcgagaaaaccacacacgcccaacgcagcctcgcttcgcagctccgccccccaacctccgaccgccagctgcaccgcctacccgcctcgtgcgcacggccccgtcagcgggcgcaccccct

SEQ ID NO: 3160 - DNA, 578 bp, Citrus clementina
cacagacacagtggcgctgtgttattcctctaggctcaatcttcgatcagataactgggctagtcaagcacaagcagttaaaagagtgaggacaatggctagtcaggagacagtgaagcaacttgaagattgctcagtttccaatgcattggggacatgggtattctcagtagccggagctttgcttgcaattccggttgggataaaacgcaaatctttagcgccccttgtattttttggcacaactggtactatgcttgacatcattatgggggtcagtgcttgtgaaagagaacatgcagaacgccaaatgaagctattggaagcccaaaatgctgcagccgatgcttctttaactgagacaggaactgagacttgaactaaagtctagatgaccatgtatctctgtatgagggtgctctgagttcgtttttcttgctgtaggagactcgctcatttagaatatcagttctctttgccttgattttccgttcgtcttttcattgcacgatcaatgactttgatgttgttcaggcatactataatatcagcgaataaaaatcagagtgttcatccag

SEQ ID NO: 3161 - DNA, 577 bp, Citrus sinensis
cacagacacagtggcgctgtgttattcctctaggctcaatcttcgatcagataactgaggctagtcaagcacaagcagttaaaagagtgaggacaatggctagtcaggagacagtgaagcaacttgaagattgctcagtttccaatgcattggggacatgggtattctcagtagccggagctttgcttgcaattccggttgggataaaacgcaaatctttagcgccccttgtattttttggcacaactggtactatgcttgacatcattatgggggtcagtgcttgtgaaagagaacatgcagaacgccaaatgaagctattggaagcccaaaatgctgcagccgatgcttctttaactgagacaggaactgagacttgaactaaagtctagatgaccatgtatctctgtatgagggtgctctgagttcgtttttcttgctgtaggagactcgctcatttagaatatcagttctctttgccttgattttccgttcgtcttttcattgcacgatcaatgactttgatgttgttcaggcatactataatatcagcgaataaaaatcagtgttcatccag

SEQ ID NO: 3162 - DNA, 643 bp, Lippia dulcis
atatattgtaagtacagtacacgacgtcgttttctctcagctggattaaggtttcgatcggagaacagaaggaggtggagaaatagatactgtagatggctggtaaagaggaagtgaaacagctcgaggaatgctctgtttcaaatgctttagggacatgggttttctcagtagctggtgctttgctggctatccccgtaggtataaaacgcaaatccctagcaccccttgtcttctttggcacgactgggacaatgctcgacataatcatgggaattagtgcttgtgaaagagaacacgcagaacgtcaaatgcagcttttggaagcacagaatgctgttgcagcggaagcagatgttgtgaccgagtctttatcataacacccctgcacttaaatgctggtaacaagaaccagtcttgtacctctgatgacttcacttactgctgtaaattcagaattccaagtttcgctatgacaataatgatactggttttgacagtgttcgtactgtttcaaggaactgtgtttttcttcacgctgagttcaccaagaaaaactcagctcgaaaaattcttatatgcaccatacattatgtattttgattttttcttatgtcaactaatacatttgtcgtgtaaaaag

SEQ ID NO: 3163 - DNA, 685 bp, Lippia dulcis
atatattgtaagtacagtacacgacgtcgttttctctcagctggattaaggtttcgatcggagaacagaaggaggtggagaaatagatactgtagatggctggtaaagaggaagtgaaacagctcgaggaatgctctgtttcaaatgctttagggacatgggttttctcagtagctggtgctttgctggctatccccgtaggtataaaacgcaaatccctagcaccccttgtcttctttggcacgactgggacaatgctcgacataatcatgggaattagtgcttgtgaaagagaacacgcagaacgtcaaatgcagcttttggaagcacagaatgctgttgcagcggaagcagatgttgtgaccgagtctttatcataacacccctgcacttaaatgctggtaacaagaaccagtcttgtacctctgatgacttcacttactgctgtaaattcagaattccaagtttcgctatgacaataatgatactggttttgacagtgttcgtactgtttcaaggaactgtgtttttcttcacgctgagttcaccaagaaaaactcagctcgaaaaattcttatatgcaccatacattatgtattttgattttttcttatgtcaactaatacatttgtcgtgtaaatgagtgccgtcatgcaagaatacccagttcaacgtcaaaaaagaa

SEQ ID NO: 3164 - DNA, 1816 bp, Gossypium hirsutum
tgagaggaaggaacaattggagcctaaagagttgaaaaaggagacggatcgatatgggaattacagttctttgatcccaaggtttcgaaatctgtaacaatggatgatatcacactttctttgaaagaatcaaatgttatttctagatgcaaggaaggcgtttcatttaaagggaagtccgtttcaaatgatttgcaaatcgtcgtcaaagaaatgcaccatgtcagttcatttacggcgagtttttggtctgaaatcacagaattcggcaagcttcagcatccgaatctcgtgaaattaatcggaaaatgccggtcggacaagggtgcgtatttggtttacgagtacgttgaagggaaacttttaagcgaaatccttggcaacttaagctgggagaggcggtggaaaattgctatcgggactgcgaaagctctacgttttttgcactctcgttgttcgccgagtgtactcgtcggagacatgtcgccggagagaattatcatcgatgcaaaagatgaacctcggctacaattcatctttcctttcgttgacaaccagcccttccttccttcctcctacgttgcaccagaagctagagagaataaaaaaatgaatgaaaagagtgacatatatggaatgggtctgattttaatagaactattaacgggaaaaactccggcagatgctgaatttaaagtgcaatattcaagcatggtggagtgggctcgttattgctactcagattgtcatcttgatatgtgggttgatcctgttattaaaagccaagcatccatcaacaaccagaaccagatcgttgccgccatgaatttagctctccattgtacggccggcgaccccactgctcggccgtgcgcggctgatgtattcgaaaccttaaaatctgctttcagaacaagttcttgtctcccaagcttaaactttagttcgcctgtttagggttgaattcctaataatatagcatgattttgttcagaaattttattttatttttgttctacgcacctgggtttctactgtttcttttgtcactcaaatgttttgtttgatggtatgaatatactttttactactgagtgtaaaaaaatgtagattaactaattaaatgccattatatgaattaattagtacagtttttcttttttcaacacaaaccgccaccttcttattcaactgtaatggttcattgacaaagagcatgaacaaaaaggaagatcatagagaaaacccaccaacccagaacagcaatcgattttcgtcttgtttacagccaagaaaagtttgaagggcagcttgaaagcaacactcaaagatactgaatgtaaatgaccttcctaaaattttaggaatgcgattctgatcccgtctccgaaaatgatgaatcatcggctgtggaattctgggcttctaatagcttcatctggcgttctgcatgctccctttcgcaagcactgattcccataatgatatcgagcattgtaccggttgtgccaaagaacacaaggggtgctaaagatttccgctttatccccaccggaattgctagcaaagcccctgctactgaaaacacccatgtccccaatgcattggaaactgagcattcttcaagctgcttaacttcttgcccacccatttccttctttcctaactatttgattttgacacacgtaaagccccccaaaaaatgaactttatatcagctaaaacgaaagccctaaaacctgaaatttgagaaagggctgataagaggactgcttcgttttctcttgttgccaacaaacaaagagaaagacgggtt

SEQ ID NO: 3165 - DNA, 1765 bp, Gossypium hirsutum
agtagaaaaaggagacggatcgatatgggaattacagttctttgatcccaaggtttcgaaatctgtaacaatggatgatatcacactttctttgaaagaatcaaatgttatttctagatgcaaggaaggcgtttcatttaaagggaagtccgtttcaaatgatttgcaaatcgtcgtcaaagaaatgcaccatgtcagttcatttacggcgagtttttggtctgaaatcacagaattcggcaagcttcagcatccgaatctcgtgaaattaatcggaaaatgccggtcggacaagggtgcgtatttggtttacgagtacgttgaagggaaacttttaagcgaaatccttggcaacttaagctgggagaggcggtggaaaattgctatcgggactgcgaaagctctacgttttttgcactctcgttgttcgccgagtgtactcgtcggagacatgtcgccggagagaattatcatcgatgcaaaagatgaacctcggttacagttcatctttcctttcgttgacaaccagcacttccttccttcctcctatgttgcaccagaagctagagagaataaaaaaatgaatgaaaagagtgacatatatggaatgggtctgattttaatagaactattaacgggaaaaactccggcagatgctgaatttaaagtgcaatattcaagcatggtggagtgggctcgttattgctactcagattgtcatcttgatatgtgggttgatcctgttattaaaagccaagcatccatcaacaaccagaaccagatcgttgccgccatgaatttagctctccattgtacggccggcgaccccactgctcggccgtgcgcggctgatgtattcgaaaccttaaaatctgctttcagaacaagttcttgtctcccaagcttaaattttagttcgcctgtttagggttgaattcctaataatatagcatgattttgttcagaaattttattttatttttgttctacgcacctgggtttctactgtttcttttgtcactcaaatgttttgtttgatggtatgaatatactttttactactgagtgtaaaaaaatgtagattaactaattaaatgccattatatgaattaattagtacagtttttcttttttcaacacaaaccgccaccttcttattcaactgtaatggttcattgacaaagagcatgaacaaaaaggaagatcatagagaaaacccaccaacccagaacagcaatcgattttcgtcttgtttacagccaagaaaagtttgaagggcagcttgaaagcaacactcaaagatactgaatgtaaatgaccttcctaagattttaggaatgcgattctgatcccgtctcggaaaatgatgaatcatcggctgtggaattctgggcttctaatagcttcatctggcgttctgcatgctccctttcgcaagcactgattcccataatgatatcgagcattgtaccagttgtgccaaagaacacaaggggtgctaaagatttccgctttatccccaccggaattgctagcaaagcccctgctactgaaaacacccatgtccccaatgcattggaaactgagcattcttcaagctgcttaacttcttgcccacccatttccttctttcctaactatttgattttgacacacgtaaagccccccaaaaaatgaactttatatcagctaaaacgaaagccctaaaacctgaaatttgagaaagggctgataagaggactgcttcgttttctcttgttgccaa

SEQ ID NO: 3166 - DNA, 712 bp, Catharanthus roseus
cctgcatagcatagcagacaaaagtcttctgaaagagctaatagaccaaaatctccttccaatttcgtcatatttccaagcatctacagatatcggtaacaattgcaatgctgcagcagcactactggccctaccaatttgtatagaggttttccgtcaatcgatttcaggttctgaggtagccaaaacctaaaattgaggaaaagtgagatactgcactttgttttattagagaaacaatatagaatggctggccaagaaaatgtgaaacagcttgaggaatgctcagtttccaatgctcttgggacatgggtattctcagtagctggcgctttgcttgcaatacctgtgggaataaaacgtaaatctttggcaccactagtcttttttggcacaactggtactatgctcgacataatcatgggaattagtgcctgcgaaagagaacatgccgaacgccaaatgaaagcttctggaagcacagaatgctggcaccgctgatgttgttggagctgaatcttgaaagagttggtggataaatgttttaggttgacgggtaggcaacagaatctgcaagaattgtctctatatctaacactctacccgatgtgccttgctctttacagtaactgacttgcatttcagataagctttatgagactatcaactctattgtaactcacatcagctattattcgcataatggtgtttt

SEQ ID NO: 3167 - DNA, 636 bp, Gossypium hirsutum
aacccgtctttctctttgtttgttggcaacaagagaaaacgaagcagtcctgttatcagccctttctcaaatttcaggttttagggctttcgttttaggtgatataaagttcattttttgggggcgtttacgtgtgtcaaaatcaaatagttaggagagaaggaaatgggtgggcaagaagttaagcagcttgaagaatgctcagtttccaatgcattgggtacatgggtgttttcagtagcaggggctttgctagcaattccggtggggataaagcggaaatctttagcaccccttgtgttctttggcacaaccggtacaatgctcgatatcattatgggaatcagtgcttgcgaaagggagcatgcagaacgccagatgaagctattagaagcccagaattccacagccgatgattcatcattttcggagacgggatcagaattgcattcctaaaattttaggaaggtcatttacattcagtatctttgagtgttgctttcaagctgcccttcgaacttttcttggctgtaaacaagacgaaaatcgattgctgttccggggttggtgggttttctctatgatcttcctttttgttaatgaaccattacagttgaataagaaggtggcggtttg

SEQ ID NO: 3168 - DNA, 1306 bp, Gossypium raimondii
cacatccaaaaaaaaaaaaatctaaacaaacgtgaataaattttctttgttccccgttcattttttttattttcctcgtgatgcatgattttcatatatatatatatgtttttgtattcaaatcggacggcgccggtgatgatcgatgactaaaatcaaacattcatatcatcacgaggtcaaaaagtttcttatttggtacgcccagagaaagatcgaaaccaaaaaaaaaagagaacacctttaaacgagcaagcaggcttgtccttggaataacctactgtatcgggcaatggacattgatgataaagaaatgaacttttggcccattagaagcccgttaaaatttcacctcaaaaatacctggaaaaaaaaaaaagaacccgtctttctctttgtttgttggcaacaagagaaaacgaagcagtcctcttatcagccctttctcaaatttcaggttttagggctttcgttttagctgatataaagttcattttttgggggcctttacgtgtgtcaaaatcaaatagttaggaaagaaggaaatgggtgggcaagaagttaagcagcttgaagaatgctcagtttccaatgcattggggacatgggtgttttcagtagcaggggctttgctagcaattccggtggggataaagcggaaatctttagcaccccttgtgttctttggcacaaccggtacaatgctcgatatcattatgggaatcagtgcttgcgaaagggagcatgcagaacgccagatgaagctattagaagcccagaattccacagccgatgattcatcattttccgagacgggatcagaatcgcattcctaaaatcttaggaaggtcatttacattcagtatctttgagtgttgctttcaagctgcccttcaaacttttcttggctgtaaacaagacgaaaatcgattgctgttctgggttggtgggttttctctatgatcttcctttttgttcatgctctttgtcaatgaaccattacagttgaataagaaggtggcggtttgtgttgaatttggtcagttgatttgggttttttggcagaggttcagatagatatgataaagagcctgaaagcgagctcaaagagttccaccattatttcgagcattaaactccaaccataaaaatgaaattaatcacccaactatgaacgtgattttgattgtgatcgaactacagaaacttgatttcttcactaacatttacgattgattttgttttggtcatcttttgttaaattgtttataacagagggaaaatgacaatgattaaattggtacaa

SEQ ID NO: 3169 - DNA, 982 bp, Arachis hypogaea
aacagaaggcttccctctccatgttgcaaagtgcaaacatgagctcgaccaaaccctaaatcactttctcattcatcactcacattatctactctcatcactcatcacttttgtattctccttctcccacacactcaagactcacacagcgtccaccattcacaattcctcaatctcctgccgtccgcgattaactgcggctggaactccgccgtcctcatttcaccgcgcctcgagctccgccgtgcacgattcactgcgcctcaagctccgttgtctctccgtcttgaggatcaccgccttcgtctgaccagcgtcgcagccgacccgccgtcctgttctccgagctctgtggtttcgccgtcctcttctatagccctctccttcgtgatcaacgctgcaaaacctatcacaggaaaaatggcaaatgaagaagtgaagcatctcgaagactgctctgtttccaatgcattgggcacttgggtattctcagtggcaggagctctgctggcgattccggtggggataaagcgcaaatctctggcaccccttgtattctttggcactactggtactatgctggatattattatgggaattagtgcttgcgaaagggaacatgcggagcgccaaatgaagttgatagaagctcaaagagctgcaaccgacacttctttggtggaggcaaacacggattcatagtcagtatatatctttctaagttgtcaaatttgtttggtttattgtaacaaaccaaatgcacttcgctggtggtccatggtcaaatgttctaattgatgcttttggaattttacctttaagatatgtaaattaaagcaggttaataagaaagcattcctttgcccatttataaattgcataaatgtttggttttcttttaccattacttagataatggtaatggaaaaacgaccttattggattctttgtaaactcagtgaggcgaacgtttaaggtatac

SEQ ID NO: 3170 - DNA, 610 bp, Sesamum indicum
ggttaaattggtagagttttggtgtgagaacaaagaaagaagagaaatttagtgatggctggaaaagaagaagtgaagcaactcgaggaatgctctgtttcaaatgctctgggcacctgggttttctcagtagctggtgctttgatcgcgattcctgtgggaatcaagcggaaatccctggcacccttagtattctttggcacaactggcacaatgcttgatataatcatgggcatcagcgcttgtgaaagagaacacgcagaacgtcaaatgaagctcttggaagcacaaaacgcagcttcagccgatgctgtgactgaatcttgataatgtttgattcgccccacttagtttgagcccaattgtgggtaacaatcaaggaacgttcttgtgcctgtcatgagtttgttgttactgtaaattggaagtccaataatgaatttggcttttcagtatagttgctgtctttggtaactgagtttatgggacaggtttgaaatcgaaatatgtccaagttcagcagagcagtgcatgttttccttttcatgtttctaatcagattcaataagttttgaattatgaacaattcctgaaaattttctaatgcctg

SEQ ID NO: 3171 - DNA, 721 bp, Amsonia hubrichtii
ttttactctcccacacgagaaccacaaccggccaccggcgactgggcgtcctttgcaaaaatcaacgacagagttggctattgattttaatccatttggaggtctccatatattgtataaaaaaaagtatagaatggctggccaagaaactgtgaaacaacttgaggaatgctcagtttccaatgctcttggcacatgggtattctcagttgctggtgctttgcttgcaatacctgtgggaataaaacgaaaatctttggcaccacttgtcttttttggcacaactggtacaatgctagatataatcatgggaattagtgcctgcgaaagagaacatgcagaacgccagatgaagcttctggaagcacagaatgctagcactgctgatgttggagctgaatcttgaaagtggtcggggatttatgttctaggttcacggcctttgcaaggcgaacagagtctgtgaatagtctttctcctggtcagatgtggcttgctcaataactgaattacctgattttagataagctttataagagttatcaacccttagttgtgcctcatcagctataactcgaatccggtggctttagccagcggtatttgcagatatttgaacttgttggtgaattcctcttaatttcgcaggaaaaggtcgttcttatttcataaataaccaggaatttaactactttttcattgattgattgttgcgttcaga

SEQ ID NO: 3172 - DNA, 679 bp, Olea europaea
cccgtttaagttcttaatcactgagcagcaggggacaagcggcaagggttttctccttctgtatcacactaaaaattgggaacatttcactgtgaaggaggcaaaatgcagtgatttctactcaacttctgcatctccaaaattggaaggattaagtatttggttcggtataaagtgaaaaggcgaatagcgataagaaaaagaaaatgtctggaaaagcggaggtgaaacaacttgaggaatgctctgtttcaaatgcactaggcacatgggtcttttcggtagctggagctttgcttgcaatcccggtgggaataaagcgaaaatctttggcaccccttgtattcttcggcacaactggtacaatgcttgatataatcatgggaatcagtgcctgtgaaagagaacatgcagaacgtcaaatgaagctcttggaagctcaaaatgcggcagcagctgatactgaatcagaatcttaaaacatgtgcagttattttgcactctcttaatctgtctcgactagtgttgccatccaagaataaaaagctggtgactaggctttttgaaaaatcttaccgtttgatttgtgctgtaggtttccatttaaaagttcaataatgtggtttgttatttgtgttaattgtcttcacatttctctctggtatgtcttatatttctg

SEQ ID NO: 3173 - DNA, 497 bp, Vinca minor
accaccaaccaccgctgtagagcttttctgccaatcgaaaaacataggatggctggccaagaaaattgtgaaacagctcgaggattgctcagtttccaatgctcttggtacatgggtattctcagtagctggtgctttgattgcaatacctgtgggaataaaacgtaaatctttggcaccacttgtctttttcggcacaactggtacaatgctcgacataatcatgggaattagtgcttgcgaaagagaacatgcagaacgccaaatgaagcttttggaagcacagaacgccgttgggactgaatcttttgggactgaatcttttgggactgaatcttgaaagagtcggtgaatatttatgttctaggttgaacggcctttctaaataaaaaacaagtgtctgcaaaatgcaacttgctcgtcatgcaactgaattagagtatacttgattttggataagcttaataagacttgtgaattctatgttgtacctcatc

SEQ ID NO: 3174 - DNA, 677 bp, Ipomoea nil
agaatctctgttctcgtttctccattctatcgcttctctcctcgaagccaatttctctgattgctcttacggtctactccaattcctgcagaggctaaagagatgcgccaagagtgatggccggacaagatgcacaacctgtgaaacaacttgaggaatgctctgtttccaatgcacttgggacatgggttttttcagtagctggtgctttgcttgcaatacctgtggggataaagcggaaatctttggcgccccttgtattcttcgggacaactggaaccatgcttgatataattatgggaatcagtgcctgtgaaagagaacacgcagaacgccagaagcttttggaagcacaaaattctgctgccgcagctgctgatgcattgcccaatattggagccggagccagagccgaatcatgatggcactcaggcacgcacgcaaatcacttcttttgttggattgctttcgattctgtggctgtcaaattttggcatttagtccaaatttttctgttaaacgtttctgttaaaattagtctaataaatcatcattacatttatgaaaccaacaagtggaataccatcttgaagtaaatggtcattacaattgtggtaaatactcaatacagctgtgggtaatgttcattgcttttgaattatgttccaaaaaaaaaa

SEQ ID NO: 3175 - DNA, 686 bp, Citrullus lanatus
atccatactccacagcaacccattttagggctcaggattccagcgggaaccataaaatccaccgtttcagatcgtaattctgtaagttcttcgccggagaagcctcatccccaacgtcaaccactgtttcgctaatattggagttgaattttgctgctgtttctcattagtaattgagttcatttaattgaggaagagacatgggaagccaagaaaatgttaagcatattgaggagtgctcagtttcaaatgcgttgggcacttgggtattctcagtagcaggagccttgctagcgattccagtgggaataaagagaaagtcactggcaccccttgtattttttggcaccactggtacaatgcttgacattataatgggaattagtgcctgtgaaagagaacatgctgagcgtcaaatgaagctattagaagaagctcaaaactctgcatcagaagcttcaattaacgattccgaatcccattcttgatatcatccttgcatggttgtatcactcactcgtcgtgccaaacaaccttttcatcctcagctgtgtttgatgatgaatacctttttggcatggcccttagctgggattgttcagccttctttcaaaccacagggacattgcttgagttgtggtattgcgcaatcaactgccttgactttattgatttgcaataaaatt

SEQ ID NO: 3176 - DNA, 688 bp, Cucumis melo
cattcgattctagggctaaccgttcagacgagactcataaaattcaccgccccagatcgtaattctataagttcatcgccggagaagcgtcatccccgccggcaatcgctgtttggctaatattggagttgatttttgctgctgtttctcagtagtaattgagttgattttattgaggaagagatatgggaagccaagaaaatgttaaacatattgaggattgctcagtttcaaatgcgttgggtacttgggtattctcagtagcaggagcgttgctagcaattccagtgggaataaagaggaaatcacttgcaccccttgtcttttttggcacaactggtactatgcttgacattataatgggaattagtgcttgtgaaagagaacatgctgagcgtcaaatgaagctattagaggaagctcaaaactctgctcctcaatcgtctcttaacgattccaattcccattcttgattttttgctaacacggttgtatcacccgttcgtatcgtgccatgcttaatgaccttttcttcccccaactgtgttaaatgatgaacactcttgtggcatggcctttggctgggtttgttcagccttctttcaaatcacagtgacattgcatcagttattgttcacgaaatcgtttgccttggctttattgatttgcaataaaattattctttagt

SEQ ID NO: 3177 - DNA, 604 bp, Fraxinus spp
cggccgggggagcggggaaaagctgtaagggtttttcttcctctgtatcacactaaaaattgggaacaatttactgtgaaggagaggcaaaaattgcagtgatttctactcaacttcttcatcaccaaaattggaaggattaagtatttggttcagtttaaagtgaaaaagcgaatagaagtaggaaaaagaaaatgtctggaaaagcggaggtgaaacaacttgaggaatgctctgtctcaaacgcactaggcacatgggtcttttcagtagctggtgctttgcttgcaatcccagtgggaataaagcgaaaatctttggcacccctcgtattcttcggcactactggtaccatgcttgatataatcatgggaatcagtgcttgtgaaagagaacatgcagaacgtcaaatgaagctcttggaagctcaaaatgctgcagcagcggttgctgaatcagaataataaaattttgcagttattttgcactctcttaatctgtctcgactagtgtagccatccaagaataaaaagctggtgactaggcttttcgaaaaatcttactgtttgatttgtgctgtaggttgccattcagaagttcaata

SEQ ID NO: 3178 - DNA, 451 bp, Sarracenia psittacina
gatttgaagagtacttccacttgttgttcaaaaagaagtttatattaaccagaaatcaagtagctggaagagcgagatggcaggccaagagaatgtgaagaaccttgaagactgctcggtttccaatgcacttgggacatgggtattctccgtagctggtgctttgcttgcgatacctgtgggaataaagcggaaatcattggcgcccctggtgttctttggcacgaccggtacaatgctcgacataatcatgggaattagccaatgcgaaagggaacacgcagaacgccaaatgcagcttttagaagcacaaaatgctggagctgccagttctttgacagaaacaggtgctgaatcttgatcttacattttatgtgcttggtattacaactttattctcaagttagctgtcgagagataactatttgtgaatagccctttatgggtatcc

SEQ ID NO: 3179 - DNA, 876 bp, Cucumis sativus
agacccctccaagctccttccttatcggaaacctgccggctgcacccgccactctcatttcggacttgttttagtttcctcatcgccatgcttcgcctctgatttttctccaatttcttccctccagatttctctctaaactcatcaattttattcgctacaagtcattgatcctttcgaggtttgcaccaattcgatcgactcactggaacgtggtcaaaccatactcattttcggccacgggcggtgacagcaacgctcacgctccagctgaacgcatgcatttcattcttttcctcaattgaagctaatattggagttgaattttgcttctgtttctcattagtaattgagttcattttattgaggaagagatatgggaagccaagaaaatgttaaacatattgaggattgctcagtttcaaatgcgttgggtacttgggtattctcagtagcaggagcgttgctagcaattccagtgggaataaagaggaagtcacttgcaccccttgtcttttttggcacaactggtactatgcttgacattataatgggaattagtgcttgtgaaagagaacatgctgagcgtcaaatgaagctattagaggaagctcaaaactctgcaactgaagcttttcttaacgattccaattccgattcttgattttgtgcctacacgggtgatacaaccgttcatgtcgtgcctaatgaccttttcttccctcaactgtgtgttattaaatgatgaacaccaacacccttgtggcatgccctttggctgggtttgttcagccttctttcaaatcacagtgacattgcatcagttataaccgtctgccttggctttattgatttgcaataaaattatattttagt

SEQ ID NO: 3180 - DNA, 613 bp, Cucurbita pepo
gaccgtcgcaataatactaatttcaacatccccagatcgaaagtctgtaaagttcctcgccggagaagcgtcatccccgccgtcaaccagtgttcagtaactgaggaagagctatgggaagccaagaacaagtgaagcatcttgaggagtgctccgtttcaaatgcgctgggcacttgggtattctcagtagcaggagcgttgctagcaattccagtgggaataaagaggaagtcactggcaccccttgtgttttttggcacaactggtacaatgcttgatatcataatgggaatcagtgcctgtgaaagagaacatgctgagcgtcaaatgaagctattagaagcccaaaactctgcagccgaagcttctgttaacgaatctgagtccctttcttgatatcattgcttacacggttgtatcagatgaatatctttgtggcatggcccttggctgatttgttacagccttctttcttcaaacccacagtgacactgaatgagttatggtttcacgagaactgtcttgactttgttgttgatcaaattatcataacatatattgatcatatatatgatatgaatcaagacatctcaataatacaatatgaactt

SEQ ID NO: 3181 - DNA, 505 bp, Platanus occidentalis
aaatattgctcgagtcgagagagtggaagacaaaaggtacgctgaggagagagatgggcggccaagaaatgtgaagcagcttgaagattgctccgtttccaatgcactgggcacatgggtattctctgtagctggggctttgcttgcgattccggtggggatacgacggaaatctttggcacccctggtgtttttcggtacaactggtaccatgcttgatattatcatgggaattagcgcatgcgaaagagaacatgctgaacggcaaatgaagcttttggaagagcaaaatcttgcaactgatgctgctatagcagagccgggaagtgagtcttgaggatattaatttcctacattctatgttctgatgtcactagtctgtgcaactacccttgctgttacagcagatgttttgtgaataagctgatgtaccgcatttattgcggcaaaaggatatttattcactttgctttcatttatatttttctttcattaatttatgact

SEQ ID NO: 3182 - DNA, 628 bp, Solanum tuberosum
ctaaaatcgccggagagagagagtcgaagctacagaatttcagttcgccgctgcggaagctccataaccaaattccttccgccgcagcgttcttattcagaaattcttttgctccgtctccgatcccgatcaatagcaatggctcgttctttctctaactctaagattctctctgctttcgtctccgactccgtttctgcttttcttagcaggcgtggatatgcggcggcatcacaaggtgcagtctccggtgtagcgaaaggaggagtgccaaggagcaacgtgatgatgcaaaaaagtggagaggaatccgtgaagacttcatgggtgccagatccagttaccggttactacaggccggaaggacaagcaaatgagattgacgctgctgagcttcggaagatgctgttgaagcacagatctggaagcaactgaaaagctttgaagctgcttctttgatctctactcatcggagatatttgattaacgagaaaagagttaagagaatttaaggaagacactgttttatcagcagaaaaaaatatttactcatgcgttgtttgctttaaattttaagcttattgttatatcttttcttttagtagtatcttttattcatgcaaatgaa

SEQ ID NO: 3183 - DNA, 661 bp, Solanum tuberosum
cggggctcccttatgtaaccctaaaatcgccggagagagagagtcgaagctacagaatttcagttcgccgctgcggaagctccataaccaaattccttccgccgtagcgttcttattcagaaattcttttgctccgtctccgatcccgatcgatagcaatggctcgttctttctctaactctaagattctctctgctttcgtctccgactccgtttctgcttttcttagcaggcgtggatatgcggcggcatcacaaggtgcagtctccggtgtagcgaaaggaggagtgccaaggagcaacgtgatgatgcaaaaaagtggagaggaatccgtgaagacttcatgggtgccagatccagttaccggttactacaggccggaaggacaagcaaatgagattgacgctgctgaactccggaagatgctgttgaagaacagatctggaagcaactgaaaagccatgcttcaaatacgaagctgcgtgactgcgtctttgatctccggttactcatcggagaaagagtcgagagaatttagggaaggcactgttttatcagacaaaaatagcagtgaaatttactcatgctttgtttgctttaaattttaagcttattgttatatcttttcttttagtaggttcttttattcatgcaaatgaac

SEQ ID NO: 3184 - DNA, 758 bp, Solanum phureja
ccctcctcattctccatctctatatatacttccccattctctccttcattcctcctcccttatgtaaccctaaaatcgccggagagagagagtcgaagctacagaatttcagttcgccgctgcggaagctccataaccaaattccttccgccgtagcgttcttattcagaaattcttttgctccgtctccgatcccgatcaatagcaatggctcgttctttctctaactctaagattctctctgctttcgtctccgactccgtttctgctttacttagcaggcgtggatatgcggcggcatcacaaggtgcagtctccggtgtagcgaaaggaggagtgccaaggagcaacgtgataatgcaaaaaagtggagaggaatccgtgaagacttcatgggtgccagatccagttaccggttactacaggccggaaggacaagcaaatgagattgacgctgctgagctccggaagatgctgttgaagcacagatctggaagcaactgaaaagccatgcttcaaatatgaagctgcgtctttgatctccggttactcatcggagaaagagttgagagaatttagggaaggcactgttttatcagacaaaaatagcagtgaaatttactcatgctttgtttgctttaaattttaagcttattgttatatcttttcttttagtaagtatcttttattcatgcaaatgaaataattatagtattagtagtaaattttcagttttttagaggtatttattttttgaa

SEQ ID NO: 3185 - DNA, 661 bp, Solanum melongena
tatatgtaaccctagtttcgccggagagagtcgaagctacggaatttcagttagcagcgctgcgggagcatcaaaagcaaattccttccgccgcagcgttattatttcgaaattcttttgctccgactccgatcgaaaataatggctcgttctttctccaactctaagattatctctgctttcgtctccaattccgtttctacttttcttagaaggcgtggatatgcggcggcatcacaaggtgcggtctccagtgtagggaaaggaggagtgccaaggagcaacgtgatgatgcaaaaaagcggagaggaatccgtgaagacttcatgggtgccggatccagttaccggttactacaggccggagggacaagggaatgagattgaccctgctgagctccggaagatgcttttgaagcatagatctggaagcaactgaaaagccacggatcaaacaggaagctctgcgtatttggtctccggttactcatcggaggtctctgatcaacgagaaaaagagcatttaggggagactgttttatcagaaaaatatagtgaaatctatttacgctttcttccttttaaattttaattttaagcttaattttgttatcctgttctatcttttaatttctgcaatgaacaacttaattagatgtatt

SEQ ID NO: 3186 - DNA, 571 bp, Nicotiana tabacum
ctcgtatatatgttgtaaccctagaataaccagagagtcgaagttagagaattttagttcgccgctgcggaatctccacaatcaattccttccgctgctgcgttcttcctttgaaattcttttgctccgactctaaccgtttgaaaaaatggctcgctctttctctaacaccaaggtcctttctgctttcgtctccgactctgtttctgcttttcttagcaggcgtggatacgcagcgggatcgcaaggggtggtttcgggcggtgcaaaaggaggagtgccaaggagcaacatgatgatgaataaaagtggagaggaatcagtgaagacatcatgggtgccagatccagtgactggttactataggccagagggagttgccaatgaaattgatgctgctgagcttcgaaagatgctcttgaagcacaaacctagaaacaactgaaaagccattggattaaaagcaaagctgtgcctttatcagaaaaaaattgtgaaatctactcatcgatgcttactgctttttaaaattgtaagcttaatattgttatcctatctctatcttttattt

SEQ ID NO: 3187 - DNA, 683 bp, Nicotiana tabacum
atatatgttgtaaccctagaataaccagagagtcgaagctagagaatttcagttcgccgctgcggaagctccacaaccaattccttccgctgctgcgttcttcctttgaaattctttcgctccgattctaaccattaagaaaaatggcacgctctttctctaactccaaggtcctctctgctgttgtgtccgactctgtttctgcttttctttgcaggcgtggatacgcagcgggatcgcaaggggcgctttcaggcggtgcaaaaggaggagtgccaaggagcaacatgataatgaataaaagtggagaggaatcagtgaagacatcatgggtgccagatccagttaccggttactacaggccagagggagttgctaatgaaattgatgctgctgagcttcgaaagatgcttttgaagcacaaaccgagaagcaactgaaaagccattggattaaaagcaaagctgtgtctttatcggatttttttgtgaaatctcctcctcgatgcttactgctttttaaaattgtaagcttaatattgttctcctatctctatcttttatttgtgcaaaatgaacaacttatgaaaagaaagcttgtagtagttaaattccggttcttagctagtatttagtttttgaattaatcttgagtaaacaatctgtacgattttactgaagaaa

SEQ ID NO: 3188 - DNA, 601 bp, Capsicum annuum
gcacgagggtcttaccctaaatttctccttaagacagaaagtcgaaagctagagaatttctgttcgctgctgtggaagctaaataaataaaattcccttccgccgcagcgttctttcttatttagagattctttcgctttcgtctcccatttgaaaaaaaatggctcgttctttctctaactctaaggttgtttctgctgtcgtctccgattccgtttgtgcttttcttagcaggcgtggatatgcggctgcatcacaaggtgcagtatccagtgtagctaaaggaggaatgccaaggagcaatgtgatgatgcaaaaaggcggagaggaaacgttgaagacttcatgggtgccagatccagttaccggttactacaggccggagggaaaagcgaatgagattgacgctgctgagcttcggaagatgctgctgaagcacaaacccacaaacaactaaaaagagctattgattaaaaacaaacatgtgtctttgatctccggttagtcattcgaggtctttgattgacgatgaaatgagttggagaatttagggagactttgttatgagaaaaaaaaaaaaatagtgaaatgtactccttgc

SEQ ID NO: 3189 - DNA, 824 bp, Capsicum annuum
tcaatcctgctcgatggtgattttagaaacgttgcttgttctttaataggatatggtgacaagatttttgcactgtcacggtaataaactaattgagcctccgactggcttatttctactgggaaaggccctcatgccgaattcggcacgaggttctccttaagacagaaagtcgaaagctagagaatttctgttcgctgctgtggaagctaaataaataaaattcccttccgccgcagcgttctttcttatttagagattctttcgctttcgtctcccatttgaaaaaaaatggctcgttctttctctaactctaaggttgtttctgctgtcgtctccgattccgtttgtgcttttcttagcaggcgtggatatgcggctgcatcacaaggtgcagtatccagtgtagctaaaggaggaatgccaaggagcaatgtgatgatgcaaaaaggcggagaggaaacgttgaagacttcatgggtgccagatccagttaccggttactacaggccggagggaaaagcgaatgagattgacgctgctgagcttcggaagatgctgctgaagcacaaacccacaaacaactaaaaagagctattgattaaaaacaaacatgtgtctttgatctccggttagtcattcgaggtctttgattgacgatgaaatgagttggagaatttagggagactctgttatgagaaaaaaaaaaaaatagtgaaatgtactccttgctttttaattttaagcttgatgtttttgtaatttatctacatctttttttattaatgcaataacaattgcagtattattatactttcattttt

SEQ ID NO: 3190 - DNA, 395 bp, Capsicum annuum
tggctcgttctttctctaactctaaggttgtttctgctgtcgtctccgattccgtttgtgcttttcttagcaggcgtggatatgcggctgcatcacaaggtgcagtatccagtgtagctaaaggaaggaatgccaaggagcaatgtgatgatgcaaaaaggcggagaggaaacgttgaagacttcatgggtgccagatccagttaccggttactacaggccggagggaaaagacgaatgagattgacgctgctgagcttcggaagatgctgctgaagcacaaacccacaaacaactaaaagaagctattgattaaaacaaaacatgtgtctttgatctccggttagtcattcgaggtctttgattgacgatgaaatgagttggagaattttaggg

SEQ ID NO: 3191 - DNA, 681 bp, Triticum aestivum
aaaatttcggccgatccaccacaccctgcaatggcgtccgcgctcaccaacgtgagcctgtctaccttcgcgcccacggccaggggcgacgtcctggcgaggccgcaggtggcccccgcccgcgtcaccttcccgacggcgtaccgcggcagcggcgccctctcctgcagggcgggcgggccggccacgccgccgggcatctccgacaagatgtcggacagcatcaaggaggcccaggagacgtgctcggaggacgccgccagcggggagtgcgccgcggcgtgggacgaggtggaggagctcagcgccgcggccagccacgcccgggacaagctcaaggactcggacccgctcgagaactactgcaaggagaaccccgagaccgacgagtgccgcacctacgacagctgagcgtacgtgctaatttgttctggacggcggatagtgaagctggacgtggtgttcttggctcatgggagcccgagaaacctgctatgtctcaacctaccgttacttacacgatcgggatgtatgtagtaaaaacgcgccaaatattttcccagggacatacgtggttgatatacaattgatattacagacgtttatttaaagttgtattatggatgtgtgcatgggtatggtgtagaggcgagtgtctggtcgtcctttccataaaaaaaa

SEQ ID NO: 3192 - DNA, 664 bp, Pseudoroegneria spicata
gaaccacataaaatttcggtcgatccaccgcaccctgcaatggcgtccgcgctcaccaacgtgagcctgtctaccttcgcgcccacggccaggggcgacgtcctcgcgaggccgcaagtggccgccgcccgcgtgaccttcccgacggcgtaccgtggcagcggtgccctctcctgcagggcgggcgggccgtccacgccgtcgggcatctccgacaagatgtccgacagcatcaaggaggcccaggagacgtgctcggaggacgccgccagcggggagtgcgcggcggcgtgggacgaggtggaggagctcagcgccgcggcgagccacgcccgcgacaagctcaaggactcggacccgctcgagaactactgcaaggagaaccccgagaccgacgagtgccgcacctacgacagctgagcgtacgtgccaatctgttctggacggcggatactgaaggtcgacgtggtgttcttggctcatgggagcccgagaaacctatgtctcaacctaccccgttacttactcgggatgtatgtagtaaatgctccaaatattttcccagggacatgcgtggttgatacaattgataatacagacgtttatttaaagttatattatggatgtgtgcatcggcatgctgcggagactagagtctcattta

SEQ ID NO: 3193 - DNA, 583 bp, Secale cereale
  misc_feature (569)..(569): n is a, c, g, or t
ataaaatctcgggcgatccaccacaccctgcaatggcgtccgcgctcaccaacgtgagcctctctaccttcgcgcccacggccaggggcgacgccgtcctcgccaggccgcaggtggccgccgcccgcgtcaccttcccggacggcgtaccgcggcagcggtgcgctctcctgcagggcgggcgggccgtccacgccgccgggcatctccgacaagatgtcggagagcatcaaggaggcccaggaggcgtgctcggaggacgccgccagcggggagtgcgcggcggcgtgggacgaggtggaggagctcagcgccgcggccagccacgcccgggacaagctcaaggactcggacccgctcgagaactactgcaaggagaaccccgagaccgacgagtgccgcacctacgacagctgagcgttcgtactgctaatttgttctggatggcagatacgatacttgatggtggacatggtgctcttggctcataggagcccgacaaacctatgcctcaatctacagttacttactgggctgtgtgcagtaaatgctccaaatattttcccagnacatacataattga

SEQ ID NO: 3194 - DNA, 886 bp, Secale cereale
cgtcctgtacctgacatgcatctaactggacttagcctgagtttcaggccggtgtgcgtgtatttgttttattgggaaacacttaccatcaaccgacggaataacagagccgctccgtcatctttcctgcggccgaaccacataaaatctcgggcgatccaccacaccctgcaatggcgtccgcgctcaccaacgtgagcctgtctaccttcgcgcccacggccaggggcgacgccgtcctcgccaggccgcaggtggccgccacccgcgtcaccttcccgacggcgtaccgcggcagcggtgccctctcctgcagggcgggcgggccgtccacgccgccgggcatctccgacaagatgtcggagagcatcaaggaggcccaggaggcgtgctcggaggacgccgccagcggggagtgcgcggcggcgtgggacgaggtggaggagctcagcgccgcggccagccacgcccgggacaagctcaaggactcggacccgctcgagaactactgcaaggagaaccccgagaccgacgagtgccgcacctacgacagctgagcgttcgtactgctaatttgttctggatggcagatatgatacttgaaggtggacatggtgctcttggctcgtaggagcccgacaaacctatgtctcaatctacagttacttactgggctgtgtgcagtaaatgctccaaatattttcccagggacatacatggttgataaattgataatacatacgtttgtttgaagttttactatggttgtgtgcatccttatggcgcagaaatgagaggctgatccttcttttacaaaacttaaaaaaaaaaaaaacaaaactagacatacaacgaagacacaggaggagtagcccccccccccccc

SEQ ID NO: 3195 - DNA, 633 bp, Secale cereale
ggcgtccgcgctcaccaacgtgagcctgtctaccttcgcgcccacggccaggggcgacgccgtcctcgccaggccgcaggtggccgccgcccgcgtcaccttcccgacggcgtaccgcggcagcggtgccctctcctgcagggcgggcgggccgtccacgccgccgggcatctccgacaagatgtcggagagcatcaaggaggcccaggaggcgtgctcggaggacgccgccagcggggagtgcgcggcggcgtgggacgaggtggaggagctcagcgccgcggccagccacgcccgggacaagctcaaggactcggacccgctcgagaactactgcaaggagaaccccgagaccgacgagtgccgcacctacgacagctgagcgtagtgctaatttgttctggatggcggatacgatacttgaaggtggacatggtgctcttggctcataggagcccgacaaacctatgtctcaatctacagttacttactgggctgtgtgcagtaaatgctccaaatattttcccagggacatacatggttgataaattgataatacatacgtttgtttgaaggtttaccatggttgtgtgcatcgttatggcgcagaaatgagaggctgatccttctttt

SEQ ID NO: 3196 - DNA, 612 bp, Leymus cinereus x Leymus triticoides
gcacgaggcataaaatttgtgtcgatccaccacacgctgcaatggcgtccgcgctcaccaacgtgagcctgtctaccttcgcgcccacggccaggggcgacgtcctggcgaggcctcaggtggccgcccgcgtgaccttcccgacggcgcaccgcggcggtgccctctcctgcagggcgggcgggccgtccacgccgccgggcatctccgacaagatgtcggacagcatcaaggaggcccaggagacgtgctcggaggacagcgccagcggggagtgcgcggcggcgtgggacgaggtggaggagctcagcgccgcggccagccacgcccgcgacaagctcaaggactcggacccgctcgagaactactgcaaggagaaccccgagaccgacgagtgccgcacctacgacagctgagcgtactgctaatttgttctggatggcagacaagtcagatacttgaaggtggacttggtattcttggctcataggagcccgagaaacatacgtctcaacctaccgttacttacttgggatgtatgtagtaaatgctccaaatgttttcccagggacatacgtggtttatacaattgataatacatacgtttattta

SEQ ID NO: 3197 - DNA, 708 bp, Hordeum vulgare
aaaatttccgccaaacccaccacacacccagcaatggcgtccgcgctcaccaacgtgagcctgtctaccttcgcgcccacggccaggggcgacgtcctcgccaggccgcaggtggccgccgccgccgccgcccgggtcaccttcccgacggcgtaccgcggcagcggcgccctctcctgcagggcgggcgggccgtccacgccgtcgggcatctccgacaagatgtcggagagcatcaaggaggcccaggagacgtgctcggaggacgccgccagcggggagtgcgcggcggcgtgggacgaggtggaggagctcagcgcagcggccagccacgcccgggacaagctcaaggactccgacccgctcgagaactactgcaaggagaaccccgagaccgacgagtgccgcacctacgacagctgagcgtagctaatttgttgtggacgtacggcggatactcaaggtggacgtgcgtggtatttcttggctcgtggggggccgggaaaactatgtcgatcgactcagcctaccgttacctactcgggatcgatgtatgtagtaaaaatgctcgaaatattttcccagggacatacgtgtggttgatatacaattgatgatacatatacgtttattcaaagttgtattatgtatgtatgtgtgcatcgttatgatgcagagacgagagccagatcgaacgctgttttggcc

SEQ ID NO: 3198 - DNA, 842 bp, Hordeum vulgare
aacttgttacagcccaaccacataaaatttccgccaaacccaccacacacccagcaatggcgtccgcgctcaccaacgtgagcctgtctaccttcgcgcccacggccaggggcgacgtcctcgccaggccgcaggtggccgccgccgccgccgcccgggtcaccttcccgacggcgtaccgcggcagcggcgccctctcctgcagggcgggcgggccgtccacgccgtcgggcatctccgacaagatgtcggagagcatcaaggaggcccaggagacgtgctcggaggacgccgccagcggggagtgcgcggcggcgtgggacgaggtggaggagctcagcgcagcggccagccacgcccgggacaagctcaaggactccgacccgctcgagaactactgcaaggagaaccccgagaccgacgagtgccgcacctacgacagctgagcgtagctaatttgttgtggacgtacggcggatactcaaggtggacgtgcgtggtatttcttggctcgtggggggccgggaaaactatgtcgatcgactcagcctaccgttaccttgtatgtagtaaaaatgctcgaaatattttcccagggacatacgtgtggttgatatacaattgatgatacatatacgtttattcaaagttgtattacgtatgtatgtgtgcatcgttatgatgcagagacgagagccagatcgaacgctgttttggccatcagatcgcactgcacgcatccaagagtaatctggtagccatgttagattttgatttgagatcgttcgagtcaggaccgaaccgagctaacacacgaagctatcgattcggtcatgtatcac

SEQ ID NO: 3199 - DNA, 735 bp, Avena sativa
taactacacacaaaatcgtatcgacacgagctagttggtgctgcaatggcgtctgcgctgacgaacgtgagcttgtctatcttcacggccgcggccaggggcgatgtcctcgcgaggccgcaggtggccgcccgggtcacgttccctacgttgggcggccgccttgtcgcttgccggggcgtcgggccttcgacgcccccaggcatctcggacaaggtgtcggagagcatcaaggaggcccaggaggcgtgctcggaggacggcgccagcggggaatgtgcggccgcttgggacgaggtggaggagctcagtgccgcggctagccacgcccgcgacaagctcaaggactccgacccgctcgagaactattgcaaggagaaccccgagaccgacgagtgccgcacctacgacagctgagcgtatgtgctaattaatttgttctagaagggtggataagatacttgaaggggtcgttgatcgcataagcaatgataccgaggggagagaaacggggaaaaatacaaggtttttaccccttgaatatggacaaagtaagattctctgttttcttcgcctctattgctgttcaataaacgcctgtatgtaatgggaaatgactatatgaataatatatatgtatgacatgtttatactgggttgagaattttatttactacccctttgtcatgagaattattagatgtcaccgatttatatttaggtttaccaaaaaaa

SEQ ID NO: 3200 - DNA, 657 bp, Lolium multiflorum
caaaaatctcatatcaaccgacgagctagctgctgctgcaatggcgtctgcgctgacgaacgtgagcctgtctaccttcgcggccgcggcccgaggcgacgtcctcgcgaggccgcagggccccgcccgtgtcacgttcccggcggtgagccgcgtcgtcgcctgccgggccggcgggcctgcgacgccgccgggtatctcggacaaggtgtcggagagcatcaaggatgcccaggaggcgtgctcggacgacagcgccagcggggagtgcgcggcggcgtgggacgaggtggaggaactcagcgccgcggccagccacgcccgcgacaagctcaaggattccgacccgctcgagaactactgcaaggagaacccggagaccgacgagtgccgcacctacgacagctgagcgtacgtgttaattaatttgttctagactggaagataagatcgatacttgaaggggtcgctgatcacacaagaaatgatacttggaggggagtgaaaagaaagaaatcaaggttttttacccggtgaatatgcaccatgattctgtgttttctccacctctgttgttgctattcaatatacacctgtatgtaatcgaaaatggttatatgaataatcatatttgtatgacatgtttctactcggaaa

SEQ ID NO: 3201 - DNA, 680 bp, Avena sativa
agctcataactacacacaaaatcgtatcgaccgacgagctagttggtgctgcaatggcgtctgcgctgacgaacgtgagcttgtctatcttcacggccgcggccaggggcgatgtcctcgcgaggccgcaggtggccgcccgggtcacgttccctacgttgggcggccgccttgtcgcttgccggggcgtcgggccttcgacgcccccaggcatctcggacaaggtgtcggagagcatcaaggaggcccaggaggcgtgctcggaggacggcgccagcggggaatgtgcggccgcttgggacgaggtggaggagctcagtgccgcggctagccacgcccgcgacaagctcaaggactccgacccgctcgagaactattgcaaggagaaccccgagaccgacgagtgccgcacctacgacagctgagcgtatgtgctaattaatttgttctagaagggtggataagatacttgaaggggtcgttgatcgcataagcaatgataccgaggggagagaaacggggaaaaaatcaaggtttttaccccttgaatatggacaaagtaagattctctgttttcttcgcctctattgctgttcaataaacgcctgtatgtaatgggaaatgactatatgaataatatatatgtatgacatgtttatactgggttgagaattttattt

SEQ ID NO: 3202 - DNA, 650 bp, Triticum aestivum
ccacgcgtccgctaaccacataaaatttcggccgatccaccacacactgcaatggcgtccgcgctcacaaacgtgagactgtctaccttcgcgcccacggcaaggagcgacttcctggcgaggccgcaggtggcccccgcccgcgtcaccttcccgacggagtaccgcgggagtggcgccctctcctgtagggcgggcgggacggccacgccaccagaaatctccgacaatatgtctgacagcatccaggatgcccaggatacgtgctcagatgacgccgcaagtggagagtgagccgcggtttgagacgaggtggatgagctcactgccgcaggcagccaagcccgggataagcgtcaaggactcggacacgctcgataactactgctaggagaaccccgagaccgactagtgccgcacctacgacagctgaacgtacgtgctaatttgttctggactgaggatctgaagctggacgtgctgctcttggctcatgtgaccccgagaaacctgctatgtctcaacctgacgttacttacgcgatcgatatgaatgtaccataaacgcgccaaatattatcccaatgacataggtggctgactgaccattgatctgacccacgtgtagtctaagtagtattatggatgtgc

SEQ ID NO: 3203 - DNA, 638 bp, Triticum aestivum
ctaaccacataaaatttcggccgatccaccacacactgcaatggcgtccgcgctcacaaacgtgagactgtctaccttcgcgcccacggcaaggagcgacttcctggcgaggccgcaggtggcccccgcccgcgtcaccttcccgacggagtaccgcgggagtggcgccctctcctgtagggcgggcgggacggccacgccaccagaaatctccgacaatatgtctgacagcatccaggatgcccaggatacgtgctcagatgacgccgcaagtggagagtgagccgcggtttgagacgaggtggatgagctcactgccgcaggcagccaagcccgggataagcgtcaaggactcggacacgctcgataactactgctaggagaaccccgagaccgactagtgccgcacctacgacagctgaacgtacgtgctaatttgttctggactgaggatctgaagctggacgtgctgctcttggctcatgtgaccccgagaaacctgctatgtctcaacctgacgttacttacgcgatcgatatgaatgtaccataaacgcgccaaatattatcccaatgacataggtggctgactgaccattgatctgacccacgtgtagtctaagtagtattatggatgtg

SEQ ID NO: 3204 - DNA, 678 bp, Brachypodium distachyon
gcctaaaccacagaaaagaaagaaaaactcgtctggatcaacgaagctgctgcctgctgttgcaatggcgtctgcactgaccggcgtgagcctgtctacccccgcgacgttcgcggcggccacggccaggggcgacaggccgcaggtggcgccggcccgcgtcacgctcaggtcgatggtgatgggccgcggcacggtcgcgtgcagggccggtgggccgtccacgccgccgggcatctcggacaagatgtcggagagcatcaaggaggcccaggaggcgtgctcggaggacagcgccagcggggagtgcgcggcggcgtgggacgaggtggaggagctgagcgcggcggccagccacgcccgcgacaagctcaaggagtccgacccgctggagaactactgcaaggagaaccccgagaccgacgagtgccgcacctacgacagctgatccatcggtccaagcgcccgtcggcccgtgtacgtgcatgttaatttgttatagacgtacggcagataattaaagatacttcaaggggtcctcttgcttgaccgcagataaaattatgcttgaaggggaagtgaaaaaagaaaggtcttttacctgggtgaatttgcaccaagctttttattcaacctgtatctattcattacatatataattatatatatatttactct

SEQ ID NO: 3205 - DNA, 1735 bp, Brachypodium distachyon
cgggtgcacgtaaaagcttcccttctcaaacacccaaaccgagctataaatacaaaccttaccgcttcaaacgcaaggccggccttgttacagcctaaaccacagaaaagaaagaaaaactcgtctggatcaacgaagctgctgcctgctgttgcaatggcgtctgcactgaccggcgtgagcctgtctacccccgcgacgttcgcggcggccacggccaggggcgacaggccgcaggtggcgccggcccgcgtcacgctcaggtcgatggtgatgggccgcggcacggtcgcgtgcagggccggtgggccgtccacgccgccgggcatctcggacaagatgtcggagagcatcaaggaggcccaggaggcgtgctcggaggacagcgccagcggggagtgcgcggcggcgtgggacgaggtggaggagctgagcgcggcggccagccacgcccgcgacaagctcaaggagtccgacccgctggagaactactgcaaggagaaccccgagaccgacgagtgccgcacctacgacagctgatccatcggtccaagcgcccgtcggcccgtgtacgtgcatgttaatttgttatagacgtacggcagataattaaagatacttcaaggggtcctcttgcttgaccgcagataaaattatgcttgaaggggaagtgaaaaaagaaaggtcttttacctgggtgaatttgcaccaagctttttattcaacctgtatctattcattacatatataattatatatatatttactctaagaaccatgcgaaactgctcttccgcgctcagggaacctacctccccttgttgaggctttttcaagcctgatggttggattttgctattgtgatatcctgaagtatggtgcctttggattacatgctatatattagtttgattttatcgtcctatcaagtgatacaatcacaaaacttcaaacacggacggttctacagtgtcatacgatcctatttacgatccatgatttggataagacttgaaatctcaaccttgtgctttaaacttttgagcaattgtcggggctaaaatttacatttcataagagtgaactcttttgctttcgcgaggctttcaactctgccacacaatattaggagttgtttgactcgtgtgttcggaagggaaaacaccactccctatggggtaatttggtgttcatcaactctttttttgactgatggtgttcatcaactttattctcacttatatagtcatatgtatgatgtctttctttgatattgcacgtaacaaatacattggttcgcaaactccggctcaggatcttttctttatcaaggatggctctcaagtgagatttcaggagatattttttgctcgggaccggcccctcaaagactaatatccagccttatttcttatatggagcgtgatactttggcacacgtccttgcttcctttgtacttttggtgtactatcttcaagccgttggatcaccaactgactttgctgacatgatctaactagagcaagtggtcacggacatttacatccatcataagtggtagtctagtcgtcggattctgtttgttcatactagtttatttcattaaatgtactaaacttattgtgtagtattattggttgtgtgcgtctcggtgcagtgcgtgtgtgataccttatggttttacgacaatataactctatgatcaataaagacttctatttttagaaataaaaa

SEQ ID NO: 3206 - DNA, 2000 bp, Triticum aestivum
tgttgccggtttggagccagtgatgagctgcctcacgttccgccgctccgccgccgacgccagccgcctccagacggcctcctcgtcttcatgttcttcatctcgattcccatacgtagtctgaatgccagtcgtactagtagtaattccagtattattactagtagcatcagcaatcttctcttgtaaacaaacgtacgccgctcgtgctcgcggttgcgttcgcgcggacggaggggtcctcttcttctgctgctgctccgtctgaatcttcttcttcttctcgccggttgacggtcgcgacggcggccatggatcccaacagcttcaaaaccggaggccttctgcttccaaccatcgagaggcgctgcgcttcgcctccatctgtgatcgtgatcggcggcggaatctcagggatcgccgcggctcgtgtcctctccaattcctctttcgaggtgactgtccttgagtcgagagatcgaatcggtggccgtgttcatacggattactcctttggatgccccattgacatgggagcctcatggttgcacggtgtcagcaatgagaattctttagcaccactgataagccatcttgggctgagattataccacactagtggtgacaactctgttttgtatgaccatgatttggaaagctgttcgctctttgataagaacggccttgcagtcccaatggagacggctgctaaagttggcgtgatatttgagaaaattctcaaggagacggtgaaactccgtgatgagcaggagcacgacatgccccttgaacaggcaatctcgatggtgcttgagaggcaccctgatctcaagctggaagggctagatgatcgaatcctgcaatggtgcgtctgccggctggaggcatggtttgctgcagatgcagatgaaatatctctgaagaactgggatcaggaacatgttctcactggtggccatggcctgatggttgatggatactttcctgtaattcaggctctcgctcaaggtctcgacatccgtctgaatcagagagtaaagaaaattgcacgccagcaaaagggagtgacagtcaccatcgaggacggcacacaatactcggccgatgcctgcataatcactgtgccgcttggtgtgctgaaggcaaacgtaatcaagttcgagcctgagctgccatcctggaagagctccgccatcgccgaccttggtgtcggcatagaaaacaaggtcgccatgcacttcgacaaggccttctggcctaatgtccaggtgctgggcatggtcggcccgacgcccaagacgtgcggctacttcctgaacctccacaaggccaccggccacccggtgctcgtcttcatggccgccggtcggttcgcccaggatgtggagaagctctcggacaaggaggcggtggaactcgtcatgtgtcacctgaggaagatgatacccgacgccactgaacccactcagtacctggtgtcgcggtggggctcggacccgaactcgctggggtcctactcgtgcgacctggtggggaagccgtcggacgtgtgcgagaggttctcggcgccggtggagagcgtgctgtacttcgccggagaggcggccagcgcggagcactctggcgcggtgcacggcgcgtactcgtcaggtatggacgccgccgaggaatgccggaggaggctgctgatgagcaagggcgtgccggacctcgtccaggtcggcgccgcggcgtgcgaggagatggccgacgtcgtcgcccctctccagatttgccgcacctagggatggtgattcttcgttacagctgcgttctgccatgcccgattgatctgaagattgacagaagccgatcagtgtgcagtcggtcagtccgagtcggcagaacgcaagattgaattcagtttttcttttttttttttacatgttctattttctcgtgttccttcggatcaaggaacatttgatcgatgcctgtgctgctgtgcactctggagactt

SEQ ID NO: 3207 - DNA, 2219 bp, Triticum aestivum
gccttctccagccaccgcccgccggaagaaagaaagcatctttgcttctcgccgccgccggtgagggagggaggaaggaaggaggcaggggatcccattgggtgttgccggtttggagccagggtgatgagctgcctcacgttccgccgctccgccgccgacgcaagccgcctccaggacggcctcctcgtcttcatgttcttcatctcgattcccatacgtagtctgaataatagtcgtactagtagtaattctagtattactagtagtaatctcttgtaaacgcacgccgctcgtgctcgcggttgcgttcgcgcggacggaggggccttcttctgctgctgctccgtctgaatcttcgtcttcttcttctcgtcgggcgacggtcgcgccggcggccatggatcccaacagcttcaaaaccggaggccttctgcttccaaccattgagaggcggtgcgcttcgcctccatctgtgatcgtgatcggcggcggaatctcagggattgccgcggctcgtgtcctctccaattcctcttttgaggtgactgtccttgagtcgagagatcgaatcggcggccgtgttcacacggattactcctttggatgccccattgacatgggagcctcatggttgcacggtgtcagtaatgagaattctttagcaccactgataagccatcttgggctgagattataccacactagtggtgacaactctgttttgtatgaccatgatttggaaagctgttcgctctttgataagaacggccttgcagtcccaatggagacggctgctaaagttggcgtgatatttgagaaaattctcaaggagacggtgaaactccgtgatgagcaggagcacgacatgccccttgaacaggcaatctcgatggtgcttgagaggcaccctgatctcaagctggaagggctagatgatcgaatcctgcaatggtgcgtctgccggctggaggcatggtttgctgcagatgcagatgaaatatctctgaagaactgggatcaggaacatgttctcactggtggccatggcctgatggttgatggatactttcctgtaattcaggctctcgctcaaggtctcgacatccgtctgaatcagagagtgaagaaaattgcacgccagcagaagggagtgaccgtcaccatcgaagacggcacgcaatactctgccgacgcctgcataatcactgtgccgctcggtgtgctgaaggcgaacataatcaagttcgagcctgagctgccctcctggaagagctccgccatcgcggacctcggcgtcggcatagaaaacaaggtcgccatgcacttcgacaaggccttctggcctaatgtccaggtgctgggcatggtcggccctacgccgaagacctgcggctacttcctgaacctccacaaggccactggccacccggtgctcgtcttcatggcagccggtcggttcgcccaggatgtggagaagctctcagacaaggaggccgtggaactcgtcatgtgtcacctgaggaagatgatacccgacgccactgaacccagtcagtacctggtatcgcggtggggctcggacccgaactcgctggggtcctactcgtgcgacctggtggggaagccgtcggacgtgtgcgagaggttctcggcgccggtggagagcgtgctgtacttcgctggagaggcggccagcgcggagcactcgggagctgtgcacggcgcatactcgtcaggcatggacgccgctgaggaatgccggaggaggctgctgatgaggaagggcgttccggacctcgtccaggtcggcgccgccgcctgcgaagagatggccgacgtcgtcgcccctctccagatttgccgcacctagagatgattcttcgatacagctgcgttctgccatgcccgattggtctgatgattgacagaagccgatcaatgtgcagtcgatcagtccgagtcggcagaacgcaagattgaattcagatttccttttttttcacatcttctattttctcgtgttgctttggatcaaggaacatttgatcgatgcctgtgctgctgtgcactgtggacacttgatttatagcgttaccaatttgttatgtccgatcaatcaataaattttagacaagtgacatttgggtactgagtcttgtacgaatgatttttttccatctggacatgaatcctgggctgctgggcattgtggcctc

SEQ ID NO: 3208 - DNA, 2149 bp, Triticum aestivum
gccttctccagccaccgcccgccggaagaaagaaagcatctttgcttctcgccgccgccggtgagggagggaggaaggaaggaggcaggggatcccattgggtgttgccggtttggagccagggtgatgagctgcctcacgttccgccgctccgccgccgacgcaagccgcctccaggacggcctcctcgtcttcatgttcttcatctcgattcccatacgtagtctgaataatagtcgtactagtagtaattctagtattactagtagtaatctcttgtaaacgcacgccgctcgtgctcgcggttgcgttcgcgcggacggaggggccttcttctgctgctgctccgtctgaatcttcgtcttcttcttctcgtcgggcgacggtcgcgccggcggccatggatcccaacagcttcaaaaccggaggccttctgcttccaaccattgagaggcggtgcgcttcgcctccatctgtgatcgtgatcggcggcggaatctcagggattgccgcggctcgtgtcctctccaattcctcttttgaggtgactgtccttgagtcgagagatcgaatcggcggccgtgttcacacggattactcctttggatgccccattgacatgggagcctcatggttgcacggtgtcagtaatgagaattctttagcaccactgataagccatcttgggctgagattataccacactagtggtgacaactctgttttgtatgaccatgatttggaaagctgttcgctctttgataagaacggccttgcagtcccaatggagacggctgctaaagttggcgtgatatttgagaaaattctcaaggagacggtgaaactccgtgatgagcaggagcacgacatgccccttgaacaggcaatctcgatggtgcttgagaggcaccctgatctcaagctggaagggctagatgatcgaatcctgcaatggtgcgtctgccggctggaggcatggtttgctgcagatgcagatgaaatatctctgaagaactgggatcaggaacatgttctcactggtggccatggcctgatggttgatggatactttcctgtaattcaggctctcgctcaaggtctcgacatccgtctgaatcagagagtgaagaaaattgcacgccagcagaagggagtgaccgtcaccatcgaagacggcacgcaatactctgccgacgcctgcataatcactgtgccgctcggtgtgctgaaggcgaacataatcaagttcgagcctgagctgccctcctggaagagctccgccatcgcggacctcggcgtcggcatagaaaacaaggtcgccatgcacttcgacaaggccttctggcctaatgtccaggtgctgggcatggtcggccctacgccgaagacctgcggctacttcctgaacctccacaaggccactggccacccggtgctcgtcttcatggcagccggtcggttcgcccaggatgtggagaagctctcagacaaggaggccgtggaactcgtcatgtgtcacctgaggaagatgatacccgacgccactgaacccagtcagtacctggtatcgcggtggggctcggacccgaactcgctggggtcctactcgtgcgacctggtggggaagccgtcggacgtgtgcgagaggttctcggcgccggtggagagcgtgctgtacttcgctggagaggcggccagcgcggagcactcgggagctgtgcacggcgcatactcgtcaggcatggacgccgctgaggaatgccggaggaggctgctgatgaggaagggcgttccggacctcgtccaggtcggcgccgccgcctgcgaagagatggccgacgtcgtcgcccctctccagatttgccgcacctagagatgattcttcgatacagctgcgttctgccatgcccgattggtctgatgattgacagaagccgatcaatgtgcagtcgatcagtccgagtcggcagaacgcaagattgaattcagatttccttttttttcacatcttctattttctcgtgttgctttggatcaaggaacatttgatcgatgcctgtgctgctgtgcactgtggacacttgatttatagcgttaccaatttgttatgtccgatcaatcaataaattttagacaagtgacatttggg

SEQ ID NO: 3209 - DNA, 2125 bp, Secale cereale
cgccgccgccgcagcagcaacgatctcatcgccgtcgtcgggaaggaatcccctggtgttgccggtttggagccagggtgatgagctgcctcacgttccgccgctccgccgccgacgccagccgcctccaggacggcctcctcgtcttcatgttcttcatctcgattcccatacgtagtctgaataacaatcgcattactactagtaattctagtattactagtagtaatctcctgtaaacgcacgccgctcgtgctcgcggctgccgacggaggggtcctcttctgctgctgctgctccgtctgcgtcttcctcctcttcttctcgatcggcgacggccgcgacggcggccatggattccaacagcttcaaaaccggaggccttctgcttccaaccattgagaggcggtgcgcttcgcctccatctgtcatcgtgatcggcggtggaatctcagggattgccgcggctcgtgtcctctccaattcctctttcgaggtgactgtccttgagtcaagagatcgaattggtggccgtgtccatacggattactcctttggatgccccattgacatgggagcctcgtggttgcacggtgtcagtaatgagaattctttagcaccactgataggccatcttgggctgagattatatcacacaagtggggacaactctgttctgtatgaccatgatttggaaagctgttcgctctttgataagaacggccttgcagtcccaatggagacagctgctaaagttggcgtgatattcgagaaaattctcaaggagacggtgaagctccgtgacgagcaggaacatgacatgccccttgaacaggcgatttcaatggttcttgagaggcaccccgatctcaagctagaagggctagatgatcgaatcctgcaatggtgtgtctgccggctggaggcatggtttgctgcagatgcagatgaaatatctctgaagaactgggatcaggaacatgttctcactggtggccatggcctgatggttgatggataccttcctgtaattcaggctctcgctcaaggtcttgacatccgtctgaatcagagagtaaagaaaattgcacgcgagcacaagggagtgacagtcaccatcgaggacggcacacaatactcggccgacgcctgcataatcactgtgccgcttggtgtgttgaaggcgaacataatcaagttcgagcctgagctgccatcctggaagagctcggccatctccgaccttggcgtcggcattgaaaacaaggtcgccatgcactttgacaaggccttctggccgaatgtccaggtgctgggcatggtcggccctaccccgaagacctgcggctacttcctgaacctccacaaggccaccggccacccagtgcttgtcttcatggcagccggtcggttcgcccaggatgtggagaagctctcggacaaggaggccgtggaactcgtcatgtgtcacctgaggaagatgatacccgacgccactgaacccaacaagtacctggtgtcacggtggggctcggacccgaactcgctggggtcctactcctgtgacctggtggggaagccgtcggacgtgtgcgagaggttctcggcgccggtggagagcgtgctgtacttcgccggagaggcggccagcgccgagcactcgggcgcggtgcacggcgcgtactcgtcaggcatggacgccgcagaggaatgccggaggaggctgctgatgagcaagggcgttccggacctcgtccaggtcggcgccgcggcgtgcgaggagatggccgacgtcgtcgcccctctccagatttgccgcacctagggatgatgattcttcgttacagctgcgttctgccacgcccgattgatttgacgattgacagaagccgatcaatgtgcagtaaatcagtccgagtcggtcaggacgcaagattgaattctgatattatttttcacaccttctattttctcgtgttgcttggatcaagaaacatttgatcgatgcctgtgctgctgtgcgctctggacacttgttttatagcgttaacaatttgttatgtccaatcaatcaataaattttagacaattgacaatttaaaagggtaaaaaaaaaaaaaaaaaa

SEQ ID NO: 3210 - DNA, 2145 bp, Secale cereale
gactagatcccttggcaatccaccacccacccgagaggaagaacaagcaaagctcgtccttccatctcgccgccgccgccgcgatctcatcgccgtcgtcgggaaggaaaggaaggagggaaggaaccccctggtgttgccggtttggagccagggtgatgagctgcctcacgttccgccgctccgccgccgacgccagccgcctccaggacggcctcctcgtcttcatgttcttcatctcgattcccatacgtagtctgaatcacaatcgtgctactagtaattccagtattactagtagtaatctcctgtaaacgcacgccgctcgtgctcgcggctgcggacggagggctcctcttctgctgctgctccgtttgcgtcttcctcttcttcttctctatcggggacggccgcgacggcggccatggattccaacagcttcaaaaccggaggccttctgcttccaaccattgagaggcggtgcgcttcgcctccatctgtcatcgtgatcggcggcggaatctcagggattgccgcggctcgtgtcctctccaattcctcttttgaggtgactgtccttgagtcgagagatcgaattggcggccgtgttcacacggattactcctttggatgccccattgacatgggagcctcatggctgcacggcgtcagtaatgagaattctttagcaccactgataggccatcttgggctgagattataccacaccagtggcgacaactctgttctgtatgaccatgatttggaaagctgttcgctctttgataagaatggccttgctgtcccaatggagacagctgctaaagttggcgtgatatttgagaaaattctcaaggagacggtcaagctccgtgacgagcaggaacatgacatgccccttgagcaggcgatttcgatggtgcttgagaggcaccctgatctcaagctagaagggctagatgatcgaatcctgcaatggtgtgtctgccggctagaggcatggtttgctgcagatgcagatgaaatctctctgaagaactgggatcaggaacatgttctcactggtggccatggcctgatggttgatggataccttcctgtaattcaggctctcgctcaaggtcttgacatccgtctgaatcagagagtaaagaaaattgcacgccagaacaagggagtgacggtcaccatcgaggacggcacacaatactcggccgacgcctgcataatcactgtgccgcttggtgtgctgaaggcgaacataatcaagttcgagcccgagctgccatcctggaagagctcggccatctccgaccttggtgtcggcatagaaaacaaagtcgccatgcacttcgacaaggccttctggcctaatgtacaggtgctgggcatggtcggccctacgccgaagacctgcggttacttcctgaacctccacaaggccaccggccacccagtgctggtcttcatggcagccggtcggttcgcccaggatgtggagaagctctcagacaaggaggccgtggaacttgtcatgtgtcacctgaggaagatgatacccgacgccactgaaccgaacaagtacctggtgtcacggtgggggtctgacccgaactcgctggggtcctactcgtgcgacctggtggggaagccgtcggacgtgtgcgagaggttctcggcgccggtggagagcatgctgtactttgccggagaggcagccagcgcggagcactcaggcgcggtgcacggcgcgtactcgtcaggcatggacgccgcagaggagtgccggaggaggctgctgatgagcaagggcgttccggacctcgtccaggtcggcgccgcggcgtgcgaggagatggcagacgtcgtcgcccctctccagatttgccgcacctagagatgattcttcgatacagctgctgcgttctgccatgcccgactgatttgatgatggacagaagccgatcaatgtgcagtcgatcagtccgagtcggcagaacgcaagattgaattcagattttttttcttcacatcttctattttctcgtgttgcttgggatcaagaaacatttgatcgatgcctgtgctgatgtgcactctggacacttgatttatagcgttaacaatttgttacgtccaatcaat

SEQ ID NO: 3211 - DNA, 2269 bp, Triticum aestivum
acgcaacacaatcctcggatcaattccgacttctccatccgccgcccgccggaagaaagaaagcatctttgcttctcgccgccgccggtgagggagggagggaggaaagaaggaaggaagcaggggatccgactcggtgttgccggtttggagccagtgtaatgagctgcctcacgttccgccgctccgccgccgacgcaagccgcctccaggacggcctcctcgtcttcatgttcttcatctcgattcccatacgtagtctgaataatagtcgtactcgtagtaattccagtattattagtagtagcaccagcaatcttctcttgtaaacaaacgtacgccgctcgtgctcgcggttgcgttcgcgcggacggaggggccttctcctgccgctgctccgtctgaatcttcgtcttcttcttctcgtcgggcgacggtcgcgccggcggccatggatcccaacagcttcaaaaccggaggccttctgcttccaaccatcgagaggcggtgcgcttcgcctccatctgtcatcgtgatcgggggcggaatctcagggatcgccgcggctcgtgtcctctccaattcctcttttgaggtgactgtccttgagtcgagagatcgaattggtggccgtgtccacacggattactcctttggatgccccattgacatgggagcctcatggttgcacggtgtcagtaatgagaattctttagcaccactgataggccatcttgggctgagattatatcacaccagtggtgacaactctgttctgtatgaccatgatttggaaagctgttcgctctttgataagaacggccttgcagtcccaatggagacagctgctaaagttggcgtgatatttgagaaaattctcaaggagacggtgaaactccgtgacgagcaggaacacgacatgccccttgaacaggcaatctcaatggttcttgagaggcaccctgatctcaagctagaagggctagatgatcgaatccttcaatggtgcgtctgccggctggaggcatggtttgctgcagatgcagatgaaatatctctgaaaaactgggatcaggaacatgttctcactggtggccatggtctgatggttgatggatacttacctgtaattcaggctctcgctcaaggtcttgacatccgtctgaatcagagagtaaagaaaattgcacgccagcagaagggagtgacagtcaccatcgaggatggcacacaatactcggccgacgcctgcataatcactgtgccgctcggtgtgctgaaggcgaacataatcaagttcgagcccgagctgccatcctggaagagctccgccatcgccgaccttggtgtcggcattgaaaacaaggttgccatgcacttcgacaaagccttctggccgaatgtgcaggtgctgggcatggtcggcccgacgcccaagacgtgcggctacttcctgaacctccacaaggccaccggccacccagtgcttgtcttcatggcagccggtcggttcgcccaggatgtggagaagctctcggacaaggaggctgtggaactcgtcatgtgtcacctgaggaagatgatacccgacgcaactgaacccaacaagtacctggtgtcgcggtgggggtcagacccgaactcgctggggtcctactcgtgcgacctggtggggaagccgtcggacgtgtgcgagaggttctcggcgccggtggagagcgtgttgtacttcgccggagaggcggccagcgcggagcactctggtgcggtgcacggcgcctactcatctgggatggaagctgcagaggaatgccggaggaggttgctgatgagtaagggcgttccagacctcgtccaggtcgctggcgccgcctgcgaggagatggccgacgtcgtcgcccctctccagatttgccgcacctagagatgattcttcttcgatacagctgcgttctgccatgcccgattggtttgatgattgacagaagccgatcaatgtgcagtcgatcagtccgagtcggcagaacgcaagattgaattcagattatttttgacattttctatttctcgtgttgcttggaatcaagaaaccttgtagggatgcccgagctgctgtgcactctggacactagatttatagtgttacctattgttatgctcgtcatcaatcaataaatataatacagttgatatttggggattaatgaatcttgtggtggttctttcattacaacatgaatagcaggcacgcatttctggttctggtcgg

SEQ ID NO: 3212 - DNA, 2234 bp, Hordeum vulgare
cgccacgcccaccttccccggaagccacgcaacacagatcctcggatcaattccgcccgccaaccggaagaagaaagatcaacctttgcttctcgccgccggcgccggtgaggaaggaaggaagcgggggatcccactcggtgttgccggtttggagccagggtgatgagctgcctcacgttccgccgctccgccgacgcaagccgcctccaggacggcctcctcgtcttcatgttcttcatctcgattcccatacgtagtctgaatctgaatagtaatcgtgctagtagcaattctagtacgtattattactagtagcaccagcagtctcctgtaaacgtacgctgctcgtgctcgcgctcgcgcggacggaggggtcttcctctgctgctgctccgtctgcatcttcgtcttctgcttcttctttccctcggtcgacggccgcgacggcggccatggatcccagcagcttcaaaaccggaggccttctgcttccaaccattgagagacggtgcgcttcgcctccatctgtcatcgtgatcggcggcggaatctcggggattgccgcggctcgtgtcctctccaactcctcttttgaggtgactgtccttgagtcgagagatcgaattggtggccgtgttcatacggattactccttcggatgccccatcgacatgggagcctcatggttgcacggtgtcagtaatgagaattctttagcaccattgatcggccatcttgggctgagattataccacacaagtggtgacaactctgttctgtatgaccatgatttggaaagctgttcgctctttgataagaacggccttgcagtcccaatggagacagctgctaaagttggcgtgatatttgagaaaattctcaaggagacagtaaaactccgtgatgagcaggaacacgacatgccccttgaacaggccatctcaatggtgcttgagaggcaccctgatctcaagctacaagggctagatgatcgaatcctgcaatggtgtgtctgccggctggaggcatggtttgctgcagatgcagacgaaatatctctgaaaaactgggatcaggaacatgttctcactggtggccatggtctgatggtggatggatactatcctgtaattcaggctctcgctcaaggtctcgacatccgtctgaatcagagagtaaagaaaattgcacaccagcaaaagggagtgacggtcaccatcgaggacggcacacaatactcggccgacgcctgcataatcactgtgccgcttggtgtgctgaaggcaaacataatcaagttcgagcccgagctgccatcctggaagagctctgccatcgccgaccttggcgtcggcatagagaacaaggttgccatgcacttcgacaaggccttctggcccaatgtccaggtgctgggcatggttggcccgacgccaaagacctgcggctacttcctgaacctccacaaggccaccgggcacccggtgcttgtcttcatggccgccggtcggtttgcccaggatgtggagaagctctcagacaaggaggccgttgaactcgtcatgtgtcacctgaggaagatgatacccaatgccactgaacccagtcaatacctggtgtcacggtggggctcagacccgaactcgctggggtcctactcgtgcgacctggtggggaagccgtcggacgtctgcgagaggttctcggcgcctgtggagagcgtgctgtacttcgccggagaggcggccagtgcggagcactcaggcgctgtgcatggtgcctactcgtctgggatggacgctgcagaggaatgccggaggaggttgctgatgaggaaaggcgtccccgaccttgtccaggtcggcgccgcctccgaggagatggccgacatcgtcgcccctctccagatttgccgcacctagagatgattcttggatacagctgcgtcctgccatgcccgattgatttgatgattgacaaagccaatcaatgtgcagtcaatcagtccgaatcggcagaacgcaggattgaattcaattttttttacagcttctattttcttgtcttgattgggatcaagaaacctttgattgcctgtgcttgtgcaccctggacacttgatttatagtgttacctatgttatgttatgttcagtgaatcaatttaatacaagtgacatttggggactgaatcttgtgtgattttttcattgtgggcatgaatcctgtatt

SEQ ID NO: 3213 - DNA, 2080 bp, Hordeum vulgare
aggaaggaaggaagcgggggatcccactcggtgttgccggtttggagccagggtgatgagctgcctcacgttccgccgctccgccgacgcaagccgcctccaggacggcctcctcgtcttcatgttcttcatctcgattcccatacgtagtctgaatctgaatagtaatcgtgctagtagcaattctagtacgtattattactagtagcaccagcagtctcctgtaaacgtacgctgctagtgctcgcgctcgcgcggacggaggggtcttcctctgctgctgctccgtctgcatcttcgtcttctgcttcttctttccctcggtcgacggccgcgacggcggccatggatcccagcagcttcaaaaccggaggccttctgcttccaaccattgagagacggtgcgcttcgcctccatctgtcatcgtgatcggcggcggaatctcggggattgccgcggctcgtgtcctctccaactcctcttttgaggtgactgtccttgagtcgagagatcgaattggtggccgtgttcatacggattactccttcggatgccccatcgacatgggagcctcatggttgcacggtgtcagtaatgagaattctttagcaccattgatcggccatcttgggctgagattataccacacaagtggtgacaactctgttctgtatgaccatgatttggaaagctgttcgctctttgataagaacggccttgcagtcccaatggagacagctgctaaagttggcgtgatatttgagaaaattctcaaggagacagtaaaactccgtgatgagcaggaacacgacatgccccttgaacaggccatctcaatggtgcttgagaggcaccctgatctcaagctacaagggctagatgatcgaatcctgcaatggtgtatctgccggctggaggcatggtttgctgcagatgcagacgaaatatctctgaaaaactgggatcaggaacatgttctcactggtggccatggtctgatggtggatggatactatcctgtaattcaggctctcgctcaaggtctcgacatccgtctgaatcagagagtaaagaaaattgcacaccagcaaaagggagtgacggtcaccatcgaggatggcacacaatactcggccgacgcctgcataatcactgtgccgcttggtgtgctgaaggcaaacataatcaagttcgagcccgagctgccatcctggaagagctctgccatcgccgaccttggcgtcggcatagagaacaaggttgccatgcacttcgacaaggccttctggcccaatgtccaggtgctgggcatggttggcccgacgccaaagacctgcggctacttcctgaacctccacaaggccaccgggcacccggtgcttgtcttcatggccgccggtcggtttgcccaggatgtggagaagctctcagacaaggaggccgttgaactcgtcatgtgtcacctgaggaagatgatacccaatgccactgaacccagtcaatacctggtgtcacggtggggctcagacccgaactcgctggggtcctactcgtgcgacctggtggggaagccgtcggacgtctgcgagaggttctcggcgcctgtggagagcgtgctgtacttcgccggagaggcggccagtgcggagcactcaggcgctgtgcatggtgcctactcgtctgggatggacgctgcagaggaatgccggaggaggttgctgatgaggaaaggcgtccccgaccttgtccaggtcggcgccgcctccgaggagatggccgacatcgtcgcccctctccagatttgccgcacctagagatgattcttggatacagctgcgtcctgccatgcccgattgatttgatgattgacaaagccaaacaatgtgcagtcaatcagtccgaatcggcagaacgcaggattgaattcaattttttttacagcttctattttcttgtcttgattgggatcaagaaacctttgattgcctgtgcttgtgcaccctggacacttgatttatagtgttacctatgttatgttatgttcagtgaatcaatttaatacaagtgacatttggggac

SEQ ID NO: 3214 - DNA, 1697 bp, Secale cereale
accgacgccgcccgtgctcgcggctgccgacgaggggtccgtcgttctgctcgctgctgctccgtctgcgtcttcctcctctcttctcgatcggcgacggccgcgacgcggccatggatcaacagctcaaaccggaggccttctgcttccaaccattgagaggcggtgcgcttcgcctccatctgtcatcgtgatcggcggcggaatctcagggattgccgcggctcgtgtcctctccaattcctctttcgaggtgactgtccttgagtcgagagatcgaattggtggccgtgtccacacggattactcctttggatgccccattgacatgggagcctcatggttgcacggtgtcagtaatgagaattctttagcaccactgataggccatcttgggctgagattatatcacacaagtggggacaactctgttctgtatgaccatgatttggaaagctgttcgctctttgataagaatggccttgcagtcccaatggagacagctgctaaagttggcgtgatattcgagaaaattctcaaggagacggtgaagctccgtgacgagcaggaacatgacatgccccttgaacaggcaatttcaatggtgcttgagaggcaccctgatctcaagctagaagggctagatgatcgaatcctgcaatggtgtgtctgccggctggaggcatggtttgctgcagatgcagatgaaatatctctgaagaactgggatcaggaacatgttctcactggtggccgatggcctgatggttgatggataccttcccgtaattcaggctctcgctcaaggtcttgacatccgtctgaatcagagagtaaagaaaattgcacgcgagcacaagggagtgacggtcaccatcgaggacggcacgcaatactcggccgacgcctgcataatcactgtgccgcttggtgtgctgaaggcgaacataatcaagttcgagcccgagctgccatcctggaagagctcggccatctccgaccttggtgtcggcatagaaaacaaagtcgccatgcacttcgacaaggccttctggccgaatgtccaagtgctgggtatggtcggcccgacgcccaagacgtgcggctacttcctgaacctccacaaggccaccggccacccggtgcttgtcttcatggcagccggtcggttcgcccaggatgtggagaagctctcggacaaggaggccgtggaactcgtcatgtgtcacctgaggaagatgatacccgacgccactgaacccaacaagtacctggtgtcacggtggggctcggacccgaactcgctggggtcctactcgtgcgacctggtggggaagccgtcggacgtgtgcgagaggttctcggcgccggtggagagcgtgctgtacttcgccggagaggcggccagcgctgagcactcgggcgctgtgcacggcgcgtactcgtcaggcatggacgccgcagaggaatgccggaggaggctgctgatgagcaagggcgttccggacctcgtccaggtcggcgccgcggcgtgcgaggagatggcagacgtcgtgcccctctccagatttgccgcacctagagatgattcttacatacagctgcgttctgccatgcccgattgatttgatgattgacagaagccgatcaatgtgcagtcagtcagtccgagtcggcagaacacaagattgaattct

SEQ ID NO: 3215 - DNA, 1787 bp, Leymus cinereus x Leymus triticoides
  misc_feature (963)..(963): n is a, c, g, or t
  misc_feature (1481)..(1481): n is a, c, g, or t
ctcttcgtcttcttctcgtcgggtgacggtcgcggtggcggctatggatcccaatagcttcaaaaccggaggccttttgcttccaaccattgagaggcggtgcgcttcgcctccatctgtcatcgtgattggcggcggaatctcagggattgccgcggcccgtgtcctctccaattcctcttttgaggtgactgtcctcgagtcgagagatcgtattggtggccgtgttcataccgactactcctttggatgccccattgacatgggagcctcatggttgcacggtgtcagtaatgagaattctttagcaccattgattggccatcttgggctgagattatatcacacaagtggcgacaactctgttctgtatgatcacgatttggaaagttgttcgctctttgataagaatggccttaaagtcccaatggagacagctgctaaagttggcgtgatattcgagaaaattcttaaggagacggtgaaactccgtgatgagcaggaacatgacatgccccttgaacaggcaatttcaatggtgcttgagaggcaccctgatctcaagctagaagggctagatgatcgaatcctgcaatggtgtgtctgccggctggaggcatggtttgctgcagatgcagatgaaatatctctgaaaaactgggatcaggaacatgttctcactggtggccatggtctgatggttgatggatactatcctgtaatccaggccctcgctcaaggtcttgacatccgtctgaatcagagagtaaagaaaatcgcccaccagtacaacagagtgatagtcaccattgaggacggcacgcaatactcggcggacgcctgcataatcactgtgccactcggtgtgctgaaggcaaatgtaatcaagttcgagcccgagctgccatcctggaagagctccgccattgccgaccttggtgtcggcatagaaaacaaggttgncatgcacttcgacaaggccttctggcccaatgtccaggtgctgggcatggtcggcccgacgccgaagacctgcggctacttcctgaacctccacaaggccaccggccacccggtgctcgtcttcatggctgcgggtcggttcgcccaggatgtggagaagctctcggacaaggaggccgtgaaactcgtcatgtgtcacctgaggaagatgatacccgacgccactgaacccaggcaatacctggtgtcgcggtgggggtctgacccgaactctctggggtcctactcttgcgacctggtgggcaagccgtcggacgtgtgcgagaggttctcggcgccggtggagagcgtgctgtacttcgccggagaggcggccagcgcggagcactctggcgcggtgcacggcgcctactcgtcgggtatggacgccgccgaggagtgccggaggaggctgttgatgcggaagggcgtcccggacctcgtccaggtcgctggtgcctgcgaagagatggccgacntcgtcgcccctctccagatttgccgcacttaggattctttgatacagctgtgttctgccatgcccgattgatttgatgattgacaaaggccgatcagtttagtcaaatcaatccgagttggcagaacgcaagattgaaattcagatttttttttacagcttctattttctcgtttcttgagatcaagaaacatttgatcgatgcctgtgcttctgtgcactctggacactggatttatagtgttgcctattgttatcttcaatcaatcaatcaataaattttagacaagtgacatttggggactga

SEQ ID NO: 3216 - DNA, 2148 bp, Avena sativa
aaaatcagatcacgccacacaccgcgacgccgccggagaagaaggaggcgcaaagcacaccctttgcctctcgccggctcgatcggatcgccgccgtcgcgacgaacaaatcgtcggcgaggaaggaaggatccaccctcgcgttgccggtttggagccagtcaaggttatgagctgcctcacgctccgccgctcctccgacgccagccgcctccaggacggcctccttgtcttcgtcttcttcatctcgattcccatacgtaatttgaataatcgtactagtagtaattgtagtagtaccaccagtctcctgtaaaccgcgctcgtgctcgctgccgcgtgtgcgcggacggaggggtcctcttctgccgcttctctgtctgcgtattctccatcttcgtctcgttcgtcgacggccgcggcggcggctatggatcccaacagcttcaaaaccggaggccttttgcttccaacaattgagaggcggtgcgcttcgccgccatcggtcatcgtgatcggcggtggcatctcggggattgcggcagctcgtgtcctctccaattcctcctttgaggtgactgttctagagtcgagagatcgtatcggtggccgtgttcacaccgactactccttcgggtgccccatcgatatgggggcctcatggctgcatggcgtcagtaacgagaattcgttggcaccattgattggccatcttggcctgaggttgtatcacactagtggtgacaactctgttctgtatgaccatgatttagaaagttgttcgctgtttgataagaatggccttcaagtcccaatggagaccgctgctaaagttggtgaaatatttgagaaaattcttcaggagacggtgaaactccgtgatgagcaggaacatgacatgccccttcaacaggcgatttctatggtgcttgagaggcaccctgatctaaagctagaagggctagatgatcgagtcatgcaatggtgtgtctgccggctcgaggcatggtttgctgcagatgcagatgaaatatctctgaaaaactgggaccaggaacatgttcttacaggtggccatggtctgatggttgatggatactatcctgtaattcaggctcttgctcagggtcttgacatccgtctcaatcagagagtaaccaaaatcgcccgccaatacaacggagtgacagtcaccaccgaggacggcacgcaacactctgccgacgcctgcataatcacggtgccgctgggcgtgctcaaggcgaacataatcaagttcgagcccgagctacccacctggaagagctctgccatcgccgaccttggtgtcggcatagagaacaaggtggccatgcacttcgacaaggccttctggcccaacgtgcaggtgctgggtatggtcggcccgaccccgaagacgtgcggctacttcctgaacctccacaaggccaccggtaacccggtcctggtctacatggccgccggccggtttgcccaggaggtggagaaactttccgacaaggaggctgtggccctcgtcatggctcacctcaagaagatggtgccagaagccactgaacctacgcagtacctggtgtcgcggtggggctctgacccgaattctctggggtcatactcttgcgacctggtggggaagccggcggatgtgtgcgagaggttctcggcgccggtggatagcatgctgtatttcgccggagaggcggccagcgcggagcactcgggcgcggtgcacggcgcctactcgtcgggcatggatgccgccgaggagtgccggacgcggctgctgatgcggaagggcgtcccggatctagtccaggtcgctgccgcctgcgaggagatggccgacgtcgtcgcccctctccagatttgccgcacgtagaatgcgagatgcgacgaagcgaaggtttattctgccatgcccgattgatctgatgactgagtgactgacacaaagattgcaatttgtgcgatcgatcgatccgagtcggcagattgccagattgaaactatttactactagtacatttttcattttctttgtgttgctttggattttaaatcacgttcagcaattgagttgcatttggaaactgtatatttcttttatgaaaacgtaaaagccttgcg

SEQ ID NO: 3217 - DNA, 2169 bp, Avena sativa
aaaatcagatcacgccacacaccgcgacgccgccggagaagaaggaggcgcaaagcacaccctttgcctctcgccggctcgatcggatcgccgccgtcgcgacgaacaaatcgtcggcgaggaaggaaggatccaccctcgcgttgccggtttggagccagtcaaggttatgagctgcctcacgctccgccgctcctccgacgccagccgcctccaggacggcctccttgtcttcgtcttcttcatctcgattcccatacgtaatttgaataatcgtactagtagtaattgtagtagtaccaccagtctcctgtaaaccgcgctcgtgctcgctgccgcgtgtgcgcggacggaggggtcctcttctgccgcttctctgtctgcgtattctccatcttcgtctcgttcgtcgacggccgcggcggcggctatggatcccaacagcttcaaaaccggaggccttttgcttccaacaattgagaggcggtgcgcttcgccgccatcggtcatcgtgatcggcggtggcatctcggggattgcggcagctcgtgtcctctccaattcctcctttgaggtgactgttctagagtcgagagatcgtatcggtggccgtgttcacaccgactactccttcgggtgccccatcgatatgggggcctcatggctgcatggcgtcagtaacgagaattcgttggcaccattgattggccatcttggcctgaggttgtatcacactagtggtgacaactctgttctgtatgaccatgatttagaaagttgttcgctgtttgataagaatggccttcaagtcccaatggagaccgctgctaaagttggtgaaatatttgagaaaattcttcaggagacggtgaaactccgtgatgagcaggaacatgacatgccccttcaacaggcgatttctatggtgcttgagaggcaccctgatctaaagctagaagggctagatgatcgagtcatgcaatggtgtgtctgccggctcgaggcatggtttgctgcagatgcagatgaaatatctctgaaaaactgggaccaggaacatgttcttacaggtggccatggtctgatggttgatggatactatcctgtaattcaggctcttgctcagggtcttgacatccgtctcaatcagagagtaaccaaaatcgcccgccaatacaacggagtgacagtcaccaccgaggacggcacgcaacactctgccgacgcctgcataatcacggtgccgctgggcgtgctcaaggcgaacataatcaagttcgagcccgagctacccacctggaagagctctgccatcgccgaccttggtgtcggcatagagaacaaggtggccatgcacttcgacaaggccttctggcccaacgtgcaggtgctgggtatggtcggcccgaccccgaagacgtgcggctacttcctgaacctccacaaggccaccggtaacccggtcctggtctacatggccgccggccggtttgcccaggaggtggagaaactttccgacaaggaggctgtggccctcgtcatggctcacctcaagaagatggtgccagaagccactgaacctacgcagtacctggtgtcgcggtggggctctgacccgaattctctggggtcatactcttgcgacctggtggggaagccggcggatgtgtgcgagaggttctcggcgccggtggatagcatgctgtatttcgccggagaggcggccagcgcggagcactcgggcgcggtgcacggcgcctactcgtcgggcatggatgccgccgaggagtgccggacgcggctgctgatgcggaagggcgtcccggatctagtccaggtcgctgccgcctgcgaggagatggccgacgtagtcgcccctctccagatttgccgcacgtagaatgcgagatgcgacgaagcgaaggtttattctgccatgcccgattgatctgatgactgagtgactgacacaaagattgcaatttgtgcgatcgatcgatccgagtcggcagattgccagattgaaactatttactactagtacatttttcattttctttgtgttgctttggattttaaatcacgttcagcaattgagtggcatttggaaactgtatatttcttttatgaaaacgtaaaagccttgcgtcaaaagagcttccattcttt

SEQ ID NO: 3218 - DNA, 1760 bp, Secale cereale
tcgccgtcgtcgggaaggaatcccctggtgttgcctcgccgccgccgcagcagcagcgatctcatcgccgtcgtcgggaaggaatcccctggtgttgccggtttggagccagggtgatgagctgcctcacgttccgccgctccgccgccgacgccagccgcctccaggacggcctcctcgtcttcatgttcttcatctcgattcccatacgtagtctgaataacaatcgcattactactagtaattctagtattactagtagtaatctcctgtaaacgcacgccgctcgtgctcgcggctgccgacggaggggtcctcttctgctgctgctgctccgtctgcgtcttcctcctcttcttctcgatcggcgacggccgcgacggcggccatggattccaacagcttcaaaaccggaggccttctgcttccaaccattgagaggcggtgcgcttcgcctccatctgtcatcgtgatcggcggcggaatctcagggattgccgcggctcgtgtcctctccaattcctctttcgaggtgactgtccttgagtcgagagatcgaattggcggccgtgttcacacggattactcctttggatgccccattgacatgggagcctcatggctgcacggcgtcagtaatgagaattctttagcaccactgataggccatcttgggctgagattataccacaccagtggcgacaactctgttctgtatgaccatgatttggaaagctgttcgctctttgataagaatggccttgctgtcccaatggagacagctgctaaagttggcgtgatatttgagaaaattctcaaggagacggtcaagctccgtgacgagcaggaacatgacatgccccttgagcaggcgatttcgatggtgcttgagaggcaccctgatctcaagctagaagggctagatgatcgaatcctgcaatggtgtgtctgccggctagaggcatggtttgctgcagatgcagatgaaatctctctgaagaactgggatcaggaacatgttctcactggtggccatggcctgatggttgatggataccttcctgtaattcaggctctcgctcaaggtcttgacatccgtctgaatcagagagtaaagaaaattgcacgccagaacaagggagtgacggtcaccatcgaggacggcacacaatactcggccgacgcctgcataatcactgtgccgcttggtgtgctgaaggcgaacataatcaagttcgagcccgagctgccatcctggaagagctcggccatctccgaccttggtgtcggcatagaaaacaaagtcgccatgcacttcgacaaggccttctggcctaatgtacaggtgctgggcatggtcggccctacgccgaagacctgcggttacttcctgaacctccacaaggccaccggccacccagtgctggtcttcatggcagccggtcggttcgcccaggatgtggagaagctctcagacaaggaggccgtggaactcgtcatgtgtcacctgaggaagatgatacccgacgccactgaaccgaacaagtacctggtgtcacggtgggggtctgacccgaactcgctggggtcctactcgtgcgacctggtggggaagccgtcggacgtgtgcgagaggttctcggcgccggtggagagcatgctgtactttgccggagaggcagccagcgcggagcactcaggcgcggtgcacggcgcgtactcgtcaggcatggacgccgcagaggagtgccggaggaggc

SEQ ID NO: 3219 - DNA, 2195 bp, Brachypodium distachyon
agaatcccgcacgccaaacccgatccccaaatctgccgccggagaggaaaaaagaagcgaaatcccctctcgcatctgctcctcctcgtcgcgtggcggtgaggaaggaaggaagggatcggagaggacccctacggcgttgccggtttggagcccggacagggttatgagctgcctcaagcaccgccgctgctccgacgccagccgcctccaggacggcctcctcgtcttcgtcttcttcatatcgattcccatacgtagtgccagtaatcgttttctcagtaattccagtagtaattttagtattattagtagtacgagcgatctcttgtaaacggcgttcgtgctcgcggctgctgcgtgcgcgctgacggaggggttctcctctgttgttgcttctccgtctgcgtcttcttctccttgttcggcttcggcagcggcgtcaggggccgctatggatcccaatagcttcatgaccggaggccttttgcttccgaccattgagaggcgatgcgcttcgcctccatccgtcatcgtgatcggcgggggaatctctgggattgctgcagctcgtgtcctctccaattcttcttttgaggtgaccgttctggagtcgagagatcggattggaggtcgtgttcataccgactactcctttggatgccccattgatatgggggcctcatggctgcacggtgtcagtaatgaaaattcgttggcaccattgatcggccatcttggactgagattataccaaactagtggtgacaactctgttctctatgatcatgatttagaaagttgttcgctctttgataagaatggggttcaagtcccaagggaaacagctgctaaagttggaaaagtatttgagagaattcttgaggagacagtgaaactgcgtgacgagcaggaacatgacatgccccttcaacaggcaatttcaattgtgcttgagaggcacccccatctgaagctgcaagggcttgatgatcgagtcttgcaatggtgtgtttgccggctggaggcatggtttgctgcagatgcagatgaaatatctctgaaaaactgggatcaggagcatgttcttactggtggtcatggtctgatggtggatggatactatcctgtagttcaggctcttgctcgaggtcttgacatacgcctcaaccaaagagttaccaaagtttcccgccagcacaacagagtgacggtcaccatcgaggatggcacacaacactgtgcagacgcttgcataattacagtgccactcggtgtgctcaaagcgaacataatcaagtttgagcctgagctgcccctgtggaagagctctgccattgcggacctcggtgtgggcatagaaaacaaggtcgccatgcacttcgaccgggccttctggccgaacgtccaggtgctgggaatggttggcccgacgccgaaaacatgcggctacttcctgaacctccacaaggccactggcaaccctgtcctcgtctacatggctgcggggagattcgcccaagaggtggagaaactctcggacaaggaggccttggatatcgtcatgtcccacctgaagaaaatgataccagccgcacctgaacctacgcagtatctggtatctcgctggggctccgacccaaattccctggggtcctactcgtgcgacctggtcgggaagccggccgacgtgtgcgaaaggttctcagcccccgtggagaacctctactttgccggagaggcagccagcgcagagcactctggagctgtgcacggcgcctactcctcaggccttgccgctgccgaggattgccgcaagcggctcatgttgcagaagggcgtcccggacctcgtccaggtcgcggcgtgtgaggaggttgcctccgccgccgctgaggttgtcgcccctttccagatctgtggcacctaaattccattccaaaggagttgtctgttctgccatggccgattggctccatgctcgattgctcaggagattaattcagattctatatcttcccgatttctttctcttgtgtttgttagtacaattaaaattaaatgttgagatcgatgcgtgggtcgctgtactcaggtcactggattgtcctatttatctatcatttcctaataatgtaacagaaaacagatatttggggagtgaatgagttgttcgttgatcatcgtttttgttt

SEQ ID NO: 3220 - DNA, 2665 bp, Brachypodium distachyon
ccagaatcccgcacgccaaacccgatccccaaatctgccgccggagaggaaaaaagaagcgaaatcccctctcgcatctgctcctcctcgtcgcgtggcggtgaggaaggaaggaagggatcggagaggacccctacggcgttgccggtttggagcccggacagggttatgagctgcctcaagcaccgccgctgctccgacgccagccgcctccaggacggcctcctcgtcttcgtcttcttcatatcgattcccatacgtagtgccagtaatcgttttctcagtaattccagtagtaattttagtattattagtagtacgagcgatctcttgtaaacggcgttcgtgctcgcggctgctgcgtgcgcgctgacggaggggttctcctctgttgttgcttctccgtctgcgtcttcttctccttgttcggcttcggcagcggcgtcaggggccgctatggatcccaatagcttcatgaccggaggccttttgcttccgaccattgagaggcgatgcgcttcgcctccatccgtcatcgtgatcggcgggggaatctctgggattgctgcagctcgtgtcctctccaattcttcttttgaggtgaccgttctggagtcgagagatcggattggaggtcgtgttcataccgactactcctttggatgccccattgatatgggggcctcatggctgcacggtgtcagtaatgaaaattcgttggcaccattgatcggccatcttggactgagattataccaaactagtggtgacaactctgttctctatgatcatgatttagaaagttgttcgctctttgataagaatggggttcaagtcccaagggaaacagctgctaaagttggaaaagtatttgagagaattcttgaggagacagtgaaactgcgtgacgagcaggaacatgacatgccccttcaacaggcaatttcaattgtgcttgagaggcacccccatctgaagctgcaagggcttgatgatcgagtcttgcaatggtgtgtttgccggctggaggcatggtttgctgcagatgcagatgaaatatctctgaaaaactgggatcaggagcatgttcttactggtggtcatggtctgatggtggatggatactatcctgtagttcaggctcttgctcgaggtcttgacatacgcctcaaccaaagagttaccaaagtttcccgccagcacaacagagtgacggtcaccatcgaggatggcacacaacactgtgcagacgcttgcataattacagtgccactcggtgtgctcaaagcgaacataatcaagtttgagcctgagctgcccctgtggaagagctctgccattgcggacctcggtgtgggcatagaaaacaaggtcgccatgcacttcgaccgggccttctggccgaacgtccaggtgctgggaatggttggcccgacgccgaaaacatgcggctacttcctgaacctccacaaggccactggcaaccctgtcctcgtctacatggctgcggggagattcgcccaagaggtggagaaactctcggacaaggaggccttggatatcgtcatgtcccacctgaagaaaatgataccagccgcacctgaacctacgcagtatctggtatctcgctggggctccgacccaaattccctggggtcctactcgtgcgacctggtcgggaagccggccgacgtgtgcgaaaggttctcagcccccgtggagaacctctactttgccggagaggcagccagcgcagagcactctggagctgtgcacggcgcctactcctcaggccttgccgctgccgaggattgccgcaagcggctcatgttgcagaagggcgtcccggacctcgtccaggtcgcggcgtgtgaggaggttgcctccgccgccgctgaggttgtcgcccctttccagatctgtggcacctaaattccattccaaaggagttgtctgttctgccatggccgattggctccatgctcgattgctcaggagattaattcagattctatatcttcccgatttctttctcttgtgtttgttagtacaattaaaattaaatgttgagatcgatgcgtgggtcgctgtactcaggtcactggattgtcctatttatctatcatttcctaataatgtaacagaaaacagatatttggggagtgaatgagttgttcgttgatcatcgtttttgtttgactgtcattgcaacttgcaaaagggtggaggagaagtgcacggcagcgtttgtctgcctccttttttgaatgaagggggcatagtttgggtaggtggcaactgtgtccaagcctccaaggtcgatgatggcgacacaagggagggcatgtacaggtacagctgtgttgcgggatttccatgaggcaggagctagtttcttcagtagcatctccgggtaccggagattgttggtatcgggctgcttgagtgcactcctccaaacagggcatggcttagagtggcgttgttgttgtttttttaccgctgctgcacttcaggcaaggtgttctctgtgtgttagccagaagactaagtgtcctttccgatgcatacacgttctccattacccatgtcttgcggttgtaatccttgccatatatatgcttgtaacctgtactcgcaaactcaatcaatcacaatctactca

SEQ ID NO: 3221 - DNA, 2291 bp, Oryza sativa
tccttatatttggtcgcctcaaatcaacttcataccaaaccgaaccgaaggaccccacccaaaatcacacgcgccaaccagatcaaacccacctcgcaggagaagagaagcgatctacctctcctcgaggtggtggtgaggatttggagttgaattgtggggagggggacctcgcgggtgttgccggtttggagcccaagatagggttatgagctgcttcgcggaccgccgctgctacgccgccagccgccgccaggacggcctcctcgtgttcatgttcttcatctcgattcccatacgtactagtagcagtagtagtaataattgtaattccagtagtagtattagtagtaatctcctgtaagcggagttcctcctcgcggctgcgtgtacggggacgggaggaccttcttcctcttcgtgttcatcttcttcttcttcttcctctcttccttcggcttcggcgctggcggctatggatcccaatagcctcaaaactggaggcctcttgcttccgaccattgagaggcaatgtgcttcgcctccatccgtcatcgtgatcggtgggggaatttcaggggttgcagcagcccgtgctctctccaatgcttcgtttgaggtgactgttttggagtccagagatcgcgtaggcggtcgtgtccataccgattactctttcggatgcccaattgatatgggagcctcatggctccacggcgtttgtaatgagaactccttggcaccattgattggctatcttgggctgaaattatatcgcactagtggcgacaactctgttctgtatgatcatgatttagaaagttatgcactctttgataaggctggccatcaggtctcaaaggagacagttgctaaagttgaagaaacatttgaaagaattcttgatgagacagttaaagtgcgtgatgagcaggaacatgacatgccccttctacaggcgatttcacttgttcttgagaggcacccccatctgaagttacaagggatagatgatcaagtcttgcaatggtgtgtctgtcggcttgaggcatggtttgctgcagatgctgatgaaatatctctgaaaaactgggatcaggagcatgttcttaccggtggccatggtctgatggtgaacggatactatcctataattcaggctcttgcacaaggtctagatatccggcttaatcaaagggtaaccaaaattgcccgccaattcaatggagtgacagttaccactgaagatggaacaagttactctgccgatgcttgcatcattacagtaccgctcggtgtgctcaaggcaaacataatcaagttcgagcctgagttgccctcatggaagagctctgcaatcgcagaccttggtgtcggtatcgagaacaagatcgccatgcacttcgatacagtcttctggcctaatgttgaggtgctgggaatggttggcccaacgcctaaagcatgtgggtacttcctgaacctccacaaggccaccggcaatccggtcctcgtctacatggccgccggtagatttgctcaagaagtggaaaaactgtcagacaaggaggccgttgatctggtcatgtctcacctgaagaaaatgctacctgacgccactgaacctacgaagtatttggtttcacgctggggttctgacccgaactcgctgggttcctactcgtgcgacctggtcgggaagccggccgacgtgtcggcgcggttcgccgcaccggtggagaacctctacttcgccggcgaggcggccagcgccgaccactcggggtccgtccacggcgcctactcgtcggggatcgccgccgccgatgagtgccggaagcgcatcctgatgcagaagggcatccctgacctcgtccaggtcaaggcctacgaggagatggccggagtcattgctccccttcagatttgcaggacctgaaaaaactgaacctgctccaccctgccattgtcatggaatctggattgattcaattgccatgcctatgccctggaatcttgatgattcaatcactcatacaagttcaagttcatgtaggggattaactgcatgaatcaaaattattaattaataattatgtaattgtcatgttattattgaataaataaatcgagatcatgcttgagatctttgtactgggacacagtttcaattaattaatgctagtaacaaccttggagtgaatgaatgtgagtagttgggctggagttgcttgttcgtcttttgctgctgtgattgcaacctgcgagggagaagtgcacggctgtctcgt

SEQ ID NO: 3222 - DNA, 2172 bp, Oryza sativa
tcataccaaaccgaaccgaaggaccccacccaaaatcacacgcgccaaccagatcaaacccacctcgcaggagaagagaagcgatctacctctcctcgaggtggtggtgaggatttggagttgaattgtggggagggggacctcgcgggtgttgccggtttggagcccaagatagggttatgagctgcttcgcggaccgccgctgctacgccgccagccgccgccaggacggcctcctcgtgttcatgttcttcatctcgattcccatacgtactagtagcagtagtagtaataattgtaattccagtagtagtattagtagtaatctcctgtaagcggagttcctcctcgcggctgcgtgtacggggacgggaggaccttcttcctcttcgtgttcatcttcttcttcttcttcctctcttccttcggcttcggcgctggcggctatggatcccaatagcctcaaaactggaggcctcttgcttccgaccattgagaggcaatgtgcttcgcctccatccgtcatcgtgatcggtgggggaatttcaggggttgcagcagcccgtgctctctccaatgcttcgtttgaggtgactgttttggagtccagagatcgcgtaggcggtcgtgtccataccgattactctttcggatgcccaattgatatgggagcctcatggctccacggcgtttgtaatgagaactccttggcaccattgattggctatcttgggctgaaattatatcgcactagtggcgacaactctgttctgtatgatcatgatttagaaagttatgcactctttgataaggctggccatcaggtctcaaaggagacagttgctaaagttgaagaaacatttgaaagaattcttgatgagacagttaaagtgcgtgatgagcaggaacatgacatgccccttctacaggcgatttcacttgttcttgagaggcacccccatctgaagttacaagggatagatgatcaagtcttgcaatggtgtgtctgtcggcttgaggcatggtttgctgcagatgctgatgaaatatctctgaaaaactgggatcaggagcatgttcttaccggtggccatggtctgatggtgaacggatactatcctataattcaggctcttgcacaaggtctagatatccggcttaatcaaagggtaaccaaaattgcccgccaattcaatggagtgacagttaccactgaagatggaacaagttactctgccgatgcttgcatcattacagtaccgctcggtgtgctcaaggcaaacataatcaagttcgagcctgagttgccctcatggaagagctctgcaatcgcagaccttggtgtcggtatcgagaacaagatcgccatgcacttcgatacagtcttctggcctaatgttgaggtgctgggaatggttggcccaacgcctaaagcatgtgggtacttcctgaacctccacaaggccaccggcaatccggtcctcgtctacatggccgccggtagatttgctcaagaagtggaaaaactgtcagacaaggaggccgttgatctggtcatgtctcacctgaagaaaatgctacctgacgccactgaacctacgaagtatttggtttcacgctggggttctgacccgaactcgctgggttcctactcgtgcgacctggtcgggaagccggccgacgtgtcggcgcggttcgccgcaccggtggagaacctctacttcgccggcgaggcggccagcgccgaccactcggggtccgtccacggcgcctactcgtcggggatcgccgccgccgatgagtgccggaagcgcatcctgatgcagaagggcatccctgacctcgtccaggtcaaggcctacgaggagatggccggagtcattgctccccttcagatttgcaggacctgaaaaaactgaacctgctccaccctgccattgtcatggaatctggattgattcaattgccatgcctatgccctggaatcttgatgattcaatcactcatacaagttcaagttcatgtaggggattaactgcatgaatcaaaattattaattaataattatgtaattgtcatgttattattgaataaataaatcgagatcatgcttgagatctttgtactgggacacagtttcaattaattaatgctagtaacaaccttggagtg

SEQ ID NO: 3223 - DNA, 2165 bp, Sorghum bicolor
tctcatcgccttcaggcttcagctccatccatcatcatcaatcccagatcaggaccacccggcgaagaaaagagaaaaatatctcctctcttcccctctctctctgtctccaccggatcggttcgcttcgttgtgggaggagaggagagattgagagaccgtggtgcgcggaggggacgagattttgccggtttggagccagataggggtatgagctgcttcgcgcaccgccgctgctccgacgtcgcccgccgccaggacggcctcctcgtcttcgtcttcttcctctcgattcccatacctagtagtaattctaatttaagtagtagtaatctcttgtaaactgcgctcgcctttgcgtttgcgtgtacggggacggagggaccttctgtggttgcttcttcctctttcccacccttttcttctccttccacggcggcggcgccggcggcggcgggtatggaccccaatggcctcaaaactggaggccttttgctcccgaccattgagaggcggtgcacgtctcctccatccgtcattgtcatcggtggtggcatctctggcgttgcagctgcccgtgccctctccaattcttcatttaaggtgactgttttggagtcgagagatcgtattggcgggcgtgttcatactgattactcatttggatgcccaattgatatgggagcctcatggctgcatggcgtgtgtaatgagaattcattggcgccattgattggctatcttgggctgaggttatatcgcacaagcgatgacaactcagttctgtatgatcatgatttagaaagctatgctctctttgataaggatggtaatcaggtcccaaaggagacagtcgataaagttggagaaacttttgagagaattcttgaagagacggtgaaagtgcgtgatgagcaggaacatgacatgccacttctacaggcgatttctattgtgtttgagaggcacccccatctaaagctagaagggctagatgatcaggtcttgcaatggtgtgtctgccggcttgaggcatggtttgctgcagatgcagatgaaatatctctgaagaactgggatcaggagcgtgttcttactggtggacatggactaatggtgaatggatactatcctgttattgaagctcttgctcaaggtcttgacatcaggcttaaccaaagggttaccgaaattacccgccaatacaatggagtcaaggtcactactgaagatggcacaagctacttcgctgacgcttgcataatctccgtgccacttggtgtgctcaaggcgaacgtaataaaatttgaacctgagctgccctcatggaagagctctgccattgcggacctcggcgtcggcgtcgagaacaagatcgctatgcactttgacagagtcttctggcccaacgttgaggtgctgggaatggttgggccgacgcctaaagcctgtgggtacttcctgaacctgcacaaagcgaccggcaatccggtcctcgtctacatggctgccggaaggtttgcccaggaagtggagaaattgtcggataaggaagccgtcagcttggtcgtttctcacctgaagaagatgcttccagatgcctctgaaccaacgcagtacctggtgtcacgctggggctccgacccgaactctctggggtcctactcctgcgacctggtcggaaagccggccgacgtgtgcgcgaggttctccgcccccgtggataacctgtacttcgccggcgaggcggccagcgccgagcactcggggtcggtgcacggcgcctactcgtcgggcattgccgcagccgaagaatgcaggaagcgcctactgacgctgaagggcatcccggacctggtccaggtcgcggcatgggaggagatggccggagctgtggctcccctgcagatttgcaggacctgactacctgagtgagctggatcagtgattcagtggctgccttggagtggtttgatgacgttgttgctgcttcctgacgatcgcgaaagtcctttatattgtgtaataatgttattatcttgaacgtgtgtattgtctggaataagtcaagatcgactgatactgaacttattacgttactccttcaaatacttaataataaattatgagtccttaattcaaagatatacactgtcctgatatat

SEQ ID NO: 3224 - DNA, 2252 bp, Sorghum bicolor
ctggcaaacgggcgaagcccaaaaacttaatggcatttgggcgaaacccactcttggcgctggcaaaacagccaatttctcgatcaggaccacccggcgaagaaaagagaaaaatatctcctctcttcccctctctctctgtctccaccggatcggttcgcttcgttgtgggaggagaggagagattgagagaccgtggtgcgcggaggggacgagattttgccggtttggagccagataggggtatgagctgcttcgcgcaccgccgctgctccgacgtcgcccgccgccaggacggcctcctcgtcttcgtcttcttcctctcgattcccatacctagtagtaattctaatttaagtagtagtaatctcttgtaaactgcgctcgcctttgcgtttgcgtgtacggggacggagggaccttctgtggttgcttcttcctctttcccacccttttcttctccttccacggcggcggcgccggcggcggcgggtatggaccccaatggcctcaaaactggaggccttttgctcccgaccattgagaggcggtgcacgtctcctccatccgtcattgtcatcggtggtggcatctctggcgttgcagctgcccgtgccctctccaattcttcatttaaggtgactgttttggagtcgagagatcgtattggcgggcgtgttcatactgattactcatttggatgcccaattgatatgggagcctcatggctgcatggcgtgtgtaatgagaattcattggcgccattgattggctatcttgggctgaggttatatcgcacaagcgatgacaactcagttctgtatgatcatgatttagaaagctatgctctctttgataaggatggtaatcaggtcccaaaggagacagtcgataaagttggagaaacttttgagagaattcttgaagagacggtgaaagtgcgtgatgagcaggaacatgacatgccacttctacaggcgatttctattgtgtttgagaggcacccccatctaaagctagaagggctagatgatcaggtcttgcaatggtgtgtctgccggcttgaggcatggtttgctgcagatgcagatgaaatatctctgaagaactgggatcaggagcgtgttcttactggtggacatggactaatggtgaatggatactatcctgttattgaagctcttgctcaaggtcttgacatcaggcttaaccaaagggttaccgaaattacccgccaatacaatggagtcaaggtcactactgaagatggcacaagctacttcgctgacgcttgcataatctccgtgccacttggtgtgctcaaggcgaacgtaataaaatttgaacctgagctgccctcatggaagagctctgccattgcggacctcggcgtcggcgtcgagaacaagatcgctatgcactttgacagagtcttctggcccaacgttgaggtgctgggaatggttgggccgacgcctaaagcctgtgggtacttcctgaacctgcacaaagcgaccggcaatccggtcctcgtctacatggctgccggaaggtttgcccaggaagtggagaaattgtcggataaggaagccgtcagcttggtcgtttctcacctgaagaagatgcttccagatgcctctgaaccaacgcagtacctggtgtcacgctggggctccgacccgaactctctggggtcctactcctgcgacctggtcggaaagccggccgacgtgtgcgcgaggttctccgcccccgtggataacctgtacttcgccggcgaggcggccagcgccgagcactcggggtcggtgcacggcgcctactcgtcgggcattgccgcagccgaagaatgcaggaagcgcctactgacgctgaagggcatcccggacctggtccaggtcgcggcatgggaggagatggccggagctgtggctcccctgcagatttgcaggacctgactacctgagtgagctggatcagtgattcagtggctgccttggagtggtttgatgacgttgttgctgcttcctgacgatcgcgaaagtcctttatattgtgtaataatgttattatcttgaacgtgtgtattgtctggaataagtcaagatcgactgatactgaacttattacgttactccttcaaatacttaataataaattatgagtccttaattcaaagatatacactgtcctgatatattattagctaaagtatggttgtatgtatacgatggttgttcgttctgttatta

SEQ ID NO: 3225 - DNA, 2171 bp, Saccharum officinarum
catcatcatcatcatcatcacagatcaggaccacccgtcgaagaacagagagaaatatctcctctcttcctccctccaccgggtcggtttctcgcgcttcgttgtgggaggaagaccgtggtgcgcggaaggggccgagattttgccggtttggagccagataggggtatgagctgcttcgcgcaccgccgcttctccgacgtcgcccgccgccaggacggcctcctcgtcttcgtcttcttcctctcgattcccatacctagtagtaattccaatttaagtagtagtaattgtagtagtaatctcttgtaaactgcgctcgcctttgcgtttgcgtgtacgggggcggagggactttctgtggttgcttgttcctctttctcatcctattcttctccttccacggcggcgccggcggctggaatggatcccaatggcctcaaaactggaggccttttgctcccgactattgagaggcggggcacgtcgcctccatccgtcattgtcatcggtggtggcatctcgggcgttgcagctgcccgtaccctctccaattcttcattcaaggtgactgttttggagtcgagagatcgtattggtgggcgtgttcatactgattactcatttggatgcccaattgatatgggagcctcatggctgcacggtgtgtgtaatgagaactcactggcgccattgatcggctatcttgggctgaggttatatcgcacaagcgacgacaactcagttttgtatgatcatgatttagaaagctatgctctatttgataaggatggtaatcaggtcccaaaggagacagttgataaagttggagaaacattcgagagaattcttgaagagacggtgaaagtgcgtgatgagcaggaacatgacatgccacttctgcaggcaatttctatcgtgtttgagaggcacccccatctaaagctagaagggctagatgatcaggtcttgcaatggtgtgtctgccggcttgaggcatggtttgctgcagatgcagatgaaatatctctgaagaactgggatcaggagcgtgttcttaccggtggacatggactgatggtaaatggatactatcctgttattgaagctcttgctcaaggtcttgacatcaggcttaaccaaagggttactgaaatcacccggcaatacaacggagtcaaggtcactactgaagatggcacaagctactttgctgacgcttgcataatctccgtgccactcggtgtgctcaaggcgaacataataaagtttgagcctgaactgccctcatggaagacctctgccatcgcggaccttggtgtcggtgtcgagaacaagatcgctatgcactttgacaacgtcttctggcccaacgttgaggtgctgggaatggttggaccgatgcctaaagcctgtgggtacttcctgaacctgcacaaagccaccggcaatccggtcctcgtctacatggctgccggaaggtttgcccaggaagtggagaaactgtcagacaaggaagccgtcagcttggtcgtttctcacctgaagaagatgcttccagatgccactgaaccaacgcagtacttggtgtcacgctggggctccgacccgaactctctggggtcctactcgtgcgaccttgttgggaagccggccgacgtgtgcgcgaggttctccgcccccgtggagaacctgtacttcgccggcgaggcggccagcgccgagcactcggggtcggtgcacggcgcgtactcgtcgggcattgccgccgccgaagaatgcaggaagcgcctcctgacgctgaagggcatcccggacctggtccaggtcgcggcgtgggaggagatggccggagctgtggctcctctgcagatttgcaggacctgactacctgagtgagctccgatcagtgtgattcagtggctgccttggagtggtttgatcgcttcgctgcttgctgacgactgcgaagtcttttatattgtgtaaaatgtcatattatcttgaacgtgtgtattgtctggaataagtcaagatcgactggtattgaagtcaagtgttattacgttactctttcatacttaagaaattattatgagtccttaattcaaagatattgtcctgatatatctagttaaaaatttgagtcctattccaaaattatattagct

SEQ ID NO: 3226 - DNA, 2245 bp, Panicum virgatum
gactgcaaacaaaaccaaagccaccctggtccgcaaagcgtagccgcaaaactccatcccataatccacacgcacgccatccagatcagagccaccggccagaggagaacaaaaatatcttctcctctcgtccctccatcggatcggttccccgactcctcctgccgccgatcgatcgagagggcgaccgcggcgtgtgcggggcacgagattttgccggtttggagccagagaggggtatgagctgtttggcgcaccgccgctgctccgacgccgcccgccgccaggacggcctcctcgtcttcgtcttcttcctctcgattcccatacgtagtattagtaattccaatttaagtagtagtaatagtagtagtaatctcttgtaaactgcgctcgccctcgcggttgcgagtacggggacggagggaccttctgttgcttgttcctctttctcctctctcttcctctgcggcattggcagcggtggttatggatcccaatggcctcaaaactggaggccttttgctcccaaccattgaaaggcggtgcacatcgcctccatcagtcatcgtgatcggcggtggcatctctggcgtggcagctgctcgtgctctctccaattcttcatttaaggtgactgttctggagtccagagatcgtattggtggacgtgttcatactgattactcatttggatgcccaattgatatgggagcctcatggctgcacggtgtatgcagtgagaattcactggcaccattgatcggctatctcgggctcaggttatatcgcaccagcaatgacaactctgttctgtatgatcatgatttagaaagctatgctctctttgataaggatggcaatcaggtcccaaaggatacagttgataaagttggagaaacatttgaaagaatccttgaagagacggtgaaagtgcgtgatgagcaggaacatgacatgccccttctacaggctatttctattgtgtttgagaggcacccccatctaaagctggaagggctagatgatcaggtcctgcaatggtgtgtctgccggctcgaggcatggtttgctgcagatgcagatgaaatatctctcaaaaactgggatcaggagcgtgttcttactggtggtcatgggctgatggtaaatgggtattatcctgttattgaggcttttgctcgaggtcttgacatcaggcttaatcaaagggtcaccaaaatttcccggcaatacaatggagttaaggtcactactgaagacggcacgaattattttgctgactcttgcataatcactgtgccgctcggtgtgctcaaggcaaacataatcaagttcgagcctgaactgcccccatggaagagctccgcgatcgcggacctcggtgttggcatcgagaacaagatcgccatgcacttcgacagagtcttctggcccaacgttgaggtgctgggaatggttggaccgactcctaaagcttgtggatacttcctgaacctccacaaggccactggcaatccggtcctcgtgtacatggctgctggaaggttcgcccaggaagtggagaaactgttggacaaggaagctgtcgatctggtcgtttctcacctgaagaagatgcttccagatgctactgaacctacgcagtacttggtgtcacgctggggctctgacccgaactctctggggtcctattcgtgcgacctggtcgggaagccggccgacgtgtgcgcgaggttctccgcccccgtggagaacctgtacttcgccggtgaggcggccagcgccgagcactcggggtccgtgcacggcgcgtactcgtcgggcctcgccgccgccgaagaatgtaggaagcgcctcctgacgcagaagggcgtcccagacctcgtccaggtcgcggcttgggaggaggtggccggagttgtggctcccctgcagatttgcaggacctgagcttggggcagctgcgtggccgtttgatcttaatttcagctgcttcgacagtgttatgtgagaagaacaggatagaatagaataaatcgaaagcaaacaagccgaatgggataaagaagccatgaactttcccagtcgtcgcgactcctattattatgtcgtaatatgtgtatcgtaaactcgttactgtcttgatagtaaataagtggagatcaagtgctgatctacagcggtcgaacactgactgaactcttataatggtataataaaaaaaattgagacatgtctggtg

SEQ ID NO: 3227 - DNA, 2210 bp, Setaria italica
gcctttaacttcaaaccaaaccaagagcaaagcgtcgccgcaaacactccatcccgtaaaacacacacgcgccatccagctcaatcaaagccaccgcccaccgaccggagaagggaggaaaaaaatatcttctcttctctccatcggatcgggatccttgactcctcgtgctgccgatcgattgatcgagagggggagatcgtggtgtgtggggggtgacgagattttgccggtttggagccaattaggggtatgagctgttttgcgcaccgccgctgctccgacgccgcccgccgccaggacggcctcctcgtcttcgtcttcttcctctcgattcccatacgtagtattagtaatagtagtaattctaatttaagtagtagtaatctcttgtaaactgcgatcctgttcgcggtttcgtgtacgggcacggagggactttctgttgttgcttgttcctctttccccactcctccttcctcctccttggcggcagcggcagcggcggttatggatcccaatggcctcaaaactggaggccttttgctcccaactattgagaggcggtgcacgacgcctccatccgtcatcgtgatcggcggtggcatctcgggcgttgcagctgctcgtgctctctccaactcttcatttaaggtgactgttctggagtccagagatcgtattggtggacgtgttcatactgattactcatttggatgcccaattgatatgggagcatcatggctgcacggtgtgtgcaatgagaattcactggctccattgatcggatatcttgggctgaggttataccgcaccagcgatgacaactctgttctgtatgatcatgatttagaaagctatgctctctttgataaggatggcaatcaggtcccaaaggagacagttgataaagtaggagaaacatttgaaagaattcttgaagagacggtgaaagtgcgtgatgagcaggaacatgacatgccccttctacaagcaatttccattgtgtttgagaggttccccgagttaaagctagaagggctagaagatcaggtcttgcaatggtgtgtctgccggcttgaggcatggtttgctgcagatgcagatgaaatatccctgaaaaactgggatcaggagcgtgttcttactggtgggcatggactgatggtaaatggatactatcctgttattgaggctcttgctcaaggtcttgacatcaggcttaatcaaagggtcaccaaaattacccggcaatacaatggagttaaggtcactactgaagacggtacgaactacttcgccgacgcttgcataatcacagtgccactcggtgtgctcaaggcgaacataatcaagttcgagcctgaactgcccccatggaagagctctgccatcgcggacctcggtgttggcattgagaacaagatcgccatgcacttcgacagagtcttctggcccaacgtcgaggtgctgggaataactggtccgacgcctaaagcatgtggatacttcctgaacctccacaaggccaccggcaatccggtcctcgtgtacatggctgctggaaggttcgcccaggaagtggagaaactgtccgacaaggaagccgtcgatctggtcgtttctcacctgaagaagatgcttccagatgctactgaacctacgcagtacttggtgtcacgctggggctctgacccgaactctctggggtcctattcgtgcgacctggtcgggaagccggccgacgtctgcgtgaggttctccgctcccgtggagaacctgtacttcgccggtgaggcggccagtgccgaccactcggggtccgtgcacggcgcgtactcgtcgggcctcgccgccgcagaagattgtaggaagcgcctcctgacgctgaagggcgtcccggacctagtacaggtcgcggcgtgggaggaggtggccggagctgtggctcccctgcagatttgcaggacctgagcttggaacatctgcgtctgcgcccgctatgctgtgaaagaatgcggggaagaagccgtatactttttcctagtcggcgcgtgcagatgattgcccagtcttatattattattatgtcgtaataaaaattgtattatcgtaaacgtgttactgtcttgattggaataagttgagcactcggacactgaaactctctatcaaaatcgagtcctatgttatattcaccgtttgctgag

SEQ ID NO: 3228 - DNA, 2238 bp, Pennisetum glaucum
gcctttttaacttgaaacccaaacccaacagccaagaccaaaagcgtagccgcaaaaactccatcccattaaacgcgcacgcctgccatccagatcaaaggctcaccaccgcccacctacctacctataccggagaagagacgggaaaaatatcttcgccccccccccatcggatcggatcctcgatttctcctcctgctgccgatcttcgatcgaacgcgagggggaggtgcgcgtgcgtggggggacgagatcttgccggtttggagccagctaggggtatgagctgtttcgcgcaccgccgctgctccgacgccgcccgccgccaggacggcctcctcgtcttcgtcttcttcctctcgattcccatacgtagtactagtaataatagtggtgattctaatttaagtagtagcgatctcttgtaaactgcggtcgtgttcttcgcggtctcgcgctctttctgtttggcgcttgctcctctttcccccactccctctctcctcctcttcttcttcttcctcctccttggcggcagcggcagcggcggttatggatcccaatggcctcaaaacaggaggccttctgctcccaaccattgagaggcggtgcacgtcacctccatccgtcgtcgtgatcggcggtggcatctcaggcgttgcagctgctcgtgctctctccaactcgtcatttaatgtgaccgttctggagtccagggatcggattggtggacgtgttcatacggattactcattcggatgcccaattgatatgggagcatcatggctgcacggtgtgtgcaacgagaattcactggcaccattgattggatatcttgggctgaggttataccgcaccagcgatgacaactctgttctatatgatcatgatttagaaagctatgctctctttgataaggatggcaatcaggtcccaaaggagacagtcgataaagtcggagaagtatttggaagaattcttgaggagacggtgaaagtgcgtgatgagcaggaacatgacatgccccttctacaagcaatttccattgtgttcgagaggcaccccgagttaaagctagaagggctatatgatcaggtcttgcaatggtgtgtctgccggcttgaggcatggtttgccgcagatgcagatgaaatatccctgaaaaattgggatcaggagcatgttcttactgggggccatggactgatggtaaatggatactatcctgttattgaggctctagctcaaggtcttgacatcaggcttaatcaaagggtcaccaaaattaaccggcaacacaatggagttaaggtcactactgaagatggcacgaactacttcgccgacgcttgcataatcacagtgccactcggtgtgctcaaggcgaacataatcaagttcgagcctgaactgcccccatggaagagttctgccattgcagacctaggtgttggcattgagaacaagatcgccatgcacttcgacagcgtgttctggcccaacgttgaggtgctgggcataactggcccgacaccgaaagcttgtggatacttcctgaacctccacaaggctaccggcaatccagtcctcgtgtacatggctgctggaaggttcgcccaggaagtggagaaactgtcggacaaagaagccgttgatctggttgtttctcacctgaagaagatgcttccagatgctaccgaacctacgaagttcttggtgtcacgctggggatctgaccccaactctctggggtcctattcgtgcgacctggtcgggaagccggccgacgtctgcgcgaggttctccgcccccgtggagaacctctacttcgccggtgaggcggccagcgccgaccactcggggtccgtgcacggcgcgtactcgtcgggcctcgccgccgcagaagattgcaggaagcgtctcctgacgctgaagggcatcccggaccttgtacaggtcgcggcgtgggaggagctcgccggagtcgtggctcccctgcagatttgcaggacctgagctttgaattgctgcgcccgatatgccgcgcggatttgatttcaccacttcggcactacctcacctcagaacgcggcgaaggcgtgaaatttcctagtcggtgcgcgtgaaggattgcaattgtaaaaaaaaaaaaactcatgacacattttacgatgatactctaaagtgttaccgtttggaataagtcgagcactctggcactgaaactctatcaaaatc

SEQ ID NO: 3229 - DNA, 2227 bp, Setaria italica
caagagcaaagcgtcgccgcaaacactccatcccgtaaaacacacacgcgccatccagctcaatcaaagccaccgcccaccgaccggagaagggaggaaaaaaatatcttctcttctctccatcggatcgggatccttgactcctcgtgctgccgatcgattgatcgagagggggagatcgtggtgtgtggggggtgacgagattttgccggtttggagccaattaggggtatgagctgttttgcgcaccgccgctgctccgacgccgcccgccgccaggacggcctcctcgtcttcgtcttcttcctctcgattcccatacgtagtattagtaatagtagtaattctaatttaagtagtagtaatctcttgtaaactgcgatcctgttcgcggtttcgtgtacgggcacggagggactttctgttgttgcttgttcctctttccccactcctccttcctcctccttggcggcagcggcagcggcggttatggatcccaatggcctcaaaactggaggccttttgctcccaactattgagaggcggtgcacgacgcctccatccgtcatcgtgatcggcggtggcatctcgggcgttgcagctgctcgtgctctctccaactcttcatttaaggtgactgttctggagtccagagatcgtattggtggacgtgttcatactgattactcatttggatgcccaattgatatgggagcatcatggctgcacggtgtgtgcaatgagaattcactggctccattgatcggatatcttgggctgaggttataccgcaccagcgatgacaactctgttctgtatgatcatgatttagaaagctatgctctctttgataaggatggcaatcaggtcccaaaggagacagttgataaagtaggagaaacatttgaaagaattcttgaagagacggtgaaagtgcgtgatgagcaggaacatgacatgccccttctacaagcaatttccattgtgtttgagaggttccccgagttaaagctagaagggctagaagatcaggtcttgcaatggtgtgtctgccggcttgaggcatggtttgctgcagatgcagatgaaatatccctgaaaaactgggatcaggagcgtgttcttactggtgggcatggactgatggtaaatggatactatcctgttattgaggctcttgctcaaggtcttgacatcaggcttaatcaaagggtcaccaaaattacccggcaatacattaaggtcactactgaagacggtacgaactacttcgccgacgcttgcataatcacagtgccactcggtgtgctcaaggcgaacataatcaagttcgagcctgaactgcccccatggaagagctctgccatcgcggacctcggtgttggcattgagaacaagatcgccatgcacttcgacagagtcttctggcccaacgtcgaggtgctgggaataactggtccgacgcctaaagcatgtggatacttcctgaacctccacaaggccaccggcaatccggtcctcgtgtacatggctgctggaaggttcgcccaggaagtggagaaactgtccgacaaggaagccgtcgatctggtcgtttctcacctgaagaagatgcttccagatgctactgaacctacgcagtacttggtgtcacgctggggctctgacccgaactctctggggtcctattcgtgcgacctggtcgggaagccggccgacgtctgcgtgaggttctccgctcccgtggagaacctgtacttcgccggtgaggcggccagtgccgaccactcggggtccgtgcacggcgcgtactcgtcgggcctcgccgccgcagaagattgtaggaagcgcctcctgacgctgaagggcgtcccggacctagtacaggtcgcggcgtgggaggaggtggccggagctgtggctcccctgcagatttgcaggacctgagcttggaacatctgcgtctgcgcccgctatgctgtgaaagaatgcggggaagaagccgtatactttttcctagtcggcgcgtgcagatgattgccgagtcttatattattattatgtcgtaataaaaattgtattatcgtaaacgtgttactgtcttgattggaataagttgagcactcggacactgaaactctctatcaaaatcgagtcctatgttatattcaccgtttgctgagatgtgtgcttgattaagattggctagagcgagatgtgatattac

SEQ ID NO: 3230 - DNA, 2266 bp, Zea mays
tagaaaaaatatgaaatgcgtggatggaagcgaaatagaggcgctgggccgctggcacggagaaacaacgcagcgtaaggcgcgccagccgtggacgtgtacgtgtacccgtgtcgtgtctaaacggacttcctcatctccgcgtctatttaaggcccactcctcgcatcgcctttaactcccatcccagatcaggattagccgaccacccgccgaaggccagagagaaatatctcatcttctctccaccggatcggttcaatcgagagcgagggagaaagggaggtggtgcgtcgaggggggccgagattttgccggtttggagccagataggggtatgagctgcttcgcgcaccgccgccgctccgacgtcgcccgccgccaggacggcctcctcgtcttcgtcttcttcctctcgattcccatacgtaccagtagttttaatttaagtagtagtaattgtagtagcaatctcttgtaaactgcgctcgcctttgcgtgttcgtggtccttttgcgctttctcgtccctctttctctcaatctctccttattcttctccttccacggcgaagccggcggctggtatggatcccaatggcctcaaaactggaggccttttgctcccgaccatcgagaggcggtgcacgtcgcctccatccgtcattgtcatcggcggtggcatctcgggcgttgcagctgcccgtgccctctccaattcttcatttaaggtgactgttttggaatcgagagatcgtattggcgggcgcattcatactgataactcgtttggatgcccaattgatatgggagcctcatggctacacggcgtgtgcaatgagaatccactggcaccattgataagctatcttgggctgaggttataccgcacaagcgatgataactcagttctgtatgatcatgatttagaaagctatgctctctttgataaggatggtaatcaggtcccaaaggagacagtcgataaagttggagaaacattcgagagaattcttgaagagacggtgaaagtgcgcgatgagcaggaacacgacatgccactgctacaggcaatttctattgtgtttgagaggcacccccatctaaagcttgaagggctagatgatcaggtcttacaatggtgtgtctgccggcttgaggcatggtttgctgcagatgcagatgaaatatctctgaagaactgggatcaggagcgtgttcttactggtggacatggactgatggtaaatgggtactatcctgttattgaagctcttgctcaaggtcttgacatcaggcttaaccaaagggtcaccgaaattacccgccagcacaatggagtcaaggtcactactgaagatggcacaagctacttggccgacgcctgcataatctcagtgccactcggcgtgctcaaggcgaacgtaataaagttcgagcctgagctgccccagtggaagagctccgccatcgccgacctcggcgtgggcaccgagaacaagatcgccatgcacttcgacagggtcttttggcccaacgtcgaggtgctgggaatggtcgggccgacgcccaaagcctgtgggtacttcctgaacctgcacaaagccaccggcaatccggtcctcgtgtacatggccgccggaaggttcgcccaggaggtggagaagctgtcggacaaggaagccgtcggcctggtcgtttctcacctgaagaagatgctcccggatgccactgaaccgacgcagtacctggtgtcgcgatggggctccgaccccaactccctggggtcctactcgtgcgacctggtcgcgaagccggccgacgtgtgcgcgaggttcgccgcccccgtcgagaacctgcacttcgccggcgaggcggccagtgccgagcactcggggtccgtgcacggcgcctactcgtcgggcatcgccgctgccgaggaatgcaggaagcggctcctggcgctgaagggcatcccggacctggtccaggtcgcggcgtgggaggagatggccggagctgtggctcctctgcagatttgcaggacctgagtgagattggatcactggctgcctttggacattggagtggatcgtggatcgcttcgctgctccctgatggttgccgagtctttttttatatttaccttaccttgaaggccgttgtgtcttgtctggaataaatcaagattgactggcactgaaagtgtcatcgcgtcactctttcatacttattaataaatatcacaagtctgtcctgagatctca

SEQ ID NO: 3231 - DNA, 2272 bp, Cenchrus ciliaris
  misc_feature (26)..(26): n is a, c, g, or t
  misc_feature (1349)..(1349): n is a, c, g, or t
  misc_feature (1403)..(1403): n is a, c, g, or t
ccaaagagcaagcgtagccgcaaaanctccatcccattaaacacacgcgtgccatccagatcaaaggcgcccacctaccgaccggagaagggagggaaaaaaatatcttctcctctctcttctcctctctccatcggatcggatcctcgacttcttctgctgccgatcgattgatcgcgaggggggagatcgtcgtgcgtgtggggggacgagattttgccggtttggagccagtcaggggtatgagctgttttgcgcaccgccgctgctccgacgccgcccgccgccaggacggcctcctcgtcttcgtcttcttcctctcgattcccatacgtagcatgagtaattgtagtaattctaattctaatttaagtagtagtaatctcttgtaaactgtggtcgtgttcgcggtttcgtgtacgggcacggagggacttcctgctgttgcttgttcctctttccccactccttcttcctcctcgtccttccccttggcggcagcggcagcggcggttatggatcccaatggcctcaaaactggaggccttttgctcccaaccattgagaggcggtgcacgtcgcctccatccgtcatcgtgattggcggtggcatctcaggcgttgcagctgctcgtgctctctccaattcttcatttaaggtgactgttctggagtccagagatcgtattggtggacgtgttcatactgattactcatttggatgccctattgatatgggagcatcatggctgcatggtgtgtgcaatgagaattcactggcaccattgatcggatatcttgggctgaggttataccgcaccagcgatgacaactctgttctgtatgatcatgatctagaaagctatgctctctttgataaggatggcaatcaggtcccaaaggagacagttgataaagtaggagaaacatttgaaagaattcttgaagagacggtgaaagtgcgtgatgagcaggaacatgacatgccccttctacaagcaatttccattgtgtttgagaggcaccccgagttaaagctagaagggctatatgatcaggtcttgcaatggtgtgtctgccggcttgaggcatggtttgctgcagatgcagatgaaatatccttgaaaaattgggatcaggagcatgttcttactgggggccatggactgatggtaaatggatactatcctgttattgaggctcttgcgcgaggtcttgacatcaggcttaatcaaagggtcaccaaaattacccggcaatacaatggcgttaaggtcactaccgaagatggcatgaactacttcgcggatgcttgcataatcacagtgccacttggtgtgctcaaggcnaacataatcaagttcgagcctgaactgcccacatggaagagctctgccattgcngacctcggtgttggcattgagaacaagatcgccatgcacttcgacagagtgttctggcctaatgttgaggtgctgggcataactggcccgacgccgaaagcttgtggatacttcctgaacctccacaaggccaccggcaatccagtcctagtgtacatggcggctggaaggttcgcccaggaagtggagaaactgacggacaaggaagccgtcgatctggtcgtttctcacctgaagaagatgcttccagatgctactgaacctacgaagtacctggtgtcacgctggggatctgacccgaactctctggggtcatattcgtgcgacctggtcgggaagccagccgacgtctgcgcgaggttctctgcccccgtggagaacctctacttcgccggtgaggcggcgagcgccgatcactcggggtccgtgcacggcgcgtactcgtcgggcctcgccgccgcagaagattgcaggaagcgtctcctgacgctgaagggtatcccggaccttgtacaggtcgcggcgtgggaggagctcgccggagctatggtttccctgcagatttgcaggacctgagctttgaattgctgctgccgatctgccgcggatttgatttcatcacttgggtgctacctcacctcagaacgcggcgaaggcgtgaaatttcctagtcggcgcgcgcaaaggattgcacttatatcatgtcataaaagtatactcgtgacattttacgataatactcgtaaaagtgttgctgtctggaacaactaaataagtcgagcactcggacactgaaactcttcatcaaaatcaagtctgtgcttgtttaagaatttagaataaggaaaaacaaaggggtttgtacttca

SEQ ID NO: 3232 - DNA, 1700 bp, Secale cereale
acgtctccgcgacgacccgcacccgaccgatagcccccttctccgcggcccgcttcgccttctccggcgagcaaacccccacaccggtctcaccggcggccatgccggctacggactaccagggctcctcctcctcctcccactccccgttcgtctccttcggccgctcgctgctgtcccggagccgggacaccccggcgtcccccgccatgctcccgtcaggcggggaggccgaggccgaggcgttccagcggcacctggccgttagcctcgcgaagctgagggacggggaggatttcctctccgtcgcgtggatccggcggctcctcgaggcgttcctgctgtgccaggaggagtttcgcgcggtggtggccgacgcgcggcgccggggcggcggaggcgcgctggcggagaggctggtgggcgagtaccacgagcgcgcggtgaaggcgctcgacgtgtgcaacgccgcccgcgacggggttgaccaggtccggcgctgggggcggctcgccggcatcgcggcgtccgtgctgctgggacccggggagatccacgagggccagctccgccgcgcgaggaaggcgctgtccgacctctcgatcctcctcgtcgacgacgcggccgccgccgggggcgggggcggcgtcgcctccttcctcgcctcccaccgcaaccgctccttcggccgcgggagccgcgcgtccccgtctcgcgcgtcctccgcctcctcctcgtcgtcctcctcctcgcacttccgctcgctctcgtggagcgtctcccgcacgtggtcggcgtcgcggcagctgcaggccattgggtccggcctggccgcgccgcgcgcgcacgaggcgggcctcgctgcgcccgtgtacgcaatgggatgcctgctgcacctcgcctcgtgggcgctcgtcgcggccgtcccgtgcccggaccgcgccgcggcgctccaagcgcaccacctccccgccgcaccgccgcgcggggcattcgcgtgggcgccgccgctcctgacgctccaggaccggctcaccgaggagggaaagcgcaaggacaggcgcaattcctgcggcctcctcaaggaaatccacgcgctcgagaagtgcgcgcagaggctcgccgaggcgatcgacgcggcgcccatcccactcagcggagagagggaggccgcggtgcgggaggccgccgcggagctcgccgccgtgtgcagcgccatgaaggacggcctggagccgctggagaggcaggtccgggaggtgttccaccgcattgtgcgcagccgcatggagggcctcgactcgccgatgcccaacgccgccgactgaaccatcatcaagaatccgcattttggccgcgcgctgccgcggcggcgataggtagctcctctcctgtccgtggtttttgatcacccgtgatctgtctcgcagtcagtagtagtataagtttaaaatgtgtatcgttctgtaaaggaaaggggaaagggaaggaaccatctttctgcaaagatttattccttcttctcatgttttgatgctgcatttggtgtgtatcatcagatttttgttagtcgtctaagatatgtgtgcgcggctaattcttgagctacttgcgtctgtgagctctgcgatgtcgcttgctctgatcttagaatgtcaaaggaaagaagaaaataaaaaaaatactggagtgattagctt

SEQ ID NO: 3233 - DNA, 1893 bp, Hordeum vulgare
acacccatcaacaacaccgcacctcaccgcagcttcatcgcaaatccaaaacaaaacgcctccgccgacgacccgcacccgcgcccgatagcccccctcctccgcggcccgcttcgccttctccggcgagaaacccccacaccggtctcaccggcggccatgccggctacggactaccagggctcctcctcctcctcccactccccgttcgcctccttcggccgctcgctgctgtcccggacccgggacaccccggcgtcccccgccatgcttccgtccggcggggaggccgaggccgaggcgttccagcggcgcgtcgccgtcagcctcgcggagctgggggacggggaggggttcctctccgtcgcgtggatccggcggctcctcgaggcgttcctgctctgccaggaggagttccgggcggtggtggccgaggtgcggcgccgcggcggtggaggtgcgcaggcggagaggctggtgggcgagtaccacgagcgcgcggtgaaggccctcgacgtgtgcaacgccgcccgcgacggggttgaccaggtccggcgctggggtcggctcgccggcatcgcggcgtccgtgctgctcgcccccggggagatccacgagggccagctccgccgcgcgaggaaggcgctgtccgacctctcgatcctcctcgtcgacgacgcggccgccgccgggggcgggggcggcgtcgcctccttcctcgcctcccaccgcaaccgctccttcggccgcgggagccgcgcttccccgtctcgcgcgtcctccgcctcgtcctcttcctcctcctcctcgcacttccgctcgctctcgtggagcgtgtcccgcacctggtcggcgtcgcggcagctgcaggccatcgggtccggcctggcggcgccgcgcgcgcacgaggcgggcctcgccgctcctgtctacgcaatgggatgcctgctgcacctcgcttcgtgggcgctcgtcgcggccgtcccgtgcccagaccgcgtcgcggcgctccaggcgcaccacctccccgccgcgccgccacgcggggcattcgcgtgggcgccgccgctcctggcgctccaggaccggctcaccgaggaggggaagcgcaaggacaggcgcaattcctgcggcctcctcaaggaaatccacgcgcttgagaagtgcgcgcagaggctcgccgaggcgatcgacgcagcgcccatcccgctcaccggagagagggaggccgcggtgcgggaggccgccacggagctcgccgccgtgtgcagcgccatgaaggacggcctggagccgctggagaggcaggtccgggaggtgttccaccgcattgtgcgcagccgcatggagggcctcgactcgccgatgcccaacgccgccgactgaaccatccgtcatcaagaatccgcattttggccgcgcgctgcggcggtgataggtagctcctctcctgtccgtggtttctgatcacccgtgatctgtctcgcagtcagtagtagtagtataagtttacaatgtgtatcgtgctgtaaaggaaaggggaaagggaaggaaccatctttctgcaaagatttattccttcttctcatgttttgatgctgcatttggtgtgtgtatcatcagatttttgttagtcgtcgtctacgacatgtgtgcgcggctaattcttgagctgcttgcgtctgcgagatcgcttgctctgatgttagaatgtgtcacagaaagaaggaaaaagaagaagaaaattactggagtgaatagcttctgtgttgttcttgactctctatgatgtccacattctcatttttcgtgtcatctggaacattttcagtttgaacgttagcttaaggcattgtactctttgtacatagaaatgccgcacttaaaaatgtc

SEQ ID NO: 3234 - DNA, 2341 bp, Oryza sativa
ctcttcaagtattccactatagtaaaatgctcgtacctcattctatgcaaaagatgacaatatttcattttaactttgtaaggacccaggagtaattacaacccttttagagcccctcctaccaaaaccccctgagagagaaagctaaacaaaaactagaaacattctcagttccagaagaatatttgcacccacagaaagaaatcatttacaaaccaaagattaaacaaatccaaacaatcatgattagctaagaccacttccccctaaaccccaaaatatcattaaactaatcccctccctaatcacaatcccatacatatatacacccatccatccatccatccacacatcaccacctcaccatctccatccatctcacccgttaacccgctaagctctctctccaagatccgcttcggtttcctctccggcgatctcgccggcgaccatgccggcgaccgactaccagggctcctcctcgacccactcccacccgtcgcccttctcctcgttcggccgctccctcctctcgctccgccgcgacagccccgccgccgccgccggcgcgtccccggccatggcgtccggcgaggaggccgacctggaggcgttccagcggcacgtggcggcgcacctcgccgatctcaggggcggggaggacgagctcctgtccatcgagtggatccggcggctgctcgaggcgttcctgctgtgccaggaggagttccgggtggtggtggcgctggcgcgccgccgcggggcgctgtcggcggcggcggagaagatggtgggggatttctacgagcgcgcggtgaaggcgctcgacgtgtgcaacgccgcacgcgacggcgtcgaccaggtcaggcggtgggagcggctcgccggcatcgcggcgtccgtgctgctcgccccaggggagatccacgagggccagctccgccgcgcgcggaaggcgctctccgacctctcggtgctcctcatcgacgacgccgcggccgccgcgggtggcggcggcgtcgcctccttcctctcctcccaccgcaaccgctccttcggccgcgcccgcgcgtcgccctcccgctccgcgacgctcgcctcctcctcatcctcctcgtcgtcgtcctcctcctcctcccacttccgctcgctctcgtggagcgtctcccgcaactggtcggcggctaggcagctgcaggccatcgggtccggcctggcggcgccgcgcgcgcacgaggggggactcgtggcgccggtgtactccatgggctgcctgctccacctcgccgcgtgggccctcgtcgccgccgtgccgtgcccggaccgcgccgccgcgctccaggcgcaccacctccccgccgcgccgccgcgcgccgcgttcccatgggcgccgccgctgctcgcgctccaggagcgcctcaccgaggaggggaagcgcaaggacaggcgcaactcctgcggcctcctcaaggaaatccacgcgctggagaaatgcacgcagcggctcgccgaggcgatcgacgccgcacccgtcccgctctccggtgagcgcgaggccgaggtacgggaggccgccgccgagctggctgccgtgtgcgccgccatgagggccggccttgagcctctcgaaaggcaggtcagggaggtgttccaccgcattgttcgcagccgcatggaggggctcgattcgccgatgctcaacgccgattgaaacatggagaattcacatttgatcgcgcaatgtggtggtgataggtaatgccgatcgaaccgtcgagaatttggatttgatcgcgcaaatgtggtggttataggtagctctcctgttcttggtttttttcctcacttgtggtggtctagtagtaattataaaatgtgtgccgttctgtaaaggaaggggggaaaggaaaggaaccatctttatgtaaagatgattccttcttcccatgttttgatgctgcatttggtgtatatcatggcatttttgttagtcctccatgtgtgcgcggctaattctgggagtaacttatagttgaaaaatctgtgaggtcgctatgaaatgtggcctgttgtcgagaatgtcgacaaaaaaattaaacaagaaaaaaaaatctactgtggtttagttcgattgtgttgtgtcataattcatgtttggtcctgatatttggatggtttaatcaaaaggtcaaatcttgaaactatcatgcgtgcaaaattcagcaatgtttgacattatgaagtactgctgtagcggtgtagactttttccatcctttcagttctacatatggttctgtgaaatccttaatttggttttatattcaatatgggaatctttt

SEQ ID NO: 3235 - DNA, 1855 bp, Oryza sativa
acatcaccacctcaccatctccatccatctcacccgttaacccgctaagctctctctccaagatccgcttcggtttcctctccggcgatctcgccggcgaccatgccggcgaccgactaccagggctcctcctcgacccactcccacccgtcgcccttctcctcgttcggccgctccctcctctcgctccgccgcgacagccccgccgccgccgccggcgcgtccccggccatggcgtccggcgaggaggccgacctggaggcgttccagcggcacgtggcggcgcacctcgccgatctcaggggcggggaggacgagctcctgtccatcgagtggatccggcggctgctcgaggcgttcctgctgtgccaggaggagttccgggtggtggtggcgctggcgcgccgccgcggggcgctgtcggcggcggcggagaagatggtgggggatttctacgagcgcgcggtgaaggcgctcgacgtgtgcaacgccgcacgcgacggcgtcgaccaggtcaggcggtgggagcggctcgccggcatcgcggcgtccgtgctgctcgccccaggggagatccacgagggccagctccgccgcgcgcggaaggcgctctccgacctctcggtgctcctcatcgacgacgccgcggccgccgcgggtggcggcggcgtcgcctccttcctctcctcccaccgcaaccgctccttcggccgcgcccgcgcgtcgccctcccgctccgcgacgctcgcctcctcctcatcctcctcgtcgtcgtcctcctcctcctcccacttccgctcgctctcgtggagcgtctcccgcaactggtcggcggctaggcagctgcaggccatcgggtccggcctggcggcgccgcgcgcgcacgaggggggactcgtggcgccggtgtactccatgggctgcctgctccacctcgccgcgtgggccctcgtcgccgccgtgccgtgcccggaccgcgccgccgcgctccaggcgcaccacctccccgccgcgccgccgcgcgccgcgttcccatgggcgccgccgctgctcgcgctccaggagcgcctcaccgaggaggggaagcgcaaggacaggcgcaactcctgcggcctcctcaaggaaatccacgcgctggagaaatgcacgcagcggctcgccgaggcgatcgacgccgcacccgtcccgctctccggtgagcgcgaggccgaggtacgggaggccgccgccgagctggctgccgtgtgcgccgccatgagggccggccttgagcctctcgaaaggcaggtcagggaggtgttccaccgcattgttcgcagccgcatggaggggctcgattcgccgatgctcaacgccgattgaaacatggagaattcacatttgatcgcgcaatgtggtggtgataggtaatgccgatcgaaccgtcgagaatttggatttgatcgcgcaaatgtggtggttataggtagctctcctgttcttggtttttttcctcacttgtggtggtctagtagtaattataaaatgtgtgccgttctgtaaaggaaggggggaaaggaaaggaaccatctttatgtaaagatgattccttcttcccatgttttgatgctgcatttggtgtatatcatggcatttttgttagtcctccatgtgtgcgcggctaattctgggagtaacttatagttgaaaaatctgtgaggtcgctatgaaatgtggcctgttgtcgagaatgtcgacaaaaaaattaaacaagaaaaaaaaatctactgtggtttagttcgattgtgttgtgtcataattcatgtttggtcctgatatttggatggtttaatcaaaaggtcaaatcttgaaacta

SEQ ID NO: 3236 - DNA, 1366 bp, Secale cereale
ggggggggggggggggagtggcgcaacgacgggattctattcctcctacaatgaactaaaagtttccgaccgagggaccaaaccaaggaggaaccaaaaatcgcctcctggcgggcaacgaacggctggagatgctactaagtagtaagactatttagttttgggatggaagaagtagcttgacaaaacgtcttttatattatggtaagtttagggagtagacaacagtaagagggtacatagtttggtgtaactagcagtaggcgctgctggtccactgctctatgcacaaatacttcccagcctctgcggctccaatttgcaaaagctactcgagaattaacccaacccagtcggccttctcctaccaaccaagcagctccaaacaccaagaaatccacagaaaccgagatctctctctctccgggccgacggatcctgggttgttgtagctgggcaatggcgaccgacgcgatcctggagaccatcaagcctcgtcggagcccgtggctggaggacctcccggtgacgaatgggggcgcagcgaagggcggcaaggtcgacctgtccgggatgcgccggcgcgtgtcgtcgtccttgtcgctgagcctccagccgctgtccacatcgtcgtccgctgcgttccggcgcgcgcggtcaatgccgtcgatcaaggcgctggcggcggcgggcgcggtgcggcagtggtgggagtgggggctcgggtgggtgatgacccggaagccctccttcgcgcgtggtctcgagatgagcgacgacgaggccgccctgctcgggtgccactgccgcggcacgctccggcacgtcttctacaaggcgcgcgccgaggtgcgccgcctcctcggccgcgacggccgcccgctcggaggcgtcgccgcgcaggacttcaggtatgactccgtcagctacgcccagaacttcgacaacggcgacgtcgacgccagatgctagccgctgcgcctgcgcacgcgtggattcggacgccaccattcgtgtcaaaatggaaggtatacatggctcgatcgaccgatcattgcggcactaattgttgcatacgaactatcgcttcttggacgcagcaataaaccgaattgtttgtaagatgctagcagatatagcacgccgtgtatgtgtgtgtgttttgtctaaacgatcgcaggtgatccagcagcgggtggtgcgtgctgttcagggaccagttgtatatttcttccaactcttctttcttgtgtttttccgagtcttttcttggagatatccgtccctacaatgtaatcgagcccgtggatcaggaaggggatcctaagctgcaaaatgtacatgttgctgtaacacattgcaaaag

SEQ ID NO: 3237 - DNA, 962 bp, Pseudoroegneria spicata
  misc_feature (6)..(8): n is a, c, g, or t
gctgcnnnatggcgaccgacgcgatcctggagaccatcaagcctcggcggagcccgtggctggaggacctcccggtgacgaatgggggcgcagcgaagggcggcaaggtcgacctgtccgggatgcgccggcgcgtgtcgtcgtccttgtcactgagcctccagccgctgtcctcttcgtccgcggcgttccggcgcgcgcggtcgatgccgtcgatcaaggcgctggcggcggcgggagcggtgcggcggtggtgggagtgggggctcgggtgggtgatgacccggaagccctccttcgcgcgtggcctcgagatgagcgaggacgaggccgccctgctcgggtgccactgccgcggcacgctccggcacgtcttctacaaggcgcgcgccgaggtgcgccgcctcctcggccgcgacggcctcccgctcggaggcgtcgccgcgcaggacttcaggtacgactccgtcagctacgcccagaacttcgacaacggcgacgtcgacgccagatgctagctgctgcgcctgcgcacgcgtggattcggacgccgccattcgtgtcgaaagggaaggtatacatagctcgatcgacggatcactgcggcattaattgttgcatacgaactatatgcagcttcttggatcgcagcaataaaccgagttgtttgtaagatatactagcagcatatagcacggcgtgtgtgtgtgtgtgtgtgtgtgtgtgtgtgtgtgttttgtctgaacgatcgcagatgatccagcggtgagtgatgcgtactgttcagggaccagatgtatatttcctccactcttctttcttgtgtttttccgagtcttttcttggatacatccgtccctacaatgtaatcgagcccgtggatcaggatggggatctcgagctggcaaaatgtacatgttcctgtaacacattgcaaaagcaaatcaataagcatttctgga

SEQ ID NO: 3238 - DNA, 1263 bp, Hordeum vulgare
cagcgagttttttttctttttttttgactgtgaacaaagttgtaaaaagtacgtttttgtaggccgcagccagagggtacatagtttggtgtaactagcagtaggcgccagcctgctggtccacttctctatgcacaaatattcccgacctctgcggctccaatttgcaaaagctactcgagaattaacccaacccacccggcctcctcctaccaaccaagcagctccaagcctccaaacaccaagaaatccacagaaactgagatctctctctctgacccgacggatcccgggttgttgtagttgggcaatggcgaccgacgcgatcctggagaccatcaagcctcggcggagcccgtggctagaggacctcccggtgacgaatgggggcggaggcgcagcgaagggcgccaaggtcgacctgagcgggatgcgccggcgcgtgtcgtcgtccttgtcactgagcctccagccgctgtcctcgtcgtcgtccgcggcgttccggcgcgcgcggtcgatgccgtcgatcaaggcgctggcggcggcgggcgcggtgcggcagtggtgggagtgggggctcgggtgggtgatgacccggaagccctcgttcgcgcgtggcctcgagatgaacgacgaggaggccgccgtgctcggttgccactgccgcggcacgctccggcacgtcttctacaaggcgcgcgccgaggtgcgccgcctcctcggccgcgacggcctcccgctcggaggcgtcgccgcgcaggacttcaggtacgactccgtcagctacgcccagaacttcgacaacggcgacgtcgacgccagatgctagccgcttcgcctgatcacgcgtggattcggatgccgccattcgtgtcgaaaggggaggtatacatgggcacatggctcggtcgatcgatcgatcattgcggcattaattgttgcatacgaactatattcagcttcttgaacgcggcaataaaccgaattgtttgtaagatactggtagcatatagcacggcgtgtgtgtgtgtgtgtttcgtctcgacgatcgcagctgatccagcagcgagtgatgcgtactgttgagggaccagatgtatatttcttccactcttcgttcttgtgtttttccgagtcttttcttggatacatccgtccctaccctacaatgtaacagagcccgtggatcaggatggggatctcgagctggcaaaatgtacatgttcctgtaacacattgcaaaagcaaatcaataagcatttc

SEQ ID NO: 3239 - DNA, 1399 bp, Hordeum vulgare
ttgtgactgtgaacaaagttgtaaaaagtacgtttttgtaggccgcagccagagggtacatagtttggtgtaactagcagtaggcgccagcctgctggtccacttctctatgcacaaatattcccgacctctgcggctccaatttgcaaaagctactcgagaattaacccaacccacccggcctcctcctaccaaccaagcagctccaagcctccaaacaccaagaaatccacagaaactgagatctctctctctgacccgacggatcccgggttgttgtagttgggcaatggcgaccgacgcgatcctggagaccatcaagcctcggcggagcccgtggctagaggacctcccggtgacgaatgggggcggaggcgcagcgaagggcgccaaggtcgacctgagcgggatgcgccggcgcgtgtcgtcgtccttgtcactgagcctccagccgctgtcctcgtcgtcgtccgcggcgttccggcgcgcgcggtcgatgccgtcgatcaaggcgctggcggcggcgggcgcggtgcggcagtggtgggagtgggggctcgggtgggtgatgacccggaagccctcgttcgcgcgtggcctcgagatgaacgacgaggaggccgccgtgctcggttgccactgccgcggcacgctccggcacgtcttctacaaggcgcgcgccgaggtgcgccgcctcctcggccgcgacggcctcccgctcggaggcgtcgccgcgcaggacttcaggtacgactccgtcagctacgcccagaacttcgacaacggcgacgtcgacgccagatgctagccgcttcgcctgatcacgcgtggattcggatgccgccattcgtgtcgaaaggggaggtatacatgggcacatggctcggtcgatcgatcgatcattgcggcattaattgttgcatacgaactatattcagcttcttgaacgcggcaataaaccgaattgtttgtaagatactggtagcatatagcacggcgtgtgtgtgtgtgtgtttcgtctcgacgatcgcagctgatccagcagcgagtgatgcgtactgtcgagggaccagatgtatatttcttccactcttcgttcttgtgtttttccgagtcttttcttggatacatccgtccctaccctacaatgtaacagagcccgtggatcaggatggggatctcgagctggcaaaatgtacatgttcctgtaacacattgcaaaagcaaatcaataagcatttccggaacgtgaatcaagtactcagtcagacaaggagacaagcttgatgttctgtttttttttccttccctgtgagattcagatctggttcttgttctggttctggtttagggtccctttctttgcagctgtgcacggcgcgacgcgggagcaactgct

SEQ ID NO: 3240 - DNA, 2436 bp, Triticum aestivum
ccgcctctcgtctcgtctctcgtcccaatcccaccgcccggcacccccccggctccgtctcctccccgcacgcatcaccctctctcccctcgcccctggcccgagagaacccacacgcaaacccaacgaacacgcggcgccgcgttgagaaacccccgaggaacgatgaccccaggagcaggcccccattgcggcatggctgcggccgccggcgtctggcagctcgttggcgtcgccgtggccacgctcctcgcggcggtcctcgtagccgtcgcgctggggcgccagcgccagcgccgccgcagggccccgctcgaagggatccccgcgccggaggacggctgcgaggtcgctgacggcgcatggagcgcggcagtcgacggcccgacggacgtcatcatcgtcggagccggggtcgccggatctgccctcgcctacacgctcggaaaggatggccgacgggtgcatgttatagagagagaccttacagagcccgatagaattgtgggtgaattgttacaacccggaggctacctgaaattgatggaattgggtctgcaggactgcgttgatgaaattgatgcacagcgtgtccttggttatgcattattcaaagatgggaagaacacaaaactttcttaccccttggagaagttccattcagatgtggctggcaggagctttcacaatggacggttcatacagaggatgcgtgaaaaggctgcatctttgcccaatgtccaactggagcaaggaacagttacatctttgcttgaagaaaatggtacagttaagggtgtgcaatacaagatcaagtcaggtgaagaactaaaagcttatgcaccattgacaattgtatgtgatggctgcttttcgaacttaagacgtgccctttgctccccaaaggttgaggtgccgtcttgctttgttggcctggtcctggagaattgtgaacttcctcatgcgaaccatggccatgttatcttggccaatccttctcccatcctattttacccgataagcagcaccgaggttcgctgtttggtagatgtccctggtcagaaggtgccttccatagcaagtggtgaaatggcaaattatctcaagaccgtggttgcacctcagattcctccacaaatctatgattcttttatagcagcaattgataagggaagcataagaacaatgccaaataggagcatgccagctgcaccacacccaacacctggtgcacttttgatgggagacgctttcaatatgcgacaccctttaactggtggaggaatgactgttgcattatcagatatagttgtcctgcgtaatcttatcaagcctcttcgcaatctgcatgatgcctctgccctctgcaaatacctagagtcattctatactctgcggaagccggttgcttctacaataaacacattggctggtgctctgtacaaagtcttcagttcctcacctgacaaggctagggatgagatgcgccaagcttgttttgattacttgagccttggaggtgtctgttcaaatgggcccattgctctactctctggtcttaatcctcggccattgagtttggttgcacacttctttgctgttgctatcttcggtgttggacgactgatgctcccccttccttcacctaaacgaatgtggactggagcgagattgatttcgggtgcatgtggtatcatcttcccaatcatcaaagctgaaggtgtgaggcaaatgttcttccctgctaccgtccccgcgtattaccgtgcacctcctgaagcggagttctgatctatgaaggtgcagctaatctctcgcacgatgacatttttcctgtgttggtagttgttgaaaatgtgctgtgttggtagtccgaatggatcgaggaacgtgtatagtatctccgttgggtgctgatcctgcttttggaatgttctgaattgctgcatcggtgcccatgttgattcgtcctagctaaattgtacatctttgttgtgctactaatgaattgcgcctgctgttctaactagtggaccaaggtggtgttccttgtctactgatcgtgagctgtgttgtgtgcgtttcaaatcagaccactgtataccatgttaggctgaactctgttatggaccatgatatgccttcagttgtatgggccagcccatcaaatgtggagcttatcccttacctagagtcccagttgattaagcatgtctcttagaaaagagtccagtttaaagatcctatgagagtttgaataaagatacccacagaaatctctgcataagtcaatgacataggatttagatgtgcaatgcttatgacacatctagatgtgctttagcaaaactgtttgaataaaattactgacttgtcaagtcttgtctgctatataaagggcctgacccctcaataaataaagcagagagatatttt

SEQ ID NO: 3241 - DNA, 2430 bp, Triticum aestivum
ccgcctctcgtctcgtctctcgtcccaatcccaccgcccggcacccccccggctccgtctcctccccgcacgcatcaccctctctcccctcgcccctggcccgagagaacccacacgcaaacccaacgaacacgcggcgccgcgttgagaaacccccgaggaacgatgaccccaggagcaggcccccattgcggcatggctgcggccgccggcgtctggcagctcgttggcgtcgccgtggccacgctcctcgcggcggtcctcgtagccgtcgcgctggggcgccagcgccagcgccgccgcagggccccgctcgaagggatccccgcgccggaggacggctgcgaggtcgctgacggcgcatggagcgcggcagtcgacggcccgacggacgtcatcatcgtcggagccggggtcgccggatctgccctcgcctacacgctcggaaaggatggccgacgggtgcatgttatagagagagaccttacagagcccgatagaattgtgggtgaattgttacaacccggaggctacctgaaattgatggaattgggtctgcaggactgcgttgatgaaattgatgcacagcgtgtccttggttatgcattattcaaagatgggaagaacacaaaactttcttaccccttggagaagttccattcagatgtggctggcaggagctttcacaatggacggttcatacagaggatgcgtgaaaaggctgcatctttgcccaatgtccaactggagcaaggaacagttacatctttgcttgaagaaaatggtacagttaagggtgtgcaatacaagatcaagtcaggtgaagaactaaaagcttatgcaccattgacaattgtatgtgatggctgcttttcgaacttaagacgtgccctttgctccccaaaggttgaggtgccgtcttgctttgttggcctggtcctggagaattgtgaacttcctcatgcgaaccatggccatgttatcttggccaatccttctcccatcctattttacccgataagcagcaccgaggttcgctgtttggtagatgtccctggtcagaaggtgccttccatagcaagtggtgaaatggcaaattatctcaagaccgtggttgcacctcagattcctccacaaatctatgattcttttatagcagcaattgataagggaagcataagaacaatgccaaataggagcatgccagctgcaccacacccaacacctggtgcacttttgatgggagacgctttcaatatgcgacaccctttaactggtggaggaatgactgttgcattatcagatatagttgtcctgcgtaatcttatcaagcctcttcgcaatctgcatgatgcctctgccctctgcaaatacctagagtcattctatactctgcggaagccggttgcttctacaataaacacattggctggtgctctgtacaaagtcttcagttcctcacctgacaaggctagggatgagatgcgccaagcttgttttgattacttgagccttggaggtgtctgttcaaatgggcccattgctctactctctggtcttaatcctcggccattgagtttggttgcacacttctttgctgttgctatcttcggtgttggacgactgatgctcccccttccttcacctaaacgaatgtggactggagcgagattgatttcgggtgcatgtggtatcatcttcccaatcatcaaagctgaaggtgtgaggcaaatgttcttccctgctaccgtccccgcgtattaccgtgcacctcctgaagcggagttctgatctatgaaggtgcagctaatctctcgcacgatgacatttttcctgtgttggtagttgttgaaaatgtgctgtgttggtagtccgaatggatcgaggaacgtgtatagtatctccgttgggtgctgatcctgcttttggaatgttctgaattgctgcatcggtgcccatgttgattcgtcctagctaaattgtacatctttgttgtgctactaatgaattgcgcctgctgttctaactagtggaccaaggtggtgttccttgtctactgatcgtgagctgtgttgtgtgcgtttcaaatcagaccactgtataccatgttaggctgaactctgttatggaccatgatatgccttcagttgtatgggccagcccatcaaatgtggagcttatcccttacctagagtcccagttgattaagcatgtctcttagaaaagagtccagtttaaagatcctatgagagtttgaataaagatacccacagaaatctctgcataagtcaatgacataggatttagatgtgcaatgcttatgacacatctagatgtgctttagcaaaactgtttgaataaaattactgacttgtcaagtcttgtctgctatataaagggcctgacccctcaataaataaagcagagaga

SEQ ID NO: 3242 - DNA, 1142 bp, Raphanus sativus
  misc_feature (212)..(212): n is a, c, g, or t
  misc_feature (242)..(242): n is a, c, g, or t
  misc_feature (1000)..(1000): n is a, c, g, or t
gacagcctgtctataaagacatttgcatacttaattattcagagagagagagagagagagagagagagagagataagctttcgaagaagatgaagaatgataataccaactcagcaagaagcaatctggtgaaagataatgaactgtttcatgtgattcacaaagtcccttgtggagatactccctatgtcaaagccaaacatgctcagttnatagagaagaacccggagatggcaatagtntggttttggaaagccataaacacaggagacagagtagacagtgctctcaaggacatggctgtcgtaatgaaacaacttgaccgttccgaagaagctatcgaagccattaaatcctttcgtcctcgttgttccaagaactctcaagattccctagacaatgtcctaatcgacctatacaagaagtgcgggagaatggaggagcaagttgagctgttgaagaggaagctaaggcagatctatcaaggagaggctttcaacggcaaacccaccaagaccgctagatcccatggcaagaagtttcaagtgaccgttcaacaagaaatcgcaagattactggggaacttgggatgggcatatatgcaacaagccaagtacttatccgcagaagcggtatacagaaaagctcagatggttgagccagacgctaacaaatcgtgcaacctagcgatgtgccttatcaaacaaggcaggtttgaagaggcaagaccacttcttgacgatgtatttacgtctagggttttaggtgcagatgattgtaggacaaggcaacgggctgatgagcttctgagtgagctagaggcttcgctgccacgtcggctagatgctgagatggaggatgtcttgggaaatatcttggacgatgactttgttcttgggcttgaagagatgacagccagtaattatagatctaagaggctcccaatctttgaacagatctcttcttttagaaatcaattagtttgctagtgatttgaatnttatgtttcgtgtttgtcatatttagttcgtgtgttcatagttttgatgggttataaaagacgaatgtgttatgttttcttatgtaaatttgtatatacaacaacaataataatactgtcatgttggtgacttttaagacca

SEQ ID NO: 3243 - DNA, 2558 bp, Triticum aestivum
caaaagttggaagggtctcccaggagaactcggtattcaatttgagtaccagagagagttctttgaacagggaattactggcccctgctgcctgtttaattcgtcagtgcttgaaagctattggtagctggctggaacagattggtgaggtgagcgtgaaggtaaatgaaggatcccaactagataatgtttcagattattatgaagtgattggtcctcctattcaagagtccgacaacatgttgctgataggtcaaggggggatgcctcaagttggtaacatcacaggaaagggaaagatgcaagaaactagcagtgcaccagatgtacagttgcacactgaaaatgccattgccgctactctgactggtggcaaccttctatatgctcacccagattcaggaactgatgaacaacaaggtatactcagcaagacaggctggcatcatgttgtctctgatgtcagttcacaagaaacgtcttttcatatccctttacaccgtatgctttcattactattgcgggaagcaatgaagaaatgttccggagaggatgccaaaacagaggaatgttcggttgtgcggtccaatgagttcttctctcaggtacttggaggttgtgagcctcatgggtttgcttcagttgtgatggagcatccattaagagttagagtgttttgcgcacaagtgcgtgccggaatgtggcgtaagaatggtgatgcacctacactaagtgctgagtggtaccgctctgtgcaatggtttgaacagggcttggagtcggatttgtttctgcttcaatgctgtggtgcattatcttctccagagttctttgtgaggaccattcaagaaagatttggtctgtcagattatacatctctggatctcactcaacagaatgagtatgagccggttcttatacaagaaatgctaaccttgattgtgcaactagtcaaagaacgcagattttgtgggtgttccacagcagacaacttgaagagagaattgatttataaattggctgttggagatgccacccatagccagattgtgaggtctcttccccgtgacctttcgtcaagcgaacaacttcaagatgttctagattcagtcgcagtttattctgatccatctggaaagaaaaagggcaagtatgtgcttcgcgaagcattctggaaggaattggacttgtatcacccgcgttggagttccagggaattacaggttgctaaggagagatattgccgtttttgcaaagtttctactcttggcgctcaactacctcaatggactaatgttcttagccctctgcggaatatttctaagattgccacctccaaagctgtccttcaaattgttcgtgctgttctcttttatgctgtttacaccgacgcatcatcagtatcacgtgcccctaacaatgttcttgtgactggtctgcacctgctttcgttggcacttgacatatgtgaatcagagagtcaaatttcggcggaccagtacgggatggacatagtgcagcatgatgatgaatcgtgggttgttctgtcatcggatgaaaaagaggcttttcccatattgacctactctacagaactagtctccccagagactgacaaactaaagaaggatagcatgctaaccttgcttgtttcactgatgcacaaggaaaagaatgatagcaccttttctggatgcaatattccttctctagttgagaccttgttaaagagatttgccaagttaagtaagcagtacatgtctgcagtaagacaactggcaccacaagtactcccatccattccagatcatgccagcgccaaacagaatttaggatctccagattcgacaggaaaacaccaatgcgaagctgcaatcatggcaaaaatgggagcagagcagtcaaaacctgctgaaagtatgaagtcctcaggaaatgaatggcatgacgttccaacatttgagccagatgcgcccaaatcaactgccgttgagacgcggccagtttgctctctgtgccaggattcggattccaaaagtccactctgctgtttgattcgtcttcagagtgccatggaaactatgatggcagagactgttgaagatggtcagacaccaagatcagttgcagagtttgcttccaaggtactctcccatgtcagttccacaagctcgctgaagttgccggctgttcaagttcttgaggataaactcgaggcggaaagacggggtgcagctgcactccgggaagaaatcggtgccctgaagaagcaagcagaaagggttgatgcggtcatcgccaaaacccaacaggagatgaaggaagtcaggaagaagcaagccgaaactgaccagattcttcagcttctcctgcgcaggtctcagggtaaccccgcttcttagtctgtgttgaaactgtgattcttatggatgtatggcgaccttatttgaacttgtcgttgtgtgaacccacttggtatcttgtgtatatatcttaaataaaatgtgagttaaatgctggatgtatgtgacatattcagtatgtgtattgtattgggc

SEQ ID NO: 3244 - DNA, 3691 bp, Triticum aestivum
cgcgctgtctgcgggactgtctgggggcagaatggcgttgcttaccgctgccggacctgcgaaagtgaccccacatgcgtgatttgtgttccgtgcttccagaatggtaatcacaaggatcatgattactccatccttgaaacaggtggtgggtgttgtgattgtggggatgctactgcttggaagcctgaagggttctgctcgaggcataagggggccgaacaaattaagcctcttaccgaggagcttgcgagttccgtagggcctgtgttggacgagctgttgctgttctggaaggagaggatatgcgtgcctcatgcaaaggctgatgattattgcaagagggttgcccaagagttgacggtttctgtcgctgacatgctgcttcgcttctgcgcatgtagtgaaagccttctaagttttgtgtgccaaaggatccatgagtcccctggtctcttggatgcattgatgagggcagagaggatactggacaagaaagttgtgatcaaattgcatgagttgcttttgaagcttatcgctgaaccggcttttaagtatgagtttgccaaagttttcatacagtactaccctgttgcattttctgaagttattaaagggggcaacgactatgtgctggaggagtatccactgataccagccttttctgtccaaatatttactgtgcctgcgctgactacaaggcttgtgcgcgagcacaatttgttgggtactctccttgaatgtttgacagctctgtttctttcttgcgttggtgaggatggtcgtttacagacgagcaaatgggtaaatttgtatgatgcttcttttagattattggaagatgcgcgctatgtcctgagacatgaggaggtttccatgtatgttgcttctgagaggcctgacctgacaagttcatgggttaagctgttgttacttgtgcaaggaatggatcctcagaagagagtgacgagtattcatgttgaagatgagaatgagaatctgtctgcgcctttcgtgctaggtcactatcttggggtcattcagagtcttttgatgacgggagtattttcttctcttgggcaacaagagtcaacaagtgttaccatatgctccactacgataaaaggcatcgaaagtgttgagaaccggcggcttgcaaaagttggaagggtctcccaggagaactcggtattcaatttgagtaccagagagagttctttgaacagggaattactggcccctgctgcctgtttaattcgtcagtgcttgaaagctattggtagctggctggaacagattggtgaggtgagcgtgaaggtaaatgaaggatcccaactagataatgtttcagattattatgaagtgattggtcctcctattcaagagtccgacaacatgttgctgataggtcaaggggggatgcctcaagttggtaacatcacaggaaagggaaagatgcaagaaactagcagtgcaccagatgtacagttgcacactgaaaatgccattgccgctactctgactggtggcaaccttctatatgctcacccagattcaggaactgatgaacaacaaggtatactcagcaagacaggctggcatcatgttgtctctgatgtcagttcacaagaaacgtcttttcatatccctttacaccgtatgctttcattactattgcgggaagcaatgaagaaatgttccggagaggatgccaaaacagaggaatgttcggttgtgcggtccaatgagttcttctctcaggtacttggaggttgtgagcctcatgggtttgcttcagttgtgatggagcatccattaagagttagagtgttttgcgcacaagtgcgtgccggaatgtggcgtaagaatggtgatgcacctacactaagtgctgagtggtaccgctctgtgcaatggtttgaacagggcttggagtcggatttgtttctgcttcaatgctgtggtgcattatcttctccagagttctttgtgaggaccattcaagaaagatttggtctgtcagattatacatctctggatctcactcaacagaatgagtatgagccggttcttatacaagaaatgctaaccttgattgtgcaactagtcaaagaacacagattttgtgggtgttccacagcagacaacttgaagagagaattgatttataaattggctgttggagatgccacccatagccagattgtgaggtctcttccccgtgacctttcgtcaagcgaacaacttcaagatgttctagattcagtcgcagtttattctgatccatctggaaagaaaaagggcaagtatgtgcttcgcgaagcattctggaaggaattggacttgtatcacccgcgttggagttccagggaattacaggttgctaaggagagatattgccgtttttgcaaagtttctactcttggcgctcaactacctcaatggactaatgttcttagccctctgcggagtatttctaagattgccacctccaaagctgtccttcaaattgttcgtgctgttctcttttatgctgtttacaccgacgcatcatcagtatcacgtgcccctaacaatgttcttgtgactggtctgcacctgctttcgttggcacttgacatatgtgaatcagagagtcaaatttcggcggaccagtacgggatggacatagtgcagcatgatgatgaatcgtgggttgttctgtcatcggatgaaaaagaggcttttcccatattgacctactctacagaactagtctccccagagactgacaaactaaagaaggatagcatgctaaccttgcttgtttcactgatgcacaaggaaaagaatgacagcaccttttctggatgcaatattccttctctagttgagaccttgttaaagagatttgccaagttaagtaagcagtgcatgtctgcagtaagacaactggcaccacaagtactcccatccattccagatcatgccagcgccaaacagaatttaggatctccagattcgacgggaaaacaccaatgcgaagctgcaatcatggcaaaaatgggagcagagcagtcaaaacctgctgaaagtatgaagtcctcaggaaatgaatggcatgacgttccaacatttgagccagatgcgcccaaatcaactgccgttgagacgcggccagtttgctctctgtgccaggattcggattccaaaagtccactctgctgtttgattcgtcttcagagtgccatggaaactatgatggcagagactgttgaagatggtcagacaccaagatcagttgcagagtttgcttccaaggtactctcccatgtcagttccacaagctcgctgaagttgccggctgttcaagttcttgaggataaactcgaggcggaaagacggggtgcatctgcactccgggaagaaatcggtgccctgaagaagcaagcagaaagggttgatgcggtcatcgccaaaacccaacaggagatgaaggaagtcaggaagaagcaagccgagactgaccagattcttcagcttctgttacgcagatctcagggtaaccccacttcttagtctctgttgagactgtggttctactgggtatatcagtgtatgtcgaacttatttgaactcgttgtgtgaaccacttcgtatcttgtgtatatcttgaataaaacgtgagttgaatgctggatgtatgtgacat

SEQ ID NO: 3245 - DNA, 3576 bp, Triticum aestivum
gattaagcctcttaccgaggaacttgcgagttccgtagggcctgtgttggacgagctcttgctgttctggaaggagaggatttgcattcctcatgaaaaggctgacgtttgcaagaagagggttgccgaagagttgacgattgctattgctgacatgctgcttcgcttctgcgcatgtagtgacaaccttctaagttttgtgtcccaaaggatccatgagtcccctggtctcttggatgcattgatgagcgcagaaaggatactgcacaggaagattgtgggaaaattgcatgagttgcttttgaagcttatcgctgaaccggcttttaagtatgagtttgccaaagttttcatacagtactaccctgttgcattttctgaagttattaaagggggcaacgactatgtgctggaggagtatccactgataccagccttttctgtccaaatatttaccgtgcctacgctgactacaaggcttgtgcgcgagcacaatttgttgggtactcttcttgaatgtttgacagctctgtttctttcttgtgttggtgaggatggccgtttacagacgagcaaatgggtaaatttatacgatgcttcttttagattattggaagatgcacgctatgtcctgagacatgaggaggtttccatgtatgttgcttctgagaggcctgatctaacaagttcatgggttaagctgttgttacttgtgcaaggaatggatcctcagaagagactggcgagtattcatgttgaagatgagaatgagaatctatctgcgcctttcgtgctaggacactatcttcggatcattcagaatcttttgatgatgggagcattttcttctcctgggcaacaagaatcaacaagtgttactatatgctccggtacgataaaaggcatcgaaagggttgcgaaccagcagcttgcaaaagttggaagggtctcccaggagaactcggtatgcaatttaggtaccagagagagttcttcgagcagtgagttaccatcacctgctgcctgcttagttcgtcagtgcttgaaagctattggtagctggctggaacagattggtgaggtggggatgaaggtaaatgaaggatcccaactagtcgatgttgcagattattatgaagtaattggtcctcctattcaagagtccgacaacatggtgatgacaggtaaaggggggatgcctcacgttggtaacatcacaggaaagggaaagatgcaagaaactagcagcgcaccagatgtacaattgcactctgaaaatgtcattgccgctactctgactgatcacaagtttttatatgctcacccagattcaggaactgatgaactaggtatactcaacacaacaggctggcatcatgttgtctttgatgtcagttcacaagccacatcttttcatatccctttacaccgtatgctttcgttactattgcgggaagcaatgaataaatgtttcggagaggatgccaaaacagaggaatgttcagttgtgcggtccaatgagttcttctctcaggtacttggaggttgtgagccttatgggtttgcttcagttgtgatggagcatcccttaagagtcagagtattttgcgcacaagtgcgtgctggaatgtggcgtaagaatggtgatgcagctatactaagtgctgagtggtaccgctctgtgcaatggtttgaacagggcttggagtcggatttgtttctgcttcaatgctgtggcgcattatcttctccagagttctttgtgaggaccattcaagaaagatttggtttgtcagattatacatctctggatctcactgaacacaatgagtatgagccggttcttatacaagagatgctaaccttgattgtgcaactagtcaaagaacgcagattttgtgggcgttccgcagcagacaacttgaagagagaattgatttataaattggctgttggagatgccacccatagccagattgtgaggtctcttccccgtgaccttttgtcaagcgaacaatttcaagatgttctagattcagtcgcagtttattctgatccatctggaaataaaaagggcaagtatgtgcttcgcgaagcattctggaaggaactggacttgtatcatccgcgctggagttccagggaattgcagattgctaaggagagatattaccgtttttgcaaagtttctgctcttggtgctcaactacctcaatggactcatatttttagccctctgtgcagtatttctaagattgccacctccaaatctgtccttcaaattgttcgtgctgttctcttctatgctgtttacaccgacgcatcatcggtatcgcgtgcccctgacagcgttcttgtgactggtctgcacctgctttcgttggcacttgacatatgtgaatcagggagtcaaatttctgccgaccagtatgggatggacttactgcagcatgatgatgaatcgtgggttgttctgtcatcggatgcagaagaggcttttcccatattgacctactctacagaactagtctccccagagtctgacaagctaaagaaggatagcatgctaaccttgcttgtttcactgatgcacaaggaaaagaatgacaacaccttttctggatgcaatattccatctctagttgtgagtttgttaaagagatttgccaagttaagtaagcagtgcatgtctgcagtaagacaaatggcaccacaagtactcccatccattccagatcatgccagcgccaaacagaatttaggatctcctgatttgactggaaaacgccaatgcaaagctgcaatcatggcaaaaatgggagaagagcagtcaaaacgtgctgaaagtatgaagtcctcaggaaatgaagggcgtgatgttccaacatttgagccagatgcgcccaaatcaactgccgttgagacacgatcagtttgttctctgtgccaggattcgggttccaaaagtccactctgctgtttgattcgtcttcagactgccatggaaactatgatggcagacactgttgaagatggtcagaccccaagttcaattgcggagttcgcttccaaggtactctcccatctcagctccacaagctcgtcgaagtcatcagctgttcaagttctcgaggataaactcgaggtggaaagacggggtgcggctgcgctccgagaagaaatgggcgccttgaggaagcaagcagaaaaggccgatgcggtcatcgcgaaaacccaacaagagatggaggaagtcaggaagaagcaagccgagaccgaccagattcttcagcttctcctgtgcagatctcagggtaaccccgcttcttagtctctgttgagactggttcttatggatgtactgtatgtcagaacttatttgaacttgtcgttgtgtgaaccacttcgtatcttgtgtaaatcttcaataaaatgcgagttgaaagctggatgtatgtgacatgtaaagtattagggtgtattgtaatgggctatacaatgcaatgcatgatgcttctgatcgccatttggccggtagatgttgcttgtggccaccatctaaaaacaacttcatct

SEQ ID NO: 3246 - DNA, 3144 bp, Secale cereale
tcagcattttctgaagttattaaaggggcgacgactatgtactggaggagtatccactgataccagccttttctgtccaaatatttaccgtgcctacactgactacaaggcttgtgcgcgagcacaatttgttggctactcttcttgaatgtttgacagctctgtttctttcttgtgctggtgaggatggtcatttacagacgagcaaatgggtaaatttgtacgatgcttcctttagattattggaagatgcacgctatgtcctgagacatgaggatgtttccatgtatgttgcttttgagaggcctgatctaacaagttcatgggttaagctgttgttacttgtgcaaggaatggatcctcagaagagactggcaagtattcatgctgaagatgagaatgagaatctatctgcaccttttgtgctaggacactatcttgggatcattcagaatcttttgatggcgggagcattttcttctcctaggcaacaagagtcaacaagtgttactatatgctccactacgataaaaggcatcgaaagtgtcgagaaccagcggcttgcaaaagttggaagggtctccaggagaactcggtatgcaatttgagtaacagagagagttctttgagcagtgaattaccagcacctgctgcctgcttaattggtcagtgcttgaaagctattggtagctggctggagcagattggtgaggtgggcgtgaaggtaaatgaaggatcccaacaagataatgttgcagattattatgaagtaattggtcctcctattcaagaatccggcaacatgttgctgataggtcaaggggtgatgcctcaggttggtaacatcacaggcaagggagagatgcaaatgcaagaaactagcagtgtgccggatgtacaattgcaatctgaaaatgccattgctgttactctgactgctggcaaccttttatatgctcacccagattcaggaactgatgaacaaggtatactcagcaagacaggctggcatcatgttgtctttgatgtcagttcacaagaaacttcttttcatatccctttacaccgtatgctttcattactattgcgggaagcaatgaggaaatgtttcggagaggatgccaaaacagaggaatgttcagttgtacggtccaatgagttcttctctcaggtacttggaggttgtgagccttatgggtttgcttcagttgtgatggagcatccattaagaatgagagtattttgcgcacaagtgcgtgacggaatgtggcgtaagaatggtgatgcagctatactaactgctgagtggtaccactctgtgcaatggcttgaccagggcttggagtcggatttgtttctgcttcagtgctgtggtgcattatcttctccagagttctttgtgaggaccattcaagaaagatttggtttgtcagattatacatctctggatctcacggaaagaatgagtatgagtcagttcttatacaagaaatgctaacttttattgtgcaactagtcaaagaacgcagattttgtgggtgttccacagcagacaacttgaagagagaattgatttataagttggctgttggagatgccacacatagccagattgtgaggtctcttccgcgtgacctttcgtcaaatgaacaatttcaagatgttctagattcactcgccgttttttctgatccatctggaaagaaaaagggcaagtatgtgcttcgtgaagcattctggaaggaattggacttgtatcacccgcgctggagttccagggaattacagattgctaaggagagatattaccgtttttgcaaaatttctgctcttggcgctcagctacctcaatggactcatgttcttagccctctgcgcagtatttctaagattgccacctccaaagctctccttcaaattgttcgtgctgttctcttttatgctgtttacaccgacgcgtcatcggtatcacgtgcccctaacaatgttcttgtgactggtctgcacctgctttcgttggcacttgacatatgtgaatcagagagtcaaatttctgcggaccagtataggatggacttactgcagcatgatgacgaatcatgggtcgttctgtcaacggatgtcgaagaggcttttcccatattgacctactctacagaattagtctccccagagtctgacaaactaaagaaggatagcatgctaaccttgcttgtttcactaatgcacaaggaaaagaatcacagcaccttttctggatgcaatattccatctctagttgagagtttgttaaagagatttgccaagttaagtaagcagtgcatgtctgaagtaagacaaatggcaccacaagtactgccatccatgccagatcatgccagacccaaacagaatttaggatctccagattcaatgggaaaacaccaatgcgaagctgcaaccatggcaaaaatgggagcagagcagtcaaaacttgctgaaagtatgaagtcctcaggaaacgaagggcataatgttccaacatttgagccagatgcacctagatcgaatgccgttgagacgcgacaagtttgctctctgtgccgggattcggattccaaaagcccagtctgctgtttgattcgtcttcaggctgctgtggaaactatgatggcagagactgtcgaagatggtcaggccccaagatcagttgcagagttcgcttccaaggtactctcccatgccagttccacaggctcgtcgaagtcaccagctgttcaagctcttgaggataaactcgaggcggaaagacagggtgcggctgcgctccgagaagaaatcgacgccttgaagaagctggcagaaaaggccgatgcggtcatcgtcaaaacccaacaagagatggaggaagtcaggaagaagcaagccgagaccgaccagattcttcagcttctcttgcgcaggtctcagggtaaccccgcttcttagtctctgttgagactctggttctactggatgtatgtcagaacttatttgaacttgtcgttgtgtgaaccacttgtgtatatcttcaataatgcgagttgaatgctggatgtatgtgacaagtattcgggtgtattgtattaggctatgcaatgcaatgcatgatgcctctgattgcca

SEQ ID NO: 3247 - DNA, 3404 bp, Triticum aestivum
gctgacatgctgcttcgcttctgcgcatgtagtgaaagccttctaagttttgtgtcccaaaggatccatgagtcccctggtctcttggatgcattgatgagggcagagaggatactggacaagaaagttgtgaacaaattgcatgagttgcttttgaagcttatcgctgaaccggcttttaagtatgagtttgccaaagttttcatacagtactaccctgttgcattttctgaagttattaaagggggcaacgactatgtgctggaggagtatccactgataccagccttttctgtccaaatatttactgtgcctgcgctgactacaaggcttgtgcgcgagcacaatttgttgggtactcttcttgaatgtttgacagctctgtttctttcttgcgttggtgaggatggtcgtttacagacgagcaaatgggtaaatttgtatgatgcttcttttagattattggaagatgcacgctatgtcctgagacatgaggaggtttctacatatgttgcttctgagaggcctgatctaacaagttcatgggttaagctgttgttacttgtgcaaggaatggatcctcacaagagagtgacgagtatccctgctgaaggtgagaatgagaatctatctgcgcctttcatgctagggcattatcttgggatcattcagaatcttttgctgaagggagcattatcttctcctgggcaacaagagtcaacaaatgttactgcatgctccaccgcgacaaaaggcatggaaagtgccaagaaccagcggcttgcaaaagttggaagggtctcccatgagaactcggtatgcactttgagtgattcgagcagtgagataccatcacctgctgcctgcttaattcgtcagtgcttgaaagctattggtagctggctggaactgactggtgatttgggcgtgaaggtaaatgaaggatcccaactagataatgttgcagattattatgaagtaattggtcctcctattcaagagtcaggcaacatgttgctgataggtcaaggggggatgcctcaggttggtaacatcacaggaaggggaaagatgcaagaaactagcagtgttgttactctgactggtggcaaccttttatatgcccacccacattcaggaactgatgaactaggtctattcagtaagacaggttggcatcatgctgtctttgatgtcagttcacaagaaacgtcttttcatatccctttacaccatatgctttcattactattgcgggaagcaatgaagaaatgtttcggagaggatgccaaaacagaggaatgttcagttgtgcagtccaatgagttcttttctcaggtacttggaggttgtgagccttatgggtttgcttcagttgtgatggagcatccattaagagtgagagtattttgcgcacaagtgcgtgccgggatgtggcgtaagaatggtgatgcagctatactaagtgctgagtggtaccgctctgtgcaatggtttgaacagggcttggagtcggatttgtttctgcttcaatgctgtggtgcattatcttctccagagttctttatgaggaccattcaagaaagatttggtttgtcagattatacatctctggatctcactcaacagaatgagtatgagtcggttcttatacaagatatgctaacttttattgtgcaactagtcaaagaacgcagattttgtgggtgttccatagcagacaacttgaagagagaattgatttataaattggctgttggagatgccacccatagccagattgtgaggtctcttccccatgacctttcgtcaagcgaacaatttgaagatgttctagattcagtcgcagtttgttctgatccatctggaaagaaaaagggcaagtatgtgcttcgcgaagcattctggaaggaattggacttgtatcacccgcgctggagtcccagggaattgcagattgctaaagagagatattaccgtttttgcaaagtttctgctcttggcgctcaactacctcaatggactcatgtttttagccctctgcgcagtatttctaagattgccacctccaaagctgtccttcaaattgttcgtgctgttctcttctatgctgtttacaccgacgcatcatcggtatcacgtgcccctagcaatgttcttgtgactggtctgcacctgctttcgttggcacttgacatatgtgaagcagagtctcaaatttctgcggaccagtatgggatggacttactgcagcatgatgatgaatcgtgggttgttctgtcatcggatgcagaagaggcttttcccatattgacctactctacagaactagtctccccagagtctgacaagctaaagaaggatagcatgctaaccttgcttgtgtcactaatgcacaaggaaaagaataacagcaccttttctggatgcaatattccatctctagttgagagtttgttaaagagatttgccaagctaagtaagcagtgcatgtatgaagtaagacaaatggcaccacaagtactcccatccattccagatcatgccagcgccaaactgaatttaggatctccagattcgacgggaaaatgccaatgcgaagctgcaatcatggcaaaaatgggagcagagcagtcaaaacctgctgaaagtatgaagtcgtcaggaaatgaagggcatgatgttccaacaattgagactgccgttgagacgcgaccagtttgctctctgtgccaggattcggattccaaaagtcgactctgctgtttgattcgtcttcaggctgccatggaaactatgatggcagagactgttgaagatggtcagaccccaagttcaattgcagagctcgcttccaaggtactctcccatgtcagttccacaagctcgctggagtcgccggctgttcaagttcttgaggataaactcgaggcagaaagacggggtgcagctgcgctccgggaagaaatcagcgccctgaagaagcgagcagaaaaagctgatgtggtcatcgcgaaaacccaacaggagatggaggaagtcgggaagaagcaagccgagactgaccagattcttcagtttctgttacggagatctcagggtaaccccgcttcttagtctctgtcgggactgtgattctaccggatgtgtgtcttacttatttgaacttatcgttgtgtgaaccacttggtatctgcttgtgtatatcttcaataaaatgtgagctaaatgctggatgtatgtgacatattcagtattgggatgtactaccattgtattgggctatcggctatatgcaatgcatgatgcttcattgcttctgattgccatttggctgatcgatgttgcttcctgatgtgtggagctcccagctgctgagctgcacgcagcgaacatcgcatgtc

SEQ ID NO: 3248 - DNA, 1989 bp, Triticum aestivum
ttgagcctcatgggttttgcttcagttgtgatggagcatccattaagagttagagtgttttgcgcacaagtgcgtgccggaatgtggcgtaagaatggtgatgcacctacactaagtgctgagtggtaccgctctgtgcaatggtttgaacagggcttggagtcggatttgtttctgcttcaatgctgtggtgcattatcttctccagagttctttgtgaggaccattcaagaaagatttggtctgtcagattatacatctctggatctcactcaacagaatgagtatgagccggttcttatacaagaaatgctaaccttgattgtgcaactagtcaaagaacgcagattttgtgggtgttccacagcagacaacttgaagagagaattgatttataaattggctgttggagatgccacccatagccagattgtgaggtctcttccccgtgacctttcgtcaagcgaacaacttcaagatgttctagattcagtcgcagtttatcctgatccatctggaaagaaaaagggcaagtatgtgcttcgcgaagcattctggaaggaattggacttgtatcacccgcgttggagttccagggaattacaggttgctaaggagagatattgccgtttttgcaaagtttctactcttggcgctcaactacctcaatggactaatgttcttagccctctgcggagtatttctaagattgccacctccaaagctgtccttcaaattgttcgtgctgttctcttttatgctgtttacaccgacgcatcatcagtatcacgtgcccctaacaatgttcttgtgactggtctgcacctgctttcgttggcacttgacatatgtgaatcagagagtcaaatttcggcggaccagtacggaatggacatagtgcagcatgatgatgaatcgtgggttgttctgtcatcggatgcagaagaggcttttcccatattgacctactctacagaactagtctccccagagtctgacaagctaaagaaggatagcatgctaaccttgcttgtttcactgatgcacaaggaaaagaatgacagcaccttttctggatgcaatattccatctctagttgagagtttgttaaagagatttgccaagctaagtaagcagtgcatgtctgcagtaagacaaatggcaccacaagtactcccatccattccagatcatgccagcgccaaacagaatttaggatctccagattcgacgggaaaacaccaatgcgaagctgcaatcatggcaaaaatgggagcagagcagtcaaaacctgctgaaagtatgaagtcctcaggaaatgaagggcatgatgttccaacatttgagccagatgcgcccaaatcaactgccgttgagacgcgaccagtttgctctctgtgccaggattcggattccaaaagtccactctgctgtttgattcgtcttcagactgccatggaaactatgatggcagagactgttgaagatggtcagaccccaagatcagttgcagagttcgcttccaaggtactctcccatgtcagttccacaagctcgctgaagtcgccggctgttcaagttcttgaggataaactcgaggcagaaagacggggtgcagctgcgctccgggaagaaatcagcgccctgaagaagcgagcagaaaaagctgatgtggtcatcgcgaaaacccaacaggagatggaggaagtcgggaagaagcaagccgagactgaccagattcttcagtttctgttacggagatctcagggtaaccccgcttcttagtctctgtcgggactgtgattctactgggtatatcagtgtatgtcgaacttatttgaactcgttgtgtgaaccacttcgtatcttgtgtatatcttgaataaaacgtgagttgaatgctggatgtatgtgacattcagtattgggatgtactgtactattgtattgggctatgcaatgcatgaatagacttactagaattagacc

SEQ ID NO: 3249 - DNA, 3078 bp, Triticum aestivum
gagggtaccccctgcaagagtgttgctgaggagttgacgacttctattgctgacatgctgcttcgcttctgcgcatgtagtgaaagccttctaagttttgtgtgccaaaggatccatgagtcccctggtctcttggatgcattgatgagggcagagaggatactggacaagaaagttgtgaacaaattgcatgagttgcttttgaagcttatcgctgaaccggcttttaagtgtgagtttgccaaagtttttattcagtactaccctgttgcattttctgaagttattaaagggggcaacgacaatgttctggaggagtatccactgataccagccttttctgtccaaatatttaccgtgcctacgctgactacaaggcttgtgcgcgagcacaatttgttgggtactcttcttgaatgtttgacagctctgtttctttcttgtgttggtgaggatggccgtttacagacgagcaaatgggtaaatttgtatgatgcttcttttagattattggaagatgcacgctatgtcctgagacatgaggaggtttctaattatgttgcttctgagaggcctgatctaacaagttcatgggttaagctgctgttacttgtgcaaggaatggatcctcgcaagagagtgacgagtattcatgttgaagatgagaatgagaatctatctgcgcctttcgtgctaggacactatcttgggatcattcagaatcttttgatgatgggagcattttcttctcttgggcaacaagagtcaacaagtgttactatatgctccagtacgataaaaggcatcgaaagggttgcgaaccagcagcttgcaaaagttggaagggtctcccaggagaactcggtatgcaatttaggtaccagagaaagttcttcgagcagtgagttaccatcacctgctgcctgcttaattcgtcagtgcttgaaagctattggtagctggctggaacagattggtgaggtgggggtgaaggtaaatgaaggatcccaactagacgatgttgcagattattatgaagtaattggtcctcctattcaagactccgacaacatggtgatgacaggtaaaggggggatgcctcacgttggtaacatcacaggaaagggaaagatgcaagaaactagcagcgcaccggatgtacaattgcactctgaaaatgtcattgccgctactctgactgatcacagctttttatatgctcacccagattcaggaactgatgaactaggtatactcaacacaacaggctggcatcatgttgtctttgatgtcagttcacaagccacatcttttcatatccctttacaccgtatgctttcgttactattgcgggaagcaatgaagaaatgtttcggaaaggatgccaaaacagaggaatgttcagttgtgcagtccaatgagttcttctctcaggtacttggaggttgtgagccttatgggtttgcttcagttgtgatggagcatccattaagagtgagagtattttgcgcacaagtgcgtgccggaatgtggcgtaagaatggtgatgcagctatactaagtgctgagtggtaccgctctgtgcaatggttcgaacagggcttggagtcagatttgtttctgcttcaatgctgtggtgcattatcttctccagagtactttatgaggaccattcaagaaagatttggtttgtcagattatacatctctagatctcactgaacagaatgagtatgagtcagttcttatacaagaaatgctaacttttattgtgcaactagtcaaagaacgcagattttgtgggcgttccacagcagacaacttgaagagagaattgatttataaattggctgttggagacgccacccatagccagattgtgaggtctcttccccgtgacctttcatcaagcgaacaatttcaagatgttctagattcagtcgcagtttgttctgatccatctggaaagaaaaagggcaagtatgtgcttcgcgaagcattctggaaggaattggacttgtatcacccgcgttggagtcccagggaattgcagattgctaaagagagatattaccgtttttgcaaagtttctgctcttggcactcaactacctcaatggactcatgttttgaatcctctgcgcagtatttctaagattgccacctccaaagctgtccttcaaattgttcgcgctgttctcttctatgctgtttacaccgacgcatcatcggtatcacgtgcccctaacaatgtttttttgactagtctgcacctgctttcgttggcacttgacatatgtgaatcagagagtcaaatgtctgcagaccaatatggaatggacatagtgcagcatgatgatgaatcgtgggttgttctgtcatcggatgcagaagaggcttttcctatattgacttactctacagaactagtctccccagagtctgacaagctaaagaaggatagcatgctaaccttgcttgtgtcactgatgcacaaggaaaagaatgacagcaccttttctggatgcaatattccttctctagttgagaccttgttaaagagatttgccaagttaagtaagcagtgcatgtctgcagtaagacaaatggcaccacaagtactcccatccattccagatcatgccagcgccaaacagaatttaggatctccagattcgacgggaaaacgccaatgcgaagctgcaatcatggcaaaaatgggagcagagcagtcaaaacctgctgaaagtatgaagtcctcaggaaatgaagggcatgacgttccaacatttgagccagatgcgcccaaatcaactgccgttgagacgcggccagtttgctctctgtgccaagattcggattccaaaagtccactctgctgtttgattcgtcttcagactgctatggaaactatgatggcagacactgttgaagatggtcagaccccaagatcagttgcagagttcgcttccaagctactctcccatgccagctccataggctcgtcgaagtcgccagctgttcaagttcttgaggataaactcgaggcagaagacggggtgcagctgctctccgggaag

SEQ ID NO: 3250 - DNA, 1421 bp, Secale cereale
agtactcgaacggtgcccttacgcagttgcagaacacaccgagtgcaaactagaacccattaggctacgtgaacacccgaatacacagacaatttcatctcacactgactaaatgcaaaggagcatcaggctgcacagtattcaatcagcctttcgagcatcttggccaggcgagctttacgggcattaaaaggattagttagactccaggctctcgttaggggccatgctgtacgaaagcaagcagcagaaacacttcagtgtatgcaatcactagtaaaggctcaagctcgtgtcagagcaagacaggttcgtattggtttggaaggtcaggtgacccagaagaaggctcctgaaaaaaatcctcacgaggatcctgctcgagaaattgaggaacgctggtgtggcggtattggctcggcggaagatatgcaagctaaagtattgaaaaagcaagaagctgccgctaagcgggaaagagcaatggcatacgctttaacgcaccagcggcaagcaggttccaggaaactgaaagctgcagatgtccaagggccagaggcggatgagaaccagtgggggcggaactgggtggagaggtgggtggctgtacgcccgtgggagaacaggttactggaaggtaacgccaaagagaatgtaccaattggcgatgataaggaggctgaggaaaatggggacagggatgtaagcaagccaaaaggaaaagctgcagtttcgggcattcagtcaaatggttcaagccagacgaaagatgcaaaacacaagaagtcacattctgatgcaagtggttcttcatcaggacaatctgcggctgtgccacccgccgcttctttgggatcatctaagctgaaaccgaagccatcggaccaaacctctgaggaagtcagccctcagcctacagatccggctccgcggtccacaagtaatcccaaggaaaggccatcagcacaagtcattgcaccaaccaagaagcggctatcccttcctaacaacgcagctgccggtggcgcggcaagaaaaggccaggcgagcagcagcgagaaaactcggtctgtcggttccaggaacatggcgaaaggagcgtccaagtctgaaccaaagcagcggcagagccctggcagcgcaaccccgaagcgggttcaggcacaggcctcatcctgatgaatcaatcgactccctcccatttcattcagaaacttagtcatggcaatgcccatccgtcacgtgtgccgttgcatcatctgtgtacatagaccgagaaataaacaaccctgcatctagatcgccgccacgccccatgcgccatcggtgccgcgttgtcgtaagccatttctgtgtgtatcttctcttcctcaagccactctttcatggaaagaaccgaagaaggcaagcaccatgttatc

SEQ ID NO: 3251 - DNA, 1493 bp, Secale cereale
cagcagagaaaggagctctgctgctcaggtgctacacaaacggaaacattccgtggatactgaaggtgcccttgcatgcagaacacacagtgcaaactgaaccattggctagtgacaccaatacacagacaatttcatctcagactgaactaaatgcaaaggagcatcaggctgcaacagttattcaatcagcctttcgagcattcttggccaggcgagctttacgggcattaaaaggattagttagactccaggctctcgttaggggccatgctgtacgaaagcaagcagcagaaacacttcagtgtatgcaatctctagtaaaggctcaagctcgtgtcagagcaagacaggttcgtattggtttgaaggtcaggtgccccagaagaaggctcctgaaaaaaatgcccaggaggatcaagctcgagaaattgaggaacgctggtgtggcggtattggctcggcggaagatatgcaagctaaagtattgaaaaagcaagaagctgccgctaagcgggaaagagcaatggcatatgctttaacacaccagcggcaagcaggttccaggaaactgaaagctgcagatgtgcaagggccagaggcggatgagaaccagtgggggcggaactgggtggagaggtgggtggctgtacgcccgtgggagaacaggttactggaaggtaacgccaaagagaatgtaccaattggcgatgataaggaggctgaggaaaatggggacagggatgcaaacaagccaaaaggaaaagttgcagtttcgggcactcagtcaaatggttcaagccagacgaaagatgcaaaacacaagtcacactctgatgcaagtggtcttcatcagggcaatctgcggctgtgcacccgccgcttctttgggatcatctaagctgaaaccgaagccatcggaccaaacctctgaggaagtcagccctcagcctacagatccggctccgcggtccacagtaatcccagaaaggccatcagcacaagtcaatgcaccaaccaagaagcggctatcccttcctaacaatgcaactgccagcggcggagcagaaaaggccaggcgagcagcagcgagaaaacgcggtccgtcggttccaagaacacgacgaaaggagcgtccaagtctgaaccgaagcagcggcagagcccgggagcgcaaccgcgaagcgggtccaggcacaggcctgatcctgatgaatcaatcgactccctcccattttattcagaaacttagtcatggcagtgcccatctgtcacgtgtgccgttgcaccatctgtgtacatagaccgagaaataaacaaccctgcatctagatcgccgccacgccccatgcgccatcggtgccgcgttgtcgtaagccatttctgtgtgtatcttctcttcctcaagccactctttcatggaaagaagcgaagaaggcaagcaccatgttatctgcaagttgtgtctatgtctatctatccttgagtgtgag

SEQ ID NO: 3252 - DNA, 1214 bp, Triticum aestivum
cgacaaggtgagggagctcacggaccacgtcgcgcggctggcgcgcgagggcacggcggtgaacatcggacgcgtggccttcacgacgagcctgaaccttatctcccgcaccatcttctccatcgacctcaccagcctcgacgacatgagcagttccaaggagttccaggaagtgatcacggccatcatggaaggtctggggaccccgaacttgtcggatttcttcccggtgctcgcgccggccgacctgcagggcatgcgccggcggctggcgcggctcttcgcgcggctgcacgccgtgttcgacgccgaggtggaccagaggctgcacggccgcgacgccggccagcccaggaagaacgacttcctcgacgtgctgctcgatgtggcggcgcgtgaggatggcaaggacctgctcgaccgtgagacactgcgctcacactttacggacttgtttgctgccggtagtgacacaagctctagcacagtggaatgggcaatgacagagcttctccaaaacccatcatcaatggctatggtttgcgacgagctcgcacaagttatcggctcaagaagaaacattgaagaagctgatatttctcgtttgccctatctccaagcagtcataaaagagacttttcgactccaccctcccgctccactcttgttgccacgccaaccagagacgacggtcaaaatagcaggttgcacaatacctaaaggttcacgcgtgttcataaatgtatgggcgataggtcgggataaagatgtatggactgaacctgagaagtttatgccagagcggttcttgggttcagcaattgactttaggggtgttgactctgagctccttccatttggtgcggggcgtcggatctgccctggaatggcattggcaattaggatggtgcatgtgatgctcgcttcattattaaatcaatttaaatggagtctccctgttgagctggaacgggatgggattgatatggaagatcagtttggcctgacgctagcgaaggtcgtgcccctttgtattatagcaacacccatttgagccaataagaaaatgcaacattgttgacaatggtgttgttgatgtgtaataatgtaaatgtatcagccttgtaatttataccaatatttatgtgaaacttttcatattctctcagagtataaacctttcataccttcattagtcaatgatttttgaaacc

SEQ ID NO: 3253 - DNA, 784 bp, Triticum aestivum
gcgtgaggatggcaaggacctgctcgaccgtgagacactgcgctcacactttacggacttgtttgctgccggtagtgacacaagctctagcacagtggaatgggcaatgacagagcttctccaaaacccatcatcaatggctatggtttgcgacgagctcgcacaagttatcggctcaagaagaaacattgaagaagctgatatttctcgtttgccctatctccaagcagtcataaaagagacttttcgactccaccctcccgctccactcttgttgccacgccaaccagagacgacagtcaaaatagcaggttgcacaatacctaaaggttcacgcgtgttcatcaacgtatgggcgataggtcgagataaagatgtatggattgaacctgagaagtttatgccggagaggttcttgggttccacgattgattttcggggtgtggattttgagctccttccatttggtgctgggcgtcggctctgccctggaatggcattggcaattaggatggtgcatgtgatgctcgcttcattgttaaatcaatttaaatggagtctccctgttgagctggaacgggatgggattaatatggaagatcagtttggcctgacactagcaaaggtcgtgcccctttgtattatagcaacacccatttgagccaataacaaaatgcaacattgttgagaatggtgttgttcatgtgtaataatgtaaatgtatgagccttgtaatttataccaatatttatgtgaaacttttcatattctctcaaaaaaaaaa

SEQ ID NO: 3254 - DNA, 1276 bp, Triticum aestivum
gcctggctgccccccgggccgaggtggcgcgcgttccgcaagatcatggccacggagctcttcgcgccgcaccggctcgacgcgctccaccacctccggagcgacaaggtgagggagctcacggaccacgtcgcacggctggcgcgcgagggcacggcggtcttcacgacgagcctgaaccttatctcccgcaccatcttctccatcgacctcgacgaccacggccgctccgaggatttccaggaggtgatcacggccatgatggaaggcttgggcaccccgaacgtgtccgacttcttcccggtgctcgcgccggccgacctgcagggcatgcgccggcgcctggcgtggatcttcgcgcggctgcacgccgtgttcgacgccgaggtggaccagaggctgcgcggccgcgacgctggccagcccaggaagaacgactacctcgacgtgctgctcgacgtggcggcgcgtgacgagggaaaggacctgctggaccgtgagacgctacgctcacagttcacggatttgtttgttgctggtagtgacataagctctagcacagtggaatgggcaatggctgagcttcttcgaaacccatcatcaatggctaaggtttgtgacaagcttgcacaagttatcgtctctagaagaaacattgaagaagctgacattgtacgattgccctatctccaagctgtcataaaagagacttttcgactccaccctccagctccactcttgttgccacgacaacctgagatgacagtcaaaatagctggttacacaatacctaaaggttcacgcgtgttcataaatgtatgggcgataggtcgagataaagatgtatggacagaacctgagaagtttatgcctgagaggttcttgggttcggcaattgactttaagggtgtagattttgagctccttccatttggtgcggggcgtcgaatctgccctggaatggctttggcaattaggatggtgcatgtgatgcttgcttccttgttaaatcagtttaagtggagtcttcctattgagctggaacgtgatgggattgatatgcaagatcactttggcctgacactagtaaagaatgtgcccctttgtattatagcaacaccgatttcaggaaaataaaaggcaccatattaagagtgttttagacgttgttaatgtgtaataattcaaatgtatgagccatgtaatttatatcattacttatgtgacaaatttgatattctctcagagttcaaaccgtatgcgccttcgttatcca

SEQ ID NO: 3255 - DNA, 810 bp, Triticum aestivum
  misc_feature (153)..(153): n is a, c, g, or t
  misc_feature (155)..(155): n is a, c, g, or t
cgacttcctgggacgtgctgctcgacctggcggggggtgaggatggcaaggacctgctggaccgtgagacagtgcgctcacactttacggatttgttgcttgccggtagtgacacaagctctagcacagtggaatgggcaatgactgagcttntnaaaaacccatcatcaatgagtaaggtttgcaacgagcttgcgcaagttatcagcgcaggaagaaacattgaagaagctgatattgttcggttgccctatctccaagctatcataaaagagacttttcgactccaccctcctgcaccactcttgttgccacgccaaccagagacgacggtcaaaatagcaggttgcacaatacctaaaggttcacgcgtgttcataaatgtatgggcgataggtcgggataaagatgtatggactgaacctgagaagtttatgccagagcggttcttgggttcagcaattgactttaggggtgttgactctgagctccttccatttggtgcggggcgtcggatctgccctggaatggcattggcaattaggatggtgcatgtgatgctcgcttcattattaaatcagtttaagtggaatctccctgttgagctggaacgggatggaattgatatggaagatcaatttggcctgacgctagcgaaggtcgtgcccctttgtattatagcaacacccatttgagccaataaggaaatgcaacattgttgacaatggtgttgttgatgtgtaataatgtaaatgtatcagcctcgtagtttataccaataaatatgtgggaggggttcatattctctcc

SEQ ID NO: 3256 - DNA, 787 bp, Leymus cinereus x Leymus triticoides
  misc_feature (33)..(34): n is a, c, g, or t
atgtggcggcgcgtgaggacggcaaggacctgnncgaccgtgagacgctacgctcacagttcacggatttgtttgctgctggtagtgacacaagctctagcacagtggaatgggcaatggctgagcttctccaaaacccaacatcaatggctaatgtttgtgacgagcttgcacaagttatcggctcaagaagaaacattgaagaagctgacattgttcgattgccctatctccaagctgtcatcaaggagacttttcgactccatcctcctgctccactcttgttgccacggcaacctgagatgacagtcgaaatagcaggttacacaatacctaaagattcacgcgtgttcataaatgtatgggcgataggtcaagataaagatgtatgggctgagcctcagaagtttatgccggagaggttcttgggtttgacgattgacttcaggggtgcggattttgagctccttccatttggtgcagggcgtcggatctgccctggaaaggctttggcaattaggatggtgcatgtgatgctcgcttccttgttaaattagttcaagtggagtcttcctgttgagctagaacgagatgggatggatatggaagatcagtttggcctgacactagcaaaggtcgtacccctttgtattataccaacaccaatttgagccgaaaacaaaatgcaacattgttaagagtggtctagatgttgttactgtgtaataattcaaatgtatgagtcatataatttatattgttacttatgtgacaaatttgatattca

SEQ ID NO: 3257 - DNA, 685 bp, Triticum aestivum
ctggtagtgacacaagctctagcacagtggaatgggcaatgacggagcttctccaaaacccagcatcaatgtctagcgcttgcaacgagcttgcagaagttattggctccaaaagaaacattgaagaagacgatattgttcggttgccctatctccaagctgtcataaaagagacttttcgacttcatcccccgggccgttcttgttgccacgcaaacccgagagaacattaaaaatagccggttacacaatacctaaagattcacgtgtgttcataaacgtatgggcgataggtcgagataaagatgtatggactgaacctgaaaagtttatgccagagaggttcttgggttcaacaattgactttaagggtgcggactttgagctccttccatttggtgccggacgtcggatctgccctggaatgccattggctattaggatggtgcatttggtccttgcttcgttgttaaatcaatttaagtggagcttccctgttgaacttgaaagggatgggattgatatggaagaaaagtttggcctatcactaacgaaggtcgtgcctcttcgtattgtaccaacaccgatttgaattagaaacaaaatgtgtcccaaagtaagactgcttaatatgttttaatatgtaataatcaaaatgtattacccatggaatttataccgttat

SEQ ID NO: 3258 - DNA, 708 bp, Triticum aestivum
agcacagtggaatgggcaatgactgagcttctgcaaaacccatcatcaatgactaaggtttgcaacgagcttgcgcaagttatcggctcaggaagaaacattgaagaagctgatattgttcggttgccctatctccaagctgtcataaaagagacttttcgacttcatcccccgggcccgttcttgttgccacgcaaacccgagagaacattaaaaatagccggttacacaatacctaaaggttcacgtgtgttcataaacgtatgggtgataggtcgagataaagatgtatggacagaacctgagaagtttatgcctgagaggttcttgggttcatcaattgactttagggttgtggattttgagctccttccatttggtgcagggcgtcgaatctgccctggaatgactttggcaattaggatggtgcatgtgatgcttgcttccttgttaaatcagtttaagtggagtcttcctattgagctggaacgtgatgggattgatatgcaagatcactttggcctgacactagtaaagaatgtgcccctttgtattatagcaacaccgatttgaggaaaataaaaggcaccattttaagagtgttttagatgttgttaatgtgtaataattcaaatgtatgagccatgtaatttataccattatttatgtgacaaatttgatattctctcagagttcaaaccttatgcg

SEQ ID NO: 3259 - DNA, 927 bp, Triticum aestivum
gtattttgccgcatttcaaattcccaccatagcccttacatggactgcacttcatccaacgcacaagaaaataagtccacgcacaatggcttcttctattataatgcaatgggaagaatatcaaatctaactctgaaaataatggaattattgcttatataattcatccatacagtattgctatgtgcaccacaaaacaattttccattgttgtatagcagattagcaaattatccattgtacgttatgtgatgcttgtttagagtatctagatagctacatttgccagactatattgatgtgactttgcatgttaggatttgtttgccgccggcactgacacaagctctagcacagtggaatgggcattggccgagcttctccaaaatccatcatcattggctaaggcttgcaatgagcttgaacaagttatcggcccaacaagaaacattgaagaggctgacattgttcggttgccctatatgcaagctatcataaaagagacttttcgactccatcctcctgctccactcttgttgccacgccaacctgaagcaacactgaaaatagcaggctacacaataccaaaaggttcacgcattttcataaacgtatgggcaataggtcgagataaagatgtatgggatgaacctgaaaaatttatgccggaaaggttcttggattccacagttgactttagaggtgcggattttgagctccttccatttggtgccggacgtcggatctgccctgggatgacactggcaactaggatggtgcatttgatcctcgcttcattgttacatcagtttaagtggagtctccctgctgagatggaaagggatgggattgacatggaagataagtttggcctcacacttactaaggtcgttcccctttgtattgcagcaacaccagtttgaattg

SEQ ID NO: 3260 - DNA, 2152 bp, Zea mays
gtctccatctctgctaatctgtgaaactaatcatcatcgtctccagtctccctagtccctgctgccgctgccgcttgtcgctgacgccgtcgctcctccgcatctaagctgccagcggcgaccaaacccgctccgcctctcctccgtccgtccccgcaccagctggttccctcccgtgaactcgcacgctcacaggttttataattgtttgcaaaagggctatagtacttgatgagatgaagtcaacagtgttttcagcagctgttgtttctattgggtatgcattgcttggatgggattttgcagcattatcagaagctaatcatcatatggaaaaagaatttgaattgttgaatggaccttctattgaagctggagaatcatgattggtgcaatctttgctccttccatcgtctactttgctttgttggtttactacttgccagagtcacctaggtggcttgcaagtgatggaaagattagtgaggccagagtttctctgcagtggcttagaggaaagaaacatgatgtttcaggagagatagctgctattgtggaaggtgtggacatcatatcggactccactgttggcgctgctcgtgctcagagtttctctggaaccagtgctagccacacttggccccgtagtactttttattggcagctttcagacccactagttgatcttctcggaagcgttcatgagaatatgtcagaaggaggaagtagacggaatagtttcttcccagtcttcaacagtttttcttttccagagcatgaacatatgaatgaacacagggatggtaacagtgatcaacagactagggagacttattatgctggagaagctaataatggagatggtttaagggcttctctgctttctcaggcagcaagtgttgaagtaaatgatacaaatacctcttttacttctgaagggagctcttcatatttaagaaggcatggaacatcagtgcttgcacaagagtttatggcgtctatacatgattatgacattgaagaagaagaagaagaaatccatgggtttgcattgcctcaccagtctgcacctcgtgatatggaaagcaccgggagacatccattcagacatcaaatagtccggttatctgaaacagctgatatgaagtttaaatggcgggtgcttcttcaaccaggaatcaggcatgccttatgttatggcatgttaattcaagcccttcagcaatctacaggaatcagtggtcttctccgctgcgctcctgaaatatttgagcagtctggagtggctagtttgttttcagacattggactttctcctcattcaacatcaattctcatgagtacccttaatgctttgctgatactcccttgtataactgccgcaatgctgctgatggatgtctgcgggagaagggttattgtgctggccactactcctgtcctgatactatcattgagtgttatgtctatgtccaccctggtgaatatgggaccgttcgaaagtgccgtcctcttccacttcgcattaaccatttgcttctggtcctatgtcattggtttgggaccgataccaaacattctctgctccgagatattcccaaccaaggcccgtgcgacatgtgcaagtttctgttcgctttccttctggtttgggggcctgctttcagcgtactgcttcccggtgatgttgagcaccatcgggcttggcggagcgtgtgggatctatgcacttgtgtgctgcgctccgctttttctcgtctactatcgaataccagagacgaagatgcttaacctggagctcattgcggagctgttcaagctttcaaggcaggagcatgtacagtagattgtccaggaaccgaggtagcccaggctgagtgccgatggatggtgatgtgtgtacatatgacaaatgtaactttggatgctgaatttgtttttgctagttaggaggattggtgatagtgtacgaagtggtttactcttttgctgtccacaggttgctggcagtgtttgtagtgttttgtcttagggggaattcctgtactccactgtaattgtaatgtaccctataacttatttgtcatcgcaaatatcctaatgcaatttcttatccttccataccattgctagtggtatagaagggaccagg

SEQ ID NO: 3261 - DNA, 1326 bp, Sorghum bicolor
agaggagattttgtacatacatgtaaaatccaaattttggtttgtttcaggcccggcgagccctgcgcgcactacgtggcctggtgcgcctgcaggcgctggtgcgcggtcaccaggtgcggcggcaggtgcacctcaccatgcgctgcatgcaggccctcgtccgagcccaggcccgcgtccgcgcgcgccgcgtcacccagcacccgctcctcctcctcccgccgccgacacctccagccagccgcgccaccctgctaggagcgccatacgtcgagccggcattgcaaggccaccgcgacgtcagtgacgacggcgaggtggcagacctgctgctgaggcagagaagcagaagcagaagcagaggcaggctcggaagaggcgaggataacggcggcgggaggagcccttccggcgcctgggacagcagtagccgcaccctggaggacgccagggccgagggcgcgcgccggcacgacgccgccgcacgccgagagcgggcgctcgcctacgcctacgcctaccagcagcggcagtgccagcggcaggaggacgagaaggccggcctgggcttccactggctggagcgctggatggccgcgacgcaggcgcagcagcagcagcaggagcaggagcaggagcacgcgcccgaccacgccaagactacgcaccagagcgccaccaccaggacgacgtcctacgtcacggcggccgctgctttcccgaacggcatgtcggagaagacggtggagatggagacgtcgtttgggagtccactgaaccatcatgccgccacggttgcgcacgggcggccgcccgccatcccaggctacatggccgcgacaaggtccgctcgagccaaggcgcgtcccgtgccgccgtcggctacaccgacgcacgccaggagccggtccggcggcggtctcgccggggactcgtcgagctcgggccagaacggcagtgcgatcgccgggtacagcccggactcgagcggcacaggggaatggaccccgccgcggttcggtgtcagcacgcgcaccaccaacagcagggtggcctatacatgagcttaacttgagcatggcattcaagacaaaaatctaatgcatcgtcatgactcatgagtgtgcttgagagttgagacgtgttcgcgactcatttttggttgttcttgttgttcacaatgtatgtatagcttgctatgtcagatgccacggcgcttgatgctgctgtaaagtaaacgatctcaatactcaaaacggttgcaaataaacactcgagaattctaaatgtgttattatggctcagctgagattgaagcttttt

SEQ ID NO: 3262 - DNA, 1298 bp, Sorghum bicolor
ggcccggcgagccctgcgcgcactacgtggcctggtgcgcctgcaggcgctggtgcgcggtcaccaggtgcggcggcaggtgcacctcaccatgcgctgcatgcaggccctcgtccgagcccaggcccgcgtccgcgcgcgccgcgtcacccagcacccgctcctcctcctcccgccgccgacacctccagccagccgcgccaccctgctaggagcgccatacgtcgagccggcattgcaaggccaccgcgacgtcagtgacgacggcgaggtggcagacctgctgctgaggcagagaagcagaagcagaagcagaggcaggctcggaagaggcgaggataacggcggcgggaggagcccttccggcgcctgggacagcagtagccgcaccctggaggacgccagggccgagggcgcgcgccggcacgacgccgccgcacgccgagagcgggcgctcgcctacgcctacgcctaccagcagcggcagtgccagcggcaggaggacgagaaggccggcctgggcttccactggctggagcgctggatggccgcgacgcaggcgcagcagcagcagcaggagcaggagcaggagcacgcgcccgaccacgccaagactacgcaccagagcgccaccaccaggacgacgtcctacgtcacggcggccgctgctttcccgaacggcatgtcggagaagacggtggagatggagacgtcgtttgggagtccactgaaccatcatgccgccacggttgcgcacgggcggccgcccgccatcccaggctacatggccgcgacaaggtccgctcgagccaaggcgcgtcccgtgccgccgtcggctacaccgacgcacgccaggagccggtccggcggcggtctcgccggggactcgtcgagctcgggccagaacggcagtgcgatcgccgggtacagcccggactcgagcggcacaggggaatggaccccgccgcggttcggtgtcagcacgcgcaccaccaacagcagggtggcctatacatgagcttaacttgagcatggcattcaagacaaaaatctaatgcatcgtcatgactcatgagtgtgcttgagagttgagacgtgttcgcgactcatttttggttgttcttgttgttcacaatgtatgtatagcttgctatgtcagatgccacggcgcttgatgctgctgtaaagtaaacgatctcaatactcaaaacggttgcaaataaacactcgagaattctaaatgtgttattatggctcagctgagattgaagctttttaacggaaagcattcctatgag

SEQ ID NO: 3263 - DNA, 1541 bp, Saccharum officinarum
caaacagaaacatgtgaattacttatagtagaccgttcaatagatcagattgcgccaattattcatgaatggacttatgatgctatgtgccatgatctgctttgtatggatggcaataagtatgttcatgaggttccaagtaaaaatgggtcggcaactgaaaaaaaggaggtcctgttagaagatcatgaccctgtctggcttgagcttaggcatgcacatatagcagatgcaagtgagagactacatgataagatgaccaacttcatttcaaagaacaaagctgcacaattgcaccaagcacgaaccggtggggaattatctacaagagatttacaaaaaatggttcaggctcttccacagtacagtgatcaaattgataagctttccctgcatgttgagattgcaggaaaactcaataacataatacgggaacaatgtcttcgggatgttggacaactagagcaagatcttgtgtttggcgatgctggaacaaaagaactaatcaactttatgagaacacaattggttgtaagtcgtgaaaataagttacgcttgctgatgatttatgcagcacttaacccggagaagtttgaaagcgacaagggtgcaaaattaatgcagttggcaggattatctggtgatgacatgattgctgtaaataatatgcgttgcttatgtgggcctgataccaaaaagtcttcagtagggggttttacactgaaatttgatgttcataagaagaagcacgcacatagaaaagagcgaacaggggaagaatcagcatgggcactatcccgattttatcctattttggaggaattgattgaaaagcttagcaaaggtgagcttccaaaagatgaatataactgtatgaacgaccctagtcctagtgctcatggaccgccaaccagtagctctgcccgatcaagtcccgctcactctatgcgatccagacgaacaggtggcacatgggctagacctcgtggctctgatgatggatattcaagtgattctgtgttgaagcatgcctccagtgacttcaggaaacttggtcagcgtatatttgtttttgtaataggtggtgctactcgatcagagttacgtgctgcacacaagctttcatccaagctgaagcgagacatcatccttggttcatctagccttgatgatcctccccagttcatcacaaaattaaaattgatgtcagcagaagaattgacacttgatgatcttcagctgtaaatggtgtcatcgcccacttggaatgggttagttcaatatgaactttcgccataagttgtatgtacctttttattttctttttagttttctgtccgctcttgtttgtgggggcatatcatattcattcggtgaaatgtattcttaacaccacttttactggtgaatgtatataaatagtggccgacataactatacggatcaattttttagattgggccattggtttgttggtttcattttccctacgaacttctgtatccacatgtgatgaggcaggttatacttttgaatgtatt

SEQ ID NO: 3264 - DNA, 1604 bp, Panicum virgatum
caagacaattgatgcttctacaatgacaacactacgagacttggtccccacaaagcttgctgctggtgtatggaattgccttgcgaagtataaaatgacaatacctgaatttcctcaaacagaaacatgtgaattacttatagtagaccgttcaatagaccagattgcaccaattattcatgaatggacgtatgatgccatgtgccatgatctgctatgtatggatggcaacaagtatgttcatgaggttccaagtaaaaatgggtcagcaactgaaaaaaaggaggtcctgttagaagatcatgaccctgtctggcttgagcttaggcatgcccatatagcagacgcaagtgagagacttcatgataagatgacccactttgtttcaaagaacaaagctgcacaactgcaccaagcaagaaatggtggagagctatctacaagagatttacaaaaaatggttcaggctcttccacagtacagcgatcaaattgacaagctttccctgcatgttgagattgcaggaaaactaaataacataatacgggaacaatgtcttcgggatgttggacagctagagcaagatcttgtgtttggcgatgctggaacaaaagaagtaatcaattttttgagaacacaattgggtgtaagtcgtgaaaataagttgcgcttgctgatgatttatgcagcacttaacccagagaagtttgaaagtgacaagggtgcaaaactgatgcagctggcaggattatctgatgatgacatgattgctgtaaataatatgcgttgcttatgtgggcctgatacaaaaaaatccacaggaggaggttttacactgaaatttgatgttcataagaagaaacatgcacatagaaaagagcgaacaggggaagaatcagcatgggcgctgtcccgattttatcctgttctagaggaattgattgagaagctcagcaaaggtgagctgccaaaagatgagtataactgtatgaacgaccctagtcctagtgctcatggactgccaaccagtagctctctccaaacaagtccagctcactcaatgcgatctagacgaacaggtggcacatgggccagacctcgtggctcagatgatggatattcaagtgattctgtgttgaagcatgcatcaagtgacttcaaaaaacttggtcagcgtatatttgtttttgtcattggtggttctactcgttctgagttacgtgctgcacataaactttcatccaagctgaaaagggaggtcatccttggttcatctagccttgacgatcctccccaattcatcacaaaactgaagttgatgtcagcagacgaactgacacttgatgatcttcagatataaatagggccgtacccagttcgaagttggaatggtgctgttcaatatgagccgtaaatttgtatgtattcttatttcttcataattcttgtatcagcttgtgtgtggggcagcatcatattgattcggtagaaagtgtagactcaacagtacctttactctgattggattaatgtacataatagtgaacatcagctgtaactatacggagcatttttagattgggccaatggtttgttggtttcaa

SEQ ID NO: 3265 - DNA, 1244 bp, Brachypodium distachyon
tttctgtacagattgcaggaaaactcaatagcataataagggaacaatgtcttcgagatgttggacagctagagcaagatcttgtgtttggtgatgccgggacaaaagaattaatcaattttttgaggacacaattgggtgtaagtcgtgaaaataagttgcgtttgctgatgatttatgcagcaatcaacccagaaaagtttgaaagtgataagggcacaaaattgatgcagttggcaggattatccgctgacgacatgattgctgtgaataatatgcgttcgttatgttctgatacaaaaaagccctcaggaggaggctttacactgaaatttgatgttcacaagaaaaaacatggatacagaaaagagcgaacaggggaagagtcagcatgggcgctgtcccgattttatccagttctagaggaattaattgagaagctcagcaagggtgaattgccaaaagatgaatataactgcatgaatgaccctagtcccagtttccatggattaccaacgaccactaccagcagctcagcccgcacaagcccagctcactcgatgagatctagaaggacgggtggctcatgggctaggcctcgtggttctgatgatggatattcaagtgattcggtattgaagcatgcatctagtgatttcaaaaagcggggccagcgaatatttgtttttgtcattggtggtgctactcgatcagagttacgtgctgcacacaagcttacatccaagctgaagcgggaggtcatccttggttcatccagccttgatgatccaccccagttcatcacaaaactgaagatgatgtcagctgaagagttgacattggacgatcttcagatataaaaaaaaataacggacatggactctggctccatcaggaatttctccttgtacttattttagtattttctttgtgatcgttaggtctagttatgagctaattgcattaaccacaggctatcgatgcattaaccacaggcagtcctgtatcatattcattttagtagggagtgtattctctacaccggctactcataattgaatgaatgtacataacagtggccggcaactgtaactatgtgattttatttttggttgggctggtggttggtttgttatctccacttaatgagaaatgttgtatgtttgtgacccaagtaacatgcacacgcctgtgagttttcctggtattataaatggaatgatctacattattccatttcaaga

SEQ ID NO: 3266 - DNA, 1753 bp, Avena sativa
ggcattggaggagctttctgcgagagcgcagaaggctttaacaagtacaatgcgtgtttgaacacaatggctactcgtatatcaacagtatttgcatcaatgagggaatttccccgtgtgcactaccgcgttgccaagacaattgatgcttctacaatgacaacacttagggacatggtgcccacaaagatagctgctggtgtgtggaattatctctccaaatataaaacatcaattcctgaatttccacaaacggaaacttgtgaactgctcatagtagaccgttcagtagatcagattgcaccaataattcatgaatggacttatgatgccatgtgccatgatctgctattcatggatggtaacaaatatgtacatgaggtcccaagtaaaaatggttcagcctcagaaaaaagagaggttctgttagaggaccatgatccagtttggcttgaacttcgacatgcccatatagcagatgcaagtgaaagactccatgataagatgacacatttcgtttcgaagaataaagctgcccaattacaccaagcaagaactggaggagagctatcaactagggacctacaaaaaatggttcaagcccttccacagtatagtgatcaaattgacaagctttctctgcatgtcgagattgcaggaaaactcaatagcataataagggagcaatgtcttcgagatgttggacagctagagcaagatcttgtctttggtgatgccggaacaaaagaattaatcaattttttcaggacgcaattgggtgtaagtcgtgaaaataagttgcgcttgctgatgatttattcagcaatcaacccggataagtttgaaagtgataagggcacaaaattgatgcagttggcaggattatctgctgatgacatgaatgctgtgaataatatgcgctacttatgtgctgacataaaaaagcccccaggaggaggttttacactaaaatttgatgttcataagaaaaaaaatggacatagaaaagagcgaacaggggatgaatcagcatgggcattgtccagattttatccggttttggaggagttgattgagaagctcagcaggggcgagttaccaaaagatgaatataactgcatgaacgaccctagtcccagtttccatggactacctaccagtacaagcacctcagcccgcacaagcccagctcactcgatgagatccaaaaggacgggtggttcatgggctaggcctcgtggttctgatgatggatattcaagcgattcagtattaaagcatgcttccagtgacttcaaaaagcttgggcagcgaatatttgtttttgtcattggtggtgctactcgatccgagttacgcgctgcacacaagctcacatccaagctgaagcgggaggtcatccttggttcgtccagccttgatgacccaccccagttcatcacgaaactgaagatgatgtcagccgaagagctgacactggatgatcttcagatataaaagcattatgcacatgggctgtggcgccatccggaatttcctcattgtacttattttgttactattaactttgtgatcgttagtcctagttacacgatcacatcaaaccacaggctatcagtacgttaagctgcatcatattcattttgtagggaatgacttctcaaaaccggctactcatatttgcatgtgtacataacagtaaccagcaactgtaactatgtgaggattttttatctggctaatggttggtttt

SEQ ID NO: 3267 - DNA, 1450 bp, Saccharum officinarum
tcaatagatcagattgcaccaattattcatgagtggacatatgatgctatgtgccacgatctactgtgtatggatggcaacaagtatgtgcaagaggttgcaagtaagaatggttccgcaaatgagaaaaaggaggttttgttggaggatcatgatccagtatggcttgagctgcggcatgcgcatatagctgatgctaatgaaaggctgcatgaaaagatgaccagttttgtatcaaagaacaaagcagctcaactacagcaggcaagatctggtggagagttatctaccaagcagttgcagaaaatggttcaagctcttccacaatacagtgatcaaattgacaagctcacccttcatgttgagattgcaggaaagcttaataatataatcaaagaacaacacctcaaagatgttggacagctagagcaagatcttgtgtttggtgatgctgggacaaaagaactaatcagtttcttacgaacccgcatggatgtaagtcgtgaaaataagctgcgtttgctgatgatttatgcttccatcaacccagagaagtttttcgaaagtgagaaaggtgcaaagctgatgcagcttgcaggattatctgctgatgacatgattgtagtaaataatatgcgctgcttacgtggacctgatactaaaaagtcttcagttggggcctttactttgaaatttgatcttcagaagaaaaagcctggtatcagaaaggagcggattggggaagagtcaacatggatgctatctcgattttatcccatcctggaggacttgattgagaaacttagtaagggtgagctaccgaaggatgagtaccactgcatgaatgaccctagtcctagtttccgtggaattccaggaagcacatctgctcaaacgagcccagctcatcagccggcccaatccatgagatctagacgaataggtggcacatgggctagacctcggaactctgatgatggttattcgagtgactctgtactgaagcatgcatcaagtgacctcagaaagttgggccagcgcttatttatctttgtaattgggggtgctactcggtctgagttgcgtgttgcccacaagctgtcaggcaaactgaagagagaaattatccttggctcctctagtcttgatgacccaccgcagttcatcactaaattgaagatgttatcaaccgaggagctgtcgctggatgatttgcaaatataacaatgccaaggacgattggccttgacattctccactgtaattatttacttgcatcactacaacgggtttagttatactcccttaaccttgtaccgaaccacaggctctcttacacaggctagaggggcatgaatcatgatattcattcggtagccaccgtcagatattcacaatccagtgtacatacatgacagcgaccagagactgtaatataggtggcaacttt

SEQ ID NO: 3268 - DNA, 2031 bp, Saccharum officinarum
ccaccgccggagccgaacactcctcatctcccatcccatttccgggagagccagtcgccactgctgcatctcaagggcagaggtcgtcgtaccgatcgccttcgccgcagaacaggtgccattccgctcgctctccggctctctcctccggacgtgggcgctctcccagaacaaaacgcctacctactctctaggtgacgtttcggaaagttcgttgaggcatcaaagaattgcctgccctgcgccgtgtgacggcgcagcatgaactgcttcgccggtctgctcagcggcaagaggaaggcatccaagggtaagagcaagggcgcttacgccaacaaggctagcggcaatgattgccccaaggtgaagcccgtggagttcatggacatggcttacactgttgtagacgacgccagctggtgccgagacactgttcctgcgtctgcatgcaacagtaggtttgtcgttcacgcacccgccgagctagcaggccatgccagtggccacaacggcgacaaggccgcagttaagaaggactcatccgccggcgttggctcctcctccggttacagcagcgatgccaagagcgccgagccggacgacggcgagcgctccagccttggccgcatgtcgccaacggcatcgccaaagctgatgcgctcctgctccaacatcgagacggcgaggtctgtcgtcccggcagggtccgacctgccggcgaagtcgcgctcctacaacgacctgaagaccctgccccccggacggtcgaccgcccgcagcggtgtgatcgacgcgagcccgacggcatccttcaggacctcgtgctccgccgaccgcgtcatgctgaagaagcggtcgtcgaggcaggtgctcccgtcccggagccggaagctgtggtggcagatgttcctctggagccaccgcaacctgcaccggccgggcgcgaacgcgaccatgcccacgatgcttccatctccggggaaagaagaagaaggcggtgcggcgcaccaacacgacgggtacacgtccgacacgctgggcgcggtcaccgcggccgacgccaagaacaagggcgtcgccgtggaggcggaccccatcccgagccagtgggtcgcgttctcctcgccgctggaccgggtcagcgcgtgggtgaacagtctcgggaacggctcgttccacgccgtcgacgagggtgatgccacggggcactttggcgacggcggcgcctctcgcccgcaaccgcggtgctctgagatcgtggagctgtcgacgacgacggccggcggcaagaggcatccgccgcaggcgaagcggcgcgcggcggatgaggctgcccaggcgagcggcatcgtgcagacgctcaacagcttctcccccgtcgcgcacatcgccggcatggggcttaaggccgtcccgacgatcgcggccttctcgaccctccgggccgtaaatctgtctggaaacatgattgttcaaatcagcgctggatcgttgcccaaaggcctgcactcgctggatctgtcgaggaacaagattgcaatcatcgaggggctgcgcgagctgacgaggctgcgggtgctcaacctcagctacaacccggatctcacggatcgggcatggcctgtcgagctgcacggcgatcagggagctgtacctggccgggaacaagatcagtgacgtggaggggcttcaccggctgctcaagctggccgtcctggacgtgagcttcaacaagatcaccacggccaagtccctgggccagctggtggccaactacggctcgctgcgggcgatcaacctgctgggcaacccggtgcaggccaacaccggcgacgacacgctccgcaaggccgtgtcgggcctgctcccgcggatcgagtacctcaacaagcaggccgtgaagccgcagcgcgcgcgggaggcggccaaagacagcgtcgcgcaggcggcgctcgggaacgccggctggaactcggggaggcggctcacgcggcgcctcaccagagccccgggtcgtcggtgaagggacgg

SEQ ID NO: 3269 - DNA, 715 bp, Saccharum officinarum
cccacgcgtccgcgctcttctgctcacacaaccacggccgtctcgagctcgaccgcagccgcaatgccgtggctcctagtcgtcgcggtgcttgccggcttcgcgcttggtccctccgccggcacggaccacatcgtgggcgccaaccatgggtggaaccccaacatcaactactccctctggtccggcaaccagaccttctacgtcggcgacctcatctcgttccggtaccagaaggggacgcacaacgtgttcgaggtgaacgagacggggtacgacaactgcaccatggccggggtcgccggcaactggacctccggcaaggacttcatcccgctccccgaggcccgccgctactacttcatctgcggcaacggcttctgcctgcagggcatgaaggtcggcatcaccgtccacccgctcccgcacaacgccacctccaagggctccaacagccgtgggagcaccggtgcacaggaagaggccgccgcggcggctcttggggccaggagcgccgcgtggctggcgacgcttgcagtcgtcgcagctgcagtggctgctttctgctaggacctttttattccaagcattctctgaacattgttctagtattatttgttttgcttttgccccaatttcatttgtgtttttaactcctctgcaagtaaatctgcttgtcatgagtaatgctaagctaagaatttactactgattc

SEQ ID NO: 3270 - DNA, 1050 bp, Zea mays
gctcaattcccgccaaatctgctgaaatccgtggtgccccaacaaaaaaagcgggccacacccacactccgcagcaaaaccatactcgagtcgggctcggggctgacactagcgatataattggtgctgctgccgggctcctgtgtcctgtctcctttcctacgcggctacgccggtccgcccactgactgtacgacagcacttccgccgcagttcacttgctctctgcctcctcttcgctcttctgctcacataaccacggccgtctccccaacgtggtgctcgcaccgcagccgcaatgtcgtggctccttgtcgccgcggtgcttgccggcttcgcgcttggtccctccgccggcacggaccacatcgttggggccaaccatgggtggaaccccaacatcaactactccctctggtccggcaaccagaccttctacgtcggcgacctcatctcgttccggtatcagaaggggacgcataacgtgttcgaggtgaacgagacggggtacgacaattgcaccatggctggggtcgccggcaactggacctccggcaaggacttcatcccactccccgccgcccgccgctactactttgtctgcggcaacggcttctgcctgcaaggcatgaaggtcgccatcactgtccacccgctcccgcacaacgctacctccaagggctccagcagccatgcggacaccggcgcacaggaagaggccgccgcggcggcgctcgggaccaggagcgccgcgtggctggcgacgctcgcagtcgccgcagctgcagtggctgctttctgctaggagccttattccatgcattcactgaacattgttctagtatttttgtttttgctcccatctcattcggatctttcacttttctgcaagcaaatctgcttgagaagctaaactacccttccgacaactcatcaatgcatttcacaaaaaaaccaatttaagcaccaacatgccatgtattacaggttgcgacgactctgaacactagaaagaaggaagcaacaaaccctataagagattgtcgaata

SEQ ID NO: 3271 - DNA, 878 bp, Setaria italica
ctccccgcaaagcactcccacagtcccacttgctgctatttctcatcgccgctcgtatcctgcgtgcgcacacagccgccgagccacggccgtttcgctcgcccacagcgcccgccatgtcgtggctcctggccgtcgccgtgctcgccggcttcgcggttgatctgtcggcggcgacggaccacatcgtgggcgccaaccacgggtggaaccccaacatcaactactccctctggtccggcaaccagaccttctacgtcggcgacctcatctcgttccggtaccagaaggggacgcacaacgtgttcgaggtgaacgagacggggtacgacaactgcaccatggacggggtcgccggaaactggacctccggcaaggacttcatcccgctccccgaggcccgccgctactacttcatctgcggcaacggcttctgcctgcaaggcatgaaggtcgccatcaccgtccacccgctcgcgcgcaacgcctcctcatccaatggctccagcggccacggcagctccggcgcgcagggagaggcctccgcggcggcgctcgggacgaggagcgccgcatggctgccagcgctcgcggccgccgttgctgctatctgttaggagttggattcccagatttctctgaacatttttgttttattatctctgtgttctgctccttttgctcccatttcatgggtcttcatcaaatttgcatcaacttctctgcaagcgagactgcctaagaagaaagctatctcctgacaactcatccatgcattccacaaaacccggtttaagaaacaacacgccatgtattacaggttgcgaccactctgaacactagaaagaaggaacaaaccctatagagattgtcgaata

SEQ ID NO: 3272 - DNA, 527 bp, Setaria italica
ccgtttcgctcgcccacagcgcccgccatgtcgtggctcctggccgtcgccgtgctcgccggcttcgcggttgatctgtcggcggcgacggaccacatcgtgggcgccaaccacgggtggaaccccaacatcaactactccctctggtccggcaaccagaccttctacgtcggcgacctcatctcgttccggtaccagaaggggacgcacaacgtgttcgaggtgaacgagacggggtacgacaactgcaccatggacggggtcgccggaaactggacctccggcaaggacttcatcccgctccccgaggcccgccgctactacttcatctgcggcaacggcttctgcctgcaaggcatgaaggtcgccatcaccgtccacccgctcgcgcgcaacgcctcctcatccaatggctccagcggccacggcagctccggcgcgcagggagaggcctccgcggcggcgctcgggacgaggagcgccgcatggctgccagcgctcgcggccgccgttgctgctatctgtta

SEQ ID NO: 3273 - DNA, 1241 bp, Zea mays
gcacgactgcacgagtcgcggtcggtcgttttcttctccctcccgaacggcaacatttcttttctccaaaccatataccctagcccgtgcacaggtgggcgcccgccgccacctgcggctcggtggactccggcatcgacacccctggcccccagcgccgcagatcgcaagctctcagcaacgcgtgcttggtaggaacccgtgccgaccgactcttcctctgcgggacggtctcgagtttggtcgggagatgggtgacgggagctgctgcgtctgcaaggaggcgccgcccaagtacaagtgcccttcttgtcgcacgccctattgctctgtcacatgctttaaaaagcacaaagaggaatcttgtcaaaagatattgcatcaggaagaaattagcaagtcagcattgcaggaggaagttacactgcacaccacatgcactgcagaatctccaaatacagcgtgccctacaaaagctcttgaagttgaggacctaagctggcttgttgacaacaatagactaaggtccttagcggaactgaaagggatccaagacgctctcagggatcctgaactgcagagaatgatacttcaaattgatgggtcttccgaatcagaaaaagaattggagaaagtgatggaaggtcaagcttttcgcgagttcactgataagattcttgacattgtcaacccacaagaataaccgtctaccctgtttggtgggattctgacgctagagtaaacagaagcatccgggcaaacaaagcaaaagtggagctcatctctgttttcctttttccaggatggtataattcataacatatcttgagtcgcctgtttttccatgatggggtagactttagaacacatactgtgtcgcctggtgaaaggaaattacgtctgctgaaaaatctctcttgccaaatatagtttttcttctgtattctagtgttgtattctagtgtggtagacagcgactctacactgactactgagggtgtgtttggtttggttttgacttttgctctctaaaaacgaaaagcaaacggcccgagccagaaagcagcttttttcaaaagcatgctttcttgcaatgcaaattgaaagcacatttgaatctatttttagcggcttttgaatggaaccatgtaaataatatggaagaacttgtagcgacttttagtggcttctaaccaacggtataatatgaaagaatttgtagcgacttttagtggtttcta

SEQ ID NO: 3274 - DNA, 1737 bp, Zea mays
gaaatcccggattctgatttggactgcaccggtgcacctcctgcctgccaagtgccaacgcacaccggagagccgcgacctctccgtcgccctcgccccctcccaccctcctctgccctgcgttgtcgtctccctcgccagtccgtcgcgcccgccgaggagctgagctgaaccgaggccggccgttgcgcgccgcccgagaagaagacgaagacgagcagacgacggctcctctcctacgccgtcctctctctcttgaactgaaacagcgtcgcccacatgctgatcggcatgccgcaggcagcagcagcagtagtgcacggcaaggaccccagcaccgtccgtccggcggcggcgctgcccctgaagctcctccgccctctcctcctcgtggcggtgctcggcacgggcttcctcgccgccgtggcgctgctcgtcggcggccccgcctactcgtccgcgctcccgcgcccgccggtcgccctgccgcccgcgccgccgtcgggcggcgggaagcagccgctggagcggtgggcgcgggcgccggcgtccgcgtggcacaacatgaccgacgacgagctgctgtgggcggcgtcgtggcgccccagcgtccggcgctacccgtaccgccggacgcccaaggtggccttcatgttcctgacccgcggcccgctgccgctggcgccgctgtgggagcgcttcttcgccggcgccgggggcggggacgccggcctcttctccgtctacgtgcacgccacgccggggtaccgccccgacttcgcgccggcgtccgccttctaccgccgccaagtgcccagccaggtggccgagtggggcgagccgagcatgttcgacgcggagcggcggctgctggcgaacgcgctgctggacccgggcaacgagcgcttcgtgctgctgtccgagtcgtgcgtgccgctgtacggcttcccggcggtgtacagctacctgacgcggtcgcgggagagcttcgtgggcgcgttcgacgacccgggcccgggaggccggggccggtaccagggcgggctggccccggaggtggtccgcgagcagttccgcaagggcgcgcagtggttcgaactggagcgcgccctcgccgtcgacgtggtcgccgacggccgctactaccccaagttccgggagcactgccggccgccgtgctacgcggacgagcactacctgccgacggcgctctccatcctggcccccgcgcggatcgccaaccgcagcgtcacgtgggtggactggtcccgcggcggcgcgcacccggccacgttcggggaggccgacgtcggcgaggcgttcctcaggcggctcacggcgcccgggaaggaccagggcaactgcacctacaacggccagccggcgcaggtgtgctttttgttcgcaaggaagctggcgcccggcacgctgcagccgctgctcaggctcgccccgaagctgctcggatacggctgactgtcactgtcactctgactgctcacctctgaatctgaatctgaatcttctccaacgtgacacaaagacacctctgaatctgatttaacgcacaactgtgttacaatctactactagtatgactaaacacatttagtatgactaaaggcatgccattacagttgattgctatgaatatgtactctagactcgatgatcgtcatccatcatcgagcagtgtagctccatcacgtacacaattatacacaaacttgctccaaa

SEQ ID NO: 3275 - DNA, 1897 bp, Secale cereale
gggcggcgacgggcgcacgcacgcacgcagaggcggacgcggacgggactctcgccgtcaggaggaggactgcgccgcacgagaggcgacgagcgatggcggccgggacgggccgggtgctgccgctgctggccgtggcggcggcgctcgcggccgcgctcctctacggcgcgcccttctccaagagcctgggcggcgaggggtgcagcctgctcccgcacggccacttctggatcgccagccagcgggtcgtcgcgctcggccgcgtcggccccgccgcagtggaggtgaaggaggggctgatcaacgccatcgccgtcggggactaccggagcttcgtgctccgccgcccgctcgttgactacggggacgccgtcatcatgcccggcctcatcgacgtgcacgcacatctcgacgagcccggccgggaggagtgggagggcttctccaccggcacaagggccgccgccgcaggtggcataactacgttggtggacatgcctctcaacagctacccttccacggtctctgaagaaaccctcaaactcaaggtggacgcagctcgggataagctatatgttgatgtcgggttttggggaggccttgtacccgagaacgccttgaacccaagcaaattggagagcctgctaaatgcaggagtgttagggcttaagtcttttatgtgcccctctggtatcaacgacttccccatgacaaattcaactcatatcgaggagggcctggttacattggcaaagtacaagagacccttacttatccatgcagaacgcataccggatgtcgcgagtgatgagaagctcgatggcgaactagatccccgatcttacgcaacatatctcaagtctagaactccagcatgggaggaatcagccgttagagatttgaaacgtgccatgaaggacaccgaggtggggggccggtcagaaggagctcatcttcacattgttcatctctcagattcaaaaactaccctcgagcttctaaaggatgcaaaacacagcggcgcaaaagtcacaatagaaacctgtcctcactacctcgcattttcggccgaggaagttccggatggggacactcgtttcaagtgctctcctcctatacgtgatgccgccaacaaggaaaacctttgggaagctctgcttgacgggcacatcgatatgctcagctcggaccactcgccctcaacccctgatctcaagctaatggaggaaggcaacttcatgaaggcatggggaggtatctcatctctgcagtttgtcctccctgtaacatggtcatacgggaaaaagtacggcatcactctaaaccagctagcctcgtggtggagcgagaagcccgcagagctcgcggggcagaagaacaaggggtctcttctaccggggtaccatgccgacatcgtggtgtggaaacccgaggcgcagttccatctcgacgacacccatgccgtgtaccacaagcaccggaacatctcggcgtacctagggaaggagctatcgggcaaggtgctgtcgacgttcgtgagggggaacctggtgttcgccgagggaaagcacgccggggccgcctgcggcgccaccatcctcgccaagtagaactgtagagctacgatgtcattgctgatttctagcgtatatgatcgtgtgcgctgtgtagcatgtatatgtagccgtttccctgtgtatcattggatccgtcgcatacatccattccccaccattgttgtatatccatccattcattggacagcaccagtgtaggttatttctctgaattattcagatgcagtaccccatctattgtactgtatgtggaagtacagtgctgaacttctgataacatctatgagtatgaaaaggaggtgaactattctgaaact

SEQ ID NO: 3276 - DNA, 1893 bp, Hordeum vulgare
acgcacgcagacgcggccggacaggactctcgccatcaggagagagatagagaggtaggggacgagcgatggcggctgggaagggccgggtgctgccgctgctggccgtggcggcggcgctcgccgccgcgctcctctacaccgcgcccttctccaagagcctgggcggcgaagggtgcagcctgctcccgcacggccacttctggatcgccagccagcgggtcgtcgcgctcggccgcgtcggccccgccgcagtggaggtgaaggaggggctgatcaacgccatcgccgtcggggactaccggagcttcgtgctccgccgcccgctcgtcgactacggggacgccgtcatcatgcccggcctcatcgacgtgcacgcgcatctcgacgagcccgggcgggcggagtgggagggcttctccaccggcacaagagccgccgccgcaggtggcataactacgttggtggacatgcctctcaacagcttcccctcaacggtctctgaagaaactcttaaactcaaggtggatgcagctcgggataagctatatgttgatgtcgggttttggggaggccttgtacccgagaacgccttgaacccaagcaaattggagagcctgctaaatgcaggagtgttagggcttaagtctttcatgtgcccctctggtatcaacgacttccccatgacaaattcaactcatatcgaggagggcctagttacattggcaaagtacaagagacccttgcttatccatgcagaacgcataccggatgtcgcgagtgatgaggagcttgatggtgaattggatcctcgatcatacgcaacatacctgaaatctagaacacctgcatgggaggaatcagccgttagagatttgaaacgtgccatgaaagacactgaagtggggggtcggtcagaaggagctcatcttcacattgttcatctctcagattcaaaaactagcctcaggcttctaaaggatgcaaaacacagtggcgcaaaagtcactatagaaacctgtcctcattacctcgcattttcggctgaggaagttccagacggagacactcgtttcaagtgctctcctcccatacgtgatgctgccaacaaggaaaacctctgggaagctctgcttgacgggcacatcgacatgctcagctcagaccactcgccgtcgactcctgatctcaagctaatggaggaaggcaacttcatgaaggcatggggaggtatctcatctctgcagtttgtcctccctgtaacatggtcacacgggaaaaagtatggcatcaccctgaaccagctagcctcatggtggagcgagaagcccgccgagctcgcggggcagaagaacaaggggtctattctgccggggtaccatgccgacattgtggtgtggaatcccgaggcacaattccatctcgacgacagccatgccgtataccacaagcaccggaacatctcggcgtaccttgggaatgagctatcgggcaaggtcctgtcgacattcgtgagggggaacctagtgttcgccgaaggaaagcacgctggggccgcctgcggcgccaccatcctcgccaagtaaaaccgtagagctagaatgttgttgccgatttctagcgtatatgatcgtgtgcgcttgtgtagtatgtatgtgtgcaggtctgtagttgtttccctgtgtataatttggatccatcgcatgcatccatccatcccatcccccaccattgttgtatacccacccattcattggacagcaccagtgtaggttatatctctgaattattcagatgcagtaccccttctattgtacaatgtggaatgtgaattgttctgctgctttttatcttctgataatatctatgaaagcaatgtgaatagttctgcta

SEQ ID NO: 3277 - DNA, 1787 bp, Avena sativa
gatggtggcgtcggcggcgtcggggaaggtcctgccgctgctggccgtggcggcggcgctcgcggccgcgctcctctacgcagcgcccttctccaagagcctgggcggggaagggtgcagcctcctcccgcacgaccacttctggatcgccagcgagcgggtcgtcacgctcggccgcgtcggccccgccgcagtggaggtgaagggaggtctgatcaacgccatcgccgtgggggactaccggagcttcgtgctccgccgcccgatcctcgactacggggacgccgtcatcatgccggggctcatcgacgtgcacgcgcatctcgacgagcccggacgcgcggagtgggaggggttctccaccggcaccagagccgctgctgcaggtggcataacaacgttggtggacatgcctctcaacagcttcccatcaacggtttctgaagaaactctcaaactgaagttggacgcggctcgggataagctatatgttgatgtcgggttttggggaggccttgtaccagagaacgccatggacccaggtaaactggagagcctactaaatgcaggagtgttaggactcaagtcctttatgtgcccctctggtatcaacgacttccccatgacaaactcaactcatatcgaggagggcctggttacattggcaaagtacaagaggcccttacttatccacgccgaacgcataccagatgtcgcaagtgacgaggagctagatggtgaactagatcctcgatcttacgcaacatatctgaagtcaagaccagcaacatgggaggaatcagctattagagatttgaaacatgccatgaaggacacggaggtggggggtcggtcagaaggagctcaccttcacattgtccatctctcggatgcagaaactaccctcgagcttctaaaggatgcaaaacacagcggcgcaaaactcagtatagaaacctgtcctcattacctcgcattttcagctgaagaagttccagatggggatactcgtttcaagtgctcccctcctatacgtgatgccgccaacaaggaaaatctctgggaagctctgcttgatgggcacatcgacatgctcagctcggaccactcaccgtcgactcctgatctcaagctaatggatgaaggcaacttcttgaaggcgtggggaggcatatcatctctgcagtttgtcctcccgataacatggtcacatgggcaaaagtacggcatcactctgaatcagctagtctcgtggtggagcgagaagcctgctgagcttgcggggcaaaagaacaaggggtctattctgccaggttatcatgccgacatcgtagtctggaaacccgaggcgcggttccatcttgatgacagccatactgtataccacaagcaccggaacatttcggcgtatcttggcactgagctatctggcaaggtcttgtctacttttgtgagagggaacctggtgttcgccgaagggaagcacgccggtgctgcttgtggtgtccccatccttgcaaagtaaaaaacaaatgctgattcgtagcgtttgtggcgtatatgatcgtgtgcgctttgtatatcgatttgtagttagtctccttttgtatagttgcatccatagcatctccagcattgttgtataccccatccacttattggaattctgcctcacttggacagcatagtatagtaggatatctgaatttgatttttttcagaaatattcagatgtactcacttcgattgtatgtgcaagtacaattatcataatatgtattctactg

SEQ ID NO: 3278 - DNA, 1848 bp, Avena sativa
cgagggacggaaagggacggcactcgccctcgtctcgtcgtcatcgtcaggagagaggagcgatggtggcgtcggcggcgtcggggaaggtcctgccgctgctggccgtggcggcggcgctcgcggccgcgctcctctacgcagcgcccttctccaagagcctgggcggggaagggtgcagcctcctcccgcacgaccacttctggatcgccagcgagcgggtcgtcacgctcggccgcgtcggccccgccgcagtggaggtgaagggaggtctgatcaacgccatcgccgtgggggactaccggagcttcgtgctccgccgcccgatcctcgactacggggacgccgtcatcatgccggggctcatcgacgtgcacgcgcatctcgacgagcccggacgcgcggagtgggaggggttctccaccggcaccagagccgctgctgcaggtggcataacaacgttggtggacatgcctctcaacagcttcccatcaacggtttctgaagaaactctcaaactgaagttggacgcggctcgggataagctatatgttgatgtcgggttttggggaggccttgtaccagagaacgccatggacccaggtaaactggagagcctactaaatgcaggagtgttaggactcaagtcctttatgtgcccctctggtatcaacgacttccccatgacaaactcaactcatatcgaggagggcctggttacattggcaaagtacaagaggcccttacttatccacgccgaacgcataccagatgtcgcaagtgacgaggagctagatggtgaactagatcctcgatcttacgcaacatatctgaagtcaagaccagcaacatgggaggaatcagctattagagatttgaaacatgccatgaaggacacggaggtggggggtcggtcagaaggagctcaccttcacattgtccatctctcggatgcagaaactaccctcgagcttctaaaggatgcaaaacacagcggcgcaaaactcagtatagaaacctgtcctcattacctcgcattttcagctgaagaagttccagatggggatactcgtttcaagtgctcccctcctatacgtgatgccgccaacaaggaaaatctctgggaagctctgcttgatgggcacatcgacatgctcagctcggaccactcaccgtcgactcctgatctcaagctaatggatgaaggcaacttcttgaaggcgtggggaggcatatcatctctgcagtttgtcctcccgataacatggtcacatgggcaaaagtacggcatcactctgaatcagctagtctcgtggtggagcgagaagcctgctgagcttgcggggcaaaagaacaaggggtctattctgccaggttatcatgccgacatcgtagtctggaaacccgaggcgcggttccatcttgatgacagccatactgtataccacaagcaccggaacatttcggcgtatcttggcactgagctatctggcaaggtcttgtctacttttgtgagagggaacctggtgttcgccgaagggaagcacgccggtgctgcttgtggtgtccccatccttgcaaagtaaaaaacaaatgctgattcgtagcgtttgtggcgtatatgatcgtgtgcgctttgtatatcgatttgtagttagtctccttttgtatagttgcatccatagcatctccagcattgttgtataccccatccacttattggaattctgcctcacttggacagcatagtatagtaggatatctgaatttgatttttttcagaaatattcagatgtactcacttcgattgtatgtgcaagtacaattatcataatatgtattctactg

SEQ ID NO: 3279 - DNA, 1824 bp, Setaria italica
gacgcagcaaaaacagaaagggacggcacttaggcgaggaggaggaggagccatggcggcatcggcgaaggggcggctcgtgccggtgctcgcggtggtggcggcgctcgcggccgcgctcctctaccgcgcgcccttctccaagagtttgggcggcgaagggtgcagtctcctcccgcacgaccacttctggatcgccagcgaacgcgtcgtcacgctcggccgcgtcgggcccgccgcagtggaggtcaaagggggactgatcaacgcgatcgccgtcggggactacaggagcttcgtgctccggcggccgctcctcgactacggtgacgcggtcatcatgcccggactcatcgacgtgcatgcccatctcgatgagcctggacgtgaagagtgggagggcttctccactggtacaaaggcagctgctgcaggcgggataacaacgctagtggacatgccactcaacaactttccatcaacagtttctgaagaaactctcaagctgaagctcgaagcagctcgggataagctatatgttgatgtagggttctggggaggtctcgtgccagagaacgccttcaacccaagtgctctagagagcctcctaaatgcaggagttttaggactgaagtcttttatgtgtccctcgggcatcaacgactttcccatgacaaattcaactcatatcgaggaaggattggtcacactggcaaaataccagagacctttgcttgtccatgctgaacgtatacctgatgtcgaggatgaagatggactcgatggtgaactagatccccgatcctatgcgacatatctgaagtctagaccaccagcatgggaggaatcagctattagagatttgcaacgtgcgatgaaggatacagaggcaggaggtcggtcagaaggagcccatattcacatcgttcatctgtcagatgcaaaaacttcccttgaacttatgaaggatgctaaacgcactggtgcaagtgtgactgtagaaacatgtcctcattacctggcattttcagctgacgaagttccagatggggatactcgcttcaaatgtgctcctcctatacgtgatggcatgaacagagaaaatctttggaaagctctgcttgacgggcacatagacatgttaagctcagaccactcaccgtcagctcctgatctcaaactaatggaagaaggcaactttttaaaggcatggggaggtatatcatcattgcagtttgttcttcctgtgacatggtcgtacgggaagaagtatggcattactctgaatcaactagccgcatggtggagtgaaaatccagctaagcttgcagggcaaaagaacaagggagctattctgccgggataccatgctgacattgtagtatggaaacctgaggcacagttcgaacttgatgacagccattctgtatatcataaacatcggaatatttcagcatatttaggtaaagagctttctggtaaggtcctgtctacttttgtgagaggaaatcttgtatttgctgaagacaagcatgcaaaggctgcctgtggtgtccaaatcctcgccaaataaaattgtggatgcaaagctgctccagtactgcacttgttgatccatagcgtatattctcgtatgcgctgtgtttctctgtaggttacccctgtgcataattgaatccatttatgccactgttgtatagtagaacctgcaattggactggcctgaattttgccccagttgccatttggcttgctggaccttctgtattgcaattttttttctattgatatggaaaaaacaagctgtgcaagtttgctgttgcc

SEQ ID NO: 3280 - DNA, 1988 bp, Zea mays
cacgggcagaaagggacgcgactcgtcagggcgattccgattacgagtagacgggcaggacaggacaagggaggaacggcggcggcggcgcagggcagggtaaaccatggcggcatcggccaagggacggctcgtgcccgtgctcgcggtggcggcggcgctcgcggccgtgctcctctaccgcgcgcccttctccaagagcttgggcggcgaagggtgcagcctcctcccgcacgaccacttctggatcgccagcgaccgcgtcgtcacgctcggacgcgtcggccccgccgcagtagaggtcaaaggagggctcatcaacgccatcgccgtcggggactaccggagcttcgtgctccgccgaccgctccttgactacggggacgccgtcatcatgcccggcctcatcgacgtgcatgcccatctggatgagcctggacgtgccgagtgggaaggcttctccaatggcacaagagcagctgcggcaggtgggataacgacgctggtggatatgccactcaacagcttcccgtcaacagtctctgaagaaactctcaaactgaagctggaagcagctcgggataagctatatgttgatgtggggttttggggaggccttgtgccagagaatgccttcaacccaagtgctttggagggcctcctaaaggcaggcgttttaggactcaagtcttttatgtgcccctcaggcatcaacgactttcccatgacaaattcaactcatatcgaagaaggattggttacactggcaaaatacaagagatctttacttatccatgcagaacgtatacctgaggctgaggatcatgatttgcaagaagatgaattagatcctcggtcctatatgacgtatctgaagtctagaccaccatcatgggaggaagcggctatcagagatctgcaacgtgcaatgaaggatacggagttggggggtcggtccgaaggagctcatattcacattgttcatctatcagatgcaaaaactagcttggaacttatgaaggatgctaaacgcagtggtgcaagtctgtctatagaaacatgccctcattacctggcattttcgtctgaagaagttccagatggagatactcgctttaaatgttctcctcccatacgtgatgacacaaacagagaaaatctttggaaagctctgcttgatggacacatagacatgctaagttcagaccactcaccatccactcctgacctcaaactaatggaggaaggcgactttttaagggcatggggaggcatatcatcattgcagtttgtcctcccggtgacatggtcatatgggcgaaagtatggcgttactctgaatcagctagcctcatggtggagcgaaaggccagccaagcttgcaggccaaaagaataagggagctattctaccaggataccatgctgacattgtagtatggaaacccgaaacagagtttcaacttgacaacaaccatgctatatatcataaacatcagaatatttcagcgtatttaggaaagcaactttctggtaaggtcctgtcgacttttgtgagaggaaatcttgtgtttgctgaagacaagcatgcaaatgctgcttgtggtgttcctatcctcgctaagtaacatacaggtggatccagaactgccattgttgatccgtagtgtatacaatcgtatgcacgtgtcaatttgtaggttgctctcctgtatataattgaactcattcatgtcattgttatatagtagcaatctatttatattggcacacattttgccttgatccctaattagactatcattagtttttttttctattgatattgtcagcattcgggagaaggcatactctccagaatgctaacaaaatatccgctgagacttcatcagtagaagataaactcatagtctgatgaaatagataagatggtggtatgacacagtcccttcaacgcccagccattccagttccatcaaggcacaacag

SEQ ID NO: 3281 - DNA, 2114 bp, Sorghum bicolor
cacgggcagaaagggacgcaactcgactgcgagggacagacaaggggaggcgcagggcagggcaaaccatggtggcgtcggccaagggacggctcgtgtccgtgctcgcggtggcggcggcgctcgcggccgtgctcctctaccgcgcccccttctccaagagcttgggcggcgaagggtgcagcctcctcccgcacgaccacttctgggtcgccagcgaccgcgtcgtcacgctcggccgcgtcggccccgccgcagtggaggtcaaaggagggctcatcaacgccatcgcggtcggggactaccggagcttcgtgctccgccgtcctctcctggactacggggacgccgtcatcatgcccggcctcatcgacgtgcatgcccatctcgacgagcctggacgtgccgagtgggagggcttctctactggtacaagagcagctgcggcaggcgggataacgacgttggtggatatgccactcaacagcttcccgtcgacagtctctgaagaaactctcaaactgaagctggaagcagctcaagataagctatatgttgatgttgggttctggggaggacttgtgccagagaacgccttcaacccaagtgctttggagggcctcctaaatgcaggcgttttaggactcaagtcttttatgtgcccctcaggcatcaacgacttccccatgacaaattcaactcatattgaggaaggattggttacactggcaaaatacaagagacctttacttatccatgcagaacgtatacctgaggctgaggatgatgatatgcgagaggatgaactagatcctcgatcctatatgacgtatctaaagtctagaccaccatcatgggaggaatcagctatcagagatctacaccgtgcaatgaaggatacggagtcggggggtcggtccgaaggagctcatattcacattgttcatctatcagatgcaaaaacttccttggaacttatgaaggatgctaaacgcagtggtgcaagtttatcaatagaaacatgccctcattacctggcattttcatctgaagaagttccagatggcgatactcgctttaaatgttctcctcccatacgtgatgacacaaacagagaaaatctttggaaagctctacttgatggacacatagacatgctaagttcagaccactcaccatcaactcctgatctcaaactaatggaggaaggcaactttttaagggcatggggaggcatatcatcattgcagtttgtcctcccggtaacatggtcatatgggcgaaagtacggcattactctgaatcagctatcctcatggtggagcgaaaagccagccaagcttgcaggccaaaagaacaagggagctattctaccaggataccatgctgacatagtagtatggaaacccgaaactgagttccaactcgatgacagccatgttatatatcataaacatcagaatatttcggcgtatctaggaaagcaactttctggtaaggtcctgtcaacttttgtgagaggaaaccttgtgtttgctgaagacaagcatgcaaatgttgcttgtggtgttcctatcctcgctaagtaacatgcaggtggatccagagctgccattgttgatgatccgtagtgtatacaatcgtatgcaccatgtcaatttgttggttgctcttgtatattttttaaacaaactgcagaagctctgcccctcaattaagagaggagtaaaagagttttatgtacaggttatagatgaactgcaagggaaaacagagaaggccaacaagagtggcaaatattagcagaaacccgggtagaacacattaaatgtcattgttgtgtagtagcagtctaaaggtattggcatgcattttgccttgatccccacttagactattggttcgctctattgatatggaagaatacaatttgtccattttcacgtcactttcttaggttgctattggtgttatgggcatttggagtagcgtagaggtgacgattcatggggaagacgagtagatggttgcatcctcaaagctgtggaagattcactccggcactttgctttatatagcgagataattttgtctccatgaaactttttttcgcg

SEQ ID NO: 3282 - DNA, 2196 bp, Sorghum bicolor
ctagactagccgagcgcaggatcccacgggatcccacttcacttcccacgggcagaaagggacgcaactcgactgcgagggacagacaaggggaggcgcagggcagggcaaaccatggtggcgtcggccaagggacggctcgtgtccgtgctcgcggtggcggcggcgctcgcggccgtgctcctctaccgcgcccccttctccaagagcttgggcggcgaagggtgcagcctcctcccgcacgaccacttctgggtcgccagcgaccgcgtcgtcacgctcggccgcgtcggccccgccgcagtggaggtcaaaggagggctcatcaacgccatcgcggtcggggactaccggagcttcgtgctccgccgtcctctcctggactacggggacgccgtcatcatgcccggcctcatcgacgtgcatgcccatctcgacgagcctggacgtgccgagtgggagggcttctctactggtacaagagcagctgcggcaggcgggataacgacgttggtggatatgccactcaacagcttcccgtcgacagtctctgaagaaactctcaaactgaagctggaagcagctcaagataagctatatgttgatgttgggttctggggaggacttgtgccagagaacgccttcaacccaagtgctttggagggcctcctaaatgcaggcgttttaggactcaagtcttttatgtgcccctcaggcatcaacgacttccccatgacaaattcaactcatattgaggaaggattggttacactggcaaaatacaagagacctttacttatccatgcagaacgtatacctgaggctgaggatgatgatatgcgagaggatgaactagatcctcgatcctatatgacgtatctaaagtctagaccaccatcatgggaggaatcagctatcagagatctacaccgtgcaatgaaggatacggagtcggggggtcggtccgaaggagctcatattcacattgttcatctatcagatgcaaaaacttccttggaacttatgaaggatgctaaacgcagtggtgcaagtttatcaatagaaacatgccctcattacctggcattttcatctgaagaagttccagatggcgatactcgctttaaatgttctcctcccatacgtgatgacacaaacagagaaaatctttggaaagctctacttgatggacacatagacatgctaagttcagaccactcaccatcaactcctgatctcaaactaatggaggaaggcaactttttaagggcatggggaggcatatcatcattgcagtttgtcctcccggtaacatggtcatatgggcgaaagtacggcattactctgaatcagctatcctcatggtggagcgaaaatccagccaagcttgcaggccaaaagaacaagggagctattctaccaggataccatgctgacatagtagtatggaaacccgaaactgagttccaactcgatgacagccatgttatatatcataaacatcagaatatttcggcgtatctaggaaagcaactttctggtaaggtcctgtcaacttttgtgagaggaaaccttgtgtttgctgaagacaagcatgcaaatgttgcttgtggtgttcctatcctcgctaagtaacatgcaggtggatccagagctgccattgttgatgatccgtagtgtatacaatcgtatgcaccatgtcaatttgttggttgctcttgtatattttttaaacaaactgcagaagctctgcccctcaattaagagaggagtaaaagagttttatgtacaggttatagatgaactgcaagggaaaacagagaaggccaacaagagtggcaaatattagcagaaacccgggtagaacacattaaatgtcattgttgtgtagtagcagtctaaaggtattggcatgcattttgccttgatccccacttagactattggttcgctctattgatatggaagaatacaatttgtccattttcacgtcactttcttaggttgctattggtgttatgggcatttggagtagcgtagaggtgacgattcatggggaagacgagtagatggttgcatcctcaaagctgtggaagattcactccggcactttgctttatatagcgagataattttgtctccatgaaactttttttcgcgagcatgcgttttactaagaggaagaagagatgttcg

SEQ ID NO: 3283 - DNA, 1683 bp, Pennisetum glaucum
agagtttgggcggcgaagggtgcagcctcctcccgcacgaccacttctggatcgccagcgagcgcgtcgtcacgctcggccgcgtcgggcccgccgcagtggaggtcaaagcggggctcgtcaacgcgatcgccgtcggggactaccgcagcttcgtgctccggcggccgctcctcgactacggcgacgcggtcatcatgcccggactcatcgacgtgcacgcacatctcgacgagcctggacgtgaagagtgggagggcttctccaccggtacaagggcagctgctgcaggcgggataacaacgctggtggacatgccgctcaacagctttccgtcaacagtttccgaagaaactctcaagctgaagctcgaagcagctcgggataagctatatgttgatgtagggttctggggaggcctcgtgccagagaacgccttcaacccaagtgctctggagagcctcctaaatgctggagttttaggactgaagtcttttatgtgcccctcaggcatcaacgactttcccatgacaaattcaactcatatcgagcaaggattggttacactggcaaaatacaagagacctttgcttatccatgctgaacgtatacctgatgttgaggatgatgatggactcgatggcgaactagatcctcgatcctatgcaacgtatctgaagtctagaccaccagcatgggaggaatcagctatccgagatttgcaacgtgcgatgaaggatacggaggcagggggtcgatcagaaggagctcatattcacattgttcatctgtcagatgccaaaacttcccttgaactaatgaaggatgctaaacgcactggtgcaagtgtgactgtagaaacatgtcctcattacctggcattttcagctgaggaagttccagatggggatactcgcttcaaatgcgctcctccgatacgtgatgacatgaacagagaaaatctttggaaagctctgcttgacgggcacatagacatgttgagctcagaccactcaccgtcagctcctgatctcaaactaatggaggaaggcaactttttaaaggcatggggaggcatatcatcattgcagtttgttcttcctgtgacatggtcgtatgggaagaagtacggcattacgctgaatcaactagccacatggtggagtgaaaatccagctaagcttgcagggcaaaagaacaagggagctattctgccgggataccatgctgacattgtagtatggaaacctgagtcacagttcgaactcgatgacagccattctgtatatcataaacatcggaatatttcagcatatttaggtaaagagctttctggtaaggtcctgtctactttcgtgagagggaatcttgtatttgctgaagacaagcacgcaaaggctgcctgtggtgttcaaatccttgcgaaatgaaattgaaggctcaatggaggatatgcaaaagctgctccagtactgcacttgttgatccataacgtatactctcgtatgcgctgtgtgtctctgtaggttacccctgtgcataattcaatccatttatgccattgttgtatagtagaacctgcaattggactggcctgaaattttgccccagttgccatttggcctgttggaccttctgtattgaaaaaagtatatttgatatggaaaaaaaaaccaacctgtg

SEQ ID NO: 3284 - DNA, 1942 bp, Hordeum vulgare
ggctgcgcggtcgccgacggccaagggagcgcggccgtggacggcccgacggacgtcatcatcgttggtgccggggtggccggatctgccctcgcctacacgctcggaaaggatggtcgacgggtgcatgttatagagagagacctgacagagcccgatagaattgtgggtgaattgttacagcctggaggctacctgaaattgatggaattgggtctgcaggactgtgttgatgaaattgatgcacagcgtgtccttggttatgcattattcaaagatgggaagaacacaaaactttcttaccccttggagaagttccattcagatgtggctggcaggagctttcacaatggacgatttatacagaggatgcgtgaaaaagctgcatcattgcccaatgtccaactggagcaaggaacagttacatctttgcttgaagaaaatggtacagttaagggtgtgcaatacaagatcaagtcaggtgaagaactaaaagcttatgcaccattgacaattgtgtgcgatggctgcttttcgaacttaaggcgtgccctttgctctccaaaggttgaagtaccgtcttgctttgtagggcttgtcttggagaattgtcaacttcctcatgcgaaccatggccatgttatcttggccaatccttctcccatcctattttacccgataagcagcaccgaggttcgctgtttggtagatgtccctggccagaaggtgccctccatagcaagtggtgaaatggcaaattatctcaagaccgtggttgcacctcagattcctccagaaatctacgattcttttatagcagccattgataagggaagcataaggacaatgccaaataggagcatgccagctgcaccacatccaacacctggtgcacttttgatgggagatgctttcaatatgcgacaccctttaacaggtggaggaatgactgttgcattatcagatatagtcgtcttgcgtaatcttctcaagcctcttcgcaatctgcatgatgcctctgccctctgcaaatacctagagtcattctacactctacggaagccggttgcttctacaataaacaccttggctggtgctctatacaaagtcttcagtgcctcgcctgacaaggctagggacgagatgcgccaagcatgctttgattacttaagccttggaggtgtctgttcaaatgggcccattgctctactctctggtcttaatcctcggccattgagtttggttgcacacttctttgctgttgctatcttcggtgttggacggctgatgctcccccttccttcacctaaacgaatgtggactggagcgaggttgatctcgggcgcatgtggtatcatcttcccaattatcaaagctgaaggtgtgaggcaaatgttcttccctgctaccgtccccgcgtattaccgtgctcctcctgaagcggagttctgaagtacgaaggtgcagctaatctcttgcaccaaggcatttttcctgtgttggtagtcgttcgccagtgttagccggtcgttgaaatgtgttgtgttggtagtccgaatggatcgaggaacgtgtatagtatctccggtgggtgctgatcctgtctgttgaaatgttctgaattgctgcatcggtgcccatgttgattggtcctagttaaattgtacatttttgttgtactactacggtggtgtcccttgtctactgcgcgtgagctgtgctttctaaattctataaatcgtagtagaccactgtgtaccatgttaagctgaaccccgttatagaccatgatatgtcttcagttatacgggccagcccatcaaatgaggagccttatcccttatttagagtctcaattgattaagcaagtttgttagaaaagaatccattcagtttagagagtctattagagtttaaataatcccaccgactcgtggtcttg

SEQ ID NO: 3285 - DNA, 2928 bp, Triticum aestivum
cggaaaggatggtagacgggtgcatgttatagagagagacctgacagagccagatagaattgtgggcgaattgttacaacctggaggctacctgaaattgatggaattgggtctgcaggactgcgttgatgaaattgatgcacagcgtgtccttggttacgcgttgttcaaagatgggaagaacacaaaactttcttaccccttggagaagttccattcagatgtggctggcaggagctttcacaatggacggtttattcagaggatgcgtgaaaaagctgcgtcgttacccaatgtccaactggagcaaggaacagttacatctttgcttgaagaaaatggtacagttaagggtgtgcaatacaagatcaagtcaggtgaagaactaaaggcttatgcaccattgacaattgtatgtgatggctgcttttcgaacttaagacgtgccctttgctctccaaaggttgaggtgccgtcttgctttgttggcctggtcctggagaattgtgaacttcctcatgcgaaccatggccatgttatcttggccaatccttctcccatcctattttacccaataagcagcaccgaggttcgctgtttggtagatgtccctggtcagaaggtgccttccatagcaagtggtgaaatggcaaattatctcaagaccgtggttgcacctcagattcctccacaaatctatgattcttttatagcagcaattgataagggaagcataagaacaatgccaaataggagcatgccagctgcaccacatccaacacctggtgcacttttgatgggagatgctttcaatatgcgacaccctttaacaggtggaggaatgactgttgcattatcagatatagtcgtcctgcgtaatcttctcaagcctcttcgcaatctgcatgatgcctctgccctctgcaaatacctagagtcattctatactctgcggaagccggttgcttctacaataaacacattggctggtgctctatacaaagtcttcagttcctcgcctgacaaggctagggacgagatgcgccaagcttgctttgattacttaagccttggaggtgtctgttcaaatgggcccattgctctactctctggtcttaatcctcggccattgagtttggttgcacacttctttgctgttgctatctttggtgttggacggctgatgctcccccttccttcacctaaacgaatgtggaccggagcgagattgatttcgggtgcatgtggtatcatcttcccaatcatcaaagctgaaggtgtgaggcaaatgttcttccctgctaccgtccccgcgtattaccgtgcacctcctgaagcagagttctgatctacaaaggtgcagctaatctctcgcacgatgacatttttcctgtgttggtagtcgcccgccagtgttagccggttgttgaaaatgtgctgtgttggtagtccgaatggatcatggaacgtgtatagtatctccgttgggtgctgatcctgtttttgaaatgttttgaattgctgcgtcagtgcccatgttgattcatcctagctaaattgtacatctttgttgtactactgatgaactacgcctgctgttctaactagtggactaaggcggtgttccttgtctactgatcgtgagctgtgctgtgtgcgtttcaaatcagaccactgtataccatgttaggctgaacgctgttatggaccattatatgccttcagttatatgggccagctcatcaaatgccttatttcatctagagttccagttgattaagcatgtctcttagaaaagagtccagtttcgagatcctctgtgagtttgaataagatacctacagaaatctctgcataagtcaatgacataggacttagatgtgcaatacttatggcacatctagatgtgctttagcaaaactgtattaagaactccgaaattccttccaaaaattctttaatcagcgttggtgccaaaactggattttacagtcctaggattgtaagcacacattgttcccacattccgctgtgcttacagtttcactcttgcaatcgtcttccccgtctccgaactcatgcagccaatatcttttgacataaccctgtggaaggattgaatggcgtatatagtcggagcacacgatcttaggtgtagaattgctttcagggcagtggctccaccgtactacgacatggcaatgtacctgccatctgcagcctacctccaatggcaactagcttcgtcttggctgtgccctcctattcttatttgctggaacagataggcttgagggagtcaacttccgaagagaagcatgcagcatcatgactgcataactcaacccaatggcatacacaagagcaaactgcaggttgcatacatatagtagtatagcagtggcaatctgggcacagtgcagaagagcctgcccaattccgggcgctcgtgtggcgagctcccaccggttccggcagtaccgcacagcctcccacacggcgaggctggccagcaaccccagcagcgacataggcatccggtacaggcagcaggcgaagacgaggacggatagcgcggcatagttgcgggcgtagcggcggacgttctcctggacgcggagtcgggcctgggtgggggtcgggggccaggagtaggaggcgacgccgggagcgccgataaaggcgagggaccaggagggggtgggcgcggcgaggtcggcggcggagaggcacgcaaaggggttgagcgcgaggagagaggctagggtgcgcgcgaaggcgaggacgtcggcggcggcgccggcccccgaggaggtggatgcggggctggcgcgtgtgggggcggctgcggcgggtgcgggggcggaggagtcgaggaggtcgaggtagccggagtcgcggagccagcggtcgagagcggggtccggt

SEQ ID NO: 3286 - DNA, 1967 bp, Quercus alba
atggggaagctctcgtgtttcggtgtataacaagttaaggacgtgttcccaaaaaagctattccattattttttaaaccacacacaaacacgcgtagcacgaagaaaccaacagagagagagagagagattcgttgtggcttttttactctgtgagctctcgatcgctacgcattgggggtgaaaatggtggcggtggctttggatcagtacgcgttgggagcgatcgtcgtctcggctttcgcgctcgtccttgcgatttatagcttcgtcgccgcgaagaaaaaggtcgctggagaggcgcgaaccgaggcggtgaactgcgtcgccacggcgacggccgctaacggagaatgtagatccgctaacgccgccgacgccgacgttatcatcgtcggtgctggcgtcgccggctccgctctcgctcacactctcggcaaggatggacgtagagttcatgtgattgaaagagatttaacagagcctgaccgaattgtcggtgaattgctacaacctgggggctatctcaaattaattgagttaggacttgaagattgtgtgaacgaaattgatgcgcaacgcgtatttggttatgcactttttaaggatgggaaaaacacccgactctcttatcccttggagaaatttcactcagatgtgtccggaagaagctttcacaatgggcgcttcatacagaggatgcgggagaagtctgcttcccttcccaatgtacgattggagcaaggaactgttacctctctgcttgaagaaaatggaacagttaaaggcgtgcaatacaagactaaagatggaaaagaaatgacggcatatgcacctttaactgttgtttgtgatggctgtttctcaaacttgcgtcgctccctttgcaatcctcaggtagatattccctcttgttttgttggtttggttctggagaattgcgaacttccttatgcaaatcacgggcatgtcatactaggagacccttcccccattttgttttatcctattagtagcacggaggttcgctgtctggttgacgtacccggacagaaagttccatctattgcaaatggtgaaatggcaaactatttgaagactgtcgtggcccctcaggtcccccctgaaatatatgattcttttgttgctgctattgataaaggtaacattaggacaatgcccaacagaagcatgccagctgctccccatcctactcctggtgccttgttaatgggggatgcattcaacatgcggcaccccttgactggggggggaatgactgtggcattgtctgatatcgttgtgctacggaatcttctcaagcctttgagagacttaaatgatgcacctaccctctgcaagtatcttgaatccttctacaccttgcgtaagccagtggcatccaccattaatactttggcaggggccttgtacaaggtcttttgtgcttcacctgatcaagcaaggaaggaaatgcgcgaggcctgctttgattatttaagtcttggaggtgtattctcaacaggaccagttgctctactctcagggttgaaccctcgccctttgagcttggttctccattttttcgctgttgcagtatatggtgttggccgcttatgcctgccctttccttcaccttcacgcgtctggattggagccagattaatttcgggtgcatcagcaatcatcttccccataatcaaggccgaaggagttaggcaaatgttcttccctgcgactgttccagcttattacagagctccacctgttaagggagatcattaaagcaatgtagctaaaaattggctgcagtcaagatgagcaatcagttcggcatttgccttaaccctgttcaaaatgaagggagggtgaatacttcaaaaatgagatgtacattattaataacgctttttggtttttagaacttgttctttctagtacgtttataaaactactattcttttaaag

SEQ ID NO: 3287 - DNA, 1763 bp, Amorphophallus konjac
ggggaggagggggaggaagtggagtgccgcctcctctaagaccgggtccccgcgggctgaagaatgtgggtcgcctgcggccggcgacggccctgcggacgtcatcgtcgtcggagccggcgtcgccgggtcagccctcgcgtacgccctcgggaaggatggacgtcggattcatgttatagagagagatttgactgagcctgacagaattgttggagaactgcttcagcctgggggttacctaaaactcattgagttgggacttcaggactgtgtggaggagattgatgctcaacgtgtatttgggtatgcccttttcaaggatgggaagaacaccaaactgtcatatcccttggagaactttgatgccgatgttgctgggaggagcttccataatgggcgcttcatacagaggatgcgagagaaggctgcctctattcccaacgttcatttggaagaaggaactgtgacatccttgattgaagaaaatggcactgttaaaggagtatcctacaagaccaaagatggtgaagagcttaaagcatatgcacctcttacaattgtttgtgatggttgtttctcaaacttgcgacgctctctttgctccccaaaggtggatattccctcctgtttgttggtttggtcctcgagaactgccaactaccatacccaaatcatgggcatgtcattctagcagatccttcacctatcttattttatcctatcagtagttccgaagttcgctgtttagttgatgtgcctgggcagaaggtcccttctgtagccaatggtgaaatggcaaactatttgaagactgtcgttgcaccccagcttcctcaggaactgcaaaactcctttatatctgccatcaacaaggggagcataagaacaatgccaaataggagcatgccagcttctccctgcccgactcctggagctttattaatgggggatgcattcaatatgcgtcatcccttgacgggcggaggaatgaccgtggcgttgtctgatattgctgttctacgcaatcttcttaaacctctacgtgatctccatgatgcaccggctttatgcagatacctggagtctttttacacattgaggaagcctgtcgcttctacaataaacactttggcaggtgccttatacaaggtcttcagtgcctcccctgatcaggcaatgaatgaaatgcgtcaagcttgctttgattatctaagccttggggggttattctctgctggtccagtgtccttgctatctggtttgaaccctcgtcccttgagcctggttgttcatttctttgctgttgccatatatggagtgggtcgtttgttgatcccatttccctcgccgaagcgtatgtggattggagccagactgatttcgggtgctgcaaatatcatattccccattataaaggcagaaggggttaggcaaatgtttttccctgcaacagtccctgcatattacagagctccacctgaagactgaagaggttaatgttgtcaccatgttggcatgcagggaagtgttgtctggcttgtcaagggaaaactaatttttaggatccttcgaatggctctcccttcgactggttgtgttgtatcaaagaccttccaactatgaagtcaaattgccatcatgttgccaaggtgctgttgtatgcgtcaatgagattcaaaagtgctccatgaagctgtaaatatgctaatattaactgagtaccattttgaaagaactgtcttttctgtggaggaatgtta

SEQ ID NO: 3288 - DNA, 1789 bp, Papaver somniferum
agaatgattcagtacatcttaggaggaatcctagcatcattgttagggtttatttttattgaaattaaatggaaataagaagaataaaaagaatgagatccgagatgaatgtgttaagagttctatcaatggtgatttacgatccaatggtgatacagatattataattgttggtgctggtgttgctggtgctgctcttgcctacacccttggaaaggatgggcgacgagttgttgtgattgagagagatttaaccgagcctgacagaattgttggagaactgttacaaccaggaggctacctgaagttgatagaattggatcttcaggattgtgtagagcaaattgattcccaaagagttctaggttatgctcttttcaaggatggtaaagatactagactctcatatcccttggaaaagttccactcagatgtggctgggagaagctttcacaatggccgctttattcaacggatgagggagaaagcctctacccttcccaatgtgcggttggagcagggaactgtaacatccttactagaagaaaatgggaccattaagggagtattgtacaagaccaagtctggtgaagaaataaatgcatatgctcctctgacaattgtatgcgatggttgcttttcaaacttgcgtcgttctctctgcagcccgaaggttgaggttctctcatgttttgttggcttgatccttgagaactgcaagcttccccatcaaaaccatgggcatgtaattctagcagacccttcaccaatcttattttatcaaatcagcagtaccgaggtacggtgtttggttgacgtacctggccaaaaagtaccatcaattggaaacggtgaaatggcaaaatatttgaagactatggtggctcctcagattcctcctcagatatatgattcctttatagcagcaattgacaaaggaagcataagaacaatgccaaatagaagcatgccagctgctcctcttcccaccccaggtgccctattaatgggagatgcattcaatatgcgccaccctttaaccggcggagggatgaccgtggcattgtctgacattgttgttctacagaatcttcttaggcctctgaggaacctgaatgattcagcttcgttatgtaaatatttggaatccttttacaccttgcggaagcctgtggcgtctaccataaatactttggctggagccctgtacaaggtcttttgtgcttctcctgatcgggcaaggaaggaaatgagagaagcatgtttcgactatttgagtcttggaggggtttgtgctgaaggcccaatagctttactctctggactcaatccacgcccattgagcttagtttgccatttctttgctgtggccatattcggagttggccgtctattgctaccatttccatcacccaagcgtctatggattggagctaaattgatttcgactgcatctggcattatatttccaattataagggctgaaggagtcagacaaatgttttttcctgccacagttccagcatactacagatcgccaccagtcgagtagaaacagaccatccataagagaaatcatatagccaatgatagcgaagaagggtcagaattcgatattgtaatttgtaccagtaaaataggtcgtcctcttcccaagatctaaattaagtttagggaaagacgtttatgtgcagaatttgttcatataggaatattcctttactggttctttgcaacttgtacgaactggaatttttgtatctaaactcttgaaaacaagtggattaca

SEQ ID NO: 3289 - DNA, 2272 bp, Malus domestica
gatccggattcgtattttgcaaagagcatcggcgtggctgcgcgcgtgtgtatatttgtcgtcgtcgtggtgacctgtggggatgccctataaaacgcggtcacctcgtgaccttgttgtaacggactcgaaacggtttcaaaaattaaaacgcagttcgccagcgcagagtctgccgaatattccagaaatacagagagagagagagagagagagagagagagagagagagagagagagagagagagtgtgtgaggccgtggcatccacaaaaggccgcgcgcagagaaacagaagcgtcgttgtttcggaggaggaagaatggcggatcagtacttgctcggatggatcttcgccaccgtgctgggcgccgtgtttctgtgcagagcgctggcgaggaggaacggcgagagagggagagctttggtggaggaggagaggagcgagtgcgtgaagagcgtgatggtctccaacggagaatgcagatccactgacggcgacgtagacgtcatcatcgtcggagctggtgttgccggcgccgctcttgctcacactctcggcaaggatggacgtcgggtgcatgtgattgaacgagacttgacagagcctgaccgaatagttggcgagctactacaacctggaggctacctcaaattaattgagctgggactagaagattgtgtggagcaaattgatgctcagcgggtttttggatatgctcttttcaaggatgggaaaaataccaaactctcttaccccttggagaaatttcactcagatgtgtctggaaggagctttcacaatggccgtttcatacagaggatgcgggagaaggctgcaactcttcccaatgttctattggagcaaggaacagttacatcgctacttgaagaaaagggaacaattaaaggtgtgcaatacaagactaaaactggcgaagagatgaccgcatatgcacctcttactattgtttgtgatggctgtttctccaacttgcgtcgctctctttgtgatcctaaggtggatgtgccttcttgttttgtagggttaattctggagaattgcaatcttccacatgctaatcatggacatgttatattagcagacccttctcctattttgttctatcaaatcagtagcacggaggttcgctgtctggttgatgtaccgggacaaaaagttccatccatttcaaatggtgaaatggcaaagtatttgaagactgtggtggctccgcagattccccctcaaatttatgattccttcatagctgcagtggataagggttccataaggacaatgccgaacagaagcatgcccgccgctccctaccctactccgggagctctcttgatgggggatgcattcaacatgcgccaccctctaacaggtggaggaatgactgtggccttgtctgatattgttgtgctgcggaatcttcttaggcctttgggcaacctaaatgatccatctacactgtccaaatatcttgaatccttctacactctccgcaagccagtggcatccacgataaatacattggcgggtgccctttacaaggtcttttcttcttcacctgatcaagcaaggaaggaaatgcgccaggcttgctttgactatctaagtctcggaggtgtattctctatgggaccagtctctctactctcggggttgaaccctcgccctttgagtttggttctccatttcttcgctgtcgcagtgtatggtgttggccgtcttctgctgccatttccgtcacctaaacgcgcctggattggagccagattaatttcgagtgcctcaggaatcatcttccccataatcaaggcagaaggagttagacaaatgttcttccctgcaactgttccggcatattacagagcgcccgtcttaagtgagaagcagatgaagaagaccgtagatggcgtgaattgatggtaccgagaaaacagcgctgtcgggagaggattttccgatgcggactgcccccggccattcctcattagaagttgagggggaaggtgaatgcaaaaaacagaaagatttattgtagtaaccgcagattttgctttttagaattcttctttctttgtgttcataccattgtttaaaatatctatgaaattgacgatattttgaagagacaatgattgatatgaaaataggggtgaaattctatatcggcgagatattgcaaaatcaatgtgtattgaaaatatttaccgattcattacaaaaattttgcggaaatctattataaatttcaaacttt

SEQ ID NO: 3290 - DNA, 2150 bp, Ricinus communis
atgagtccaatctcaatccagctgccaccaagaccacaactttaccggtcattaatttcgtctctttctctctctacctataaacagccaccttctcctccttcattctctctgacaatcgcaaactcaccaccacaaccacagccacaagccaccgtctcatcaaaaacaagaactattactagactaagcaacagcagcaatagggttaatcttttgcaagccgagcaacacccccaagaaccatcttccgatctttcttattcttcttctccaccgcattgtgttagtggtggctataatataaagcttatggaagttgggactgataactacgctgttattattattcttgggactttctttgcctctctttttgcttttgtttttctttccatcttacgttataacttcaagaacaagaacaaggcaaagatccatgacgaaaccacattaaagacccagaatgataatgtaaggttgcctgataacggctccggtaatgacgtcataattgttggtgctggggttgccggtgctgccctcgcttatactcttggaaaggatggaaggagagttcatgtgatagaaagggacttaacagagcctgacagaatagtcggtgagctgctccaaccaggcggatatctgaaattaattgaattgggtcttgaagattgtgtgcaggaaattgatgcccagagagtgcttggttatgctctcttcaaggatggtaaaaatactagattatcgtatcccttggaaaaattccatgctgatgttgcagggaggagcttccataatgggcgttttattcagaggatgagagaaaaagctgctagccttcccaatgtaaaattagagcaaggaacagtgacatccctacttgaagaaaatgggactattaagggggttcaatacaaaactaaggatggccaagaaatcagagcttatgcacctcttacaattgtttgtgatggatgcttctcaaacttgcgtcgttctctatgtaatcctaaggtagatgtgccctcttgttttgtgggtttagtccttgagaattgtcagctcccttttgcaaatcatggacatgttgttctggcagatccttcgccgattctgttttatccaattagcagcactgaggttcgctgtttggttgatgtgccgggacaaaaagtaccttcaattgctaatggtgaaatggccaagtatttgaagaacgtggtggcaccgcagattcctcccgtgcttcatgatgccttcatatccgcaatagataaaggtaatatcaggacgatgccaaatagaagcatgccagctgatccccatcctactcctggagcccttctaatgggtgacgctttcaatatgcgccatccattgactggtggcgggatgactgtggcactgtcagatatcgttgtgctccgggatcttcttaagccactacgtgaccttaatgatgcaacttccctgaccaaatatcttgaatccttttatacattgcgcaagcctgttgcatctacgataaatactctggcaggtgcattgtacaaggtattctctgcttctcctgatcaggcaaggaaggaaatgcgccaagcatgcttcgactatctaagccttgggggcatattttcatcaggacctgtggctttactctctggtctcaacccacgtccactaagcttagtaatgcatttctttgctgttgcaatatatggtgttggtcgcctgcttcttccatttccttcacctaaatccgtatggattggggctagactgatatcaagtgcatccggtattattttccccattatcaaagcggagggagtgaggcaaatgttctttcctgctactattcctgcaatatacagacctcctcctgttaaagatacatcagatgatgagcaaaagtcaaggtagcttgagttgtcatagtcaagatcaaacctgcttacatttgcaagttccgaggatgtcaaatgtacacactgtatctattgagaaaatgtgggactgatgttaatttctggtcagtagatacagttgtttaattgtatacattattattctcttagaactgaagattgtaagtagacctttggactttcttgatctatgattatgaaattttttgtagtccg

SEQ ID NO: 3291 - DNA, 2460 bp, Ricinus communis
cgaaaagttgatgagaatcttaattgattcaagcgccagggattatgttatgtatcgattctgctttccttctaacaaatacacaacaattacgtatccagttcttctaatcttttcatactcagaaatgtgaacaaacaaaattgtgaaaaaccaaggaaatatcccccagaccagagaaaaaacaaaacaaaaaaaagaaaaagaaaaagaaataaatgagtccaatctcaatccagctgccaccaagaccacaactttaccggtcattaatttcgtctctttctctctctacctataaacagccaccttctcctccttcattctctctgacaatcgcaaactcaccaccacaaccacagccacaagccaccgtctcatcaaaaacaagaactattactagactaagcaacagcagcaatagggttaatcttttgcaagccgagcaacacccccaagaaccatcttccgatctttcttattcttcttctccaccgcattgtgttagtggtggctataatataaagcttatggaagttgggactgataactacgctgttattattattcttgggactttctttgcctctctttttgcttttgtttttctttccatcttacgttataacttcaagaacaagaacaaggcaaagatccatgacgaaaccacattaaagacccagaatgataatgtaaggttgcctgataacggctccggtaatgacgtcataattgttggtgctggggttgccggtgctgccctcgcttatactcttggaaaggatggaaggagagttcatgtgatagaaagggacttaacagagcctgacagaatagtcggtgagctgctccaaccaggcggatatctgaaattaattgaattgggtcttgaagattgtgtgcaggaaattgatgcccagagagtgcttggttatgctctcttcaaggatggtaaaaatactagattatcgtatcccttggaaaaattccatgctgatgttgcagggaggagcttccataatgggcgttttattcagaggatgagagaaaaagctgctagccttcccaatgtaaaattagagcaaggaacagtgacatccctacttgaagaaaatgggactattaagggggttcaatacaaaactaaggatggccaagaaatcagagcttatgcacctcttacaattgtttgtgatggatgcttctcaaacttgcgtcgttctctatgtaatcctaaggtagatgtgccctcttgttttgtgggtttagtccttgagaattgtcagctcccttttgcaaatcatggacatgttgttctggcagatccttcgccgattctgttttatccaattagcagcactgaggttcgctgtttggttgatgtgccgggacaaaaagtaccttcaattgctaatggtgaaatggccaagtatttgaagaacgtggtggcaccgcagattcctcccgtgcttcatgatgccttcatatccgcaatagataaaggtaatatcaggacgatgccaaatagaagcatgccagctgatccccatcctactcctggagcccttctaatgggtgacgctttcaatatgcgccatccattgactggtggcgggatgactgtggcactgtcagatatcgttgtgctccgggatcttcttaagccactacgtgaccttaatgatgcaacttccctgaccaaatatcttgaatccttttatacattgcgcaagcctgttgcatctacgataaatactctggcaggtgcattgtacaaggtattctctgcttctcctgatcaggcaaggaaggaaatgcgccaagcatgcttcgactatctaagccttgggggcatattttcatcaggacctgtggctttactctctggtctcaacccacgtccactaagcttagtaatgcatttctttgctgttgcaatatatggtgttggtcgcctgcttcttccatttccttcacctaaatccgtatggattggggctagactgatatcaagtgcatccggtattattttccccattatcaaagcggagggagtgaggcaaatgttctttcctgctactattcctgcaatatacagacctcctcctgttaaagatacatcagatgatgagcaaaagtcaaggtagcttgagttgtcatagtcaagatcaaacctgcttacatttgcaagttccgaggatgtcaaatgtacacactgtatctattgagaaaatgtgggactgatgttaatttctgtccggtaaatatcatctgaaacgaaaccccgaatatgccgaaggagctactaatcatgtcgggtgaaccttgacaattgctgacaggcatgctcagagtctgcaaaaagctaggccagttactaaacaatgggcgtcttaaaaatttctggattggcccaaattaatatgattttcatatacttgttacaatattcttctatcc

SEQ ID NO: 3292 - DNA, 1799 bp, Triticum aestivum
gcttctactctggaatatgcaatggaggcgtggatgtggagcaccagcgctggatctgggcaacggaggcatggatgtggagcggcacccgagcggcggatctgtcttcgtcctcacggtgcccacgtcgtcgtcttcgccggagtagctgcttcctcccctgcccaacgatggtcgacgggtgcatgtcatagagagagacctgacagagcctgatagaattgtgggtgaattgttacaacctggaggctacctgaaattgatggaattgggtctgcaggactgcgttgatgaaattgatgcacagcgtgtccttggttatgcattattcaaagatgggaagaacacaaaactttcttaccccttggagaagttccattcagatgtggctggcaggagctttcacaatggacggttcatacagaggatgcgagaaaaggctgcatctttgcccaatgtccaactggagcaaggaacagttacatctttgcttgaagaaaatggtacagttaagggtgtgcaatacaagatcaagtcaggtgaagaactaaaagcttatgcaccattgacaattgtatgtgatggctgcttttcaaacttaagacgtgccctttgctctccaaaggttgaggtgccgtcttgctttgttggcctggtcttggagaattgtgaacttcctcatgcgaaccatggccatgttatcttggccaatccttctcccatcctattttacccgataagcagcaccgaggttcgctgtttggtagatgtccctggtcagaaggtgccttccatagcaagtggtgaaatgacaaattatctcaagaccgtggttgcacctcagattcctccacaaatctatgattcttttatagcagcaattgataagggaagcataagaacaatgccaaataggagcatgccagctgcaccacatccaacacctggtgcacttttgatgggagatgctttcaatatgcgacaccctttaacaggtggaggaatgactgttgcattatcagatatagtcgtcctgcgtaatcttatcaagcctcttcgcaatctgcatgatgcctctgccctctgcaaatacctcgagtcattctatactctgcggaagccggttgcttctacaataaacacattggctggtgctctatacaaagtcttcagttcctcgcctgacaaggctagggatgagatgcgccaagcttgctttgattacttgagccttggaggtgtctgttcaaatgggcccattgctctactctccggtcttaatcctcggccattgagtttggttgcacacttctttgctgttgctatctttggtgttggacgactgatgctcccccttccttcacctaaacgaatgtggactggagcgagattgatttcaggtgcatgtggtatcatcttcccaatcatcaaagctgaaggtgtgaggcaaatgttcttccctgctaccgtccccgcgtattaccgggctcctcccgaagcggagttctgaatgacgaaggtgcagctaatctctcttgcacgatgacatttttccctgtgtcggtagtcgtctacagtgttagccggtcactggaatgtgctgtgttggtagtctgaatggatcgaggaacgtgtatagtatctccgctgggtgctgatcctgtttttgaaatgttttgaattgctgcgtcggtgcccatgttgattcgtcctagtgaaattgtacatctttgttgtactacgccctccgttccgaattacttgtcgcacttatggatgtatcaagatgtattttagtt

SEQ ID NO: 3293 - DNA, 1816 bp, Prunus persica
gcggaggagaaatggcggatcagtacttgcttggatggatcttggcctctgtgctgggcctcgtggcgctgtacagaacgctggtgaagaggaacgacgatcgtcgcagcgctctggtggagaagagaagcgagtgcgtgaagagcgtcatggtctcgaatggagaatgcagatctactgacggcgatgtcgacgttataatcgtcggagcaggcgtcgcaggcgccgctctggctcacactctcggcaaggatggacgtcgagttcatgtgattgaacgagacttgcaagagccagaccgaattgttggtgaactactacaacctggaggctacctcaaattaattgagctgggactagaagattgtgtggaggaaattgatgctcagcgggtgtttggctatgcccttttcaaggacgggaaaaatactaaactctcttaccccttggagaaatttcactcagatgtgtctggaaggagcttccacaatggccgtttcatacagaggatgcgggagaaggctgcaactcttcccaatgtgcaattggagcaaggaacagttacttctctgcttgaagaaaagggaacaattaaaggtgtgcaatacaaggataagactggccaagagatgacagcatatgcacctcttactattgtttgtgatggctgtttctccaacttgcgtcgctctctttgtgatcctaaggtggatgtgccttcttgttttgttgggttaatcctggagaattgcgatcttccgcatgcaaatcacggacatgttatattagcagacccttctcctattttgttctatcaaatcagtagtacagaggttcgttgtctggttgatgtacctggacaaaaagttccgtccatttcaaatggtgaaatggcaaagtatttgaaggctgtggtggctcctcagattccccctcaactttatgatgccttcatagctgcagttgataagggtaccataaggacaatgcccaacagaagcatgccagccgctccctatcctactcctggagcactattgatgggagatgcattcaacatgcgccaccctctaacagggggaggaatgaccgtggcattgtctgatatcgttgtgctgcagaatcttctcaggcctttgaccaacctaaatgatgcatccacactgtcgaaatatcttgaatcgttttacactctgcgcaagccagtggcatccactataaatacattggcaggggccctttacaaggtcttttcttcttcacctgatcaagcgaggaaggaaatgcgtcaggcttgcttcgattacctaagtctcggaggtgtattctctaatggaccagtatctctactctcgggactcaaccctcgcccattgagtttggttctccatttcttcgctgttgcagtatacggtgttggtcgactgttgctgccatttccatcgcctaaacgcgcctggattggagccagattaatttccagtgcctcaggaatcatattccccataattaaggccgaaggagttagacaaatgttttttcctgcgactgttccagcatattacagagcacctgtctctagcgagaagcaaatgaaaaagactgaagatagcataaattgaaggttttgagaaaaccgtgctgccggcagaggctccgattccttgtgcgaagttgaaggggaggatggtgaatgcaaaaaacagagatttgttgtagtaaccgcagattttgttttctaggactctttctttctatgtgtttattcctttaattttttttttttcaagtacataattgaaagaaaaagacttct

SEQ ID NO: 3294 - DNA, 1976 bp, Theobroma cacao
gtcccaaatctcaccaaactctccttgaccaatccagtattacttggagaaccactccaaattttgatcattttgactagctgggtttaaccaatttgtttatgtctcaaaattggtttcttgctctgataaacatagttttccactttcataaaatatgggatacgagtgtatagttgaagggctggtagccgctctgctggggtttgttttcttgtacaacgctttcgtaagaggattcaacaagacaaaagctgcagcaggtgctgcttcttcttcttcttcttccatggtgtctccaatggaaaattgtgtgaggaaaacagggaatggcgaggttgctgggagtacagacattatcatagttggcgctggagttgctggttctgctcttgcttatacatttggaaaggacggacgccgagtgcatgtgatagagagagacttaagtgagcctgacagaattgttggtgaacttctacaaccagggggctaccttaagttaattgagttggattgtgtagatgacattgatgctcaacaggtttttggctatgctctgtacaaggatggaaagaataccaggttgtcttatcccctggaaaagtttcactctgatgttgctggaagaagcttccacaatggacgtttcatacaaaggatgcggcagaaagctgcttctcttcccaatgtaactctagaacaaggaacagtaacatctctgcttgaagaaaatgggactatcaagggagttcagtacaaaactaagggtggtcaagagttgacagcatatgctccccttactattgtatgcgatggttgtttctcaaatttgagacgctctctctgtgacccgaaggttgaggtcccctcttgttttgttggattggttctggagaactgtgagcttccgcatgcaaactatggacatgttatattggcagacccttcacctatcttgttttaccctatcagcagcaccgagattcgttgcttggttgatgtgcctggccaaaaagttccttctgtttccaatggtgaaatggcccagtacttgaaaactgtggtggctccccagattccttctgaactgcacactgcctttatatccgcaattgataagggcaacataagaaccatgccaaacagaagcatgcctgctgctccacactcaactcctggtgcacttttaatgggtgatgcattcaatatgagacatcctttaaccggagggggaatgactgttgcactatctgatattgtggtactaagggatcttctaagacccctgtacgatctgtatgatgcatctactctttgcaaataccttgaatctttttataccttgcggaagccagtggcatctacaataaacacattggctggcgccctatacaaggtattcagtgcctcccctgatccagcaaggaaggagatgcggcaagcatgctttgactacttgagccttggaggcgtattctcaaatggaccaatctctctgctctccggtttgaacccccgccccataagcttagtcctacattttttcgcggtggctgtctatggcgttggccgcttgttacttccatttccttcacccaaacgcatttggactggggctagattgatttcgggtgcatcaggcatcattttccccattatcaaggctgaaggggttagacaaatgtttttccctgcaactgtgccagcatactacagagctcctcctgttcattgagagaatgaggaaaacaatgggaaaactcagaaaccccacaaatatttactgctaagccaaactaatttgtatcagtagttgatcttctgccacgaattcttttttactttctacctaagtaaacaaatcaagtgtataataggaaccatgttggtatggtattatttcagagaattgacatagcattacagtctttcctttgaatcaagtacaatcttaatacagcaaagtttcatat

SEQ ID NO: 3295 - DNA, 1998 bp, Gossypium hirsutum
tcacagcgaagcaacagctgaaagccgtttcagattcaaagcaccaccgtctcacgctaatcaaaacaaacaaaaaccagccaaaattcatcaccgttatcaaagagagaatcaacagagcaaagggattccgattttctctttttcttcttttttgtgctttcacagtctctacgttgtcgttcttttttggcttagcatttggaggaggagaggagaggagaagatgagaaaaatggcggatccttacgtgttggcgtggatctcggtttttgtaacgacgcttcttgctttgtgcggtgtcgttttgaagagacggaaagtgaacgggatctcttcctcaaggactatgtcggtgacaagcgtatcggctgttgacggagaatgtagatccgctgatggttgtgatactgacgtcatcattgttggagctggtgttgctggatccgcactcgctcacactcttggcaaggatggacgtcgagtgcatgtgattgaaagagatttatcagagcctgaccgtattgttggggaactgctacaaccagggggctatctcaagttaattgagttgggacttgaagattgtgtggaggaaattgatgctcagcaggtatttggttatgcgcttttcaaggatgggaaacgtacccgactttcttatcccttagaaaatttccactcagatgtatctggcaggagcttccacaatggacgtttcatacagaggatgcgggagaaagcagcttctcttcccaatgtacgtttagagcaaggtgtagttacttctctacttgaagaaaaagggactatcagaggagtgcagtataaaacaaaagatggccgtgaattgacagcatttgcacccctaaccattgtttgtgatggctgtttttcgaacttacgtcgctccctttgcaaccctcaggtagatgtaccctcatgttttgtcggattggtactggagaattgctatcttccttacgcaaatcacgggcatgttatactagcagatccttcccccattttgttctatcctattagcagcacagagattcgttgtctcgttgatgtacctggtcaaaaggttccttctattgccaatggggagatggcaaattatttgaagacagttgtggctcctcaggttccaccggaaatttacgattcatttgtagcagctgttgataagggaaatattaggacaatgccaaacagaagcatgccggcttctccttatcccactcccggagccctattaatgggagatgcatttaacatgcgccatccattaactggcggaggaatgactgtggctttatccgatattgttgttcttcgtgatctactgaagcctctgcgtgacctcaatgatgcaccaacactctgtaaatatctagaatcattttacaccttgcgtaagcctgtggcatctacaatcaatacattggcaggtgcattgtacaaagtgttctgcgcatcacctgatcaagcaaggaaggaaatgcgacaggcttgtttcgattatctaagccttggaggtgtattctcaacaggtccaatatcgttgctctcaggtttaaaccctcgccccttgagcttggttctgcatttctttgcggtggcgatatacggtgtcggtcgtttactgttgccattcccttcacctaaacgaatttggattggagctcgactcatctcgggagcatcaggaatcatattccctatcataaaggcagagggagttaggcaaatgttcttcccagcgacagttcctgcatattacagaagagcacctcctgcaaattaatttatagcaagaatttagctttttcgctacgacaaaaatagttagtaaatttcatttcgtattctctcttttcaaaggttaggggaaagatttaccggaaaatgccccaactaagaaaaatgaatgaattatgaatgagaaaatgtatctttgctttgatcaaacacaatatcaaattatccaaaatt

SEQ ID NO: 3296 - DNA, 2405 bp, Gossypium raimondii
gagagattaaattttaaatatacaaaaaatacagggacctagagcaaattaaaccaaattaaaacgagggatgcgtagtttaagtccaaccacatagaaggtgcaaattagcaagaagtatatataacttacgttcccttgcgttatgtggacactctataaaagcctaaaccccatctcgtgtattttcccgtgctgttttcctctaaaacgttttcgaaaacagaaaaaaaaaaaaaaaaagaaaagaaaacattcacagcgaagcaacagctgaaagccgtttcagattcaaagcaccaccgtctcacgctaatcaaaacaaacaaaaaccagccaaatttcatcaccgttatcaaagagagaatcaacagagcaaagagattccgattttctctttcctttttcttcttttttgtgctttcacagtctctacgttgtcgttcttttttggcttagcatttggaggaggagaggagaggagaagaatgagaaaaatggcggatccttacgtgttggcgtggatctcggttttcgtaacgacgcttcttgctttgtgcggtgtcgttttgaagagacggaaagtgatcgggatctcttccgcaaggactgagtcggtgacgagcgtatcggctgttgacggagaatgtagatccgctgatggttgtgatactgacgtcatcattgttggagctggtgttgctggatccgcactcgctcacactcttggcaaggatggacgtcgagtgcatgtgattgaaagagatttatcagagcctgaccgtattgttggggaactgctacaaccagggggctatctcaagttaattgagttgggacttgaagattgtgtggaggaaattgatgctcagcaggtatttggttatgcgcttttcaaggatgggaaacgtacccgactttcttatcccttagaaaatttccactcagatgtatctggcaggagcttccacaatggacgtttcatacagaggatgcgggagaaagcagcttctcttcccaatgtacgtttagagcaaggtgtagttacttctctacttgaagaaaaagggactatcagaggagtgcagtataaaacaaaagatggccgtgaattgacagcatttgcacccctaaccattgtttgtgatggctgtttttcaaacttacgtcgctccctttgcaaccctcaggtagatgtaccctcgtgttttgtcggattggtactggagaattgctatcttccttacgcaaatcacgggcatgttatactagcagatccttcccccattttgttctatcctattagcagcacagagattcgttgtctcgttgatgtacctggtcaaaaggttccttctattgccaatggggagatggcaaattatttgaagacagttgtggctcctcaggttccaccggaaatttacgattcatttgtagcagctgttgataagggaaatattaggacaatgccaaacagaagcatgccggcttctccttatcccactcccggagccctattaatgggagatgcatttaacatgcgccatccattaactggcggaggaatgactgtggctttatccgatattgttgttcttcgtgatctactgaagcctctgcgtgacctcaatgatgcaccaacactctgtaaatatctagaatcattttacaccttgcgtaagcctgtggcatctacaatcaatacattggcaggtgcattgtacaaagtgttctgcgcatcacctgatcaagcaaggaaggaaatgcgacaggcttgtttcgattatctaagccttggaggtgtattctcaacaggtccaatatcgttgctctcaggtttaaaccctcgccccttgagcttggttctgcatttctttgcggtggcgatatacggtgtcggtcgtttactgttgccattcccttcacctaaacgaatttggattggagctcgactcatctcgggagcatcaggaatcatattccctatcataaaggcagagggagttaggcaaatgttcttcccagcgacagttcctgcatattacagaagagcacctcctgcaaattaatttatagcaagaatttagctttttcgctacgacaaaaatagttagtaaatttcatttcgtattctctcttttcaaaggttaggggaaagatttaccggaaaatgccccaactaagaaaaatgaatgaattatgaatgagaaaatgtagctttgctttgatcaaacacaatatcaaattatccaaaaatttcaccctcagtaaaagatacaattgaattaagaaatccaatgagggctgtaaaattaagcatggtatgttatgccttctgataaatacaatagtatcacaattcacaccccctctggtttattcgctctcggtaaaaaaaaaaa

SEQ ID NO: 3297 - DNA, 2530 bp, Cannabis sativa
tatttatgccataaaaaataaactacaccctcaatctcatatgaaaattctccaaataagaaccgacgcccaaaccgactagtgaccaagaaacgcaaacttgaaattgtgtgtttcgatatggaattgcaggcttccggggttttaagatccggcggagcagacggttcaatcaggtggacccagtttcggacccgaatgttgaacccttgttgtgcgaaaacgtattagaattaaggaggagaggtggggaaataacagttattttattagtcaacacgtggttcggcaggcgcaggctaaggctggtgagtgtgaccactgagttggcgcaatttagcattgtatggtaacgtagatgttgagctgtaaaattgtcgttttgagactttgagttgtgagcgagggatataaaaagtgtcacgttgtcctcataaacctcctcgtgggtgggtctgttttccaaaaaagaaatacaaaaacaaaaactcaggcattgccgaaagagagacagaaccgagaacgaccgggaaggaccagccggtgtttgtcgtttccgccggaaatggtcgatcagttcgtgattggttggatctcagtctcttttctcagccttcttgctttctacaatcttgttctcaagaagaacaagattccgaaggattcttcggacaagataaccgaatgtatccagaatgacatcacggccattaacggcgaatgccgatccaaagatggcgacgtcgacgtaattattgtcggagccggtgtcgctggttctgctcttgctcacacactcggcaaggatggacgtcgagtgcatgtgattgaaagagacttaacggagccagacagaattgttggtgaactactgcaacctggaggctatctcaaattaattgagctgggacttcaagattgtgtagaggaaattgatgcccagcgtgtctttggatatgctcttttcaaggatggaaaagacactcggctgtcttaccccttggagaaatttcattccgatgtggctggaaggagctttcacaatgggcgtttcattcagaggatgcgggcaaaagctgcttctcttccgagtgtacaactagagcaaggaacggttactacactgcttgaagaaaatggaatagttaaaggggtgcaatacaagacgaagactggccaagaaatggcggcatatgcgcctctgactattgtttgtgatggctgtttctcaaacttacgccgttcgctttgcaatcctaaggtagatgtgccatcttgttttgttggtttagttttggaaaactgcaaccttccatatgtaaatcacgggcatgttatactagcagatccttctcccattttgttctatcaaattagtagtacagaagttcgctgtctggttgatgttccaggacagaaggttccttctatttcaaatggtgaaatggcgaagtacttgaaggctgtggtggctcctcagattcctcctcaaatttttgattcctttgtggctgcaattgacaagggtaacataaggacaatgccgaatcggagcatgcctgcttctccccaccctacccctggagccttgctaatgggagatgcatttaacatgcgccatcctcttaccggtggaggaatgactgtagcattgtctgatattgttgtccttcgtgatcttctgaagcctttacatgacttaaatgattcatataatctctgcaaataccttgaatctttttacactttgcgtaagccagtagcatccactataaacacattggctggagctctgtacaaggtcttttgtgcttcacctgatcaagcaaggaaggaaatgcgtaatgcttgcttcgattatttaagcctaggtggtattttctcaacaggaccagtgtctcttctttcaggattaaaccctcgtccactgagcttggttcttcatttttttgctgttgcaatattcggtgttggtcgattgttgcttccatttccatcgcctaagcgcatgtggattggagcaagattggtttcgagtgcatcaggaatcatcttcccgattatcaaggccgaaggagtaaggcaaatgttcttccctgctactgttccagcttattacagaggccctcctgctaagtgaaatccagttggttgaacattacaaagacacaaccacactagagaaggcaaaagttgagtctgttgtcatcatacacattcattatcctatttgtacctctcgtccccctccccatgctcaaaatgaatttggggaacagtgtaatgcttcaccactacttgtgcagtatgcgaaggttttagtttctaggactgttaatgttatttttaatgtataaatatcatttcaaaatatcaaaaaaaaaaaaatgtcatttcaaaatccaaaatttgtcacctttttcttgttggtttctttacaatttatcatagcaaaaattgtctttgataagtcaatcaattcataaatcaaaacctgtaatcttttcgcatcaccgaaaaccagctctct

SEQ ID NO: 3298 - DNA, 2083 bp, Manihot esculenta
cgttcgaaaaaaaggcattttgccagcgaagctttcgtactctagctaacaaaagcaaaaccaccactcgatagagaaatccagagctttaccagccagacaaacacgcacagcgagcaagagagcgagcgagagagattaatactcatctccttgtcgattctgcttatctaatcagattcagaatgaaaatggcggatcattacttgctaggatggatcttggcctccgtcgcggggcttttcgctttctactatatggtttatttggtagtgaagcgggaggagcggaataatagacaagacttactgcaggcgggaagcgagtccgtcaagaccatgtccgctaacagtggagaatgcagatccgatgacgacggcgattttgacgtcatcatcgttggcgccggtgttgctggctctgctctcgctcataccctaggcaaggatgggcgtcgagtgcatgtcattgaaagagacttgactgaacctgacagaattgttggtgaattgcttcaaccagggggctacctgaagttaattgagttgggacttgaagattgtatggaggaaattgatgcacagcgggtttttggttatgctcttttcaaggatggaaaacatacccaactagcgtatcccttggagaagtttcattcagatgtagcagggaggagctttcacaatgggcgtttcatacagaggatgcgggaaaaagctgcatcccttcccaacgtacgattggagcaaggaactgtgacttctctacttgaagaagaagggacaattaaaggtgtgctttacaaaactaaaactggtgaagagcttacagcttttgcacctttaacaattgtttgtgatggctgtttctcgaatctgcgtcgctcactttgcaatcctaaggtagatgtgccctcctgttttgttggcttggtcttagagaattgccaacttccttatgcaaatcatgggcacgttatcctagcagacccgtccccaattctattctatcccatcagcagtacagaagttcgctgtctagtcgatgttcctggtcagaaggtcccttctgtttcaagtggtgagatggcaaattatttgaagactgtggttgcgcctcaggttcccccagaaatttataattcttttgtagctgcagttgacaagggtaacattaggacaatgccaaacagaagcatgccagctgctccctatcccacccctggtgccttgttgatgggtgatgcatttaacatgcgccatcctctaactggaggaggaatgactgtggcactttctgacattgttgtgctacgtgatcttctcaagcctttgcgggacctacatgatgcacctactctgtgcagatatcttgaatccttctacactttgcgtaagcctgtggcatctacaatcaacacattagcaggtgccctctacaaggtgttctgtgcttctcctgatgaagcaaggaaggaaatgcggcaggcttgttttgattatttgagtcttggaggtgtattttcgacaggaccagtctctttgctctcaggtttaaaccctcgtccattgagcttggttctccatttctttgctgtagcaatctatgctgttggtcgtttgttactgccatttccttcacctaggcgcatgtggattggagctaggttaatttcgggtgcatcaggaatcatatttccgattatcaaggcggaaggagcgaggcaaatgttcttccctgcaactgttccagcttattatagaactcctcccaggaaatgtaattaatattaaaagaaaaagaaatcatagataatgaggtacgagtcttgcctcattgtattctcattcctttattcaaagttaaggtcgcggttgaaagcgaaagaagtgaatcaccatacgctttagtctttagtaaccatctttttcttctctgagcccaaaataattttccttttttgttttattttgtagcattgttaatgttttgtaaaagaacctaaaaccttgtagaaaaatcgacacctgtggctccttttattctgaaaacgtgaaaattgatttttagatttatttggttt

SEQ ID NO: 3299 - DNA, 2107 bp, Mimulus guttatus
agcactctgattcacgcacaaattaccatttgaatccaccatatctctttctttctttaatcccccacgagtacagcgaagcgaggaccgagaacctctatctagagagagaaagaaagaggagagagagagagagagagagcagcttcggtcattgctcccggcaacagatagtttttactctaaaagaagctacctgcattgccggcaataatggtggatcttactcttttcgcctctcttttacctttcctttttggcttcctctttctttattattttggctttttgaggaaaaaaaatcaggatattcggtcgaacagccctgcctccgccgccaccaccaccaccaccaccaccaccgccgtcgttggaggaggagaatgcggatcgagggatgacgtcatcattgtcggtgctggcgtcgctggcgctgcccttgctcacactcttggcaaggagggaagacgtgttcgagttatcgaaagagatttaacggagcccgacaggattgtcggagaactcctacaaccaggcggttacctcaaactcgtcgaattaggattggaagattgtgtggaggaaatcgatgctcagagggtgttcggttacgcactattcaaagacggaaaagccactcgactttcgtatccattggagaaatttcactccgatgtatctggtaggagcttccacaacggacgcttcattcaaaggatgcgagaaaaagcttcttctcttccaaatgtttgtgtcgaccaaggaactgtcacatctctgctcgaagaaaacggaaccatcagaggtgtacagtacaaaacgaaatccgggcaagagttgaaagcttacgcacccttaacaatcgtatgcgatggctgcttttctaacctccgacgctctctttgcagtccaaaggtggaagtgccgtcttgtttcgtcggtctggtcctcgagaattgccaactcccgtttgcaaatcacggccacgtgattttagcagacccatcgcctatcctattttaccccataagcagcaccgagattcgctgtcttgttgacgttcccggtgagaaagttccctccatttcaaacggtgaaatggccaaatatttgaacaccgtcattgctccacaggtccctccagaactgcacgatgcttttatttccgcgattgagaaagggaacataaggacaatgcccaataggagcatgccagctgcccctcatcctacgccgggtgctttgcttatgggggatgcattcaacatgcgtcacccattgacaggtggcggaatgactgtcgcactatcggatattgttgtcctgcgcaatctccttaagccactgaacgacctcggcgatgcatccgctctttgcaaatatctcgaatgtttctacactttgcgcaagcctgtggcgtcgactatcaatacattggccggtgcactatacaaagtgtttagtgcttcaccggacgaagcaagaaacgagatgagacaggcgtgcttcgactatttgagccttggaggtgtttgctcaaacgggcccgtttctttgctctcgggtttgaaccctcgcccactcagcttggtttgtcatttctttgctgtggctatatttggggttggtcgattattgcttccctttccatcgcccaaacgaatgtggattggagctagattaatatcgagtgcttctggaataatattcccaatcataaaggcggaaggtgtgaggcaaatgttcttcccagctacagtacctgcttaccacagagctcctcccactaaagattctgatgttgatgtccaaatttagttttgtattaaaaaagtcgaaatcgtcgcatatatttcggacttaggtccgatgtttttgtgaatgatttcgagcatattaagataccatgtatttttatttttttgttgaattatttgaagttgttggacttgtctgtaaatagatccttccctctagtgttgttctggactatgtttagtatgaaaaggaaaaaaaaaaatttaaaaattgttgtttaaactttgcatcacttttataactcttgaatcattttgaaataatagacaaattatgatattgtacaact

SEQ ID NO: 3300 - DNA, 2116 bp, Malus domestica
ccaaacaaacggttacaaaacactcaaaaggcaattcgccagcgcagagactgccgaatattccacaaaaccggagagagagcgagactgtgtgtgtgagccgcggcatccataaaaggccgcgcacacgcacagagagaaattgagggagggagaagcgtcgttgtttgggaggaatggcggatcagtacttgctcggatggatcttcgccaccgtgctgggcgtcgtatttctttacagagcgctggcgaagaggagcgacgagaaagggagaggtttggtggaggaggagaataggagcgagtgcgtgaagagcgtgatggtctccaacggagaatgcagatccactgacggcgacgtcgacgtcatcatcgtcggtgcgggtgtcgccggcgccgctctcgctcacactctcggcaaggatggacgtcgggtgcatgtgattgaacgagacttgacagagccagaccgaattgttggtgaattactacaacctggaggctaccttaaattaattgagctgggacttgaagattgtgtggagcaaattgatgctcagcgggtttttggatatgctcttttcaaggatgggaaaaatactagattgtcttatcccttggagaaatttcactcagatgtgtctgggaggagctttcacaatggccgtttcatacagaggatgagggagaaggctgcaactcttcccaatgtgcgattggagcaaggaacggttacttcactgcttgaagaaaagggaacaattaaaggtgtgcaatacaagactaaaactggcgaagagatgaccgcatatgcacctcttactgttgtttgtgatggctgtttctccaacttgcgtcgcactctttgtgatcctaaggtggatgtgccttcttgttttgttgggttggttctggagaattgcaatcttccacatgctaatcacggacatgttatattagcagacccttctcctattttgttctataaaatcagtagcacagaggttcgctgtctggttgatgtacctggacaaaaagttccctccatttcaaatggtgaaatggcaaagtatttgaagactgcggtggctcctcagattccccctcaaatttatgattccttcgtagctgcagtggataagggtaccataaggacaatgccaaatagaagcatgcccgccgctccctacccaactcctggagctctattgatgggggatgcattcaacatgcgccaccctctgacaggcggaggaatgactgtggccttgtctgatattgttgtgctgcggaatcttcttaagcctttgggcaacctaaatgatccatctacactgtccaaatatctggaatccttctacactcttcgcaagccagtggcatccacaataaatacattggcgggtgccctttacaaggtcttttcttcttcacctgatcaagcaaggaaggaaatgcgccaggcttgctttgactatctaagtctcggaggtgtattctctacaggaccagtctctctgctttcggggttgaaccctcgccccttgagtttggttctccatttctttgccgttgcagtgtatggtgttggtcgtctgttgctgccatttccatcacctaaacgcgcctggattggagccagattaatttctagtgcctcaggaatcatattccccataatcaaggcggaaggagttagacaaatgtttttccccgcaactgttccggcatattacagagcacccgtctcaagcgagaagcagctgaaaaagactgaaggttgcgtaagctgatggtaccgcgctgttgggagaggattttccgatgggcaccgctcccggccattcctcatttgcagttgaggggaaggtgaatgcaaaaaaacagaaagatttgttgtagcaaccgcagtttttttttttaggactcgttctttctatgtgttcatacctttattttttttcaagtacataatggaagattcaaaatccatgcatcatttcttgcacctgaggtccgaagtttgacttctccctccctcgatatttgcttgtatcgcaagaaaaaaatccataaaaataaacaacacttctaatggccaataaacgtgagtatg

SEQ ID NO: 3301 - DNA, 1954 bp, Aquilegia formosa
aaagcacacaacacgccaaaagagagacagagtaacgcgagaaagacagagagaaagagaaagagacagagagatcttgttctttcttcatctttccagagcgagagagagagagaaatcttgttctttctttgttcttcgttctggaatttgaagatgaatgagtatatatttggaggaattattggagctttgttagggttttttctattatatggtttatcattactaacgaagaataagaataagaagaagaagaacgaatcttctattcatattcaaaacgaatgtaataagagttctgttgttgataatggtgatgttcaatcaagtgatattgatgtaattgttgttggtgctggtgttgctggtgctgctcttgcttatacgcttggaaaggatgggcgtcgagttcgcgtgattgagagagatttggaagaaccagacagaattgttggggaactgttacagccaggtggctacttgaaattggtagagttgggccttgcagattgtgtagagaaaattgatgctcagagagttctaggatacgcacttttcaaggatggtaaagacacaaaacttgcatatcctctagaaaaatttcattcggatgtggctgggaggagttttcacaatggacgtttcattcaacgcatgcgtgagaaagctgcatcccttccaaatgtccgtctggagcagggaactgtaacatccttactagaagaaaacgggattgttaaaggcgtactgtacaaggcaaatggtgaggaacagacagcatatgctcctcttacaattgtatgtgatggttgcttttcaaacttgcggcgctctctctgcagtcctaaggtagatgtaccttcttgctttgttggtttgattttggagaactgtcaacttccatatccgaaccatgggcatgttgttttgggagatccttcccccattttgttttaccccatcagcagtagcgaaattcgctgtttggttgatgtacctggacaaaaggtgccttctatttccaatggcgaaatggccaactatttgaagactgtggtagctccccaaatcccccacgagctgtatgattctttcctagcagcaattgaaaaaggcagcattagaacgatgccaaacagaagcatgccagctgctccccatcctactccaggtgctttactcatgggggatgcattcaatatgcgtcatccattgactggtggagggatgacagttgccttgtctgatatagttgtgcttcagaatcttattaagcctcttcgcaatctgcacgatgcatctgccttgtgcaaatatctggaatctttctacaccttgcgcaagcctgtggcatctactataaataccttggccggtgccctgtacaaggtcttttgtgcttcgtctgatcaggcaaggaaggaaatgcggcaagcctgctttgattatttaagccttggaggagtttgctcatcggggccagttgctctactatctggtcttaacccgcgtccattaagcttggtctgccatttttttgctgtggctatatacggcgttggccgcctgctgcttccattcccttcaccaaaacgtctatggattggagctaaattgatttcgggtgcatcaggcatcatctttcccattataaaggcggaaggcgtcaggcagatgtttttccctgctactgttccagcatattacagagttcctcctgttaactgaaaggaagaaaaataaaagggagggagaaagagaaaaatgtcttcttgtaacagtacgtgtaatatccattcttgtttattaatttggtaggggaacatttctcttcttatacagataagatcctgtgcataacatccatattttttatttctccagttttcctcgaaactgtatactgtctgccctgagttttttgaacatgaattttgcatatcttgatttg

SEQ ID NO: 3302 - DNA, 1943 bp, Vitis vinifera
aacaccacagctccacagagaaacgttgtcgtttcgacgcactgctcgatctcgtcttcagccccacattcccacaggcgcttgaagatgttccacccctacattctcggagctttctttgcttctgtgttggggtttctcctttacgctttacgtgataaagagaggaaagacaaccgccaccgccaccatcgtgcagatgggcttgttacgagtagctccgaaatcgggcaatgtcgccaggatgacggcttcggcaccgatataatcattgtcggcgccggagttgccggttcggccctcgcccacactctcggcaaggatggaaggcgagttcacataattgaaagagacttgacggagcctgacagaattgttggtgaattgctgcagccaggggggtacctgaaactaattgaattgggccttgaggattgtgtggaggaaattgatgctcagcgggtacttggatatgctcttttcaaggatgggaaaaatacaagactctcttacccattggaaaagtttcattcagatgtggcgggaaggagcttccacaatggtcgtttcatacagaggatgagagaaaaagctgcttctctttccaatgtacgtatggagcaaggaacagtaacatcactccttgaagaaaatgggactattaagggggttcaatacaaaacgaaggctggtcaagaacttaaagcatatgcaccacttacaattgtgtgtgatggttgcttctcaaatttgcgtcgctctctttgtaaccctaaggtagatgtgccctcctgttttgttggtttggtcctggagaactgtcagcttccctttgcaaatcacggacatgttattttagcagatccttcacccatcttgttttatccaattagtagtactgaggtccgttgcttggttgatgttcctggacaaaagttaccttctattgccaatggtgaaatggccaaccatttgaaaaccagggtggctccccagcttccacctcaactttatgatgcctttatctcagcaattgatcaaggaaagataaggaccatgcccaatagaagcatgccagctgatccttatcctacacctggagccttattaatgggtgatgccttcaatatgcgccatcctttaactggcggaggaatgaccgtggcactatctgatattgttgtactacgagatcttcttaagccgctgtccaacctgaatgatgcggtttcattgagcaaatatcttgaatccttctacaccttgaggaagccggtggcatctaccattaatactctggcaggtgccctttataaggtgttttgtgcttcccctgatcaagcaaggaaggaaatgcgagaggcttgttttgactacttgagtctcggaggtgtttgttcagcaggtccagtggctttactctctggtctgaatcctcgccctttgagcctagttgtccactttttcgctgtggctatatatggtgttggtcgcctgttgctaccatttccttcactcaaacgcttgtggattggagccagattgatttcggctgcatcgagtataatcttccccatcataaaggcagaaggagtgaggcaaatgttcttccccgtaaccatgccagcatactacagagctcctcctgctaaatgagataaaaaccaaatggcatgctcaaagtcgaagtagctttagtttgttgtttggtcttcatgttgtctcgacaaagtagcttgtatctatgactatgctcccatgtagacttgggatgccaaatgtttccttcaatgaccgttgtgcaagagatgactgtaaacgggttattcaaatgtataaatgagcaaccacttagaatccaggagtatgtgttctgctgacttttccaaatataattcaatgaaatcctccccattctgcgtgtatattaaatgggtgttgat

SEQ ID NO: 3303 - DNA, 1850 bp, Aquilegia formosa
tccagagagagagagagagagaaatctggttcgttctttctctggaatttgaagaagatgaatgagtacatatttggaggaattattggagctttgttagggttttttctattctacagtttatcattatcattactaacgaagaagaagaataagaataagaataacgaatcttgtattcagattcaaaacgaatgcaataagagttttattgttgataatggtgatattcaatcaaatgatattgatgtgattgttgttggtgctggtgttgctggtgctgctcttgcttacacgcttggaaaggatggacgtagagttcgtgtgattgagagagatttggaagaaccagacagaattgttggggaactgttacagccaggaggctacttgaaattgatagagctgggccttgcagattgtgtagaggaaattgatgctcagaaagttctaggatacgctcttttcaaggatggtaaagatacaaaacttgcatatcctctagaaaaatttcattcggatgtggctgggaggagttttcacaatggacgtttcattcaacgcatgcgtgagaaagctgcatcccttccaaatgtccgtctggagcagggaactgtaacatccctactagaagaaaacgggattgttaaaggtgtactatacaaggcaaatggtgaagaacagacagcatatgctcctcttacaatcgtatgtgatgggtgcttttcaaacttgcggcgctctctctgcagtcctaaggtagatgtaccttcttgctttgttggtttgattttggagaactgtcagcttccatatccgaaccatgggcatgttgtcttgggagatccttcccccattttgttttaccccatcagcggtaccgaaatccgctgtttggttgatgtacctggacaaaaggtgccttctatttccaatggcgaaatggccaactatttgaagactgtagtggctccccagatcccccatgagctgtatgattctttcctagcagcaattgaaaaaggcagcattagaacgatgccgaacagaagcatgccagctgatccccatcctactccaggtgctttactcatgggggacgcatttaacatgcgtcatcctttgactggtggagggatgacagttgccttgtctgatatagttgtgcttcagaatcttattaagcctcttcgcaacctgcacgatgcatctgccttgtgcaaatatctggaatctttctacaccttgcgcaagcctgtggcatctactataaataccttggctggtgccctgtacaaggtcttttgtgcttcgtctgatcaggcaaggaaggaaatgcggcaagcctgctttgattatttaagccttggaggagtttgctcatcaggcccagttgctctactatctggtcttaacccacgcccattaagcttggtttgccatttttttgctgtggctatatacggcgttggccgcctgctgcttccattcccatcaccaaaacgtttatggattggagctaaattgatttcgggtgcatcgggcatcatctttcccattataaaggcggaaggtgtcaggcagatgtttttccctgctactgttgcagcctattacagagctgctcctgttaaggaagaaaggaaaaaaaatgtctgcttgtaacagtacgtgtaatatccattcttgtttattaatttgagtaagggaacatttctcttcttttacagataagatcctgtgcataacatccatatattttatttctccagttttcctcgaaagtgtatactctgtctgtcctgagttctttggacaagaattttgcatatcttgatttgaaactcact

SEQ ID NO: 3304 - DNA, 1976 bp, Gossypium hirsutum
gacattcacagcgaagcaacagctgaaagccgtttcagattcaaagcaccaccgtctcacgctaatcaaaacaaacaaaaaccagccaaaattcatcaccgttatcaaagagagaatcaacagagcaaagagattccgattttctctttttcttcttttttgtgctttcacagtctctacgttgtcgttcttttttggcttagcatttggaggaggagaggagaggagaagatgagaaaaatggcggatccttacgtgttggcgtggatctcggttttcgtaacgacgcttcttgctttgtgcggtgtcgttttgaagagacggaaagtgatcgggatctcttccgcaaggactgagtcggtgacgagcgtatcggctgttgacggagaatgtagatccgctgatggttgtgatactgacgtcatcattgttggagctggtgttgctggatccgcactcgctcacactcttggcaaggatggacgtcgagtgcatgtgattgaaagagatttatcagagcctgaccgtattgttggggaactgctacaaccagggggctatctcaagttaattgagttgggacttgaagattgtgtggaggaaattgatgctcagcaggtatttggttatgcgcttttcaaggatgggaaacgtacccgactttcttatcccttagaaaatttccactcagatgtatctggcaggagcttccacaatggacgtttcatacagaggatgcgggataaagcagcttctcttcccaatgtacgtttagagcaaggtgtagttacttctctacttgaagaaaaagggactatcagaggagtgcagtataaaacaaaagatggccgtgaattgacagcatttgcacccctaaccattgtttgtgatggctgtttttcgaacttacgtcgctccctttgcaaccctcaggtagatgtaccctcatgttttgtcggattggtactggagaattgctatcttccttacgcaaatcacgggcatgttatactagcagatccttcccccattttgttctatcctattagcagcacagagattcgttgtctcgttgatgtacctggtcaaaaggttccttctattgccaatggggagatggcaaattatttgaagacagttgtggctcctcaggttccaccggaaatttacgattcatttgtagcagctgttgataagggaaatattaggacaatgccaaacagaagcatgccggcttctccttatcccactcccggagccctattaatgggagatgcatttaacatgcgccatccattaactggcggaggaatgactgtggctttatccgatattgttgttcttcatgatctactgaagcctctgcgtgacctcaatgatgcaccaacactctgtaaatatctagaatcattttacaccttgcgtaagcctgtggcatctacaatcaatacattggcaggtgcattgtacaaagtgttctgcgcatcacctgatcaagcaaggaaggaaatgcgacaggcttgtttcgattatctaagccttggaggtgtattctcaacaggtccaatatcgttgctctcaggtttaaaccctcgccccttgagcttggttctgcatttctttgcggtggcgatatacggtgtcggtcgtttactgttgccattcccttcacctaaacgaatttggattggagctcgactcatctcgggagcatcaggaatcatattccctatcataaaggcagagggagttaggcaaatgttcttcccagcgacagttcctgcatattacagaagagcacctcctgcaaattaatttatagcaagaatttagctttttcgctacgacaaaaatagttagtaaatttcattttgtactctctcttttcaaaggttaggggaaagatttaccggaaaatgccccaactaagaaaaatgaatgaatttgctttgatcaaacacaatatcaaattaacc

SEQ ID NO: 3305 - DNA, 2068 bp, Fagus grandifolia
ggtggctatatatatatataaagaaaactcatgcttttggtgaataacgaatttagttctgatttgttcacgaaagagctcgcaagccaaggccagcgaggataaacaaagagagaaagacaaggtaaagctgaagagagagagagagagagacacagagagggagattcttgagctcggtggaacgcattggtgaaaatggtggatcaatacacgttgggagggatcttggcctcggttttcgcgctcgtggcgatttatactcttgtggccaagaagaagaacaacaataaccgtagagattctccaaacgcgcgaagcgagtccgtgaacagcgtcgccaccgctaaaggagaatgtagatccactaactccgacgccgacgttatcatcgtcggagccggcgtcgccggcgccgctctcgctcacactctcggcaaggagggacgcaaagttcacgtgattgaaagagatttaacagagcctgaccgaattgttggtgaattgctacaacctggaggctatctcaaattaattgagttggggcttgaagattgtgtggagaaaatcgatgcgcaacgagtgtttggttatgccctttttaaggatgggaaaaacacccgactctcttatcccttggagaaatttcactcagatgtgtctggaaggagctttcacaatgggcgcttcatacaaaggatgcgagagaaggctgctacccttcccaatgtacaattggagcaaggaactgttacttctctgcttgaagaaaatggagcaattaaaggcgtgcaatataagactaaagatggcaaagaactgacagcatgtgcacctttaaccattgtttgtgatggctgtttctcaaacttgcgtcgcaccctttgcgatcctcaggttgatgttccttcttgttttgttggtttggttctggagaattgtgatcttccttatgcaaatcatggacatgtcatactagcagatccttctcccattttgttttatcctattagtagcacagaggttcgctgtctggttgatgtacctggacagaaagttccgtctattgcaaatggtgaaatggcgaactatttgaagactgttgtggccccgcaggttccccctgaaatacacgattcttttgttgctgctattgataaaggtaacataaggacaatgcccaacagaagcatgccagctgctccccatcctactcctggtgccttgttaatgggggatgcattcaacatgcgccaccccttaactgggggagaatgactgtggcattgtctgatattgttgtgctacgaaatcttctcaggcctttgcaagacttaaatgatgcagctaccctctgcaagtatcttgaatccttttacaccttgcgtaagccagtggcatccacgatcaatactttggcaggggccttgtacaaggtcttttgtgcttcacctgatcaagcaaggaaggaaatgcgcgaggcttgctttgattacttaagtcttggaggtgtattctcaaccggaccagtttctctactctcagggttaaaccctcgccccttgagcttggttctccattttttcgctgttgcagtatttggtgttggccgtttattgctgccctttccttcaccttcccgcatctggattggagccagattaatttcgggtgcatcagggatcatcttccccataatcaaggcagaaggagttaggcagatgttcttccctgcgactgttccagcttattacagagctccacctgttaagggtaatcattaaagcaagatgcctaaagagaatgtagcgaaaaattggctgcggtcaagactaggcaataagtattggtgccttacctcgttcaaagtggaggaggagggtgaatacttggaaaatgagatgtgcattaatacacattttgatttttagaacttgttcgttctagtgtgttaataacttatattcttcaagtatactatagttttgtttctattgacttagttcttcagatcagaaagtccttcttcatgcttatttcattgcttggcttacttttttgaaaaact

SEQ ID NO: 3306 - DNA, 1620 bp, Papaver somniferum
agttctatcaatggtgacttacgatccaatggtgatacagatattataattgttggtgctggtgttgctggtgctgctcttgcctacacccttggaaaggatggacgacgagttgttgtgattgagagagatttaaccgagcctgacagaattgttggagaactgttacaaccaggaggctacctgaagttgatagaattggatcttcaggattgtgtagagcaaattgattcccagagagttctaggttatgctcttttcaaggatggtaaagatactagactcgcatatcctttggaaaagttccactcagatgtggctgggagaagctttcacaatggccggtttattcaacggatgagggagaaagcctctacccttcccaatgtgcggttggagcagggaactgtaacatccttactagaagaaaatgggaccattaagggagtattgtacaagaccaagtttggtgaagaaataaatgcatatgctcctctgacaattgtatgcgatggttgcttttcaaacttgcgtcgttctctctgcagcccgaaggttgaggttccctcatgttttgttggcttgatccttgagaactgcaagcttccccatcaaaaccatgggcatgtaattctagcagacccttcaccaatcttattttatcaaatcagcagtaccgaggttcggtgtttggttgacgtacctggccaaaaagtaccatctattggaaacggtgaaatggcaaaatatttgaagactatggtggctcctcagattcctcctcagatatatgattcctttatagcagcaattgacaaaggaagcataagaacaatgccaaacagaagcatgccagctgctcctcttcccactccaggtgccttattaatgggagatgcattcaatatgcgccaccctttaaccggcggagggatgactgtggcattgtctgacattgttgttctacagaatcttcttaggcctttgaggaacctgaatgattcagcttctttatgtaaatatttggaatccttttacaccttgcggaagcctgtggcatctaccataaatactttggctggagccctgtacaaggtcttctgtgcttctcctgatcaggcaaggaaggaaatgagagaagcatgtttcgactatttgagtcttggaggggtttgtgctgaaggcccagtagctttactctctggactcaatccacgcccattgagcttagtttgccatttctttgctgtggccatatttggagttggccgtctattgctaccattcccatcacccaagcgtttatggattggagctaaattgatttcgactgcatctggcattatatttccaattataagagctgaaggagtcagacaaatgttttttcctgccacagttccagcatactacagatcaccgccagtcgagtagaaacagaccatccgtaagagaaatcatatagcaaatgatagcgaaaaagggtcagaatattgatattgtaatttgtaccagtaaaataggtcgtcctcttcccaggatctaaattaagtttagggaaagacgtttatgtgcagaatttgttcatataggaatattctgttactggttcttcgcaac

SEQ ID NO: 3307 - DNA, 1939 bp, Citrullus lanatus
ggggtcccgttaagcaactcggtcgttggcgtaaagttttgccagcggagagagatacgcgcagagggaatttataagcaattgacgaagagagagggggaggaaactcagagggccacaggagggagagttatcgtcgttgtcgtcgtcgcattggcggtctctgtgaggtcgctgcttctgtactcggaaaaaatggtggatcagtgcgggttaggctggatcttggcctcagttctcggagccgcggctctatatttcttgttcggcaagaaaaactgcggagtttctaatgaacggaggcgtgagagcctaaagaatatcgccaccacgaatggagaatgcaaatcgagtaacagcgacggcgacattatcattgtcggagccggagttgccggatccgctcttgcctatactctcgccaaggatggtcgtcgggtacatgtgattgaaagagacttgacagagccggacagaattgttggtgaattattacaaccgggaggctatcttaagttaacagagttgggacttgaagattgtgtaaatgatattgatgcccaacgagtgtatggttatgctctttttaaggatggaaaggataccagactctcctatcccttggaaaaatttcactcggatgtttccgggaggagctttcacaatggacgcttcattcaaaggatgcgtgagaaggccggatccctgcccaatgtgcgcttggagcagggaacggtcacttctctgctcgaggaaaatggtacaattaaaggtgtgcaatacaaaaacaagtctggacaagagatgaaagcttatgcgcctttgactattgtttgtgatgggtgcttttcaaatttgcgacgctctctttgcaaccctaaggttgatgttccctcttgttttgttggcctcgtactggagaactgtgaccttccttatgcaaatcacggacatgtgatactagcagatccttctcccattttgttctatcccatcagcagtacagagatccgctgtctagtggatgtgcctggtcagaaagttccttccatttcaaacggtgaaatggctaactatttgaagaatgttgttgctcctcagattcctcctcaactttatgattcattcatagctgctattgataagggtaacatcagaacaatgccaaatagaagtatgccagcagatccatatcctacccccggagccctattgatgggcgatgcattcaatatgcgtcaccctctaactggcggagggatgactgttgcattgtctgacattgttgttctaagagatcttctcaagcctctgcgtgatctgaatgatgcacccactctctgcaagtatctcgaagcattctacacactacgcaagccagtggcttcgactataaacacgttggcaggtgccctatacaaggtattttgtgcatcaccagaccaggctagaaaggaaatgcgtcaggcttgcttcgattatctaagcctcggtggaatcttctcgaatggaccagtttctttactctctgggttgaaccctcgccccttgagcttggttctccatttctttgcggtggctatatacggtgttggtcgattgctgatcccatttccttctcccaaacgcgtctggattggagccagattgatttcgggtgcatcggccattatctttccgattatcaaggctgaaggagtaaggcagatgtttttccccaagaccgttgcagcttattacagagctccacccgtcgtaagaaagaggtaacacttctggcataagaaaggagaaaggttatgtgagaacaaatgtgtttaatggcaggggcttttgtggcaaaccgtgttggttccgatccgaagatgtaaatcgactcactaattattctttcctttctgttgcgttgtgtgatgttagttatccagaacctggtgtg

SEQ ID NO: 3308 - DNA, 3143 bp, Gossypium hirsutum
aaaccccatctcgtgtattttcccgtgctgttttcctctaaaacgttttcgaaaacagaaaaaaaaaaaaaagcattcacagcgaagcaacagctgaaagccgtttcagattcaaagcaccaccgtctcacgctaatcaaaacaaacaaaaaccagccaaatttcatcaccgttatcaaagagagaatcaacagagcaaagagattccgattttctctttcctttttcttctttttgtgctttcacagtctctacgttgtcgttcttttttggcttagcatttggaggaggagaggagaggagaagatgagaaaaatggcggatccttacgtgttggcgtggatctcggttttcgtaacgacgcttcttgctttgtgcggtgtcgttttgaagagacggaaagtgatcgggatctcttccgcaaggactgagtcggtgacgagcgtatcggctgttgacggagaatgtagatccgctgatggttgtgatactgacgtcatcattgttggagctggtgttgctggatccgcactcgctcacactcttggcaaggatggacgtcgagtgcatgtgattgaaagagatttatcagagcctgaccgtattgttggggaactgctacaaccagggggctatctcaagttaattgagttgggacttgaagattgtgtggaggaaattgatgctcagcaggtgtttggttatgcgcttttcaaggatgggaaacgtacccgactttcttatcccttagaaaatttccactcagatgtatctggcaggagcttccacaatggacgtttcatacagaggatgcgggagaaagcagcttctcttcccaatgtacgtttagagcaaggtgtagttacttctctacttgaagaaaaagggactatcagaggagtgcagtataaaactaaagatggccgtgaattgacagcatttgcaccgctaaccattgtttgtgatggctgtttttcaaacctacgtcgctctctttgcaaccctcaggtagatgtaccgtcgtgttttgtcggattagtactggagaattgccatcttccttatgcaaatcacgggcatgttatactagcagatccttcccccattttgttctatcctattagcagcacagagattcgttgtctcgttgatgtaccaggtcaaaaggttccttctattgccaatggggagatggcaaattatttgaagacagttgtggctcctcaggttccaccggaaatttacgattcatttgtagcagctgttgataagggaaatattaggacaatgccaaacagaagcatgccggcttctccttatcccactcctggagccctattaatgggagatgcatttaacatgcgccatccattaactggcggaggaatgactgtggctttatctgatattgttgttcttcgtgatctactgaagcctctgcgtgacctcaatgatgcaccaacactctgtaaatatctagaatcattttacaccttgcgtaagcctgtggcatctacaatcaatacattggcaggtgcattgtacgaagtgttttgcgcatcacctgatcaagcaaggaaggaaatgcgacaggcttgtttcgattatctaagccttggaggtgtattctcaacaggtccaatatcgttgctctcaggtttaaaccctcgccccttgagcttggttctgcatttctttgcggtggcaatatacggtgttggtcgtttactgttgccattcccttcacctaaacgaatttggattggagctcgactcatctcgggagcatcaggaatcatattccctatcataaaggcagagggagttaggcaaatgttcttcccagcgacagttcctgcatattacagaagagtacctcctgcaaattaatttatatcaagaatttagctttttcgctacgacaaaaatagttagcaaatttcattttgtactctcttttcaaaggttagggaaagatttaccggaaaatgccccaactaagaaaaatgaatgaatttgctttgatcaaacacaatatcaaattaaccaaaaatttcaccctctgtaaaaacatttacagtaaaagatataatattgaattaagaaatcctatgagggctgtaaaattaagcatggtatgttataccttccgataaatacaatagtatcacaattcacaccccctctggtttattcgctctcggtaaaaaaaaaaaccattattcatctgagatgtaaaagcctagaaatacaacatgaaatatatgaactgagttaaaactctcaacaaaaaaaattgattttcggtgctgagtgtgcactccaatccatcggtagaggtaagaagtgtagggttttaaatatattctacatccctatttctaacacttcacacttactcaactcttgtcgaaaagtagctcggtttttcagttttcataccctcgtgttcttcctttcttgctttatagcctcgtacgacatcatcacctctttaaatttcgcctcggcaacttctttattatcctggttctgatctgggtggaattgtttcgccttggccctgaatgctgtcttaatctcatcttcagtatatggtttcaatcgggctctgtcaagacctaaaaccgtgtagtgatgtgataatggatagctcgctcgctctctttgaggtggcctgtaattagttctttgatctctgtaagatgcatctgctttccaataccaatcatctcgttgaaagtgttgatggtaagcaccgggaccagtttctttccaggtttcatagctccttttgtgtttatttcgttccctgttaaacacactttgcatccgccttattcgttccactctttccatttcttcttcgtgctcttcttgcattcggcgattataccttctccatgcttcctcttgaaaggatgttcgagaagaacctcctcctcgtgatgattttgacctgactaactgagtatatatccaatcaacagatctcctcagctgactaaccgcgaaagtggttgcagtggcgccaattaaaccaaagaggagaattccccaaagtttggggtcatcatctttggctttataatccttgtttggagacgaccattgtttatccctttcagctccttcgcctccca

SEQ ID NO: 3309 - DNA, 2124 bp, Glycine max
atagtagcaaagtgttacaattcaaaagtcacatgtaaacaggaacaaagaggtgttccaagaaactacaaaactagtactcaatcccatctttttgcaatcccagtttcaccgatctctaggagaggatggattatcagtacattctaggagggattatggcttgtagttttgcttttttgtatgttgtgtacagttttggagcaaaggtcacagattcaagttcaatacatgtaaagagtaatgaatgtgcaaagatatcatcagagaatggaatatgctcacatgaggatgcaggaagtgctgacatcattattgtgggtgctggggttgctggttcagctcttgcttgcactcttggaaaggatggacggcgagtgcatgtaattgaaagggatttaagtgaacctgacaggatcgtgggtgaattgctacaacctgggggctatcttaagttaattgagttgggtcttgaggattgtgtggatgaaattgatgctcagcaagtctttggctatgctctgtataaggatggcaaaaataccaaactctcttatcccttggaaaattttggctctgatatttctgggagaagctttcataatggccgtttcatacagagaatgcgagaaaaggcttcatctcttccaaatgtaaaattagaacaaggaactgtcgcatctctacttgaggaaaaaggaaccatcactggggtgcactacaaaaccaaaagtggtgaagagttcacagcaaaggctcccctcaccatagtatgtgatggttgtttttccaacttgagacgttctctttgcaatcctaaggttgaagtaccctctcattttgttggtctggtcttggagaattgtaatcttccatatgcaaatcatggacacgtcatcttaggtgatccttcccccattttgttttatcccatcagtagcactgagattcgctgtttggttgatgtgcctggccaaaaattaccttcccttggtagtggtgaaatggcccgttatttgaaaactgtggtagctcctcaggttcctccagagctgtatgattcatttattgcagctgttgacaaaggaaacataagaaccatgccaaatagaagcatgcctgcctcaccttatcccacaccaggtgcccttctaatgggagatgccttcaatatgcgtcaccctttaaccggaggaggaatgactgtggctttatctgacattgttgtgctaagggacttacttaaaccccttcatgatctccatgatgcttctgctctttgcagataccttgaatcattctacaccctacgcaagcctgtagcatctacaataaacacactagccggggcattgtacaaagttttttgtgcatctcctgatccagctagaaaggaaatgcgccaagcatgtttcgattacttgagccttggaggtgttttctcagatggaccaatagctctactctctggtctaaatcctcgtccattgagtttggttctccatttcttcgccgtcgctatatatggtgttggccgcttgctcataccatttccttctccaaaacggatgtggattggagctagattgatttcaggtgcatcaggcatcattttccccattattaaggctgaaggggtgagacaaatgttcttcccagcaactgtgccagcatattacagaacccctcctgtccatccattgaacacacatgaaggaaatacatggaattaatatataatggttcccttttcccacattctttccacctgtagtattccatttctgccatcaagaataagagagggaactcattccataattaggatactcattttgtgcaactgcaaccaatattatagtataaaaaaaacttgaatttgggacccgagaaagaagttccaaaactaatcgtgcaattattcgagttaaaaaatgctaaggtttgtcttcaatgcaaattggtgttattatatggctactattatggtatattggtattgtatgcataatcacttagatgaggggcaaggtaagtacacagtgcagaaagaagttgttgtaatgtgacaattgaagcaaccaccaaaaggaagatagtattgcatttgtcaaagattattat

SEQ ID NO: 3310 - DNA, 2002 bp, Nicotiana tabacum
  misc_feature (119)..(119): n is a, c, g, or t
  misc_feature (1178)..(1178): n is a, c, g, or t
agtcatcgaagtgtgcgtgctgtccagaaacctctccctctcgccagcgaagcattcataaatttacaacccaacatttatttaatatattgttgtttttattatcccattttcttgtnttagatagagaaaagattcccattgttgtaagctatagaaggagtttttgacggagagaaccaattccgtcgccgtttgccgtcgcagacaatggtggatatgggtctttccggatctgtacttgcggtggtgtttggcttcgtggcagttttgtggtttttcattcagagaaacggtggccgcaaagataaaaataatgaccccgccaccgccaccaccagcaccactacaacaacggtgtatgatggagaatgcagatcaaaggatgcaaacgacaacgctgacatcatcatcgtcggtgccggagttgccggtgccgctcttgctcacacccttggcaaagaggggcgtcgtgtaaaagtaattgaaagagatttgacagagcctgatcgaattgttggagaactcctacaaccaggtggcttcctcaaattgcaggagttgggtttggaagattgtgtggagaatattgatgctcagcgagtgtttgggtatgctcttttcaaggatggcaagagcactcgtctttcttatcccctggagaaatttcacgctgaggtttctggaaggagctttcacaatgggcgtttcattcaaagaatgcgagagaaagctgcatctcttcccaatgtcaaactggagcaaggcactgttacgtctctgcttgaagaaaacgggaccattagaggtgttcagtacaaaaacaaatctggcgaagagttgaaagcctatgcaccattgaccatagtatgtgatggttgtttctcaaatctacggcgtaccctttgcgacccaaaggtagaagtgccttcctgttttgttggtctggtcctggagaactgccagcttccacatgcaaaccatggacatgtcattttggctgatccatcacctatcttgttctatcccataagcagtaccgaggtccgctgtctggttgatgtacctggtcaaaaagtgccttctatttcaaatggtgaaatgggcaaatatttgaaaagcatcgttgctccccaggtccctcctgagataaaagatgcattcattgccgcaattgntaaaggtaacatcaggacaatgccaaaccgaagcatgccagctgctcctcatccaactcctggtgctcttctcatgggagatgcattcaatatgcgtcatcccttgactggtggaggaatgactgtagcattgtctgatattgttgtattacgtgatcttcttaaacctcttcgtgatttgaatgatgcacctacactttgtagatatctggagtccttttacaccttgcgtaagcctgtggcatccaccataaatacattggctggtgccttgtataaggtgttttgtgcttcacctgatcaagctaggaaggaaatgcgcgatgcatgctttgactatttgagccttggtggagtattctccacaggacctgtatctttgctttctggcttaaaccctcgtccattaagtctcgtttgtcacttctttgctgtggctatctatggtgttggccgcttgctgctgcctttcccatcacccaaacgtatgtggattggagcccggctgatctcgggtgcatctggaattattttccctatcatcaaggcagaaggagtgaggcagatgttcttccccgctactgttcctgcatattacaggtctcctcctgaagtgaaattgtaacttcgagaaacagaataaggctaatgcctgtgtgccacctccatcggtattctggttgtgagtgtcttaaagagtttagtccaactgttacatattttttgatgctagtttttcttttcttcccttctcgtttgttcccatgattgattgtattattaactggaaaggcggcctgacttattcaatcatatattgtctc

SEQ ID NO: 3311 - DNA, 1933 bp, Vinca minor
aatatccatttggttattaattttactatcaattacattcagagaggaggcggggtggcgccaccgttgcagccgccgctggggacgatggatcagtacatggttgttgtcgcaacgacgacgttcttaggtttcgttttcctctacattttactttggaagacttttaagaataataaggaaaagaaacatgcagaaggaaataataatgggattcgactgacggtttgcccaccaccgctgactggatcgaccgagactgacgtcattgttgttggtgctggcgttgctggcgccgccctggcttacactctcggcaaggatggtcgacgtgttcatgtaatagaaagagacttgacggagcctgacagaatcgtaggtgaacttcttcagcctggggggtaccttaagctgattgagcttggccttgaagattgtgttcaggaaattgatgctcaaagggtgcttggatatgctcttttcaaggatggaaaaagtacaaaactttcttatcctttagaaaaatttcattcagatgttgctggaagaagtttccacaatgggcgtttcattcagaggatgagagaaaaagctgctacacttcccaatgtacgactcgaacaaggtactgtaacatccctgcttgaagaaaatggcactgtaaaaggggttcagtacaaaaataaaacaggcgaacaagtccaagcttatgctcctcttactattgtctgtgatgggtgcttttcaaatttgcgacggtctctttgcagccccaaggtggatgttccctcttgctttgttggtttggtcttagagaattgccaacttccattcgccaaccatggtcatgttgttcttggtgatccttcacccatcctattttatccaatcagtagcacagaaattcgctgcctagttgatgtgccaggccaaaagcttccttccattgccaatggtgaaatggcaaactatttgaggaccaaggtggctccacaggttccatcagagctgcacgatgcattcatatctgctattgataaaggaagtattagaacaatgccaaacagaagcatgccagcagcgccacttcctacacccggagctatcttaatgggcgacgctttcaacatgcggcatcctttaactggtggaggaatgactgtagcactttccgacattgtagttctgcgggacctgcttaagcccttgcgtaacatgaatgatgcagagtcattgtgtaaatatctggaatcattttacactctgcgtaagccggtggcagcaacgataaatactttggctggagctctctacatggttttctgtgcttctcctgatcaagcaaggaaggaaatgcgccaagcatgttttgattatttgagccttggaggtgtttgttccaccggaccagtagctctactctcgggtctaaatcctcgtccactgagcttagttctccatttctttgctgttgctgtatatggagttggtcgcctgttggcaccttttccttctcccaagcggttgtggatctcagccagattgatctcgggtgcatcgggtattatctttcccattataaaggcggaaggagtcaggcaaatgttctttccagcaactgttccagcatattacagagccccacctgcaaaataatattatggtcttgtctggacattccttctcctccttaaagcaaggaggttctctacatgtaccaactaccaaacagaagaaaaggaacacgggattaagctagatatttggagtctaagatataactcatgagtcactgtaaaaaccgaatctcaggaagaataaaaatatcaaatacatatttcatgaccgaatctcgggagtacaatgttttctcaatgataggttctaatcatttgtaaacttaattcctaaatacattgcatctcatagttca

SEQ ID NO: 3312 - DNA, 1603 bp, Eschscholzia californica
aggaggatcattgcctcttgttaggtttattctttttatattcctactcacagagaaagaaaaaggaaagaaatattgattcaattgagatccgaaatgaatgtgttaaaagatctataaacgatgatgattcacgatccgataatggagatgatttcgatgttataattgttggagctggtgtcgctggttctgctcttgctcatacgcttggaaaggatggacgtcgagtacgtgtcattgagagagacctgacggagcctgacagaattgtgggagaactgttacaaccgggaggttacctgaaattagtagaactaggtcttgaagattgtgttgagcaaattgattctcagagagtgttaggttatgctcttttcaaggatgggaaagatactagacttgcatatcctttagaaaagttccattctgatgtgtctgggaggagctttcataatgggcgttttattcaacggatgagggaaaaagctgcttcccttccaaatgtacggttagaccaaggaactgtgacatccttactagaagaaaatggcacagttagaggagtattatacaagaataaggctggtgaagaaataaatgcatatgctcctcttacaattgtatgtgatggttgtttttctaacttgcgtcgctctctctgcagtccaaaggtggaggtgccctcttgctttgttggtctcgtcctggagaattgtcagcttccatacccaaaccatggacatgttgttttggcggacccttcacccatcttattctatcctatcagtagtaccgaggttcgttgtttagttgatgtacctggtcagaaagtaccatctattgctaatggtgagatggccaactacttgaagactactgtagctccccagattcctgctcaatttatgattcatttatagcggcaatcgataaaggaagcattagaacaatgccaaacagaagcatgcctgctgctcctcatcccactcgaggggccttattaatgggggacgctttcaacatgcgtcatcccttaactggtggagggatgacagttgcattgtctgatatagttgttttaaacaaccttcttaagcccttgcggaatcttaatgatgcagcagctttgtgcaaatatctggaatcattttacaccttgcgtaagccggtggcgtctaccataaatacgttagctggtgcactgtacaaagtgttttgtgcttcacctgaccaggcaaggaaagaaatgcggcaagcatgtttcgattatttaagtcttggaggagtttgttcaactggtccagtggctttactctctggtcttaacccacgtcccttaagcctggtcagccatttctttgcagtcgcgatatatggtgttggtcgtttactactgccctttccttctcccaaacgtatctggattggtattcaattgatttggagtgcatcaggtatcattttccctattataaaggctgaaggagttagacaaatgttcttccctagaacagttccagcatattatagatcagctccagtagagtaaaatgaagaacgccgcaaagagagaatcggaaatcaaatcaagaaattgaca

SEQ ID NO: 3313 - DNA, 1587 bp, Chelidonium majus
tcaccattgttgttgatcgagttagtttctctcactagaacatcatgatccagtacatcttaggaggaatcctagccatctttgttagggttcttctttctattcaatgcttcttcgcagagtaaaaagaagaagattattgagatccgagatgaatgtgtgaagagctccattaatggtgatttaagatcagatattggtgctggaaatacagatgttataattgttggtgctggtgtcgctggtgctgctctcgctcacacgctcggaaaggatggacgccgagtacttgtgattgagagagatctgacggagcctgacagaattgttggagaattgttacagccaggaggctacctgaagttgattgaactaggtcttcaggattgtcttgaaaaaattgattctcagagagtgctgggttacgctctttttaaagatgggagagatactagactcgcatatcccttggaaaagttccattcagatgtgtccggtaggagctttcacaatgggcgttttattcaacggatgagggaaaaggctgctacccttccgaatgtaaagttggagcagggaactgtaacatccttactagaagaaaatggtaccatcaaaggagtgctgtacaagactaaggatggtgaagaaacaaatgcatatgctccccttacaatcgtatgcgatggttgtttttcaaacttgcgtcgctctctctgcagtcctaaggtagaggttccctcttgttttgttggtttgatcctggagaactgccaacttccatatcaagaccatgggcatgttgttttagcggacccgtcacctatcttattttatcaaatcagtagtactgaggtccgctgtttggttgacgtacctgggcaaaaagtgccatctattgctaatggtgagatggccaaatatttgaagactatggtggcgccccagattccccctcagatatatgattcctttgtagcagcaattgataaaggaagcataagaacaatgccaaacagaagcatgcctgctgctccccttcccactccaggggccctattaatgggggatgcatttaatatgcgtcaccctttaactggcggagggatgactgtggcattgtctgacattgttgttctacaaaatcttcttaagcctctgcgcaatttgaatgatgcacctgctttgtgcagatatctggaatccttttacaccttgcgtaagccggtggcatctaccataaataccttggctggtgccctgtacaaggtgttttgtgcttcacctgatcaggcaagaaaagaaatgcgggacgcatgtttcgattatttaagtcttggaggaatttgttctcaaggcccagtggctttactctctggtctcaacccacgaccattgagcttggtgtgccatttcttcgctgtagccatatttggtgttggtcgtctactactgccgtttccttcacccaagcgtttgtggattggagctagattgatttcgggtgcatcaggtatcatttttcctattataaaggcagaaggtgttagacagatgtttttccctgcaacagttccagcatattac

SEQ ID NO: 3314 - DNA, 1767 bp, Fragaria vesca
cgcaaaatggtggtggatcagtacctgttggcctggatcttcgcctccgtcatagctctcatagcgatgtacggcacggtggcgacgaggcggagaaataacaaccgccgagcttcgctggaggaggaggagagaagccgcggctgcctcatggtctcagacgcggaatgcagatcggctgacggcgacgttgacgtcatcatcgtcggcgccggtgttgccggctctgctctggctcacactctcggaaaggatggacgtcaagtgcgtgtgattgaacgagatttgacagagccagaccgtattgttggtgaactgttacaacctggaggctacctcaaattaattgagctgggacttgaagattgtgtggaggaaattgatgctcagcgagtgtttggttatgctctattcaaggacgggaaaaatactcggctctcttaccccttggagaaatttcactcagatgtgtctgggaggagcttccataatggccgtttcatacagaggatgcgagataaggcggcaactcttcccaatgtgcaattggagcaaggaacagttacttctctgcttgaagaaaagggaacaattaaaggtgtgcaatacaagactaaaacaggtcaagagatgacagcatatgcacctcttaccattgtttgtgatggctgtttctctaacttgaggcgctctctttgcgatcctaaggtggatgtgccttcttgttttgttggtctgattctggagaactgtgatcttccacatgcaaatcacgggcatgttatcttagcagacccttcccctatcttgttctatcagatcagtagtacagaggttcgctgtctggttgatgtacctggacaaaaggttccttccatttcaaatggtgaaatggccaagtatttgaagaccgtggtggctcctcagattccccctcaaatttatgatgcctttgtagctgcagttgataaaggtaacatcaggacaatgccaaacagaagcatgcctgccgctccctatcctactcctggagctttattgatgggggatgcattcaacatgcgccaccctctaactgggggaggaatgactgtggcattgtctgatattgttgtgctccgggatcttctcaggcctttgtgcaccctaaatgatgcacctactctatccaaatatcttgaatccttttacacactgcggaagccagtggcatccaccataaatacattggcaggggccctttataaggtcttttcatcttctcctgatcaagcaaggaaggaaatgcgccaggcttgctttgattatctgagtctcggaggtgtattctctatgggaccagtctctctactctcaggactaaaccctcgccccttgagtttggttacccatttctttgctgtcgcagtatatggtgttggtcgacttttgctgccattcccatcacctaaacgcctttggattggtgccagactaatctctagtgcctcgggaatcattttccccataattaaggcagaaggggttaggcaaatgttttttcctgcaacagttccagcgtattacagaacccccgtctcaagtgaaaagatgagaaagaaggatgatggcagaattgcagatgatatgtaaattcaatgcattcaatggataatagatcattggaagtagattttgtgtcataggacttcatgagttcattctttctagtttctagtatgtaattgacaccaaacaaaagaaaaaagaaacagaacttctagtgtt

SEQ ID NO: 3315 - DNA, 2448 bp, Theobroma cacao
taataaaaatcactagtaaaatcaatgggaattgcagacaaatcacatgcgagaaaatgaaatgaaacttggccacacccctttaaggccctaacagacaaaatcgtggtcgtgatcattcccttcaagaaaaggaaaacgtaatcttaatcttatttcctattttaagtaattagaagaccttagatagaaactagaactttcctccaccaccaaataaacatgccagagtcagaccaccgttttttcatatcctcccagcttagctttgctcttaacttgtcgtttcttttgttttctcattcattttgtggagtctttgacatcaagaccacaagttttgccctcatgaaaaaacaagaaagtgggaaactgtaaattttaagaatcaattacaaatgagacctgtgctttaaaggttactgtttccatcttcttcaatgccattacttagtttaactctaactactatcaaccttcaatataaagcggccccggtcccatttcctacgatatcttccaaacccaccacatgtcagagtctttcatcaaaaccaaggctaagaaagctcttcaaaactaccagcagtttccgcttttctaaaacccaaggcctttctgcctctcttcttgctaattccgcttctgggtttcaccgttttaaggaaatggtgatggtttttgatagttacatcgttgggacgtttttggtttcccttcttggctttgtttttcttttcattttgcggcataataataacagtagaaagaagaaaatcgagaaaggttctagggacttcaagatccaaaccgatgctgttagcggaaccgaaataggggaatgcttgccggaaaatggttccggcactgacgtcatcattgtcggtgccggtgttgctggtgctgctctagcttatacacttggcaaggatggaaggcgtgttcatgtgatagaaagagacttgacagaaccagacagaattgttggagaactgcttcagccaggaggataccttaaattagttgaattgggccttgaggattgtgtagaggaaattgatgcccagagagtgcttggttatgctctcttcaaggatgagagaaatactaaattgtcatatcccttggagaaatttcatgcagatgttgctgggaggagcttccataacgggcgtttcatacagaggatgagagaaaaagctagtactcttcccaatgtacgactagagcaaggaacagtaacatctctccttgaagaaaatgggacaattagaggggtgcagtacaaaactaaggatggtcaagaactaggagcttatgctcctcttactattgtatgtgatggttgcttttcaaatctacgtcgctctctttgcaaccccaaggtggatgtgccctcttgttttgtgggtttggtcctagagaactgtgaacttccattttcaaatcacgggcatgttatcctaggagatccttcaccaatcctgttttatccaatcagtagcacagaggttcgctgcttggtcgatgtacctgggcagaaagtaccttccattgctaatggtgaaatggcaaattatttgaagaccatggtggcaccacaggttccacctgagcttcgtgatgccttcatagctgctgttaataaaggtaatattagaaccatgccaaacagaagcatgccagctgatcctcatccgactcctggagcacttctaatgggtgatgctttcaacatgcgtcatcctttaactggtggaggaatgactgtggcattgtctgatattgttgtacttcgggatcttcttaggcctctgcatgacctgcatgatgcagcttgcctgaccaagtatcttgaatcattttacacattacgcaagcctgtggcatctacaataaatactctggctggtgccctatataaggtgttttctgcgtcccctgatcaagcaaggaaggaaatgcgccaagcctgttttgactatttaagcctcggtggtatcttttcaacagggccagtggctttactctctggtctaaaccctcgcccgttgagtctagttcttcatttctttgctgtggcaatatatggagttggtcgcctgctcctaccatttccttcacttcgacgcatgtggatcggagctaggttaatctcgagtgcatcaggtataattttccccataatcaaggcagagggagtgaggcagatgttcttccctgcaacagtgccagcactatatagagctcctcccgttgattgatatgccctatcatggtagcttaagctctgtagcaccctagattaaaaggctagaactgcctttgtcttattgcttggacagaccagtgcatgctaaatgtatatcaagacaccgtacagctgtgttagattagagacggctaggaactattctttcattatatgaacaaaaattctcccaaact

SEQ ID NO: 3316 - DNA, 3026 bp, Solanum tuberosum
ggtgaccagaaatctctctgtctcgccagcaaagcattcatcaaatacagcctaataataatactctttctattttcatttttagatatatagagagattcacgggcattgttagagaagcaacgacgtcgtttctcttgctccgtccccgtttcccgtcctttttcttcattgtcgccggcgacaatggtggatttgggtctctccggatctcttcttgcagtggtgttggggttcgttgcagttttctgttttttcattcagagaaatggtggctgcagcaaaagtaaaattgatgactcagcaactagcaccactacaactacggtgtacagtggaaagtcccgatcaaaggatggaaacgacgacgttgatatcatcatcgtcggtgccggagttgccggtgctgctcttgctcacactcttggcaaggaagggcgtcgtgtaaaagtaattgaaagagatttgacagagcctgatcgaattgttggagaactcctacaaccgggtggttacctcaaattgcaggagttgggattggaagattgtgtggagaaaattgatgctcaacgagtgtttgggtatgcccttttcaaggatggaaagagtacacgtctttcttatcccctggagaagtttcactccgatgtttctggaagaagcttccacaatgggcgtttcattcaaagaatgcgagagaaagctgcagcccttcccaatgtcaaactagagcaaggcactgttacgtctctgcttgaagaaaacgggatcattagaggtgttcagtacaagactaaatctggtgaagagttgaaagcgtatgcacctttaactgtagtatgtgatggttgtttctcgaatctacgacgtaccctttgcgacccaaaggtagaagtcccttcttgttttgttggtctggtcctggagaactgccagcttccacatgaaaatcatggacatgtcattttggctgatccatcacctatcttgttctatcccataagcagtactgaggtccgctgtctggttgatgtacctggtcaaaaagtgccttctatttcgaatggcgaaatggccaaatatttgaaaagtgtagttgctccccaggtccctcctgagataaaagatgcattcattgccgcaattgataaaggaaacatcaggacaatgccaaaccgaagcatgccagctgctcctcatcctactcctggtgctcttctcatgggagatgcattcaatatgcgccaccccttgactggtggaggaatgactgtagcattatctgatattgttgtattgcgtgatcttctcaaacctcttcgtgatttgaatgatgcatctactctttgcagatatctggagtcattttacaccttgcgtaagcctgtggcctccaccatcaatacgttggctggtgccttgtataaggtgttttgtgcttcacctgatcaagctaggaaggagatgcgtgaagcatgctttgattatttgagcctcggtggagtattctcagatggaccagtatctttgctttctggcttaaaccctcgtccattaagtctcgtttgtcacttctttgctgtggctatctttggtgttggccgcttgctgcttcctttcccatcacccaaacgtatatggattggagcccggctaatatcgagtgcatcggcaatcattttccctatcatcaaggcagaaggggtcaggcagatgttcttccccgcaactgttcccgcatattacaggaagccctcctgaagtgaggttgtaactgctataaacagaataaggctatgtcattgtaccacctccatcagtattctggttgagtttcaagagtttagtccaactgttgcataatttttggttgctagtgttcccttgtaatctttttcctttttagtttgttcccatgattgattacactataaactggaaagtaaatataagttgtacaatcataagaaaaaaaaaaaaagaaaacaaaagaaatagaaaaatagaacaagaaaacaaaaaacaagaagataagataacatacaagaaacaataagacttcgagagggggtgagggcccggggtacaccaattctcggcgccaatactaggtagaggttccggatattataccgcgcgcgcggcactccacgatagctgcgacagctcccgctttttataaccagactcggctcctggtagacctctgggagaagataacaccttgtgcgtgttaaccccaagacttataaatctcgcgccttttgacagcaaaatattcacccctgtatttcggcgcaggcttggcgttatacttaggcagaaagagaggcgccccgggatagcccgatatttctgctctctttttcccgacagaacagggtttggcgcgccaaggcccttgtgaaaattttgcggcacgaattgtgtgagaacctgccgccccctaggtaattacctggggggcgcatttatacaccgcccgcttgagacagagcgttgcattggtgagttaaaccgagctcgccagcttgttgaacgccggtttacacaagtgttcttcgtcgccaatggtggggcccactttgatggtgggccccacggagtatctcccctcgtgatttatcgccgacgtcttcattcctgctcccgcccgatttatgcccgttgtttctcctaacgcgcgcgcaaatcatgatgttcctggcccgaggaggctttttctaccccccggggttcagaaagcggctctccactaagagatttcccggcggggaggggccttcaccctcctttttatgaggcggggggtttcccgcgcggaagtttatagagggtgcgccctttttataaacgtggagggcacgacgtccttctaaggagatctctcgcaacaaaagaaacaccttcctgaattattaaacgagggtgtctacgaatctggggttccacccgggtatagttgggggggcacaaattcgtggcctcctttgaattaaaaacagcgggttttatgcacaccgccc

SEQ ID NO: 3317 - DNA, 1972 bp, Solanum phureja
aaaagtgtgcgtcgtgtctagaaatctctctgtctcgccagcaaagcattcatcaaatacagcctaataataatactctttctattttcatttttagatatatatagagattcacgggcattgttagagaagcaacgacgtcgtttctcttgctccgtccccgtttcccgtcctttttctgcattgtcgccggcgacaatggtggatttgggtctctccggatctcttcttgcagtggtgttggggttcgttgcagttttctgttttttcattcagagaaatggtggctgcagcaaaagtaaaattgatgactcagcaactagcaccactacaactacggtgtacagtggaaagtcccgatcaaaggatggaaacgacgacgttgatatcatcatcgtcggtgccggagttgccggtgctgctcttgctcacactcttggcaaggaagggcgtcgtgtacaagtaattgaaagagatttgacagagcctgatcgaattgttggagaactcctacaaccgggtggttacctcaaattgcaggagttgggattggaagattgtgtggagaaaattgatgctcaacgagtgtttgggtatgcccttttcaaggatggaaagagtacacgtctttcttatcccctggagaagtttcactccgatgtttctggaaggagcttccacaatgggcgtttcattcaaagaatgcgagagaaagctgcagctcttcccaatgtcaaactagagcaaggcactgttacgtctctgcttgaagaaaacgggatcattagaggtgttcagtacaagactaaatctggtgaagagttgaaagcatatgcacctttaactgtagtatgtgatggttgtttctcgaatctacgacgtaccctttgcgacccaaaggtagaagtcccttcttgttttgttggtctggtcctggagaactgccagcttccacatgaaaatcatggacatgtcattttggctgatccatcacctatcttgttctatcccataagcagtactgaggtccgctgtctggttgatgtacctggtcaaaaagtgccttctatttcgaatggcgaaatggccaaatatttgaaaagtgtagttgctccccaggtccctcctgagataaaagatgcattcattgccgcaattgataaaggaaacatcaggacaatgccaaaccgaagcatgccagctgctcctcatcctactcctggtgctcttctcatgggagatgcattcaatatgcgccaccccttgactggtggaggaatgactgtagcattatctgatattgttgtattgcgtgatcttctcaaacctcttcgtgatttgaatgatgcatctactctttgcagatatctggagtcattttacaccttgcgtaagcctgtggcctccaccatcaatacgttggctggtgccttgtataaggtgttttgtgcttcacctgatcaagctaggaaggagatgcgtgaagcatgctttgattatttgagcctcggtggagtattctcagatggaccagtatctttgctttctggcttaaaccctcgtccattaagtctcgtttgtcatttctttgctgtggctatctttggtgttggccgcttgctgcttcctttcccatcacccaaacgtatatggattggagcccggctaatatcgagtgcatctgcaatcattttccctatcatcaaggcagaaggggtcaggcagatgttcttccccgcaactgttcctgcatattacaggaagccctcctgaagtgaggttgtaactgctataaacagaataaggctatgccattgtaccacctccatcagtatactggttgtgagtttcaagagtttagtccaactgttgcataatttttggttgctagtgatcccttgtaatctttttcctttttagtttgttcccatgattgattacactattaactggaaagtaaatataagttgta

SEQ ID NO: 3318 - DNA, 1993 bp, Solanum lycopersicum
aatttagtatatgtggcttgttctgtttaattcgtaaaaaagtgtgctttgtgtctagaaatctctctgtattgacagcaaagcattcatcagatacagcctaataatactactctttctattttcatttttagatatatagagattcacgggcattgttagagaagcaacgtcgtcgtttctcttgctccgttcccgtctcccgtcctttttctgcattgtcgccggcgacaatggtggatttaggtctcttcggatctcttcttgtagtggtgttggggttcgttgcagttttctgttttttcattggtcgtaacaaaagtaaaaatgatggctcggcaactagcaccactacaactacgctgtataatggagagtccagatcaaaggatggaaacgaagacgttgatatcatcatcgtcggtgccggtgttgccggtgctgctcttgctcacactcttggcaaggaggggcgtcgtgtaaaagtaattgaaagagatttgacggagcctgatcgaattgttggagaactcctacaaccgggtggttatctcaaattgcaggagttgggattggaagattgtgttgagaaaattgatgctcaacgcgtttttgggtatgcccttttcaaggatggaaagagtacacgtctttcttatcccctggagaaatttcactctgatgtttctggaaggagcttccacaatgggcgtttcattcaaagaatgcgagagaaagctgcagctcttcccaatgtcaaactcgagcaaggcactgttacgtctctgcttgaagaaaaggggatcattagaggtgttcagtacaagactaaatccggtgaagagttgaaagcatatgcaccattaactgtagtatgtgatggttgtttctcgaatctgcgacgtaccctctgtgatccaaaggtagaagtcccttcttgttttgttggtctggtcctggagaactgtcagcttccacatgaaaatcacggacatgtcattttggctgatccgtcacctatcttgttctatcccataagcagtactgaagtccgctgtctggttgatgtacctggtcaaaaagtgccttctatttcgaatggtgaaatggccaaatatttgaaaagtgtagttgctccccaggtccctcctgagataaaagatgcattcattgctgcaattgataaaggaaacatcaggacaatgcccaaccgaagcatgccagctgctcctcatcctactcctggtgctcttctcatgggtgatgcattcaacatgcgccaccccttgactggtggaggaatgactgtagcattatctgatatcgttgtattgcgtgatcttctcaaacctcttcgtgatttgaatgatgcatctactctttgcagatatctggagtcattttacaccttgcgtaagcctgtggcctccaccatcaatacattggctggtgccttgtataaggtattttgtgcttcacctgatcaagctaggaaggagatgcgtgaagcatgctttgattatttgagcctcggtggagtattctcagaaggaccagtatctttgctttctggcttaaaccctcgtccattaagtctcgtttgtcatttctttgctgtggctatctttggtgttggccgcttgctgcttcctttcccatcaccgaaacgtatatggattggagcccggctaatatcgagtgcatctgcaatcattttccctatcatcaaggcagaaggggtcagacagatgttcttccctgctactgttcccgcatattacaggaagccctcctgaagtgaggttgtaactgctataaacagaataaggctatgccattgtaccacctccatcagtattctggttgtgagtttcaagagtttagtccaactgttgcacaatttttggtttctagtcttcccttgtaatctttttcctttgttcccatgattgattacactattaactgcaaagtaaatataagttgtaaaagt

SEQ ID NO: 3319 - DNA, 2036 bp, Cajanus cajan
aaaagcaagtcacgtaaaaggaaacaaagaggtgttcgaagaaactagaaaactagtttcaccaatattttggagatgatggattatcagtatattctgggagtgattctggctggtagtttggcatttgtgtatgttgtgtacagttttggagcaaggaagaaggtgaagtacacagattcaagttcaatacatgtaaaaagtaatgaatgtgcaaagacatcagagaatggaaaatgttcatatgaagctgcaggaagtgctgacatcatcattgtgggtgctggggttgctggtgcagctcttgcttacacgcttggaaaggatggacggcgagtccatgtgattgaaagggatttgagtgaacctgacaggattgtgggtgaattgctacaacctggtggctatctgaaattaattgagttgggtcttcaggattgtgtgcatgaaattgatgctcagcaagtctttggctatgctctgtataaggatggaaaaaatactaagctgtcttatcccttggaaaattttgactctgatgtttctgggagaagctttcataatggccgtttcatacagagaatgcgagaaaaggcttcatctcttccaagtgtaaagttagaacaaggaactgtcacatctctacttgaagataatggaatcatcactggggtgcattacaaaaccaaaagtggacaagagttcacagcaaaggctccccttactatagtatgtgatggttgtttttccaacttgaggcgttctctttgcaatcctaaggttgaagtaccctcccattttgttggtctggtcttggagaattgtaatcttccatatgcaaatcatggacatgtcatcttaggtgatccttcacccattttgttttatcccatcagtagcactgagattcgctgtttggttgatgttcctggacaaaagctaccttcccttggtagtggtgaaatggcccgttacttgaaaactgtggtagctccccaggttcctctagagctgtatgcttcttttatagcagctgttgacaaaggaaatataagaaccatgccaaatagaagcatgcctgcctcaccatatcccacacctggcgcacttctaatgggagatgccttcaatatgcgtcaccctttaaccggaggaggaatgactgtggctttatccgacattgttgtgctaagggatcttcttaaacctcttcatgatctgcatgatgcttctgctctttgcagataccttgaatcattctataccctacgcaagccagtagcatctactattaacacactagctggggcattgtacaaagtgttctgtgcatctcctgatccagcaagaaaggaaatgcgccaagcatgttttgattacttgagccttggaggggttttctcaaatggaccaatagctctactgtctggtctaaatcctcgtccattgagtttggttctccatttcttcgcagtggctatatatggtgttggccgtttgctgataccatttccttctccaaaacggatgtggattggagctagattgatttcaggtgcatcaggcatcattttccccattattaaggctgaaggagtaagacaaatgttcttcccagcaactgtgccagcatattacagggcccctcctgtccattgaacacacatgaaggaaaggcttggaatatataatagttccattttcccacattcttttttcctctagtattccactatctgtcaaaagaataagagaggggactcattttgtgcaattgcaaccaatattgttgtataaaattaaaaaaaacaaaacaaaacaaaaaaaattgaatttgggaccgaagaaagaagtccccaaaaccaatcttccaagcattagatttagtgttaaaaaaatgctatgtattgtcttcaatgcaagttggtgatatttggctactagtatggtattgtatgcatttttacttggatgagaggcaaggtaagtacacagtgcagaaagaagtcgttgaagtgtggcaattgaaacaatca

SEQ ID NO: 3320 - DNA, 1994 bp, Amsonia hubrichtii
tatagcgtccgactctaccaaactcccttcacccctatcatcgccgttagctctgctgctgtactcaggcaagcccagaaggagaaaacccactctacccgtacctttttcatctatcaaacaaaccccattacagaggccaagaagaaatccatttgcttttgaccaaacagagggggatcgcagtggtgccggctacgatggatcagtacgttgttgttgcaacgttcttcgcatctctatttggactcctttttctctacattttgcgtccgaggactgttgagaataagcaagtgaagcatgcagatgaccatggtatccagatgactgtttgcccactccagagtggatcggatactgatgtcattgttgtcggtgctggtgtagctggtgccgccctggcttacactcttggcaaggatggtcgacgtgttcatgtaattgaaagagacttggcagagcctgacagaattgtaggtgaactacttcaacctggggggtatcttaagctgattgagctgggtcttgaagattctgttgagaaaattgatgctcaaagggtgcttgggtatgctcttttcaaggatggaagaagtacaaagctttcttatcctttggaaaagtttcattcggatgtggctggaagaagcttccacaatgggcgtttcattcagaggatgagagaaaaagctgctacacttcccaatgtacgactagagcaaggtactgtaacatccctgcttgaagaaaatggcactgtcaaaggtgttcagtacaaaactaaagcaggcaaagaactccaagcttatgctcctcttacaatagtctgtgatgggtgtttttcgaatttgcgacgatctctttgtagccccaaggtggatgttccctccagctttgttggtttggtcttggagaactgtcaacttccgttccccaaccatggccatgttattcttggagatccttcacccatcttattttatccaatcagtagcacagaagttcgttgcttagttgatgtaccaggccaaaagcttccttccattgccaatggtgaaatggcaagctatttgaggaccacggtggctccacaggttccatcagaactgcaagctgcattcatatctgctattgacaaaggaaatattagaacaatgccaaacagaagcatgccagcagcgccacttcctacacctggagccctcttaatgggtgatgctttcaacatgcggcatcctttaactggtggaggaatgactgtagcactttctgacattgtagttctccgggatctgcttaaacccttgcaggacatgaatgatgcagagtctctatgcaaatatctggaatccttttacacactgcgtaagccagtggcatcaacaataaatactcttgctggagcccttttacaaggttttctctgcttctcctgatcaagcgaggaaggaaatgcgccaagcatgttttgattatttgagccttggaggtgtttgttccacaggaccaatagctctactctcgggtctaaatccgcgtccactgagtttagttctccatttctttgctgttgccgtatatggagttggtcgtctattgacaccttttccttctcttaagcggttgtggattggagctagattgatctcgggtgcgtctggtatcatctttcccattataaaggcggaaggagtcaggcaaatgttcttcccagcaactgttccagcatattacagagctcctcctgcaaaagagtaaattatggtcttcttcctgaaaggcaatctagctcttgtccagacattccttctcttgcttaaagcgagggaggttatacgcattctaccacccacaagaagaggaacaatggattaagctagataatagatatttaacgtgtaagatataactgatgagtctagtaaaagcagaaatcttgggaagaataaaataccaaatatattacttaactcgttagaaattcagaccag

SEQ ID NO: 3321 - DNA, 2038 bp, Aquilegia formosa
gttacacgtaagcataaacaagaaccagaaagatagaagaaagacagagtgctctgttttcttgattaaagattctctctctctctctattgttagagcttgggaaggaaggaagtaacattaacataacaagatgattgaatacatgttgggaggaatcattgcttctcttcttgggtttctctttctttactcttcttcttcttatttgtttggcaaaaagaagaagaaaaatgtaaaacaagaagataatgaatgtgttacaagttctaccaaatgtaatcttaattcaaatacccctgatgttattattgttggtgctggtgtagctggtgctgctcttgcttatacactcggaaaggatggacgccaagtgcacgtaattgagagagatgtgacagagccagacagaattgttggagagctgttacaaccaggaggctacttgaaattggttgaactaggccttgaggattgtgtggaagaaatagatgctcaaagggttttgggttatgctcttttcaaggatgggaagaatgctaaactcacatatcccctgactgagttccataaagatgtggctgggaggagctttcacaatggacgtttcatacaacggatgagagagaaggcagcgacactgcccaatgtccgcttggagcaaggaactgtaacctccctgcttgaagaaaatgggacaataaagggagtatcctacaagactaagaccggtgaagaactacaagcttatgctccattaactgtcgtatgtgatggttgcttttcaaacttgcgccgctctctgtgcagtcctaaggtggaagtgccctcttgttttgttggtttgatcctggagaattgctctcttccattcccaaaccatgggcatgtcgtcctaggagacccttcacccatcttattttatcccatcagcagtactgaggttcgttgtttggtcgatgtacccggacaaaaggtaccttcgatttctaatggggaaatggccaactatttgaagacagtggtagctccgcaggtccctcctcagctatatgattcttttctggccgcagtcgaaaaacgaagcataagaactatgccaaatagaagcatgcctgcagcgccccttcccactccaggggctatcttaatgggagatgcattcaatatgcgtcatcctttgactgggggagggatgactgtggctttgtctgatattgttgtcctacaaaaccttcttaagcctctgcgagatttgaatgacgcatcttcactgtgcagatatttggaatccttttacacacttcggaagccagtggcatctacaattaatacactagcaggtgccctatacaaggtgttttgtgcttcacctgatcaggcaagaaaggaaatgcgccaagcttgttttgattatctaagtcttggaggcgttttttcatcggggcctgttgctttgctctctggtcttaatcctcgcccactaagcttggtttgtcatttttttgctgtggccatatttggcgttggtcgcttattgatgccatttccttctcccaagcgcttgtggcttggagctagactgatttcaggtgcttcaggtatcatatttcccatcataaaggcagaaggattcaggcagatgtttttccctgcaactgtcccagcatattacagagctccgcctacaaagtgagaaggaaagaagaattcacattctgaaatataaaggtagctgctctaataaggtgcttgctgataccagctactttgctctctactattcgacttatgctccacaatttgtactatatcagataccattgttggtcaagctatattagactaggagaactttcacctagcacccaacttagcttgtgaaatatgtattcatattccagcttagcttgtagcccactggttcttcacatgttctattgttgtcgatgttctggaactttctttgtgagaacattgttaagtttttattggtatagttagacatgaaagttcggtgttgcatgttatgcagaaa

SEQ ID NO: 3322 - DNA, 1917 bp, Cucumis sativus
ggggttccgttaagcaattcggtcgttggcgtgaagttttgccagcggagagagatacgcgcagagagaatttataatcaagtacaagagagagggagagatagagagataaaagggaggaaactcggggagggccacaggagagagagagcgagagagagtatcgtcgctgtcgtcgtcgcattggcgatctctttgaggtcgctgcatctatactcggaaaaaatggtggatcaatgcgcgttaggatggatcttggcctctgttctcggagcttcggctttatatttattgttcggcaagaaaaactgcggagtttcgaatgaacggaggcgtgaaagcctaaagaatatcgccaccaccaatggagaatgcaaatcgagtaatagcgacggcgacattatcattgtcggagccggtgtcgccggatccgctcttgcctatactctcgccaaggatggtcgtcaagtacatgtgattgaaagagatttgtcagagccggacagaattgttggtgaattattacaaccgggaggctatcttaagttaacagagttgggacttgaagattgtgtggatgaaattgatgcccaaagagtgtatggttatgctctttttaaggatggaaaggatactagactctcctatcccttggaaaaatttcactcggatgtgtctgggaggagctttcacaatggacgcttcattcaaaggatgcgcgagaaggccgcatccctgcctaatgtgcgcttggagcagggaacagtcacttctctcctcgaggaaaatggtacaattagaggagtccaatacaaaaacaagtctggccaggagatgacagcttatgcacctttaactattgtttgtgatggttgcttttcaaatttgcgacgctctctttgcaacccaaaggttgatgttccctcttgttttgttggcctcatactcgagaattgcgaccttcctcatgcaaatcatggacatgtgatactcgcagacccttctcctattttgttctatcccattagcagtacagagatccgctgtctggtggatgtgcctggacagaaagttccttccatttcaaacggtgaaatggctaactatttgaagaatgttgttgctcctcagattcctcctcaactttataattccttcatagctgctattgataagggtaacatcagaacaatgccaaatagaagtatgccagcagatccatatcctacccccggagccttattgatgggtgatgcattcaatatgcgtcaccctctaactggtggcggaatgaccgttgcattgtctgatattgttgttcttagagatcttctcaagcctctgcgtgatctgaacgatgcacccactctctgcaagtatcttgaagctttctacactctccgcaagccagtggcttcgacaataaacacgttggcgggtgccctatataaggtcttttgtgcatcaccagatcaggctagaaaggaaatgcgtcaggcttgctttgattatttaagcttgggtggaatcttctcgaatggaccggtttctttactttctgggttgaaccctcgccccctgagtttggttctccatttcttcgcagttgcaatatacggtgttggtcgactactcataccatttccttctcctaaacgcgtttggattggagccagattgatctcgggtgcatcggccattatctttcctattataaaggctgaaggagtaaggcagatgtttttccccaagaccgttgcagcttattacagggctccacccatcgtaagagagagataacagttccgtcgtaagataggagaaaggtcttaatgcagtggattttgtactaaacctttttagttctctatagatcgacgatgcttgtaaaaatgtactcattaatttttttttttt

SEQ ID NO: 3323 - DNA, 1951 bp, Eschscholzia californica
ggacaaattttagagagagagagaaagttgacaattttatcgttgtcgattcaaattttctctctctaaaagatgatccaatacatcttaggaggaacccttgcttctttgctagggtttttctttctacttaatgttgttgtatatagaaagaagaaggaaagaaagaatgaatcaattgagatcttagatggatgtgtaaaaagatctattaataatgatgatgatttacgatctgagaagaacgaagatgattttgatgttataattgttggagctggtgttgctggtgctgctttagctcatacacttgggaaggatggacgaagagtccgtgttatcgagagagatctaacagagcctgacaggattgtgggagaactgttacagccaggaggctacctgaaattgattgaactgggtcttgaagattgtgttgagaaaattgattcccaaaaagtgttaggatatgctctttttaaggatgggaaagatactagactggcttatcccttggaaaagtttcattcagatgtgtcagggaggagctttcataatgggcgttttattcaacggatgagggagaaagctgcgtcccttccaaatgtacggttggagcaaggaactgttacaactttattagaggaaaatggcgtaattagaggagtattgtacaagaacaaggctggggaagaaataaatgcatatgctcctcttacaatagtatgtgatggttgcttttcaaacttgcgccgctctctctgcagcccaaaggttgatgttccctcttgttttgtcggtttggtcctggagaactgtcaacttccatacccaaaccacgggcatgttgttcttgcagacccttcacccattttgtttatcctatcagtagttctgaggttcgctgtttggttgacgttcctggggaaaaggtaccatctattgctaatggcgatatggccaaatatttgaagactgtagtggcgccccagatcccacatcagatatatgattcctttattgctgcaattgataaaggaagcattagaacaatgccaaacagaagcatgcctgctgctccccatccaactccaggagctctattaatgggggatgcatttaatatgcgtcatcctttaaccggtggagggatgactgttgcattgtctgatatagttgttctaaacaatcttcttaagcctttgcgcaatcttaatgatgcatctgctttgtgcaaatatctcgaatccttttacacattgcgtaagcctgtggcatctacaataaatactttggctggtgccctatacaaagtcttcagcgcttcaccagatcaagcaaggaaagagatgcggcaagcatgtttcgattatttaagtcttggaggaatttgttcagcaggtccagtggctttactatctggtcttaacccacgtccgttaagcttagttagccatttctttgctgttgccatatacggtgtaggtcgtttattactcccatttccttcacccaagcgtatctggatcgggtttagattgatttggagtgcatcaggtattatttttcctattataaaggcagaaggacttcgacagatgtttttccctgcaactgttcctgcatattataggtctcctccagtaaaatgaaacaatacaaccaattcggaaaggaatcgaaaacaacaaaatcgctctactgaaaatgatcttttgaagcaaggtagtttgtaacactagtagtccattcctgtgaagatcaagctcaaacccatggaagttcaggtcactgcagaatataagttttcaactgggtttctttcaatatgtataaactggaatttttgtatctgaatttcctgtaatcatgtttacatcctagttgaaaactcattcttttttatgtttgattggtttgtatttatgatgacaacaactgattttggaat

SEQ ID NO: 3324 - DNA, 2437 bp, Cannabis sativa
aaataaaagagaaaagtttatatttgttcaccgtgggagggaaggagggagaggggagagaggagagagagaagcttagcataagaatatgaatgaattgatgatgttatggtaatggtagtaattaaacaaccacatcttgtcttcggtgttagatcccattttccaactcaatcacatccacattttcatttccattcacagccatttccagcaactcacctccctaaaacccctctcttcttcctccataaatcttcctccacctccaaggaccagggaccagcgaccagcctcaccctcctctcctccatccaattaatccaccatcatcacacaaccaacatcacccttctatccccacattctcctcttctttcttcttcttctgggtatcgttttttgcttccgcccaagatggtgcccctcgatccctacgttttctggactttccttgcctcctttttgggttttttggctctctgcgttctacgtcgccgtaatgcgggtgtcgagaagaacaagacgacggccacccagacccttttgagtcgtcaagaagccaggatctccggtgacgaaagagattccagggccgttttggggtctgataccgacgttttaattgtcggtgctggcgttgctggctccgctctcgcgtgcactctcggcaaggatggaaggagagttcgtgtaattgaaagagatttgaccgagccagatagaattgtgggtgagcttcttcagccaggggggtatctgaagctggtagaattgggtcttgaagattgtgtggaggaaattgacgctcaaagaatactaggatatgctcttttcaaggatgggaagaacaccagtctttcatatcctttggagaagtttcatgcagatgtagctgggaggagtttccacaatgggcgttttatacaaagaatgagagaaaaagctgctactcttcccaatgttcagttagagcaaggtactgtgacatccttgattgaagaagatgggacaattaaaggggttcaatacaaaacaaaggatggtgaagaacacaaagcttatgctcctctaacaattgtttgtgatggctgcttctcgaatttgcggcgcaatctgtgtgagcctaaggtgcaagtgccttcttgttttgtaggtttagttttggagaactgtcaactcccttatgcaaatcatgggcatgttattttagctgatccttctccgattttgttttatccaataagtagcactgaggttcgctgtttggttgatgtgcctggtcaaaaggtgccttctgttgctaatggtgagatggccaagtacttgaagactgtggtggcaccacagataccaccccaaattcaagaagccttcatatcagctgttgataaaggaaacattagaaccatgccaaacagaagtatgcctgccaatccacatcctactcctggagctcttctactgggtgatgctttcaacatgcgtcatcctttgactggcggaggaatgactgtagctctatctgatattgttgttctacaggaacttctcagtccattgcgagacttaaacaatgcggattcattgtgcaaatatctcgagtccttctacactttgcgcaagcctgtggcatctacaataaacacattagcagatgccttgtacaaggtattctctgcctctcctgatcaggcaaggaaggagatgcgccaagcatgttttgactatctaagccttgggggtacttgttcaacaggaccagtggccttactttctggtctaaatcctcgccctttaagtttagttctccattttttcgctgtggctatatatggtgttggacgccttctatttccatttccatcacccaaacgaatgtggattggagctagattgatttcgagtgcatcaggtattatatttcccataatcaaggcagaaggactgcggcagatgtttttcccagcaactataccagcatattacagagctcctcccgtcaagggtgataccgagagcaaatgaaccaaagagagttcataagttccacttccacgtccattcttccattaagtggtacaattttcgcaacattagaaacatttattatttgtaatgaacaaaactattattttagaacctccaaccacccccaacccccaaccaaaaataaataaataaagaaaaaagtagtgactattattgtagaaaaggaaagcctatgaatgtatgtattttagttcacaaaactgaacataatttagaagtaaatttcattcatgtgtatttcattataaaatgtggaggggttattggtcattttgggcaaagcttgggagttaatttacttttatgtaagtattttttctttttaaaatattaatattacttatttactattacttattttatgattaaattattcggatttttc

SEQ ID NO: 3325 - DNA, 2048 bp, Vitis vinifera
gcaccgactggaacgtcgttgccactgggctcaaccccagagtccatgtcaccaccccattattttctataaattgccacgctctctcctcctcacccaaaccagaaacaccacggctccccagagaaacgttgtcgtttcgacacactgctcgatctcgtcttcagccccgcattcccacaggcgcttgaagatgttccacccctacattctcggagctttctttgcttctgtgttggggtttctcctttacgctttacgtgataaagagaggaaagacaaccgcccccgccaccatcgtgcagatgggcttgttacgagtagctccgaaatcgggcaatgtcgccaggatgacggcttcggcaccgatataatcattgtcggcgccggagttgccggttccgccctcgcccacactctcggcaaggatggaagacgagttcacattattgaaagagacttgacggagcctgacagaattgttggtgaattgctgcagccaggggggtacctgaaactaattgaattgggccttgaggactgtgtggaggaaattgatgctcagcgggtgcttggatatgctcttttcaaggatgggaaaaatacaagactctcttacccattggaaaagtttcattcagatgtggcgggaaggagcttccacaatggtcgtttcatacagaggatgagagaaaaagctgcttttctttccaatgtacgtatggagcaaggaacagtaacatcactccttgaagaaaatgggactattaagggggttcaatacaaaacgaaggctggtcaagaacttaaagcatatgcgccacttacaattgtgtgtgatggttgcttctcaaatttgcgtcgctcactttgtaaccctaaggtagatgtgccctcctgttttgttggtttggtcctggagaactgtcagcttccctttgcgaatcacggacatgttattttagcagatccttcacccatcttgttttatccaattagtagtaccgaggtccgttgcttggttgatgttcctggacaaaagttaccttctattgccaatggtgaaatggccaaccatttgaaaaccagggtggctccccagcttccacctcaactttatgatgcctttatctcagcaattgatcaaggaaagataaggaccatgcccaacagaagcatgccagctgatccttatcctacacctggagccttattaatgggtgatgccttcaatatgcgccatcctttaactggcggaggaatgactgtggcactatctgatattgttgtactacgagatcttcttaagccgctgtccaacctgaatgatgcggtttcattgagcaaatatcttgaatccttctacaccttgaggaagccggtggcatctaccattaatactctggcaggtgccctttacaaggtgttttgtgcttccactgatcaagcaaggacggaaatgcgagaggcttgttttgactacttgagtctcggaggtatttgttcagcaggtccagtggctttactctctggtctgaatcctcgccctttgagcctagttgtccactttttcgctgtggctatatatggtgttggtcgcctgttgctaccatttccttcactcaaacgcttgtggattggagccagattgatttcggctgcatcgagtataatcttccccatcataaaggcagaaggagtgaggcaaatgtttttccccgtaaccatgccagcatactacagagctcctcctgctaaatgagataaaaaccaaatggcatgctcaaagtcgaagtagctttagtttgttgtttggttttcatgttgtctcgacaaagtagcttgtatctatgactatgctcccatgtagacttgggatgccaaatgtttccttcaatgaccgttgtgcaagagatgactgtaaacggttattcaaatgtataaatgagcaaccacttagaatccaggggtatgtgttctgctgacttttccaaatataattcaatgaaatcctccccattctgcgtgtatattaaatgggtgttgat

SEQ ID NO: 3326 - DNA, 2012 bp, Solanum lycopersicum
aatttagtatatgtggcttgttctgtttaattcgtaaaaaagtgtgctttgtgtctagaaatctctctgtattgacagcaaagcattcatcagatacagcctaataatactactctttctattttcatttttagatatatagagattcacgggcattgttagagaagcaacgtcgtcgtttctcttgctccgtttccgtttcccgtcctttttctgcattgtcgccggcgacaatggtggatttaggtctctccggatctcttcttgtagtggtgttggggttcgttgcagttttctgttttttcattggccgcagcaaaagtaaaaatgatggctcggcaactagcaccactacaactacgctgtataatggagagtccagatcaaaggatggaaacgaagacgttgatatcatcatcgtcggtgccggtgttgccggtgctgctcttgctcacactcttggcaaggaggggcgtcgtgtaaaagtaattgaaagagatttgacggagcctgatcgaattgttggagaactcctacaaccgggtggttatctcaaattgcaggagttgggattggaagattgtgttgagaaaattgatgctcaacgcgtttttgggtatgcccttttcaaggatggaaagagtacacgtctttcttatcccctggagaaatttcactctgatgtttctggaaggagcttccacaatgggcgtttcattcaaagaatgcgagagaaagctgcagctcttcccaatgtcaaactcgagcaaggcactgttacgtctctgcttgaagaaaaggggatcattagaggtgttcagtacaagactaaatccggtgaagagttgaaagcatatgcaccattaactgtagtatgtgatggttgtttctcgaatctgcgacgtaccctctgcgacccaaaggtagaagtcccttcttgttttgttggtctggtactggagaactgtcagcttccacatgaaaatcacggacatgtcattttggctgatccgtcacctatcttgttctatcccataagcagtactgaagtccgctgtctggttgatgtacctggtcaaaaagtgccttctatttcgaatggtgaaatggccaaatatttgaaaagtgtagttgctccccaggtccctcctgagataaaagatgcattcattgctgcaattgataaaggaaacatcaggacaatgcccaaccgaagcatgccagctgctcctcatcctactcctggtgctcttctcatgggtgatgcattcaacatgcgccaccccttgactggtggaggaatgactgtagcattatctgatatcgttgtattgcgtgatcttctcaaacctcttcgtgatttgaatgatgcatctactctttgcagatatctggagtcattttacaccttgcgtaagcctgtggcctccaccatcaatacattggctggtgccttgtataaggtattttgtgcttcacctgatcaagctaggaaggagatgcgtgaagcatgctttgattatttgagcctcggtggagtattctcagaaggaccagtatctttgctttctggcttaaaccctcgtccattaagtctcgtttgtcatttctttgctgtggctatctttggtgttggccgcttgctgcttcctttcccatcaccgaaacgtatatggattggagcccggctaatatcgagtgcatctgcaatcattttccctatcatcaaggcagaaggggtcagacagatgttcttccctgctactgttcccgcatattacaggaagccctcctgaagtgagattgtaactgctataaacagaataaggctatgccattgtaccacctccatcagtattctggttgtgagtttcaagagtttagtccaactgttgcataatttttggttgctagtcttcccttgtaatctttttcctttgttcccatgattaattacactattaactgcaaagtaaatataagttgtaaaagtataccttatctcttctctg

SEQ ID NO: 3327 - DNA, 1948 bp, Manihot esculenta
gtgctctctcggttaactatatcttttaacacgagaaaaaaaagccattgccagcgaagctttctactctagctaccaaagcaaaaccaccaccagatagggaaatccagggagggagagagagcttgaaacgcctctccgccgccgtgtctgctttcaatcggatcttaaaatgaaaatggcggaccattacttgctaggatggatcttggcctccgtcctggggcttttcgctttctactacatggtttatttggtagtgaggcgagaggaggagaataatagacgagcattttcggagcagagaagcgattccgtcaagactatccccgctacaaatggagaacgcagatccgatgacgactgtcatgttgacgttatcatcgtaggcgccggcgttgctggctctgctctcgctcatacccttggcaaggatgggcgccgagtgcatgttattgaaagagacttaactgaacccgacagaattgttggtgaattgctacaaccagggggctacctaaagttaattgagttaggacttgaagattgtgtggaggaaattgatgcacaaagagtgttcggttatgctcttttcaaggatggaaaacatacacaacttgcttatcctttggaaaagtttcactcagatgttgcagggaggagctttcacaatggccgttttattcagaggatgcgggaaaaagctgcatcccttcctaacgtacaattggaacaaggaactgtcacttctctacttgaagaaaaagggacaattaaaggtgtgttgtacaaaacaaaaactggtgaagagcttacagcttatgcgcctttgacaatcgtctgtgatggctgtttctccaatttgcgtcgctctctttgcaaccctaaggtggatgtgccctcttgttttgttggtttggtcctagagaattgtcaacttccatatgcaaatcatgggcacgttatactagcagacccttccccaattttattctatcctatcagtactacggaagttcgctgtcttgttgatgtacctggtcagaaggtcccttctatttcaagtggtgaaatggctaattatttgaagaatgtggtggctcctcaggtacccccagaaatatacagttcttttgtagctgctgttgataggggaaacattaggacaatgccaaacagaagtatgccagcttctccctatcctacccctggtgctttattgatgggtgatgcattcaacatgcggcatcctctaactggaggaggaatgactgtggcactatctgacattgttgtgctgcgggatcttctgaagcctttgcgagacctacatgatgctcctacgctctgcagatatcttgaatccttctataccttacgtaagcctgtggcatctacaatcaatacattggcaggtgccctgtacaaggtgtttagtgcttcacctgatgaagcaaggaaggaaatgcgccaggcctgctttgattatttgagtcttggaggcatattctcaacaggaccagtctctttgctttcaggcttaaaccctcgtccattgaccttggtcctccatttctttgctgtagcaatttatggcgtggggcgtttgttactgccattcccttcccctcagcgcatctggattggagctagattggtttcgggagcatctggaatcatcttccccattattaaggcagaaggagttagacaagtgttctttcctgcaactgttccagcatattatagagctcctcccattaaacacaattaactgcacaaggaaatggaagatactgctgtccaaggcagctgcattgtattctcaaagaattgtgaattatcataaacattagtttttagaacgctgtttgcttctacatgtctgtaaaatattactctaagcttgaaatatataagtttggtaagaaactagaaaccttaaatg

SEQ ID NO: 3328 - DNA, 2480 bp, Theobroma cacao
ttcgcgtgctcttgtttttgaaaacgtttcaaagccaaggcatagccagcgaagcgaggcctatcagaatcaacccaccgccaacaaagggagaagaacaaacaaacaaccaagaaatcaaaaccataaacaaagagaacaagagagagatttgattctctttctctctcgccgtagtcgtttaagcggagcctctgtttcttttttctggttagcatttggaggagaaaatggcggattcgtacgtgtggggatggatcttgggctccgtgatgacgctggttgcgttgtgcggtgtcgttttaaagagacggaaagggagcggaatctccgcgacgaggactgagtccgtgaagtgcgtctcctcgattaacggaaaatgcagatccgctgacggtagcgacgctgatgtcatcatcgttggagctggcgttgctggctccgccctcgctcacactctcggcaaggatggacgtcgagtgcatgtgattgaaagagacttgacagagcctgaccgtattgttggagaattgctacaaccagggggctatctaaagttaattgagttgggacttgaagattgtgtggaggaaattgatgctcagcaggtatttggttatgctcttttcaaagatgggaagcatacccgactttcttatcccttagaaaagttccactcagatgtatctggtaggagctttcataatggacgtttcatacagaggatgagggagaaatcagcttctcttcccaatgtacgtttggagcaagggacagttacttctctacttgaagaaaagggaacaattagaggagtccagtacaaaactaaagatggcagggaattgacagcatttgcacccctgaccattgtctgtgacggttgtttttcaaacttgcgtcgctccctttgcaaccctaaggtagatgtaccctcttgttttgtgggattggtcctggagaattgcaatcttccatactcaaatcatgggcatgttatactagcagatccttcccccattttgttctatcctatcagcagcacagaggttcgctgtctggttgatgtacctggtcagaaggttccttctattgcaaatggggagatggcaaattatctgaagaccattgtggctcctcaggttcctccagaaatctacaattcatttgtagcagctgttgataagggaaatattaggacaatgccaaacaggagcatgccagctgctccttatcccactcctggagccctattaatgggagatgcattcaacatgcgccatccattaactggtggaggaatgactgtggcattatcagatattgttgtcctccgcgatctactaaggcctctgcgtgacctcaatgatgcacctaccctctgcaaatatcttgaatcattttacaccttgcgtaagcctatagcatctactatcaataccttggcaggtgccttgtataaggtgttctgtgcttcacctgatcaagcaaggaaagaaatgcgtcaggcttgcttcgattatctaagccttggtggtgtattctcaacaggacctatctctttgctctctggtttgaaccctcgccctgtgagcttggttctgcatttctttgctgtggcaatatatggtgttggtcgtttactattgccgttcccttcacctaagcgaatctggattggagctaggctgatctcgggagcgtcaggaatcatcttcccaattatcaaggcagaaggagttaggcaaatgtttttccctgcaactgttcctgcatattacagagctcctcctgttgagtgagatccagatatggagaacggaaatgctacgacaaactagtttgtaatctcatttgtcttcccccttttcaaagtaatggggaagagcaaatgctcaactaaggacctcattctttaggctgtccataaggtctttcccccttatttcctcaaaaaaaaaagaaaaaagaaaatccgagattaaagtatataatctttccaaaatggtggaatgaaatcttggaagaggaaatctactgctgttttgactatgatttgttaatttaatttctattaatattaaggacttgttcacagtgcttacgatttacacgtactcttggcggtgctgtcatcatacttttctttctttttcttattttgtttgtctttgggggtaggtggggggaagagagatttgaattcggggcgtccttttcagccattcatcattcgtcatcttatataatagcattgaaataagtttttaatatttgaattcatgggatactactcttagtgccagcaagattttggctggcttgctggcccaagatgttattaatccgccgataatagactaatcctgtccggaggaagcggtcaaggatttgttccctaccgcgacaagatctgtgttgacactaacaccatgtttgttagagaagggaaaaaacccaaataaagtagttttctttcc

SEQ ID NO: 3329 - DNA, 2243 bp, Amborella trichopoda
ccggcaggaggagagagaaagggcaaaatcacctctttagagagagaaaaagaagtgagagaaaggacaggctttggcaggcaggtgcagagagcaaagtacataaaggagagagagaagatcatacgtgcaaacattagcgaccacaggttcaccggatcacaaaccaaaccccgctatatgtaaggctctttccagctcattttcatggacgatattttaagggaaaattaaagcaaaaaaaaggaaaaaaaagcttgattttccattttcgatccagagagagagagagagagctctggttagggctagccggttcttctgcaaactctcgctcgaagatgctgcagtttctgtttgggctagcccttgcctctttgatagcaattgccttattttctggttttaaaaagaagagtccccggcaaaatcctgcggttttccggccaggtgtccgggaaactgagaatggtagttttcaggcgaaggattcaagcacagatgtgatcattgttggtgcaggtgttgcaggctcggctcttgcgtatactcttggaaaggatggacgtcgggttcaggtgattgagagggacttgacagagcctgataggattgttggagaattattgcagcctggtggctacctgaaattggttgagctgggccttgatgactgtgttcatgaaatagatgctcaaagagtgctgggttacgcacttttcaaggagggcaagaacaccaaagtttcatatcccttggaaaattataattcagatgtagctggaaggagctttcataatgggcgcttcattcaaaggatgcgggaaaaagctgcttctcttcctcaggtccaattggagcaaggaactgtgacttcattgattgaagaaaagggaactgtcaagggtgtgagatataagtcaaatggtgaagaacatgaggcctatgcccctctcacaattgtatgtgatggttgcttttcgaacttgcggcgttctctctgcacccctaaggtcgaagtgccatcttgctttgttggcttggttctggatctggagaattgccatctcccatatccaaaccatgggcatgttgtcttagcggatccttcacccatactattctatcccataagcagcaccgagatccgctgcttagttgatgtacctggccagaaagtaccttctattgctaatggagaaatggccaactatttgaagactgtggtggcccctcagattccagaacaactaagagaatcatttttaatggctattgagaaaggaagcataagaacaatgccaaacaagagcatgcctgcttctccataccctactcctggcgctctgcttatgggtgatgcattcaacatgcgccatcctctaactggtggtggcatgactgttgcattatctgatattgttgttctccataaccttcttaaacctctccgtgaccttcatgatgcccctgcactttgcaaatatctggagtccttttataccttgcgcaagccagttgcctctactataaatacattggcaggtgctttgtacaaagtcttttgtgcatctcctgatcaagcgatgaaagaaatgcgtcaggcctgcttcgactatctaagtcttggaggtgtcttctcaactggacctgtggccttactatctggccttaacccacgacctctaagcttggttctccatttctttgccgttgctgtatatggtgtcgggcgtctattgttgcctttcccttctcccaagcgcttatggcttggagctagattactttcgggggcattaaatatcatttttccaattattaaagctgaagggatcaggcaaatgttctttcccaacactgtgcctgcttattacagggcacctccaagttaagtgagcagtatgacaggccaaggtacttgctgccactgtctcgctctctgttcaattgcaatgtggctgtgagaattcattttgtatgtaatgttgtctcgtagcaggtaaatgtaggtgtaggtggaaaagtggatttatgttcttcaatgttgtctctgtttatttgtactcccaattgactttttcacggtatatacgaggggctcaatagccttcctttaagctcttgcactcgtctcttttatggatagtgttttggtgagtgcaccttattccagtgtacctgccctttggttccaaaattacagaggtcgataaactaaaaaaaagaaagaaagaaagaaa

SEQ ID NO: 3330 - DNA, 1939 bp, Euphorbia peplus
gaaaacattgccagctaaggcatttgttgtgtcctttagagagccccaaaagcaaacgccaccatacataaccaccactaatcctgattcaataatctccaaggagagataaaatccagtatcagttgtcgtttctgtttcgatttttggatttcaaaatgaaaatgtcggatcattacttgctcggatggatcgtcgcctccgtaatgatgatattctccgtatctactggctctatttagtcgttgtcaggaaagaggaggaagacgagaataacagacaggccaaacgtaactccgttaccaccgtctcccccgtcacggcagaatgcagatccggtgacagacctcatgctgatgtcatcatagttggcgctggcgtcgccggcgctgctcttgctttcactctcggaaaggagggacgacgtgtacatgtcattgaaagagacttgtctgaacctgacagaattgttggggagttactacaaccagggggatacctgaagttaattgagttggaacttcaagattgtgtggaagaaattgatgcacagcgggtgtttggttatgctctttttaaagatgggaaacatactcaacttgcatatccattggaaaagttccattctgatgtagcaggaaggagctttcacaatggccggtttatacagaggatgcgtgaaaaagctgcatcccttaccaatgtacaattggagcaaggaactgttacttcccttcttgaagaacaagggataatcaaaggagtacagtacaaaacaaaaaacggtgaagagctcacagtttttgcacctttgacaatcgtttgtgatggatgcttctcaaatttgcgccgctccctttgcaaccctaaggtagacgtgccttcttgttttgttggtttggtcctggagaattgcaaacttccttatgcaaatcatgggcacgtcattttaggagatccttccccgattttattctatcctatcagtagtacagaagttcgctgtctggttgatgtacctggccagaaagttccttccatttcaaatggtgaaatggcaagctatttgaagaacgttgtggctcctcaggttcccccagaattacatgattcttttttagctgcggttgataaggggagcatccgaacaatgccaaacagaagtatgccagctgctccatatcctactcctggagcattgttgatgggtgatgcgtttaacatgcgtcatcctcttaccggaggaggaatgactgtggcactttctgacattgttgtgctccgtaatcttctcaagcctttgcacgacctacatgatgcacctacactctgtagatatctcgagtccttttacaccttgcgtaagccggtggcgtctacaatcaatacactggccggtgcgcttcacacggtattctctgcttcaactgatgaagcacgacaggaaatgcgccaggcttgctttgactatttgactcttggaggcgtattctcaacgggaccaatcgctttgctctcgggtttaaaccctcgtccattaagtttggttcttcatttcttcgcagttgcaatttatggtgttggtcgcttattgctgccattcccttctgtgaagcgcatgtggattggagctaggcttatttcgggtgcgtcaggaatcatctttccgataatcaaggcagaaggtgtgaggcaaatgttcttccctgcaaccgtgccagcttattatagagctccacctgttgaagtaaattaaattgtgtacaaatgcaaacccgtgcttgttgtattttaaaccccgtgtgcctgacggaacaactgtgaaatatcataccacctgtgactttgagcttgaaaatctagatgaaattttgtggacaatggttctctagttgtttctttaactctaattctatttaaggagtgctaatctgaattt

SEQ ID NO: 3331 - DNA, 1709 bp, Chelidonium majus
tagagttcaattgaacgaaaatgaatgcattaagaagagttgtatggataatggagaattcaagtcggagagtaaaggagagactgatgttataattgttggtgctggtgttgctggtgctgctctggcttatacgcttggaaaggacggacgtcgtgttcatgtgatagagagagatctaacagagccagacagaattgttggggagctactacaacctggtggctacctgaaactaattgagctgggtcttcaagattgtgttgaaaaaattgatgctcagagagtcttagggtatgctcttatcaaggatggccaaaatactagagtctcgtatccattggaagaattcgattccgatgtggctggaaggagctttcacaatggacgcttcatacaacggatgcgggagaaagcagaaaccttgccaaatgtacggttggaacaaggaaccgttacttccttgctagaagaaaatgggaccattaaaggagttttatacaagaataagagtggcgaagaactaaaagcatatgctcctcttacagtagtctgtgatggttgtttttcaaacttgcggcgctctctttgcaaccctaaggtggatgtgccctcttgttttgttggattgatcttggagaactgtaaacttccacatccaaaccatggacatgttgttttagcagatccttcccccatcttgttttatcaaatcagtagctatgaagttcgctgtttagttgatgtacctggtcaaaaagtaccctctatttcaaatggggatatggccaactatttgaagacagtggtggctccccagattccatcccagctatttgattcctttgtagcagcagttgataagggaaacataagaacaatgccaaacagaagcatgccagctgatccccatcccactccaggggccttgttaatgggggacgcattcaacatgcgtcatcctttaacaggtggtggaatgactgtggctttatctgatattgttctgctacataatcttctaaagcctctgcgggatctgaatgatgcatcttcactgtgcaaatatttggaatccttttacactttgcgtaagccagtgtcatctacaataaacaccttggcaggtgcactatacaaggtcttttgtgcttcgcctgatcaggcaagaaaggaaatgcgcgaggcctgttttgactatttgagcctcggaggagttttctcatcaggaccagtggcattactctctggtcttaacccgcgcccattgagcttggtttgccatttctttgcagtagccatttatggtgttggccgcctattactgccatttccttcacccaaacgaatgtggatgggagctaggttaatttcgagtgcttcaggtatcatctttccaattattaaggcagaaggagtcaggcaaatgttcttcccggccactgttccagcatattatagagctcctccagttaagtgacgatgaaacaaatgacaaatattatcagaattaagccattgtagtagtaatgctgtctattgaatgagattatggagtttaagatagattattcttctccacccttgttcaggttgtcaattcaatatgttgtattaatatttgtcgtccctcgataagtcattctctgtcgacgaagttaattcttcctccaagggaagatttgcataataatattcatctcttagta

SEQ ID NO: 3332 - DNA, 2083 bp, Glycine max
aaaagtcacacgtaaacaggaacaaagaggtgttccaagaaactaaaaaactagtacttaatcccatcttctgcaatcccagtttcactgatctctcggagaggatggattatccgtacattctaggagggatcatggcttgtagttttgcatttttgtatgttgtgtacagttttggagcaaagaaggtcacagattcaagttcaatacatgtaaagagtaatgagtgtgcaaagacatcatcagaaggtggaatatgttcttcagatgaggatgcaggaagtgctgacatcatcattgtgggtgctggggttgctggtgcagctcttgcttacactcttggaaaggatggacggcgagtgcatgtaattgaaagggatttgagtgaacctgacaggatcgtgggtgaattgctacaacctgggggctatctgaggttaattgagttgggccttcaggattgtgtggatgaaattgattcacagcaagtctttggctatgctctgtatatggatggcaaaaataccaagctgtcttatcctttggaaaaattcagctctgatatttctgggagaagctttcacaatggccgtttcatacagagaatgcgagaaaaggcttcgtctcttccaaatgtaaaattagaacaaggaactgtcacatctctacttgaagagaaaggaaccatcactggggtgcactacaaaatcaaaagtggacaagagttcacagcaaaggctcccctcaccatagtatgtgatggttgtttttccaacttgaggcgttctctttgcaatcctaaggttgacgttccctctcattttgttggtctggtcttggagaattgtaatcttccatatgcaaatcatggtcacgtcatcttaggtgatccttcacccgttttgttttatcccatcagtagcactgagattcgctgtttggttgatgtgcccggccaaaaattaccttccctaggtggtggtgaaatggcctgttatttgaaaactgtggtggctcctcaggttcctccagagctgtatgattcttttatagcagctattgacaaaggaaacataagaaccatgccaaatagaagcatgcctgcctcaccttatcccacaccaggtgcacttctaatgggagacgccttcaatatgcgtcaccctttaactggaggaggaatgactgtggctttatctgacattgttgtgctaagggatttacttaaacctcttcatgatctgcatgatgcttctgctctttgcagataccttgaatcattctacaccctacgcaagccagtggcatctacaataaacacactagctggggcattgtacaaggtcttttgtgcatctcctgatccagctagaaaggaaatgcgccaagcatgtttcgattacttgagccttggaggtgttttctcagatggaccaatagctctactctctggtctaaatcctcgtccattgagtttggttctccatttcttcgcagtcgctatatacggtgttggccgcctgctcataccatttccttctccaaaacggatgtggattggagctagattgatttcaggtgcatcaggcatcattttccccattattaaggctgaaggagtgagacaaatgttcttcccagcaactgtgccagcatattacagaacccctcctgtccattgaacacacatgaaggaaatacatggaatatataaaattcccttttcccacattcttttcacctgttgtattccacttttgccaagaagaataagagagggaactcattccataattaggatactcattttgtgcaactgcaaccaatattattgtattaaaaaaacattttttaatttgggacccgagaatgaagttccaaaaccaatcttgcaggtattagagctaagaaatgctaggctttgtcttcaatgcaagttggtgttatttggctactagtatatggtatattggtattgtatacgttatcttcacttagatgaggggcaaggtaagtacacagtgcagaaagaagttggtgtaatgtgacaatggaagcaaccaccaaatggaagattattata

SEQ ID NO: 3333 - DNA, 2395 bp, Vitis vinifera
aactcaaacctgcacacaaccaatactctgacaaggctttcgtccttctgagaaagaggagcagctcatcttcttccaacccatttttctttgttatttgaagatgatttatcagtgggtattgggaggaattgttgcttctttgttggggtttcttcttctggaccgttcaagagggaagagggtgaagagcagagcaggaggacatttaatggagaaaatgaaggatgagtgtgtcaagagctctgcaaatggagaatgctgctcgggtttcgatggcggtaccgatgtgattgttgttggagctggggttgctgggtctgctctggctcacactcttggcaaggatgggcgaagagttcatgtgattgaaagagacttgagccagcctgacagaattgtgggtgaactgctacaaccaggaggctatctaaaattgattgagttgggtcttgaggattgtttaaatgagattgatgctcagagggtccttggatatgctctttacaaggatgggaaaaatgctaggctctcttatcccttggaacagtttcactcggatgtggctgggagaagctttcacaatggacgatttgtccagaggatgcgtgagaaggctgcatcgcttcccaatgtaaaaatggaacaaggaacggtgacatctctgattgaagaaaaagggtctatcaaaggagtgcaatacaggaccaaggctggtgaagaactgaaagcatatgctccccttacaattgtatgcgatggttgtttttcaaatttacgacgctctctttgcaaccctaaggtggatgtgccctcttgttttgttggtttagtcctcgagaactgtcagctcccacatgcaaatcatggacacgttattctggcagacccttcacccatcttgttttatccgattagtagcaatgagattcgctgtttggttgatgtacctggccagaaagtaccttcaattgctaatggtgaaatggcctgctatttgaaaacagtagtggctcctcagatcccccctgagctgcataatgccttcatatccgcaattgataaggggaatgtgaaaacaatgccaaatcgaagtatgccagcctctccctatcccactccaggtgcgcttttgatgggagatgcattcaacatgcggcatcctttaactggaggtggaatgactgtggcgctctctgatattgttgttctgcgagatcttcttaaacctctgcaaaatctaaatgatgcagctgctctttgcaaatatcttgaagccttttacactctacgtaagccagtggcatccacaataaacacattggccggagccctatataaggtgttttgcgcatcaccagatcaagcaaggaaggaaatgcgtgaagcatgttttgactatttgagtcttggaggtatcttctcaaatggaccaattgctctactctctggcctaaaccctcgcccattgagcttggttctccacttttttgctgtggctgtctatggagttggccgcttattgcttccatttccttcgcccaagcgcatgtggattggggccagattgatttcgggtgcatcaggcatcattttccccattataaaagctgaaggagtcagacaaatgttctttcctgcaactgttccagcatattacagaggtccacctaattgagataatgaaaataagaaatccacagtcaacaactgaaattgtaatagccaggctgttgtgtttgtcttccttttgttttccaagagaagttcttgtttgtatcagtcatgttcctcataagaaatcaaggtggggttccatgctagaatcaacagaatatgaagtaccaatataaattatatttgttctaggaaattgttcatgaaacaggattccctccgaaatagaataacgattttcttcctagaaaatgaatgcaattttatcatagtagatgtgttcttcagtagccgtggacttatatgtgtatgtgactatttctcaatatcaaatgcgctcatctagcattagctagcgatttgtcttagtctcataggagtgaagaaaatggttctggtggaattgagttaagctcttatttgtttaatggagactgtagaaagcaattgaaactacatttttgggaaaagcaagcagttcttgaatggcaatcaggggtttcttgttaccttatcatagctggaaaactgttacatgacattaagcagatggctttcgggtaggggtttttacaacgtaaaacagggtgatcttaacaacttccttgggttggaggctagcagcattcttctgttatcatgtctgaggactaatgttatgaacatttgtgttttggaatataaagcttatatcaatcaatgatggggcaaattgaaa

SEQ ID NO: 3334 - DNA, 1822 bp, Capsicum annuum
gcacgaggcctctccccgcccccgctcaactactcttaccatttctatacacaacgattcgcattttgttacacaacctaaacgacgtcgtttttctacattgtcgccgccgacaatggcagatttactcaccggatctattctcacagtggtactaggtttagtcgcagtgttttggtttttggtttggaagaatagtgggcggagaaaaattgaaatcattgacccgactactaatagcactgccacgacgacggtatatgatggagaatgtagatcaaaggatggagatgatgacgtggatattattgttgtcggtgccggcgttgctggtgctgctctcgctcatacacttggcaaggaaaggcgtcgtgtaaaagtaattgaacgagatttgacggagcctgatcgaattgttggagaactcctgcaaccaggtggctacctcaaattgcaggagttgggattggaagattgtgtggagaaaattgatgctcaacgagtgtttgggtatgctcttttcaaggatggtaagagcacacgtctttcttatcccctggagaaatttcactctgatgtttctggaaggagcttcacaatggcgtttcattcaaagaatgcgagagaaagctgcatctctccccaatgtcaagctagagcaaggtactgttacgtctgcttgaagaaaacgggaccattagaggtgttcagtacaagactaaatctggtgaagagatgaaagcatatgcaccattaaccgtagtatgtgatggttgtttctcgaatctacggcgtaccctttgcgatccgaaggtagaagtgccttcttgttttgttggtctggtcctggagaactgccagcttccacatgaaaatcatggacatgtcattttggctgatccatcacctattttgttctatcccataagcagtactgaggtccgttgtctggttgatgtacctggtcaaaaagtgccttctatttcgaatggtgaaatggccaaatatttgaaaagcgtagttgctccccaggtccctcctgagataaaagatgcattcattgctgcagttgacaatggaaacatcaggacaatgccgaaccgaagcatgccagctgctcctcatccaactcctggtgctcttctcatgggagatgcattcaatatgcgccaccccttgactggtggaggaatgactgtggcattgtctgatattgttgtattgcgtgatcttctcaaacctcttcgtgatttgaatgatgcccctactctttgcagatatctggagtccttttacaccttgcgtaagcctgtggcctccaccatcaatacattggctggtgccttgtataaggtgttttgtgcttcacctgatcaagctaggaaggagatgcgcgaagcatgctttgattatttgagccttggtggagtattctcagaaggaccagtatctttgctttctggcttaaaccctcgtccattaagtctcgtttgtcatttctttgctgtggctatctttggtgttggtcgcttgctgcttcctttcccatcacccaaacgtatatggattggagcccgactaatatcgggtgcatctgcaatcatttttcctatcatcaaggcagaaggggtcaggcagatgttcttccccgctaccgttcctgcatactataggtctcctcctgaagtgaggttgtaactgctttaaacagaataaggctatgccattctgcctcctccatcagtattctggttatgagtttcatagtttagtcccaactgtttcataattttcggttgctaatgttttcttgtaatatttt

SEQ ID NO: 3335 - DNA, 1930 bp, Phaseolus vulgaris
atagtagcaattgttataattcataagttacacgtaaaacaggaacaacgaggtgttccaagaaaccagaaaactattgttcaatccatcttttgctgtcccagtttcaccaatctctcagagacgatggattatcagtatattctaggagggatcatggtttctagtttcgcatttttgtattttgtgtacatttttggagcaaaaaaggtcacagattcaagtttagttcatgtaaaaagtaacgagtgtgagaagaaatcatcagaaaatggaatatgctcacacgaggctgcagaaagtgctgaaatcatcattgtgggtgcaggcgttgctggtgctgctcttgcttacacgcttggaaaggatggacgccgagtacatgtgattgaaagggatttgagtgaacctgacaggatcgtgggtgaattgctacaacctgggggatatttgaagttaattgagctgggtcttcaggattgtgtaagtgaaattgatgctcagcaagtctttgggtatgctctgtataaggatggcaaaaataccaagctcccttatcccttggaaaaatttagctctgatgtttctgggagaagctttcataatggccgtttcatacagagaatgagagaaaaggcctcatctcttcctaatgtcaatttagaacaaggaactgtcacatctctacttgaagaaaaaggaaccatcaccggggtgcagtacaaaaccaaaagtggacaagagttcacagcaaaggctcccctcaccatagtatgtgatggatgtttttccaacttgaggcgttctctttgcaatcctaaggttgaagtaccctctcattttgttggtctgatcttggagagttgtgatcttccatatgcaaatcatggacacgtgatcttaggtgatccttcacccattttgttttatcctatcagcagcactgagattcgctgtttggttgatgtgccaggccaaaaattaccttccctaggcaatggtgaaatggctagttatttgaaaactgtggtagctcctcaggttcctaaagagctgtatagttctttcatagcagctgttgagaaaggaagcataagaaccatgccaaatagaagcatgccagcctcacctcaacccacacctggtgcccttctaatgggagatgccttcaatatgcgtcaccctttaacaggaggaggaatgactgtggctttatctgacattgttgtgctaagggatctacttaaaccccttcggaatctgcatgatgcttctgctctttgcagataccttgaatcattctacaccctacgcaagccagtagcatccacaataaacacactagctggggcattgtacaaagtgttttgtgcatctcctgatccagctagaaaggaaatgcggcaagcatgttttgattacttgagccttggaggtgttttctctaatggaccaatatctctactctctggtctaaatcctcgtccattgagtttggttctccatttcttcgcggtcgctatatatggtgttggccgcttgatcataccatttccttctccaaaacggatgtggattggagctagattgatttcaagtgcatcaggcataatattcccgattattaaggctgaaggagtgagacaaatgttcttcccagcaactgtggcagcatattacagagctcctcctgttccttgaacacacatgaaggaaagacctgtaatatataatgcctcccttttcccacattctttctttgtgtagtattccactttttccttaaacaataagaaattgaactcattccatagttaggaatctctttttatgcattgtgcctcgcacttgcagtacgtatgatacaaatcaaattacgtaataaaatgttaatacaaataattttctttctccaaaaaaatttaaaaaa

SEQ ID NO: 3336 - DNA, 1863 bp, Gossypium hirsutum
ccgcgcaggtgtatcaacgcagagtacatgggaccccattgttgcataaacctagaaccttctatctctctgttctccttcattcccaaatttagaagaaaaaaaaatggagatgtttttcgataattatattgtcggcacgttcttggtttccctttttgccttcctttttcttttcattttgcggcgctataataataataataataatgataataacaccaggaagaagagattcgagaaagggtattctagggaatttaagatccaaaccggtaccggcaaaggagaatgctcgcctggaaatggttccggcgatgaagtcatcatcgtcggtgccggtgttgctggtgctgcgcttgcttatacccttggcaaggatggaaggcgggttcatgtgatcgaacgagacttgaccgaaccggatcggatcgttggagaactgttgcagccaggagggtaccttaaactagttgaattaggccttgaagattgcgtagaggacattgatgctcagcgtgtgttcgggtacgctctcttcaaagacgggagaaacacgaaattgtcatatcccttggagaagtttcaggcagatgtttcaggacgaagcttccataatggccgtttaatacaaaggatgagagaaaaagccgctactcttccgaatgtaaagctagagcaagggacagtgacatctttgattgaagaaaaagggacaattataggggtgcaatacaaaactaaagatggtgaagaactaagagcttatgctcctcttacgattgtatgcgatggttgtttttcgaaccttcgcaggtccctttgcaaccctaaggtggatgtaccctcttgttttgtgggtttggtcttagagaactgtgaactcccgttttcgaatcatggccacgttatcctagccgatccttcacccatcttgttttatccgattagtagtacagaggttcgttgcttggtcgatgtacctgggaagaaagttccttccgttgctaatggggaaatggcgaatcatttgaagaccgtggtggcacagcaggttccacccgagcttcgcgatgccttcatagctgcagtcgacaaaggtaatatccgaaccatgccaaatagaagcatgccggctgatcctcatccgactccaggtgcacttcttatgggagatgctttcaacatgcgccatcctttaaccggcggtggtatgaccgtagcattgtccgatattgttgtacttcgagatcttcttaggcctttgcataaccttcatgatgcagcctccttaaccagctatctcgaatcattctacacgttacgcaagcctgtcgcatctacaataaatactctggccggtgctctttacaaggtgttttccgcttcacctgacgaagcaaggaaggaaatgcgccaagcctgtttcgactatttgagccttggaggtgttttttcaacaggaccagtggctttactctccggtctaaaccctcggccgttgagtttagtacttcatttctttgccgtcgcgatttacggagtcggtcgtctgctcctaccttttccttcgttccaacgcatgtggattggagctaggttaatttcgagtgcatctggaattattttccccataatcaaggcagagggagtgagacagatgttcttcccagctacggttccggcggtatatagagctcctcctgtcgtcaactgatgcaaccaagattaaaagcttggaaccattacctcttcgctttagaccccatgatcgataagtgttatattgcatgtatgatgaggacattgtacaactgtaagatatgttttgatactattctttctatgaacaaaattctccaa

SEQ ID NO: 3337 - DNA, 1996 bp, Musa acuminata
atcaaccgctgctcggaacacgcgaggagcgtgagagagagaggacagagaggaggcggagagtgagcgaggaggggatggcttctgtggcggcggagatggcggagcactaccttttcgcggccattgtcgcttcgatcttggccttccttcttctcgccggaatccggggtcggaaggccgcgagggggaggaagaggaccgacgatggagctcctttcgccgccgggaaggagcagtgcgattcggacgccgatgggtgcggcgtcccggacgtgatcgtcgtcggctctggcgtcgcgggttccgccctcgcctacacgctcggaaaggatggaagacgggtacatgttattgagagagatttaacagagcccgacagaattgttggtgaacttttgcaacctggaggatacttgaaactggttgagttgggccttcaggattgtgttgaagaaattgatgctcagcgggtccttggctatgctctttttaaagatggaagaaatactaaacttgcttaccctctggaaaaatttcattccgatgttgctgggaggagctttcatcatggacggttcatacaaaggatgcgacagaaagctgcaactttacccaatgttcggctggagcagggaactgtaacatcattgcttgaagaaaatggaacaattaagggggtactgtataagaataaagctggtgaagaattaaaagcttttgcacctcttacaattgtatgtgatggctgcttttcaaatttgcggaagtctctctgctctcctaaggtggatataccgtcttcttttgttggtttggttcttgagaactgtgaacttccattcccaaaccatgggcatgttgtcttggcggatccctcacccattttattttatccaataagtagcaatgaggtacgctgtttggttgatgtgcctggacagaaagtaccttctgtaacgaatggtgaaatggctagctacctaaagacagtggtgacacctcagattccagctcaactgcatgatccttttatatcggcaatcgacaagggaaatattagaacaatagcaaataggagcatgccagctgttcctcatcccacacctggagccctgttaatgggggatgctttcaatatgcgtcatcctctaaccggtgggggaatgactgtggccttatctgatatagttcttctacataatcttctcaagcctcttcgtgatcttcatgatgcatccactctctgcaattacttggagtctttttacaccctacggaagccaattgcttctacaataaacaccttagcaggtgctctttacaaggtctttagtgcatcacctgatcgagctaggaatgaaatgcgccaagcatgtttcgactatttaagcctgggaggtgtattctcaaatggacccatttctttactctcaggtctgaatcctaggccattgactttggttgcacacttctttgctgtcgctatatatggtgttggccgcctattgctgccatttccttcccccaaacgaatgtggattggagctagacttatttctggtgcctcaggtatcattttccccatcatcaaagcagaaggggttcggcaaatgttcttccctgcaactgttcctgcatattataggaaaccccctgccaattgaaacatcaagatgggtggtgaattcagctcaagctcaactgtgtaccatttttaggttaaataactgttgcagacataacatgttcttagtttgcaattccacgaggccggatctggcattgaatttgtattcccattatcgtgcatgtggagtggaaactataaagatcactaacttgttaatcactcaggtaccgtgagactaattttttgacaataaacagtgtttttgtgatttcggtttccagtgattgtgtaagttgaattgcatggatatggtctgagattacaggaatatggtttgaaggtattaaagctcaagattgctct

SEQ ID NO: 3338 - DNA, 1935 bp, Vitis vinifera
actcctgctcctccagttgtaaacttgtgatattcatataagacgcacacccacactaggaaaaacgcgacgccagcgaaacctagtgagagaaaaacgagagagggagagagaagccgtcgacgacgtcgcttcggtcttggtctcgctgctccattcgcattcggaaatggtggatcagggcatcctgggatggatcttcgcctccttgctggggttcgtcgtcttccgtagcgtgcttctgaagaacaagaagaagggcggtgcttctgtggagatcagggatgaatgcgtgaaaagcaccgctaatggagaatgcagatcgaagaccgcttgcgaggaggctgacgtcatcatcgtcggggccggcgtcgcgggcgccgctctggctaatactctcggcaaggatgggcgtagggtacgcgtgattgaaagagacttaactgagcctgaccgaattgttggtgaactgctacagccagggggctacctcaaattgattgagttggggcttcaagattgcgtagaggaaattgatgctcagcgggtgtttggctatgctctctttaaggatggaaagaatacgaaactctcttatcctctggaaaaattcgattcagatgttgccggaaggagctttcacaacggccgcttcatacaaaggatgcgagagaaagctgcaacccttcccaatgtacagttggagcaaggaactgttacatctttacttgaagaaaaggggaccattagaggggtaaattacaagactaaagatggtgaaacaatgacagcatatgctcctttaaccattgtatgtgatggttgtttctcaaacttgcgccgctccctttgtacccctaaggtagatgtgccctcatgttttgtcggtttgttgctggaagactgtgagctcccatttgcaaatcatgggcatgttgttttagcagatccttctcctatcttgttttatcgtatcagcagtacagagattcgatgtctggttgatgtacctggtcaaaaggtgccttctatttcaaatggtgaaatggccaagtatttgaagactgtggtggctccccaaattcctcctgagctgtatgatgggtttatagctgcaatcaataaaggaaacataaggacgatgcctaatagaagcatgccagctgctccacatcctactcctggggccttgttgatgggggatgcgtttaatatgcgccatcctttaactggtggaggaatgaccgtggcactatctgatattgttgtgctccgagatcttctcaggcctctgcatgacctgaatgatgcagctacactttgcaaatatctcgagtccttttataccttgcgaaagcctgtggcatccacaataaatacattggcaggtgccctgtatagggtgttttgtgcttcaccagatcaagcaaggaaggaaatgcgtgatgcgtgctttgattatttaagccttggaggtgtgtgttcatcagggccagtgtctctactatcagggctaaatcctcgtccattgagcttggtttgtcacttctttgcggtggcaatatttggtgttggtcgtttattgctgccatttccttcaccaaaacgtgtatggattggagctagaataatttcaggtgcatcgggaatcatcttccccatcataaaggcagagggagttagacaaatgttctttcctgcaacagttccagcatattacagagctcctcctgttaagtgaagttttgaagctgaattacaaaaggtgaaaatggttaaagggggtttcaatcaagacgagctactttgtcacattcccttgttcaaagataacggggaagtgattcttcgaatatgtgcattatgacatgttttggttgtcaggacttcctttttctctgatatcaaaatatactcttttctttttcttccaaa

SEQ ID NO: 3339 - DNA, 2381 bp, Vitis vinifera
cacaaccaatactctgacaaggctttcgtccttctgagaaagaggagcagctcatcttcttccaacccatttttctttgttatttgaagatgatttatcagtgggttttgggaggaattgttgcttctctattggggtttcttcttctggaccgttcaagagggaagagggtgaagagcagagcaggaggatatttaatggagaaaatgaaggatgagtgtgtcaagagctctgcaaatggagaatgctgctcgggtttcggtggcggtaccgatgtgattgttgttggagctggggttgctgggtctgctctggctcacactcttggcaaggatgggcgaagagttcatgtgattgaaagagacttgagccagcctgacagaattgtgggtgaactgctacaaccaggaggctatctaaaattgattgagttgggtcttgaggattgtttaaatgagattgatgctcagagggtccttggatatgctctttacaaggatgggaaaaatgctaggctctcttatcccttggaacaatttcactcggatgtggctgggagaagctttcacaatggacgatttgtccagaggatgcgtgagaaggctgcatcgattcccaatgtaaaaatggaacaaggaacggtgacatctctgattgaagaaaaagggtctatcaaaggagtgcaatacaggaccaaggctggtgaagaactgaaagcatatgctccccttacaattgtatgcgatggttgtttttcaaatttacgacgctctctttgcaaccctaaggtggatgtgccctcttgttttgttggtttagtcctcgagaactgtcagctcccacatgcaaatcatggacacgttattctggcagacccttcacccatcttgttttatccgattagtagcaatgagattcgctgtttggttgatgtacctggccagaaagtaccttcaattgctaatggtgaaatggcctgctatttgaaaacagtagtggctcctcagatcccccctgagctgcataatgccttcatatccgcaattgataaggggaatgtgaaaacaatgccaaatcgaagtatgccagcctctccctatcccactccaggtgcgcttttgatgggagatgcattcaacatgcggcatcctttaactggaggtggaatgactgtggcgctctctgatattgttgttctgcgagatcttcttaaacctctgcaaaatctaaatgatgcagctgctctttgcaaatatcttgaagccttttacactctacgtaagccagtggcatccacaataaacacattggccggagccctatataaggtgttttgcgcatcaccagatcaagcaaggaaggaaatgcgtgaagcatgttttgactatttgagtcttggaggtatcttctcaaatggaccaattgctctactctctggcctaaaccctcgcccattgagcttggttctccacttttttgctgtggctgtctatggagttggccgcttattgcttccatttccttcgcccaagcgcatgtggattggggccagattgatttcgggtgcatcaggcatcattttccccattataaaagctgaaggagtcagacaaatgttctttcctgcaactgttccagcatattacagaggtccacctaattgagataatgaaaataagaaatccacagtcaacaacagaaattgtaatagccaggctgttgtgtttgtcttccttttgttttccaagagaagctcttgtttgtatcagtcatgttcctcataagaaatcaaggtggggttccatgctagaatcaacagaatatgaagtaccaatataaactgtatttgttctaggaaattgttcatgaaacaggattccctccgaaatagaataacgattttcttcctagaaaatgaatgcaattttatcatagtagatgtgttcttcagtagccgtggacttatgtgtgtatgtgactatttctcaatatcaaatgcgctcatctagcattagctagcgatttgtcttagtctcataggagtgaagaaaatggttctggtggacttgagttaagctcttatttgtttaatggagactgtagaaagcaattgaaactacatttttgggaaaagcaagcagttcttgaatggcaatcaggggtttcttgttaccttatcatagctggaaaactgttacatgacattaagcagatggctttcgggtaggggtttttacaacgtaaaacagggtgatcttaacaacttccttgggttggaggctagcagcattcttctgttatcatgtctgaggactaatgttatgaacatttgtgttttggaatataaagcttatatcaatcaatgatggggcaaattgaaa

SEQ ID NO: 3340 - DNA, 1984 bp, Gossypium raimondii
acacctccattcagcaccacatatcatactttcttctacatttatacttcacaaagcaccatttccaaaatctaccccattgttgcataaacctagaaccttctatctctctgttctccttcattcccaaatttgaaagaaaaaaaaaatggagatggttttcgataattatattgtcggcacgttcttggtttccctttttgccttcctttttcttttcattttgcggcgctataataataataataataatgataataacaccaggaagaagagattcgagaaagggtattctagggaatttaagatccaaaccggtaccggcaaaggagaatgctcgcctggaaatggttccggcgatgaagtcatcatcgtcggtgccggtgttgctggtgctgctcttgcttatacccttggcaaggatggaaggcgagttcatgtgatcgaacgagacttgaccgaaccggatcggatcgttggagaactgttgcagccaggagggtaccttaaactagttgaattaggccttgaagattgcgtagaggacattgatgctcagcgtgtgttcgggtacgctctcttcaaagacgggagaaacacgaaattgtcatatcccttggagaagtttcaggcagatgtttcaggacgaagcttccataatggccgtttaatacaaaggatgagagaaaaagccgctactcttccgaatgtaaagctagagcaagggacagtgacatctttgattgaagaaaaagggacaattataggggtgcaatacaaaactaaagatggtgaagaactaagagcttatgctcctcttacgattgtatgcgatggttgtttttcgaaccttcgcaggtccctttgcaaccctaaggtggatgtaccctcttgttttgtgggtttggtcttagagaactgtgaactcccgttttcgaatcatggccacgttatcctagccgatccttcacccatcttgttttatccgattagtagtacagaggttcgttgcttggtcgatgtacctgggaagaaagttccttccgttgctaatggggaaatggcgaatcatttgaagaccgtggtggcacagcaggttccacccgagcttcgcgatgccttcatagctgcagtcgacaaaggtaatatccgaaccatgccaaatagaagcatgccggctgatcctcatccgactccaggtgcacttcttatgggagatgctttcaacatgcgccatcctttaaccggcggtggtatgaccgtagcattgtccgatattgttgtacttcgagatcttcttaggcctttgcataaccttcatgatgcagcctccttaaccagctatctcgaatcattctacacgttacgcaagcctgtcgcatctacaataaatactctggccggtgctctttacaaggtgttttccgcttcacctgacgaagcaaggaaggaaatgcgccaagcctgtttcgactatttgagccttggaggtgttttttcaacaggaccagtggctttactctccggtctaaaccctcggccgttgagtttagtacttcatttctttgccgtcgcgatttacggagtcggtcgtctgctcctaccgtttccttcgttccaacgcatgtggattggagctaggttaatttggagtgcatctggaattattttccccataatcaaggcagagggagtgagacagatgttcttcccagctacggttccggcggtatatagagctcctcctgtcgtcaactgatgcaaccaagattaaaagcttggaaccattacctcttcgctttagaccccatgatcgataagtgttatattgcatgtatgatgaggacattgtacaactgtaagatatgttttgatactattctttctatgaacagaattctccaattctccaaatggaacctctgttaaaaattaaattctccctatcccttatataatttatatcaaataaaaattaatttta

SEQ ID NO: 3341 - DNA, 2252 bp, Citrus sinensis
tctaactgtaactactgtttataataataagcggcctctctctccaagtttctctctcctcaccgatctgtcttcaccaccacaaaaccccacgaaaaaacaaacaaaaacagaaggagccagctgctactcctgctgttcccaaaacagaaaagaaatcttgatcaaacaacgaccgtccatctttcttgcatcatcaacctcgggttctcaccgtttcttcaatctttctaccgagaacaaggcttcgatggatcactacattgcgggcactctcattgccgctgtgtttctccttctcttcgttgtccgccgcaacgacagtaagaagccaaggaaggtttccacgacgtacaagacgcagaacgacgtttttcggagctctgttaacgccggaaagaatggctcccctaccgacgtcatcattgttggtgccggtgttgccggtgctgccttggctcatactcttggcaaggatggaagacgagttcatgtgatagaaagagatgtgactgagcctgacagaattgttggtgagctgcttcagcctggaggatacctgaaattagttgaattaggtcttgaggattgtgtggaagaaatcgatgcccagcaagtacttggttatgctcttttcaaggatggaaaaagtacaagactgtcatatccattggagaaatttcatgcagatgtttctggaaggagcttccacaatgggcgtttcattcagcggatgagagaaaaagcagctagtcttcccaatgtacgactggagcaaggaactgtaacatccctgcttgaagaaaatgggactataaaaggtgttcagtacaaaactaaggatggtcaagaacttcgtgcttatgctcctcttacaattgtttgtgatggttgcttctcaaacctgcgccgttcactttgcaaaccaaaggttgatgtgccctcttgttttgtcggcttagtcttagagaattgtcaacttccttttgcaaaccacgggcatgtcattctagcagatccttcacccatcttattctatccaatcagtagtacagaggttcgatgcttggttgatgtacctggtcagaaggtaccttccatcagtaatggtgaaatggccaattatttgaaggccatggtggcacctcaggttccccctgagcttcatgaggccttcgtttctgcagttgagagaggcaacattagaactatgccaaatagaagtatgcctgctgatccccagcctactcctggggcccttctgatgggtgatgctttcaacatgcgtcatcctttaactggtggtggaatgactgtggcgttgtctgatattgttgtactcaggaatcttcttaagccactccatgactttaacgatgcagcttctcttggccgatatcttgagtccttttacaccctgcgcaagccagtggcatctacaataaatactctggcaggtgccctttacaaggtgttttcctcttctcctgatcaagcaaggaaggaaatgcgccaagcatgtttcgattatttaagccttggaggtgtcttttcaactggaccagttgctctactttctggtctaaaccctcgccccttgagtttagttctccatttctttgctgtggcaatatatggtgtcggtcgtttgctactgccgtttccttcacctaagcgcatgtggattggagctaggttaatttcgggtgcatcaggtatcattttccccatcattaaggccgaaggagtgaggcaaatgttcttccctgccaccatacctgctgtctacagagcccctcctgttgaggattgacataccaaacaaaaatcaatgtagctgaggctttgttgctattaagaacgtgcctcttgtatctgaacctccatcaaccttaaggacatcttatatgcaaactgcctttgttaaaaagggtaaaaagatagaaaacagaagaacgtggacattatataattatttgtggtttcgaggatggataaaatcatacaaacaatcccataattgtattgtatgatactttattatcttaaaactgaaagggatatctatttgtaagtctcagtctccagagaaagaaaaacttctcatttatgttaggcatatatttgtaagatgcctcttcaactggataccccttccaattaaagaagtgataagcaattaaaggtttttctcgtaccatgttgtttacggtaaacatctcatcttgttgggcatggtcgtctagctctga

SEQ ID NO: 3342 - DNA, 1880 bp, Populus trichocarpa
ttgccggcaaagctccctccaccttcccaaatttttattttttcagaggattaaacgagagcgcaagacaaagaaatctttccttctctaacgtcgtcgttcccattctttaattgatcgtttttgcatttaaaaaataatggcggatcagtgcatgccaggatggatcttagctactctgtttggtctctctgctatctattatttggtaaccaagaaaaaggaacagagagctaataaggatttgttggaggcgagaagcgagtccgttaatagcatagccaccaccagtggagaatgcagatccagtaatgtttccgatgtcgacgttatcattgtcggcgccggtgttgctggcgctgctctcgctcatactcttggcaaggatggtcgtcaagtgcacgtcattgaaagagacttgactgagcctgataggattgtgggtgaatttctacagccagggggttaccttaagttaattgaattgggacttgaagattgtgtggagaaaattgatgctcagagggtgtttggttatgcacttttcaaggatggaaaacatactcgactctcttatcctttggaaaagttccactcaaatgtagctggaaggagctttcacaatgggcgtttcatacagagaatgcgggacaaagctgcgtccctccccaatgtacaattggagcaaggaactgtcatatctctacttgaagataaagggactattagaggcgtgcagtacaaaacaaaagatgggcaagagctgaaggcatttgcacctctgacaattgtttgtgatggctgtttctcaaacctgcgccgctccctttgcaaccctaaggtggatgtgccctcttgttttgttggcatggtcctggagaattgccagcttccatgtgcaaatcatgctcatgttatcttaggggatccgtctccgattttgatgtatcctattagcagtaccgaggtccgctgtctggttgatgtacctggtcagaaggttccttccatttcaagtggtgaaatggcaaaatatttgaagactgtggtggcacctcagcttcccccagaagtttatgatgcctttctagctgctgttgataaaggaaatataaggacaatgccaaacagaagcatgccagctgctccttatcctactcctggtgcattgttgatgggcgatgcattcaacatgcgtcatcctcttaccgggggaggaatgactgttgcattgtctgacattgttgttttacggaatcttctcaggcctttgcgcaaccttaatgatgcacctacactctgcaaatatcttgaatctttctacaccttgcgcaagcctgtagcatccacaatcaatacactggcaggtgccctctacaaggttttttgtgcttcacctgatcaagcaatgaaggaaatgcgtcaggcgtgctttgattatttaagtcttggaggcgttttttcagcaggacccgtgtctttgctctcaggcttaaacccccgtccgttgagcttggttgcccacttctttgcggttgctatatacggggttgggcgtttgttctgccattcccttcacctaaacgcatctggattggagctagattgatttcaggtgcatcaggaatcatcttccccatcattagggcagaaggagttagacagatgttcttccctgcaactgttccagcatattatagagctcctccagtcaagtgagattgattcggcaagatgtggagatagcgtaagccacttctgttcccactccttcccttgttgaaagtcgtctgggtgagggtgaatgcttcgaagaataactgtgcattattatagatttttgttgctaggatgttcataaaacttcaactctgaccaat

SEQ ID NO: 3343 - DNA, 2002 bp, Citrullus lanatus
aattttcactccccgtagcgatttttctttcgtcgtcgccgccgcagggttctcccctgaggttgctgtgatttgccattctcttgaaccaggaaacaatggtggatcactgcgccttcggctggatcttgtccgccttcctcgccttcgccattgccttctctttcttcctcgcttccaggaggaaccgccgagtaggaggtgccgattccacgccgaggaccgactgtgtcagaagctctgcatccaccaatggagaatgcagatccgtcgacggcgacgccgacgtcatcatcgtcggagccggtgttgctggttccgctcttgctcacactctcggcaaggatggtcgtcgagttcacgtgattgaaagagacttgacagagccggatagaatcgtcggtgaattactgcagcctgggggctacctcaaattgattgagctaggattgcaagattgcgttgaggaaattgatgcacagaaggtttatggctatgcccttttcaaggatggcaagaatactcgactttcttacccattggaaaattttcactctgatgtatctggaagaagctttcacaatggacgcttcatacagagaatgaggaagaaagctgcttcacttcccaatgtgagattggagcaagggacagtgacttcgttactggaaaaaaagggaacaatcaaaggcgtgcactataagtccaaaaatggtgaagaaaaaacagcatatgcccctctgaccattgtttgtgatggttgcttctcaaatttgcgtcgctctctttgcaaccctatggttgatgttccatcgtgttttgtgggattggttctggagaattgccaacttccttttgcaaatcatgggcatgttgttcttggagatccttctcctattttgttctatcccatcagcagtaccgagatccgttgtctagttgatgttcctggtcagaaggttccttctatatcaaatggtgaaatggaaaagtatctgaagaccgtagtagctcctcaggttcctcccgaaatccatgatgcatttatagctgctattgagaagggtaatataaggacaatgccaaatagaagcatgcctgccgctccccaaccgacacctggtgccttactaatgggtgatgcattcaacatgcgccaccctctcaccggtggaggaatgacagtagctttgtctgatattgttgtgctcaggaacctcatcaagccattgaaagacttgaatgatgcaccaactctctgcaagtatctagaatccttttacactctgagaatgccagtggcttctacaatcaacacattggcaggggcattatacaaggtgttttgtgcatcgccagatcaagccaggaaggaaatgagacaagcttgctttgattatttgagccttggaggaatattctcaaatggacccgtctccttgctttcgggattgaatcctcgcccattgagtctcgttctccatttctttgcggtcgcaatatatggagtcggtcgcttactgcttccatttccttctctgaaaggcatctggattggagcaagattgatctatagcgcatcaggaatcatatttccaataataaaggctgaaggagttaggcagatgttcttcccagcaacggttcctgcttattacagaaccccaccagtttttaaacccatagcttgaaagtaatgatgcagagagaaaggatgaagttgttggggattgtttgtatcatatctgaggaggaagaagaggcattacaaggaagacaagtcaagtttttgttgttagattttggttttaattgtggattaataaaactgtgtacttgtgaactggagccaggagtgtaaatattcttaattcatttgaggagcacccaatcattcatgtattgtcaaaccgcttgggaacgctttaatagactagagagacttccttttgtttaatttggtggtatttaaaatgcataacattgtgcaagtttccatttt

SEQ ID NO: 3344 - DNA, 2055 bp, Vitis vinifera
cgcatgttagcaagaggagagcttaagaagaaatgtaatgaaaggcacgggtgaaagtggctataaaaaggggtgtatcagcctgaaaactctcactcctgctcctccagttgtaaacttgtgatattcatataagacgcacacccacactaggaaaaacgcgacgccagcgaaacctagtgagagaaaaacgagagagggagagagaagccgtcgacgacgtcgcttcggtcttggtctcgctgctccattcgcattcggaaatggtggatcagggcatcctgggatggatcttcgcctccttgctggggttcgtcgtcttccgtagcgtgcttctgaagaacaagaagaagggcggtgcttctgtggagatcagggatgaatgcgtgaaaagcaccgctaatggagaatgcagatcgaagaccgcttgcgaggaggctgacgtcatcatcgtcggggccggcgtcgcgggcgccgctctggctaatactctcggcaaggatgggcgtagggtacgcgtgattgaaagagacttaactgagcctgaccgaattgttggtgaactgctacagccagggggctacctcaaattgattgagttggggcttcaagattgcgtagaggaaattgatgctcagcgggtgtttggctatgctctctttaaggatggaaagaatacgaaactctcttatcctctggaaaaattcgattcagatgttgccggaaggagctttcacaacggccgcttcatacaaaggatgcgagagagagctgcaacccttcccaatgtacagttggagcaaggaactgttacatctttacttgaagaaaaggggaccattagaggggtaaattacaagactaaagatggtgaaacaatgacagcatatgctcctttaaccattgtatgtgatggttgtttctcaaacttgcgccgctccctttgtacccctaaggtagatgtgccctcatgttttgtcggtttgttgctggaagactgtgagctcccatttgcaaatcatgggcatgttgttttagcagatccttctcctatcttgttttatcgtatcagcagtacagagattcgatgtctggttgatgtacctggtcaaaaggtgccttctatttcaaatggtgaaatggccaagtatttgaagactgtggtggctccccaaattcctcctgagctgtatgatgggtttatagctgcaatcaataaaggaaacataaggacgatgcctaatagaagcatgccagctgctccacatcctactcctggggccttgttgatgggggatgcgtttaatatgcgccatcctttaactggtggaggaatgaccgtggcactatctgatattgttgtgctccgagatcttctcaggcctctgcatgatctgaatgatgcagctacactttgcaaatatctcgagtccttttataccttgcgaaagcctgtggcatccacaataaatacattggcaggtgccctgtatagggtgttttgtgcttcaccagatcaagcaaggaaggaaatgcgtgatgcgtgctttgattatttaagccttggaggtgtgtgttcatcagggccagtgtctctactatcagggctaaatcctcgtccattgagcttggtttgtcacttctttgcggtggcaatatttggtgttggtcgtttattgctgccatttccttcaccaaaacgtgtatggattggagctagaataatttcaggtgcatcgggaatcatcttccccatcataaaggcagagggagttagacaaatgttctttcctgcaacagttccagcatattacagagctcctcctgttaagtgaagttttgaagctgaattacaaaaggtgaaaatggttaaagggggtttcaatcaagacgagctactttgtcacattcccttgttcaaagataacgggaaagtgattcttcgaatatgtgcattatgacatgttttggttgtcaggacttcctttttctctgatatcaaaatatactcttttctttttcttccaaagttgccatattatttctagggtggca

SEQ ID NO: 3345 - DNA, 2015 bp, Ricinus communis
gtagcatcgggtccctgaagaatctcgtgtctctgtttcttaactaatctaaaagacaaaaacagccattattgccagcgaagctttcgtattctagctatattagccaaaaaaaagcaaaagtatactaccaccacaacctccatcaaatacagaaacagctcgagagaaaccatacgctgtcgtttcggacatgaaaatggcggataattacttgttaggatggatcttatgttctataataggactgtttggattgtattatatggtgtatttggtggtcaaaagagaagaagaagataacaacagaaaagctctgttacaagcaagaagtgactccgccaaaactatgtccgccgtcagtcaaaatggagaatgcagatccgataaccctgccgatgctgacatcatcatcgttggtgctggcgttgctggttccgctctggctcatactctcggcaaggatgggcgtagagtgcatgttattgaaagagacttgactgaacctgacagaattgttggtgaattgctacaaccggggggctatctaaagttaattgagttaggacttgaagattgtgtggaagaaattgatgcacagcgggtgtttggttatgcactttttatggatgggaaacacacccaactctcttatcccttggaaaagtttcactctgatgtagcagggcggagcttccacaatgggcgttttatacagaggatgcgggagaaagcttcatctattcctaatgtacgattggaacaaggaactgtcacttctctaattgaagaaaaagggataatccgaggagtggtttacaaaacgaaaactggtgaagagctcacagcttttgcaccactaacaattgtttgcgatggttgtttctcaaacttgcgtcgctccctttgcaaccccaaggtggatgtgccctcttgttttgttggtttggtcttggaggattgcaaacttccatatcaatatcatgggcacgttgtattggcagacccttccccaattctgttctatcagatcagtagtacagaagttcgctgtctagttgatgtacctggccagaaggttccttctatttcaaatggggagatggcaaaatatttgaagaatgtggtggcacctcaggttccgccagaaatatatgattcctttgtagctgcagttgataagggaaacattcggacaatgccaaacagaagcatgcctgcttctccttatcctactcctggtgcattattgatgggtgatgcattcaacatgcgccatcctctgactgggggaggaatgactgtggcactatctgacattgttgtgttgcgggaacttctgaagcccttgcgtgacctgcatgatgcacctactctctgcagatatcttgaatccttctacaccttgcgaaagcctgtggcatctacaatcaatacgcttgcaggtgccctctacaaggtgttttgtgcttcatctgatgaagcaaggaatgaaatgcggcaggcttgctttgattatttgagtctaggaggtgtattctcaactggaccaatctctttgctctcgggtttaaatcctcgtccattgagcttggttgtccatttctttgctgtggcaatttatggtgttggccgtttgttactgccattcccttcacctaagcgcgtctgggttggagctaggttgatatcgggtgcatcaggaatcatcttccccattatcaaggcagaaggagttagacagatgttcttccccgcaaccgtcccagcatattatagagctcctcctgttgaatgcaattagtttgacaagaatgtgagtgaaaaattcgtgacaagaaggaacggggcgtttctcattttggttttaatctcatccctttgttcaaatcaaagttgaggggaaaagaagtgtgaattgtaatacgctttagtttataggagaatgttttccctaggatgtctatatctgtgactctgagctcaaaatatataaatttttttattttcactta

SEQ ID NO: 3346 - DNA, 2050 bp, Ricinus communis
agagaggctataaaaaggagtagcatcgggtccctgaagaatctcgtgtctctgtttcttaactaatctaaaagacaaaaacagccattattgccagcgaagctttcgtattctagctatattagccaaaaaaaagcaaaagtatactaccaccacaacctccatcaaatacagaaacagctcgagagaaaccatacgctgtcgtttcggacatgaaaatggcggataattacttgttaggatggatcttatgttctataataggactgtttggattgtattatatggtgtatttggtggtcaaaagagaagaagaagataacaacagaaaagctctgttacaagcaagaagtgactccgccaaaactatgtccgccgtcagtcaaaatggagaatgcagatccgataaccctgccgatgctgacatcatcatcgttggtgctggcgttgctggttccgctctggctcatactctcggcaaggatgggcgtagagtgcatgttattgaaagagacttgactgaacctgacagaattgttggtgaattgctacaaccggggggctatctaaagttaattgagttaggacttgaagattgtgtggaagaaattgatgcacagcgggtgtttggttatgcactttttatggatgggaaacacacccaactctcttatcccttggaaaagtttcactctgatgtagcagggcggagcttccacaatgggcgttttatacagaggatgcgggagaaagcttcatctattcctaatgtacgattggaacaaggaactgtcacttctctaattgaagaaaaagggataatccgaggagtggtttacaaaacgaaaactggtgaagagctcacagcttttgcaccactaacaattgtttgcgatggttgtttctcaaacttgcgtcgctccctttgcaaccccaaggtggatgtgccctcttgttttgttggtttggtcttggaggattgcaaacttccatatcaatatcatgggcacgttgtattggcagacccttccccaattctgttctatcagatcagtagtacagaagttcgctgtctagttgatgtacctggccagaaggttccttctatttcaaatggggagatggcaaaatatttgaagaatgtggtggcacctcaggttccgccagaaatatatgattcctttgtagctgcagttgataagggaaacattcggacaatgccaaacagaagcatgcctgcttctccttatcctactcctggtgcattattgatgggtgatgcattcaacatgcgccatcctctgactgggggaggaatgactgtggcactatctgacattgttgtgttgcgggaacttctgaagcccttgcgtgacctgcatgatgcacctactctctgcagatatcttgaatccttctacaccttgcgaaagcctgtggcatctacaatcaatacgcttgcaggtgccctctacaaggtgttttgtgcttcatctgatgaagcaaggaatgaaatgcggcaggcttgctttgattatttgagtctaggaggtgtattctcaactggaccaatctctttgctctcgggtttaaatcctcgtccattgagcttggttgtccatttctttgctgtggcaatttatggtgttggccgtttgttactgccattcccttcacctaagcgcgtctgggttggagctaggttgatatcgggtgcatcaggaatcatcttccccattatcaaggcagaaggagttagacagatgttcttccccgcaaccgtcccagcatattatagagctcctcctgttgaatgcaattagtttgacaagaatgtgagtgaaaaattcgtgacaagaaggaacggggcgtttctcattttggttttaatctcatccctttgttcaaatcaaagttgaggggaaaagaagtgtgaattgtaatacgctttagtttataggagaatgttttccctaggatgtctatatctgtgactctgagctcaaaatatataaatttttttattttcacttatggacttgtgttttat

SEQ ID NO: 3347 - DNA, 2087 bp, Cajanus cajan
cagcaactgaaaccgttccaaatttctctgccagcgaggcagagagagaaacaagagcgagagagaacgagcacgtcttcctccgccgcctctgccgccaccgtttcttttctccggcgaggtttctccgattcgctttccgaaatggtggatccctacgtcctcggctggattctgtgctccgttctcactctcttcgcgctccacagtttggctttccgcggaaccagccgccgcgcttcgccggagaacaggaacgacttctcggagaccgtcaccaccaccgccggagaatgcagatcgggaaaccgcaacagcgacgctgacgtcatcattgtcggtgccggcgtcgccggcgctgctctggcgtacactctcggcaaggatggacgtcgagtacatgtcattgaaagagatctgagtgaacctgaccgaattgttggagaattgctacaacccgggggatatctcaaattaattgagcttggacttgaagattgtgtggacaaaattgatgctcaacaagtgtttggctatgcccttttcaaggatgggaagcatactcgtctctcttatcccttggagaagtttcactcagatatctctgggagaagctttcacaatgggcgctttattcagaggatgcgggagaaggccgcctcacttaccaatgtacgattggagcaaggaacagtcacttccctagttgaagagaagggtgcaattaaaggtgtgcaatataagtccaaagatggtcaggcattgacagcgtatgcaccacttaccattgtttgtgatggttgcttctcaaacttacgtcgttctctttgtaatcctaaggtagatgttccctcatgttttgttggtttagttttagaaaactgtgaacttccatgtgccaatcatggccacgttattctgggagatccttccccaatcctattctatcctataagcagtacagaggttcgctgtctggtcgatgtacctggtcagaaggttccttctatttcaaacggtgaaatggaaaagtatttgaagacaacagtggctccccagattcccccccagctttatgattctttcatagctgctgtggacaaaggcaacataaggacaatgccaaacagaagcatgccagcagatcctcatcctacacctggagcccttctgatgggagatgcattcaacatgcggcatccactaacagggggtggaatgactgtagcattgtctgatattgtggtgctgagaaatcttctaagacccttgtctgacctgaatgacgcacccacactctgcaaatacctcgaatcgttttataccttgcgtaagcctgtggcatctaccataaatacactggcaggtgctctttataaagttttttgtgcatcccctgatcaggcgaggaaggaaatgcgccaagcttgctttgattatctgagccttggaggcctattctcggaaggaccagtttctctactttctggattaaaccctcgtcccttgagcttggttctccattttttcgctgttgcaatatttggtgttggacgtttattgttaccatttccttcacctaagcgagtatggattggagcccgattaatctctggtgcatctgcaatcatcttgccaataattaaggctgaagggattcgtcaaatgtttttccctgccactgttccagcttattacagaagtcccccggtgtcacaatagcgagtgaatgcattgcgatgaaatgaaggtactctcaagatgagctttctgtaaacatgttggctcctttagtgtgtgtgtattctttgtagtctgtaactcatacaatgttgttataagtagagcattgagcaaatttgtttaattgtcattgtcattgtcaaattaaatgcagcaaaatgctgaaccatacgaatgtcagaaaacttattttaccatatcagttgtattagtatatgcacttctattttctgtcctgtcctgcaaacgggtaaaaaataggatggacagaatgaaaataagtaagattcgaaatgagacgtgaaaaattaaaaaggagtggatcttatttatttatttatctc

SEQ ID NO: 3348 - DNA, 2379 bp, Eucalyptus grandis
caggatagcgggcggagggggtggcgcacgttcgagccgcgtcgcgacacggctcacgtgtcggtcctctctagactctctctctctctctctctctctctctctctctctatatgagcctctatttctcgggttgagaaaccgaaactcgcgacgcgagagcaacgccagccaggaacggccagcgaggcgagacagcatcccagcgtcccagcatcattgcatttgtacaaaaggccaagcagaaagccaggagcgccctcgtcggatagagagagaaagggggagagagagagtgagagagagagagagagagagaggaggggagttttttctccggggagagattctccggagggtagtgtggcggttgctttgcttttccgtcgtttcttggtcgtccgcgtccccgttccgttcgctggtcggagaagatggcggtggatcagtcggtggtgggttggatcttggcgtctcttctgggtctcgctgcgctgtgccgtctggtggcgaggagaggagggaggagaggaggcggggaggggagggaatgcggcgtcgtcgggaccgacggcattgtgacgacgggcaagcaatgcggatccgaatccgtgaacggggacggcagcgaggccgacgtcatcatcgtcggggcgggcgtcgccggtgcggccctcgctcatacgcttggcaaggatggacgccgagtgcatgtcattgaacgagacctgacagagcctgatcgaatagttggggaattgctgcaacctggcggctatcttaagctaattgagttgggactcgaagattgtgtgaaggaaattgatgctcagcgggtatttggttatgctcttttcaaggatggacaaaatactcgattatcctatcccttggagaaatttcactcagatgtgtctgggaggagctttcacaatggacgttttatacagagaatgcgggaaaaagctgcgactctctccaatgtaaaactggagcaagggacggtaacctctttgatagaagaaaagggaaccattaaaggcgtgcaatacaagacaaaggatgggaaagagctggcggcttatgcacctctgactgttgtctgtgatggatgtttctcaaacctgcgtcgctccctttgcaaacccaaggttgacataccatcatgcttcgttggcctgattttggagaaatgtcaacttccttatgcaaaccacgggcatgttattctggcagatccctctcctatcttgttttatccaatcagcagcacagaggtccgttgtcttgttgatgtacctgggcaaaaagtgccaaatatctcgaacggtgaaatggctaactacttgaagacagttgtagctcctcaggttcctcacgaaattcacgaagcctttgttgctgctgttgataaaggaaacataaggacaatgcctaatagaagcatgcctgctgctccccatcccactcctggagctttattaatgggggatgcattcaacatgcgccatccattaactggaggaggaatgactgtggcactctcggatattgttgtgctccgcgatctcctcaggcctttgcgtgacttaaacgacgcacccactttgtgcaagtatctggagtccttctataccttgcgcaagccggtggcatccacaataaatacattggcgggagccctatacaaagtcttctgtgcttcacccgatccagcaaggaaagagatgcgacaagcctgctttgattacttaagccttgggggcgtcttctcaaatggaccagtttctttgctttcgggtttgaaccctcgaccattgagtctggttctccacttctttgcggttgcgatctatggcgttggccgattaatgctgccttttccttcaattaagcgcatgtggatcggagctagattgatatcgggtgcatcgggaatcatattccccatcatcaaggctgaaggggtaaggcaaatgttcttccccgcgatggttcctgcgtactacagaggtccacctgcgaagtgagatccataagccaagctcaagcagtagctaaaagcttcaagaacacaaaggacagttggtggcggcatctgctttcccttgttcggagtcgttgggagggtaatgtttcaacagtgtctgaaagttttgggtagtcagatattgtccataactccatgtagaaactatcatgtgggatgttttctcgaatgtgtggctctgtgactcggaacgagactaacttatcagatgattgtttttgttgtcggtttgtctgtgtcaagaggtaaggacagttcttgaggaagtgtgatctccacccgatcccgtgcgatgaacatatcgaattgagcgcctgagtatcacccag

SEQ ID NO: 3349 - DNA, 2148 bp, Populus trichocarpa
cacaaccacacgttaaaagtctctctccataaagggaaaccttcccctaaaatctctatctaccttgccttctccgtatcctcttcaagaagcaccaaaccacaaacaccccacaggagaagagaacctaaagaaccaatctttgttttctcttcttcttcctcttcttcttcttctgtgcatcagtgtcataattattatataaagaagatgacggtggtgattgataagcacaatgtccttgtgggcactttctttgcctttcttttcttgtacattttgcgccaaaatatctggaaaagagaaaagatcaggaagagaacaacattgaagatccaaaacgatagtgctgtgtctgtcttaaggcatgaaaatggaggaggcttctcctctgctgatgacgtcattgttgtcggtgctggtgttgctggtgctgccttggcttatactcttggcaaggatggaagacgtgttcatgtgatagaaagagacatgaaagagcctgacagaattgtcggtgaactgctccaacccgggggatatctaaaattaatcgaattaggccttgaggattgtgtggaggaaattgatgcccaacgagtgcttggatatgctctcttcaaggatgggaagaatactagattgtcataccctttggaaaaattccacacagatgtttctgggagaagcttccataatggacgtttcattcagaggatgagagaaaaggctgctaccctgcccaatgtaagactagaacaaggaacagtcacatctctgcttgaagaagatgggactgttaagggtgttcaatacaaaacgaaggatggccaagaacttaaagcttatgctcctcttacaattgtgtgtgatggctgcttctcaaatctgcgccgctctctatgcaaccctaaggttgatgtgccttcgtgtttcgtgggtttgatcctggagaactgtcagcttccatttgaaaatcatgggcatgtcattctagcagatccatcaccaattttgttttatccgattagcagcacagaggttcgctgtttggttgatgtaccaggtcgaaaagtgccttccattgctaatggtgaaatggccaattatttaaagaacatggttgcaccacagattccatctgagcttcgcaatgccttcatatctgctatagataaaggtaatatcaggaccatgccaaatagaagcatgccagcggaaccacatcctactcctggagcgcttctgatgggtgatgctttcaacatgcgtcatccattaactggtggtgggatgactgtggcattgtctgatattgttgtacttcgtgatcttcttaaaccacttcgtgaccttaatgatgcagcttcgttgaccaaatatcttgaatccttttacaccttgcgcaagccagttgcatctacgataaatactctagcaggtgctttgtataaagtgttctctgcttcctctgatgatgcaaggaaggaaatgcgcgaagcatgttttgactatttaagccttgggggtaatttctcagcaggacctgtggcattactgtctggtctaaaccctcgtccactgagtttggtccttcatttctttgcggttgccgtatatggtgttggtcgtttgctacttccatttccatcgcctaaacgcgtgtggattggagcgagattaatttcgagtgcatcaggcattattttcccaattatcaaagcagagggagtgaggcaaatgtttttccctgccactattcctgctgtttatagagctcctcctgttgattgatacatcagatgtgccgaatcaaagaggctttattactgtcaacaaaagccagttcgtttctgcaagttccctgttcataaatgtcaagggcttgtttggatatatatatatatatatatatatatatatatatatatatatataaagaactatgagggcatgctatatgcaaactagtgtgtagacggcaattgatcttatgtatcatgaagttgcatgaacttcttgaataaatgtcttccgaagttgagttcatgtgatgtcaatatgaacaccaacttttattccttttattatcaataaaatttctacagggttgaacctcgcctgtgaggggctggtggttacaattaa

SEQ ID NO: 3350 - DNA, 1998 bp, Gossypium hirsutum
aattacttactattcgctcgtgtttctaaaacaaattcacgactgccagcgaagccaagtacagccgttgcagccatcgaattctaaactccataaaaacaaacagagagatttttgacgtccttgtatacgcttagctttctttctttctggtttagttttttggcgacggagtaaatggctgattcatacgtgctgggatggatcttgtgttccgtgatggcgctggttgcgctatgcggtgtcgttttgagaaggcagaaatggaaggggatttccatgagaactgagcccctgaagaccgtcctaacgagtaacggagaatgcggatctgctgacgccagccacgctgatgtcatcatcgttggagctggcgttgctggttccgccctcgctcacactctcggcaaagatggacgtcgagtgcaagtgattgaaagagacttgagtgaacctgaccgtattgttggggaattgctacaaccagggggctatctcaagttaatcgagttgggacttgaagattgtgtagaggaaattgatgctcagcaagtatttggttatgctcttttcaaggatgggaagcatactcaactttcttacccattagagaagttccactctgatgtatctggtaggagctttcataatggacgtttcattcagcggatgcgggagaaatcagcttcccttcccaatgtacatttagagcaagggacagtcacttctctacttgaagaaaaagggataatcagaggagtgcagtacaaaactaaagatggtcgagaattgactgcatttgcatctctgaccattgtatgtgatggttgtttttcgaacttgcgtcgctccctttgcaaccctaaggtagatataccttcttcttttgtgggattggtcctggagaattgtcatcttccatactcaaatcatgggcatgttatactagctgatccttcccccattttgttctatccgatcagcagtacagagactcgctgtctggttgatgtacctggtcagaaggttccttctattgcaaatggtgagatggcaaattatctaaagaccatcgtggctccccaggttcccccagaaatctacgattcctttgtagcagccgttgataagggaaatattaggacaatgccgaacagaagcatgccggctgctcctcatcccacccctggagccctattaatgggagatgcattcaacatgcggcatccattaaccggcggaggaatgactgttgctttatccgatattgttgtcctccgtgatctattaaggcctctacatgacctcaatgatgcccctatgctctgcaaatatcttgaatcattttacacattgcggaagcccgtggcatcaaccatcaacaccttagcaggcgccttgtacaaggtattctgtgcttcccctgatcaagcaaggaaggaaatgcgacaagcttgcttcgattatctaagtcttggtggtgtatgctcagcaggacctatctccttgctgtctggtttaaaccctcgccccttgagcttggttctacattttttcgcagtggcaatatacagtcttggtcgtttactattgccattcccttcacccaagcgaatctggattggagctagattgatatcgggagcatcaggtatcatctttcccattatcaaagcagaaggagttaggcaaatgttttttccggcgacagtgcctgcatattacagagctcctccaactgtaaaatgagggaagaatttaccaaatgaccaccacaaactggtttgtaacttaattctttaggcttttcataagtaaatcatatttcccaaaaatggtggatgaaccttgtatgagtaaaaacattagtacacgtttgtaataaaataaagctgtaattgaatagagttgtaattgaatagagctctaatggaatagagctataatcagtaattcaattgtctggttgaattaaatggaatagaactgtaatagtat

SEQ ID NO: 3351 - DNA, 1998 bp, Gossypium hirsutum
aattacttactattcgctcgtgtttctaaaacaaattcacgactgccagcgaagccaagtacagccgttgcagccatcgaattctaaactccataaaaacaaacagagagatttttgacgtccttgtatacgcttagctttctttctttctggtttagttttttggcgacggagtaaatggctgattcatacgtgctgggatggatcttgtgttccgtgatggcgctggttgcgctatgcggtgtcgttttgagaaggcagaaatggaaggggatttccatgagaactgagcccctgaagaccgtcctaacgagtaacggagaatgcggatctgctgacgccagccacgctgatgtcatcatcgttggagctggcgttgctggttccgccctcgctcacactctcggcaaagatggacgtcgagtgcaagtgattgaaagagacttgagtgaacctgaccgtattgttggggaattgctacaaccagggggctatctcaagttaatcgagttgggacttgaagattgtgtagaggaaattgatgctcagcaagtatttggttatgctcttttcaaggatgggaagcatactcaactttcttacccattagagaagttccactctgatgtatctggtaggagctttcataatggacgtttcattcagcggatgcgggagaaatcagcttcccttcccaatgtacatttagagcaagggacagtcacttctctacttgaagaaaaagggataatcagaggagtgcagtacaaaactaaagatggtcgagaattgactgcatttgcatctctgaccattgtatgtgatggctgtttttcgaacttgcgtcgctccctttgcaaccctaaggtagatataccttcttcttttgtgggattggtcctggagaattgtcatcttccatactcaaatcatgggcatgttatactagctgatccttcccccattttgttctatccgatcagcagtacagagactcgctgtctcgttgatgtacctggtcagaaggttccttctattgcaaatggtgagatggcaaattatctaaagaccatcgtggcaccccaggttcctccagaaatctacgattcctttgtagcagccgttgataagggaaatattaggacaatgccgaacagaagcatgccggctgctcctcatcccacccctggagccctattaatgggagatgcattcaacatgcggcatccattaaccggtggaggaatgactgttgctttatctgatattgttgtcctccgtgatctattaaggcctctacatgacctcaatgatgcccctatgctctgcaaatatcttgaatcattttacacattgcggaagcccgtggcatcaaccatcaacaccttagcaggcgccttgtacaaggtattctgtggttcccctgatcaagcaaggaaggaaatgcgacaagcttgctttgattatctaagtcttggtggtgtatgctcagcaggacctatctccttgctgtctggtttaaaccctcgccccttgagcttggttctacattttttcgcagtggcaatatacagtcttggtcgtttactattgccattcccttcacctaagcgaatctggattggagctagattgatatcgggagcatcaggtatcatctttcccattatcaaagcagaaggagttaggcaaatgttttttccggcgacagtgcctgcatattacagagctcctccaactgtaaaatgagggaagaatttaccaaatgaccaccacaaactggtttgtaacttaattctttaggcttttcataagtaaatcatatttcccaaaaatggtggatgaaccttgtatgagtaaaaacattagtacacgtttgtaatgaaataaagctgtaattgaatagagttgtaattgaatagctctctaatggaatagagctataatcagtaattcaattgtctggttgaattaaatggaatagaactgtaatagtat

SEQ ID NO: 3352 - DNA, 1818 bp, Allium cepa
gatgatgatgcaattgtcgaacgaatatctctttggaggggtcatagcgtcgattctagggtttctttttcttctcaaatccaccaattatttcaatttgaagaagaagaacattgataggacgagtgataataccgagaatgtaggtagtaaaggggaaagtggtgggagttgcgatggacctgacgtcgtcatcgttggtgccggagttgctggagctgctcttgcttatactcttggaaaggatggaagacgagttcaagtaatcgaaagagatttgaaggagccagacaggattgttggtgaattgctacaacctggtggctacctaaaactaatggagcttggccttgaggattgtgtggaagaaatagatgcacaacgggtacttggatatgctctgtttaaggatggaaagaatactagactctcgtatcccttggaaaagttccataaagatgttgctgggaggagcttccataatggacgatttattcaaaggatgcgagagaaagcaatgacgttgcccaatgtaaaattagaggaaggtacagtaacatctttgattgaagaaaatggagcagttaagggtgtgtcatacaagtctaaatctggtgaagaactcaaagcttatgcacctcttacaattgtatgtgatggttgcttctcaaatcttaggcgcgttctttcctctccaaaggtggatgtaccttcttgttttgttgggctgatacttgagaattgtcagttaccatatgcaaaccatgggcatgttgtattaggtaatccatcaccaattctgttttatcccataagcagcactgaggttcgatgtttagttgatgtgcctggccagaaagtgccttcaatatctagcggggaaatggcaaatcatttgaagactgtggtagctcctcaggtgcctgctgagctgaaggaagctttcattgcagcagttgataaaggaaacatacgaactgcacagaacaagagtatgccagcagctccagttccaacgccaggagccttgctaatgggagatgcattcaatatgcgtcatccattaacaggtggaggaatgaccgttgcattgtctgacattgttgtgttaagaaatcttcttaagcctctgcgtgatcttcacgattcttcttctttgtgcaaatatttagaatccttctacaccttgcgtaagccagtggcatctacaataaacacattggctggagcattgtataaagtattttgtgcatcgccagatgaagcaagaaatgagatgaggcaagcctgctttgactatctaagccttggtggcgtttattctactgggccagttgccttgctctctggtcttaaccctagaccattgagcttggtttgccacttcttcgctgttgcaatatatggtgttggccgtctattgtttccatttccttcacccaagcgattatggattggtgctagattaatatcagcagcctcgggtataattttcccaataatgaaggcagaagggtttagacagatgttcttccccgcaactgtgcctgcatattacagggctcctccggctaagtgaaagcattaaaaatacgaatggaacatgcagtagcgtttgtgaaggataatagtgttttccatgttattgtaatggtgttaatttagctctcacctttgtaagtattttgctactattctcggatattcagatggtatatgacggaaaaatgaatgtgaatgttggatgtttggattttgaagattggaaacataatataggatcgatattcggtattttatttaatgtatagtcttctg

SEQ ID NO: 3353 - DNA, 2638 bp, Quercus alba
aaggtccacaagagcaaccaacaccacaaaaaagctagagagaattactaaaggtttcattttgatcccaacccattcttcttcatctgggtctctttgttttgttccaaagaagataatggttgtgattgatcagcacgtactctggacattctttgcctccctcttcggctttgttcttctctacataattcgtcgtaataacaatgccaataacaggaagctaaagaagaagaattctccacaacaatgtgtcgacgacaacagcttcaccgacggagagttccgccacgttaatggctctgactccggcaccgacgtcatcgtcgtcggcgccggtgttgcaggtgccgctcttgcttacactctcggcaaggatggaagacgagttcatgtgatcgaaagagacttgacagagccggatcgaattgttggtgaactgctgcagcctgggggatacctgaaattagttgaattgggccttgaagattgcgtggaggaaattgatgctcagcgtgttcttggatatgctctcttcaaggaagggaaaaatacaaaattgtcttatcccttggaaaaatttcattcagatgtgtccgggaggagcttccacaatggacgtttcatacaaaggatgagagaaaaagccgctactctttccaatgtgaaattggagcaaggtacagtaacatccctgcttgaagaaaataagactatcaggggggttcagtacaaaacaaaggatggccaagaacacacagcttatgctcctcttacaattgtgtgtgatggttgcttctcaaatctgcgccgcgctctttgcaaccccaaggtagatgtgccctcttgttttgtgggtttagtcttggaaaactgtcaacttccatttgcaaatcatgggcatgttattttagcagacccttctcccatcttgttttatcccatcagtggtacagaggttcgctgtttggttgatgtacctggtcagaaattaccatccattgctaatggcgaaatggccaaatatttgaaaacaatggtggctccacagattccacctgagcttcatgatgccttcgtgtcagcaatcgataaaggaaacattagaactatgccaaatagaagcatgccagcagatccacatcctactcctggagcccttttaatgggtgatgctttcaacatgcgtcatcctttaactggtggtggaatgactgtggccctatctgatattgttgtacttcgagatcttcttaagccattgcgtgacctaaatgatgcagcttcattgtccagatatcttgaatccttttacaccttgcgcaagccagtggcatctacaataaatactctggcaggtgccctctataaggtgttttctgcttcacctgatcaggcaaggaaggagatgcgccaagcatgctttgactatttaagcctgggaggaatattttctacaggaccgattgctttgctctctggtctgaaccctcgtccattaagtttagttctccatttctttgctgttgcaatatatggtgttggtcgcctgctactaccatttccttcgcctcaacgcttgtggattggagctagattgatttggagtgcagcaggtataatatttcccatcatcaaggctgaaggagtgaggcagatgttcttccctgcaactgttccagcatattataaagcccctagtgttaagtcagatatttagaagaatatggcaaagatctgttagctttgaatttttttgtagtaaagcaaaccagcttgcattacgtagtgaagacgggaagatttgtatgcttgagccctccattagagttcataagatttgaattcttgagccctccattagagtacataaaatttgtatgcttgagccttccactagagggcatagtacaattatttgttcaaaccactactaagttgcatttgactgggtgaacaatacttctgttccaactcaaaacatgtatttctcctttacgtttaagaatattttttgaactcaaaacatgtatttctcctttacgtttaagaatatttttttgggagattgaggtctgacgatgttttgtttagacatttctaaatatagaagatattttatattttatatcttttttgaagtgtgattaattttctttctaatagtgtccttggttggtcagaaaatttaggaaaggatgtaaaatgtaaatttctaaatttgtcatgttcttatttgggaaccaatgaaacctaatccttcatttaagtgtgtactttcagatctttgatttcctgcttattgcactagtccttcaatttccttagttgtagaaaatggcgttttctgtctgatttgagctataaactttttgttttgtggatgatggatgtctgaaaactctctctcatttggatctctctaaaaatttgggtaggattcttctagaaatggtataggaaaagttgataaattaaagttttgatttttagttctgtcttacactgaggtctttagttccaaaatctcgtttagatcttatgtattgggatgcattttatttggatttggcgtattagttctgatctactgggctttggatttgtattttcttgaattgtgtttgaaatcacttat

SEQ ID NO: 3354 - DNA, 1912 bp, Capsicum annuum
gcacgaggcctctccccgcccccgctcaactactcttaccatttctatacacaacgattcgcattttgttacacaacctaaacgacgtcgtttttctacattgtcgccgccgacaatggcagatttactcaccggatctattctcacagtggtactaggtttagtcgcagtgttttggtttttggtttggaagaatagtgggcggagaaaaattgaaatcattgacccgactactaatagcactgccacgacgacggtatatgatggagaatgtagatcaaaggatggagatgatgacgtggatattattgttgtcggtgccggcgttgctggtgctgctctcgctcatacacttggcaaggaaaggcgtcgtgtaaaagtaattgaacgagatttgacggagcctgatcgaattgttggagaactcctgcaaccaggtggctacctcaaattgcaggagttgggattggaagattgtgtggagaaaattgatgctcaacgagtgtttgggtatgctcttttcaaggatggtaagagcacacgtctttcttatcccctggagaaatttcactctgatgtttctggaaggagcttccacaatgggcgtttcattcaaagaatgcgagagaaagctgcatctctccccaatgtcaagctagagcaaggtactgttacgtctgcttgaagaaaacgggaccattagaggtgttcagtacaagactaaatctggtgaagagatgaaagcatatgcaccattaaccgtagaatgtgatggttgtttctcgaacctacggcgtaccctttgcgatccaaaggaaaaagtgccttcttgttttgttggtctggtcctggaaaactgccagcttccacatgaaaatcatggagatgtcattttggctgatccatcacctattttgttctatcccagaagcagtactgaggtccgttgtctggttgatgtacctggtcaaaaagtgccttctatttcgaatggtgaaatggccaaatatttgaaaagcgtagttgctccccaggtccctcctgagataaaagatgcattcattgctgcagttgacaatggaaacatcaggacaatgccgaaccgaagcatgccagctgctcctcatccaactcctggtgctcttctcatgggagatgcattcaatatgcgccaccccttgactggtggaggaatgactgtggcattgtctgatattgttgtattgcgtgatcttctcaaacctcttcgtgatttgaatgatgcccctactctttgcagatatctggagtccttttacaccttgcgtaagcctgtggcctccaccatcaatacattggctggtgccttgtataaggtgttttgtgcttcacctgatcaagctaggaaggagatgcgcgaagcatgctttgattatttgagccttggtggagtattctcagaaggaccagtatctttgctttctggcttaaaccctcgtccattaagtctcgtttgtcatttctttgctgtggctatctttggtgttggtcgcttgctgcttcctttcccatcacccaaacgtatatggattggagcccgactaatatcgggtgcatctgcaatcatttttcctatcatcaaggcagaaggggtcaggcagatgttcttccccgctaccgttcctgcatactataggtctcctcctgaagtgaggttgtaactgctttaaacagaataaggctatgccattctgcctcctccatcagtattctggttatgagtttcatagtttagtcccaactgtttcataattttcggttgctaatgttttcttgtaatatttttcctttacgtttgttcccgtcattgaatacattattaactggaaagtgaatataagctgtacagtcatgtatttttctctgttctaaa

SEQ ID NO: 3355 - DNA, 2589 bp, Citrus sinensis
  misc_feature (2506)..(2506): n is a, c, g, or t
gtaacttttgtttataataagaagcggcctctccctccgagtttctctctcctcaccgatctgtcttcaccaccacaaaaccccacgaaaaaacaaacaaaaacagaaggagccagctggcagctgctgctactgctgttcccaaaacagaaacgaaatcttgatcaaacaacgaccatccatctttcttgcatcatcaacctcgggttctcaccgtttcttcaatctttctaccgagaacaaggcttcgatggatcactacattgcgggcactctcattgccgctgtgtttctccttctcttcgttgtccgccgcaacgacagtaagaagccaaggaaggtttccacgacgtacaagacgcagaacgacgtttttcggagctctgttaacgccggaaagaatggctcccctaccgacgtcatcattgttggtgccggtgttgccggtgctgccttggctcatactcttggcaaggatggaagacgagttcatgtgatagaaagagacgtgactgagcctgacagaattgttggtgaactgcttcagcctggaggatacctgaaattagttgaattaggtcttgaggattgtgtggaagaaatcgatgcccagcaagtacttggttatgctcttttcaaggatggaaaaagtacaagactgtcatatccattggagaaatttcatgcagatgtttctggaaggagcttctacaatgggcgtttcattcaacggatgagagaaaaagcagctagtcgtcccaatgtacgactggagcaaggaactgtaacatccctgcttgaagaaaatgggactataaaaggtgttcagtacaaaactaaggatggtcaagaacttcgtgcttatgctcctcttacaattgtttgtgatggttgcttctcaaacctgcgccgttcactttgcaaaccaaaggttgatgtgccctcttgttttgtgggcttagtcttagagaattgtcaacttccttttgcaaaccacgggcatgtcattctagcagatccttcacccatcttattctatccaatcagtagtacagaggttcgatgcttggttgatgtacctggtcagaaggtaccttccatcagtaatggtgaaatggccaattatttgaaggccatggtggcacctcaggttccccctgagcttcatgaggccttcgtttctgcagttgagagaggcaacattagaactatgccaaatagaagtatgcctgctgatccccagcctactcctggggcccttctgatgggtgatgctttcaacatgcgtcatcctttaactggtggtggaatgactgtggcgttgtctgatattgttgtactcaggaatcttcttaagccactccatgactttaacgatgcagcttctcttggccgatatcttgagtccttttacaccctgcgcaagccagtggcatctacaataaatactctggcaggtgccctttacaaggtgttttcctcttctcctgatcaagcaaggaaggaaatgcgccaagcatgtttcgattatttaagccttggaggtgtcttttcaactggaccagttgctctactttctggtctaaaccctcgccccttgagtttagttctccatttctttgctgtggcaatatatggtgtcggtcgtttgctactgccgtttccttcacctaagcgcatgtggattggagctaggttaatttcgggtgcatcaggtatcattttccccatcattaaggccgaaggagtgaggcaaatgttcttccctgccaccatacctgctgtctacagagcccctcctgttgaggattgacggaccaaacaaaaatcaatgtagctgaggctttgttgctaataaggccgtgcttcttgtatctgaacctccatcaaccttaaggacatattatatgcaaactgcctttgttaaaaagggcaaaaagatagaaaacagaagaacgtggacattatataattatttgtggtttcgaggatgcataaaatcatacaaacaatcccataattgtattgtatgatgctttattatcttaaaactgaaagggatatcaatttgtaagtctcagtctccagagaaagaaaaacttctcatttatgttaggcatatatttgtaagatgcctcttcaactggataccccttccaattaaagaagtgataagcaattaaaggttttttctcgtacggccacgggctccggccgcgcgcccggctgcagggcgggcgctccaaaaggatccacggtctacctacgcgggcctcgccgcggcacaccctcttcactagcggcgaccgcagttcaactccctgggcgggcgggttacgagccgcgcggaccggcgaacgccgcgcgggcgtgacggcgcgcccgcgggcgctcggggggcgcggcccgtcggagcgcggccgggggccgcgcccggggtggcccggggccgggcggcgcggcggaggggagtcgcacaggcgcggcggcgggccgcgcgggggcncgcgacgcgggtgggcgttggcgtggagcgggtgagacgcggccacgggggcgcgaggcgcgccccggccacggcctaagtac

SEQ ID NO: 3356 - DNA, 2259 bp, Citrus clementina
tctaactgtaactagtgtttataataagaagcggcctctccctccgagtttctctctcctcaccgatctgtcttcaccaccacaaaaccccacgaaaaaacaaacaaaaacagaaggagccagctggcagctgctgctactgctgttcccaaaacagaaacgaaatcttgatcaaacaacgaccatccatctttcttgcatcatcaacctcgggttctcaccgtttcttcaatctttctaccgagaacaaggcttcgatggatcactacattgcgggcactctcattgccgctgtgtttctccttctcttcgttgtccgccgcaacgacagtaagaagccaaggaaggtttccacgacgtacaagacgcagaacgacgtttttcggagctctgttaacgccggaaagaatggctcccctaccgacgtcatcattgttggtgccggtgttgccggtgctgccttggctcatactcttggcaaggatggaagacgagttcatgtgatagaaagagacgtgactgagcctgacagaattgttggtgaactgcttcagcctggaggatacctgaaattagttgaattaggtcttgaggattgtgtggaagaaatcgatgcccagcaagtacttggttatgctcttttcaaggatggaaaaagtacaagactgtcatatccattggagaaatttcatgcagatgtttctggaaggagcttctacaatgggcgtttcattcaacggatgagagaaaaagcagctagtcgtcccaatgtacgactggagcaaggaactgtaacatccctgcttgaagaaaatgggactataaaaggtgttcagtacaaaactaaggatggtcaagaacttcgtgcttatgctcctcttacaattgtttgtgatggttgcttctcaaacctgcgccgttcactttgcaaaccaaaggttgatgtgccctcttgttttgtgggcttagtcttagagaattgtcaacttccttttgcaaaccacgggcatgtcattctagcagatccttcacccatcttattctatccaatcagtagtacagaggttcgatgcttggttgatgtacctggtcagaaggtaccttccatcagtaatggtgaaatggccaattatttgaaggccatggtggcacctcaggttccccctgagcttcatgaggccttcgtttctgcagttgagagaggcaacattagaactatgccaaatagaagtatgcctgctgatccccagcctactcctggggcccttctgatgggtgatgctttcaacatgcgtcatcctttaactggtggtggaatgactgtggcgttgtctgatattgttgtactcaggaatcttcttaagccactccatgactttaacgatgcagcttctcttggccgatatcttgagtccttttacaccctgcgcaagccagtggcatctacaataaatactctggcaggtgccctttacaaggtgttttcctcttctcctgatcaagcaaggaaggaaatgcgccaagcatgtttcgattatttaagccttggaggtgtcttttcaactggaccagttgctctactttctggtctaaaccctcgccccttgagtttagttctccatttctttgctgtggcaatatatggtgtcggtcgtttgctactgccgtttccttcacctaagcgcatgtggattggagctaggttaatttcgggtgcatcaggtatcattttccccatcattaaggccgaaggagtgaggcaaatgttcttccctgccaccatacctgctgtctacagagcccctcctgttgaggattgacggaccaaacaaaaatcaatgtagctgaggctttgttgctaataaggccgtgcttcttgtatctgaacctccatcaaccttaaggacatattatatgcaaactgcctttgttaaaaagggcaaaaagatagaaaacagaagaacgtggacattatataattatttgtggtttcgaggatgcataaaatcatacaaacaatcccataattgtattgtatgatgctttattatcttaaaactgaaagggatatcaatttgtaagtctcagtccccagagaaagaaaaacttctcatttatgttaggcatatatttgtaagatgcctcttcaactggataccccttccaattaaagaagtgataagcaattgaaggcttttctcgtaccatgttgtttacggtaaacatctcatcttgttgggcatggtcgtctagctctga

SEQ ID NO: 3357 - DNA, 1682 bp, Eucalyptus grandis
agaaaaacaaggcccacgatcgaacagctccagaagtcacgcgtttccttcttccctgctggagtagttcgagaatggcggcgggtcggcttcggaatgagaattcgaacgggttgtgctgggtgggtggcatcttggcctctgttctcggagtcttgattctttaccgtttggttgcgagaaagaggagacgaaatgggggggaatgcgttaaaagcatgagaaccgcgaaggacgaggagagcagatcggtgaacgaaaatggcgggggcgactttgacgtcatcgtcgtcggagctggggtggctggctctgctctcgcctacacgctcgggaaggacggccgccgagtgcatgtgattgaaagggacttgtcggagcctgaccggattgtcggagagctattgcaaccaggtggttacctcaaactgattgagttgggacttgaagattgcgtggagaaaattgatgcacaacaggtgtttggttatgcactcttcaaggatggacgaaatacacgactttcctatccactggaaatgtttagctctgatgtgtctggtaggagcttccacaatggccgcttcatacagaaaatgcgggaaaaagcagccactctccccaacgtgcaactggagcaagggacagtcacttctttgcttgaagacaatggaactgtcaaaggaatccaatacaagacaagaacaggtcaagagctcactgcatatgcacccttgaccgttgtttgtgatggatgcttctcgaatttgcgacgttccctttgcgatcccaaggttgatgtgccgtcctgttttgtcggtctagttctggagaactgcaaccttccttatgcgaaccatgggcacgtcattttagctgatccctctccaatcctcttttaccccatcagtagcaccgaggtccgctgtctggttgacgtaccaggccaaaaggtgccttcaatttcaaacggggaaatggcaaactatctaaaaaccgtggtagcacctcaggttccccctgaaatccttgatgcctttgtggcagcggtggatagaggaaacatgcggaccatgccaaacagaagcatgccggccattccacatcccactccaggagctttgctaatgggggacgctttcaatatgcgtcatccgttaaccggaggaggaatgaccgtggcactctctgatattgttgtgctacgggatcttctacggcctttgaggaacctcaatgatgcgcctgctctctgcagatatctcgaatcattctacacgttgcgtaagccagtggcatccacgataaatacgctggcaggggctttgcacaaggtcttttgtgcatcgcccgatgaagcaaggaaggagatgcgacaggcatgcttcgactatctttgccttgggggcttgttctcgacaggacccatttctttgctctccggtctgaatcctcgtccactgagcttggttctccatttctttgcggttgcgatatatggtgtggggcgtttgttgctgccgctcccttctcccaaacgcatctggatcggattcagattaatttcgggcgcatccgggattatattcccgatcatccgagcagaaggggttaggcaaatgttcttcccggcgactgtcccagcatattacagagctccaccggtgaagtgagtgtcggtt

SEQ ID NO: 3358 - DNA, 1889 bp, Glycine max
aactgaaaacgttccaaatttcactgccagcgaggcagagagagaaactagagagagagagagagcgaacacaccgttcatttctccttcgtcgtcgtcgtcgtttcgccgtcgcattttccggcgaggtttctctgttttgtttaaccgaaatggaggatccgtacgttctcggttggattctgtgctccgtcctgagcctcttggcgctctacagcctggccttcggcggagcgggccgtcgccgcgcttcgccggagaagaggaacgagttatcggagaccgtgacgacctccgccggagaatgcagatcggagaaacgaaacggcgacgctgacgtcatcattgtcggagccggcgtcgccggcgccgccctggcgcacactctcggaaaggatgggcgtcgagtacacgtcattgaaagagacctgagtgagcctgatcgaattgttggagagttgctacaacccggtggctatctcaaattaattgagctcggacttgaagattgtgtggacaaaattgatgctcagcaagtgtttggttatgcacttttcaaggatgggaaacatactcgtctctcttaccccttggagaagtttcactcagatgtctctggcagaagctttcataatgggcgctttattcagaggatgcgggagaaagccgcctccattcccaatgtacgattggagcaaggaacagtcacttccctaattgaagagaaggggacaattaaaggtgtgcaatataagaccaaagatggtcaggaattggcaacatatgcacctcttaccattgtttgtgatggctgcttctcaaacttacgccgttctctttgtaatcctaaggtggatattccctcatgctttgttggtttagttttagagaactgtgaacttccatgtgcaaatcatggccacgtcatactgggagacccttcgccaatcttattctaccctataagcagtacagagattcgctgtctggtcgatgtacctggacagaaggttccttctatttcaaacggtgaaatgggaaagtacttgaagacaacggtggctccacagattcccccccagctttatgatgccttcattgctgctgttgacaaaggcaacataaggacaatgccaaacagaagcatgccggcagatcctcatcctacacctggagcccttttgatgggagatgcattcaacatgcggcatccactaaccgggggcggaatgacggttgcattgtctgatattgtggtgctgagaaatcttctaaggcccttgtctgacctgaatgatgcacccacactctgcaaataccttgaatccttttataccttgcgtaagcctgtagcatccaccataaatacattggcaggtgctctttacaaagttttttgtgcatcccctgatcaggcaaggaaggaaatgcggcaagcttgttttgattatctcagccttggaggcctattctcggaaggaccagtctctttactctctggattaaatcctcgtcccttgagcttggttctccatttctttgctgttgcaatatacggtgttggccgtttattgttaccatttccttcacctaagagagtatggattggagcccggctaatctctggtgcatctgcaatcatcctccccataattaaggctgaagggattcgtcagatgtttttccctgccactgttccagcttattacagaacacctccagttgcacaataaattgagggaaggttcagttcgtagttctgtaagcattttggcttctttattgtgtattctttgtagtctgtaactcaatgttataagtgaatgtatgatctctctttcctttttggtacaccagaaattaaatccatgatcttaaactaaatcacc

SEQ ID NO: 3359 - DNA, 1699 bp, Cucumis sativus
ttctctcctactacgaaacgatggtggatcactgcaccttcggctggatcttctccgctttccttgccttcgtcattgccttctctttcttcctctctcctaggaagaatcgccgaggccggggaaccaattccacgccgaggagggattgtctcagcagctctgcaactaccaacggagaatgtagatccgtcgacggcgacgccgacgtcatcattgttggagccggtgttgccggttccgctcttgctcacactctcggcaaggatggtcgtcgagttcacgtgattgaaagagacttgacagagcctgataggattgttggtgaattattgcagcctggtggctatctaaaattgattgagttaggactgcaagattgcgttgaggaaattgatgcacagaaggtgtatggctatgctcttttcaaagatggaaagagcactcgactttcttacccattggaaaattttcaatctgatgtatctggaagaagcttccacaatggacgcttcatacaaagaatgagggagaaggctgcttttcttcccaatgtgagattggagcaagggacagttacttcgttgctggaagaaaaggggacgatcacaggtgtgcagtataagtccaaaaatggtgaacaaaaaacagcatatgcccctctgaccattgtttgtgatggttgcttctcaaatttgcgccgctctctttgcaaccctatggttgatgttccatcttgttttgtgggattggttctggagaattgccaacttccttacgcaaatcttgggcatgttgttcttggagatccttcccctattttgttctatcccatcagcagcaccgagatccgttgtctggttgatgttcctggtcagaaggttccttctatatcaaatggtgaaatggaaaagtatttgaagaccgtagtcgctccccaggttcctccgcaaatccacgatgcctttatagctgctattgagaagggtaatataaggacaatgccgaatagaagcatgcctgccgctccccagccgacacccggtgccttactgatgggtgatgcattcaacatgcgtcaccctctcaccggtggaggaatgacagtagctttgtccgatattgttgtgctcaggaacctcctcaagccattgaaagacttgaatgatgcaccaactctctgcaaatatctagaatccttttacactctgagaaagcctgtggcttctacaatcaacacattggcgggggcattatacaaggtgttttgtgcatcgtcagatcaagccaggaaggaaatgagacaagcttgctttgattatttgagccttggaggaatattctcaaatgggcctgtctccttgctttcgggattgaatcctcgcccattgagtctcgttctccatttctttgcggttgcaatatatggagttggtcgcttactgcttccatttccttctccgaaaggcatctggattggagcaagattggtctatagcgcatcaggaatcatatttccaataataaaagcggaaggagttaggcaaatgttcttcccagcaactgttcctgcttactacagaaccccaccagtttttaactcatagcatcagagggatgacatacacaaaagaaagatcaaattgggcattgtttatatcataattcccgaggaagaagaggcataacatggaaaaga

SEQ ID NO: 3360 - DNA, 2051 bp, Musa acuminata
acatatatacacagtcccgctgtttctatttattgatgacagcgaggtatggtcggagaacaggatagaaagagagggtaaaagagggagacgagagaaggtttcctcttggggagaagacaatggcggatcaatacctgttgggagccgtcgtcgcttcgatcctagggttcctcctcctgcacgtagggttccatggctggaaggggagggcgcgtcgtactgctggaaagtgtggttccggcccggtggtccccggagacgggggaaccgaagttatcatcgtgggtgccggcgttgccggctctgccctcgcttacgcgctggggaaggatggtagacgtgtccatgtcatcgagagggatttgtctgagcctgacagaattgttggtgaacttttgcaaccaggaggctacctaaaattgttagagctaggccttgaggactgtgtcgacgaaattgatgctcagcgagtccttggttatgctctttttaaagatgataaaagtaccaaactctcataccctttggagaaattccattcagacattgctgggaggagcttccataatgggcgtttcatccaaaggatgagagagaaggcagcgtccttgcctaatgttcggttggaacagggaaccgtgacatccttgattgaagaaaatggaacagtcaagggggtagtctacaagaccaaatctggtgaagaattcaaagctctttcacctcttacaattgtatgtgatggctgcttttcgaatctgaggcgcacactctgctctcctaaggtggatgtaccttcttgttttgttggtttggttctagagaactgccaacttccttttccggatcatgggcatgttatcttagcaaatccttcaccaatattgttttacccaattagtagcactgagattcgctgtttggttgatgtacctggacagaaggtaccttctattgctaatggtgaaatggcaaattatctgaagacgatggtggcacctcaggttccaaccgaactgcatgattcttttgtagcggccattgacaagggaagcattagaactatgccaaacagaagcatgccagctgctcctcatccaacagctggtgccctcttgatgggcgatgcatttaatatgcgccatcctctgaccggaggaggaatgacagtggccttgtctgatatagtcgtgctacgtaatcttcttaagcctctacatgatcttcatgatgctgccgctctctgcaaatacctggaatccttctacactttgcggaaaccggttgcttctacaataaacactctggcaggcgccttgtacaaggtattcagtgcatcacccgatcaagctaggaatgaaatgcgacaagcctgtttcgattatctgagccttggaggtgttttctcaagtgggccaattgctttactctctggtcttaatccccgccccctgagtttggttgcgcacttctttgccgttgctatctatggagttggccgtctattgttgccctttccttcgctggagagattgtggattggagctagactgatttctggtgcagcaggtatcattttcccgattattaaagcagaaggcgtccggcaaatgttcttccctgctactgtccctgcatattatagagctcctcctgttaattgaaacagtggaaaatgtttgtgcccatatacggagtcaaatctgtagcatctttgcccttatcacatgtgccatgttaaattttcatttatgggaatgcaagtgatgtttgctactggtctagtaagccgagattgctgggaattgtactgtaattttgactagcttttgtggtttatctcaacccaacatcaactcagttgcactttgactcctcaagtatctgtttgatttatggcaacaatatatcaacgatcagagtgaagtcgagtgagaggaagagctaactcgattatgtcgacgggatccgtttgatcggatatcgatgtggtaagttaccgtgaaataatagtcttacatctgttgagatcctaattttcttccttt

SEQ ID NO: 3361 - DNA, 2035 bp, Vaccinium corymbosum
tcctcttccggcacgcctctccgattagaaccagaaccagcaccgccgccgccggagttcgagagagaaacaagagaggcggcggtaccggcattttcaccggaggggtagagagagaaattgagggttcaaatagttcgaagatgatgatgggggcaatggtggacaattacgtcgtgggcactctcttggcgtctctgttgggggtgttcgttcttttccacatttttgcggcgcaagacgacggcggagaaggatgagatccgaaatgattgtgtccggagctccaccaacggtgaggtccgaccagagggaggaccggagaatgatgtcgtcattgtcggagcaggggtcgccggtgccgccctcgctcacacccttggcaaggaaggacggacagttcatgtaattgagagagatttgacggagcccgacagaattgtcggtgaacttttacagccaggaggatacctaaagctaattgaattgggccttgaggattgtgtggaggaaattgatgcccagagggtgttgggatatgctcttttcaaagatggaagaaatactaaattgtcttatcccttggaaaaatttcattctgatgtggctgggagaagcttccacaatgggcggttcatacggaggatgagagaaaaagccgctaccctacctaatgtacgactagaacaaggaactgtaacatccctactcgaggaaaacggaataattaagggggttcagtataaaacaaagactggtgaagaaatcagatcatatgctcctcttacaattgtttgcgacggatgcttctcaaatttacgccgttctctttgcaagcctatggtagacgtgccctcttgctttgttggcttggttttagagaactgtaaacttccatacccaaatcacgggcatgttattttagcagatccctcacctattttattctatcccataagtagcactgagattcgttgtttggttgatgtacctggcaaaaagatcccttcaattgctaacggtgaattggcaaactatttaaagacctcagtcgctccacaggtaccacctgagctgcacaaagcattcttagctgcaattgacaaaggaaatattagaacaatgcccaatagaagtatgccggctgctccttaccccactcccggagcccttttgatgggtgatgctttcaatatgcgccatcctttaactggtggaggaatgaccgttgctctgtctgatatagttgttctacgggatctgcttaagcctctgcgtgacctcaatgattcagcttcattgtgtaaatatcttgaatcgttttacactctgcgtaagcctgtggcatccacaataaatactttggctggagccctatacaaggtgttttgtgcatctcccgatcaagcaaggaaggaaatgcgcgaagcatgttttgattatttaagccttggaggtgtgtgttcaacaggaccagtggctctgctctctgggctaaaccctcgcccattgagcctggtactccatttctttgctgtggctatttatggtgttggtcgtctcttacttccattcccttctcctaaacgcttgtggattggagctaggttaatatcgggtgcatctggtatcattcttccgataataaaggcggaaggagtgagacaaatgttcttccctgcaactgtcccagcgtattatagagctccgcctggtgaatgaaataagaattttgctcggtagacataaaggttgtgtttgggtcaaggagaaactaggttttgcttttaactgacagccttgttgaagttggtgcagaagtatgtttattgcttcaaagtttctaccaagcggggacattgagcattatttctatctgaatcgaatttgagatgactagaacctgaatgttggatgtctgagtgaactttttcttagaactgtgaagatttctggatataaccttttgagtgtaataaaatctctattcttttccttgctagtaaaataatcgataataggtcgtacccctttt

SEQ ID NO: 3362 - DNA, 2142 bp, Gossypium raimondii
gtataacttactgttcgctcgtgtttctaaaacaaattcaacgactgccagcgaagccaagtacagccgttgcagccatcgaattctaaactccataaaaacaaacagagagattttcgacgtccttgtatacgcttagctttcttcctttctggtttagttttttggcgacggaggaaatggcggattcatacgtgctgggatggatcctgtgttccgtgatggccctggttgcgctatgcggtgtcgttttgagaaggcagaaatggaaggggatttccatgagaactgagcccatgaagaccgtcctaacgaggaacggagaatgcggatctgctgacgccagccacgctgatatcatcatcgttggagctggcgttgctggttccgccctcgctcacactctcggcaaagatggacgtcgagtgcaagtgattgaaagagacttgagtgaacctgaccgtattgttggggaattgctacaaccagggggatatctcaagttaatcgagttgggacttgaagattgtgtagaggaaattgatgctcagcaagtatttggttatgctcttttcaaggatgggaagcatactcaactttcttacccattagagaagttccactctgatgtatctggtaggagctttcacaatggacgtttcattcagcggatgcgagagaaatcagcttcccttcccaatgtacatttagagcaagggacagtcacttctctacttgaagaaaaagggataatcagaggagtgcagtacaaaactaaagatggtccagaattgactgcatttgcatctctgaccattgtatgtgatggctgtttttcgaacttgcgtcgctccctttgcaaccctaaggtagatataccttcttcttttgtgggattggtcctggagaattgtcatcttccatactcaaatcatgggcatgttatactagctgatccttcccccattttgttctatccgatcagcagtacagagactcgctgtctggttgatgtacctggtcagaaggttccttctattgcaaatggtgagatggcaaattatctaaagaccatcgtggctccccaggttcccccagaaatctacgattcctttgtagcagccgttgataagggaaatattaggacaatgccgaacagaagcatgccggctgctcctcatcccacccctggagccctattaatgggagatgcattcaacatgcggcatccattaaccggcggaggaatgactgttgctttatccgatattgttgtcctccgtgatctattaaggcctctacatgacctcaatgatgcccctatgctctgcaaatatcttgaatcattttacacattgcggaagcccgtggcatcaaccatcaacaccttagcaggcgccttgtacaaggtattctgtgcttcccctgatcaagcaaggaaggaaatgcgacaagcttgcttcgattatctaagtcttggtggtgtatgctcagcaggacctatctccttgctgtctggtttaaaccctcgccccttgagcttggttctacattttttcgcagtggcaatatacagtcttggtcgtttactattgccattcccttcacctaagcgaatctggattggagctagattgatatcgggagcatcaggtatcatctttcccattatcaaagcagaaggagttaggcaaatgttttttccggcgacagtgcctgcatattacagagctcctccaactgtaaaatgagggaagaatttaccaaatgaccaccacaaactggtttgtaacttaattctttaggcttttcataagtaaatcatatttcccaaaaatggtggatgaaccttgtatgagtaaaaacattagtacacgtttgtaatgaaataaagctgtaattgaatagagttgtaattgaatagctctctaatggaatagagctataatcagtaattcaattgtctggttgaattaaatggaatagaactgtaatagtattcttgtgtttggttgaataaaatagagttataatagcaagaaaagaagctgaaatgaccagaatactcttagtaaaatttttttgtagttgaatgactattattattaaattttaataacattattattaaatataatttaa

SEQ ID NO: 3363 - DNA, 2005 bp, Gossypium hirsutum
gcaagttagtaaatgagtaacgtaagcacagatgctggtgagttgtaaactttgtcttcccacctggtttctttctacttctcagaaggttcaagaaacacatttagcattgcaattttgcaaagcgaagcgaaagcattcaaacttctctgaatcgtcaaacaaacaaacaagcacagcagttcaagaaatcagaaccgtagacaatagagagaataaggagcgagattcgagtctctttctctctcgatcgacttcatcgttgggttggcggtgcgtgcctctatttcttttattgtttggcattcagagggaaaaaaaaaggaacgaatggcggattggtacttgtgggcatggatcttgtgctccacgatgacgcttgttgttctccgtggttccgttttgaagagacggaaggggaacggaatctccgcgacgaggggtgagtccgtgaagagagtcctcgcgggtaacggagaatgcagatccgctgacggcagcgacgctgatgtcattattgttggagctggcgttgctggctccgccctcgctcacactctcggcaaggatggacgtcgagtgcatgtcattgaaagagacttgacagagcctgaccgtattgttggggaattgctacaacctggcggctatctcaagctaattgaattaggacttgaagattgtgtagaggaaattgatgctcagaaggtatttggttatgctcttttcaaggatgggaaacatacccgactttcttaccccttagaaaatttccactcagatgtatctggtaggagctttcacaatggacgcttcatacaaaggatgcgggagaaagcagcttctcttcccagtgtacgtttagagcaagggacggttacttctttacttgaagaaaaagggacaatcagaggagtgcagtacaaaactaaagatggtcgagaattgacagcctttgcacctctgaccattgtttgtgatggttgtttttcaaacttgcgtcgctccctttgcaacccaaaggtagatgtaccctcttgttttgttggattggtcctcgaaaattgccatcttccatactcaaatcatgggcatgttatactagcagatccatcccccattttgttctatcccattagcagcactgaggttcgctgtctggttgatatacctggtcagaaggttccttctattgcaaacggggagatgacaaactatctgaagaccattatggctcatcaggttcccccagaaatctatgattcatttgtagcagccgttgataagggaaatattagaacaatgccaaacaggagcatgccggcttctccttatcccactcctggagccctattaatgggagatgcattcaacatgcgccatccattaactggtggaggaatgactgtggctttatctgacattgttgtcctccgtgatctgctaaggcctctgcgtgacctcaatgatggacctaacctttgcaaatatcttgaatcgttttacaccttgcgcaagcctgtggcatccaccatcaatacattggctggcgccctgtacaaggtgttcagtgcttcacctgatcaagcaaggaaggaaatgcgccaagcttgcttcgattatctaagccttggtggtgtattctcaacaggaccaatctccttgctctctggtttgaatcctcgccctttgagtttggtgatgcatttctttgcggtggcaatatatggtattggtcgtttactggttccattcccttcacccaaaagaatctggattggagctagattgatcacgggggcatcaggaatcatcttccctattatcaagtcagaaggagttaggcaaatgtttttcccagcgactgttcccgcatattacagagctccccctcttaagtgagaaacccatactttctaatatcattagtgttcccccttttctagagtgtgggaaaggtaattgctcaactaacaacctctttctttaacctgtctataagttt

SEQ ID NO: 3364 - DNA, 2028 bp, Mimulus guttatus
gagtgcgcacacaaaaaaaggaaaaaaaaaaaggggagaattctcgccgattaaacttccgatcaccgtcaacaatcaatcaatcatcgccgtcgcgacaccgtcacagtggtcggaaatggtgatgatcgatcagtacatattcgggggtttcgtcgcttctctgttcgcgttcgtgttgctgtacagtttgcggaggaggacaattgggaaaacgaagggcggcgcgtcgaaggctgcgactgcgagcatcgacgaatgcgtcaccagccccgccgcggacggcggttccaaggcggaatccggtggagacgctgacgtcatcattgtcggcgccggcgttgctggggctgccctcgcttataccctcggaaaggaagggcgtcgagttcgtgtgatcgaaagagacttaaccgagccggatcgtattgtcggtgaactcctacagccaggtggctacttaaaattgatcgagttaggcctcgaagattgtttgagtaatattgatgctcaacgagttttcggatatgccctttacaaggatggtaaagacacgaaattatcttatccgctcgagaaatttgactcggatgtttccggaaggagcttccataatggccggttcatacagagaatgagagaaaaggcttcgactgttgcaaatgtaagaatcgaacaaggaacagttacttcattgctcgaagagaatggaactgttaaaggagtacaatacaaaacaaagaagggagaagaaatcactgcttatgcccctcttacagttgtttgtgacggttgtttttcgaacctgaggcgctctctctgtactcccgaggtggaaaatccatcatgtttcgtcggattaatcctcgaaaattgcgatctcccacacgctaatcacgggcatgttgttcttggagatccttcgcctattctattctatccaatcagcagcacagagattcgatgtttagtcgatgtacctggacaaaaagttccttcaattgctagcggtgaaatggctaattacttgaagactgtagttgctcctcagattcctcctcagctttacaattcttttatagctgccatcgagaaagggaatataaggacaatgccgaacagaagcatgccagcaaatccacaccctacaccaggtgcacttctaatgggagatgcattcaacatgagacatcctttgacaggtggcggaatgacagttgccttatccgatattgttcttttacgtgatcttcttagacctatacacgatctaaacgatgcttcgatcctttgcaagtatctcgaatccttctacactctaagaaagccggtggcatctacaatcaatactttggcaggagccctttacaaggttttctgtgcatcgcccgatcctgcaagaaacgaaatgagaagggcttgttttgactatcttagccttggaggggtttgctctaacgggcctatttcgctcctctcgggcctaaatccgagcccgttaagcctctttctccatttcttctccgtggctgtttttggagttggtcgattattgcttccgtttccttctccacagagggtgtggttgggtgctagactgctatcaggtgcatctggaattattttcccaattataaaagctgaaggagttagacagatgttcttcccggctacagttccagcctactacagatctccccctgttaattaaagataaataatcgacggaattctcctattcgttattttttgtgtagtttgcttttcttgaaatggtgtttattagtttgtgttattttgttggtgttttttactttttagcctttaaacaaaggcatgtggagaagaccaatacgagatttaaagattagaatatattgtaaagcttcttatgttcttagaacatgaaataaatatttacatctcaaacttgtattttatcacttgtaatgtaataaaatatgtttactatcttctcttgaattcttggacaatgaacaaaccagaatgattttgtctcgctttccg

SEQ ID NO: 3365 - DNA, 1986 bp, Trigonella foenum-graecum
cctttgccaccttggcagagagataagaagaatctccaacgcaaaacccaaacccaacacctctttctccgtcacttccgccgtttgtttcttccgacgagattcttccaccgtaatgatggatctgtatttgctcggttggattttaagcactgttttgagtctatttgcgttatacaatttgattttcaccgagaggagaaattatggttcgccggagaaggtgaatcagcgtgaggaggatagcgtgacgagtactgatgctggagagattaaatcggagaaacttaacggtgatgctgatgttataattgttggtgctggtattgctggtgctgctttggctcatactcttgggaaggatggacgccgagtgcatgtcattgaaagagatctgagtgagcctgacagaatcgttggagagttgctacaacccggtggctatctcaaattagttgaactggggcttcaagattgtgtagacaacattgatgcgcagagagtgtttggttatgctcttttcaaggacgggaaacatacccgtctctcttatcccttggaaaagtttcactcagatgtctctggcagaagttttcacaatgggcgttttattcagaggatgcgagagaaggctgcctcccttcccaatgtaaatttggagcaaggaacagtcatttccctacttgaagagaaggggacaatcaaaggtgtgcaatacaaaaataaagatggtcaggcattgacagcatacgctcctcttaccattgtttgtgatggctgtttctcaaacttgcgtcgttctctttgcaaccctaaggtagataatccctcttgttttgttggcttaattttagaaaactgtgaacttccatgtgccaatcatggccacgtcatacttggagatccttccccaattcttttctatcctataagcagtacagagattcgttgtcttgttgatgtacctggtacgaaggttccttctatttcaaacggtgatatgacaaagtatctaaagacaacggttgctccgcaggtcccccctgagctttatgatgcattcatagccgcagtggacaaaggcaacattaggacaatgccgaacagaagtatgccagcagatcctcgtcctactcctggagctgtactgatgggagatgcattcaacatgcgtcatccactaacagggggcggaatgaccgtagcattgtctgacattgtggtgttgagaaatcttctcaagcctttgcgtgacctgaacgatgcacctgcactttgcaaatacctcgaatccttttataccttgcgtaagcctgtggcatccacaataaatacattggcaggagccctttacaaggttttcagtgcatcccccgatcctgcaaggaaggaaatgcgccaagcttgttttgattatctgagccttggaggcctattctcagaaggaccgatctctttactttcaggattaaaccctcggcccttaagcttggttcttcatttctttgctgtcgcagtatttggtgttggccgtttactgttaccatttccttcacctaaacgagcatggattggagctcgattactctctggtgcatctggaatcattttacccataattaaggccgaaggaattcggcagatgtttttccctgccactgtaccagcttattacagagctcccccggcttcacaagagtgagtattggcaaatgcattttgaaaaaacaaagttgctatcaagatgagctagctctatcatccgttcttgagaaattgaggaaaggttgatgctattagatatatgtatacattttggcatagtgtgtattctttgtagtttgtaactggtataataatctcaaaagtgcatgtatttcttttccatttcctttttgctattttagaaaattgaatccattacattaaagtttaaactagactaaaactatcatccctcttaatcagaggttatgagttcgaatg

SEQ ID NO: 3366 - DNA, 1755 bp, Gossypium hirsutum
aataattatattgtcggcacgttcttcggtttcccttttgccttcctttttctttcattttgcggcgctataataataataataataatgataataacaccaggaagaagagattcgagacagggtattctagggaaattaagacccaaaccggcgccggcaaaggagaatgctcgcctggaaatggttccggcgatgacgtcatcatcgtcggtgccggtgttgctggtgctgctcttgcttatacccttggcaaggatggaaggcgagttcatgtgatcgaacgagacttgaccgaaccggatcggatcgttggagaactgttgcagccaggagggtaccttaaactagttgaattaggccttgaagattgcgtagaggacatcgatgctcagcgtgtgctcgggtacgctctcttcaaagacgggagaaacacgaaattgtcatatcccttggggaagtttcaggcagatgtttcaggacgaagcttccataacggccgtttcatacaaaggatgagagaaaaagccgctactcttccgaatgtaaagctagagcaagggacagtgacatctttgcttgaagaaaaagggacaattataggggtgcaatacaaaactaaagatggtgaagaactaagagcttatgctcctcttacgattgtatgcgacggttgtttttcgaacctccgccggtctctttgcaaccctaaggtggatgtaccctcttgttttgtgggtttggtcttagagaactgtgaactcccgttttcgaatcacggccacgttatcctaggcgatccttcacccatcttgttttatccgattagtagcacagaggttcgttgcttggtcgatgtacctgggaagaaagttccttccgttgctaatggggaaatggcgaatcatttgaagaccgtggtggcacagcaggttccacccgagcttcgcgatgccttcatagctgcagtagacaaaggtaatatccgaaccatgccaaatagaagcatgccggctgatcctcatccgactccaggtgcacttcttatgggagatgctttcaacatgcgccatcctttaaccggcggtggtatgaccgtagcattgtccgatattgttgtacttcgagatcttcttaggcctttgcataaccttcatgatgcagcctccttaaccagctatctcgaatcattctacacgttacgcaagcctgtcgcatctacaataaatactctggccggtgctctttacaaggtgttttccgcttcacctgacgaagcaaggaaggaaatgcgccaagcctgtttcgactatttgagccttggaggtgttttttcaacaggaccagtggctttactctccggtctaaaccctcagccgttgagtttagtacttcatttctttgccgtcgcgatttacggagtcggtcgtctgctcctaccgtttccttcgttccaacgcatgtggattggagctaggttaatttggagtgcatctggaattattttccccataatcaaggcagagggagtgaggcagatgttcttcccagctacggttccggcggtatatcgagctcctcctgtcgtcaactgatgcaaccaagattaaaagattgaaaccgttacctctttgctttagaccccatgattgataagtgttatgttgcatgtatgatgaggacattgtacaactgtaagatatgttttgataccgttctttctatgaacagaattctccaaatggaacctttgtt

SEQ ID NO: 3367 - DNA, 1998 bp, Tropaeolum majus
gagagagagagagaggctcgactttcgtcgttaccgacttagtgttttctctggatttgcattacgaatggcggatcactacggttggggatggatcttaagctcactgctcgctctggcggcgtttacggtttgattgtgaagaaccggaggcgtagaatcgaaaagagtgaagacgcggaggtgagaagtgagtgcgtcaagagtgtttattccgctgacgcggaatgtagatccgataacggcgatgtcgatgtgattatcgttggtgccggcgtggccggcgcggctctcgcgcatactctcggaaaggatggacgacgtgtgcttgtaattgaaagagacttgaccgagcctgaccgtattgttggggaattgctgcaacctgggggctatctcaagctaattgaattgggacttcaagattgcgtagaggcaattgatgctcaacggatttttggttatgcacttttcaaggatgggaaaagtacacaactatcttatcccttggagaagttccactctgatgtatctggtaggagctttcacaatgggcgttttatacagaggatgcgggagaaagctgatacactccctaatgtacaactggagcaaggaaccgttacatctcttctagaagagaaagggacaattaaaggtgtgcaatacaagactaaaactgaccaagtactgacagcaaatgcacccctgaccatagtttgtgatggctgtttttcaaacttgcgtcggtccctatgcaatcctaaggtggatgtgccttcatgttttgttggtctggtcctggagaattgcgaacttccatttgcaaaccatggacatgttgtcttagcagatccttcccccatattgttctaccctataagtagcacagaggttcgttgtctggttgatgttcctggccagaaggtaccttctatcgcaaatggtgaaatggcaaactatttaaagacggcagtggctcctcagattcccccagaactctataattcctttttagctgccattgataaaggaaacattaggacaatgccaaacagaagcatgccagctgccccctatcctactcctggagccctattaatgggagatgcattcaacatgcgacatcctttaactggtggaggaatgactgttgcactgtctgatatagttgtcctacgcgatcttctcagacctttacttgaccttcatgatgcacctacactttgcaaatatcttgaatcgttttacaccttgcgcaagccagtggcatccacaataaatacgttagcaggtgctttgtacaaagtgttttgtgcatcacccgatcaggcaaggaatgaaatgcgcaaggcttgctttgattacctaagtcttggtggtgtatgctcaacgggacccgtctctttgctctcaggtttgaatcctagaccactgagtctggttctccatttctttgctgttgcggtttttggtgttggccgtttgctactgccattcccttcacctaagcgcatctggattggggctagattgatttcgggtgcatcaggaatcatcttacccatcattaaggcagaaggattccggcaaatgttcttcccggcaaccgttcctgcatattacagaggtcctcccgctaaatgatcggaaacgaatgccgagaacacttggttatatatcggtagaggaattcctcgttagaactcaaaaatgtttgaaggtaagtctgtgcttttttagcaatggagatgctcattttctttatatgtggttagctgtgttattctttgtgtccataagtttttctcccttttcatctacttcatttatattttagttttttttttcttccaagaatcaagtttagtgaagcattttgttgggcgggcgggaatttggaagaaaacatgtaaatcttatttggatattggaaggaaaacaagaattttattgctatttgtttattttgacaaaaaaaaaaaaaaaaggccgcct

SEQ ID NO: 3368 - DNA, 1926 bp, Tropaeolum majus
gctcgactttcgtcgttaccgacttagtgttttctctggatttgcattacgaatggcggatcactacggttggggatggatcttaagctcactgctcgctctggcggcgtttacggtttgattgtgaagaaccggaggcgtagaatcgaaaagagtgaagacgcggaggtgagaagtgagtgcgtcaagagtgtttattccgctgacgcggaatgtagatccgataacggcgatgtcgatgtgattatcgttggtgccggcgtggccggcgcggctctcgcgcatactctcggaaaggatggacgacgtgtgcttgtaattgaaagagacttgaccgagcctgaccgtattgttggggaattgctgcaacctgggggctatctcaagctaattgaattgggacttcaagattgcgtagaggcaattgatgctcaacggatttttggttatgcacttttcaaggatgggaaaagtacacaactatcttatcccttggagaagttccactctgatgtatctggtaggagctttcacaatgggcgttttatacagaggatgcgggagaaagctgatacactccctaatgtacaactggagcaaggaaccgttacatctcttctagaagagaaagggacaattaaaggtgtgcaatacaagactaaaactgaccaagtactgacagcaaatgcacccctgaccatagtttgtgatggctgtttttcaaacttgcgtcggtccctatgcaatcctaaggtggatgtgccttcatgttttgttggtctggtcctggagaattgcgaacttccatttgcaaaccatggacatgttgtcttagcagatccttcccccatattgttctaccctataagtagcacagaggttcgttgtctggttgatgttcctggccagaaggtaccttctatcgcaaatggtgaaatggcaaactatttaaagacggcagtggctcctcagattcccccagaactctataattcctttttagctgccattgataaaggaaacattaggacaatgccaaacagaagcatgccagctgccccctatcctactcctggagccctattaatgggagatgcattcaacatgcgacatcctttaactggtggaggaatgactgttgcactgtctgatatagttgtcctacgcgatcttctcagacctttacttgaccttcatgatgcacctacactttgcaaatatcttgaatcgttttacaccttgcgcaagccagtggcatccacaataaatacgttagcaggtgctttgtacaaagtgttttgtgcatcacccgatcaggcaaggaatgaaatgcgcaaggcttgctttgattacctaagtcttggtggtgtatgctcaacgggacccgtctctttgctctcaggtttgaatcctagaccactgagtctggttctccatttctttgctgttgcggtttttggtgttggccgtttgctactgccattcccttcacctaagcgcatctggattggggctagattgatttcgggtgcatcaggaatcatcttacccatcattaaggcagaaggattccggcaaatgttcttcccggcaaccgttcctgcatattacagaggtcctcccgctaaatgatcggaaacgaatgccgagaacacttggttatatatcggtagaggaattcctcgttagaactcaaaaatgtttgaaggtaagtctgtgcttttttagcaatggagatgctcattttctttatatgtggttagctgtgttattctttgtgtccataagtttttctcccttttcatctacttcatttatattttagttttttttttcttccaagaatcaagtttagtgaagcattttgttgggcgggcgggaatttggaagaaaacatgtaaatcttatttggatattggaaggaaa

SEQ ID NO: 3369 - DNA, 2155 bp, Cannabis sativa
acttccacgtcttataatttgaaatgaagaaacaaatgtcttttccaactctataaatatccatcaagctatcatctctttcgcctaacttgcacgtaaaaacagaaacaagagtagatatatgagagagaagtaaaaccaagaaaatattaattgacatttgtaaaagaaaaagacagagaaaactagggatccaaatccattataggaagatggtttttgatcagtatttgcttggtggagtcatagcttcattggcggggttcgtgttcttgtataattacagttacaggggaaagaagatcatgagtagtaccaaagcaaaatcaatggagttatatagtaatgggtttgttaagacatcatcaaacggtgccgtttctccttctggtatcccaaaagaaggtacagatgtcatcatcgttggagctggagttgccggtgcagctcttgcttacacccttgccaaggatggaagaagagttcatgtgattgaaagggacttgaatgagccagatagaattgttggtgagctacttcaaccaggagggtatctaaaattgatcgagctgggtcttgaagattgtgtaaaagagatcgacgctcagagagtttttggctatgctctttacaaagatgggaaaagcaccaaactttcatatcccttagaaaaatttcattctgatgtggctggcagaagctttcacaatggaagattcatacaaagaatgcgtgaaaaggcttcatcactttctaatgtgagattggaacaaggaacagtaacttctcttcttgaggaaaagggaacaatcaaaggtgttcaatacagaaataaggctggtcaagagttgacttctcatgctcccctaactatagtttgtgatggctgtttctcaaatctaagacgctctctttgcaagccacaggttgatattccctcctgttttgttggtttggtgttagaaaactgtgatcttccttatgcaaatcatggccatgtgatcttggcagacccttccccaatcctgttttaccctataagcagcaccgaaattcggtgtctggttgatgtgcctggccaaaaagttccttctgtggctaacggtgaaatggctacttacttgaaaagtgcagtagctcctcagattcccccggagttgaatgcttctttcatagctgcaattgacaaaggaaacatcagaaccatgacaaacagaagcatgcctgcctctccatatcctactcctggcgcattgttgatgggagacgcattcaacatgcgccaccctttgaccggtgggggaatgaccgttgctctttcggacattgttgttttaaggaaccttctaaggccactccatgatctccatgactcatctgcactatgcaaataccttgaatccttttacactcttcgtaagccagtggcatctaccataaacacattggctggtgctttgtacaaagtgttctgtgcttcccctgaccctgcaaggaaagagatgcgtgaagcttgttttgactatcttagtcttggtggcatttgcacaaacggaccagtagctctgctctctggtctcaacccatgtccattaagcttggttctccatttttttgctgtcgctgtctttggtgtcggacgcttattaattccattcccttcgccacgaagaatgtggattggggccagactgatttcgggtgcatcaggtataatttttccaattataaaggcagaaggagttagacaaatgttctttccagttactgtaccagcatattacagagttcctcctgttcaatgaggaaaaataagacaccaaatccaaattcagaagtgtaacatgtaaaagcagaggttatcatagatgtaatttacttgtaacacaatttagttgtagcaatcaacattggttctcatccctgagcaaaacgaaggatatggggtggggatcaatgttacacttcctaaaaaagatatgctcttattttttttatatgtattgtaaaagtttgttgcaaggaatcaatatatgttttataaaattttgtttattcagatgaactgataatcatattgaaattttgctggacaaaaaaaattcacaacattagatatctttttaattcgaacaaatactattttgaaccgtgt

SEQ ID NO: 3370 - DNA, 1575 bp, Gossypium raimondii
tcatcttataatatcatggcttacgaatatatatttggaatctttgcctgttttcttggttttgttttgttttattacaatacaagaaccaacaaaacagcggccgcggcagcgtcaacggtggtttcggcccgtaatggtgagggtactgagggtactgcaactgatattattattgttggtgctggtgttgctggtgcagctcttgcttatacacttggaaaggacggacggcgagtacgtgtgatcgaaagggacttaaatgaacccgataggattgttggtgaacttttacaaccagggggatatcttaaattgattgaattaggccttgaagattgcgtagatgagattgatgctcaacgagttttcgggtacgctttgttcaaagatggaaagaatacgaagttgtcttatcctttggaaaatttccattccgatgttgccggacgaagctttcataacggacgtttcattcaaaggatgcgccacaaagcggcttctcttcccaatgtgagtttagaacaagggagtgtcacatctctaatagaagaaaaagggactgttaaaggaattcaatacaaaactaaggatggtcaagaatttatggcctatgctccccttacgatcgtatgcgacggtggtttctcaaatttaagacgctctctttctaatccaaaggtcgatgtaccttcttgtttcgtcggtttgattctcgagaattgcgagcttccgcatgcgaatcatggacatgttataatagcagacccttcgcctatcttattttaccctattagcagcactgagattcgttgcttggtcgacgtacccggccaaaaagtaccttcggtttccaatggtgagatggctcattacttaaaaactatggtggctccccagattcctccacaactatacacggcgtttatcactgcggtcaacaagggaaacataagaaccatgacgaatagaagtatgccagcggctccacaaccaactccgggtgcacttttactcggtgatgcattcaatatgcgacatcctttaactggaggaggaatgactgttgctttatccgatattgttctcttaagggatcttttaagaccactccataatcttcatgatgcatctgctctttgtagatatctcgaatcgttttacaccttacgaaagccagtggcatctacaataaacacattggctggtgctttatacaaggtatttagtgcctcagctgataaagcaagggaggaaatgagggaagcatgtttcgattatttgagcttaggaggtgcattttccgagggaccgatatctctactctccggtctaaacccgcatcctataagcctagtgctacatttcttcgccgtggcaatatacggtgttggccgtttgttacttccatttccttctcccacacgcatctggactggggctcgattgatttcgggtgcatcgggcatcatcttccctattatccgagctgaaggagttagacaaatgtttttccctgcaactgtgcctgcatattacagagctcctccagttgattaatttgaagaacaatgg

SEQ ID NO: 3371 - DNA, 2013 bp, Tabernaemontana elegans
ggaaaccacaaccaaggaatttattgggaggccagggaggggaagcgccgccgtcgtcaaccgtcgtcaaccgtcaactgacgtccggcattgctataaaactgatggatcactacattttcggaacgatttggggtgtggcattgggatttctagcactgtacgccctctttctgaggagaaatggtggccggagagtcgccgtggagaatagagacagttacgccgccaccaccactgtcattgacggagaatgtagatccaggaatagcgatgtcgacatcatcattgttggcgccggcgtggccggtgccgctcttgctcacactcttggcaaggatggcagacgggttcatgtgatcgaaagagacttgacagagcctgaccgaattgttggagagctactacaacctggtggctatctcaaattgattgagctgggactggaagactgcgtggaaggaattgatgctcagcgagtttttggatatgctctgttcaaggatggaagaaagactcggctttcttatcccttggaaagatttcactctgatgtggcaggcaggagctttcataatgggcgcttcattcaaagaatgcgggagaaggctgcctctcttcccaatgttaggttggagcaaggaacagtcacttctctacttgaagaaaatgggaccattagaggtgtacaatacagaaccaaatcaggtgaggaattgactgcttatgcccctctgacaattgtatgtgatggttgcttttcaaacttacgccgctcgctttgtgatcctaaggttgatgtagcttcttgttttgttggtctggttttggagaactgccaacttccctttgcaaatcatggccatgtcattctcggagatccatctcccatcctgttttatccaatcagcagcactgaggttcgctgtctggttgatgtaccgggtcaaaaggtgccctctattacaaatggtgaaatggtcaaacatttgaagacggttgttgctccacagatccctcctgaattgaacgaggcattccttgctgcagttgataaaggaaatattagagcaatgtccaacagaagcatgccagcagctcctcatcctactccaggggctttgctcatgggggatgcattcaacatgcgccaccctttgactggaggaggaatgactgtggcattatctgatatagttgttctgcgtgatcttcttagacctcttagggatctgaatgatgtgcctactctttgcaaatatcttgaatcattttacactttgcggaagcctgtggcatccactatcaacacattagctggtgccctctataaagtgtttagtgcttctcccgatcaagcaaggaaagaaatgcgtcaggcatgctttgactacttgagtcttggaggtgtgttctcagctgggccggtgtctttgctttccggtctgaatcctcggcctttaagcttggtttgccatttctttgctgtggcagtatatggtgttggccgcttgttgctacctttcccctctcttaagcgtatgtggattggtgcccgtttgatttcaagtgcatcaggaatcatattccccatcatcaaagctgaaggagtcaggcagatgttcttccctgctactgttccagcatattacagaggacctcctgctaaatgactttgttggcaaggtaggaaagcgcaaatatgctctattgctgtatcacattcaggtttgccagcatttataatctggtgtttgggacatctttgaagtattggacgaaggggaatatgtggatgaatgtttgtgaattgtgaaatatattttggtcttaggtcttttgttgcgagtctatcaattttattttttagacttgattgaacaaaccagtctcttccttttttgcctttactttttatcgtgtatagtgccttcgccatgactgtatcagccttgtaaataatttggattgactgaaccctgttgaaccgtggtgaccagtagtcaaataagt

SEQ ID NO: 3372 - DNA, 3330 bp, Phalaenopsis aphrodite
cggtacagagataaaagacatcgcctcctcctccaggtgaacaaaggtggagagaagagagagagagagtgagagcgcgtgaggaggcttcgtcgctgaatggagatgctacagaggtatctcttcggaggcatcctcgcctctctgttgggctttctcctacttctgatatcgcgggataagaagaagaagaagaacaatgagcctgtcaatagcggcgattcggcggcgattctgatgactggctgcggcggcggtgaggctgaacgcggtaatgcggatgatcaagttgaggtcatcatcgttggggctggcgttgctggatcggcccttgcctacacgctcggcaaagatggacgccgagtgcatgttattgaaagagatttgacagaacctgatagaattgttggtgaacttttacaaccaggaggctacctaaaattggttgaattaggccttgaggactgtgttgaagaaattgatgcacagcatgtttttggttatgctcttttcaaggatggtcaaaataccaaactctcttatccattggaaaaatatggttctcatgttgctgggagaggctttcataatgggcgatttgtgcagaggctgagagaaaaagctgcatctttacctaatgttcggatggaggagggaactgttacatctttgcttgaagaaaatgggattgtcaagggggtgacatacaagagtaaagctggttatgagctgaaagcttttgctccgcttactattgtatgtgatggttgcttttcaaatctacgacgtgctctctgcaatccaaaggtggatataccgtcttctttcattggcttggttctcgagaattgcaaactacccttttcaaatcatgggcacgtcatcttagcagatccttcccccattcttttttatcccataagcagcactgaagttcgttgtttggtcgatgtgcccggacgaaaagtgccttccatagcaaacggagaaatggcgaattatctaaagactgtggtagtatctcagataccttgtcaacttcatgacgtcttcattgcggctgtcgacaaaggaaaaatcagaaccatgccaaataggagtatgccggccgctcctcatcctacacctggagcacttctgatgggcgatgcattcaacatgcggcatccgctaacgggtgggggaatgacggtggcattgtcagatattgtggtgctacacaatcttcttaagccgttgcatgatctccacgatgcatcagctctctgtaaatatttggaatccttctataccttgcgtaagcccgttgcttccacaataaacactttggctggtgcgctgtacaaggttttcagtggttcacctgatcaggctagaaatgaaatgcggcaagcatgcttcgattatctaagccttggaggcacttgttccaccggacctgtggctttactctctggattgaatcctcggccgatgagcctcgtcacccacttctttgctgttgctatatttggtgttgggcgggtcctgtttccattcccttcaccgaagagaatgtggattggagctcggttgattaccggtgcatgcgagatcatattccccatcttaaaagcagaagggttcagacagatgttcttccctgcaaccgttcctgcgtattacagagctcctcctgcaaactgatacaaacccaccaaatctatttctgttcatctttcaaatttcagactcagaaaactattattactatttttggaatttctgtagcatcaatgaactaccatgttcctgatatttgtagaatgtgtaaactactttgtccatcaatgtattctattttcttttaaaaaaaaaaaaaaccagcttttacagttcaattcattaaaagatgtcatcgtcagatgatcctttcctactccaccaccaaaacctgctctatcacgttcctcaacagagcaggagagagaaactccgcttccagcccgacaacccttgccttcccaaccccatggctcacttccccaccggaactggtttacttcagatccagccgccgcaaggcagcttctctctgactctatctccggctgcctcccttctcccgctcggaccgttcacgggctactccgccgtgctgaaccggtccaggtttttgaacccggctcggcagcttttggaggaggtttgcgaggttgccgcagccccgccgttcgccggagattcaccggaagtcatgtcgttggattttgaggtggcgccggaagagcaacagtggaagaaagctcggcttttgtccttgattgatgaggtctgtagaagatacaggatatattatcaacaggtgcaaaatgttatcacatcattcgaaatggtagccgggttgagcacagctgccccatatgtttcattggctctcaaggccatgttcaagcacttcaggtgtttgaaagatgcaatgtctaaacaacttaaccttagccacagggattcagcgaagcaaggcatcggccgaacggagatttctagcattggtacgtgtttacgacaagatgggaacaaccttgattcctataggcagccgcatacgtggcgaccacaaaggggactccccgagcgtgcagtggctgtacttcgtgcatggttattcgaacatttcttgcacccgtatcccacagatgtagataagcaaatgcttgccaaacaagcaggtctgacaagaaaccaggtctctaactggtttataaacgcaagagttaggctatggaagccaatggttgaagaaatacacaaccttgaaattaggcagcttcagaaaaccatagaccctaatgataaaaccccaatggctgatcaaaaggaagcttccaaaccctcttcatctattgcaactgccacaagtaaccaaccacctcaaaacaactgcatccaaaggaaccaaaatccctattccagatctctaaacaatgaactttcttacatcgaagaaccgtgcaattacacgtacaatgattttgcctgccgcgatatcggacggaacgcaggtagtgtttctctgacgctcggacttcatcaagacggcggcggcattcacttgccggagccgcttccgttgaatgttgctagacgatttgggcttgatgattgcaatgatgcttatgttgttggtggatttgaagggcaagagagggggtttgggaaggatgtgggtggacatctgcttcatgattttgttggttaatgaagttatatgaagattgttaagattattttaacgtatgagctctgttgattaaagttatttgcttaattgcatgtatactacatcct

SEQ ID NO: 3373 - DNA, 1886 bp, Phalaenopsis aphrodite
gagagagagtgagagcgcgtgaggaggcttcgtcgctgaatggagatgctacagaggtatctcttcggaggcatcctcgcctctctgttgggctttctcctacttctgatatcgcgggataagaagaagaagaagaacaatgagcctgtcaatagcggcgattcggcggcgattctgatgactggctgcggcggcggtgaggctgaacgcggtaatgcggatgatcaagttgaggtcatcatcgttggggctggcgttgctggatcggcccttgcctacacgctcggcaaagatggacgccgagtgcatgttattgaaagagatttgacagaacctgatagaattgttggtgaacttttacaaccaggaggctacctaaaattggttgaattaggccttgaggactgtgttgaagaaattgatgcacagcatgtttttggttatgctcttttcaaggatggtcaaaataccaaactctcttatccattggagaaatatggttctcatgttgctgggagaggctttcataatgggcgatttgtgcagaggctgagagaaaaagctgcatctttacctaatgttcggatggaggagggaactgttacatctttgcttgaagaaaatgggattgtcaagggggtgacatacaagagtaaagctggttatgagctgaaagcttttgctccgcttactattgtatgtgatggttgcttttcaaatctacgacgtgctctctgcaatccaaaggtggatataccgtcttctttcattggcttggttctcgagaattgcaaactacccttttcaaatcatgggcacgtcatcttagcagatccttcccccattcttttttatcccataagcagcactgaagttcgttgtttggtcgatgtgcccggacgaaaagtgccttccatagcaaacggagaaatggcgaattatctaaagactgtggtagtatctcagataccttgtcaacttcatgacgtcttcattgcggctgtcgacaaaggaaaaatcagaaccatgccaaataggagtatgccggccgctcctcatcctacacctggagcacttctgatgggcgatgcattcaacatgcggcatccgctaacgggtgggggaatgacggtggcattgtcagatattgtggtgctacacaatcttcttaagccgttgcatgatctccacgatgcatcagctctctgtaaatatttggaatccttctataccttgcgtaagcccgttgcttccacaataaacactttggctggtgcgctgtacaaggttttcagtggttcacctgatcaggctagaaatgaaatgcggcaagcatgcttcgattatctaagccttggaggcacttgttccaccggacctgtggctttactctctggattgaatcctcggccgatgagcctcgtcacccacttctttgctgttgctatatttggtgttgggcgggtcctgtttccattcccttcaccgaagagaatgtggattggagctcggttgattaccggtgcctgcgagatcatcttccccatcttaaaagcagaaggcttcagacagatgttcttccctgcaactgttcctgcgtattacagagccccccctgcaaactgatacaaacccaccaattctatttctgttcatctttcaattttctgagctcagaatattattattattattggaatttctgtagcatctatgaactaccatgttcctgatatttggagaatgtgtaaactactttgtccatcaatgtattcttttctttattatttatttgggtccgattaatagcagagaccactgggaacgttagtctatttactaaatacgaccgccttatttctatccacttttctaaattaccctac

SEQ ID NO: 3374 - DNA, 3861 bp, Gossypium raimondii
cgaaataatatatataaatgtgtgcatgggctacctacgggagatgatttttgctacttattgaataaataataaatatttacttatgaaaaagcaaaaatgaaaaaaaatcattataaaccagaaaaacaggggaaaaaaacaaataaatcaagtagccaggcagggagtaattaattaggaattaaaaagaaggaggcgcaagttagtaaatgagtaacgtaagcacagatgctggtgagttgtaaactttgtcttccctcgtggtttctttctacttctcagaaggtttaagaaacacatttagcattgcaattttgcaaagcgaagcgaaagcattcaaacttttctgaatcgtcaaacaaacaaacaagcacagcagttcaagaaatcagaaccgtagacaatagagagaataaggagcgagattcgagtctctttctctctcgatcgacttcatcgttgggttggcggtgcgtgcctctatttcttttcttgtttggcattcagaggaaaaaaaaaaggaacgaatggcggattggtacttgtgggcatggatcttgtgctccacgatgacgcttgttgttctccgttgttccgttttgaagagacggaaggggaacggaatctccccgacgaggggtgagtccgtgaagagagtcctcgcgggtaacggagaatgcagatccgctgacggcagcgacgctgatgtcattgttgttggagctggcgttgctggctccgccctcgctcacactctcggcaaggatggacgtcgagtgcatgtcattgaaagagacttgacagagcctgaccgtattgttggggaattgctacaacctggcggctatctcaagctaattgaattaggacttgaagattgtgtagaggaaattgatgctcagaaggtatttggttatgctcttttcaaggatgggaaacatacccgactttcttaccccttagaaaatttccactcagatgtatctggtaggagctttcacaatggacgtttcatacaaaggatgcgggagaaagcagcttctcttcccaatgtacgtttagagcaagggacggttacttctttacttgaagaaaaagggacaatcagaggagtgcagtacaaaactaaagatggtcgagaattgacagcctttgcacctctgaccattgtttgtgatggttgtttttcaaacttgcgtcgctccctttgcaacccaaaggtagatgtaccctcttgttttgttggattggtcctcgaaaattgccatcttccatactcaaatcatgggcatgttatactagcagatccatcccccattttgttctatcccattagcagcactgaggttcgctgtctggttgatatacctggtcagaaggttccttctattgcaaacggggagatgacaaactatctgaagaccattatggctcatcaggttcccccagaaatctatgattcatttgtagcagccgttgataagggaaatattagaacaatgccaaacaggagcatgccggcttctccttatcccactcctggagccctattaatgggagatgcattcaacatgcgccatccattaactggtggaggaatgactgtggctttatctgacattgttgtcctccatgatctgctaaggcctctgcgtgacctcaatgatggacctaacctttgcaaatatcttgaatcgttttacaccttgcgcaagcctgtggcatccaccatcaatacattggctggcgccctgtacaaggtgttcagtgcttcacctgatcaagcaaggaaggaaatgcgccaagcttgcttcgattatctaagccttggtggtgtattctcaacaggaccaatctccttgctctctggtttgaatcctcgccctttgagtttggtgatgcatttctttgcggtggcaatatatggtattggtcgtttactggttccattcccttcacccaaaagaatctggattggagctagattgatcacgggggcatcaggaatcatcttccctattatcaagtcagaaggagttaggcaaatgtttttcccagcgactgttcctgcatattacagagctccccctcttaagtgagaaacccatacttcctaatctcattagtgttcccccttttctagagtgtgggaaaggtaattgccaactaacaacctctttctttaagctgtctataagttttcacattttcctctctctctcgaaaaaaaaaaaaagaaaaagaaaaagaaaaagaaaaaaaaagataaaagtacataaagttttacaaaatggtgggatgtatcttggataaagaaactatgctttgtttgttattaagattcaagttaaatgtcatgcaggaatgtgtcctttaggtataaattttcccaaagctttagcatatattctcttggtgcgtggtgcggtgccagcaagtttttcgctagctgctgatccgtgacattaataatggtcccataatagacatatagaataatccagtgcagcggaatcggtcgagatttgttctcttccacttaacaattatacaacccgtgcaaacatttggcagtatttggatggctaattgcttcgattgatcatcgttttgcttgatttaaacatagacgaagacttctctatcagaagtataatttactttcccaccatatgcgatttgatgacacattcgagaaaaaagaaagaaaaaaaaaggtaaacttaactataatgatattgatcacaaggaggacaaatcaattaatgaggatatatgctattacttaaagaaattagaattaactttgagattaactccgtatcaatattgttttttcctttatcaaattattcatctcttgcaaaatgcctacaactacaacctcagtatgaactcggtttttttttttttttaaagttgatcggcagtgatgacaggtgggtatgaactcttcaacactggagtcgaggtagaagtatagggttttgaatttctacatcccctattattacacttcatttcccaactcttctagacaaataaccaggtttttaatttatgccctcatgttcttcctctcctgctttatcgcctcgtaggaggtcattacctctttaaattttgcctctgcagcttctgaaatatagcacaaggtctcaggaatgtaacattaaataaaaaccccaaattaatgctgttaaaatttataagcttttaatactgacagcacatcagacgcatcacatctcacctttatttttctggttctgatctgggtggaactgttttgccttcgccctgaatgctgtctgcaaacagacaatgtaatctcagttcagcatcacaagcatgacatgaaatccagtaacgagcagaaacggtgataataccagtttttgaattaagttctttgattgatatagctccaccttaaaaatgagaactataagctaacaaactatacaacaaatatagttgatatgacatagaccagcaaactttgtcaattaactaacccttacatttacaggaagggttttgcaagggcgtcctatctactggaatatgacatacttgaccaaatgtggttcagtcacaatgtaatacattaatgaagcaaaccactcattacaggaaccatttttgaagattatgaattcattgggttatttgatggacattaacataaattagcaatctgtctaccttgagaagattatgagcttaatggttaagacaaccggtatagtgggtaaagttaaagcaagtcaactagatgtaccagaaatgtcatattatataaaaaaacataactaccatatcaaaatgaagtatcaaatttgggaaatggaatac

SEQ ID NO: 3375 - DNA, 2005 bp, Gossypium hirsutum
cgcaagttagtaaatgagtaacgtaagcacagatgctggtgagttgtaaactttgtcttcccacctggtttctttctacttctcagaaggttcaagaaacacatttagcattgcaattttgcaaagcgaagcgaaagcattcaaacttctctgaatcgtcaaacaaacaaacaagcacagcagttcaagaaatcagaaccgtagacaatagagagaataaggagcgagattcgagtctctttctctctcgatcgacttcatcgttgggtgcctctatttcttttcttgtttggcattcagagggaaaaaaaaaggaacgaatggcggattggtacttgtgggcatggatcttgtgctccacgatgacgcttgttgttctccgtggttccgttttgaagagacggaaggggaacggaatctccgcgacgaggggtgagtccgtgaagagagtcctcgccggtaacggagaatgcagatccgctgacggcagcgacgctgatgtcattgttgttggagctggcgttgctggctccgccctcgctcacactctcggcaaggatggacgtcgagtgcatgtcattgaaagagacttgacagagcctgaccgtattgttggggaattgctacaacctggcggctatctcaagctaattgaattaggacttgaagattgtgtagaggaaattgatgctcagaaggtttttggttatgctcttttcaaggatgggaaacatacccgactttcttaccccttagaaaatttccactcagatgtatctggtaggagctttcacaatggacgtttcatacaaaggatgcgggagaaagcagcttctcttcccaatgtacgtttagagcaagggacggttacttctttacttgaagaaaaagggacaatcagaggagtgcagtacaaaactaaagatggtcgagaattgacagcctttgcacctctgaccattgtttgtgatggttgtttttcaaacttgcgtcgctccctttgcaacccaaaggtagatgtaccctcttgttttgttggattggtcctcgaaaattgccatcttccatactcaaatcatgggcatgttatactagcagatccatcccccattttgttctatcccattagcagcactgaggttcgctgtctggttgatatacctggtcagaaggttccttctattgcaaacggggagatgacaaactatctgaagaccattatggctcatcaggttcccccagaaatctatgattcatttgtagcagccgttgataagggaaatattagaacaatgccaaacaggagcatgccggcttctccttatcccactcctggagccctattaatgggagatgcattcaacatgcgccatccattaactggtggaggaatgactgtggctttatctgacattgttgtcctccatgatctgctaaggcctctgcgtgacctcaatgatggacctaacctttgcaaatatcttgaatcgttttacaccttgcgcaagcctgtggcatccaccatcaatacattggctggcgccctgtacaaggtgttcagtgcttcacctgatcaagcaaggaaggaaatgcgccaagcttgcttcgattatctaagccttggtggtgtattctcaacaggaccaatctccttgctctctggtttgaatcctcgccctttgagtttggtgatgcatttctttgcggtggcaatatatggtattggtcgtttactggttccattcccttcacccaaaagaatctggattggagctagattgatcacgggggcatcaggaatcatcttccctattatcaagtcagaaggagttaggcaaatgtttttcccagcgactgttcccgcatattacagagctccccctcttaagtgagaaacccatactttctaatatcattagtgttcccccttttctagagtgtgggaaaggtaattgctcaactaacaacctctttctttaacctgtctataagttttcacatttcc

SEQ ID NO: 3376 - DNA, 1878 bp, Medicago truncatula
agagagagagagaagaatctcaaacgccaataactacacctaattctccgtcatcaccactgtcaccatcgccggcgagattcctccgatatggatctatacaatatcggttggattttaagctctgttttgagtctatttgcgttatacaatttgattttcgccgggaagaagaattatgatgtgaatgagaaggtaaatcagcgtgaggatagcgtgacgagtactgatgccggtgaaattaaatcggacaaacttaacggtgatgctgatgttatcattgttggagctggtattgctggtgctgctttggctcatacacttgggaaggatggacgtcgagtgcatattattgaaagagatttgagtgagcctgacagaattgttggagagttgctacaacccggtggctatctcaaattagttgaactcgggcttcaagattgtgtggacaatattgatgcacagcgagtgtttggttatgctctttttaaggacgggaaacatactcgtctctcttatcccttggaaaagtttcactcagatgtctctggcagaagctttcacaatgggcgttttattcagaggatgcgagagaaagctgcctcacttcccaatgtaaatatggagcaaggaacagtcatttccctacttgaagagaaggggacaatcaaaggtgtgcaatacaagaataaagatggtcaggcattgacagcatatgctcctcttaccattgtttgtgatggctgtttctcaaacttgcgtcgttctctttgcaaccctaaggtagataatccctcttgttttgttggcttaattttagagaactgtgaacttccatgtgctaatcacggccatgtcatacttggagatccttcgccaattcttttctatcctataagcagtacagagattcgttgtctggttgatgtacctggaacgaaggttccttctatttcaaacggtgatatgacaaagtatctaaagacgacagttgctccacaggtcccccctgagctttatgatgcattcatagccgcagtggacaaaggcaacataaggacaatgccaaacagaagtatgccagcagatcctcgtcctactcctggagccgtactgatgggagatgcattcaacatgcgtcatccactaacagggggcggaatgaccgtagcattgtctgacattgtggtgttgagaaatcttctcaagcctatgcgtgacctgaacgatgcacctacactttgcaaatacctcgaatccttttataccttgcggaagcctgtggcatccaccataaatacattggcaggagccctttacaaggttttcagtgcatcccccgatgaagcaaggaaggaaatgcgccaagcttgttttgattatctcagccttggaggcttattctcagaaggaccgatctctttactttcaggattaaaccctcggcccttaagcttggttctccatttctttgctgtcgcggtatttggtgttggccgtttactattaccatttccttcacctaagcgggtgtggattggagctcgattactctctggtgcatctggaatcattttacccataattaaggccgaaggaattcggcagatgtttttccctgccactgttccagcttattacagagctcccccggtaaatgcattttgaaaaaataaagttgctatcaagatgagctagctttatcacccattcttgagaatttgatgaaaggttgatgctaatagatatatgtatacattttggcatagtgtgtattctttgtagtttgtaactggtacgatctcaaaagtgcatgtatttcagttcctttttgctattttagaaaaattgaatccattacataccagactttaa

SEQ ID NO: 3377 - DNA, 2133 bp, Medicago truncatula
gccaacttggcagagagagagagaagaatctcaaacgccaataactacacctaattctccgtcatcaccactgtcaccatcgccggcgagattcctccgatatggatctatacaatatcggttggattttaagctctgttttgagtctatttgcgttatacaatttgattttcgccgggaagaagaattatgatgtgaatgagaaggtaaatcagcgtgaggatagcgtgacgagtactgatgccggtgaaattaaatcggacaaacttaacggtgatgctgatgttatcattgttggagctggtattgctggtgctgctttggctcatacacttgggaaggatggacgtcgagtgcatattattgaaagagatttgagtgagcctgacagaattgttggagagttgctacaacccggtggctatctcaaattagttgaactcgggcttcaagattgtgtggacaatattgatgcacagcgagtgtttggttatgctctttttaaggacgggaaacatactcgtctctcttatcccttggaaaagtttcactcagatgtctctggcagaagctttcacaatgggcgttttattcagaggatgcgagagaaagctgcctcacttcccaatgtaaatatggagcaaggaacagtcatttccctacttgaagagaaggggacaatcaaaggtgtgcaatacaagaataaagatggtcaggcattgacagcatatgctcctcttaccattgtttgtgatggctgtttctcaaacttgcgtcgttctctttgcaaccctaaggtagataatccctcttgttttgttggcttaattttagagaactgtgaacttccatgtgctaatcacggccatgtcatacttggagatccttcgccaattcttttctatcctataagcagtacagagattcgttgtctggttgatgtacctggaacgaaggttccttctatttcaaacggtgatatgacaaagtatctaaagacgacagttgctccacaggtcccccctgagctttatgatgcattcatagccgcagtggacaaaggcaacataaggacaatgccaaacagaagtatgccagcagatcctcgtcctactcctggagccgtactgatgggagatgcattcaacatgcgtcatccactaacagggggcggaatgaccgtagcattgtctgacattgtggtgttgagaaatcttctcaagcctatgcgtgacctgaacgatgcacctacactttgcaaatacctcgaatccttttataccttgcggaagcctgtggcatccaccataaatacattggcaggagccctttacaaggttttcagtgcatcccccgatgaagcaaggaaggaaatgcgccaagcttgttttgattatctcagccttggaggcttattctcagaaggaccgatctctttactttcaggattaaaccctcggcccttaagcttggttctccatttctttgctgtcgcggtatttggtgttggccgtttactattaccatttccttcacctaagcgggtgtggattggagctcgattactctctggtgcatctggaatcattttacccataattaaggccgaaggaattcggcagatgtttttccctgccactgttccagcttattacagagctcccccggtaaatgcattttgaaaaaataaagttgctatcaagatgagctagctttatcacccattcttgagaatttgatgaaaggttgatgctaatagatatatgtatacattttggcatagtgtgtattctttgtagtttgtaactggtacgatctcaaaagtgcatgtatttcagttcctttttgctattttagaaaatttaatccattacataccagactataactaccatccctcttaattagatgttatgagtccgaatgtagtcctagaggctagaaatgcaccaacgttaagactcttgagagagagttttttgctattatggtcctattcgattcgataattagtctttgcggctgcacttggagcatatccaagtttctgacacaaaaaaccagctaaaataccatccgcaattcatcataacactgcgtttgatatcattctctgatatcaattgtcattgt

SEQ ID NO: 3378 - DNA, 2055 bp, Amsonia hubrichtii
gcacacttggcggttggcattgtgtgttgcctttaagcatagcgccagcgaagcacactgcagtggcaggaacatattctagtgaaatttacgaaagagccaattagacacgcaagaggaaacgacaaccagcgaaccgttcagaggcgagggaggggaagtgccgccgtcgtcaccggtcgagcgtcaactgacgtccggcattgcggtaaaactgatggatcactacattttcggaacaattttgggggtggtattgggatttgtggctctgtgcggacttcttcttaggagaaacggtggccagaccgtggagaatagtgaaaattacgcagccagcaccaccactaccaccactgtcattgatggagaatgtagatctaggaatagcgatatcgacatcatcattgttggcgccggcgtggctggtgccgctcttgctcatactcttggcaaggatggcagacgggttcatgtaattgaaagagacttgacagagcctgaccgaattgttggagagctgctacaacctggtggctatctcaaattgattgagctggaactggaagattgcgtggaaggaattgatgctcagcgagtttttggatatgctctgttcaaggatggaaaaaagactcggctttcttatcccttggaaagttttcactctgatgtggcaggcaggagctttcacaatgggcgcttcattcaaaggatgcgggagaaggctgcatctcttcccaatgttaggttggagcaaggaacagtaacttctctacttgaagaaaatggaactatcagaggtgtgcaatacaaaacaaaatcaggcgaagaactgactgcttatgcccctctgacgattgtatgtgatggttgcttttcgaacttacgccgctccctttgtgatcctaaggttgatgtaccttcttgttttgttggtctggttttggagaactgccaacttccctttgcaaatcacggccatgttattctaggagacccatctcccatgctgttttatccgatcagcagcacagaggttcgttgcctggttgatgtaccaggtcaaaaggtgccctctatttcaaatggcgaaatggtcaaatatttgaagacagttgttgctccacaggtccctcctcagttgaatgaggcattccttgctgcagttgagaaaggaaatattagaacaatgcccaacagaagcatgccagcagctcctcatcctactccaggggctttgctcatgggagatgcattcaacatgcgccaccctttgactggaggaggaatgactgtggcattgtctgatatagttgttctgcgtgatcttcttagacctcttcgtgatctgaatgatgcacctaccctttgcaaatatcttgaatcattttacactttgcggaagcctgtggcagccactatcaacacactagctggtgccctatataaggtatttagtgcttctcctgatcaagcaaggaaagaaatgcgtcaggcatgctttgactacttgagccttggaggtgtgttctcagctgggccggtgtccctgctttctggtctgaaccctcggcctttaagcttggtttgccatttctttgctgtggcagtatatggtgttggccgcttgttgctacctttcccctctcccaagcgattatggattggagcccgtttaatttcaagtgcatcaggaatcatcttcccaatcatcaaagctgaaggagtcaggcaaatgttcttccctgctactgttccagcatattatagaggacctccagttaaatgagtttgttggcaagatagggaaagcataaacatgctctgttgctgttatcacattcaagtttgtcagcatttgcgatctgcgcacaggatgtctttgaagtatttgagcaagggcaaagttagggcaaagtggggatgtttgtgaattgtgatatattttctggtcctaggtctttctttctgagtctatcgattttattttttagacttggattgaatcaacctctactctttttcttttgtgccctctctatggctgtattg

SEQ ID NO: 3379 - DNA, 2124 bp, Manihot esculenta
atgactgcagtctctctccacctcccacctacaccacaacttaacccgtctctttcttttctctataaaaccacgtcacctgctcaatctcctccgctctcttttcccctcgccacctcaccaccactgtttgcctccgtattgacctcaagaaaaagaagacaaagcagcattctacttgaggccacgaaagtaacccaaaaacctgttttcttttccgctgcttctgggactcgttcttttcaccatataaatatggcgtttgtgattgataagtttattcttgggactttctttgcctctatctctgtctttttccttctctgcattttccgccgaaaccaccagaacctcaagaacgagcagaagttcaaggaaaaagccgccttcaagacccaaaatgataatgtgcaaaggccagaagacggctccgatcctgacgtcatcatcgtcggcgctggcgtcgctggtacagccctcgcttgtacgcttggcaaggatggaagacgagttcaagtgatagaaagagacttgacagagcctgacagaatcgtgggtgaactgctccagccagggggatatctaaaattaattgaattgggacttgaggattgtgtagaggaaattgatgcccagcgagtgcttggctatgctctcttcaaagatggtaaaaatactagactctcatatccactggaaaattttcattctgatattgctgggaggagcttccataatggacgttttattcagagaatgagagaaaaagctgccaccattcccaatgtaaagctagtgcaaggaacagtgacatccctgcttgaagaaaatgggactattaagggtgttcagtacaaaactaaggatggtcaagaacatagagcctatgctcctcttactgttgtctgtgatggttgcttctcaaatctgcgtcgctctctatgcaatcctaaggtagctgtgccttcttgctttgtgggtttaattttggagaactgtcagctcccttttgcaaatcatggacatgttatcttagcagatccttcgccgattttgttttatccaattagcagcacagaggttcgctgtttggttgatgtaccaggtcaaaaattaccttccattgctaatggtgaaatggccaagtatttgaaagacgtggtagcaccacagattccaccacagcttcatgatgccttcatttctgcaatagataaaggtaatatcagaaccatgccaaatagaagcatgccagctgatcctcatccgactccgggagcccttctaatgggtgacgccttcaatatgcgacatccattaaccggcggaggaatgactgtggcactgtctgatattgttgtgcttcgagaccttctacatccattatgtgatcttaatgatgcagattctctagctaaataccttgaatccttttatacattgcgcaagcctgtggcgtcgacgataaatacactggcaggagccttgtataaagtattctctgcctcccccgatgaggcgaggaaggaaatgcgcgaagcatgctttgactatttaagccttggaggtatattttcatcaggacctgtggctttactctctggtcttaacccacggccactgagcttagtcctccatttctttgctgttgcaatatatggtgttggtcgactactgcttccatttccttcacctaaagccatctggattggagctagaataatttcaagtgcttcaggaattatttttcccataatcagagctgaaggagtgagacaaatgttcttccctgcaactgttcctgcaatatacagacatcctcctgttgatgataaatcagatgatgtgcagaaatcaaggtagcttttggctttcacagtcagatatctgcaagttccctattgataaactagcattcagcaatgaatgaaggtgcaaactgtatctgctaagaagtatcatcgttgttcttggtcttcaataagtagaaacaattgtttaataatgagaagcttctcgatgaataagctccaagagaaattgagggaggtgttgtaaggacacaagtcccaggaataattttaggccaacaagttgtggttttctcgtaactaggctgttgtg

SEQ ID NO: 3380 - DNA, 2101 bp, Cajanus cajan
tttaaataagaaagtagcattccgtgttactttatttatttatttataaataaaataaaataagaagagagattgtgaagtagaaaatagtaaaaagtaatggaaaatacagcagacataggagtcgcgagagagagttgcctcttggatggcaatggtccaatactgaggaggtgaaaaagttatttggaattatccttttttcagtgccgtacagccatacgagccatgccatggctaccaccattcacgcccttctggaagcttctccttctccactccctttatctttagttaaaccacgtaaacacaacctttctaaattcacatcacagagagcaccgcaccgtcgttttcgccataatgatggactcctacgtccttggatcgatcatatgcgccctcctcggcctcctcgcgctcctcaattttcttctcgcaccgaagaacaaccgttgcgcggataacaacattaccaccgccgccggacaatgcatttcctccaaccgccgcggagacggagacgtcgacgtcatcattgtcggagccggtgtcgctggctccgctctcgctcacactctcggcaaggatggacgtcgtgtacttgtcatagaaagagatttgagtgaaccagaccgaattgttggagagttgctacaacctggaggctatctcaaattaattgagctgggacttgaagactgtgtggagaaaattgatgctcagcaagtgtttggttatgctcttttcaaggatgggaaacacacacgactctcatatccgctggataagtttcattcaaatgtcacaggcagaagctttcacaatgggcgttttattcagaggatgagagagaaggctgcctcccttcccaatgtacgactggagcaaggaacagttacttccctacttgaagagaaggggataattaaaggtgtgctctacaaaacgaaggatagtaaggaattatcagcctgtgctccccttaccattgtttgtgatggctgtttctcaaacttgcgccgttctctttgtaatcctaaggtagatgttccctcttgtttcgttggcttagttttggagaattgtgaacttccttgtgcaaatcatggccatgtcatactgggagatccttcgccagttctgttctatcctataagtagtacagaaatccgctgtctggttgatgttcctggtcagaaagttccatctatttccaatggtgaaatggaaaattatttgaagacggtggtagctccacaggttccttctgagcttcatgatgctttcatagctgctgtggacaaaggcaacatcaggacaatgccaaacagaagcatgccagcagctccttatcctacacctggagccctcctgatgggagatgcattcaacatgcgccatcctctaactggtggtggaatgactgtggcattatctgatatagtagtgctgcgaaatcttctcaggcctttgcgtgacctgaatgatgcctccagcctttgcaaataccttgaatccttctataccttacgcaagcctgtggcatccactataaatacgttggcaggagccctttacaaggtcttctgcgcatcacctgatccagcaaggaaggaaatgcgccaagcttgtttcgattatcttagccttggaggtctattctcggaggggccagtctctttgctttcaggattaaaccctcggcccttgagcctggttctccatttctttgctgtcgcaatatatggtgttggtcgtttattgctaccatttccctcacctaaacggatttggattggagtccgattaatttctagtgcatctggaatcatcttgccaataattaaggccgaaggagtccgtcagatgttcttccctgcaactgttccagcttactaccgcaatccccccgcttcataaacgtgaattcgttttcatgagtcgagatcaaggatcaagatgcgcttgcagtgctttcccgttttccgaaatttattgggttcattgaatttcattccgaaattccagtaaacattctggctttatgtatgaattttctgtagaatcgttttcagaataaaatcttgattttttcaaa

SEQ ID NO: 3381 - DNA, 1973 bp, Cucumis melo
gcggggatctcccctgaggtcgacgtgatttcccattctctccaactactaaacaatggtggatcactgcgccttcggctggatcttctccgccctccttgccttccccattgccctctctctcttcctctctccttggaggaatcgccgagttcggggaaccgattccacgccgaggagcgctagtgtcagcagctctgcaaccaccaacggagaatgtagatccgtggacggcgacgccgacgtcgtcatcgttggagccggtgttgccggttccgctcttgctcacactcttggcaaggatggtcgtcgagttcacgtgattgaaagagacttgacagagcctgataggatcgttggtgaattattgcagcctggtggctatctcaaattgattgagttaggactgcaagattgcgttgaggaaattgatgcacagaaggtgtatggctatgcccttttcaaagatggaaagaatactcgactttcttacccattggaaaattttcactctgatgtatctggaagaagcttccacaatggacgcttcatacagagaatgagggagaaggctgcttctcttcccaatgtgagattggagcaagggacagttacttcgttgctggaagaaaagggaacgatcacaggtgtgcagtataagtccaaaaatggtgaacaaaaaacagcatatgcccctctgaccattgtttgcgacggttgcttctcaaatttgcgccgctctctttgcaccccaatggttgatgttccatcttattttgtgggattggttctggagaattgtcaacttccttatgcaaatcttgggcatgttgttcttggagatccttctcctattttgttctatcccattagcagcactgagatccgttgtctggttgatgttcctggtcagaaggttccttctatatcaaacggtgaaatggaaaagtatttgaagaccgtagtcgctcctcaggttcctccgcaaatccacgatgcatttatagctgctattgagaagggtaatataaggacaatgccaaatagaagcatgcctgccgctccccagccgacacccggtgccttactgatgggtgatgcattcaacatgcgtcatcctctcaccggtggaggaatgacagtagctttgtccgatattgttgtgctcaggaacctcctcaagccattaaaagacttgaatgatgcaccgactctctgcaaatatctagaatccttttacactcttagaaagcctgtggcttctacaatcaacacattggcaggggcattatacaaggtgttttgtgcatcgccagatcaagccaggaaggagatgagacaagcttgctttgattatttgagccttggaggaatattctcaaatgggcctgtctccttgctttcgggattgaatcctcgcccattgagtctcgttctccatttctttgcggttgcaatatacggagttggtcgcttactgcttccatttccttctctaaaaggcatctggattggagcaagattggtctacagcgcatcaggaatcatatttccaataataaaggcggaaggagttaggcaaatgttcttcccagcaactgttcctgcttattacagaaccccaccagttcttaactcatagcatcagagggatgggatacacaaaggaaggatcaagttgggcactgtttatatcataattcaggaggaagaagaggcatagcatggaagagaaggtcttttttttttttttttttgttagattttcgttctaattgtggattaataaaactgtgtacttgtgatctggagtcgggagtgtaaatattacttcatttctttcaacagcccccaaacattaatgtattgtcgaattgcttgagaacactttagtagtgggagtaaacagacttctctttgtttagtttggcaatattttaaattcatgatattgtgcgttttcttattaaaaa

SEQ ID NO: 3382 - DNA, 1865 bp, Papaver somniferum
taattattccgagatgattgagtatattttaggaggagtccttgcatttttggtgggtttcttcgtattttacagttctagttctcaaaagaatgatatcaagaagaacaaagtagtaacggtggaggaaaatgaatccgttgatgattctgttggtgagaacaatggagaattcaagtctaagagcaaagaagaaactgatgttataattgtgggtgctggtgttgctggtgctgctcttgcttatactcttggaaaggatggacgccgggtacatgtgatagagagagatctaacggaaccggataggattgttggggaactactacaacctggaggattcttgaaattagttgagctgggtcttggagattgtgtggaagagattgatgctcaaagagtctttggatatgctctttttaaagatggaaagaatacaaaagtctcatatcctttggaagagtttcaatcggatgtggctggaagaagctttcacaatggacgtttcattcaacggatgcgagaaaaagctgcaacacttcccaatgttcggttggaacaaggaactgttacttccttgcttgaagagaatggaactgttaaaggaataacatacaagaccaaaaacggggaagagctgaaagcttatgctcctcttacggttgtctgtgatgggtgcttttcaaacttgcgccgttctctctgcaccccaaaggtggatgtgccgtcttgtttcgttggattgatcttggagaactgtgagcttccatacccaaaccatggacatgttgttttggctgatccttcaccaatcttgttttatcaaatcagtagtcatgaagtgcgttgcttggttgatgtacccggacaaaaagtaccatctctttctaacggtgatatggccaactatctgaaaacggcggtggcaccccagatcccctcacaactgcatgattcgttcatatcagcaatagataaggggaacataagaacaatgcctaacagaagcatgccagctcttccccacccaactcctggtgctatattaatgggggatgcattcaatatgcgccatcctttaactggaggcgggatgaccgtggctttagctgatatcgttcttctacgtaatctgctcaaacctctgatggatcttaatgatgcctcttctctatgtagatatcttgaatccttttacactctgcgcaagcctgtggcatcaactataaatacgttggcaggtgcattatacaaggtcttttgtgtgtcacccgatgaagcaagaacagaaatgcgtgaagcctgttttgactatttaagtctcggaggagtcttctcatcaggaccagtggcattactctctggactcaatccacgtccactgagtttggtttgccatttctttgcagtagcaatttatggtgttggccgtctgttactcccattcccttctcccaaacgtttgtggattggagctagattaatatccagtgcatcgggtattatttttccaataataaaggcagaaggagtcagacaaatgttctttccagcaactttgtcagcgtattatagagctcccccagttaactgaaagagtggaaaatatggggtagttcaagtccttcaaaagaaaaattagtctaaaattcaattgttcaggttctcgtaccactttattgaaatgaaaaccaaaaataaacatggtgtaagtctgcaatattatcaaaatagtatgttaggacattatcatcgttcaaatatcctctccagtgtaactattctataatatggtatagaaaagaattcaatagattaaatctatgtaacatggtacaaatagacaaaggaaaatcaccatatta

SEQ ID NO: 3383 - DNA, 1740 bp, Sesamum indicum
gagagcgcgcgcgagagggagagagaggtctcgacgagaagttttgattcatcattcatcattcatcatccattatcacgaccgtccagcggattcgaaaatggtgatgatcgatcagtatattctcgggggattcgttgcttctttggttgctttcgtgttgctctacaacttgccaaggaagacgaggaaaactaataaggtttcgaaggttggacgtggagatgagtgcattaagacctccgccgtcggcggtggttccggaacggaggccggtggagatgctgacattattattgttggagccggggttgccggggccgctctggcttatacgcttggcaaggatgggcgtcgagttcatgtgattgaaagagacttaacggagccagatcggatagtgggcgaacttctacagcctggaggctatttgaaattgatggagttaggtcttgaagactgtgtgggtgatattgatgctcaacgagtttttggctatgccctttacaaggatggtaaagccacgaagttatcttatcccttggagaaattcgacgcggatgtatctggaagaagctttcacaatggccgattcatacagaggatgagagaaaaggcagcaacccttgcaaatgtaaggcttgaacaaggaacagtgacatccttgcttgaagaaaagggaactgttaaaggagtacaatacaagaccaagaatggtgaagagataactgcttatgctcctctcaccattgtttgtgatggatgtttttcaaacttgaggcgctctctctgcactccccaggtggatatcccctcttgcttcgttggtctgatcctggaaaattgtgagctcccatatgttaatcacggtcatgtcgtgctagcggatccttcacccatcttattctacaaaatcagcagcacagaaatacgctgtctggtcgacgttccgggccaaaaggttccttccgttgccagtggagaaatggctaattacttgaagactgcggttgctcctcagattcctcctcagctatatgatgcatttatagctgcaattgagaaaggagcaataaggatgatgcccaacagaagcatgccagcaaatcctcatccgactccgggtgcacttctaatgggggacgcattcaacatgcgccatcctttaacaggaggaggaatgacggtggccctctcggatattgttgtcctccgtgatcttcttagacctctgcatgacttacacgatgcacctactctgtgcaagtatcttgagtccttctacaccctgagaaagcctgttgcgtctacgattaatacattggcgggagcactttacaaagtgttctgtgcatcacctgatccagcaaggaaggaaatgcgtgaagcttgtttcgactatctgagccttggaggcattttctctgagggccctgtctctttactttccggtctaaacccgcgacctttaagcctctttctccattttttgccgtggccgtttatggagttggccgattattaattccatttccctcacctcaaagggtttggctaggagccagattgctttcgggtgcatctggaattatcttcccgattataaaagcagagggagtgagacaaatgttcttccctgctactgttccagcctactacagagctccccctgctgttcattagatcaaatcattcaaaactctcctattcattattttttcctttaaaacaaaaataaaa

SEQ ID NO: 3384 - DNA, 1830 bp, Gossypium hirsutum
tcagaaccgtagacaatagagagaataaggagcgagattcgagtctctttctctctcgatcgacttcatcgttgggttgcggtgcgtgcctctattcttttcttgtttggcattcagaggaaaaaaaggaacgaatggcggattggtacttgtgggcatggatcttgtgctccacgatgacgcttgttgttctccgttgttccgttttgaagagacggaaggggaacggaatctccccgacgaggggtgagtccgtgaagagagtcctcgcgggtaacggagaatgcagatccgctgacggcagcgacgctgatgtcattattgttggagctggcgttgctggctccgccctcgctcacactctcggcaaggatggacgtcgagtgcatgtcattgaaagagacttgacagagcctgaccgtattgttggggaattgctacaacctggcggctatctcaagctaattgaattaggacttgaagattgtgtagaggaaattgatgctcagaaggtatttggttatgctcttttcaaggatgggaaacatacccgactttcttaccccttagaaaatttccactcagatgtatctgggaggagctttcacaatggacgcttcatacaaaggatgcgggagaaagcagcttctcttcccagtgtacgtttagagcaagggacggttacttctttacttgaagaaaaagggacagtcagaggagtgcagtacaaaactaaagatggtcgagaattgacagcctttgcacctctgaccattgtttgtgatggttgtttttcaaacttgcgtcgctccctttgcaaccctaaggtagaggtgccctcttgttttgttggattggtcctcgaaaattgccatcttccatactcaaatcatgggcatgttatactagcagatccatcccccattttgttctatcccattagcagcactgaggttcgctgtctggttgatatacctggtcagaaggttccttctattgcaaacggggagatgacaaactatctgaagaccattatggctcatcaggttcccccagaaatctatgattcatttgtagcagccgttgataagggaaatattagaacaatgccaaacaggagcatgccggcttctccttatcccactcctggagccctattaatgggagatgcattcaacatgcgccatccattaactggtggaggaatgactgtggctttatctgacattgttgtcctccatgatctgctaaggcctctgcgtgacctcaatgatggacctaacctttgcaaatatcttgaatcgttttacaccttgcgcaagcctgtggcatccaccatcaatacgttggctgacgccctgtacaaggtgttcagtgcttcacctgatcaagcaaggaaggaaatgcgtcaagcttgcttcgattatctaagccttggtggtgtgttctcaacaggaccaatctccttgctctctggtttgaatcctcgccctatgagtttggtgatgcatttctttgccgtggcaacatatggtattggtcgtttactggttccattcccttcacccaaaagaatctggattggagctagattgatcacgggggcatcaggaatcatcttccctattatcaagtcagaaggagttaggcaaatgtttttcccagcgactgttcctgcatattacagagctccccctcttaagtgagaaacccatacttcctaatctcattagtgttcccccttttctagagtgtgggaaaggtaattgccaactaacaacctctttctttaagctgtctataagttttcacattttccactctctctct

SEQ ID NO: 3385 - DNA, 1957 bp, Lotus japonicus
atatcaaaagtcatacataaacaagaacaaagaacttccaataaccaagaaaatttgtctcatttactaccatcattctcattgtgctatccatcttctgcaaaccaatcaagtttcaccactctcttggagatggattatcagtatttgctgggaggtatattggcttgttacgcttgtagtttggcctttttgtttgttctgtacagttttgcagcaaagaggaatgccacaagttcaagtttattacatttaaagagtaatgggagtgcaaagacatcagaaaatggaatatgccaacaaaagggtgaaggaagtatagatgtcatcattgttggtgctggggttgctggtgcagctcttgcttacacacttggaaaggatggaaggcgagtgcatgtgattgaaagggacttgagtgaacctgataggattgtgggtgaattgttacaacctgggggctatctcaagttaattgagttgggtcttgaggattgtgtggatgaaattgatgctcaaaaagtctttggctatgctctttataaggatggtaaagataccaagttgtcttaccccttggaaaaatttcattctgatgtttctgggagaagctttcacaatggccgtttcatacagagaatgcgagaaaaggcttcatctcttctaaatgtaaacttagaacaaggaactgttacatctctacttgaagagaatggaaccattacaggggtgcactacaaaaccaagagtggacaagagctaatagcaaaggctcccctcaccgttgtatgtgatggttgtttttccaacttgagacgttctctttgcaaccctaaggttgaagtaccctctcattttgttggcctagtcttagagaactgtaatcttccatatgcaaatcatggacatgttatcttgggtgatccttcacccattttattctatcccatcagtagcactgagattcgttgtttggttgatgtgcctggccaaaaattaccgtcccttggtaatggtgaaatggccctctatttgaaaactgtggtagctccccaggttcccccagagctgtatacttcttttgtagctgcagttgataaaggaaacatgagaaccatgccaaatagaagcatgcctgcctcacctcatcctacacccggtgcccttctgatgggagacgccttaaatatgcgccacccgttaaccggaggaggaatgaccgtggctttggctgatattgttgtgctcaggaatctactgagacctctgcgtgatctgcgtgatgcttcttctctttgcaaataccttgaatcattctacaccctgcgcaagccagtggcatctacaataaacatattagctggggcattgtacaaggtgttttgtgcatctcctgatcctgctatgaaggaaatgagacaagcatgttttgattatttgagccttggaagtgttttctcagagggaccaacagctctgctctctggtctaaatcctcgtccactgagcttagttctccatttcttcgcggtggctatatatggcgttggccgacttatgataccatttccttctccaaaacggatatggattggagctagattgatttcaggtgcagcaggtatcattttccccattatcaaggctgaaggagtaagacaaatgttcttcccagcaatggtgccagcatattatagagtgcctcctgtctattaagcatattacaagaaaggcatggaacatgtctaaacagttcccacattctttgtacttgcagtattccattatttagaaaaatgaagaataagatagcagactccttactatgattaggaaaaatgcttatcaaaaaaaaaaaactatgattaggaaaaataattttgtacaaatgtaaaatttaaagaggaaaacatttttgaaatgatcagcctatgagcagccctaagttttcttttac

SEQ ID NO: 3386 - DNA, 1590 bp, Gossypium hirsutum
aaaggagaatgctcgcctggaaatggtccggcgatgaagtcatcatcgtcggtgccggtgttgctggtgctgctcttgcttatacccttggcaaggatggaaggcgagttcatgtgatcgaacgagacttgaccgaaccggatcggatcgttggagaactgttgcagccaggagggtaccttaaactagttgaattaggccttgaagattgcgtagaggacattgatgctcagcgtgtgttcgggtacgctctcttcaaagacgggagaaacacgaaattgtcatatcccttggagaagtttcaggcagatgtttcaggacgaagcttccataatggccgtttaatacaaaggatgagagaaaaagccgctactcttccgaatgtaaagctagagcaagggacagtgacatctttgattgaagaaaaagggacaattataggggtgcaatacaaaactaaagatggtgaagaactaagagcttatgctcctcttacgattgtatgcgatggttgtttttcgaaccttcgcaggtccctttgcaaccctaaggtggatgtaccctcttgttttgtgggtttggtcttagagaactgtgaactcccgttttcgaatcatggccacgttatcctagccgatccttcacccatcttgttttatccgattagtagtacagaggttcgttgcttggtcgatgtacctgggaagaaagttccttccgttgctaatggggaaatggcgaatcatttgaagaccgtggtggcacagcaggttccacccgagcttcgcgatgccttcatagctgcagtcgacaaaggtaatatccgaaccatgccaaatagaagcatgccggctgatcctcatccgactccaggtgcacttcttatgggagatgctttcaacatgcgccatcctttaaccggcggtggtatgaccgtagcattgtccgatattgttgtacttcgagatcttcttaggcctttgcataaccttcatgatgcagcctccttaaccagctatctcgaatcattctacacgttacgcaagcctgtcgcatctacaataaatactctggccggtgctctttacaaggtgttttccgcttcacctgacgaagcaaggaaggaaatgcgccaagcctgtttcgactatttgagccttggaggtattttttcaacaggaccagtggctttactctccggtctaaaccctcggccgttgagtttagtacttcatttctttgccgtcgcgatttacggagtcggtcgtctgctcctaccttttccttcgttccaacgcatgtggattggagctaggttaatttcgagtgcatctggaattattttccccataatcaaggcagagggagtgagacagatgttcttcccagctacggttccggcggtatatagagctcctcctgtcgtcaactgatgcaaccaagattaaaagcttggaaccattacctcttcgctttagaccccatgatcgataagtgttatattgcatgtatgatgaggacattgtacaactgtaagatacgttttgatactattctttctatgaacaaaattctccaaatggaacctct

SEQ ID NO: 3387 - DNA, 2043 bp, Manihot esculenta
aaaaagataacgtcaccttctcctctactctctcctgcgctcgccacctcgccgccgaactcacctctcgaaatacaagaagacaaagcagcattctagtgggaggccacgaaagaaacccaagaacccattatttatttattgttctcagtttctgggactcgttccggtgactatataattatggctatcgttattgataagttcatttttgggactttctttgcttctctctttggcttttttgttctctgctttttgcgacggaagcaccagaaccttgaaaacaagcagaagtttaaggaaaaagctgccttcaagactcagaattataatgtgcagaggcctgagaatagctcaggtcctgacgtcatcatcgtcggtgctggcgtcgccggtgcagccctcgcatgtacgcttggaaaggatggaagacaagttcatgtgattgaaagagacctgacagagcctgacagaattgtcggtgaactgcttcagccagggggatacctaaaattaatggaattgggccttgaagattgtgtggaggaaattgatgcccaacgagtgcttggttatgctttattcaaggatggtaaagttactagactctcatatcccctggaaaattttcattctgatgttgcggggagaagctttcataatgggcgctttattcagagaatgagagaaaaagctgccaagattcccaatgtaaagctacagcaaggaacagtgacatcccttcttgaagaaaatgggactattaatggcgttcaatacaaaactaaggatggtcaagaacttagagttcatgctcctcttacagtcgtctgtgatggttgcttctcaaatctgcgtcgctctctatgtaatcctaaggtggacgtgccttcttattttgtgggtttagttttggagaattgcgagcttccttttgcaaatcatggacatgttatcttagcagatccttcgccgattttgtgttatccaattagcagcacagaggttcgttgtttggttgatgtaccaggtcaaaaagtaccttccattgctaatggtgaaatgagtaagtacttgaaggacgtggtagcgccacagattccaccagtgcttcatgatgccttcatatctgcaatagataaaggcagtatcaggaccatgccgaacagaagcatgccggctgatccacatccgactcccggagcccttctgatgggtgacgccttcaatatgcgccacccattaactggcggagggatgactgtagcactgtctgatattgttgtgcttcgagatcttcttaacccacttcgtgatcttaacgatgcagcttctctaaccaaatacctggaatccttctatacactgcgcaagcctgtggcgtctacgataaatactctagcaggagcattgtacaaagtattctgtgcgtcccctgatgaggcaaggaaggaaatgcgagaggcatgctttgattatttaagccttggtggtgtattttcatcaggacctgtggctttactctctggtctaaatcccagtccactaagcttattcctccatttttttgctgttgcaatctatggtgttggccgtcttctactcccatttccttcaccgaaagccatgtttattggagttagactaatttcaagtgcatcaggaattattttccccattatcaaagcagaaggagtgagacaaatgttcttccctgctactgttcctgcaatatacagacaccctcctgtcaatgataaagctgatgatttgctaaagtcaagttaagcattggctgtgtcaatcgtcgatctttggttcaataagtagaaacagttgtttaatgatgtgaagcttctttggaaacaagttgaaaattcttgtgaatcatgcaggaattaatgtttatgtaatgtaattcttcagtgggtcagtttccaacacaaattttgatatggtatgagtacaagtgtgaaataggcttgtgctttgtgagataatttctctttcttggttaatattgcatttatgcaacttgta

SEQ ID NO: 3388 - DNA, 1830 bp, Medicago truncatula
ggcacgaggacaacattacatccagcgaagcagagagagagggaaaacacaacacaacacaacacagcaccgtcatcttctctccgactcaaaagagttttgagttttctctcaaaatgatagacccctacggtttcgggtggatcacatgcaccctcatcacccttgctgcactctacaatttccttttctctcgtaaaaaccattcagattcaacaaccaccgagaacattacaaccgctaccggagaatgcagatcttttaatcccaacggcgatgttgatatcatcattgtcggtgctggtgtcgccggctccgctctcgcttacactctcggcaaggatggacgacgagtacttattattgaaagagatctgaatgaaccagaccgaattgttggagagttgctacaacctggaggttatctcaaattgattgaactgggacttgatgattgtgtggagaaaattgatgctcagaaagtgtttgggtatgctcttttcaaggatgggaaacatacgagactctcttatcccttggaaaagtttcactcagatatcgctggaagaagctttcacaatgggcgttttattctgagaatgagagagaaagctgcctcccttcccaatgtacggttggagcaaggaacagtcacttccctgctcgaagagaatggtacaattaaaggtgtacagtacaaaacgaaagatgctcaggaattttcagcatgtgcacctcttaccattgtttgtgatggttgtttctcaaacttgcgccgttctctttgtaatcctaaggtagaagtcccctcttgttttgttggcttagttttagaaaattgtgaacttccatgtgcagaccatggtcacgtcatactaggagatccttcaccggttctgttctatcccataagtagtacagaaattcgctgtctggttgatgttcctggtcagaaggttccatctatttccaatggtgaaatggcaaagtatttgaagacagtggtagctccacaggtaccccctgagcttcatgccgctttcatagctgcagtggacaaaggccacataaggacaatgccaaacagaagcatgccagccgatccttatcccaccccgggagcccttctgatgggagatgcattcaacatgcgccatcccctaaccgggggtgggatgactgtggcattatctgatatagtagtgctgcgaaatcttctgaagcctttacgggacctgaatgatgcatctagcctttgtaaataccttgaatccttctataccttgcgtaagccagtggcatccaccataaatacgttggcaggagcactttacaaggttttctgtgcatcacctgatccagcaaggaaagaaatgcgtcaagcttgctttgattatctgagtcttgggggtttattttcagaaggaccagtctctttgctttcaggattaaacccttgccccctgagtttggttcttcatttcttcgctgttgcgatatatggtgttggtcgtttgttgctaccatttccttcccctaaacgcttatggattggaatacgattaatcgctagtgcatccggaatcatcttgcccattattaaggcagaaggaatccgtcaaatgttcttccctgcaactgttccagcttattatagagctcctccagatgcataaatctgtatttagtgaatacgtctttaaaagtcaaggtgattccaagatgagctagcattgttttcagttagaaatctaatggattcgattgaaacgtaaaaattatggcttttaagtttgattctttatggagtaaatattacattgctgggtt

SEQ ID NO: 3389 - DNA, 2059 bp, Panax ginseng
ttttttgttttttactccggaaagcgcgccattgtgtctggtaccccgggaaattcggccattacggccggggactcaaaattgcaggagaacaaacgtgaaaggcattgtagagagagagagttgtagatagagagagagaaacttgaacgtcaaccaacaccatgaattcatcttcttctactagtactactgatacgttgcattcttttatggaagctctgctcattgatcaatattttcttggatggatctttgctttcctttttgggttcctgctcttgcttaatttcaaaaggaagagagagaaaaataattccacggagtttggaacagatgatagcaacggttactacacaccggaaaatattgccggaagtacggacgtcatcatcgtcggcgccggggttgctggctctgctcttgcttatacgcttgccaaagatggccggagagttcatgtaattgagagggacttaactgagcaagacagaattgtaggtgaacttctacaaccaggaggctacttgaaattgattgaattagggctagaggattgtgtgaatgaaatcgatgcgcaacgagtttttggatatgccctttacatggatggtaaaaacaccaggctttcttaccccttggagaaatttcattcggatgtagctggaagaagctttcataacgggcgttttgttcaacgaatgagggagaaagctgcatcacttccaaatgtaagaatggaacaggggactgttacatctctggttgagaaaaagggaagtgtaaaaggggtgcaatacaaaaccaaggatggccaagaattgtctgcatttgctcctcttacaattgtttgtgatggttgtttttcgaatctccgtcgctccctctgcaatcccaaggtggaggtgccttcgtgttttgttggtttgattttggaaaatattgatcttccacatataaaccatggccatgtcattctagcagatccttctccgatcttgttttataaaattagtagtaccgagattcgctgtttggttgatgtgcctggacaaaaggtgccttgtatttctaatggggaattggctaattatctcaagacagtagtagctcctcaggttccaaaacagctatataactctttcatagcagcagttgacaaaggaaacattagaaccatgccaaacagaagcatgccagccgatcctcatccaactccgggtgcacttctattaggggatgctttcaatatgcgccatcctttaaccggcgggggaatgacagttgctctgtccgatattgtcttgatccgggatcttcttagacctttacgcgatctccatgactcatcaaccctctgcaaatatctcgaatccttttacacccttcgtaagcccgtggcatctactataaatacattggcaggtgccctttataaagttttttgtgcatcacctgataaagcaaggcaagaaatgcgcaatgcgtgttttgattatctgagcctcggaggaatttgttcccaagggccaattgctttactttctggcctaaacccgcgtccaattagcctatttctccacttctttgccgtggctatctatggcgttggccgcttgttgattccttttccttcaccaaaacgaatgtggctcggcgctagattgattttgggtgcatctggaattattttccctattataaagtcagaaggacttcgacaaatgttcttccctgcaactgttcctgcttactacagagctccccccattcactaagaaagtggttatggccttcattttgttatcaagagaagaacttgtatgaatattagtcccgggatgacccaagttgaaagtttagtggggtcaaatttgaaaataaaattcattaagaataaaaattaatttaataaaatgaatcacaaaattaaataatcctcaaatattgtttacaataacattttttcgaagttttattgcttgaaattgttgcatgatagcctcatttttaatagttacaaaaatatcatatatcaataacatttacgtgccttctt

SEQ ID NO: 3390 - DNA, 2307 bp, Fragaria vesca
gttaacttgttatcctatcgatgattacaatctcgaccgacggtgtacaaggaaattgaaatgatatatgtgaaaatgaaaccatacccaacgcagaaagtaaaacatttggagctatttggcttctgcagtagtgtcataatctggttcagtaacaacaatggagaatcgggtaggtgtgtaaatacaccataactacgatcattaagcagaccacaaccctcagccacatgataaaatgcaactacacaaaccaatcttccagactcatcttccaccacaaccaagctcacagctttttgctcagacccatcttccccataaaactcaccttccctcaatctctctctgcttccataaacccacaacacccgaaagcttaaccagttccacctgcattctgacacaaacagagaagagaaccaaacaagggcattctccttcttcttcttgttcttattcttcgtctgggtcttgtaattcatcttttaattcaaagatggcgacaatgatggcgatcgatccgcacgttgtctggacattcctggcttctttattgggtttccttcttctcttccttctccgtcgccggaattacggtaatgccaccgccaaggacaaaggaaatgttaaaaacaagaacaagacgagcgaggatcatgtttcagaagaatgtctgaagagctccggcactgacgtcatcatcgtcggcgccggggttgctggcgctgctcttgcacacaccctaggaaaggagggaagacgtgttcgtgtgattgaaagagacttgacagagccggatcgaattgttggggaacttctccagcccggggggtacctgaaactgattgacttgggacttgaagattgtgttgaggaaatcgatgctcagcgagttcttggatatgctctttttaaggatgggaagaatactacgctgtcctatcccctggaacagttccattcagatgtggcgggtagaagtttccacaatggacggttcatacagaggatgagagaaaaagctgccactcttcccaatgtacaattggagcaaggtacagtcacatctctgcttgaagaaaatgggataattaagggggttcagtacaaaaccaaggatggtcaagaacttcaagctcatgctccacttacgattgtctgtgatggttgcttctcaaatctgcgccgcactctttgcaagcctcaggtagaggcgccttcttgttttgtgggattaattttggaaaattgtgaactcccatttataaatcacgggcatgttattctagctgatccatctccgatcctgttttaccaaatcagtagtacagaggtccgctgtttagttgatgtgcctggccagaaagtaccacccatcgccaatggggcaatggctaactatttgaagaatgtggtagctccacagcttccacctgaacttcatgatcccttcgtatctgcaattgacaaaggaaatattagaactatgccgaatagaagcatgccggccaatccacagccaactcctggagcacttttaatgggcgatgctttcaatatgcgtcatcctttaactggtggaggaatgactgtggcactatcagacattgttatactcagggatcttcttaagccattacgtgatataaatgatgctccttcgttgtgcaactacctagaatccttttataccttgcgcaagccggtttcatctacgataaacaccctggcaggtgccctatacaaggtgttctctgcctcccctgaccaagcaaggaaggagatgcgccaagcatgttttgactatctgagccttggaggtgcctgttcaactggaccagtggctctgctctctggtctaaatcctcgcccgctgagtttagttctccatttttttgctgttgcgatatatggtgttggacgtttgcttctaccatttccttcaccaaaacgcatctggattggagtgagattaatttggggcgcagcaggcataatatttcccatcatcaaggcagaaggtgtgagacagatgttctttcctgctactattccagcttatcatagagctcctcctgctaactgagatgcaaacaataatatccaagaccaagatcgagtaaagtgatcttcagacttgttattttcaagattcctgtaatatcagctcctacctgtaaaactccacattcgtgtaaaactccacattcgtggatcttatagtgcccaattccagagaaagtaaaagctgagtaatatatatgtaaaagatttgtattgaaattgcaatgtacctttcttaca

SEQ ID NO: 3391 - DNA, 2068 bp, Phaseolus vulgaris
tgaaaaatgccttttccgaattttcttcttcagtcacagctaaaggaaatatgccatggccatcacccagtctacgtataaaagcctcgttccttcctgaaacttctcgcttctcttaagtcaggcacgaacgcaaacacgctttttctcgaaatcctcgttgcgcaagcgaattagggagagaaactatagcgagaacaccgcaccgtcgtctccgtggccgtgaggttcctcgaaatgttggacacctacgtgtttggatggatcatatgcgccgcgctgagcgtatttgtgattcgcaatttcgttttcgcggggaagaaatgttgcgcatcgtcggagaccgatgcctctatgtgcgccgaaaacatcactactgccgccggagaatgcagatcgtcgatgcgcgacggcgaatttgacgtcttaattgtcggagctggcgtcgctggctccgctctggcttacactctcggcaaggatggacgtcaagtacttgtcattgaaagagatctgagtgaaccagacagaattgttggagagttgcttcagcctggaggctatctgaagttaattgagctgggacttgaagattgtgtggataaaattgatgctcaacaagtgtttggttatgctcttttcaaggatgggaaacacattagactctcttatccgttggaaaagtttcactcagacgttgctggcagaagctttcacaatggccgttttattcaaaggatgagagagaaggctgcctcccttcccaatgtacgactagagcaaggaacagttacttccttacttgaagagaagggggtaattaaaggcgtgcaatacaaaactaaggatagtcaagaattatcagtttgtgcaccctttaccattgtttgtgatggctgtttttcaaacttgcgtcgttctctttgtgatcctaaggtagatgtgccctcttgtttcgttggtctagttttggagaattgtgaacttccttgtgcaaatcatggccatgtcatactgggagaaccttcgccagttctgttttatccaataagtagtacagaaatccgttgtctggttgatgttcctggtcagaaagttccgtctatttctaatggtgagatggctaagtatttgaagacagtgatagctccacaggttccgcatgagcttcataacgcattcatagctgcagtggacaaaggcagcatcaggacaatgccaaacagaagcatgccagcagctccttatcctactcccggagccctgttgatgggagatgcattcaatatgcgccatcctctaacggggggtggcatgactgtggcattatctgatatagtagtgctgcgaaatcttcttaggcctttgcgtgatctgaatgatgcacccagcctttgcaaataccttgaatccttttataccttgcgaaaacctgtggcgtccactataaatacgctggcaggagctctttacaaggttttttgtgcatcatctgatcctgcgaggaaggaaatgcgccaagcttgcttcgattatcttagtcttggaggtcaattctcggaagggccaatctctctgctttcgggattaaatcctcggccgttgaccctggttctccatttcttcgctgttgcaacatatggggttggccgtttactgctaccatttccttcacctaaacggatgtggattggacttcgattaatttctagtgcatccggaatcatcatgccaataattaaggcagaaggagtccgtcagatgttcttccctgcaaccgttccagcttactaccgaaatcccccggctgcttaaacgtgaattcagtgagtccgtcttcacaaatgaactaccgatgtttttattctttagaaatctaaaggattcgattttgaggcatttgaaagcaatctagctttaatgttaagttttctatagagtcgatttagactgaaaattttattttttaatatttgttaactatctacttatattttgaagttttagttcaaatgaattttattcttcacaataagaatataatttaaaacttacacaaataatttcg

SEQ ID NO: 3392 - DNA, 2041 bp, Euonymus alatus
gaaggaatagcaagccacaaaatcataaccaaacaaattcggccagagcgagagagagagggactctgctttcgggacagagacagagagagggagagagagactgttcttgtgtccgtggcttctctctggatttgcatttcggaatggtggatcattttgtcctcggctggatcctggcctctgtgttcgggctcttcactttgtaccttgtggtgttgaagcgaacgaatgacgaaaagagggccattttggaggcgagaagagagggcatgaatagcctcaacacgataaacggagaatgcagatctagtcacggagacgacgtcgacgtcatcattgtaggagctggtgtcgccggctccgctctttctcacactctcggcaaggatggacgtagagtacgtgtaattgaaagagacgtgacagagcctgaccgcatagttggtgaattgctacaaccagggggctatctcaaattgattgagttgggacttgaagattgtgttgaggaaattgattctcagcgagtatttggctatgccttgtttaaggatgggaaaagtactcgactttcttatcccttggaaaagtttcactcagatgtctcagggaggagttttcacaatggacgtttcatacagaggatgcgacagaaagttgcatcacttcccaatgtacaattggagcaaggaactgttacttcactactagaagcaaatggtataattaggggtgtgcagtacaaaactaaaagtggcgaggaacttaaagcatatgctcctctgaccattgtttgtgatggctgtttctcaaacctgcgacgctccctctgcaaaccaaaggttgatgtaccttcttgttttgttggtttgatcctagagaattgcaaccttccatatgcaaatcatggacatgttatccttggagatccttcccctattttgttttatcctatcagtagtactgaggttcgctgtttagttgatgtacctggtcagaaggttccctctatctcaaacggcgaattggcaaagtatttgaagaccgtggtggctccacagcttcctccagaaattcatgattcctttgtggctgctgttgataagggaaacctaagaacaatgccaaacagaagcatgccagcttctgcctatccaactcctggagctttgttgatgggggatgcattcaacatgcgccatcctctaacagggggaggaatgactgtggcactctctgatattgtcgtgctgcggaatcttctgagacctttgcatgatttgaatgatgccccttccctttgcaaatatcttgaatccttctacacattgcgtaagcccgtggcatccacaatcaacacactggcaggtgctttgtacaaggtgttttgtgcctcgcctgatcaagcaaggaaagaaatgcgtgaggcttgctttgattatctgagtcttggagggattttctctgcagggcctgtctctttgctgtcgggtttaaatccacgcccgttgagtttagtttgccacttctttgctgttgcaatatttggtgttggtcgtatactattgccattcccttcacctaaccgaatctggattggagctagagtcatcttgggtgcatcaggaatcatcttccccattattaaggctgaaggagtaaggcaaatgttcttcccggcaacggttccagcatactacagagctcctcctcctactaccaagtgagatccatgacaaaaacaacaaaaagaagaaaagaatcgaagggaattgttaatccgagtcaccctgcataaagtaaagggtaaggctgaatggttcatcaaaaggggtgtgccttgtcccattttaatgtttctaggagactaggatgtccatattctttcattatcagatcaaccatgcttgacttattccctctggtggctggtgaatgttcatctcattttggaaggataaaaggcaataaatttattgtgcccaataatgtgtgtatctaacttgccagggatgacgaactattagattctttacac

SEQ ID NO: 3393 - DNA, 1734 bp, Tabernaemontana elegans
gagagagagagagactcgccgcgaaatctcgattcgtatctcggagacggagacgaagatggtggtgatagatcagtacattttgggggcctttcttgtttctttatctgggttcgttttcttatacagtcagttgagaagaaagacgaagaaatataaagcttcaaaatttgaacgcaaagatgagtacattaagacctctaccaacgtcgatctccggtcggataaaggagatggtacggatatcatcattgtcggcgccggcgtcgctgggtctgctttggcttacacccttggcaaggatggacgtagagttcatgtgatagaaagagaccttactgaaccagacaggattgtgggtgagcttttacaaccagggggctacctaaaattaattgagttaggtcttgaagattgcttgagaaatattgaagctcaacaagtttttggatatgccatttacaatgatggcaaagatactaagttgtcatatcccctggagaagttcgactctgatgtttcaggcagaagctttcacaatggcagattcattcaacgaatgagagagaaagctgcaactctttccaatgttcgactggaacaaggaacagttacatctttgattgaagaaaacggaactgtgaaaggagtgcactacaagaccaaggatggccaagaactcatagcatgtgctccactcaccattgtctgtgatggctgcttttcaaatctaagacgatctctatgtgagcccaaggtggatgtaccttcttgcttcgttggtttggtcctggaaaattgtgaacttccatatgcaaatcacgggcatgttattttggcggacccttcaccaatattgttctacccaattagcaacactgaaattcggtgtctggtggatgtgcctggacagaaggtgccttccatttcaaacggtgaaatggccaaatatttaaagaatgtagtggctcctcagatccctcctcagctctataaagctttcatagctgcgattgacaaaggaaacataagaacaatgcctaacaggagcatgcctgctaatccccatcccactccaggcgctctgttgttgggagatgcattcaatatgcgccatccgttaacgggaggaggaatgactgttgctcttgcagatattgtcctccttcgggatcttctgagaccattgcataacctgcatgatgcatctactttgtgcaattatcttgaatccttctacaccctccgcaagcctgttgcatctacaataaacacattggcaggtgcactttacaaagttttttgtgcatctccggatccagcaagacaagaaatgcgtcgagcatgttttgactacctgagcttgggaggcattttttcaagcggaccagtggctttactttctggcttaaatccaaggcccttaagtttggtatgccatttctttgctgtggctgtctatggagttggccggctattaattccatttccatcaccaaagcgagcttggttaggtgctaggttgctctcaggtgcatctggaattattctcccaataatcagagccgaaggagtgagacaaatgttcttcccagctactgttccagcatactacagagctccccctgctaatgaataagccacctaaccgcataatgtatctactgaactgcattgggtgacaaaagaagtaagtactcggtgggcaattttctgtcagtaatggtgtttttt

SEQ ID NO: 3394 - DNA, 2008 bp, Panax ginseng
ccgcgggaattcgattagcgtggtcgcggccgaggtacgcgggactcaagcacacacacgttagaggaaaagaaagttatttatattgaataatcaatcataatcatcatctatttaattcatggaactcgaaaggagttatagggagaatgatgagtattttttgatgtttgctgctacgttgctttttgggtttgttctgtacttgtttactttgaggaggaggaggaggaggagagagaaaaaaggtggtgctggctccatggagatcattaatggagcatataagatgactagtagctctgaagttaacggtcattgcaccccggaggatattgccggaagttctgatgacgtcatcattgtcggtgccggcgttgccggttctgcacttgcttacacgcttgccaaagatggccggagagttcatgtaatcgaaagagacttgactgagcaagacagaattgttggtgaacttctacaaccaggagggtatttaaaattggttgaattaggccttgaggattgtgttaatgaaattgatgcacaacgagttttcggatatgccctttacatggatggtaaaaatactaggctttcttatcccctggagaaattccatgcagatgtagcaggaagaagctttcataatggccgtttcattcaacggatgagggaaaaagctgcatctcttccaaatgtacgaatggagcaagggactgtgacatctctggttgagcaaaaaggaactgtaaaaggggtgcgatacaaaaccaaaaatggccaagaaatgtcggcagcatatgctcccctgacaattgtttgtgatggttgtttttcgaatcttcggcattccctctgcaatcccaaggtggatgtgccgtcgtgttttgttggtttgattttggaaaatattgatcttccacatataaaccatggccatgttattctagcagatccttctccaatcttgttttataaaattagcagcaccgaaattcgctgtttagttgatgtgcctggacaaaaagtgccttctattgctaatggtgaattggctcattatttgaagacatcagtagctcctcagattccacctgagctatacaagtcttttatagcagcaatagacaaagggaagataaaaacaatgccaaacagaagcatgccagctgatcctcattccactccaggtgcacttcttttgggggatgctttcaatatgaggcatcccttaaccggtggaggaatgactgttgctctgtcggacattgttctgatacgtgatcttcttaggccattacgcgatctccatgactcatcaaccctatgcaaatatcttgaatccttttacactcttcgtaagccagtggcatcgactataaacacattggctggtgcgctatacaaagtgttttgcgcatcacctgacaaagcaaggcaagaaatgcgcgacgcatgctttgattacctgagcctcggagggatttgttcagaagggccaattgctctactttctggcctaaatccccgcccaatgagcctgttcttccacttctttgctgtggctatttatggcgttggccgcttattgattccatttccttcaccaagaaaaatgtggcttggagctagattgatttcgggggcatctggaattattttccctatcataaagtctgaaggagttaggcaaatgtttttcccagcaactgttccggcatactacagagctcctcccattactaaaaaaatgtaaataattatttatgcttaattaaatgctgttctcaagagcagacagacaacttgtatcatcattcatcagtggtccaagattagggtatggatccaacaaagataagatagactagtgcagggcagggcagggcagggcagtaggggattgtcaataaactgggaatatgacatttttttttatttctttccatttttaatgaaatttcacaatggcatgtggggatttgaaaacaacctcattatgtta

SEQ ID NO: 3395 - DNA, 1809 bp, Euphorbia esula
  misc_feature (421)..(421): n is a, c, g, or t
  misc_feature (580)..(580): n is a, c, g, or t
  misc_feature (976)..(976): n is a, c, g, or t
  misc_feature (1000)..(1000): n is a, c, g, or t
cgcttcttctccttcttatctaattatggaagtagtgtttgacacgtacattttggggactttctttgcttctctctttgcctttcttcttctctacatttttcgccctaacgtcaagaagatgggaaaaatcaaggaattttcgtcctctttcaacactcaaaacgattctacaattacgcctcctcccaatctctccggtaccgacgttatcatcgtcggcgctggagtcgccggcgcagccctcgcccatacacttggcaaggagggaaagcgagttcatgtaatcgaaagagatctgaaggagcctgatagaattgttggtgaactgcttcaacctggaggatatcttaaattgatggaattaggccttgaagattgtgtggaggaaattgatgcccagagaatagttggttatgcnttatttaaagatgggaaccatactaaattgacatatcctctggaaaaatttgatgctgatgtttctggaaagagttttcataatgggaggttcatccaaaggatgagagaaaaagcttctaagcttaccaataatgttcaactagagcaaggaacagtnacttctctgcttgaagaaaatggaatagttagaggggttcagtacaaaactaaggatggtcaagaacgtaaagcttatgctcctctaactatagtttgtgatggttgcttctcaaatttgagacgctctctctgcaatcccaaggttgatgtgccctcacattttgtgggcttagtcctagaaaactgtgaccttcctttagcaaatcatggacatgttattctagcagacccttcccctattctattctaccccattagtagcacagaagttcggtgtttggtagatgtcccgggtcaaaaattaccctcaatcgccagcggtgaaatggccaagtatttaaaaaccgtggtagccccacagattcctccccagctttatgaagcttttatagcngcaatagacaaaggaaatatcagnacaatgcccaataggagcatgccagctaaccctcatcctactccgggagcccttttaatgggtgacgcttttaacatgcgccacccgttaaccggtggtggaatgactgtggcactatctgatattgttcttctccgggatcttcttaagcctctccgtgacctcaatgacgcttatgcccttaccaaatatctcgaatccttttatacattgcgcaagcctgtggcttctactataaatactctagcaggtgccttgtacaaggttttctctgcatccccagatgaggcccggaaggaaatgcgagaagcttgctttgactatttaagcctcgggggttcatgttcaatgggacccgtggctctactctctggtctaaacccaagtcctctaagcttagttgtccattttttcggtgttgcaatattcggggttgggcgtttgcttgttccatttccaacccctaaaggcatgtggattggggctagaatcatttatagtgcttcgggtattatttttccgatcatcagagcagagggagtgaggcaagtgtttttcccggccacagttccggcaatctatagacaccctcctccggctgctcttgtcaatgagaaatccgttgaggcgtactagtcaaattagctacgggttcattaatttaaactatatcctctagtaaaacatatttgattagattaaaatacaattagtaagggaatttgtgcaattatacagataataccagagattaaagattgtaagctttggcaattaatatgtaattcaataaaacgtttagtgtggat

SEQ ID NO: 3396 - DNA, 1896 bp, Sarracenia psittacina
ctagggagagggagagataaagcaacttggaattgttgagttcatacgcattccgtaatggaagtgaagatgatgacgtcgatcgatcatcagtatcttcttggaggagtaattgctttttgttggggtttgttatcttctacaactcgagaaagaagacagagacgaacggagcgtcaatggcgattcagacgcaggaaaccgttaagacctctgcgaatggtttttaccggccggagagtaccggaaatactgacgtcattgttgttggtgccggcgtcgccggttccgctctcgcttacactcttggcaaagatgggcgtcgagtgcacgtaattgagagagatttaactgagccagatagaattgttggtgaacttctacaaccaggaggctatctgaaattaatcgagttgggtctcgaggattgtgtgaatgagatcgatgctcaacgagttgtcggatatgctctttacaaggatggaaaaaatgctaaattgccttacccttggaaagttttcatgctgatgtggctggaagaagctttcataacgggcgtttcatacaacgaatgagggagaaagcttcatctcttcccaatgtaagagttgaacaaggaacagtaacatctctacttgaagaaaaggggattatcaaaggagtgcaatacaaaaccaaggatggtcatgaattgacagcatatgcgcctctgacaattgtttgtgatggttgtttttcaaatttgaggcgctctctctgcaatcccaaggtagaagtgccttcttgctttgttggcttgatcctggaaaattgtcagctcccatctgcaaatcacgggcacgttattctgggcgacccttcacctatcttgttctatcccatcagcagcaccgagattcggtgcctcgtcgatgtaccgggacaaaaggtgccttccatttctagcggtgaaatggcacagtatctaaagaccgtggtggctcctcaggtccctccggaactatacaatgccttcatagcagcagttgacaaaggaaacataagaacaatgccaaacagaagcatggcagcctctccctatcccactcccggcgctcttctgatgggagatgcatttaacatgaggcatccattaaccggaggagggatgaccgttgctctatcggacattgttgtactgagagatcttctcaggcctctgcgtgatctcaaccgatcgcgctgccttgtgcagatatctcgaaacattctacactctgcgtaagccggttgcatccaccataaacacactggcaggggcattgtacaaggctttgtgcatcacggaccggcaaggcaagaatgcgtaaagcatgtttcgattatctgagcctcggcggtgttttctcaaatggacccatctctctactttctggtctaaaccctcgtcccttgatcttggttctccatttcttcgccgtggctatctatggtgtcggccgcttgttacttccattcccttcgcccaaacgcgtgtggcttggagctagattgatctcgggtgcatcgggtatcattttcctattataaaggcggagggagtccggcaaatgttttttcctgcaatggttccagcatattacagagctcctcctcgtaattgagacattcgaaataactcattttatttcctcaagagtaaatgataaaggggaacattaattctactatctagcattggttctaattcaagcgattagggatttaaaactgtgaataagtcttcccccaagacttgagttttatgttaaaaatgcaaacaaatatgtatgttgtgcttgcctacatgatctattaagcaagtatctttgtgttgaagcaagagatggaggcttttgatttgggcctaaagtattt

SEQ ID NO: 3397 - DNA, 1994 bp, Amsonia hubrichtii
tctagaccatcccggaaactcgatttgcagctcatagacgaggatggtggtgatagaccagtacatcttgggggcttttcttgcttcttcattggggttctttttcttatacaccaagttgagaagaaagacgaagaagacgtatagaccttcaaaagttgaacgcaaagatgaatacattaagacctctgctaacaccgatcgccggtcacataaaagagatggtacggatattatcattgtcggcgccggcgttgctgggtctgctttggcttacactcttggcaaggatggacgtagagttcatgtgatagaaagagaccttaccgaaccagacaggattgttggtgagcttttacaaccagggggctatctcaaattagttgagttaagtcttcaagattgcgtgaataatattgatgctcaacgagtttatggatatgccatttacaaggatggcaaagatactaagctgacttatcccctggagaagtttgaggctgatgtttcaggcagaagctttcacaatggcagattcattcaaagaatgagagaaaaggctgcaacccttccaaatgtaagactagaacagggaacagttatatctttgattgaagaaaacggcactgtgaaaggagtgcagtacaagactaaggatggccaagaaatgatagcacatgctcctctcactgttgtctgtgatggctgcttttccaatttaagaagatctctatgcgatcccaaggtggaagttccttcttgctttgttggtttggtcctggaaaatactgaacttccatatgcaaatcatgggcacgtcattcttggagacccttcacccatattgttctatccaattagtagcactgaagttcgctgtctggtcgatgtgcctggacaaaaggtgccttccatttcaaatggtgaaatggccaaatatttaaagaatgtagtggctcctcagatccctcctcagctctataaagctttcatagctgcaattgacaaaggaaacataagaacaatgccgaacagaagcatgcctgctaatcctcatccaactccaggtgctctgttattgggggacgcattcaacatgcgccatccattaacaggaggaggaatgactgttgcactttcagatattgttatccttcgggatcttctgagacctttacatgacctgcatgattcatctactttgtgcagttatcttgaatccttctacacccgccgcaagcctgttgcatctacaataaacacattagcaggtgcactttacaaagttttttgtgcttctcctgatccagcaagacaagaaatgcgtcaagcatgttttgactacctgagcttgggaggcattttttcaagtggaccagtggctttactttctggtctaaatccaaggccattaagtttggtagcccatttctttgctgttgctgtctatggcgttggccgcctattaattccatatccatcaccacagcgagcttggttgggagctagactgatctcgggtgcatctggaattattttcccaataatcagagcagaaggagtgagacaaatgttcttcccagctactgtcccagcataccacagagctcctcctgttgatgacaaattagccacctaataatatatctgctttactccattggtgagcgatgaattaagtaaaataatcttgcacttggtgagctattttgtgtctgcaatggtctccacctgctgaaaaaagaaaagaatcaggtgaaggtctaggcaatcttgagaagcaatactgtaaagcatttatggtatcttttattttattgtttattcttgtttccccaggaaaagtgaagaacatttccatctaaacctgtactatattactaagaaaataaactttctagttgcagtatgtgatctcccaaataccttgatctattgcaaattgaatgttcttggaagatgattttccttccctgctttggtcagcaaaagac

SEQ ID NO: 3398 - DNA, 2142 bp, Aristolochia fimbriata
ctgttgcaaatactgcaatttaaatcatcgttgaagccgactctttccagcaataatcatctcccgattcaggaattaaaacataacctccgtagaggaaacgcgaggctccccttgaataccgtatttctgccataacttccggtgcctgcagggacagaaattggcacccgaaccctagtcaacatttgctcagtggtcagtcgtttcctcctttgaagatgctgctggttcagtatctcttgggaggatttgtagcggctttgctcggctttgcgttgttgcctggattgcgcaggagaaagaagaagagcaagggtgatgagggaaattccactgggatccaaacctatggagagaatgttgtggggaaaggtgcccgggatggcagtacggacgttattgttgtgggagctggtgttgctgggtctgcccttgcttacaccctaggaaaggatggacgcaatgtgcttgtcatagaaagagatttaagtgagccagacagaattgttggtgaattgttacaacctggtggatatttgaagcttattgagttgggactcgaagattgtgttgaggctattgatgctcaacgagtgcttggatacgccctattcaaggatggaaaagatacaaaagtctcataccctttggagaaatttgatgatgatgtttctgggagaagctttcacaatggacgtttcatacaaaggatgcgggaaaaagcagcttctcttcctaatgttaaactagagcaaggaactgttactttccttattgaagataatgggactgtcaagggagtaaactacaagacgaagaatggtgaagaattaaaggcacatgcacctctcactgttgtttgtgacggctgtttttcaaatttacggcgctccctttgcactcctaaggtagaggttccatcacattttgtaggtttggtattggaaaactgtgaacttccttacccaaaccatggacatgttatcttggcggacccttctcctatattgttctatcccattagcagtactgaggtcaggtgtttggttgatgtacctggccaaaagttaccttctgtagccaatggtgaaatggccaactatctaaagactgttgtggctccacagcttccagcacagctccatgatgccttcatatctgctattgatagaggaactgttaggactatgccaaataagagcatgcctgcatctcctgaccccacacctggggctcttctgatgggtgatgcttttaatatgcgccatcctttaactgggggaggaatgactgtggccttagctgatattgccgtcctacacaatcttctgacacctttacgtgatttgagtgattcatctgcactttgcaggtatctggagtccttttacaccttgaggaagcctactgcatctacaataaatacattggcgggtgccttgtataaggttttttgtgcctcacctgatgaggcaatgaaggaaatgcgtcaagcctgttttgattacctaagtcttggaggtgttttttcatctggacctgttgcattgctatccggtctaaaccctcgaccactgagtttggtgtgccatttctttgcggtggctatatatggtgttggcaggctgctactgccatttccttcaccaaagcggttgtggattggagccaggctactctcgggtgcttcaaatatcatactccctattattaaggcagaaggtgttaggcagatgtttttccctgcaagtgttccggcatattatagaactcctcccactggtgaaaaaagatgaatagctgcacacgaattttagcaagcttagttttgtttcaggtgttactgttaggtccagtcaaatctgcctaggggcttctgctgtgttgtacatgttgtaacaaacttaaaagtttgtgcatcaactcatttgaattagaatgaactctgctgataacatcgtatttgttggaagatgactggttcctatctcaagagtccagaaaatctgaaccaatgttgtattgcgatagagtaagcaaatggagtgtcttctccgtttctgtaatttacattccagcttgattgtagcaaaagaattgtcaggcacaaccattcatgttaaagcttcaaaatcttcc

SEQ ID NO: 3399 - DNA, 1491 bp, Trigonella foenum-graecum
tggtgctgctcttgcttatacacttggaaaggatggacggcgagttcatgtgattgaaagagacttgagtgaacctgataggattgttggtgaattgctacaacctggtggctatctaaagttacttgagttgggtcttgaggattgtgtggatgaaattgatgctcaaagagtgtttggctatgcactttataaggatgggaaaaataccaagctatcgtatccgttggaaaaatttaactccgatgtatctggaagaagctttcacaatggtcttttcatacaaagaatgcgagaaaaggcttcatctcttccaaatgtaaaattagaacaaggaactgttacatctttacttgaagaaaatggaaccgtaaaaggagtgaactacaaaaacaagagtggacaagagttcacaacaaaggctcctctcaccgtagtatgtgatggttgtttttccaacttgagacgttctctttgtaatcctaaggttgaagtgccctctcattttgttggattggtttttggagaattgtgatcttccacatgcaaatcatggacatgttatcttgggtgatccttcaccaatttttgttttaccctatcagtagtaccgagattcgttgtttggttgatgtgcctggtcaaaaattaccttcagttggtaatggtgaaatggctcattatttgaaaactgtggtagctcctcaggttcctccagagttgtatgcttctttcatagcagcaattgataaaggcaacataagaagcatgccaaatagaagcatgcctgcatcgccttatcccacacccggcgctcttctgatgggagatgccttcaatatgcgtcaccctttaacaggaggaggaatgaccgtggctttgtcagacattgttgtgctaaggaatctacttaaacctctacgtaatctgcatgatgcttctgctctttgcaattacctcgagtcattctacaccctacgcaagccagtagcatctacaataaacacattagcaggtgcattgtacaaagtgttttgtgcatctcctgatccagctagcattgaaatgcgccaagcatgtttcgattatttgagcctcggaggtgttttctcaaatggaccaatagctctactctccggtctgaatccgcgtccactgagcttggttctccatttctttgcggtggctatatacggtgttggccgcctattgataccgtttccttctccaaaacgaatgtggatcggagctagattgatttctggtgcatcaggtattatttttcctataataaaggctgaaggagtgagacaaatgtttttcccagcaagtgtgccagcatattacagaatgcctcctgtccattaacatattgtatggtatgcagtatatccacatgtggaccattaattgccaaaacagatgagtggtggactctgctctacaattaggaagggtaggaaaaataatgtgcaactgctacctatatta

SEQ ID NO: 3400 - DNA, 1979 bp, Catharanthus roseus
ctgagagagagaagaagaaagttcgagagagagagagagaaagcaaactcgtccgacaatctcgattcgttgttgcttggagacggagatggtggtgatagatcagtacattttgggagcttttctcgtttcttcatttggattcattttcttatacagtcagttgagaagaaagacgaagaaatttaaatctaattcaaaatctgaacgcaaagatgactacattaagacctccattcacgtcgatcgccggtcggatcaaggaaatggtacggatatcattattgtcggcgccggcgtcgctgggtctgctttggcttatactcttggcaaggatggacgtagagttcatgtgatagaaagagaccttactgaaccagacaggattgttggtgagcttttacaacccggcggctatctcaaattaattgagttaggtctagaagattgcttgagaagtattgatgctcaacaagtttttggatatgccatttacaaggacggcaaagataccaagttgtcttatccccttgagaagtttgaatctgatatttcaggcagaagctttcacaatggcagattcattcaacgaatgagagagaaagctgcaactcttccaaatgtaagactagaacagggaacagttacatctttgattgaagaaaacggaactgtgaacggagtgcagtacaagactaaggatggccaagaaatcacatcacatgctcctctcaccattgtttgtgacggctgcttttcaaacctaagacgatctctatgtgatcccaaggtggatgttccttcttgctttgttggtttggtcctggaaaattgtgagcttccatatgcaaaccacgggcatgtcattctgggggatccttcacctatattgttctatccaattagcagtactgaagttcgctgtctggtcgatgtgcctggacagaaggtgccttccatttcaaatggcgaaatggccaaatatttaaagaatgtagtggctcctcagatccctcctcagctctatgaagctttcatagcagcaattgacaaaggaaacataagaacaatgccaaacagaagcatgcctgctaatcctcatccaactccaggcgcactgttgttgggggacgcattcaacatgcgccatccattaacaggaggaggaatgaccgttgctctttcagatattgttgtccttcgcaatcttctgaaacctttacgtgacctgcacgatccatctactttgtgcagttatcttgaatctttctataccctccgcaagcctgttgcatctacaataaacacattagcaggtgcactttacaaagttttttgtgcatctcctgatccagcaagacaagaaatgcgtcaagcatgttttgactacttaagcttgggaggaatattttcaagtggaccagtggctttactttctggcctaaatccaaagcccttaagtttggtactccatttctttgctgtggctgtctatggtgttggccggctattaattccatatccatcaccaaagcgagcttggttgggagttagattactctctggagcatctggaattattttcccaataatcagagcagaaggagtgaggcaaatgttcttcccagtaactgttcctgcttatttcagagctccccccctgttaaataaatgaacaagtcactcaatgataaatgtgtgcttccttccaatgttggtgagaaaacggggtagaatttcttgtactttgtgagctatgtttttttaatcagtaatgaatgaatggtctttacctgcttaaagaaaagaaaaccagggaaagatgtaggataaacaaaatatgtaaagcatttgttgtatcttttatttatagttcttgtttcaggaaaagaaaaaaagcaaaatggaagagcattcttgattgtagaaaataacatttccatctacacatgtatttatattaattgtagaaaataaaa

SEQ ID NO: 3401 - DNA, 2044 bp, Coffea canephora
agcagaaagcaagcgaacaagaaagggagagtaggccgcggaggaggctgaggattgtaacaaaaggagcagagacgccgttttgattcaacgtcgtcggcggcggcattgttgtaattctcatggaccaatatgtttgggaaacgattttggcggtggcgttaggttttgtggccgtgtatggaattctggccagaaatgctaatgctcgccggaaaagttttggtaaaggtggggcggaggatagggagcctcgtgccaccgccgccaccacccccattgatggtatatttagatccaagaacaacgacgcctccgacgatgcagacgtcattatcgtaggcgccggcgtcgctggcgccgctctcgctcacactctcgggaaggatggacgtcgggtgtatgtaatcgaaagagacttgtcagagcctgaccggattgtaggagagctgctccagccgggcggctatctcaagttgattgaactgggactagaagattgtgtggagggaattgatgcacagcgagtcttcggatacgctttattcaaggatggtaaaaggactcgtgtggcttatcccttggaaaaatttgactctgatgtttctggcaggagctttcacaatggccgcttcattcaacgcatgcgagagaaagctgcatctcttcccaatgttcgcttggagcaaggaacagtgacttctcttctggaagaaaaaggggttatcagaggcgtgcaatacaaaacaaaatctggtgaagaattgatcaagtatgcacctctcactgttgtatgtgacggttgcttttcaaatttaagacgctctctttgtgatcctaaggtagacgtcccttcttgttttgttggcttggttttggagaactgccaacttccttttgcagatcatggccatgttgttctagcagacccgtcacctattttgttctatccaatcagcagcacagaagttcgctgtctggttgatgtacctggtcaaaaggtaccatctatttcaaatggtgaaatggccaaatatttgaagacaacagtggctccacaggtccctcttgaattgcatgatgcatttattgctgcggttgacaaaggaaacattaggaccatgcccaacagaagtatgccagcagctcctcatcctacccctggggctttgctattgggagatgcattcaacatgcgacaccctttgactggaggaggaatgacagtggctctgtctgatatcgttgtactacgtgatcttctcagacctcttggcgatctgaatgatccacctaccctttgcaagtatctagaatcattttacaccttgcgtaagcctgtgtcagccaccatcaatacgttagctggtgccctctataaagtgttttgttcatcttctgatgaagcaaggaaagagatgcgtcaggcatgctttgactatttgagccttggaggtgttttctcaaatggaccagtatctctactttctggtctgaaccctcgcccattaagcttggtgtgccatttctttgcggtggcgatatacggtgttggccgcttgttgctgccttttccctcacctaagcgcatgtggattggagcaagattgatatcaagtgcatcgggaattattttccccattatcaaggctgaaggagtgaggcaaatgttcttccccgttaccgttcctgcatattatagagcaccacctgctaagtgaggttgtccagcaaatgctaaaacactaaactcctcaattgcaattatcacattcaagtttgtgtccgcggttgcaatccgatgttcaaagttagtggaaagcggatgcttttataaactggtgtgaattgtgatatattttttgctcctaggtctttttgtatctcattgtatttgtccttttttttctcaaccgtctcaagtaaacagaattttttttagtgttttttggttctctttggcgatttaattgctttgtaaataactgggatgatgtgagcttcatttcaattgtagtgtgaagaagcgaaaaaaaaaaaaaaa

SEQ ID NO: 3402 - DNA, 2035 bp, Medicago truncatula
cttaattagaagggaaggtcaaaatatcaaaactcttaattaaagcttagaaaacgatatatatcagccctatgcttatgagttaagtatatttattatgtatatgtacaaacgtttgccgctataaaaagtaaacaaagaaattagaaaaactagttttctcatttcattgatcttattgttctaataaaaaagttctttgagatggattatcagtatattcttggagggattctggcttgtagtttggcatttgtgtttgttgtgtatggttttggagaaaagaagaaaacaggttcaagttcaatggatgtgaaaagtaatggatatgcaaagacatcatcagaaaatggaatttgctcacaagagattgttggagaaacagatatcatcattgtaggtgctggagttgctggtgctgctcttgcctatacacttggaaaggatggacggcgagtacacgtgattgaaagagacttaactgagcctgatagaattgtgggtgaattgcttcaacctggtggctatctgaagttacttgagttaggtcttgaggattgtgtggatgaaattgatgctcaaagagtgtttggctatgcactttataaggatgggaaaaataccaaactgtcttatcccttggaaaagttcgactctgatgtatctggaagaagttttcacaatggtcgtttcatacagagaatgcgagaaaaggcttcaactattccaactgttaaattagaacaaggaaccgttacatcgttacttgaagaaaatggaactatcaaaggtgtgaactacaaaaataagagtggtcaagagttcacagcaaaggctcctctcaccatagtatgtgatggttgtttttccaacttgaggcgttctctttgtaatcctaaggttgaagttccctctcattttgttggattgattttggagaattgtaatcttccacatgcaaatcatggacatgttatcttgggtgatccttcaccaattttgttttaccctataagtagtaccgagattcgttgtttggttgatgtgcctactggccaaaaattaccttctcttggtaatggtgaaatggcaaattatttgaaaactgtggtagctccccaggttcctcctgaactgcatgcttcttttattgcagcagttgataaaggaaacataagaagcatgccaaatagaagcatgcctgcatcaccttatcccacccctggggctcttctgatgggagatgccttcaatatgcgtcatcctttaacaggaggaggaatgactgtggctttgtctgacattgttttgctaaggaatctacttaaacctctgcgtaatctgcatgatgcttctgctctttgcatttacctcgagtcattctacaccctacgcaagccagtggcatctacaataaacacattagcaggtgcattgtacaaagtgttttgtgcatctcctgatccagctagcattgaaatgcgccgagcatgttttgattatttgagcctcggaggtgtttgctcagatgggccaatagctctactctccggtctgaatccgcgtccattgagcttggttctacatttcttcgcggtggctgtattcggtgttggccgcctcttgataccatttccttctccaaaacgaatgtggatcggagctagattgatttctggtgcatcaggtattattttccccattatcaaggctgaaggagtgagacaaatgttttttccagcaagtgtgccagcatattacagaatgcctcctgtccattaagatgtcctaataaaggcatggtgcaaatccaaatatggcccactaattgccaaaacggatgtgtggtggactctcttctataaattataaatatgaaaataatgtgcaactgcaacctgtattatttattgtactatataattttttgaagattttttatttgaattttggacaaaagaaattggaaattcagatttatgtcactgtagtattcatgtcatttatatgagaaataacaatccttgtctcttcc

SEQ ID NO: 3403 - DNA, 2078 bp, Medicago truncatula
cttaattagaagggaaggtcaaaatatcaaaactcttaattaaagcttagaaaacgatatatatcagccctatgcttatgagttaagtatatttattatgtatatgtacaaacgtttgccgctataaaaagtaaacaaagaaattagaaaaactagttttctcatttcattgatcttattgttctaataaaaaagttctttgagatggattatcagtatattcttggagggattctggcttgtagtttggcatttgtgtttgttgtgtatggttttggagaaaagaagaaaacaggttcaagttcaatggatgtgaaaagtaatggatatgcaaagacatcatcagaaaatggaatttgctcacaagagattgttggagaaacagatatcatcattgtaggtgctggagttgctggtgctgctcttgcctatacacttggaaaggatggacggcgagtacacgtgattgaaagagacttaactgagcctgatagaattgtgggtgaattgcttcaacctggtggctatctgaagttacttgagttaggtcttgaggattgtgtggatgaaattgatgctcaaagagtgtttggctatgcactttataaggatgggaaaaataccaaactgtcttatcccttggaaaagttcgactctgatgtatctggaagaagttttcacaatggtcgtttcatacagagaatgcgagaaaaggcttcaactattccaactgttaaattagaacaaggaaccgttacatcgttacttgaagaaaatggaactatcaaaggtgtgaactacaaaaataagagtggtcaagagttcacagcaaaggctcctctcaccatagtatgtgatggttgtttttccaacttgaggcgttctctttgtaatcctaaggttgaagttccctctcattttgttggattgattttggagaattgtaatcttccacatgcaaatcatggacatgttatcttgggtgatccttcaccaattttgttttaccctataagtagtaccgagattcgttgtttggttgatgtgcctactggccaaaaattaccttctcttggtaatggtgaaatggcaaattatttgaaaactgtggtagctccccaggttcctcctgaactgcatgcttcttttattgcagcagttgataaaggaaacataagaagcatgccaaatagaagcatgcctgcatcaccttatcccacccctggggctcttctgatgggagatgccttcaatatgcgtcatcctttaacaggaggaggaatgactgtggctttgtctgacattgttttgctaaggaatctacttaaacctctgcgtaatctgcatgatgcttctgctctttgcatttacctcgagtcattctacaccctacgcaagccagtggcatctacaataaacacattagcaggtgcattgtacaaagtgttttgtgcatctcctgatccagctagcattgaaatgcgccgagcatgttttgattatttgagcctcggaggtgtttgctcagatgggccaatagctctactctccggtctgaatccgcgtccattgagcttggttctacatttcttcgcggtggctgtattcggtgttggccgcctcttgataccatttccttctccaaaacgaatgtggatcggagctagattgatttctggtgcatcaggtattattttccccattatcaaggctgaaggagtgagacaaatgttttttccagcaagtgtgccagcatattacagaatgcctcctgtccattaagatgtcctaataaaggcatggtgcaaatccaaatatggcccactaattgccaaaacggatgtgtggtggactctcttctataaattataaatatgaaaataatgtgcaactgcaacctgtattatttattgtactatataattttttgaagattttttatttgaattttggacaaaagaaattggaaattcagatttatgtcactgtagtattcatgtcatttatatgagaaataacaatccttgtctcttccaactttatgtattgatcgttagtatagtatggcattaataaac

SEQ ID NO: 3404 - DNA, 2128 bp, Malus domestica
acacccacatccctcctcctccatccgcatccacaccaatcaatttcaaattcacatccctcatcatctacctccaatctctctctcctcccataattccaaaaccagaaccagaaccagaagaaagcccaacattactagttgcacccactcccgcatttcttcatctgggtcgccgccttctccatctgggccttcttccttctcatctgggtcttcttctttctcatctgggttttcttctaagatggcggcaactgtggcggttgatccgtacgttctctggaccttcttcgcctccctcttaggttttctggctctctctgttctccgtcgccggaattccgaccacgccaagagcaatgctcagaagaacaagagtaatacgacgatcgttcaggataaaagcatcaacagctctgacgacggagaattccccccaattcacggctccggcaccgatgtaatcgtcgtcggcgccggcgttgctggcgctgccctcgcccttaccctcgccaaggagggaagacatgttcatgtgattgaaagagacttgacggagccagatcgaatcgtcggcgagcttctccagccaggagggtacctcaaattgatggagttgggtcttgaagattgtgtggaggaaatcgatgctcagcgagtggtcggttatgttctttttaaggatgggaagaacactcggctgacctatcctctggaacagttccactccgatgtggcggggagaagtttccacaatggccgattcatacagaggatgaggcaaaaagctgcaaagcttcccaatgtacaactggagcaaggtactgtaacgtccctgcttgaagtaaatgggacaattaagggggttcgatacaaaaccaaggatggtcaagaacttcaagcgcacgctcctcttacaattgtttgtgatggttgcttctcaaatctgcgccgcactctttgcaagcctcaggtagaagtgccctcttgtttcgtaggattaatcttggaaaattgcaaactcccatttgcaaatcatgggcatgttattctagcggatccctctccgatcctgttttatcaaatcagcagtacagaggtccgctgtttggttgatgtgcccggccaaagggtacctcccattgccaatggtgcaatggctaactacttgaagactgcggtggctccacaggttccaccggaacttcatgatgcctttgttgctgcaattgataagggaaatattagaacaatgccaaacagaagcatgccagctaatcctcagccaactccaggagcccttttgctgggtgacgctttcaatatgcgccatcctttaaccggcggaggaatgactgtggcactttctgatattgttgtactcaaggatcttcttaagccgctgcggaacctacatgatgcagcttcgttgtgcacatacctagaatccttttataccttgcgcaagccggttgcatctacgataaataccttggcaggtgccctatacaaagtgttctccacctcccctgatgaagcaaggacggagatgcgccaagcttgttttgactatctaagccttggaggtgcctgttcaactggaccagtggctttgctctctggtctaaatccttgtccgttgaatttagttcttcatttttttgctgtggcggtatacggtgttggtcgtttgctactaccatttccttcaccgagacgcgtgtggattggagctagattacttttgagtgcatcgggtataatattccccatcatcaaggctgaaggagtgagacagatgttctttccagctaccattccagctcatcatagagctcctcctgccgagtaagctacagaaaatgatgggggagagcaaggcagtggcatgcttcagacttgttgctgtcaagagtcgagataaaccagtcggtacctgcaaattctttcttgttaacgatagataaagaggaaatccaattgtattttccctaatgaattgtatcattatttccaaatatgtacatcttatagtggtatggctagaaaaaagaaatgtaaaagtatatgtgagatgtttgaattgaaaacaatatgaagaaatatacgtttcatatttgtgtta

SEQ ID NO: 3405 - DNA, 1926 bp, Glycine max
gcttctcttgagccacggatgcaaacacaactttactctaaatccatatcctcgttgtggccagccaagcagagagagaaactagagccagaaagagaaacaaagagagcgagagcgagagcgaaaacacctcaacgtcgtcgtcgtagccgagaggttcctcgcaatggtggacccctacgtgctcggatggatcatatgcgccgtgctcagcctcgtcgcgcttcgcaatttcgctttcgcgcggaagaaccgttgccattcgtctgagaccgatgccactcgccgcgcggaaaatgtcaccaccgccgccggagaatgcagatcctcgagtcgcgacggcgacgttgacgtcattattgtcggagctggtgtcgccggctccgctctcgctcacactctcggcaaggatgggcgtcgggtacttgtcattgaaagagatttgagtgaacaagaccgaattgttggggagttgctacaacctggaggctatctcaaattaattgagctgggacttgaagattgtgtggagaaaattgatgctcaactagtgtttggttatgctcttttcaaggatgggaagcacacaagactctcttatcccttggaaaagtttcactcagatgttgctggcagaagctttcacaatgggcgttttattcagaggatgagagagaaggctgcctccctttccaatgtacgactggagcaaggaacagtcacttccctacttgaagagaagggggttattaaaggtgtgcactacaaaacgaaggatagtcaagaattatcagcttgtgcaccccttaccgttgtttgtgatggctgtttctcaaacttgcgccgatctctttgtaatcctaaggtagatgttccctctcatttcgttggcttaattttggagagttgtgaacttccttatgctaatcatggccatgtcatactgggagatccttcgccagttctgttctatcggataagtagttcagaaattcgttgtctggttgatgttcctggtcagaaggttccatctatttcgaatggtgaaatgacaaattatttgaagacagtggtagctccacagattccacctgagcttcatgactcattcgtagctgcagtggacaaaggcaacatcaggacaatgccaaacagaagcatgccagcagctccttatcctacgcccggagccctgttgatgggagatgcattcaacatgcgccatcctctaaccgggggtggaatgactgtggcattatctgacatagtagtgctgcgaaatcttctgagacctttgcgtgacctgaatgatgcacctggcctttgcaaatacctagaatccttttataccttacgcaagcctgtggcatccactataaatacgttggcaggagcactttacaaggttttttgcgcatcacctgatccagcaaggaaggaaatgcgccaagcttgcttcgattatcttagtcttggaggtctattctcggaagggccagtctctttgctttcaggattaaaccctcggcccttgagcctggttctccatttctttgctgttgcaatatatggtgttggccgtttactgctaccatttccttcacctaaacggatgtggattggagtccgattaatttctagtgcatctggaatcatcttgccaataattaaggcagaaggagtccgtcagatgttcttccctgcaactgttccagcttactatagaaatcccccggcccaataaatgtgagttccgtgaacccatcatgagtcattcaagatgagccaccagtgttttccattcagaaaattaacgggttcaattgagatgtttgcaaacaatctggctttagtgtcatgtaaagtcgattttaaattaaatgtttgatttgttaatcttcttaaacgaggtgtaattcaaggcgc

SEQ ID NO: 3406 - DNA, 1859 bp, Triphysaria pusilla
caggtcataaaaattagggataaagaacaagagaattctcgaaaccctgttcgtcgtcacaccatttcattttttctaaaaatatggtgatgatcgaccagtatagttttgggtgttttgttgcttctttgtttgcattcgcgttgctgtacaatttgggaaggaaggtaaggagaacgaaaggtttgaaggcggtgcgtggagatgaatgtattacgagatccgccgtccggggggaggctggcggcgacgccgatattatcatcgtcggagcgggagttgcgggggcggctttggcttacactcttgggaaggagggccatcgagttcgtgtgattgaaagagacttgacagagccagatcgtatcgttggcgaacttttacagccgggaggttatttgaaattggttgagttagatcttgaagactgtgtgggcaatattgacgcccagcgagtttttggctatgctctttacaaggatggtaaaaacaccaagttatcttatcccctggataaattccactcggatgtctctgggagaagctttcacaatggtcggttcatacaacgcatgagagaaaaagctgcaactcttccaaatgtaaaacttgaacaaggaacggtgacgaccttgcttgaagaaaacggaaccgttaaaggagtaaattacaagaccaagaacggggaagagattgctgctcatgctcctcttaccattgtttgtgatggctgtttttcaaacctgaggcgggctctctgtactccccaggtggaaaacccttcttgtttcgttggattaataattgaaaactgtgaactgccacatgctaatcatggtcatgttatccttggtgacccgtcacctatcttgttgtatcctatcagcagcacagagatacgttgtttggttgatgtccctggacaaaaggttccttccattgccaacggagaaatggccaattatttgaagactgtggtggctcctcagattccacgtgagctgtataatgggtttattgctgcggttgagaaaggaaatataagaaccatgcccaatagaagcatgccagctaatcctcagccaactccgggtgcacttttgatgggggatgcattcaacatgcgccatcctttaaccggtggaggaatgactgtggccttgtccgacattgttgtccttcgtgatcttcttagacccatacaagatttaaatgacacttctaccctttgcaactatttagaatccttctacacccttagaaagccagtggcatcgactattaatacattggctggagcactttacaaagttttctgtgcatcgcctgatccagcaagtaaggaaatgaggcaagcttgtttcgattatttgagccttggaggcatttgttctgatggtcccatcgctttactttctggtttaaacccgcgccctttaagcctctttctccatttcttcgctgtggctatttatggagttggtcgtttattacttccgttcccttcacctcagagggtttggttgggagtcagattgcttttgggtgcatctggaataatatttccaattattaaagctgagggagttaggcaaatgtttttccctgctactgttccagcctactacagagctccccctgctaattagattaaatcgatcaaattgttgtactgttcattgtaattttctttttattttatttaggaaaacaaatcattttgcacgcattagaagaatcgattgttttgttctcaaggatcttatatagagcaagaaatacaatattacatctcaaacttgtattatgtgtctcaatttattacaatctctcttgaattatcaaaaaaaaaaaaaaaa

SEQ ID NO: 3407 - DNA, 2085 bp, Cajanus cajan
aaattttaagtaaagtaagcattccgtgttactttatttatttatttataaataaaataaaataagaagagagattgtgaagtagaaaatagtaaaaagtaatggaaaatacagcagacataggagtcgcgagagagagttgcctcttggatggcaatggtccaatactgaggaggtgaaaaagttatttggaattatcctttttcagtgccgtacagccatacgagccatgccatggctaccaccattcacgcccttctggaagcttctccttctccactccctttacctttagttaaaccacgtaaacacaacctttctaaattcacatcacagagagcaccgcaccgtcgttttcgccataatgatggactcctacgtccttggatcgatcatatgcgccctcctcggcctcctcgcgctcctcaattttcttctcgcaccgaagaacaaccgttgcgcggataacaacattaccaccgccgccggacaatgcattcctccaaccgccgcggagacggagacgtcgacgtcatcattgtcggagccggtgtcgctggctccgctctcgctcacactctcggcaaggatggacgtcgtgtacttgtcatagaaagagatttgagtgaaccagaccgaattgttggagagttgctacaacctggaggctatctcaaattaattgagctgggacttgaagactgtgtggagaaaattgatgctcagcaagtgtttggttatgctcttttcaaggatgggaaacacacacgactctcatatccgctggataagtttcattcaaatgtcacaggcagaagctttcacaatgggcgttttattcagaggatgagagagaaggctgcctcccttcccaatgtacgactggagcaaggaacagttacttccctacttgaagagaaggggataattaaaggtgtgctctacaaaacgaaggatagtaaggaattatcagcctgtgctccccttaccattgtttgtgatggctgtttctcaaacttgcgccgttctctttgtaatcctaaggtagatgttccctcttgtttcgttggcttagttttggagaattgtgaacttccttgtgcaaatcatggccatgtcatactgggagatccttcgccagttctgttctatcctataagtagtacagaaatccgctgtctggttgatgttcctggtcagaaagttccatctatttccaatggtgaaatggaaaattatttgaagacggtggtagctccacaggttccttctgagcttcatgatgctttcatagctgctgtggacaaaggcaacatcaggacaatgccaaacagaagcatgccagcagctccttatcctacacctggagccctcctgatgggagatgcattcaacatgcgccatcctctaactggtggtggaatgactgtggcattatctgatatagtagtgctgcgaaatcttctcaggcctttgcgtgacctgaatgatgcctccagcctttgcaaataccttgaatccttctataccttacgcaagcctgtggcatccactataaatacgttggcaggagccctttacaaggtcttctgcgcatcacctgatccagcaaggaaggaaatgcgccaagcttgtttcgattatcttagccttggaggtctattctcggaggggccagtctctttgctttcaggattaaaccctcggcccttgagcctggttctccatttctttgctgtcgcaatatatggtgttggtcgtttattgctaccatttccctcacctaaacggatttggattggagtccgattaatttctagtgcatctggaatcatcttgccaataattaaggccgaaggagtccgtcagatgttcttccctgcaactgttccagcttactaccgcaatccccccgcttcataaacgtgaattcgttttcatgagtcgagatcaaggatcaagatgcgcttgcagtgctttcccgttttccgaaatttattgggttcattgaatttcattccgaaattccagtaaacattctggctttatgtatgaattttctgtagaatcgttttcagaataaaa

SEQ ID NO: 3408 - DNA, 2301 bp, Glycine max
acagtaactgtaaccgttccaaatttctatgccagcgaggcagagagagaaactagagcgagaaagagagagagcgccacgcaccgttcattccttcgtcctcgccgtttctaaccgtcgcagttttccggcgaagtttctccgatttgtttaaccgaaatggcggatctgtccgttctcggttggattctgtgctccgctctgagcctcttcgcgctctacagcctggccttcggcggagcgagccgtaaccgcgcttcgccggagaagaggaatgagttatcggagaccgtgacgacctccgccggagaatgtagatcagagaaacaccacggcgacgctgacgtcatcattgtcggagccggcgtcgccggcgcctctctggcgcacactctcggcaaggatgggcgtcgggtacacgtcattgaaagagacctgagtgagcctgatcgaattgttggagagttgcttcaacccggtggctatctcaaattaattgagctcggacttgaagattgtgtggacaaaattgatgctcagcaagtgtttggttatgcccttttcaaggatgggaaacatactcgtctctcttaccccttggagaagtttcactcggatgtctctggcagaagctttcacaatgggcgctttattcagaggttgcgggagaaagctgcctcacttgccaatgtacgattggagcaaggaacagtcacttccctggttgaagagaagggaacaattaaaggtgtgcaatataagaacaaagatggccaggagttgacaacatatgctcctcttaccattgtttgtgatggttgcttctcaaacttacgccgttctctttgtaatcctaaggtggatattccctcatgttttgttggtttagttttagagaactgtgaacttccatgtgcaaatcatggccatgtcatactgggagacccttcgccgattctattctatcctatcagtagtacagagattcgctgtctggtcgatgtacctggtcagaaggttccttctatatcaaacggtgaaatggaaaagtatttgaagacaatggtggctccacagatccccccccagctttatgatgccttcattgctgctgttgacaaaggcaacataaggacaatgccaaacagaagcatgccagcagatcctcatcctacacccggagcccttctgatgggagatgcattcaacatgcgacatccactaactgggggaggaatgactgtagcattgtctgatattgtggtgctgagaaatcttctaagccctttgtctgacctgaatgatgcacccacactctgtaaataccttgaatcattttataccttgcgtaagcctgtggcatccaccataaatacattggcaggtgctctttacaaagtattttgtgcatcccctgatctggcaaggaaggaaatgcgccaagcttgcttcgattatctcagccttggaggcctattctcggaaggaccagtctctttactttctggattaaaccctcgtcccttgagcttggttctccatttctttgctgttgcaatatacggtgttggccgtctattgttaccatttccttcacctaagagagtatggatcggagcccgattaatctcgggtgcatctgcaatcatccttcccataattaaggccgaagggattcgtcagatgtttttccctgccactgttccagcttattacagaactcctccagttgcacaataaattgagggaaggttgaagttcgtagttctgtaagcattttggcttcttttgtgtgtattctttgtagtctgtagcttgtaatgtttcaattgaatgtatcatctctgtctctctctctctctctcctttttggtacactagaaattaaatccatgatattaaactaaattacaatccactctgggcacttaaactaaagtatagcattttcgcaaacgagtttattgagtatccacctttgaatggaaagtcaaagccccactattgaatggaaagactccctatgagctgttcaatgagtatccaccttcctatgatcatctaagtgtgtttggttttctgtgtcatgcatacaactagagaacgtagtgcaaagtgtgttcgtagggtgtcaagctggaaagaaagggttaattttatttgatttagagtcgatttagaggaatcatctattttgcgttaaaagacattgacttctttaagaatgagtttctctccccccccaatctaacttgatgaatgataaataatagtatagtgataaacttgctgcttatgctg

SEQ ID NO: 3409 - DNA, 1720 bp, Flaveria ramosissima
atcttctagagagacaaacagaaaaaacccgtgcaaccaactcacgagtcaccacgagtcacgactcacacaccaccactgtaatttcttcttcacatttcattttcatggagcttgaatcacccacactgattcaccagatcaacgatcatcttcttccttacgccgttgcgttgctatttgccttcatctccttgtacatcctcaggtccaatctcaaaacacctcgtaaaccgaaggacattgctcccaaatgtcatactaactccggtgaccacggaatactccagctgccggagactgacggaagcgctgacgtcattatcgtcggagccggtgtcgccggtgctgctcttgcttgtactctcgcaaaggatggacgacgagtgcatgtgattgaaagggacttgactgaacccgatcggattgtgggtgaacttctacagccgggtggctatctaaaactgattgagttgggtcttgaggattgtgtggatggaattgaggctcaacaagtctttggttatgccatttacatggataacagaaacacaaaactttcttatcctttggaaaagtttgaatctgatatatctggaagaagctttcacaacggacgctttattcagcggatgagggagaaagctgcatctcttccaaatgtgaaactggaacaagggactgtaacttcattgcttgaggaagacggaacagttaaaggggtgaattacaaaaccaaagacggacaagtgatgactgcacgcgctccacttaccattgtttgtgatggttgtttttctaatctgcgacgcgccctctgcaagcctaaggtagaagtgccttcttgctttgtgggtctggttttggagaatattgatcttccatatgcaaaccatgggcacgttatactcgcagatccttcaccaatattgttttatccgattagtaacacagaggttcgttgtttggttgatgtccctggacagaaggtaccttctattgccaatggagaaatggccaattatctcaaaactgttgttgctccacagattccacccgagttatatgatgcatttgtggctgcagtagataaaggtaacataagaacaatgccaaacagaagcatgccagctgatcctcagcctactcccggtgcacttttaatgggagacgcgtttaatatgcgacacccgttaaccggtggaggaatgacggtggctttatcagatatcgtgttacttcgtgaccttctgagaccattaagtaatcttaatgatgcaactacactttgcaattatcttgagtgcttctatactcttagaaagccggtgtcatctacaataaacacattggcgggcgctctatacaaggtcttttgcgcatcaccagatccagccagaaaagaaatgcgtgaagcatgctttgattatctaagcctgggaggcatttgctcacaaggaccgatatctttactttcggggctcaacccacgcccgctagtcctgtttctacatttctttgctgtggccatctacggtgtcggtcgtttgcttatcccattcccatcaccaaaacggttatggcttggggctcgactcatctcgggtgcatcagggatcatctttccaattatcaagtctgaaggggttaggcaaatgttctttcctgcaacagttccagcatactacaaagctcctcatgttacttgactttaacatga

SEQ ID NO: 3410 - DNA, 1872 bp, Brassica napus
gtgacacatctcctttctcgttctctccgctgagaaatcgaaacttttctgttaatggtaacgacgatgatggagcctcaattactcggttggctctcgcctctcgtgatctccttcgttctagtcacctccgtcttcgctttctacgcacttttcgtgaagccgaggcggaacagtaataaactagactctacaacttcgaagatccatcacgatcggaccgtcacctcaaccgtcggatccctgaacgttagcgtcggagatacagtctctgatgttatcgttgttggtgccggagtcgctggttcggctctggcctacactcttggaaaggataatcgtcgagttcatgtgattgaaagagatttatcagagccggatcgtatcgttggggagcttttacaacccggtggctatctcaagttacttgagttgggtattgaagattgcgtggaggaaatagatgctcagcgagtgtatggttatgcacttttcaagaacgggaaacgcattcgcttagcttaccccttggagaagtttcacacagatgtatctggaaggagctttcacaatggtcgctttattcaaagaatgcgtgagaaagctgcttcacttcccaatgttcagttagagcaaggaacagttgtttctcttctagaagagaatggaacaatcaaaggtgttagatataagaataaagcaggagaggaatcaacagcatttgcagctttgactatagtctgtgacggttgcttctcaaacctgcgtcgctctctatgcaatcctcaggtcgatgtaccatcatgttttgtgggtttggtcctagagaactgaaacctcccatacgcaaaccacggacacgtcgtcttagcagatccatcaccaatcttgatgtatccaatcagcagcacagaggtcagatgtctggtcgacgtccctggtcagaaagtgccttctatcgcaaacggtgaaatggaaaactatttgaaaaccgttgtggctcctcagatgcctcatgaggtctatgactctttcatcgccgcggttaacaaaggaaacatcaagtccatgcccaacagaagcatgccggcttctccttaccctactccaggagctttgttgatgggagacgcattcaacatgcgtcatccgttaacaggtggaggcatgacggttgcgttatccgacattgttgtcctgcgtaatctccttagaccgctccgtgaccttagtgacggttctagtctctgcaaatatctcgaatctttttacactctacggaagccagtggcgtcaacgatcaacacccttgcgaatgcgctttacaaagtgttctgttcgtcgaaagatgaagcgagaaacgagatgagggaagcttgttttgattatctgagccttggtggtatgtgcacgagcggaccagtgtctttgctttcgggtttgaaccctcgaccgttgactcttgtctgccatttctttgcggttgccgtttatggagtcattcggttgttaatccccttcccttctccaaaacgcatgtggcttggagccaaattgatctcgggagcatcggggataatatttccgataataaaagcggaaggagtgaggcagatgtttttcccagcgactgtgcctgcatactacagagctcctccggttaaaggagaaaccaaatgttcatagctccagtttgattctctatcacaagaaatgacgtccaaaagaaaatgaaaaaggcactaaagagatcaactttgtggcgagttttgttgtgtctgtgtgtttttaaacgtatgaatgattgattatttctgttttataggttgcgacggttgtatcttactaatggaatatcattctttttcgtag

SEQ ID NO: 3411 - DNA, 2143 bp, Phaseolus vulgaris
taactgaaaccgttccaaatttcctctgccagataggcagagagagaaagtagagcgagagaggagagagagcgaacagaaccacacgcatatctttgttcttcctccgtcggggttcgcgtcagcgtcgccgtcgttcttttctccgatttgtttttccgaaatggtggatccgtacgttctcggctggattctgtgctccgttctgactctcttcgcgctctacagcctcgccttcagcggagagagccggcgtcgagcttcgccgaaggcggagaagagcatcgagctttcggaaaccgtgaccacctccacgagtgaatgcagatcggagaaacgcgacgccgacgttgacgtcattattgtcggagccggtgtagccggcgcggctctagcgcacactctcggaaaggatgggcgtcgagtacacgtcattgaaagagatctgagtgagcctgatcgtattgttggagagttgttacaaccaggtggctatctcaaattgattgagctgggtcttgaagactgtgtagacaaaattgatgctcagcaagtgtttggttatgccctttttaaggatgggaaacatactcgtctcgcttaccccttggagaagtttcactcagatatctctggcaggagctttcacaatggtcgcttcattcagaggatgcgggaaaaggcttccacccttcccaatgtgcgattagagcaaggaacagtcacttcccttgttgaagagaaggggacaattaaaggtgtgcaatataagaacaaagatggccaggaattgacaacatttgcacctcttaccattgtttgtgatggctgcttctcaaacttacgccgttctctttgtaatcctaaggttgatgttccctcatgttttgttggtttacttttagagaactgtgagcttccatgtgcaaatcatggccacgttatactgggagacccttcaccaattctattctatcgtataagtagtacagagattcgctgtctggtcgatgtacctggtaagaaggttccttctatttcaaacggtgaaatggaaaagtatttgaagacaacagtagctccccagattcccccagaactttatgatgccttcatagctgctgtggacaagggcaacataaggacaatgccaaacagaagcatgccggcagatccccttcctacacctggagcccttctgatgggagatgcattcaacatgcggcatccactaactggaggcggaatgactgtggcattgtctgatattgtggtgctgagaaatcttctaaggcccttgcctgatctgaatgacgcacccactctctgcaagtacctcgaatccttttataccttgcgtaagcctgtggcatccacaataaatacattggcaggtgctctttacaaagttttttgtgcatcccctgatcaggcaaggaaggaaatgcgccaagcttgctttgattatctaagccttggaggcctattctccgaaggaccagtttctctactttcaggattaaaccctcgtcccttgagtttggttctccatttctttgctgttgcaatatatggtgtgggccgtttattgttaccgttcccttcacctaagagagtatggattggggcccgactaatctctggtgcttctggaatcatcttccccataatcaaggcggaagggattcgtcaaatgtttttccctgtgactgttccagcttattacagaactcccccggttggacaatagtgagtatgtttttatacattttcagaaaatcaaggtgctctctggatgaacaagttagctttctttgtcttccatttttcggaatttgaggaaaggttgaagttcctatttctttaagcattttggtttctttagtgtgtattctttgtagtctgtcactcatacactgtttaagtgcatgtaatgatatctctttccctttctgctcctctagaaatcaaatccttcattgatcttaaactaaactaccatccaagtgaagcaaatgaatttaattataatctccattctcatattatcatttagatttaagtacatttaaatatgtatttagtatctattttttttaattttatatttagtacatgacaaaaaaaatttcttgacctttta

SEQ ID NO: 3412 - DNA, 1988 bp, Phaseolus vulgaris
cgttccaaatttcctctgccagataggcagagagagaaagtagagcgagagaggagagagagcgaacagaaccacacgcatatctttgttcttcctccgtcggggttcgcgtcagcgtcgccgtcgttcttttctccgatttgtttttccgaaatggtggatccgtacgttctcggctggattctgtgctccgttctgactctcttcgcgctctacagcctcgccttcagcggagagagccggcgtcgagcttcgccgaaggcggagaagagcatcgagctttcggaaaccgtgaccacctccacgagtgaatgcagatcggagaaacgcgacgccgacgttgacgtcattattgtcggagccggtgtagccggcgcggctctagcgcacactctcggaaaggatgggcgtcgagtacacgtcattgaaagagatctgagtgagcctgatcgtattgttggagagttgttacaaccaggtggctatctcaaattgattgagctgggtcttgaagactgtgtagacaaaattgatgctcagcaagtgtttggttatgccctttttaaggatgggaaacatactcgtctcgcttaccccttggagaagtttcactcagatatctctggcaggagctttcacaatggtcgcttcattcagaggatgcgggaaaaggcttccacccttcccaatgtgcgattagagcaaggaacagtcacttcccttgttgaagagaaggggacaattaaaggtgtgcaatataagaacaaagatggccaggaattgacaacatttgcacctcttaccattgtttgtgatggctgcttctcaaacttacgccgttctctttgtaatcctaaggttgatgttccctcatgttttgttggtttacttttagagaactgtgagcttccatgtgcaaatcatggccacgttatactgggagacccttcaccaattctattctatcgtataagtagtacagagattcgctgtctggtcgatgtacctggtaagaaggttccttctatttcaaacggtgaaatggaaaagtatttgaagacaacagtagctccccagattcccccagaactttatgatgccttcatagctgctgtggacaagggcaacataaggacaatgccaaacagaagcatgccggcagatccccttcctacacctggagcccttctgatgggagatgcattcaacatgcggcatccactaactggaggcggaatgactgtggcattgtctgatattgtggtgctgagaaatcttctaaggcccttgcctgatctgaatgacgcacccactctctgcaagtacctcgaatccttttataccttgcgtaagcctgtggcatccacaataaatacattggcaggtgctctttacaaagttttttgtgcatcccctgatcaggcaaggaaggaaatgcgccaagcttgctttgattatctaagccttggaggcctattctccgaaggaccagtttctctactttcaggattaaaccctcgtcccttgagtttggttctccatttctttgctgttgcaatatatggtgtgggccgtttattgttaccgttcccttcacctaagagagtatggattggggcccgactaatctctggtgcttctggaatcatcttccccataatcaaggcggaagggattcgtcaaatgtttttccctgtgactgttccagcttattacagaactcccccggttggacaatagtgagtatgtttttatacattttcagaaaatcaaggtgctctctggatgaacaagttagctttctttgtcttccatttttcggaatttgaggaaaggttgaagttcctatttctttaagcattttggtttctttagtgtgtattctttgtagtctgtcactcatacactgtttaagtgcatgtaatgatatctctttccctttccgctcctctagaaatcaaatccatcattgatcttaaactaaaaaa

SEQ ID NO: 3413 - DNA, 2055 bp, Eucalyptus grandis
caccacacgcaaacatagtctgagcttgcacatttcggaaatcccgtaaagcagcacagcttgcaccgcaagagccgagctccatcggcggacgtttctcgatctctctgctgccgcgtcgcggaggttggtggagctgttgagccgggatcggtctctgatggacggtcagtacttggtcagtggcgtcttggctctgttcctggggatcttcctgctgtacaaggggctcgggaagcagaagaggaggctgtccaagaagggtcgcggcgatgactatgtgaagagctctgtggatggaggtttcgtgcccggcggcgtcgatgggagcaccgacatcgtcattgtcggagcaggcgtcgccggtgcggctctcgcttacgcgctcgggaaggatggacgtcgcgtgcgtgtaattgagagggacctgacggagcaagatagaattgtcggcgagcttcttcaaccaggaggttacctgaaattgatggaattggaccttgcagattgcgtgcaaacaattgatgcccaaagagttgttggatatgctcttttcaaggatgggaaacacacgcagttgtcttatccattggagaattttcattcggatgttgccggcagaggttttcacaacggccgtttcgttcaaagcatgagggaaaaggccgcaactcttccaaacgtaagtctagaacaagggacagtaacatctctaattgaggaaaagggaactgtcaagggagtgcaatacaagaccaaggctggggaagagttgaaagcatatgctcccctcaccatcgtatgtgacggttgcttttcaaacctacgccgtaacctctgctttccgaaggttgatgtcccctctcatttcgtggggttggtcgtggagaattgtgatcttccattcccaaatcacggccatgtcatactggcagacccttcgcctatcttattttatccgatcagcagcactgagatccgttgtctggtcgatgtccctggccagaaattgccctctttagccagcggtgaaatggccacatatttgaagacaaaggttgctccccaggttccccctcaattgtacaaagccttcatcgcagcaattgacaagggaaacatcaagtcgatgccaaatagaagcatgcctgctaatcctcaacccacccctggagctcttctgatgggagacgcgttcaacatgcgccatccattgacaggaggaggaatgaccgtggctctttctgatatcgttttgctaaggaacctccttcgcccacttcaggatctgaatgatgcatctgctctatgcaaatatctcgagtcgttctatacactgaggaagcctgtggcgtcgaccatcaacaccctggctggtgctctgtacaaggtcttctgtgcatctccagacccggcaagaaaggaaatgcgccaggcatgcttcgactatctgagccttggcggtctatgctcaactgggccagtctctctgctctcgggtctaaacccccgtccaatgcacttggtctgccatttctttgcagtagcagtatatggtgtcgggcggctatgtcttccattcccttcgccgaaacgcatgtggctcggggccagactggttaagggtgcatcaggtatcatctttcccataataagggatgaaggagtaaggcagatgttcttccctgcgactgtgccggcttaccacagagctcctcctgttcactgagagaatgcagcaaagctcgataagcgcatgaatatgcggtcaagttcgtttcttctagtcacattcctctctcgtagtagatggagaggcctgctagttatactgcactcggaagagaaatgtgcattggaactatagatttcgttacgataagtagattcattcagaaccagattttctcaggaaccttgtaactttcctatgttctctagctgatccaatcaaatgttaataaatactactttgctcttttctgtacgtcgcctattactttggaatcaccatttcactccaccttatagaagaacggaaataaatggttgata

SEQ ID NO: 3414 - DNA, 1811 bp, Plantago ovata
tcactacattctcaccggtttcgtcgcttctatgttcggatttgtccttctctacagcctcacaaggaaggttaaaaacctaaaggttcatccaagactcagcctactgatgaaaaatgctttcagagtgaagtttcccggccggttgacaacggcgacgcagacattatcatcgtcggcgctggtgttgctggtgccgctctcgcttatactctcggcaaggagggacgacgggttcgcgtgatcgaaagagacttaacggagccagaccggatcgtcggtgagcttctacagcctggaggctacttgaagttggttgaattaggccttgaagattgtgtgggtgatattgatgctcaacgagttttcgggtatgctctttacaaggatggtaaagacaccaagttgtcatatcccttggaggagtttgagtcggatgtttccgggagaagctttcacaatggtcgtttcatacagaggatgagagaaaaggcttcaacactttcaaatgtaagacttgaacaaggaacagtgacatctttgattgaagaaaaaggaactgttaagggagttcaatacaagactaaggacggtgaagagataagcgcttttgctcctctgaccattgtttgtgatggctgtttctcgaacttgaggcgttctctctgcacacctaaggtggaaaatccatcttgttttgttggcttaatcctggagaactgtgaactaccgtatgctaaccacgggcatgtggttcttggtgatccttccccgattctattctatcccataagcagcaccgaaattcgctgtttggtagatgtccccggacaaaaggtgccttctattggcaatggcgaaatggccaattatttgaagaccgtggtggcaccacaggttccacctcagctctatgattcatttatagctactgttgagaaaggaaacataaggactatgccaaaccgaagcatgcctgcaaatcctcagccaactcctggtgcacttctgatgggagacgcttttaacatgcgtcatcctctgacaggaggaggaatgaccgtggccctatcagatattgttattcttcgtgatcttctcagacctatccgtgatctacatgatgcacctgtcctctctaactatcttgaatccttctacaccttaaggaagcctgtgtcatctacaatcaacacattggccggtgcactatacaaagtgttttgtgcatcacctgatccagcaaggaaagaaatgcgtcaagcttgtttcgactacctgagccttggaggtgtttgctctaccggccctgtagctttactttccggcctgaacccacgccctttaagcctcgtcagtcatttcttcgctgtggctgtatttggtgttggtcgcttgttacttccatttccttctccgaagagggtttggttgggagcaagactgctcatgggcgcttctggaatcatcctcccaattataaaggcagagggagtgaggcaaatgttcttcccggccacggttccagcagtttacagagctccaccggttaactagttgtatcaatcaataaatgtataataactcgaaaagtcttcattagttttttcctaagtcatacatagctgaaagatcgtatagaggaatataatgtaaaacaacattttatcaaagacttgtacactagattctgcaattggaactatctatgtaagctcttgactctgtatcagtgtaactggtatgtaattcatttgtttccagtccctttcctatctagccgtttcttccggccttcatcaagctttatc

SEQ ID NO: 3415 - DNA, 2333 bp, Zostera marina
aaattgcaaaacaaaacgttggaagagacggacggttccatccaccacaatggagatgttgccgttgatgcaatacttgtttgctggaatcgttgccgttctggtagggtttttctttctcttttggaggaagacgaagacgaagacgaagaatggaataccgccgaagaaggtagagaacgagaagagatccagcgtcaaaacagatgaccaagatggaaattacgatgtcattattgttggtgctggtgtcgctgggtctgcacttgcctatactctcggaaaggatggccgtcgtgtgcgcgtcattgagagagatctttccgaacctgacagaattgttggggaattattacaacctggagggtatcttaaactggttgaactagatcttgaagattgtgtggaagaaattgacgctcaacgagttaatggatatgcacttttcaaggatggaaggaataccaaggtggcatatcctctggaacaattcgattcagatgttgcaggcaggagctttcataatggtcgcttcatacaaaggttacgtggaaaagctgcatctctccccaatgttctattggaagaaggaactgtaaaatcactgctagaagaaaatggttctgttaaaggggtgttatacaaaactaaaacatgtgaagaaataaaagtatatgcacctctcacaattgtctgtgatggctgtttctcaaacttaagacgatctctctgctctcctaaggtagatgtgccttcttgttttgttggcttagtgctggagaattgtgaacttccatatccaaaccacggtcatgttatcttggcagatccatcaccaattctcttttatcctattagcagcactgaggttcgttgtttggtcgatgtaccaggggaaaaagtaccatctgttgcaaatggagagatggcaaaatatttaaagactgtagtggcgccacagctacctcctgaaattcaaattccctttctagccactgttgaaaagggaaatatgagatcaatgcctaacaagagtatgcctgctgctccttatccaactccaggggctctccttatgggggatgcattcaatatgcgacatcctttaactggtggaggaatgacagttgcattgtctgatattgctgtattaaaaaatctcctgaagcctctgcgtgatctgaatgacacttcgtctttatgcaaatatctggaatcattttataccctgagaaagccagtagcatccacaatcaatacactggcaggtgctctatacaaggttttctgtgcttcaccagatcaggccatgaaggaaatgcgcgaagcttgttttgattatctgagtttagggggcgcgttctcaaatggtccggtggcattactctcaggtttgaatccccgtccactgagtctggtgtgccatttctttgctgttgcgatttatggtgttggccgcctgttgattccctttccttcaccaaagcgtatctggattggagctagattaatttcgggtgcttcaaatatcatctttcccatcataagggctgaagggattaggcaaatgttttttcctgcaactgttcctgcatattacagagctcctcctgtgaactaattaaaaaacacgttgctttaaaaacctgtaatatattattaattacactccctgcttctagaaattgtatgcgtctattaaaatttggcaatttggccattgaataatgaataattttagggtgactacttttagattaaatacattattggtaactgtctatttacttaaaaaagttatttaatttaatttgactggtgctttgtacactacaaaatcatttttgcagatattggcgtatccaaccagctaaatccaggtctcttaatcacccctgtctgcttcatctgttcccggacatgagaagcttcttcccactgcccagatgctgcatttagattagacaaaaacacgtacactgctgggctctccggctccatctccagtagccttgctgccgcaattcttcccagttttagattaccatgaaaactgcaagcactcagaagcgcccaccaaatatgactatctaataatctgcatgattcaccaaatttgcacacgattttctccacttcatccaaataaccatttctgctcagaacatcaatgatgcaggagtaatgatccacaccaggttctatatcatagtcttcaatcattgacgagaaaatgcggcaagcctcctcgacgagaccacaatggctacatgcagaaaggatgatggtaaatgtcaccccgtctggctctatttccgaatcttgttgcattt

SEQ ID NO: 3416 - DNA, 1596 bp, Euphorbia peplus
atggaggttatttttgacacctacatttttggtactttctttgcttctctgtgtgcctttctccttctcttcattttgcgccctaaagtcaagaagatggggaaaatcagagaaatatcctccatcaacactcaaaatgacactgcaattacgcctccgaagggctccggcaccgacgttatcattgtcggcgccggcgtcgccggtgcagccctcgcttgcactcttggcaaggatggaaggcgagttcatgtgatagaaagggatttgaaagagcctgacagaattgtgggcgaacttcttcaaccagggggatatcttaaattagtggaattaggtcttcaagattgtgtggaggaaattgatgcccagcgaatagttggttatgctctattcatggatgggaataatactaaattgtcatatcctttggaaaagtttgatgctgaggtttccggaaagagctttcataacgggcgtttcattcagaggatgagagaaaaagctgctagtcttcccaatgtgcaactagagcaaggaacagtgacatctctgcttgaagaaaatgggactataaagggggttcagtacaagactaaggatggtcaagaacataaagcttatgctcctctcactgttgtttgtgatggttgcttctcaaatctgcgtcgctctctgtgcaaacccaaggttgatgtgccctctcattttgtgggtttagtcctggagaattgtgacctcccttttgccaatcatggacatgttattcttgcagacccttcaccaattttattttatccaatcagcagcacagaagttcgttgtttggtagatgtgccgggtcagaaattgccctcaattgcaagtggtgaaatggccaagtatctgaagaccatggtagcgaaacagattcctccagtccttcacgacgcctttgtatctgccatagacaaaggtaatatcaggaccatgccaaaccgaagcatgccagctgatcctcttcctactcctggggctcttctgatgggtgatgcattcaatatgcgccatccattaactggtggtggaatgacagtggcactggctgatattgttctgcttcgggatcttcttaagccactccgtgaccttaatgatgctcctgctcttgccaaatatctagaatccttttatacgttgcgcaagcctgtggcatctactataaacactctggcgggtgccctgtacaaggtgttttctgcatcccctgatgaggcaaggaaggaaatgcgtcaagcttgctttgactatttaagccttgggggtgaatgtgcaatgggacctgtgtctttactctctggtctaaacccaagtccgctaaccttagtccttcatttctttggtgttgcaatatatggagttggccgtctgcttattccatttcctacacctaaaggcatgtggattggggctagaatcatttcaagtgcttcaggtattattttcccgatcatcaaagccgaaggagtgaggcaagtattcttccctgccactgttcctgcaatttacagaaaccctcctgtcaatggtaaatcggtagaggtgcccaagtcctag

SEQ ID NO: 3417 - DNA, 1077 bp, Arabidopsis lyrata
aagaagatatttgttgtccatggcgggtacttgcacttcaattaggccacgtctcattggctcttcttcaattgttgagctttccaggttaattaatcgagctggagttcctttctctgtacgaatctctaccagaaccagagctctccacggtggtggtttaaccgcacctacctctcgtgaggaaggtccttcttgtatcttcgttggaccgattgattctgctcgcaaagaaactctagaagctctttatcgccaagcgaaggatgcgtattacaatggcaagcctttgatagttgatgacatgtttgacagagttgagctaaagcttcggtggtatggttcaaaatctgttgtcaagtaccctcgttgtagtctactgagacagtcaacttatgctgatgcagaggatgatgcatcacaagttctcctgttagctaccatatggatcttgattttcttatttggtagctcggcatgtgttttgcccacgatgtatggccttggcctagtctatggaggagatccggtcgactcagggcttgtctatagcggtcaattgtcatcttctgtgcctcttttgtcaaagtttaacggcatcctcctcgccgtgctaggacctgcttttggatatccaattgcatcttctgcagtaagagtacttaaagggttatggagaaatgacttaacggctctaaaaggagactgcccgaattgcggggaagaggttttcgcatttgtgagatccgatcaatcaaaccgatcagctcacaaagccgactgtcacgtttgtgagtgcacactggagttccgtaccaaagtagagaaatctacatcacgattgggtagaaaatgggtttacggcaggatataccttgtttcacggccaaggagagatcggcgttccaagtttacataattctgacaaaagaagaaagattttttggggatggtttctactcaattgtgtattgtaaaaaggatactagaaagcttttgtagcatgcagaagattcgtaaaattgttactataacgtttttgtctcttgtagccttatcttcagacagtttacaaaa

SEQ ID NO: 3418 - DNA, 1144 bp, Eutrema halophilum
gaagacgattactacttcttcttcttcttcttcttcttcttcttcttcttcttttttggttcatggcgggcacttgtacgtcgattaggcctcgcctcttaggctcttgttcgattgctgagctctccaggttgatcaatcgagccggagttcctttctctgttcggatctccaccagaaggtccagaacccgaggccacggaggtggtttcacggcacggaccttacgtgaggaaggtccttcttgcatcttcgtcggtccgattgattccgcccggaaagaaaccttagaagctctctaccgccaagcgagggatgcgtattacaacggcaagcctttgatagttgatgacatgtttgacagagttgagctaaagcttcggtggtatggttcgaaatcggttgtcaagtaccctcggtgcagcctcctgcgacagtcaacttatgctgatgcagaggatgatgcatctcaagttctcctgttagctaccatatggatcttgattctcttgtttggtagctcagcatgcgttttgcccgcgatgtatggcctcggcttagtctatggaggagatccgtttgactcagggcttgtctatacaggccaattgtcatcttctgtgcctcttttgtcaaagtttaacggcatcctcctcaccgtgctaggacctgcttttggatatccgattgcatcttctgcaatgagagtacttgaaggcctatggagaaatgacttaacggctctaaaaggagactgcccaaattgcggggaagaggtttttgcattcgtgagatccgatcaatcaaaccgatcagctcacaaagccgactgtcatgtctgtgagtgcaccctggagttccgtaccaaagtggagaaatctgtgtcaccattgggtagaaaatgggtttacggcaggatataccttgtttcacggccaaggaggaaccggcgttccaagtatacataattctgacaaagacaaatagaattttttggtttctactcaattgtgtatctttttatttaaaagaaagaaggatattagaaactagaaaggtgtttgtatcattcaaaatattcataaaagttttactatgtaacgttttgtctcttgtagcctttttcttcccacagtttacaaaa

SEQ ID NO: 3419 - DNA, 1327 bp, Brassica rapa
gtaaacgcatgttgcgtgcacgcgccgaatcgtatcgtgtggccaccatttctcgaaccgaacagcctccaccacacgcttcttcttcttcttcttctgttttgtcttttcggttttctttccccggcgagggatagatatttttgtttatcatggcgggcacttgcagctcgataaggccaccacgcctcattggttcttgttcgagtcttgagctttccaggttgatcgatcgagctggagttcctttctccgttcggatctctaccagaagaaagtccataacaagaagccaaggaggtggtttcaccgcacctgtctcctcacgtgaggaaggtccttcttgcatcttcgtcggtccgattgattccgcaagaaaagaaactctagaagctctttaccgccaagcgaagaatgcttactacaatggcaagcctttgatagttgatgacatgtttgacagagtcgagctgaagcttcggtggtatggttcgaagtctgttgtcaagtatcctcggtgcagcctcctgcgacagtcaacttatgctgatgcagaggatgatgcatcacaagttctcctgttaggtaccatatggatcttgattctcttgtttggtagctccgcatgtgttttgcccaccatttatggcctcggcttagtctatggaggagatcctttcaactcagggcttgtctacagcagctcgacttctgtgcctcttctctcaaagttgaatggtatcctcctcaccgtgctaggacctgcttttggatatcctattgcatcttccgcagtaagggttcttaaagggctatggagaaatgacttaaccgctctaaaaggagactgtccaaattgtggggaggaggtttttgcatttgtgagatccgaccaatcaaacaagtcagctcacaaagccgactgtcatgtctgtgagtgcacactggagttccgtactaaagtggagaaatctgcatctctattgggtagaaaatgggtatacggcaggatataccttgtttcacgtcccaggagaggtcggcgttccaagtatacatagttctgatcaaagacgagataattttttggggatgggtctctctactcaattgtctatttattttaaaaaaggttactagaaagcttttgtaacattcaaaaagttcaatatatctgtaactataaacgtttctacacacttgaaagtatagtgtttttggagaattttcttgaaaattttattgatcatcataattttaggaatgagctgtatcacatgttagatctgatgccctcaaaatattatttttatattgtgtacctttt

SEQ ID NO: 3420 - DNA, 996 bp, Brassica napus
gagggatagatatttttgtttatcatggcgggcacttgcagctcgataaggccaccacgcttcattggttcttgttcgagtcttgagctttccaggttgattgatcgagctggagttcctttctccgttcggatctctaccagaagaaagtccataacaagaagccaaggaggtggtttcaccgcacctgtctcgtcacgtgaggaaggtccttcttgtatcttcgtcggtccgattgattccgcaagaaaagaaactctagaagctctttaccgccaagcgaagaatgcttactacaatgggaaacctttgatagttgatgacatgtttgacagagttgagctgaagcttcggtggtatggttcgaagtctgttgtcaagtaccctcggtgcagcctcctgcgacagtcaacttatgctgatgcagaggatgatgcatcacaagttctcctgttagctaccatatggatcttgattctcttgtttggtagctccgcatgtgttttgcccaccatttatggcatcggcttagtctatggaggacatcccttcgagtcagggcttgtctatagcagctcgtcttctgtgcctcttctgtcaaagttgaatggtatcctcctcaccgtgctaggacctgcttttggatatccaattgcatcttccgcagtaagggttcttaaagggctatggagaaatgacttaaccgctctaaaaggagactgtccaaattgtggggaggaggtttttgcatttgtgagatccgaccaatcaaacaagtcagctcacaaagccgactgtcatgtctgtgagtgcacactggagttccgtactaaagtggagaaatctgcatctctattgggtagaaaatgggtatacggcaggatataccttgtttcacgtcccaggagaggtcggcgttccaagtatacatagttctgatcaaagacgagagaattttttggggatgggtctctctactcaattgtctatttattt

SEQ ID NO: 3421 - DNA, 1177 bp, Brassica napus
aaaacgcatggttgcgctgcacgccgccgaaatcctatcgtgtggggtgtggccaccatttctcgaaccgaacagcctcccaccacacgcctcttcttcttcttctgttttgtcttttccgttttctttccccggcgagggatagatatttttgtttatcatggcgggcacttgcagctcgataaggccaccacgcttcattggttcttgttcgagtcttgagctttccaggttgattgatcgagctggagttcctttctccgttcggatctctaccagaagaaagtccataacaagaagccaaggaggtggtttcaccgcacctgtctcgtcacgtgaggaaggtccttcttgtatcttcgtcggtccgattgattccgcaagaaaagaaactctagaagctctttaccgccaagcgaagaatgcttactacaatgggaaacctttgatagttgatgacatgtttgacagagttgagctgaagcttcggtggtatggttcgaagtctgttgtcaagtaccctcggtgcagcctcctgcgacagtcaacttatgctgatgcagaggatgatgcatcacaagttctcctgttagctaccatatggatcttgattctcttgtttggtagctcagcatgtgttttgcccaccatttatggcatcggcttagtctatggaggagatcccttcaagtcagggcttgtctatagcagctcgtcttctgtgcctcttctgtcaaagttgaatggtatcctcctcaccgtgctaggacctgcttttggatatccaattgcatcttccgcagtaagggttcttaaagggctatggagaaatgacttaaccgctctaaaaggagactgtccaaattgtggggaggaggtttttgcatttgtgagatccgaccaatcaaacaagtcagctcacaaagccgagtgtcatgtctgtgagtgcacactggagttccgtaccaaagtggagaaatctgcatcactattgggtagaaaatgggtatacggcaggatataccttgtttcacgtcccaggagaggtcggcgttccaagtatacatagttctgatcaaagacgagagaatttttggggatggtctctctactcaattgtctatttatttaaaaaaggttactagaaagcttttgaacatcaaaaagttcaacaatt

SEQ ID NO: 3422 - DNA, 1229 bp, Raphanus sativus
  misc_feature (468)..(468): n is a, c, g, or t
  misc_feature (704)..(704): n is a, c, g, or t
  misc_feature (773)..(773): n is a, c, g, or t
  misc_feature (839)..(839): n is a, c, g, or t
  misc_feature (851)..(851): n is a, c, g, or t
  misc_feature (875)..(875): n is a, c, g, or t
  misc_feature (878)..(878): n is a, c, g, or t
  misc_feature (881)..(881): n is a, c, g, or t
  misc_feature (887)..(887): n is a, c, g, or t
  misc_feature (890)..(890): n is a, c, g, or t
  misc_feature (939)..(939): n is a, c, g, or t
  misc_feature (970)..(970): n is a, c, g, or t
  misc_feature (998)..(998): n is a, c, g, or t
  misc_feature (1004)..(1004): n is a, c, g, or t
  misc_feature (1016)..(1016): n is a, c, g, or t
ggatactagtaaacgaatgttgcgtgcacgcgccgaatcgtatcgtgtggccaccatctctcgaaccgaacagcctccccaccacacgcttcttcttctactgttttgtcttttcaatagttttttccggcgagggttagatattttttttgtttatcatggctggcacttgcagctcgattaggcctcgcatcattggtgcttcttcgactgttaagctctccaggttgattaacggagcaggagttcctttctccgttaggatctctaccagaacaagaagccacggaggtggtttcaccgcatccatttcatcgtcacgtgaggaaggcccttcctgtatcttcgtcggtccgattgattccgcaagaaaagaaactctagaagctctttaccgccaagcgaagaatgcttactacaatggaaagccgttgatagttgatgacatgtttgacagagtcgagctgnagcttcggtggtatggttcgaagtctgttgtcaagtaccctcgttgcagcctcctgcgacagtcaacttatgctgatgcagaggatgatgcatcacaagttctcctgttagctaccatatggatcttgattctcttgtttggtagctcagcatgcgttttcccctccatgtatggcctcggcttagtctatggaggagatcctttcgactcggggcttttctatagcagcagctcntcttctgtgcctcttctgacaaagctgaacggcatcctcctcaccgtgctaggacctgcttttggatanccgattgcatcttctgcagtaagggttcttaaagggctatggagaaatgacttaacggctctaaanggagactgcccnaactgtggggaagaggtttttgcnttngtnagatcngancaatcaaacagatcagctcacaaagccgactgtcatgtctgtgagtgcnccctggagttccgtaccaaagtggagaaatntgcgtcgctattgggtagaaaatgggtntacggnaggatatacctngtttcacggcctagagaggtcggcgttccaagtatccatagctctgacaaagacaagaattttggggaatgtttctactcaattgtctatttatttctaaaaaaagttactagaagctagaaagcttttgtaacatccaaaaatctcacaaaactgtaaaactataaacgtttctacacacctgaaagtatagtattttagagaatttcttga

SEQ ID NO: 3423 - DNA, 1352 bp, Hordeum vulgare
tgttcaaggcgtgccgtgcatgcagacgcagctgtggggggtgggtgggtggcgcacgtagggaaagccgagcacgacggcgaggctgacgttgccatcacgggagagagcgagagaaaagaggagcaaaagctgaaagcccacgcccacgccaccctgataagacgagagggacggtggaacagttgagtcgcgttgcgttgcccaccccccgccgcaactctctcatccatcgcatcccaccccatcccatccgactcctccacacgcgcttcgcgcctcaaatagcacgggcaatggcagcggcgcggccgtgttgcagcagcagcagcatccaccggcagccacgcctcctcgtcctcgccgcctgcgcgtcgcccacgccgctgcagctgctgctgctgctttagccgtctccgacttccgttccgaggcgatcgccggccggatgggtgatctgggcgtacgggttgtgggcagaggctgcgccgcgcccatggagccgcgcaaggagatggcgccgccgccgccgatggagcagcaccatcctcccctgttcatggatttctctcgtcgagatggagtcgcagatggcggcaacgtgcggaagcggccgcgcgaggccgtggcgccgccggcacggctcttctccctgcaggcgccgcagggttccccggcgcacaaggtgatacacctggcgcagctgcaccggcggccggcggcgacgggcctgcggctcgacttcgacgagggaggctcggagcacgtggcgtgcacgtcgtcgtcgccgtcctccgttctccccggcgagctcgccgctcagtgcgggcagtacagtaacgagatcgaccgactgctccaggaacacgcggagagactccggcttgcgctggccgacacgaggcgtcggcagaaccgctcgctgctgggcgccgcggaggcgctggccgcgcggcgggtcagggagatggaggcggagaccttcaaggcggcacggcgcggcgtcgagctggaggagcagctggcgcggctgagggcggaggccgcgtcgtggcaagccaaggcaatgtccgaccagtccacggcggccgcgctccacgcgcagttgcagcaggcggcggccacagcgcaggcgaggagcggcaaggccgccttggacgacgacggcgcggcgggcgcggcggacgacgccgagtctggcttcgtcgacccggacagggtggtggaggtcatcgcgccgccgccggcggccaggccgtgccgcgcgtgccggctgcggccggcgtccacggtgctgctcccgtgcaggcacctctgcgtgtgcgacgcgtgcgaccccggcgtgccggccg

SEQ ID NO: 3424 - DNA, 1350 bp, Triticum aestivum
ttcaaggcgtgcatgcagatgcagctgtgaggtgggtggtgcacgtagggaaagccgggcacgacggcgaggctgacgttgccatcacgattcacgggagagagcgaggaaaagaggagccagcaaaagctgaaagcccacgcccacgccaccctgataagacgagagggacggtagaacagttgagtcgcgttgcgtttgcgttgcccaccccccgccgcaactctctcatccatcgcatccccgcgcctcctaccgccatcccatccaactcctcttccccacgcacgcgcttcgcgcctcaaatagcacgaacggggcaatggcagcggcgcggccctgttgcagcagcagccaccggcaatcgcgcctcctcgtcctcgccgcctgcgcgtcgcccacgccgctgctgctgctttagccgtccccgacttccgctccgaggtgatcgctcccccggccggatgggtgatctgggcgtccgggttgtgggcagaggctgcgccgcgccgatggagccgcgcaaggagatggtggcgccgtcgctggagcagcaggggcagcagcagcatcctcccctcttcatggatttctcccgacgagatggagtcgcagatggcggcaacgggcggaagcggccgcgcgagaccgtggcgccgccggcacgcctcttctccctacaggcgccgcagggttctcccgggcacaaggtgatacacctggcgcagctgcaccggcggccggcggcgacgggcctgcggctcgacttcgacgagggaggctcggagcacgtggcgtgcacgtcgtcgacgtcgtcccttctccccggcgagctcgccgctcagtgcgggcggcacaacaacgagatcgaccggctgctccaggaacacgcggagcgactccggcttgcgctggctgacacgaggcgtcggcagaaccgctcgctgctgggcgccgcagaggcgctggccgcgcggcgggtcagggaggtggaggcggagaccttcaaggcggcacggcgcggcgtcgagctggaggagcggctggccaggctgagggcggaggcggcgtcgtggcaagccaaggcaatgtccgaccagtccacggcggccgcgctgcacgcgcagttgcagcaggaagcggccacagcgcaggcgaggagtggcaaggccgccgaggaggccgagggagcggcggacgacgccgagtccggcttcatcgaccctgacagggtggtggaggtggcggccccgccaccggccaggccgtgccgcgcgtgccggctccggccggccaccaccgtgctgctcccgtgcaggcacctctgcgtgtgcgccgcgtgcgatcccg

SEQ ID NO: 3425 - DNA, 655 bp, Secale cereale
cagcgagccagccagacctccctcccgtagatctctgctctccgggcgtgctcgcggcgccgatccggcgatgacgaccaaggcaagctcggggagctaatgtgggagcaccggctgcgcgcggcggcggcggtggcgttcctcgccgttgccgtggtgtcgatctccgccgtcgggcccaggctcggcgccgtggtctccttcttctggccgctgctcgtctccacgggcttcttcctcgtggccatcaccgtgctgctccggatctcgccgccgcccagcggcgcggaggagtccggcaaggagatcatcgacttcgtcgccgggtgccgccccgagcacctcctcccggaggcgtccgccgccgtggaggtgccgccggagccggagatctgaagagccgacgagagacgaggaggaggtgcgcgcggctgcgagatgacgttgttcgccggggctagctcaggagagacgtggggtaacctgtatgggcccgcctgggagccgggggccgggcgcccccggcgtgcggtgcggtggtgcagccgtggctagcgtaggatcctcccgtctccgtggtgtggtgtacaatggtaccattgaataaagatgttataaattcgctctggcagcgcaaaaaaaaaaaaaaaaacta

SEQ ID NO: 3426 - DNA, 1688 bp, Secale cereale
attccctctactggctcgtggagctcctctccctcctctgcttcttcgtcttctactaccgccacctccagtccaagaagataagcaaggcggagccgaccgaatggccaatcctgggccatcttttcggcatggtcgccaacctgtcccgcttccacgactgggccaccggcatcctcgccggcacgcgctacaacttcgaagctcgcgcggggatcaccggcgtccgcttcttcgtcacctgcgaccccgccaacgtgcgccacatcttcacctccaacttcaccaactaccccaagggcgaggagttcgccgacatcttcgacgtcttcggcgacggcatcttcaacgccgacggcgactcctggcgccgccagcgcgccaagtcacagctgatcatggccgggcctcgcttccgcgccttctcggccaggtacagccgcgacaaggtggagaggagcctcctgcctttcctcgcccacgccgccgacgccgggaccaggaccccctgcgacctgcacgacgtcttcctgcgcctcacgttcgacatgacctgcaacctcgtcttcggcgtcgaccccgggtgcctgcagatcggcctccccgtcgtgcccttcgcgcgcgccatggacgacgtgctcgagacgctcttcctccgccacatcatctcgcccaagtgctggaagctcatgtaccgctatgagctcggcaccgagaggaagatggccgcgggtcgtaggaccatcgaccgcttcgccgcggacaccatcgccaaacgcagggccgaccacaagctccgcgacgacggcgtcagcgactcgtccgacatgctctcctccttcatctgcaacggcgagtacagcgacgacttcctgcgcgacaccacggtgaacctcctgctcgccggccgggacaccaccggcgccgcgctgtcctggttcttctacctcatctccaagaacccgcgcgtcgagcagaagatcctggacgagctggcgcccatcgcttcccggaagaaaaagaacctggacggcatggtggtgttggacgtgagcgagctgagcggcatggtgtacctgcacgcggcgctgtgcgagtgcctgaggctgtacccgtccgttcccttcgagcacaaggcggcggtggccgacgacgtgctcccgagcgggcacgagatgaaggccggcgacaagatactcatcttctcctactgcatggcgaggatggagggcgtgtggggcaaggactgcatggagttcaggccggagaggtgggtcaccgccgatgggaagctgaggtacgagccgtcctacaagttcatctccttcaacgccgggcccaggacctgcctcggcaaggagatggcgttcgtgcagatgaagaccgccgccgcggccgtgctgtggaacttcgccgtcgaggccgtgccggggcacgtcgtggagccgaagctgtccatcattctccacatgaagaacgggctcgccgtcacggtcaagcgaaggaacgcagcgcccgtgcacggctagctagtagtacgtgcgtgcgtgcgtgctgccctacacgtacatctcggccgcaaggcatacggccggggcgtgcgtagctagcggacacgtacgcattagtatatgtgtatctgcaaagtggcatgtgtgcttactaataggaatgctgttccatactac

SEQ ID NO: 3427 - DNA, 1714 bp, Triticum aestivum
gtggagctcctcaccgtcctttgcttcgtcgtcttctactaccgccatctccagtccaagaaaataagcaaggcagagccgacggaatggccaatcctgggccatcttttgggaatggtcgccaacctgtcccacttccatgactgggccaccggcatcctggccggcacgcgctacaacttccaagctcgcgccgggatcaccggcgtccgcttcttcgtcacctgcgaccccgccaacgtgcgccacatcttcacctccaacttcaccaactaccccaagggcgatgagttcgccgagatcttcgacgtcttcggcgacggcatcttcaacgccgacggcgagtcctggcgccgccagcgcgccaagtcccagctgatcatggccggccctcgcttccgcgccttctcggcgcggtacagccgcgacaaggtggagaggagcctcctgcctttcctcgcccacgccgccgaggccgggtcgaccccctgcgacctgcacgacgtcttcctgcgcctgacgttcgacatgacctgcaacctcgtcttcggcgtcgaccccgggtgcctgcagatcggcctccccgtggtgcccttcgcgcgcgccatggacgacgtgctcgagacgctcttcctccgccacatcatctcgcccgcgtgctggaagctcatgtaccgctatgaggtcggcaccgagaggaagatggccgcggctcgtaggaccatcgaccgcttcgccgcggacaccatcaccaaacgcagggtcgaccataagctccgaccaaacgagggcgtcaccgactcgtctgacatgctctcgtccttcatctgcaacggcgacgcgagcgagtacagcgacgagttcctgcgcgacaccacggtgaacctcctgctcgccggccgggacaccaccggcgcggcgctatcctggttcttctaccttctctccaagaacccgagtgtcgagcagaggatcctggacgagctggcgcccatcgcttcccggaagaagaagctggacggcatggtggtgttcgacgtgagcgagctgagcggcatggtgtacctgcacgcggcgctgtgcgagtgcctgaggctgtacccgtccgtgcccttcgagcacaaggcggcggtggccgacgacgtgctccccagcgggcacgagatgaaggccggggacaagatactcatcttctcctactgcatggcgaggatggagggcgtgtggggcaaggactgcatggagttcagaccggagaggtgggtcaccgccgacgggaagctgaggtacgagccgtcctacaagttcatctccttcaacgccgggccaaggacctgcctcggcaaggagatggcgttcgtgcagatgaagaccgccgcggccgccgtgctgtggaacttcgcagtcgaggccgtgccgggacacgttgtcgagccgaagctgtccatcattctccacatgaagaacgggctcgccgtcacagtcaagaggaggaacgtcgcgggcgtgcatggctagctagtggtatacgtacctacgtgcctactgcctacacgtctcggccacaaagtatacggggcgtatgtaacgtagcggacacgtacgtacatgtacgcgtattatatgtatgcaagagtggtatgcatgtgtgcttactaatagtataatggtgttccatactacaagaatatataaaaatacaagaaaaatagac

SEQ ID NO: 3428 - DNA, 1797 bp, Triticum aestivum
tcctttgcttcgtcgtcttctactaccgccatctccagtccaagaaaataagcaaggcagagccgacggaatggccaatcctgggccatcttttgggaatggtcgccaacctgtcccacttccatgactgggccaccggcatcctggccggcacgcgctacaacttccaagctcgcgccgggatcaccggcgtccgcttcttcgtcacctgcgaccccgccaacgtgcgccacatcttcacctccaacttcaccaactaccccaagggcgatgagttcgccgagatcttcgacgtcttcggcgacggcatcttcaacgccgacggcgagtcctggcgccgccagcgcgccaagtcccagctgatcatggccggccctcgcttccgcgccttctcggcgcggtacagccgcgacaaggtggagaggagcctcctgcctttcctcgcccacgccgccgaggccgggtcgaccccctgcgacctgcacgacgtcttcctgcgcctgacgttcgacatgacctgcaacctcgtcttcggcgtcgaccccgggtgcctgcagatcggcctccccgtggtgcccttcgcgcgcgccatggacgacgtgctcgagacgctcttcctccgccacatcatctcgcccgcgtgctggaagctcatgtaccgctatgaggtcggcaccgagaggaagatggccgcggctcgtaggaccatcgaccgcttcgccgcggacaccatcaccaaacgcagggtcgaccataagctccgaccaaacgagggcgtcaccgactcgtctgacatgctctcgtccttcatctgcaacggcgacgcgagcgagtacagcgacgagttcctgcgcgacaccacggtgaacctcctgctcgccggccgggacaccaccggcgcggcgctatcctggttcttctaccttctctccaagaacccgagtgtcgagcagaggatcctggacgagctggcgcccatcgcttcccggaagaagaagctggacggcatggtggtgttcgacgtgagcgagctgagcggcatggtgtacctgcacgcggcgctgtgcgagtgcctgaggctgtacccgtccgtgcccttcgagcacaaggcggcggtggccgacgacgtgctccccagcgggcacgagatgaaggccggggacaagatactcatcttctcctactgcatggcgaggatggagggcgtgtggggcaaggactgcatggagttcagaccggagaggtgggtcaccgccgacgggaagctgaggtacgagccgtcctacaagttcatctccttcaacgccgggccaaggacctgcctcggcaaggagatggcgttcgtgcagatgaagaccgccgcggccgccgtgctgtggaacttcgcagtcgaggccgtgccgggacacgttgtcgagccgaagctgtccatcattctccacatgaagaacgggctcgccgtcacagtcaagaggaggaacgtcgcgggcgtgcatggctagctagtggtatacgtacctacgtgcctactgcctacacgtctcggccacaaagtatacggggcgtatgtaacgtagcggacacgtacgtacatgtacgcgtattatatgtatgtaagagtggtatgcatgtgtgcttactaacagtataatggtgttccatactacaagaatatataaaaatacaagaaaaatagacgtgtgtaggtgtgcgttgtgacatgtgtgtaagctgtatgtgtgtgttcactaaatagaaaatggaggcatgggcaccagcttggatgcatgatccata

SEQ ID NO: 3429 - DNA, 1767 bp, Secale cereale
ataagcaaggcagagccgaccgaatggccaatcctgggccatcttttcggcatggtcgccaacctgtcccacttccatgactgggccaccggcatccttgccggcacgcactacaacttcgaagctcgcgcggggatcaccggcgtccgcttcttcgtcacctgcgaccccgccaacgtgcgccacatcttcacctccaacttcaccaactaccccaagggcgaggagttcgccgagatcttcgacgtcttcggtgacggcatcttcaacgccgacggcgagtcctggcgccgccagcgcgccaagtcgcagctcatcatggccggccctcgtttccgcgccttctcggccaggtacagccgcgacaaggtggagaggagcctcctgcctttcctcgcccacgccgccgacgccgggactaggaacccttgcgacctgcacgacgtcttcctgcgcctcacgttcgacatgacctgcaacctcgtcttcggcgtcgaccccgggtgcctgcagatcggcctccccgtcgtgcccttcgcgcgcgccatggacgacgtgctcgagacgctcttcctccgccacatcatctcgcccaagtgctggaagctcatgtaccgctatgagctcggcaccgagaggaagatggccgcgggtcgtaggaccatcgaccgattcgccgcggacaccatcgccaaacgcagggccgaccacaagctccgcgacgacggcgtcagcgactcgtccgacatgctctcctccttcatctgcaacggcgacgcgagcgagtacagcgacgaattcctgcgcgacaccacggtgaacctcctgctcgccggccgggacaccaccggcgccgcgctgtcctggttcttctacctcatctccaagaacccgcgcgtcgaacagaagatcctggacgagctggcgcccatcgcttccccgaagaaaaagaacctggacggcatggtggtgttcgacgtgagcgagctgagcggcatggtgtacctgcacgcggcgctgtgcgagtgcctgaggctgtacccgtccgtgcccttcgagcacaaggcggccgtggccgacgacgtgctccccagcgggcacgagatgaaggccggcgacaagatactcatcttctcctactgcatggcgaggatggagggcgtgtggggcaaggactgcatggagttcaggccggagaggtgggtcaccgccgacgggaagctgaggtacgagccgtcctacaagttcatctccttcaacgccgggcccaggacctgcctcggcaaggagatggcgtttgtgcagatgaagaccgccgccgcggccgtgctgtggaacttcgccgtcgaggccgtgccggggcacgtcgtggagccgaagctgtccatcattctccacatgaaaaacgggctcgccgtcacggtcaagaggaggaacgcagcgcccgtgcacggctagtacgtgcttgcctgcctgcctgcctgcctgcctgctgccctacacgtacatctcggcctcaaggcatatatacggggcgtacgtagctagcggacacgtacgtattagtatatgtgtatctgcaagagtggcatgtgtgcttactagtagcaatgctgttccatactaccagaataaaaatatacgtaagaaaaatagatgtgtgtggtatagtagtgtgcgttgtggcatgtatgtaaggcgtaagctgtgtgtgtgttcttctctaaatagaaatagaaaatggacctatgggcaccagcttgtccc

SEQ ID NO: 3430 - DNA, 1550 bp, Secale cereale
aatggccaatcctgggccatcttttcggcatggtcgccaacctgtcccgcttccacgactgggccaccggcatcctcgccggcacgcactacaacttcgaagctcgcgcggggatcaccggcgtccgcttcttcgtcacctgcgaccccgccaacgtgcgccacatcttcacctccaacttcaccaactaccccaagggcgaggagttcgccgagatcttcgacgtcttcggcgacggcatcttcaacgccgacggcgagtcctggcgccgccagcgcgccaagtcgcagctcatcatggccggccctcgcttccgcgccttctcggccaggtacagccgcgacaaggtggagaggagcctcctgcctttcctcgcccacgccgccgacgccgggactaggaccccctgcgacctgcacgacgtcttcctgcgcctcacgttcgacatgacctgcaacctcgtcttcggcgtcgaccccgggtgcctgcagatcggcctccccgtcgtgcccttcgcgcgcgccatggacgacgtgctcgagacgctcttcctccgccacatcatctcgcccaagtgctggaagctcatgtaccgctatgagctcggcaccgagaggaagatggccgcgggtcggaggaccatcgaccgcttcgccgcggacaccatcgccaaacgcagggccgaccacaagctccgcgacgacggcatcagcgactcgtccgacatgctctcctccttcatctgcaacggcgacgcgagcgagtacagcgacgaattcctgcgcgacaccacggtgaacctcctgctcgccggccgggacaccaccggcgccgcgctgtcctggttcttctacctcatctccaagaacccgcgcgtcgagcagaagatcctggacgagctggcgcccatcgcttccccgaagaaaaagaacctggacggcatggtggtgttcgacgtgagcgagctgagcggcatggtgtacctgcacgcggcgctgtgcgagtgcctgaggctgtacccgtccgttcccttcgagcacaaggcggcggtggccgacgacgtgctcccgagcgggcacgagatgaaggccggcgacaagatactcatcttctcctactgcatggcgaggatggagggcgtgtggggcaaggactgcatggagttcaggccggagaggtgggtcaccgccgatgggaagctgaggtacgagccgtcctacaagttcatctccttcaacgccgggcccaggacctgcctcggcaaggagatggcgttcgtgcagatgaagaccgccgccgcggccgtgctgtggaacttcgccgtcgaggccgtgccggggcacgtcgtggagccgaagctgtccatcattctccacatgaagaacgggctcgccgtcacggtcaagcgaaggaacgcagcgcccgtgcacggctagctagtagtacgtgcgtgcgtgcgtgctgccctacacgtacatctcggccgcaaggcagtcggccggggcgtagcgtagctagcggacacgtacgcattagtatatgtgtatctg

SEQ ID NO: 3431 - DNA, 2174 bp, Brachypodium distachyon
ctgtctccaaccactgccccttcctccgccccgcccttggtgtcctcctgtgcgcccgccgccccacgcctcgcgacgccgtcgcccccccccccccggcccccgcgcagccatggcgccgacggtggggctgaagcggtccggcacgacgcagacgatcgcggtgccgccgccgccgcaggacgcgcggttcgcggtgcgcgaggccgtgcggtccacgatcgcgacgccgccgcccgccgaggcgccgggtgctcccgcgagggtggcccctgcgcccgcactggaggggttcctgtgcctggaggaggtggacgggaggcggtggaaatacgtggtggatgaagccccggggaaagggaaggggggcaggggcgggtctgccgtcccattgggggcctccgtcagggccgtgccgctccagtcgccgctgccgcccgccgaggaaataatggcattcgtaagatcatacgttgtgcctgaagggtttccggatagtgttactccttcatacgtcccatacatgacctggagagcactgaagcatttctttggtggagcaatgggggtgtttacaacaagaaccttgctgagctccgttggagtctctcaaagcaaggtaaccccaggtgccattgcaatcaactggatcctcaaggatggagctgggcgtgttggaaaaatgctttttgcacgacaaggaaagaagttcgacaatgatctaaaacagctccgcttttctagcgatctcttgctggagataggagctgggatagagttagctactgcagcctttcctcagttcttcttgcctatggcttgcgtagcaaatgttgtaaagaatgtcgctgctgttacgtcaacctcaacccggactccaatctacaaggcctatgcaagaggagaaaatattggagatgtgaccgctaaaggcgaatctgttgggaatattgcagatctgctgggcactggtttgagcatctatatcacaaagcggaacccatcattggttacttcatttgccctcctgtcatgtggatatctcatgagttcatatcaagaggtgaggtccgttgtgctgaataccctaaacagggcaagatttaccgttgcagtggattcctttattaagacagggtatgtcccctcattgaaggaagggaactcacaggagacactatttattcatccttggcggcatgagccagtcgcaataggatcgcgatttggagaagcatttcaagaacctgtttcatttgttgccacaagacctttgtttgaggatgagagatacatggtaacatataacccaacgaaggataaagtatatgctttgctcaaggaccaagcaaagccagatgatgttctcaaagctgctttccatgctcatgtgttgctgcattttattaatgcatcacacgcacgtaagcggatgaacaccaaccggtcggatcactacgcgaacctgcatccacgaaacatggattttctggcacacattgcagaatcttgcaaacttgtgtctgcctcttatggaactttcaagaagaaagcaagagaacagggctggataatgtcagaatcgctgcttaaccctgggaaggctcgcttatgtgtcagaggactccaatgatttttctattttccgtttgtcatcgacaggatgataccatctctagctgtcaggctaactttcggacgggatgctgatgagttgttagtagctggggtagatcagtgagcctaacatcccagacgcccctctaactttgatagttactgcagctaccaagatctggtgatgtcaaaaagatgtaactcgacccaaaaaataaagccagggaggatatgctcacgctgacccatcagaagacggagggtgacctccaactgttagctgcaccaaaagtaggtagagggaccgtatatttatgtttgctcatagtgtctagatgatcgaggacttctaactgcaaccggttccgtatgggtgctcgttgtcggctgtggcctgtggagtcattttcagaaccatggaagagctgtttctttttcgctgaccagctgcgctttagagttgtttcttgtaaattcaactagctgatacaccgtgtcttgtatgtctttgtacagtgcttgttgtaataatcggaagaaatcgttgttattccatc

SEQ ID NO: 3432 - DNA, 2357 bp, Brachypodium distachyon
catcttggcatttccgcggctccgttttttctccctctgtctgtctccaaccactgccccttcctccgccccgcccttggtgtcctcctgtgcgcccgccgccccacgcctcgcgacgccgtcgcccccccccccccggcccccgcgcagccatggcgccgacggtggggctgaagcggtccggcacgacgcagacgatcgcggtgccgccgccgccgcaggacgcgcggttcgcggtgcgcgaggccgtgcggtccacgatcgcgacgccgccgcccgccgaggcgccgggtgctcccgcgagggtggcccctgcgcccgcactggaggggttcctgtgcctggaggaggtggacgggaggcggtggaaatacgtggtggatgaagccccggggaaagggaaggggggcaggggcgggtctgccgtcccattgggggcctccgtcagggccgtgccgctccagtcgccgctgccgcccgccgaggaaataatggcattcgtaagatcatacgttgtgcctgaagggtttccggatagtgttactccttcatacgtcccatacatgacctggagagcactgaagcatttctttggtggagcaatgggggtgtttacaacaagaaccttgctgagctccgttggagtctctcaaagcaaggtaaccccaggtgccattgcaatcaactggatcctcaaggatggagctgggcgtgttggaaaaatgctttttgcacgacaaggaaagaagttcgacaatgatctaaaacagctccgcttttctagcgatctcttgctggagataggagctgggatagagttagctactgcagcctttcctcagttcttcttgcctatggcttgcgtagcaaatgttgtaaagaatgtcgctgctgttacgtcaacctcaacccggactccaatctacaaggcctatgcaagaggagaaaatattggagatgtgaccgctaaaggcgaatctgttgggaatattgcagatctgctgggcactggtttgagcatctatatcacaaagcggaacccatcattggttacttcatttgccctcctgtcatgtggatatctcatgagttcatatcaagaggtgaggtccgttgtgctgaataccctaaacagggcaagatttaccgttgcagtggattcctttattaagacagggtatgtcccctcattgaaggaagggaactcacaggagacactatttattcatccttggcggcatgagccagtcgcaataggatcgcgatttggagaagcatttcaagaacctgtttcatttgttgccacaagacctttgtttgaggatgagagatacatggtaacatataacccaacgaaggataaagtatatgctttgctcaaggaccaagcaaagccagatgatgttctcaaagctgctttccatgctcatgtgttgctgcattttattaatgcatcacacgcacgtaagcggatgaacaccaaccggtcggatcactacgcgaacctgcatccacgaaacatggattttctggcacacattgcagaatcttgcaaacttgtgtctgcctcttatggaactttcaagaagaaagcaagagaacagggctggataatgtcagaatcgctgcttaaccctgggaaggctcgcttatgtgtcagaggactccaatgatttttctattttccgtttgtcatcgacaggatgataccatctctagctgtcaggctaactttcggacgggatgctgatgagttgttagtagctggggtagatcagtgagcctaacatcccagacgcccctctaactttgatagttactgcagctaccaagatctggtgatgtcaaaaagatgtaactcgacccaaaaaataaagccagggaggatatgctcacgctgacccatcagaagacggagggtgacctccaactgttagctgcaccaaaagtaggtagagggaccgtatatttatgtttgctcatagtgtctagatgatcgaggacttctaactgcaaccggttccgtatgggtgctcgttgtcggctgtggcctgtggagtcattttcagaaccatggaagagctgtttctttttcgctgaccagctgcgctttagagttgtttcttgtaaattcaactagctgatacaccgtgtcttgtatgtctttgtacagtgcttgttgtaataatcggaagaaatcgttgttattccatctgttcaaggcttgcgtgggccacagcctcgacctggctgattgtgactgagcggctgcatgtcctgctgcctttggaagtgtatcctttgcgattgcaagtataatttgctcgccccgaagcgaaacgaaaggtttacctcgc

SEQ ID NO: 3433 - DNA, 2491 bp, Oryza sativa
tagcgaaggaaagcgcctccactataaaacgctccaccctctctctctctcacctccatcttggcattgcgttctccgccatatacaactctctctctctctctccaaccactgcgtcgtctcgcatcggtcggtgtcgcgaccacccggtcgccgccggtggaggtttcgggtcggccacctgactaagccgcggccacgcaggtcgccggcgccggtgcgcgcggcagggatggcgccgacggtggggatcaagcggtcggcggcggcggtggcgacgcagaccatcagcgtgccgccgcccgacgcgcggttcgcggtgcgggaggccgtgcgggccaccatcgcgtcgccgccggtcgaggcgccccccgccgccgccgggaaggcggcggcgccggcgcccgcggtggaggggttcctgtgcctggaggaggtggacgggaggcggtggagctacgtggtggatgggggacaggggaaagggaaggggagggggagggggaggagcggcgcggccgttcccatgggggcctccgttagggccgtgccgctgcagtcgccgctgccgcccgccgaggaagttatggcattcataagatcatatgttgtgcctgaaggctttccggatagtgttactccgtcatacgtcccatacatgacctggagagccctgaagcatttctttggtggagctatgggtgtttttacaacaagaaccttgctgagctctgttggagtctctcaaagcaaagtaacaccaggagccattgctatcaactggatcctcaaggatggtgcaggtcgtgtcggaaaaatgctttttgcacgtcaaggaaagaagtttgactatgacctaaagcagctccgcttttctagtgatctattgctggagattggagctggaattgagttagcaactgcagcctttcctcaatttttcttgcccatggcttgcgtagcaaatgttgtaaagaatgtcgcggctgttacatcaacatcaactcgaactccaatttataaggcctatgcaagaggagaaaacattggagatgtcactgctaaaggcgaatctgttgggaacattgcagatctgctgggcactggcttgagcatcttcatttcaaaacggaatccatcattggtgacttcatttgccttcctttcatgtggttatctttggagttcatatcatgaggtgagatcggtcgtgctaaatactttaaacagagcaaggtttactgttgcggtggattccttcattaaaactgggcatatcccctcattgaaggaagggaactcacaggagacgatatttaatccaccttggcggcatgagccagttgcaataggatcacgatttggagaagcgtttcaagaacctgcttcatttgttgccatacggccattgtttgaggatgagagatacatggtaacatataaccccgcaaaggataaggtatatgctttgctcaaggatcaagcaaagtcagatgacattatcaaagcggctttccatgctcatgtattactgcatttcatcaatgcgtcacatgcacggaagcagatgaactccaggagatcagatccttatggaaacccatgtaacatggatttcatggcacacatagctgagtcctgcaaaattgtttcttcctcttatggaactttcaagaagaaagctagagaacagggttggataatgtcagaatcactgctcaaccctgggaaagctcggttgtgtcctgcaaggccataatgattttactgttactgggatggcaatatctttcagactaacttctcagctagacgggatgctcggttgtttgtagtagctgaactgacaaatgttgggcccgagcaccaagtatgaaccagtcatcctgtcatgccatgaaaacccgttttggttggcaccaaagcttaccaaaaccatgagagagcaatgcacctggcaatctcatcagcaggtggaataccacaagtgcagaataaaattatgcaccagagcaggtacgcagattaagaaatctggacaggacccaaagggcagcaaggggattccagatttccagccgttagcttgcacatatcagaggcacaaatgtttatgtttgctgctgtgttgttcgcttggcttagccgccctactgtaaccggttttatgcgttagggtgcagagtttgtcagtctttgaagctgtttatttatgcggatctggcggtctttgagatgtttccctttctttcgacctttcttagggcaactgtagattgaggttttccttcaatggagagttatgtccatatggaaacggaacccatcctgtacaatgtacatagaggtgctcggtaataattgtgatgtgtttttttccccgatttaagaatgttctcgaagaacattgcattgctgaaagttcagtgttgacgtgttgtccgtggtgtaatgttcgttctttttcactgaacaaaagccaaggagaaga

SEQ ID NO: 3434 - DNA, 2392 bp, Oryza sativa
atgggtgcgcgtagcgaaggaaagcgcctccactataaaacgctccaccctctctctctctcacctccatcttggcattgcgttctccgccatatacaactctctctctctctctccaaccactgcgtcgtctcgcatcggtcggtgtcgcgaccacccggtcgccgccggtggaggtttcgggtcggccacctgactaagccgcggccacgcaggtcgccggcgccggtgcgcgcggcagggatggcgccgacggtggggatcaagcggtcggcggcggcggtggcgacgcagaccatcagcgtgccgccgcccgacgcgcggttcgcggtgcgggaggccgtgcgggccaccatcgcgtcgccgccggtcgaggcgccccccgccgccgccgggaaggcggcggcgccggcgcccgcggtggaggggttcctgtgcctggaggaggtggacgggaggcggtggagctacgtggtggatgggggacaggggaaagggaaggggagggggagggggaggagcggcgcggccgttcccatgggggcctccgttagggccgtgccgctgcagtcgccgctgccgcccgccgaggaagttatggcattcataagatcatatgttgtgcctgaaggctttccggatagtgttactccgtcatacgtcccatacatgacctggagagccctgaagcatttctttggtggagctatgggtgtttttacaacaagaaccttgctgagctctgttggagtctctcaaagcaaagtaacaccaggagccattgctatcaactggatcctcaaggatggtgcaggtcgtgtcggaaaaatgctttttgcacgtcaaggaaagaagtttgactatgacctaaagcagctccgcttttctagtgatctattgctggagattggagctggaattgagttagcaactgcagcctttcctcaatttttcttgcccatggcttgcgtagcaaatgttgtaaagaatgtcgcggctgttacatcaacatcaactcgaactccaatttataaggcctatgcaagaggagaaaacattggagatgtcactgctaaaggcgaatctgttgggaacattgcagatctgctgggcactggcttgagcatcttcatttcaaaacggaatccatcattggtgacttcatttgccttcctttcatgtggttatctttggagttcatatcatgaggtgagatcggtcgtgctaaatactttaaacagagcaaggtttactgttgcggtggattccttcattaaaactgggcatatcccctcattgaaggaagggaactcacaggagacgatatttaatccaccttggcggcatgagccagttgcaataggatcacgatttggagaagcgtttcaagaacctgcttcatttgttgccatacggccattgtttgaggatgagagatacatggtaacatataaccccgcaaaggataaggtatatgctttgctcaaggatcaagcaaagtcagatgacattatcaaagcggctttccatgctcatgtattactgcatttcatcaatgcgtcacatgcacggaagcagatgaactccaggagatcagatccttatggaaacccatgtaacatggatttcatggcacacatagctgagtcctgcaaaattgtttcttcctcttatggaactttcaagaagaaagctagagaacagggttggataatgtcagaatcactgctcaaccctgggaaagctcggttgtgtcctgcaaggccataatgattttactgttactgggatggcaatatctttcagactaacttctcagctagacgggatgctcggttgtttgtagtagctgaactgacaaatgttgggcccgagcaccaagtatgaaccagtcatcctgtcatgccatgaaaacccgttttggttggcaccaaagcttaccaaaaccatgagagagcaatgcacctggcaatctcatcagcaggtggaataccacaagtgcagaataaaattatgcaccagagcaggtacgcagattaagaaatctggacaggacccaaagggcagcaaggggattccagatttccagccgttagcttgcacatatcagaggcacaaatgtttatgtttgctgctgtgttgttcgcttggcttagccgccctactgtaaccggttttatgcgttagggtgcagagtttgtcagtctttgaagctgtttatttatgcggatctggcggtctttgagatgtttccctttctttcgacctttcttagggcaactgtagattgaggttttccttcaatggagagttatgtccatatggaaacggaacccatcctgtacaatgtacatagaggtgctcggtaataattgtgatgtgtttttttccc

SEQ ID NO: 3435 - DNA, 2317 bp, Zea mays
gtctcctccccatcttggcattgttcgcgtcgtccgccttctctctctctctaacccactgccagccacctctgcgaccgtcgcgaccactcgccaagtaaattttcttccgcccacctgactacgcctcgacctcggcctcggcgccgcctccgtccgccggacgcggcagccatggcgccagcggtggggctcaagcgctccgccacgcagaccatcactctgccgccgcccgacacgcggctggctgtgcgcgatgtcatgcgctccacgatcccgtcgcagcccgccgtggcgccggcgtccacggagaggcaggcgcccgccgcggcgttgcaggggttcctgtgcctggaggaggtggacgggaggcggtggagctacgtggtggacggtggggccgcgaaggggaggagcaggggcggggccgtccccgctggggccgccgtcagggccgtgccgctgcagtcgccgcttccgcctgccgaggaaataatggcattcataagatcatatgtggtgcctgaagggtttccagacagtgttactccttcatatgtaccttacatgacctggagggctctgaagcatttctttggtggagcgatgggagtgtttacgacaagaaccttgctgagttctgttggagtctctcaaagcaaggtaacaccaggtgccattgctatcaactggatcctcaaggatggtgctgggcgtgtcgggaaaatgctttttgcacgtcaaggaaagaagtttgactatgacctaaagcagttgcggttttctagtgatctcttgttggaaataggagctgggatagaattaactactgctgcattccctcagtttttcttgcctatggcttgcgtagccaatgttgtaaagaacgtcgctgctgttacatcaacttcaactcgcactccaatctataaggcctatgctagaggagaaaatattggagatgtcactgctaaaggcgaatctgttgggaacattgcagatctgctcggtactggtttgagtatctttatctcaaaaaggaatccctcactggtgacttcgtttgccttcctttcctgtggatatctcctgagttcatatcaagaggtgaggtctgttgtgctgaataccctaaacagggcaaggtttaccgtcgcagtggattccttcattaaaactggtcacattccctccttgaaggaaggaaactcacaggagacgatatttaatccaccttggcggcatgagccagtcgcaataggttcaaggtttggagaagcatttcaagagccagcttcatttcttgccatacgacctctgtttgaggacgagagatacatggtaacatataacccaacaaaggataaagtatatgctttgctcaaggaccaggcaaaatcagacgacattattaaagctgctttccatgctcatgtgctattgcattttattaatgcatcacatgctcggagactgaagcagaagcagaagcaggcaaaccctgaccgatcagagtatctgtactctagaaacatggatttcctggcacacatcgctgaatcttgcaaaatagtttcctcatcatatggaacattcaagaagaaagctagggaacagggttggataatgtcagaatctctgctcaaccctggcaaggctcgattatgtgcagcaaaaccacaatgaatgtactgtttcagtttagtatcgatgagatgataccaatctcatgtttgtaagaccaacttttctaacgagacgggatggctaagttcttaggagctgaactaacatatgttggtgcctagcactaggcgtgaacctttgatctgaagcttgccaaattccaggaagaggaagagttttacgatttgaagaatgcctgaacatgtaataaaacatgcagtggataagtggtgcgctggttcgcgactcgcgagtaaagggctcaacgagggtgacttcaaacttctaactgcagagactagagcttgtatttatgtttgctgcggtatcagatttggtgtagccattcctgatgtaacctgtttcccttccgtgttggtcggctgcggggcttcttgtttggaagtctttggagttgctacgttttttacccgccacttggccgacttgtggcacttgagtgttcatctccttggcttctagaccccgttagagcatcaccagcagctgcgggagatgctcttagcaagttccagtttatcagtgaagagtcaatcactgatgtcgtccatagctccttcaaaccttgtacatacatgatcggtaataactgcaagccttctttctgttg

SEQ ID NO: 3436 - DNA, 2760 bp, Setaria italica
atgactcaggaccggacctgcgtacgacgaaactgcacgcgaggctctcttttgacggctctgctcacctcgtacttaacgcccaggcagccacaggcgctgaattccctggcctgcttggcaggcagcgcgaagcggccacacgcccccaaaaatatcacgatccaatggtcgatggaccatggacccgacaagtcgacgaccccctcctgctcctggctcctgccttgcctcctctctcagcctcccgtccttctgcttcttccacccttggtccatctgccgctcgcccactacccctcttctcctctctgctccgacaacacgctccatgacaggtgggccatagaaacgcctctctctctccatcttggcattgctcgcgtcgtccgcctttgtaaccctctctgcttcctctctctctctctaaccactgccagccacctctgcgcccgtcgcgaccactcgcgaattaattcccgttccgcccacctgactaagccgaggccccggcgccgcctccggccgccggacgcgggagccatggcgccggcggtggggatcaagcgctccaccacgcaggccgtcacgctgccgccgcccgacgcgcggctcgcggtgcgcgacgtcctgcgctccacgatcccgtcgcagcccgcggaggcgccgccggccgcggagaggccggcggcgcccgcggcggcggtggaggggttcctgtgcctggaggaggtggacggcaggcggtggagttacgtggtggaccgaggggccgtgaaggggaggggtagggccggggcggcgagccccgcgggggcctccgtcagggccgtgccgctgcagtcgccgcttccgccggccgaggaaataatggcattcataagatcatatgtcgtacctgaagggtttcctgacagtgttactccttcatatgtcccatacatgacctggagggctttgaagcatttctttggtggagcaatgggagtatttacaacaagaaccttgctgagctctgttggagtctctcaaagcaagtcaacaccaggagccattgctatcaactggatcctcaaggatggtgctgggcgtgtcggaaaaatgctttttgcacgtcaaggaaagaagtttgactacgacctaaagcagctgcggttttctagtgatctcctgctggagataggagctggtattgaattaactactgcagcattccctcaatttttcttgcctatggcttgcgtagcaaatgtcgtgaagaatgtcgctgctgttacatcaacctcaacgcgcactccaatctataaggcctatgcaagaggagaaaacattggtgatgtcactgctaaaggcgaatctgtcggtaacattgcagatctgttgggtactggtctgagcatctttatctcaaaaaggaacccatcattggtgacttcgtttgcctttctgtcctgtggatacctcctgagttcatatcatgaggtgagatctgtcgtgctgaataccctaaacagggcaaggtttacggttgcagtggattccttcattaaaactggtcacattccctccttgaaggaaggaaattcacaggagacgatatttaatccaccttggcggcacgagccagttgcaataggttcacgatttggagaagcatttcaagagcctgcttcatttgttgccataaggcctctgtttgaggatgagagatacatggtaacatataacccgacaaaggataaagtatatgctttgctcaaggaccaagcaaaatcagacgacattatcaaagctgctttccatgctcatgtgctactgcattttataaatgcatcacatgcacggaggctgaagcagaagcagaagcagaagcaggcaaaccccgaccgatcagactatggaaacctgtactcaagaaacatggatttcctggcacacatcgctgaatcttgcaaaatcgtttcatcatcatatggaaccttcaagaagaaagcaagagaacagggttggataatgtccgaatcactgctcaaccctggaaaggctcgattatgtggggcaaaaccactatgagtctactatccttctgtttaatatcgaggggatgatatcgtctctagtttgtcagtttgtgagactaacttttctgacaacgcgggatgctcagctgttagaagctgaactaacatatgttggcgcccggcactaggtttgaatcagtggaccttcagtcgcaactcccaagcttccaaattgcagggagagcaagagttatgtgatatgaagaatacctgaacgaagatgaattttcatggaggggagaggtggtgcgctggttcgcgtgctgagtaaaggggtcaacgagaggggggcttgaatttatgtttgctgatgtataagatatggtgtagccatcctgctgtaacctgttttgcgtgctggtcggctgcggagcttcttgtttcagtgtccttagagtttcttttcttttttttttttgcggaaaaagagtgcttatagtaaattccagtttcagtgagttatcagtttatcactcatgccgtcgacgacggtctccaccttgtacatacatgctcggtaataactgcaagccttctttgtgttatctggtgtgctgtggacttgtggtgctgaaagcaggacgagcctctcgaaaacaaagcacgacgaagtctgcaagcacaagaagttctttttgagtttggcgctgccttttcttagctgctttgcaccttgctt

SEQ ID NO: 3437 - DNA, 2245 bp, Sorghum bicolor
tctcctctctctctctaaccactgccagccacctctgcgcccatcgcgaccactcgccaagtaatttttcttccgcccacctgactacgcctcgacctcgacctcggcctcgccctcggcgtcgcctccgtccgccggacgcggcagccatggcgccggcagtggggctcaagcgctccgccacgcagaccatcactctgccgccgcccgagacgcggctggctgtgcgcgatgtcatgcggtccacgatcccgtcgcagcccgccgaggcgccggcgtccacggagaggccggcgccagccgcggcgctgcaggggttcctgtgcctggaggaggtggacgggaggcggtggagctacgtggtggacggcggggccgccaaggggaggggcaggggcggggccgccgtccccgctggggcctccgttagggccgtgccgctgcagtcgccgcttccgcctgccgaggaaataatggcattcataagatcgtatgttgtgcctgaagggtttccagacagtgttactccttcatatgtaccttacatgacctggagggctctgaagcacttctttggtggagcgatgggggtgttacaacaagaaccttgctgagttctgttggagtctctcaaagcaaggtgacaccaggtgccattgctatcaactggatcctcaaggacggtgctgggcgagtcggaaaaatgctttttgcacgtcaaggaaagaagtttgactatgacctaaagcagttacggtacactagtgatctgttgctggaaataggagctgggatagaattaactactgctgcattccctcagtttttcttgcctatggcttgcgtagccaatgttgtaaagaatgtcgctgctgttacgtcaacttcaactcgcactccaatctataaggcctatgcgagaggagaaaacattggagatgtcaccgctaaaggcgaatctgttgggaacattgcagatctgcttggtactggtctgagtatctttatctcaaaaaggaatccctcactggtgacttcatttgccttcctatcttgtggatatctcctgagctcatatcaagaggtgagatctgttgtgctgaataccctaaacagggcgaggtttaccgtcgcagtggattctttcattaaaactggtcacattccctccttgaaggaaggaaactcacaggagacgatatttaatccaccttggcggcatgagccagtcgcaataggttcaagatttggagaagcatttcaagagccagcttcatttcttgccataagacctctgtttgaggatgagagatacatggtgacatataacccaacaaaggataaagtatatgctttgctcaaggaccaagcaaaatcagacgacattattaaagctgctttccatgctcatgtgctactgcattttattaatgcatcacatgcacggaggctgaagcagaagcagaagcaggcaaaccctgaccgatcagagcatctgtactctagaaacatggatttcctggcgcacatcgctgaatcttgcaaaattgtttcgtcatcatatggaacattcaagaagaaagcaagggaacagggttggataatgtcagaatctctgctcaaccctggcaaggctcgattatgtgcggcaaaaccacaatgaatctactgttccagtataatttcgatgagatgataccgatctcatgtttgtaagactaacttttctaacgagacgggatgctcagttcttaggaactgaactaacatatgttgggtgcccagctctaggcatgaatcagtgaaccttcaatctgaagcgccaaattgcaggaagagcaagagttctacgatctgaagaatgcctgaacatataataaaacatacagtggataggtggtgcgctggttcgtgactcgcgagtgaagggctcaatgagattgacttcaaactgctaactgcacagactagagcttgtatttatgtttgctgctgtaacctgtttcccgtccgtgttggtcggctgccgagcttcttgtttggaagtctttggagtttcggatttcttttttccgccactttgctgacttgcggcacttgagagttgttcaaacccttcgcttctaacttagcgccctagtaaactccagtttctcagtgaagagtcatcactcatgtcgtcgatgacttcttcaaaccttgtacatacatgctccgtaataactggaagccttctttgtgtcga

SEQ ID NO: 3438 - DNA, 2579 bp, Sorghum bicolor
ttggcattgttcgcgtcgtccgccttttataactctctcctctctctctctaaccactgccagccacctctgcgcccatcgcgaccactcgccaagtaatttttcttccgcccacctgactacgcctcgacctcgacctcggcctcgccctcggcgtcgcctccgtccgccggacgcggcagccatggcgccggcagtggggctcaagcgctccgccacgcagaccatcactctgccgccgcccgagacgcggctggctgtgcgcgatgtcatgcggtccacgatcccgtcgcagcccgccgaggcgccggcgtccacggagaggccggcgccagccgcggcgctgcaggggttcctgtgcctggaggaggtggacgggaggcggtggagctacgtggtggacggcggggccgccaaggggaggggcaggggcggggccgccgtccccgctggggcctccgttagggccgtgccgctgcagtcgccgcttccgcctgccgaggaaataatggcattcataagatcgtatgttgtgcctgaagggtttccagacagtgttactccttcatatgtaccttacatgacctggagggctctgaaggtattttgtggaacttatgttcaacagtcagcttttactgcacttctttggtggagcgatgggggtgttacaacaagaaccttgctgagttctgttggagtctctcaaagcaaggtgacaccaggtgccattgctatcaactggatcctcaaggacggtgctgggcgagtcggaaaaatgctttttgcacgtcaaggaaagaagtttgactatgacctaaagcagttacggtacactagtgatctgttgctggaaataggagctgggatagaattaactactgctgcattccctcagtttttcttgcctatggcttgcgtagccaatgttgtaaagaatgtcgctgctgttacgtcaacttcaactcgcactccaatctataaggcctatgcgagaggagaaaacattggagatgtcaccgctaaaggcgaatctgttgggaacattgcagatctgcttggtactggtctgagtatctttatctcaaaaaggaatccctcactggtgacttcatttgccttcctatcttgtggatatctcctgagctcatatcaagaggtgagatctgttgtgctgaataccctaaacagggcgaggtttaccgtcgcagtggattctttcattaaaactggtcacattccctccttgaaggaaggaaactcacaggagacgatatttaatccaccttggcggcatgagccagtcgcaataggttcaagatttggagaagcatttcaagagccagcttcatttcttgccataagacctctgtttgaggatgagagatacatggtgacatataacccaacaaaggataaagtatatgctttgctcaaggaccaagcaaaatcagacgacattattaaagctgctttccatgctcatgtgctactgcattttattaatgcatcacatgcacggaggctgaagcagaagcagaagcaggcaaaccctgaccgatcagagcatctgtactctagaaacatggatttcctggcgcacatcgctgaatcttgcaaaattgtttcgtcatcatatggaacattcaagaagaaagcaagggaacagggttggataatgtcagaatctctgctcaaccctggcaaggctcgattatgtgcggcaaaaccacaatgaatctactgttccagtataatttcgatgagatgataccgatctcatgtttgtaagactaacttttctaacgagacgggatgctcagttcttaggaactgaactaacatatgttgggtgcccagctctaggcatgaatcagtgaaccttcaatctgaagcgccaaattgcaggaagagcaagagttctacgatctgaagaatgcctgaacatataataaaacatacagtggataggtggtgcgctggttcgtgactcgcgagtgaagggctcaatgagattgacttcaaactgctaactgcacagactagagcttgtatttatgtttgctgctgtaacctgtttcccgtccgtgttggtcggctgccgagcttcttgtttggaagtctttggagtttcggatttcttttttccgccactttgctgacttgcggcacttgagagttgttcaaacccttcgcttctaacttagcgccctagtaaactccagtttctcagtgaagagtcatcactcatgtcgtcgatgacttcttcaaaccttgtacatacatgctccgtaataactggaagccttctttgtgtcgatgtttctatggcgtggacatgtaccactgctgtattgttgtgagtttgtgttagtgtatttgtgtttgtcagatgggagagacctgtcctgtcctccgagcacctccgttggtgagcaggtgtggggtgtgttagatactgcgctagagacgagaggcttgaccgcttgagagccgatttaaacacggcatgatgatccagaggaaagcacgacgaagtcttgaaaacaaaacgattcttctgacttctgagtccgtca

SEQ ID NO: 3439 - DNA, 1919 bp, Pennisetum glaucum
ccgcagcagcccgcggaggcgccgccgccgccggccgcggagaggcccgccgcgccccccgccgcggtggaggggttcctgtgcctggaggaggtggacggcaggcgctggagctacgtggtcgaccgcggggccgccaaggggaggggcaggggcgcttcggcgggggcctccgtcagggccgtgccgctgcagtcgccgcttccgccggccgaggaaataatggcattcataagatcatatgtcgtacctgaagggtttccagacagtgttactccttcgtacgtcccatacatgagctggagggctttgaagcatttctttggtggagcgatgggggtatttacgacaagaaccttgctgagctctgttggagtctctcaaagtaaggcaacaccaggagccattgctatcaactggatcctcaaggatggtgctgggcgtgttggaaaaatgctttttgcacgtcaaggaaagaagtttgactatgacctgaagcagctgcggttttctagtgatctcctgctggaaataggagctggtattgaattaactactgcagcattccctcaatttttcttgccaatggcctgcgtagcaaatgtcgtaaagaatgtcgctgctgttacctcaacctcaacgcgcactccaatctataaggcttatgcaagaggagaaaacattggtgatgtcactgctaaaggcgaatctgttgggaacattgcagatctgttgggtactggtctgagcatctttatctcaaaaaggaacccatcattggtgacttcgtttgcccttctgtcctgtggatacctcctgagttcatatcaagaggtgagatctgtcgtgctgaataccctaaacagggcaaggtttacggttgcagtggattccttcattaaaacaggtcacattccctcattgaaagaaggaaattcacaggagacgatatttaatccaccttggcggcacgagccagtcgcaataggtacacgatttggagaagcatttcaagagcctgcttcatttgttgccataaggccactatttgaggacgagagatacatcgtaacatataacccgacaaaggataaagtatatgctttgctcaaggaccaagcaaaatcagacgacatcattaaagctgctttccatgctcatgtgctactgcattttataaatgcatcacatgcacggaggctcaagcagaagcggaagcaggcaaaccctgactatggaaacctgtactcaagaaacatggatttcctggcacacatcgctgaatcttgcaagatagtttcttcatcttatggaaccttcaagaagaaagcgagagaacagggttggataatgtccgaatcactgctcaaccctggaaaggctcgattatgtgggggaaaaccacaatgagtgtactatccatccttctgtttaatatcgaggggacgatatcatctctagtttgtcagtttgcgagtctaacttttctgacaaggcgggatgctcagccgttagaagctgaactaacatatgttggcgcccagcactaggagtgaatcagtggaccttcagtcgcaactcccaagcttccaaattccagggagagcaagagtcatgcgatatgaagaatgcctgaacgaagctgaataaaacgtaaggggagactggagaggtggtgctctggtttgcgcacgagtgaaggggccaacgagagggggacttgtacctgctaattgcacagactaggagcttgtatttatggttgctgctgcatcagagtttcttttcttttcctgtgccagttgtgtcttgctgatcttcttagcgctttagtaaattccagtttctcagtgagttttattagtcatgccgtcggttgacggcctccaccttgtacatacatgctcgttgctcggtaa

SEQ ID NO: 3440 - DNA, 1207 bp, Panicum virgatum
ccacgcgtccgggccagcacagcgcacagagcagagcaaacgctcgctctgcagtctgcacgaacgcgtgtcccgtccgatccttgtgacaatgtcgcccacaccttcccagctcgccggcggagagccgttccgcgtgttcgtggggtacgactcccgcgaggacatcgcgtaccgcgtgtgccgccgctccctgctgcgccgctcctccatcccggtggacgtcatccccatcgtgcagcaggagctccgcgaggccgggctgtactggcgggagcgcgggccgacggagagcaccgagttctccttcacccgcttcctgacgccgcacctcgcgggctaccgcggctgggcgctcttcgtggactgcgacttcctcttcgtcgccgacgtcgcggagctggcgcgcctcgccgacccgcgctacgccgtgctgtgcgtgcaccacgactacacgcccagggaggccaccaagatggacggcgccgtgcagacggcgtacccgcgcaagaactggtcgtccatggtgctcttcaactgcggccaccccaagaaccgcgccgcgctcacgccggaggccgtcagcacgcagaccggcgcctacctccaccgcttcatgtggctcgacgacggcgaggtcggcgaggtcccgttcgtgtggaacttcctcgtggggcacaacaaggtcgaccccgccgacgaggccggcacggcgccgcgcgcgatacactacacgtccggggggccctggttcgagaggtacaaggactgcgagttcgccgacctctgggtccaggagcgcgacgcctacgaggccgaggagaaggaggagaaggtcgccgaggatgacgatgtcaaggccgccataccaatggcacccgccgtgtcggtggacgcgtgatcgagatcccatagcctcctcctcctcgctgagctgaggccccgtttaatttggtgctattttttttcccgtcgatacgtgtagtgtgctatgttgataatcagctagcggaggtgtatgtgcctcgtgcttatcaggaatcaaacctctaggtttgatatcctacgtatcttattactagtcgtgctggcgatgtgtccgtctcatgtaccttaataaggcacaattgtgcatgtggtggaaatagattgtgcaagcatttgtggaagtactgtatttcatgaaataaataaatggacgtgtgtg

SEQ ID NO: 3441 - DNA, 1104 bp, Brachypodium distachyon
cccaaaaccaaatgtcgcccccagcccaagcacctaccaacaacctcaccggcgccggcgccggcacggatgagccgttccgcgtgttcgtggggtacgactcccgcgaggacatcgcgtaccgcgtgtgccgccgctcgctgctacgccgctcctccatccctctcgagatcatcccaatcgtccaagacgagctccggtcagcggggctgtactggcgggagcgaggacccacggagagcacggagttctccttcacccgcttcctgacgccgcacctcgccggctaccgcggctgggcgctcttcatcgactgcgacttcctcttcgtcgccgacgtggccgaactcgcccgcatgtgcgcggcggccaaccctcgccacgccgtgctgtgcgtgcaccacgactacgcgcccaaggaggcgaccaagatggacggcgccgtgcagacgctgtacccgcgcaagaactggtcctccatggtgctcttcaactgcgggcaccccaagaaccgcgccgcgctcaccccggacgaggttagcacccggtccggcgcgcacctccaccgcttcgcctggctcgatgacgatgaggtcggcgaggtgccgttcgtgtggaactttctcgtgggccataatcgggttgacccggacgatgtggccgggacgacgccgcgcgccatacactatacttccggtgggccgtggttcgagcggtacaaggactgcgagttcgctgacctttggatccaggagcgggatgcgtatgagtccgaagagaagcaagccgaggaggttaataagcccatggcggcagcaccggtgccgtcgcctgccgtttccgtggacgcgtgaatggataatgatgccttcgccggccggccggccgccggaccctgaacttcatgtcttgttcgtcctcccttcgttttcttgtagctctggcctgtgggatcatctcctagcgtacgtgttgttgtttccagttgatgtgtgttggtaggtaacaagtcatagtctgacgtattgtggtgtaataaggcccttgaggacggtcctccatgaggccgaagtgaagaataatccatgctgtatcttttacttg

SEQ ID NO: 3442 - DNA, 1388 bp, Brachypodium distachyon
ggcctcaagagcaagctgagcatcaacttatctcccagtgatgtgtgtgacacgttttattttgaactagcagacaaccgaggcatacacacagtttcgcgcttattaaaacgtacgctcgtccaagctattctgagcaccaacttatctcccacagtgactctgtgtgcacgcccatacccatcgaaatacgtacgtgacaccgtagtaaacccaaaaccaaatgtcgcccccagcccaagcacctaccaacaacctcaccggcgccggcgccggcacggatgagccgttccgcgtgttcgtggggtacgactcccgcgaggacatcgcgtaccgcgtgtgccgccgctcgctgctacgccgctcctccatccctctcgagatcatcccaatcgtccaagacgagctccggtcagcggggctgtactggcgggagcgaggacccacggagagcacggagttctccttcacccgcttcctgacgccgcacctcgccggctaccgcggctgggcgctcttcatcgactgcgacttcctcttcgtcgccgacgtggccgaactcgcccgcatgtgcgcggcggccaaccctcgccacgccgtgctgtgcgtgcaccacgactacgcgcccaaggaggcgaccaagatggacggcgccgtgcagacgctgtacccgcgcaagaactggtcctccatggtgctcttcaactgcgggcaccccaagaaccgcgccgcgctcaccccggacgaggttagcacccggtccggcgcgcacctccaccgcttcgcctggctcgatgacgatgaggtcggcgaggtgccgttcgtgtggaactttctcgtgggccataatcgggttgacccggacgatgtggccgggacgacgccgcgcgccatacactatacttccggtgggccgtggttcgagcggtacaaggactgcgagttcgctgacctttggatccaggagcgggatgcgtatgagtccgaagagaagcaagccgaggaggttaataagcccatggcggcagcaccggtgccgtcgcctgccgtttccgtggacgcgtgaatggataatgatgccttcgccggccggccggccgccggaccctgaacttcatgtcttgttcgtcctcccttcgttttcttgtagctctggcctgtgggatcatctcctagcgtacgtgttgttgtttccagttgatgtgtgttggtaggtaacaagtcatagtctgacgtattgtggtgtaataaggcccttgaggacggtcctccatgaggccgaagtgaagaataatccatgctgtatcttttacttgaagattttgtactgctgagtaagtaattaggtaatttcaataaatatttaatcagaaaaacaatgtctaaaa

SEQ ID NO: 3443 - DNA, 1043 bp, Brachypodium distachyon
ggtgactccgtaaaacccaaatgtcgcccccacccgcagcccccaccaacctcaccggcgccggcgccggcacggaggagccgttccgcgtgttcgtggggtacgactcccgcgaggacatcgcgtaccgcgtgtgccgccgctcgctgctgcgccgctcctccatcccgctcgagatcatcccaatcgtccaggacgagctccggtcagcggggctgtactggcgggagcgagaacccacggagagcacggagttctccttcacccgcttcctgacgccgcacctcgccggctaccgcggctgggcgctcttcatcgactgcgacttcctcttcgtcgccgacgtggccgagctcgcccgcatgtgcgcggcggccaaacctcgccacgccgtgctgtgcgtgcaccacgactacgcgcccaaggaagccaccaagatggacggcgccgtgcagacgctgtacccgcgcaagaactggtcctccatggtgctcttcaactgcgggcaccccaagaaccgcgccgcgctcaccccggacgaggttagcacccggtccggcgcgcacctccaccgcttcgcctggctcgatgatgatgaggtcggcgaggtgccgttcgtgtggaactttctcgtgggccataatcgggttgacccggacgatgtggccgggacgacgccgcgcgccattcactatacttccggtgggccgtggttcgagcggtacaaggactgcgagttcgccgacctttggatccaggagcgggatgcctacgaggctgaagagaaacaagacgacgatgtggcgaaacccatggcggcagcaccagtgccatcgcctgccgtttccgtggacgcgtgaatgaataatgatgccagacgacgggtggctgtcaagactgaactgcatgtttagcttgttcctcttgtcgctgtgggatcatctcctagcgtatgtgtttgttgttgtttactgtttactgtgatacgtaatcaagtcatagtgtgacgtattatcgtgtaataaagcccgtgaggcccaagt

SEQ ID NO: 3444 - DNA, 1379 bp, Brachypodium distachyon
caaccgatcgatcgaggcgtagacacacgtccccccttattagaacgctcgtagtttcaagctcctccattcagagcatcaacttacttatctcgcccggtgactccgtaaaacccaaatgtcgcccccacccgcagcccccaccaacctcaccggcgccggcgccggcacggaggagccgttccgcgtgttcgtggggtacgactcccgcgaggacatcgcgtaccgcgtgtgccgccgctcgctgctgcgccgctcctccatcccgctcgagatcatcccaatcgtccaggacgagctccggtcagcggggctgtactggcgggagcgagaacccacggagagcacggagttctccttcacccgcttcctgacgccgcacctcgccggctaccgcggctgggcgctcttcatcgactgcgacttcctcttcgtcgccgacgtggccgagctcgcccgcatgtgcgcggcggccaaacctcgccacgccgtgctgtgcgtgcaccacgactacgcgcccaaggaagccaccaagatggacggcgccgtgcagacgctgtacccgcgcaagaactggtcctccatggtgctcttcaactgcgggcaccccaagaaccgcgccgcgctcaccccggacgaggttagcacccggtccggcgcgcacctccaccgcttcgcctggctcgatgatgatgaggtcggcgaggtgccgttcgtgtggaactttctcgtgggccataatcgggttgacccggacgatgtggccgggacgacgccgcgcgccattcactatacttccggtgggccgtggttcgagcggtacaaggactgcgagttcgccgacctttggatccaggagcgggatgcctacgaggctgaagagaaacaagacgacgatgtggcgaaacccatggcggcagcaccagtgccatcgcctgccgtttccgtggacgcgtgaatgaataatgatgccagacgacgggtggctgtcaagactgaactgcatgtttagcttgttcctcttgtcgctgtgggatcatctcctagcgtatgtgtttgttgttgtttactgtttactgtgatacgtaatcaagtcatagtgtgacgtattatcgtgtaataaagcccgtgaggcccaagtgaacaatgcatgctctccttgctcgaagatttcgcacatgtgaattgcattttggaccggtatctgctcctgggtgctaaattatgttttgtcattcataagggtcaaaaggatcagaaaataattacatcatgttttctttgaaggaaacccgaggaaggagatttagggggcaaagtggactatatatgtatacccgctaaatgtccgtgctctactacgaaattaagaatttgca

SEQ ID NO: 3445 - DNA, 1186 bp, Panicum virgatum
cttaggccagcacagcacagcgcacagagcaggagcaaacgctcgctctgccggaacgtgacaatgtcgcccacagcttcccagctcgccggcggagagccgttccgcgtgttcgtggggtacgactcccgcgaggacatcgcgtaccgcgtgtgccggcgctccctgctgcgccgctcctccatcccgctggacgtgatccccatcgtgcagcaggagctccgcgaggccgggctctactggcgggagcgcgggccgacggagagcaccgagttctccttcacccgcttcctcacgccgcacctcgcgggctaccgcgggtgggcgctcttcgtggactgcgacttcctcttcgtcgccgacgtcgcggagctggcgcgcctcgccgacccgcgctacgccgtgctgtgcgtgcaccacgactacgtgcccagggaggccaccaagatggacggcgccgcgcagacggtgtacccgcgcaagaactggtcgtccatggtgctcttcaactgcggccaccccaagaaccgcgccgcgctcacgcctgaggccgtcagcacgcagaccggcgcctacctccaccgcttcatgtggctcgacgacggcgaggtcggcgaggtcccgttcgtctggaacttcctcgtggggcacaacaaggtcgaccccgccgacgaggccgggacggcgccgcgcgcgatacactacacgtccgggggcccctggttcgagaggtacaaggactgcgagttcgccgacctctgggtccaggagcgcgacgcctacgaggccgaggaggagaaggagaagcaggccgccgacgaggatgacgtcaaggccggcgccatacaaatggcacccgccgtgtcggtggacgcatgatcgagacgatcccatcatagtcgctgagctgaggccgcgcgcgtttaatttatttggtgctattatattttctcgccgatacgtgtagtgtgctataaagtgagcggaggtgtctgtacctcgtgcttattaggaatcaaacctctaggtttgacatgatcctgcgtatgttattagctataatagtcgtgcaggcgatgtgtccaatctgtcggcacgttaatcgtttattacttgtggtggaaatagttgtgcaagcatttgtggaaggaagtactgtatttcaagaaataaatggacgtgtgtg

SEQ ID NO: 3446 - DNA, 1032 bp, Oryza sativa
ctagtcatttttttcctttttttgcgggaaagctagcaaacactagtaaccttctgcttatatatcacacaaacaaatactatgtcggtcacgcctaccgacgacgtcatgatgactggcgccggcgacgtgcaggccgctgagacgttccgcgtgttcgtcgggtacgactcgcgcgaggacatcgcgtaccgcgtgtgccggcgctccctgctgcagcgctcctccgtgccggtggccgtgatcccgatcgtgcagcaggagctccggtctgcggggctgtactggcgggagcgcgggcccacggagagcaccgagttctccttcacccgcttcctgacgccccacctggccggctaccgcggctgggcgctcttcgtcgactgcgacttcctcttcgtcgccgacgtcgcggagctggcgcgcatggccgacccgcgctacgcggtgctgtgcgtgcaccacgactacgcgcccaaggaggccaccaagatggacggcgccgtgcagacggtgtacccgcgcaagaactggtcgtccatggtgctcttcaactgcgcccacccaaagaaccgcgccgcgctgacgcccgaggccgtgagcacgcagagcggcgcgtacctgcaccgcttcatgtggctggacgacgccgacatcggcgaggtgcccttcgtgtggaacttcctcgtggggcacaaccgcgtcgaccccgccgacacggccgggacggcgccgcgcgccatccactacacttccggcgggccgtggttcgagcagtacaagaactgcgagttcgcggagctctgggtccaggaacgtgacgcgtatgaggccgaggcggaggaggacgaggagaaggaagagcacgaggccaaggccatcctgcatgcccctgctgcgccgtcggcagtttccgtggacgcctgagcctcatgcggtgcctactgtttcccccctaggggtaataagatgattggaataaactcatgacggccacacctcaagaatgataagttctatatattgtgatca

SEQ ID NO: 3447 - DNA, 1219 bp, Triticum aestivum
tagaaaattccagcctgccctgcccaagcaaagaatcccgtccccaccagccaggaggaggggaaagcggctgctggatcgacgatgatgtggggcgtcgccgccgccgtcgcctccgcggccgccgtcgccgtggcctccgtcgccgagctcctcgcctgcgactgcgcccccacggagcccgccgccgccgtcgccgtcgccgtcggcagatgcgacgagttcctcctccgccagcgggaatccccggcgtcgagcggggggagcggcggccgggacgacaagttcgcgccgcggttcgacgggctgcgcttcatcgagacgctcgtcacggcgcaccgctgaaaattcccccggggattctttccagtcgtcttcttcgtgcgattcgcggggagaggctggctgctaccctattaattcggcgattggcggccaacgcgccgccagatttttgctactaggacaaattgaggtttttctttctttcctgacgattatcgtccctattgttgttgagtgatgcgattgaatcggaaccttcaagcgggcatgtgatatggtgagcgtatgtacttgtgctagcatttgcttcttcacccgatctgttatgcaagcatgatagtatgatatgagatgattgatggcatgatttcagctccaaacttgccattctcatgtatggtagtggtaggcctgctgtcgctgcttgtggttggcctccttccggaattgtccttttcccctctttgctgcacacatatcacatggctcaatctttgcaccgcatcctgtccatggcttttggggtaaagttagtagatggagcccctggatgtatggtaatgattatgctgattatgcctcgccaaattagaactagttttaaagcaaggagagtggtggtacgtgctcgtatgatgtggctccttccttaccgtccatttttccttgcagatttggctaactatctccggctcatcttgacttgttttcgtcttctaccacaagtagaattcgtgtattggaaatacttgttatcaaaatgaataaaaagatagttctagatacatccatttttgtccattttgataacaagtattttcggacgaagcgagtatcatattacgtactaccttcgttccaaagtacttgtcgtggttttagttcaaattataatcttaagagggaataaatgtggaattatacggacgcgtgg

SEQ ID NO: 3448 - DNA, 1208 bp, Triticum aestivum
tagaaaattccagcctgccctgcccaagcaaagaatcccgtccccaccagccaggaggaggggaaagcggctgctggatcgacgatgatgtggggcgtcgccgccgccgtcgcctccgcggccgccgtcgccgtggcctccgtcgccgagctcctcgcctgcgactgcgcccccacggagcccgccgccgccgtcgccgtcgccgtcggcagatgcgacgagttcctcctccgccagcgggaatccccggcgtcgagcggggggagcggcggccgggacgacaagttcgcgccgcggttcgacgggctgcgcttcatcgagacgctcgtcacggcgcaccgctgaaaattcccccggggattctttccagtcgtcttcttcgtgcgattcgcggggagaggctggctgctaccctattaattcggcgattggcggccaacgcgccgccagatttttgctactaggacaaattgaggtttttctttctttcctgacgattatcgtccctattgttgttgagtgatgcgattgaatcggaaccttcaagcgggcatgtgatatggtgagcgtatgtacttgtgctagcatttgcttcttcacccgatctgttatgcaagcatgatagtatgatatgagatgattgatggcatgatttcagctccaaacttgccattctcatgtatggtagtggtaggcctgctgtcgctgcttgtggttggcctccttccggaattgtccttttcccctctttgctgcacacatatcacatggctcaatctttgcaccgcatcctgtccatggcttttggggtaaagttagtagatggagcccctggatgtatggtaatgattatgctgattatgcctcgccaaattagaactagttttaaagcaaggagagtggtggtacgtgctcgtatgatgtggctccttccttaccgtccatttttccttgcagatttggctaactatctccggctcatcttgacttgttttcgtcttctaccacaagtagaattcgtgtattggaaatacttgttatcaaaatgaataaaaagatagttctagatacatccatttttgtccattttgataacaagtattttcggacgaagcgagtatcatattacgtactaccttcgttccaaagtacttgtcgtggttttagttcaaattataatcttaagagggaataaatgtggaattata

SEQ ID NO: 3449 - DNA, 1800 bp, Secale cereale
atagaatagaaacgacacagcagacaagagagccaaagattaaaaaaaaggactacagaaaaggggaagttgacactgagagagaaacaaatcctaccccgagcggaggactgctcgctcgctcgtcggtggtggtggtggttccgccctcctcctcctctctctccctctccgcgccgcccaggtgttagctgataaacccgaagggagaaggagctaccatgggcatttcatccaagtggatcaaatcacttgttgggataaaaaagcatggaaaagctcaaaatggcgaaagcagcagagaaaggagctctgctgctcaggtgctacacaaacggaaacattccgtggatactgaaggtgcccttgcagttgcagaacacatagtgcaaactgaaccattggctagtgacgccaatacacagacaatttcatctcagactggactaaatgcaaaggagcatcaggctgcaacagttattcaatcagcctttcgagcattcttggccaggcgagctttacgggcattaaaaggattagttagactccaggctctcgttaggggccatgctgtacgaaagcaagcagcagaaacacttcagtgtatgcaatcactagtaaaggctcaagctcgtgtcagagcaagacaggttcgtattggtttggaaggtcaggtgacccagaagaaggctcctgaaaaaaatcctcacgaggatcctgctcgagaaattgaggaacgctggtgtggcggtattggctcggcggaagatatgcaagctaaagtattgaaaaagcaagaagctgccgctaagcgggaaagagcaatggcatatgctttaacacaccagcggcaagcaggttccaggaaactgaaagctgcagatgtgcaagggccagaggcggatgagaaccagtgggggcggaactgggtggagaggtgggtggctgtacgcccgtgggagaacaggttactggacggtaacgccaaagagaatgtaccaattggcgatgataaggaggctgaggaaaatggggacagggatgcaaacaagccaaaaggaaaagctgcagtttcgggcattcagtcaaatggttcaagccagacgaaagatgcaaaacacaaaaagtcacactctgatgcaagtggttcttcatcagggcagtctgcggctgcgccacccaccgcttctttgggatcatctaagctgaaaccgaagccatcggatgaaacctctgaggaagtcagccctcagcctacagatccggctccgcggtccccaagcaatccgaaagaaaggccggcagcacaagtcagtgcaccaaccaagaagcggctatcccttcctaacaacgcaactgccagcggcggagcaagaaaaggccaggcgagcagcagcgagaaaacgcggtccgtcggttccaagaacacggcgaaaggagcgtccaagtctgaaccgaagcagcggcagagccccgggagcgcaaccgcgaagcgggtccaggcacaggcctgatcctgatgaatcaatcgactccctcccattttattcagaaacttagtcatggcagtgcccatctgtcacgtgtgccgttgcaccatctgtgtacatagaccgagaaataaacaaccctgcatctagatcgccgccacgccccatgcgccatcggtgccgcgttgtcgtaagccatttctgtgtgtatcttctcttcctcaagccactctttcatggaaagaaccgaagaggcaagcaccatgttatctgcaagttgtgtctatgtctatctatccttgagtgtaag

SEQ ID NO: 3450 - DNA, 1610 bp, Secale cereale
gcgccgcccaggtgttagctgataaacccggagggagaaggagctaccatgggcatttcatccaagtggatcaaatcacttgttgggataaaaaagcatgggaaagctcaaaatggtgaaagcagcagagaaaggagctctgctgctcaggtgctacacaaaaggaaacattccgtggatactgaaggtgcccttgcagttgcagaacacacagtgcaaactgaaccattggctagtgacaccaatacacagacaatttcatctcacactgaactaaatgcaaaggagcatcaggctgcaacagttattcaatcagcctttcgagcattcttggccaggcgagctttacgggcattaaaaggattagttagactccaggctctcgttaggggccatgctgtacgaaagcaagcagcagaaacacttcagtgtatgcaatcactagtaaaggctcaagctcgtgtcagagcaagacaggttcgtattggtttggaaggtcaggtgacccagaagaaggctcctgaaaaaaatcctcacgaggatcctgctcgagaaattgaggaacgctggtgtggcggtattggctcggcggaagatatgcaagctaaagtattgaaaaagcaagaagctgctgctaagcgggaaagagcaatggcatatgctttaacgcaccagcggcaagcaggttccaggaaactgaaagctgcagatgtgcaagggccagaggcggatgagaaccagtgggggcggaactgggtggagaggtgggtggctgtacgcccgtgggagaacaggttactggaaggtaacgccaaagagaatgtaccaattggcgatgataaggaggctgaggaaaatggggacagggatgcaaacaagccaaaaggaaaagctgcagtttcgggcattcagtcaaatggttcaagccagacgaaagatgcaaaacacaagaagtcacattctgatgcaagtggttcttcatcaggacaatctgcggctgtgccacccgccgcttctttgggatcatctaagctgaaaccgaagccatcggaccaaacctctgaggaagtcagccctcagcctacagatccggctccgcggtccacaagtaatcccaaggaaaggccagcagcacaagtcaatgcaccaaccaagaagcggctatcccttcctaacaacgcaactgccagcggcggagcaagaaaaggccaggcgagcagcagcgagaaaactcggtccgttggttccaggaacacggcgaaaggagcgtccaagtctgaaccgaagcagcggcagagccctggcagcgcaaccccgaagcgggttcagtcacaggcctgatcctgatgaatcgatccactccctcccatttcgttcagaaacttagtcatggcaatgcccatctgtcacgtgtgccgttgcatcatctgtgtatatccaagaaataaacaaccctgcatctagatcgccgccacgctccatgcgccatcggtgccgcgttgtcgtaactcgtaagccattcctgtgtgtatcttctcttcctcaagccactctttcatggaaagaaccgaagaggcaagcaccatgttatctgcaagttgtgtgttcat

SEQ ID NO: 3451 - DNA, 1757 bp, Triticum aestivum
caggtgctagctgatcactactgcactaggagggaaaaggagctaccatgggcatttcatccaagtggatcaaatcacttgttgggataaaaaagcatggaaaagctcaaaatggcgaaagcagcagagaaaggagctctgctgctcaggtgctacacaaacggaaacattccgtggatactgaaggcgcccttgcagttgccgaacgcacagtgcaaactgaaccattggctagtgacaccaatacacagacaatttcatctgagactgaactaaatacaaaggagcatcaggctgcaacagttattcaatcagcctttcgagcattcttggctaggcgagctttacgggcattaaaaggattagttagactccaggctctcgttaggggccatgctgtacgaaagcaagcagcagaaacacttcagtgtatgcaatcactagtaaaggctcaagctcgtgtcagagcaagacaggtttgtattggtttggaaggtcaggtgccccagaagaaggctcctgaaaaaatgctcaggaggatcaagctcgagaaattgaggaacgctggtgtggcggtattggatcggcggaagatatgcaagctaaagtattgaaaaagcaagaagctgccgctaagcgggaaagagcaatggcatatgctttaacgcaccagcggcaagcaggttccaggaaacagaaagctgcagatgtccaagggccagaggcggatgagaaccagtgggggcggaactgggtggagaggtgggtggctgtacgcccgtgggagaacaggttactggacagtaatgccaaagagaatgtaccgtttggcgatgataaggaggccgacgaaaatggggacagggatgtaaacaagccaaaaggaaaagttgcagtttcgggcattcagttaaatggttcaagccagacgaaagatgcaaaacacaagaagtcacattctgatgcaagtggttcttcatcagggcaatctgcggctgcgccacccgccgcttctttgggatcatctaagctgaaaccgaagccatcggatcaaacctccgaggaagtcagccctcaacctacagatccggctccacggtccacaagtaatccgaaggaaaggccagcagcacaagtcaatgcaccaaccaagaagcggctatcccttcctaacaacgctgccggtggcgcggcaagaaaaggccaggcgaacagcagcgagaaagctcagcccgtcggttccaagaacaaggcgaaaggagcatccaagtctgaatcgaagcagcggccgagccctggtagcacaagcgcgaagcgggtttaggcagaggcctgatgatcaaccaactcagttccatttcatccagaaacttagtcatggcaatgatgtcgctgcatcatctgtgtacataaaaccaagaaataaacaaccctgcatctagatcgccgccacgctccatgccccgtcggtaggcgttgctgtaaccattacctcatgcttccgtagcattctgtgtgtatgttttcttcttcgacccactcttccgaaagaaccgaagaggcaagcaccatgttatctgcaagttgtgtctatctatccttcagtgtaagaaaaaccatgctttaatgttccaacatggcatgttctgcagcatcagtggtggtggttgggtccatgcatatccttcgtatccctcatgtatattgctcactgctttcttcatggaaaggccgcccagattcttctggaggatttg

SEQ ID NO: 3452 - DNA, 1751 bp, Triticum aestivum
acagagaaatcctaccccgagcggagagagcggagggcgaccggaggactgctcgctcgctcgctcgtcggtggtggttccgccctctctccttccctccctcctccgcgctgcccaggtgttagctgatcactacttcactaggagggaaaaaggagctaccatgggcatttcatccaagtggatcaaatcacttgttgggataaaaaagcatggaaaagctcaaaatggcgaaagcagcagagaaaggagctctgctgctcaggtgctacacaaacggaaacattccgtggatactgaaggcgcccttgcagttgcagaacacagagtgcaaactgaaccattggctagtgacaccaatacacagacaatttcatctgagactgaactaaatacaaaggagcatcaggctgcaacaattattcaatcagcctttcgagcattcttggctaggcgagctttacgggcattaaaaggattagttagactccaggctctcgttaggggccatgctgtacgaaagcaagcagcagaaacacttcagtgtatgcaatcactagtaaaggctcaagctcgtgtcagagcaagacaggttcgtattggtttggaaggtcaggtaccccagaagaaggctcctgaacaaaatgctcaggaggatcaagctcgagaaattgaggaacgctggtgtggcggtattggctcggcggaagaaatgcaagctaaagtactgaaaaagcaagaagctgccgctaagcgggaaagagcaatggcatatgctttaacgcaccagcggcaagcaggttcgaggaaacagaaagctgcagatgtccaagggccagaggcggatgagaaccagtgggggcggaactgggtggagaggtgggtggctgtacgcccgtgggagaacaggttactggacagtaatgccaaagagaatgtaccaattggtgatgataaggaggctgaggaaaatggggacagggatgtaaacaagccaaaaggaaaagttgcagtttcgggcattcagttaaatggttcaagccagacgaaagatgcaaaacacaagaagtcacattctgatgcaagtggttcttcatcagggcaatctgcggctgcgccacccgccgcttctttgggatcatctaagctgaaaccgaagccatcggatcaaacctccgaggaagtcagccctcaacctacagatccggctccacggtccacaagtaatccgaaggaaaggccagcagcacaagtcaatgcaccaaccaagaagcggctatcccttcctaacaacgcagctgccggtggcgcggcaagaaaaggccaggcgaacagcagcgagaaagctcagcccgtcggttccaagaacaaggcgaaaggagcatccaagtctgaatcgaagcagcggccgagccctggtagcacaagcgcgaagcgggtttaggcagaggcctgatgatcaaccaactcagttccatttcatccagaaacttagtcatggcaatgatgtcgctgcatcatctgtgtacataaaaccaagaaataaacaaccctgcatctagatcgccgccacgctccatgccccgtcggtaggcgttgctgtaaccattacctcatgcttccgtagcattctgtgtgtatgttttcttcttcgacccactcttccgaaagaaccgaagaggcaagcaccatgttatctgcaagttgtgtctatctatccttcagtgtaagaaaaaccatgctttaatgtt

SEQ ID NO: 3453 - DNA, 2118 bp, Triticum aestivum
actgagagaaatcctaccccgagcggagagagcggagggcgaccggaggactgctcgctcgctcgctcgtcggtggtggttccgccctctctccctcccttgtccgcgctgcccaggtgttagctgatcactacttcactaggagcgaaaaggagctaccatgggtatttcatccaagtggatcaaatcacttgttgggataaaaaagcatggaaaagctcaaaatggcgaaagcagcagagaaaggagctctgctgctcagctgctacacaaacggaaacattctgtggatactgaaggctcccttgcagttgcagaacacacagtgcaaattgaaccattggctagtgacaccaatacacagacaatttcatctgagactgaactaaatacaaaggagcatcaggctgcaacagttattcaatcagcctttcgagcattcttggctaggcgagctttacgggcattaaaaggattagttagactccaggccctcgttaggggccatgctgtacgaaagcaagcagcagaaacacttcagtgtatgcaatcactagtaaaggctcaagctcgtgtcagagcaagacaggttcgtattggtttggaaggtcaggtaccccagaagaaggctcctgaacaaaatgctcaggaggatcaagctcgagaaattgaggaacgctggtgtggtggtattggctcggcggaagatatgcaagctaaagcattgaaaaagcaagaagctgccgctaagcgggaaagagcaatggcatatgctttaacacaccagcggcaagcaggttccaggaaacagaaagctgcagatgtccaagggccagaggcggatgagaaccagtgggggcggaactgggtggagaggtgggtggctgtacgtccgtgggagaacaggttactggacagtaatgccaaagagaatgtaccaattggcgacgataaggaggctgaggaaaatggggacagggatgtaaacaagccaaaaggaaaagttgcagtttctggcattcagtcaaatggttcaagcgggacgaaagatgcaaaacacaagaagtcacattctgatgcaagtggttcttcatcagggcaatctgcggctgcgccacccgctgcttctttgggatcatctaagctgaaaccgaagccatcgggtcaaacctctgaggaagtcagccctcaacctaccgatccggctacgcggtccacaagtaatccgaaagaaaggccagcagcacaagtcaatgcaccaacgaagaagcggctatcccttcctagcaacggaactgccggtggcggagcaagaaaaggccaggccaacagcagcgagaaagctcggcccgtcggttccaagaacaaggcgaaaggagcgtccaagtctgaaccgaagcagcgtcggagccctggcagcgcaaccgcgaagcgggcccaggcacaggcctgaccaatcaatccactccctcccatttcatccagaaacttagtcgtcatggcaatgcccatctgtcacgtacataaaaaccaagaaataaacaaccctgcatctagatcgccgccacgctccctgcatttcctcatgcttccgtcagctaccattctgtgtgtatgctttcttcttcaagccactgttccgaaagaaccgaagaggcaagcaccatgttatctgcaagttgtgtctgtccatccttcagtgtaagaaaaaccatgctttaatgttgcaacatggcatgttctgcagcatcagtggtggtggttgggtccatgcatatccttcgtatccctcatgtatattgctcactgctttcttcatggaaaggccgcccagattcttctggaggatttgtataagtcgcaacgtgtcccatcttgcatgcctgaccatttttgcatgatgaaagtggtggcttttgcaaagccaaagcaggatggtgtgagtatgatgatgggtctccaggtgcaatcatgcatgcagtggttggttccaatgcagccccatttgcaggtcactttaggacccggctgaaagccacctgctgcttggaacatgcctgcctgcctttgactattgatggatgcccgtgctgtgtggtaagtaagctgatgtgttgt

SEQ ID NO: 3454 - DNA, 1854 bp, Triticum aestivum
gagaaatcctaccccgagcggagagagcggagggcgaccggaggactgctcgctcgctcgctcgtcggtggtggttccgccctctctccttccctccctcctccgcgctgcccaggtgttagctgatcactacttcactaggagggaaaaggagctaccatgggcatttcatccaagtggatcaaatcacttgttgggataaaaaagcatggaaaagctcaaaatggcgaaagcagcagagaaaggagctctgctgctcagctgctacacaaacggaaacattctgtggatactgaaggctcccttgcagttgcagaacacacagtgcaaattgaaccattggctagtgacaccaatacacagacaatttcatctgagactgaactaaatacaaaggagcatcaggctgcaacagttattcaatcagcctttcgagcattcttggctaggcgagctttacgggcattaaaaggattagttagactccaggccctcgttaggggccatgctgtacgaaagcaagcagcagaaacacttcagtgtatgcaatcactagtaaaggctcaagctcgtgtcagagcaagacaggttcgtattggtttggaaggtcaggtaccccagaagaaggctcctgaacaaaatgctcaggaggatcaagctcgagaaattgaggaacgctggtgtggcggtattggctcggcggaagaaatgcaagctaaagcactgaaaaagcaagaagctgccgctaagcgggaaagagcaatggcatatgctttaacacaccagcggcaagcaggttccaggaaacagaaagctgcagatgtccaagggccagaggcggatgagaaccagtgggggcggaactgggtggagaggtgggtggctgtacgtccgtgggagaacaggttactggacagcaatgccaaagagaatgtaccaattggcgacgataaggaggctgaggaaaatggggacagggatgtaaacaagccaaaaggaaaagttgcagtttctggcattcagtcaaatggttcaagcgggacgaaagatgcaaaacacaagaagtcacattctgatgcaagtggttcttcatcagggcaatctgcggctgcgccacccgctgcttctttgggatcatctaagctgaaaccgaagccatcgggtcaaacctctgaggaagtcagccctcaacctaccgatccggctacgcggtccacaagtaatccgaaagaaaggccagcagcacaagtcaatgcaccaacgaagaagcggctatcccttcctagcaacggaactgccggtggcggagcaagaaaaggccaggccaacagcagcgagaaagctcggcccgtcggttccaagaacaaggcgaaaggagcgtccaagtctgaaccgaagcagcgtcggagccctggcagcgcaaccgcgaagcgggcccaggcacaggcctgaccaatcaatccactccctcccatttcatccagaaacttagtcgtcatggcaatgcccatctgtcacgtacataaaaaccaagaaataaacaaccctgcatctagatcgccgccacgctccctgcatttcctcatgcttccgtcagctaccattctgtgtgtatgctttcttcttcaagccactgttccgaaagaaccgaagaggcaagcaccatgttatctgcaagttgtgtctgtccatccttcagtgtaagaaaaaccatgctttaatgttgcaacatggcatgttctgcagcatcagtggtggtggttgggtccatgcatatccttcgtatccctcatgtatattgctcactgctttcttcatggaaaggccgcccagattcttctggaggatttgtat

SEQ ID NO: 3455 - DNA, 2089 bp, Secale cereale
agccaaagattaaaaaaaaaggactcagaaaaggggaagttgacactgagagagaaacaaatcctaccccgagcggaggactgctcgctcgctcgtcggtggtggtggtggttccgccctcctcctcctctctctccctctccgcgccgcccaggtgttagctgataaacccgaagggagaaggagccgacatgggcatttcatccaagtggatcaaatcacttgttgggataaaaaagcatgggaaagctcaaaatggtgaaagcagcagagaaaggagctctgctgctcaggtgctacacaaaaggaaacattccgtggatactgaaggtgcccttgcagttgcagaacacacagtgcaaactgaaccattggctagtgacaccaatacacagacaatttcatctcagactgactaaatgcaaaggagcatcaggctgcaacagtattcaatcagcctttcgagcatcttggccaggcgagctttacgggcattaaaaggattagttagactccaggctctcgttaggggccatgctgtacgaaagcaagcagcagaaacacttcagtgtatgcaatctctagtaaaggctcaagctcgtgtcagagcaagacaggttcgtattggtttggaaggtcaggtgccccagaagaaggctcctgaaaaaaatgcccaggaggatcaagctcgagaaattgaggaacgctggtgtggcggtattggctcggcggaagatatgcaagctaaagtattgaaaaagcaagaagctgccgctaagcgggaaagagcaatggcatatgctttaacacaccagcggcaagcaggttccaggaaactgaaagctgcagatgtgcaagggccagaggcggatgagaaccagtgggggcggaactgggtggagaggtgggtggctgtacgcccgtgggagaacaggttactggacggtaacgccaaagagaatgtaccaattggcgatgacaaggaggctgaggaaaatggggacagggatgcaaacaagccaaaaggaaaagttgcagtttcgggcactcagtcaaatggttcaagccagacgaaagatgcaaaacacaagaagtcacattctgatgcaagtggttcttcatcagggcaatctgcggctgtgccacccgccgcttctttgggatcatctaagctgaaaccgaagccatcggaccaaacctctgaggatccggctccgcggtccacaagcaatcccaaggaaaggccatcagcacaagtcaatgcaccaaccaagaagcggctatcccttcctaacaacgcagctgccggtggcgcggcaagaaaaggccaggcgagcagcagcgagaaaactcggtctgtcggttccaggaacatggcgaaaggagcgtccaagtctgaaccaaagcagcggcagagccctggcagcgcaaccccgaagcgggttcaggcacaggcctcatcctgatgaatcaatcgactccctcccatttcattcagaaacttagtcatggcaatgcccatccgtcacgtgtgccgttgcatcatctgtgtacatagaccgagaaataaacaaccctgcatctagatcgccgccacgccccatgcgccatcggtgccgcgttgtcgtaagccatttctgtgtgtatcttctcttcttcaagccactctttcatggaaagaaccgaagaggcaagcaccatgttgtctgcaggttgtgtctatgtctatctatccttgagtgtgagaaaaaccatgctttaatgctccaacatggccatgttctccagcactcggtggtggctggagccatcaaccatgcatgtctcttgctgattccttcatggaaagttcacccagattcttctggaggatttgcaacgtgctccatcttgcatgcttgggcattttttgcatgatgaaagtggtggcttttgcaaagccaaagcaggatggtgtgatgatgatgggtctccaggtgcaatcatgcatgcggtggttccaaaggcacgcccctattgcaggtctcgtttaggacccgactgagagccacctgcctgcctttgactaattgggatgcctgagctgtgt

SEQ ID NO: 3456 - DNA, 1890 bp, Triticum aestivum
ggggaagttggcacagagaaatcctaccccgagcggagagagcggagggcgaccggaggactgctcgctcgctcgctcgtcggtggtggttccgccctctctccctcccttgtccgcgctgcccaggtgttagctgatcactacttcactaggagggaaaaggagctaccatgggcatttcatccaagtggatcaaatcacttgttgggataaaaaagcatggaaaagctcaaaatggcgaaagcagcagagaaaggagctctgctgctcaggtgctacacaaacggaaacattctgtggatactgaaggcgcccttgcagttgcagaacacacagtgcaaattgaaccattggctagtgacaccaatacacagacaatttcatctgagactgaactaaatacaaaggagcatcaggctgcaacagttattcaatcagcctttcgagcattcttggctaggcgagctttacgggcattaaaaggattagttagactccaggccctcgttaggggccatgctgtacgaaagcaagcagcagaaacacttcagtgtatgcaatcactagtaaaggctcaagctcgtgtcagagcaagacaggttcgtattggtttggaaggtcaggtaccccagaagaaggctcctgaacaaaatgctcaggaggatcaagctcgagaaattgaggaacgctggtgtggcggtattggctcggcggaagatatgcaagctaaagtattgaaaaagcaagaagctgccgctaagcgggaaagagcaatggcatatgctttaacgcaccagcggcaagcaggttccaggaaacagaaagctgcagatgtccaagggccagaggcggatgagaaccagtgggggcggaactgggtggagaggtgggtggctgtacgcccgtgggagaacaggttactggacagtaatgccaaagagaatgtaccgtttggcgatgataaggaggccgacgaaaatggggacagggatgtaaacaagccaaaaggaaaagttgcggtttcgggcattctgtcaaatggttcaagccagacgaaagatgcaaaacacaagaagtcacattctgatgcaagtggttcttcatcagggcaatctgcggctgtgccacccaccgcttctttgggatcatctaagctgaaaccgaagccatcggatcaaacctctgaggaagtcagccctcaaccgaagccgtcggatcaaacctctgaggaagtcagccctcagcctacagatccggctccgcggtccacaagtaacccgaaggaaaggccagcacaagtcaatgcaccaacgaggaagcggctatcccttcctaacaacgcaactgccagcggcggagcaagaaaaggccaggcgagcagcagcgagaaaactcggtccgtcggttccaagaacacggcgaaaggtgcatccaagtctgaaccgaagcagcgaccgagccccggtagcgcaaccgcgaagcgggtccaggcacaggcctgatcaatcaatccactccctcccatttcattcagaaacttgttcatggccaatgcccatctgtcacgcgtgccgctgcatcatcatcatctgtgtacataaaaccaagaaataaaccaccctgcatctagatcgctgccacgcaggcgttgtcgtaacattatgtcatgctttccttcatgtgccattctatatgtatgttttcgtcgtcaagccactgttccgaagaggctctgcaagttgtctgtccatctatccttcagtgtgagaaaaaccatgcttcaatgttccagcatggcatgttctccagcactcagtggtggtggttggaaccgtcaaccatggacatcccccatgcatatctctcactgcttccttcatggaaagttca

SEQ ID NO: 3457 - DNA, 2030 bp, Secale cereale
tcgctcgctcgtcggtggtggtggtggttccgccctctctccctccctccctccctcctccgcgccgcccaggtgttagctgataaacccggagggagaaggagctaccatgggcatttcatccaagtggatcaaatcacttgttgggataaaaaagcatgggaaagctcaaaatggtgaaagcagcagagaaaggagctctgctgctcaggtgctacacaaacggaaacattccgtggatactgaaggtgcccttgcagttgcagaacacatagtgcaaactgaaccattggctagtgacgccaatacacagacaatttcatctcagactggactaaatgcaaaggagcatcaggctgcaacagttattcaatcagcctttcgagcattcttggctaggcgagctttacgggccttaaaaggattagttagactccaggctctcgttaggggccatgctgtacgaaagcaagcagcagaaacacttcagtgtatgcaatcactagtaaaggctcaagctcgtgtcagagcaagacaggttcgtattggtttggaaggtcaggtgccccagaagaaggctcctgaaaaaaatcctcacgaggatcaagctcgagaaattgaggaacgctggtgcggcggtattggctcggcggaagatatgcaagctaaagtattgaaaaagcaagaagctgccgctaagcgggaaagagcaatggcatatgctttaacacaccagcggcaagcaggttccaggaaacagaaagctgcagatgtgcaagggccagaggcggatgagaaccagtgggggcggaactgggtggagaggtgggtggctgtacgcccgtgggagaacaggttactggacggtaacgccaaagagaatgtaccaattggcgatgataaggaggctgaggaaaatggggacagggatgtaagcaagccaaaaggaaaagctgcagtttcgggcattcagtcaaatggttcaagccagacgaaagatgcaaaacacaagaagtcacattctgatgcaagtggttcttcatcagggcaatctgcggctgtgccacccgccgcttctttgggatcatctaagctgaaaccgaagccatcggaccaaacctctgaggaagtcagccctcagcctacagatccggctccgcggtccacaagtaatcccaaggaaaggccagcagcacaagtcaatgcaccaaccaagaagcggctatcccttcctaacaacgcaactgccagcggcggagcagaaaaggccaggcgagcagcagcgagaaaactcggtccgttggttccaggaacacggcgaaaggagcgtccaagtctgaaccgaagcagcggcagagccctggcagcgcaaccccgaagcgggttcagtcacaggcctgatcctgatgaatcgatccactccctcccatttcgttcagaaacttagtcatagcagtgcccatctgtcacgtgtgccgttgcaccatctgtgtacatagaccgagaaataaacaaccctgcatctagatcgccgccacgccccatgcgccatcggtgccgcgttgtcgtaagccatttctgtgtgtatcttctcttcctcaagccactctttcatggaaagaaccgaagaggcaagcaccatgttatctgcaagttgtgtctatgtctatctatccttgagtgtgagaagaaccatgctttaatgttccaacatggccatgttctccagcactcggtggtggctggagggagccatcaaccatgcatatctctcaccgattctttcatggaaagttcacccagattcttctggaggatttgcaacgtgctccatcttgcatgcttgggcattttttgcatgatgaaagtggtggcttttgcaaagccaaagcaggatggtgtgatgatgatgggtctccaggtgcaatcatgcatgcggtggttccaaagcagccccatttgcaggtctctttaggacccgactgagagccacctgcctgcctttgactaatgggatgcctgagctgtgt

SEQ ID NO: 3458 - DNA, 1540 bp, Panicum virgatum
ccacgcgtccgatgatcaaaaaaaaaaccatatcccgccgccccacctgccgccgcatctcccctagccgtcggactcgctcccggtactcccggaatcaacaagaactagtttttcccttcttgatcctccctgagcagcgagtcacatccccatctcccaccaagaaaccctaagacccccctgctaaggggcgaggaggccatgagggggaagaagccggtgaaggagctaaagctcgccgttccggcgcaggagacccccgtcgacaagttcctgacggcgagtggcacattcaaggatggtgaactgcggcttaatcaaagaggcttgcggcttatctccgaggaaaatggagatgaaaatcaatcaacaaacctgaaggtggaagatgtacagttatcaatggatgatcttgagatgatccaagtcattggtaaagggagtggtggtgttgtccagctagtgcggcacaaatgggtggggacattgtatgccttgaagggtattcaaatgaacattcaggagtcagtgcgcaaacaaatagttcaagagctcaaaattaatcaagcaacacagagtccacatatagttctgtgccatcaatctttttaccacaatggtgtcatatatcttgttcttgagtacatggatcgcggatctcttgcggacatcattaaacaagtgaagaccattctggagccataccttgcagtactttgcaagcaggtcttggagggtttattatatcttcatcatgaaaggcatgttattcacagggacataaagccgtctaacttgttagtcaaccgtaaaggtgaagtaaagattactgatttcggggtcagtgcagtgctagcaagttcaatgggtcagcgggatacatttgttggaacctacaactatatggcgcctgagaggattagtgggagctcttatgactataagagcgacatatggagtttgggactagtaatacttgagtgtgccattggtcggttcccttatataccttcagaaggagatggttggttaagcttctatgaacttcttgaagcaattgttgatcagccaccaccttctgcacctgcagatcagttctctccagaattctgctcatttatctcctcttgcatacagaaggacccagcagagaggatgtctgcttcagaacttttgaatcaccctttcatccagaagtttgagggtaaggatttagacctgcggactcttgtggagagcctggaacctccgatgaacatacccgagtagagtgccattaggatggatgacaatccttttgcaatgtattcagggtcaccttggtggccttttgatatccgcacatatttctcctgaacagcgtgcatcaccccccgtaacgcgtgatgctgtgtgtatgtttttgaccgtgtcaaaaaaactcccagggatcattgtgacaccccaagttttccttgtggcagagtgtttctcttgataaggctctccatctctatgtggcccgtgatgcatctacaagactgttttcactgtgaat

SEQ ID NO: 3459 - DNA, 1643 bp, Setaria italica
aatctcgacaccaacctctcctctgactccgagtctcgagcccgtcaccgccgccgccgctccaacccgatcccgccgccccacctgccgcctcatctccccgcaggcgtcggctccgctcctggtactcccgaagcaacaagaactagcttctgtctccttgatcctcccggagccgcgagtcctatccccatcttccactaagaaaccctaactctccctgccaaggggcgaggaggccatgagggggaagaagccggtaatggagctgaagctcgcggtgccggcgcaggagacccccgtcgacaaattcctgacggcgagtggtacattcaaggatggtgaactacggcttaatcaaagaggcttgcggcttatctccgaggaaaatggagatgaaaatcaatcgacaaacctgaaggtggaagatgtacagttatcaatggatgatcttgagatgattcaagtcattggtaaagggagtggtggtgttgtccagctagtgcggcacaaatgggtggggacattgtatgccttgaagggtattcaaatgaacattcaggagtcagtgcgcaaacaaatcgtacaagagctcaagattaatcaagcaacacagagtccacatatagttatgtgccatcaatctttttaccacaatggtgtgatatatcttgttcttgagtacatggatcgcggatctcttgcggacatcattaagcaagtgaagactgttctggagccataccttgcagtactttgcaagcaggtattggagggtttgttgtatcttcatcatgaaaggcatgtgattcacagggacataaagccgtctaacttgttagtcaaccgtaaaggtgaagtaaagattactgatttcggggtcagtgcagtgctagcaagttcaatgggtcagcgggatacatttgttggaacctacaactatatggcacctgagaggattagtggaagctcttacgactacaagagcgacatatggagtttgggactggtgatacttgagtgtgccattggccggttcccctatataccttcagaaggagaaggttggataagcttctatgaacttcttgaagcaattgttgatcagccaccaccttctgcacctgcagatcagttctctccagaattctgctcatttatctcctcttgcatacagaaggatccagcagagaggatgtctgcttcagaactcttgaatcaccctttcatcaagaagtttgagggtaaggatttggacctgcggactcttgtggagagcctggagcctccgatgaacatacccgagtagactgccattaagatggatcgacgatccttttgcaatgtattcaggatcaccgtggtggcctcttgatatccgcacatatttctcctgaaccgcgtgcatcatgtccctaatcgtgggatgctgtgtgtatgttcttgattgctgcagaaaaatgtcccatggatcattttgacacccaagctccttttattgtgttccttaatagaatgtttcttgtagcagagtatctcttgaaaaggctctccatctagttcctgatgcattagactggtttcactgtgaatgtttcttgtgacaaatttgatttttcattgtaagttgcatgagtctacgc

SEQ ID NO: 3460 - DNA, 1715 bp, Zea mays
atggcggaaatgacaagacgggtgccatatcgaatggacgaatccatatgcgcggaagaacaaattggggcctacaatggcgggagggaacaatgccatttcacgagccaagttaaaccgactcacgagccaacttcagtcaagccgagctcctctttgaaaagagagccgagctcgtctatcaaccagccaccgtgcagcggcaagggtgtcaaggtcccgtaaaatctggcttttctccctccccataccccgcagtcccgcacacacactcgctttcttcggttcttcctcctcgagcagccacttccgtctctaaccctacagcgacgacgagagcgaggccatgaaggggaagaagccggtcaaggagctcaagctcaccgtgccggcgcaggagaccccggtagacaagttcctgacggcaagtggcacgttcaaggatggtgagctgaggctcaatcagagcggcttgcggcttatctctgaggaaaacggggatgaagatgaatctacaaagctgaaggtggaagatgtgcagttatcaatggatgatcttgagatgattcaagtcattggcaaaggaagcggtggtgttgtccagctagtgaggcacaaatgggtgggcacattatttgccttaaagggtattcaaatgaacattcaggagtcagttcgtaaacaaatagtacaggagctcaaaataaaccaagcaacacagagccctcatatagttatgtgccatcaatctttttaccacaatggtgtaatatatcttgttcttgagtacatggaccgtggatcgcttgcagacattgttaagcaagtgaagactattctggagccataccttgcagtactttgtaagcaggtcttggagggtttattgtatcttcatcatcaaaggcacgtgattcacagggacataaaaccatctaacttgttggtcaaccgtaaaggtgaagtcaagattaccgacttcggagtgagtgctgtgctagcaagctcaataggtcagcgagatacatttgttggaacctacaactatatggcgcctgagcggattagtggtagcacttatgactacaaaagtgacatatggagtttgggcttagttatacttgagtgtgccattggccggttcccttatataccttcggaaggtgaaggttggttaagcttttatgaacttctggaggccattgtcgatcagccaccaccttctgcacctgcagatcagttctctccagaattctgctcatttatctcctcttgcatacagaaagatccggctcagaggatgtctgcttcagaactcttgaatcacccttttttgaagaagttcgaggataaggacttaaacctggggattcttgtggagaacctggaacctccaatgaatatacccgaatagcctgtcgtttttagtgatgaagcctttgttgtgccttcagggtttggcctcgaagcctcttggcatctgctcctcaactgcagcctccctacctgaatatgctataacatcattgtatgattcaagccccttatctgagcataagagtagagggaactatgctgcattccgtgtatggtcaccttattgtagctattgttgcgacgggccttgtgattttgagtcttgttttaacttttgcagtcttatcggctgtggattcaaaatgaacgaactgaatattcaaaacatgtttgccaac

SEQ ID NO: 3461 - DNA, 912 bp, Secale cereale
gggcctccctgggcccgcgccgtgcccgcctcggtccacttctgccgccgcagctcggccactgctccttcccactcctccctcccctccccgcagcaacagcaagcgcggcagagccgtgcgcgccggagccagagccgcctcgtcgtcggcgccgcggacgatgggaagccaaacgggaggagccgagggtggtgacgctccggccggtggaggccacgccggagtccttcgctcccttcgggcaagtcatcgccgcctcccccgacggcgaccagttcggcccccacgacgcccagctcgacctcagccgcggcatccctaggttctacatcatgagattggagagcaggccgctcaagttctcgtccatcacccaccacgccagcgtcacgcagtgcctgggctccatcggcggacaggattggtacctgggcgtggccaagccttccatcgtggacgagcagagtggacaggatggtggcaggagtcccgtgcagtcgcgcgctgggcattactatctgcccccggatcccgccgaggtctgccgttttccgggtctccggtcccaagtttctcaagctgcacgctgggacctggcacgccgggccgctgttcaaggcagacgccgtggatttctataacctggagctcagcaacaccaatgtcgttgatcacaccacgcactacttcaagaagcaggacggcgtaacctttgtgatcgaggactgagagagacgctgcacgtcacgacctaggcacagaaaactcggcgccaccgtgtgcctcgcggacgctgttcgtgccctgtccctgtatgatgaacatccagtatgtatgtatgtatgtagtcgcaataatgtacgtaatgcaagtcatctgtacgtactctacttacgtacgcgtcagccg

SEQ ID NO: 3462 - DNA, 870 bp, Secale cereale
tcagcggccacttctgccgccgcagctcggccactccttcccttcccactccttcccctccccctcctcgcagcaacggccgagccgtgcgcgccgaagccagagccgcctcgtcgtcggcgccgcaggcgatggaagccaagcgggaggagccgagggtggtgacgctccggccggtggaggccacgccggagtccttcgctcccttcgggcaggtcatcgccgcctcccccgacggcaaccagttcggcccccacgacgcccagctcgacctcagccgcggcatccctaggttctacatcatgagattggagagcaggccgctcaagttctcttccatcacccaccacgccagcgtcacgcagtgcctgggctccatcggcggacaggactggtacctcggcgtggccaagccttccatcgtggacgagcagagtggacaggatggtggcaggagtcccgtgcagtcgcgcgccgggcattactatctgcccccggatcccgccgaggtctgcgttttccgggtctccggtgcgaagtttctcaagctgcacgccgggacctggcacgccgggccgctgttcaaggcagacgccgtggatttctataacctggagctcagcaacaccaatgtcgtggatcacaccacgcactacttcaagaagcaggacggcgtaacctttgtgatcgaggactgagagagacgctgcacgtcacgacctaggcacaaaaaactcggcgcaccgtgtgcctcgcggacgctgttcgtgccctgtccctgtgtgatgaacatccagtatgtatgtatgtactcgcaataatgtacgtactgcaagtcatttgtacgtacgcacctgctgctacaactga

SEQ ID NO: 3463 - DNA, 1000 bp, Avena sativa
cagcacccgtcggccacgcgaaaaatactcctcgagacggacccgaggtgaccgaagccgggtcgacgcgagcgggatgcagcaggcgctgggcctgggccacgcgtgcagcctcggccgttactgccgccgcagcacggctaccactcctcccccttcccctccacctcatcgcaccaacagcaagagcggcagagccgtgcgcgccgaagctgcctcgtcagcgccgcagacgatggaagccaagctggaggagccaagggtggtgaagctgcgggccgtggaggccacgccggagtccttcgcgccgttcgggcaggtcatcgccgcctcccccgacggcgaccagttcgggccccacgacgcccagctcgacctcagccgcggcatccctaggttctacatcatgagattggagagcaaaccgctcaagttctcgtcaatcacccaccacgccagcgtgacgcagtgcctgggatccatcggcggccaggattggtacctcggcgtcgccaaatcttccatcgtggacggggcgccgccggaacagagtggcggcaggagtcccgtgcagtcgcgcgctgggcatttctacctgcctcccgatccggccgaggtctgcgtcttcagggtctccggtccgaaatttctcaagctgcacgcggggacctggcacgccgggccgctgttcaaggcagacgccgtggatttctataacctggagctcagcaacaccaatgttgtcgatcacaccacgcactacttcaagaaacaagacggcgtaacctttgtgatcgaggattgaaatgccacacgcgtcgcggcctaggcacgaagctggagcgcaccggcgcgcccgcaggtcgtgttcgtgtcttcctggcttttgtaacgagaacaacctgtgtgtaaatgtaataatgtgattacagctttacaagtcaggcatgatgtactatgtctgagcttcttcttcagagtcgttgctgctggtagtcgc

SEQ ID NO: 3464 - DNA, 2289 bp, Brachypodium distachyon
tacacaagcgtttcgagacggtaccgaggttaccgtacagtgtaccgaagctagcgggatgctgggcctgggccgcgcgtgcagcctcggccattcctgccgccgccccacggccactcctccttcccctcgacctcatcctcgcagcagcagcaagagcggcagagccgtcctcgccgagaccgcaccgtccgcccaggcgcagatcatggaaccggccaagcgggaggagcccagggcggtggcgctgcgggcggtggaggccacgcccgagtccttcgcgccgttcgggcaggtcatcgccgcctcccccgacggcgaccacttcgggccccacgatgcccagctcgacctcagccgcgggatccctaggttctacatcatgaggttggagagcaggccgctgaagttctcgaacatcacccaccacgccagcgtgactcagtgcctgggctccatcggcggccaagactggtacctcggcgtggccaagccttcgattgtggacggggcgcccgggcagagcgctggcagggatcccgtgcagtcccgcgctgggcattactatctgcctcccgatccggccgaggtctgcgtcttcagggtctctggtccgaaatttctcaagctgcacgcggggacctggcatgctgggccgctgttcaaggccgacgccgtggatttctataacctggagctgagcaacaccaatgttgtcgatcacacgacacacaatttcgcgaaacaagacggtgtgaccttcgtgatcgaggactgaaaccgccacatgtggcgacctagctaggcacaaaactgagtgcgccagtgccatgttccctgttcttgctcgtcttcctcctgacttttgcagtgaacaaccgatatgcaaatgcaataatatcgtactagtacagtacagtactacacaatgaactgctgcttcacagtttggtgcttcttcaaagagttcagagtcgttgaatcgtgcagaacagggacaggcaatcagccggccggtgaaagcaactgggagctgcgccatgccgcccaagcccaagtacgcaacgacttctatgaccccagcgggcaattagccggccgggccgtgctcgcgtggcagccgctcagcatcgcatcgtacgtacgcctccatgacgctggaagctaggtgcagcctccctcgacacctccacgtctgtggtctgtccggccgtcgtcccagcgttggtgcttcggtcagagcaggcaaacacaacacccatgccgattacccgctgttggcaattaattaaggagaaagagaggcagaagcgcacggcacgaggtggcgacaggcaaggggggagcgccggacgccgaatccttcgtgtccgttggctggacgactcgaccaaacaaacaaccgcccgccttttaaaaccgtcccccactcgatcgcccccactctccccccgcactccgatcgccccagaaagtggaagcccacgacgacgaagacgaagagctcgggcgttcatggtgaggtctcaccacagccactcctccagcatccatgatgtcacctacagctgcgggtactgcggctacgcgctgaacctgtgctcctcggcgcggaacacggcgggcatcggctccaccaagtacggcaagcagatcaagaagggcgtcgtcgccttcctggccgtcgacgagacccgcttcacgcgggccgacgaggtcacctgcgcgccccacttccgctccgcccgctcctggggactcttcaggaggaggtcgcgcctgctctgccgcaagtgcggcggccgcatcggcgccgtctacgaagaggagaaggaggaggacgactccgctgtactgtctgagtacggcggctcggatgatgatgacctgcccacgagctcaggtagcagcggaggcgcgtccaggcggaggaacttcgtgatcaggatcagcgccctgcagccctcgtccgatgattctgctgctgttcccttctctctatgacgaattgacgatggtgcgagttgcctgtggggaatggggattggtggaagtgtataccgggacaaggttgctgaattttgtttttatgctgatgtctatagatgacccgtttgatgcatgtaagttgatcccacagcgtttgaatcatgtaatgaaacccaccgtggttgcaattttgagtcaccttgtatatatcaatggcttaattctagctttctgtgtgtgttttttcatttcagattagttattgtcatgagtttctctgtggacacctaaattgtggag

SEQ ID NO: 3465 - DNA, 1065 bp, Brachypodium distachyon
atgccgtggaagtgtggaaccgtgcgccggtgcacccgcaccaccaagcaattagccgtgtgccaagcaggccagcacacgctacgggcggcttcggccgtttgtttgggtacacaagcgtttcgagacggtaccgaggttaccgtacagtgtaccgaagctagcgggatgctgggcctgggccgcgcgtgcagcctcggccattcctgccgccgccccacggccactcctccttcccctcgacctcatcctcgcagcagcagcaagagcggcagagccgtcctcgccgagaccgcaccgtccgcccaggcgcagatcatggaaccggccaagcgggaggagcccagggcggtggcgctgcgggcggtggaggccacgcccgagtccttcgcgccgttcgggcaggtcatcgccgcctcccccgacggcgaccacttcgggccccacgatgcccagctcgacctcagccgcgggatccctaggttctacatcatgaggttggagagcaggccgctgaagttctcgaacatcacccaccacgccagcgtgactcagtgcctgggctccatcggcggccaagactggtacctcggcgtggccaagccttcgattgtggacggggcgcccgggcagagcgctggcagggatcccgtgcagtcccgcgctgggcattactatctgcctcccgatccggccgaggtctgcgtcttcagggtctctggtccgaaatttctcaagctgcacgcggggacctggcatgctgggccgctgttcaaggccgacgccgtggatttctataacctggagctgagcaacaccaatgttgtcgatcacacgacacacaatttcgcgaaacaagacggtgtgaccttcgtgatcgaggactgaaaccgccacatgtggcgacctagctaggcacaaaactgagtgcgccagtgccatgttccctgttcttgctcgtcttcctcctgacttttgcagtgaacaaccgatatgcaaatgcaataatatcgtactagtacagtacagtactacacaatgaactgctgcttcacagtttggtgc

SEQ ID NO: 3466 - DNA, 829 bp, Triticum aestivum
cacacgcagcgcccgcctccaccaccccacccctctctccgatctcaaggttggcggccggcggcaggatgaaggccaaggcgggctcccgcgccggcgactccaggctcgcggtgaagaagagcaaggccgagaaggaccccaacaagcccaagcggcccccgagcgccttcttcgtcttcatggacaccttcaggaaggagtacaaggagaagcaccccgacgtcaagcaggtctccgtgattggcaaggccggtggtgagaagtggaagtctctgagtgatgctgagaaggctccctatgctgccaaggccgagaagctcaaggccgagtacgccaagaagatcgacgcctacaacaacccgcaggcaggagaggcgtccggcgactctgacaagtccaagtccgaggtgaacgacgaggatgacggcagcgagggcgacgagtgaagcggcacgccaagcagccgcagcagggggaggggctctctggaacgtggccgttgctgctcattgctggtgtcactgatcgatgatggatgttcgctgttagtttagctccatggtagtccctccctctctttcaggttgctgctgctgatggcgatgatagaaatggtagctctagtcccatctagtcgttgtcctggatccgagtggtgaagttgctagtctggtttccttcctgtagggtcctgtgctcggaccaccctctgttccttcgtttttagcatgttttaattcagtctctgtcggatgtacctagtgtcgtgcctgtggttgttttaagaatcctacccagatctcaatatatatggtgttgaaaggaa

SEQ ID NO: 3467 - DNA, 873 bp, Pseudoroegneria spicata
cctccctcccacccggcgaacccccacccacgcacgcgcaccgcccggctcctccccaccccactcctcgctccgacccgaaggttggcggccggcggcaggatgaaggccaaggcgggctcccgcgccggcgactccaggctcgcggtgaagaagagcaaggccgagaaggaccccaacaagcccaagcgccccccgagcgccttcttcgtcttcatggacagcttcaggaaggagtacaaggagaagcaccccgacgtcaagcaggtctccgtgattggcaaggctggtggtgagaagtggaagtctctgagtgatgctgagaaggctccctacgctgccaaggccgagaagctcaaggccgagtacaccaagaagatcgacgcctacaacaacccacaggcaggagaggcgtccggcgactctgacaagtccaagtccgaggtgaacgacgaggacgacggcagcgagggcgacgagtgaagcggcatgccaagcagcagcagggggagggggagggggtctctggaacgtggccgttgctgctcattgctagtgtcaccgatcgatgatggatattcgctgttagtttagctgcttggtagtccctccctctctttcaggctgctgctgctgctgctggtggtggtggtagaaatggtagctctagtcccatgtagtcgttgtcctggatcggagtggtgaagttgctagtcgtcttgtcttctttctgtagggtcctgtgctcgggctgccctctgttgcgtcgtttttcatgttttaattcagtctctgtcgaatgtacctagtgtcgtgcccgtggttgttttaagaaatcctacccagatctcaatatatatggcgttgaaagga

SEQ ID NO: 3468 - DNA, 832 bp, Triticum aestivum
gcacccaccaagcacacgcagcgcccgcctccaccaccccacccctctctccgatctcaaggttggcggccggcggcaggatgaaggccaaggcgggctcccgcgccggcgactccaggctcgcggtgaagaagagcaaggccgagaaggaccccaacaagcccaagcggcccccgagcgccttcttcgtcttcatggacaccttcaggaaggagtacaaggagaagcaccccgacgtcaagcaggtctccgtgattggcaaggccggtggtgagaagtggaagtctctgagtgatgctgagaaggctccctatgctgccaaggccgagaagctcaaggccgagtacgccaagaagatcgacgcctacaacaacccgcaggcaggagaggcgtccggcgactctgacaagtccaagtccgaggtgaacgacgaggatgacggcagcgagggcgacgagtgaagcggcacgccaagcagccgcagcagggggagggggtctctggaacgtggccgttgctgctcattgctggtgtcactgatcgatgatggatgttcgctgctagtttagctccatggtagtccctccctctctttcaggttgctgctgctgatggcgatgatagaaatggtagctctagtcccatctagtcgttgtcctggatccgagtggtgaagttgctagtctggtttccttcctgtagggtcctgtgctcggaccaccctctgttccttcgtttttagcatgttttaattcagtctctgtcggatgtacctagtgtcgtgcctgtggttgttttaagaatcctacccagatctcaatatatatggtgt

SEQ ID NO: 3469 - DNA, 838 bp, Triticum aestivum
cacccacgcaagccccaagcacacgcagcgcccgcctcctccccacctacccctcgctccgctccgatcccaaggttggcggccggcggcaggatgaaggccaaggcgggctcccgcgccggcgactccaggctcgcggtgaagaagagcaaggccgagaaggaccccaacaagcccaagcgccccccgagcgccttcttcgtcttcatggacaccttcaggaaggagtacaaggagaagcaccccgacgtcaagcaggtctccgtggttggcaaggccggtggtgagaagtggaagtccctgagtgatgctgagaaggctccctacgctgccaaggccgagaagctcaaggccgagtacaccaagaagatcgacgcctacaacaacccacaggcaggagaggcgtccggcgactctgacaagtccaagtccgaggtgaacgacgaggacagcgagggcgacgagtgaagcggcacgccaagcagcagcagcagggggagggggtctctggaacgtggccgttgccgctcattgctggtgtcaccgatcgatgatggatgttcgctgttagtttagccccttggtagtccctccctctctttcaggttgctgctgctgatggcgatgatagaaatggtagctctagtcccatctagtcgttgtcctggatcggagtggtgaagttgctagcctagtttcctttctgcagggtcctctgctcggaccgccctctgttgcttcgtgctttatgttttaattcagtctctgtcgaatgtacctagtgtcgtgcccgtggctgttttaagaatcctacccagatctcaatatatattggtgt

SEQ ID NO: 3470 - DNA, 824 bp, Secale cereale
ctcccacccggcgaacccaccccacgcacgccccaagcactcgcagcgcccgcctccaccccacctctcgctccgatcccaaggttggcggccggcggcaggatgaaggccaaggtgggctcccgcgccggcgactccaggctcgcggtgaagaagagcaaggccgagaaggaccccaacaagcccaagcgccccccgagcgccttcttcgtcttcatggacaccttcaggaaggagtacaaggagaagcaccccgacgtcaagcaggtctccgtgattggaaaggccggtggtgagaagtggaagtccctgagcgatgctgagaaggctccttacactgccaaggccgagaagctcaaggccgagtacaccaagaagatcgacgcctacaacaacccacaggcaggtgaggcgtccggcgactctgacaagtccaagtccgaggtgaacgatgatgacagcgagggcgacgagtgaagcagcacaccaagcagcggcagggggaggtggtctctggaacgtggccgttgctgctcattgctactgtcacagatcgatgatggatgtttgctgttagtttagctccttggtagtccctccctctctttcaggctgctgctgctgctggtagaaaaatgctctagtcccatgtagccgttatcctggatcggagtggtgaagttgctagtctagtttcctttctgtagggtcctctgctcggaccgccctctgctgcttcgtgttttatgttttaatccagtctctgtcggatgtacctacctagtgtcgtgcccgtgtctgttttaagaatcctacccagatct

SEQ ID NO: 3471 - DNA, 848 bp, Secale cereale
tcagcatctcccacccgggacccggcgaacccaccccacgcacgccccaagcactcgccgcgcccgcctccaccccacctctcgctccgatcccaaggttggcggccggcggcaggatgaaggccaaggtgggctcccgcgccggcgactccaggctcgcggtgaagaagagcaaggccgagaaggaccccaacaagcccaagcgccccccgagcgccttcttcgtcttcatggacaccttcaggaaggagtacaaggagaagcaccccgacgtcaagcaggtctccgtgattggaaaggccggtggtgagaagtggaagtccctgagcgatgctgagaaggctccttacactgccaaggccgagaagctcaaggctgagtacaccaagaagatcgacgcctacaacaacccacaggcaggtgaggcgtccggcgactctgacaagtccaagtccgaggtgaacgatgatgacagcgagggcgacgagtgaagcagcacaccaaagcagcagcagggggaggtggtctctggaacgtggccgttgctgctcattgctaccgtcacagatcgatgatggatgttcgctgttagtttagctccttggtagtccctccctctctttcaggctgctgctgctgctggtggtagaaaatgctctagtcccatgtagtcgttgtcctggatcggagtggtgaagttgctagtctagtttcctttccgtagggtcctgtgctcggaccgccctctgctgcttcgtgttttatgttttaatccagtctctgtcggatgtacctagtgttgtgcctgtggctgttttaagaatcctacccagatctcaaaaaaaaaa

SEQ ID NO: 3472 - DNA, 875 bp, Secale cereale
gactaagaagagcaaggccgagaaggaccccatcccatctcatctcccacccggcgaacccacccccccgcacgccccacgcactcgcagcgcccgcctcctcccaacccactccccgctccgatcccaaggttggcggccggcggcaggatgaaggccaaggtgggctcccgcgccggcgactccaggctcgcggtgaagaagagcaaggccgagaaggaccccaacaagcccaagcgccccccgagcgccttcttcgtcttcatggacaccttcaggaaggagtacaaggagaagcaccccgacgtcaagcaggtctccgtgattggaaaggccggtggtgagaagtggaagtccctgagtgatgctgagaaggctccttacaccgccaaggccgagaagctcaaggccgagtacaccaagaagatcgacgcctacaacaacccacaggcaggtgaggcttctggcgactctgacaagtccaagtccgaggtgaacgatgatgacagcgagggcgacgagtgaagcagcacaccaaagcagcagcagggggaggtggtggtctctggaacgtggtcgttgctgctcattgctactgtcacagatcgatgaaggatgttcgctgttagtttagctccttggtagtccctccctctctttcaggctgctgctgctgctggtagaaaaatgctctagtcccatgtagccgttatcctggatcggagtggtgaagttgctagtctagtttcctttctgtagggtcctctgctcggaccgccctctgctgcttcgtgttttatgttttaatccagtctctgtcggatgtacctagtgttgtgcctgtggctgttttaagaatcctacccagatctcaa

SEQ ID NO: 3473 - DNA, 863 bp, Secale cereale
tcagcatctcccacccgggacccggcgaacccaccccacgcacgccccaagcactcgccgcgcccgcctccaccccacctctcgctccgatcccaaggttggcggccggcggcaggatgaaggccaaggtgggctcccgcgccggcgactccaggctcgcggtgaagaagagcaaggccgagaaggaccccaacaagcccaagcgccccccgagcgccttcttcgtcttcatggacaccttcaggaaggagtacaaggagaagcaccccgacgtcaagcaggtctccgtgattggaaaggccggtggtgagaagtggaagtccctgagcgatgctgagaaggctccttacaccgccaaggccgagaagctcaaggccgagtacaccaagaagatcgacgcctacaacaacccacaggcaggtgaggcttccggcgactctgacaagtccaagtccgaggtgaacgatgatgacagcgagggcgacgagtgaagcagcacaccaaagcagcagcagggggaggtggtctctggaacgtggccgttgctgctcattgctactgtgacagatcgatgatggatgttctctgttagtttagctccttggtagtccctccctctctttcaggctgctgctgctgctgctggtagaaaaatgctctagtcccatgtagccgttatcctggattggagtggtgaagttgctagtctagtttcctttccgtagggtcctgtgctcggaccgccctctgctgctttcgtgttttatgttttaatccagtctctgtcggatgtacctacctagtgtcgtgcccgtgtctgttttaagaatcctacccagatctcaatatacagtggtggtgtt

SEQ ID NO: 3474 - DNA, 913 bp, Secale cereale
acccgggacccggccgaacccaccccacgcacgcccaagcactcgccgcgcccgcctccaccccacctctcgctccgatcccaaggttggcggccggcggcaggatgaaggccaaggtgggctcccgcgccggcgactccaggctcgcggtgaagaagagcaaggccgagaaggatcccaacaagcccaagcgccccccgagcgccttcttcgtcttcatggacaccttcaggaaggagtacaaggagaagcaccccgacgtcaagcaggtctccgtgattggcaaggccggtggtgagaagtggaagtccctgagtgatgctgagaaggctccttacactgccaaggccgagaagctcaaggctgagtacaccaagaagatcgacgcctacaacaacccacaggcaggtgaggcgtccggcgactctgacaagtccaagtccgaggtgaacgatgatgacagcgagggcgacgagtgaagcagcacaccaaagcagcagcagggggaggtggtctctggaacgtggccgttgctgctcattgctaccgtcacagatcgatgatggatgttcgctgttagtttagctccttggtagtccctccctctctttcaggctgctgctggtagaaaatgctctagtcccatgtagtcgttatcctggatcggagtggtgaagttgctagtctagtttcctttctgtagggtcctctgcttggaccgccctctgctgcttcgtgttttatgttttaatccagtctctgtcggatgtacctagtgttgtgcctgtggctgttttaagaatcctacccagatctcaatatacatggtgttgttgaaaagaaaaaaaaaaaacaaaaaaaaaaaaaaaaaaaaagaaaaagtaggaggagagagacacaggaggtagagccc

SEQ ID NO: 3475 - DNA, 823 bp, Secale cereale
cgctccgatcccaaggttggcggccggcggcaggatgaaggccaaggtgggctcccgcgccggcgactccaggctcgcggtgaagaagagcaaggccgagaaggatcccaacaagcccaagcgccccccgagcgccttcttcgtcttcatggacaccttcaggaaggagtacaaggagaagcaccccgacgtcaagcaggtctccgtgattggaaaggccggtggtgagaagtggaagtccctgagcgatgctgagaaggctccttacactgccaaggccgagaagctcaaggctgagtacaccaagaagatcgacgcctacaacaacccacaggcaggtgaggcgtccggcgactctgacaagtccaagtccgaggtgaacgatgatgacagcgagggcgacgagtgaagcagcacaccaaagcagcagcagggggaggtggtctctggaacgtggccgttgctgctcattgctactgtcacagatcgatgatggatgttctctgttagtttagctccttggtagtccctccctctctttcaggctgctgctgctgctgctggtagaaaaatgctctagtcccatgtagccgttatcctggatcggagtggtgaagttgctagtctagtttcctttctgtagggtcctctgctcggaccgccctctgctgcttcgtgttttatgttttaaatccagtctctgtcggatgtacctagtgttgtgcctgtggctgttttaagaatcctacccagatctcaatatacatggtggcgttagaaagaaagcagatggtctcgatacatgtcttgtttctgtaagggg

SEQ ID NO: 3476 - DNA, 567 bp, Secale cereale
  misc_feature (484)..(484): n is a, c, g, or t
cacgaggctccaggctcgcggtgaagaagagcaaggccgagaaggaccccaacaagcccaagcgccccccgagcgccttcttcgtcttcatggacaccttcaggaaggagtacaaggagaagcaccccgacgtcaagcaggtctccgtgattggaaaggccggtggtgagaagtggaagtccctgagcgatgctgagaaggctccttacactgccaaggccgagaagctcaaggccgagtacaccaagaagatcgacgcctacaacaacccgcaggcaggtgaggcgtccggcgactctgacaagtccaagtccgaggtgaacgatgatgacagcgagggcgacgagtgaagcagcacaccaagcagcggcagggggaggtggtctctggaacgtggccgttgctgctcattgctactgtcacagatcgatgatggatgtttgctgttagtttagctccttggtagtccctccctctctttcangctgctgctgctgctggtagaaaaatgctctagtcccatgtagccgttatcctggatcggagtggtgaagttgctagtctagt

SEQ ID NO: 3477 - DNA, 781 bp, Avena sativa
tccagcaggagagcgccgcccacctcccccaccaccgctccgccagcacgcccgccctccgatccccaaggttgcgagatgaaggcgaaggcgagcgcccgcggcgtcgactcgaggctcgcggtgaagaaggccaaggccgagaaggaccccaacaagcccaagcgccccccgagcgcttcttcgtcttcatggagggcttcaggaaggactacaaggagaagcaccccgacaacaagcaggtctccgtggttggcaaggccggtggtgagaagtggaagtccctgaccgatgctgagaaggctccctacgtggccaaggcagagaagctcaaggccgagtacaccaagaagatcgaggcctacaacaacccgcaggcagaggcgtctggagactccgagaagtccaagtcagaggtcaacgacgaggatgaaggcagcgaggctgacgagtgatgcgtccgtctgagcaagcagcagcagtaaggggaaggaggtcaggtctctctctggccgtgccctggtgtctccgatggatggatggttgctcttgtgtcctgttagtagtctagctctcgtagtccctcccttttgcctcaggctgctgctgctgctctagctagtctcatgttggtcggagtggggaagttcctagtctagttctctggtagtagttttcattcatgtcccagtcgtcttctgtatctatcgatggatgtacccgtggcttgtcttaacatctcgcagagagagagatcaatataatgcttagctgaaactgt

SEQ ID NO: 3478 - DNA, 801 bp, Avena sativa
tccagcaggagagcgccgcccacctcccccaccaccgctccgccagcacgcccgccctccgatccccaaggttgcgagatgaaggcgaaggcgagcgcccgcggcgtcgactcgaggctcgcggtgaagaaggccaaggccgagaaggaccccaacaagcccaagcgccccccgagcgcttcttcgtcttcatggagggcttcaggaaggactacaaggagaagcaccccgacaacaagcaggtctccgtggttggcaaggccggtggtgagaagtggaagtccctgaccgatgctgagaaggctccctacgtggccaaggcagagaagctcaaggccgagtacgccaagaagatcgaggcctacaacaacccgcaggcagaggcgtctggagactccgagaagtccaagtcagaggtcaacgacgaggatgaaggcagcgaggctgacgagtgatgcgtccgtctgagcaagcagcagcagtaaggggaaggaggtcaggtctctctctggccgtgccctggtgtctccgatggatggatggttgctcttgtgtcctgttagtagtctagctctcgtagtccctcccttttgcctcaggctgctgctgctgctctagctagtctcatgttggtcggagtggggaagttcctagtctagttctctgctagtagttttcattcatgtcccagtcgtcttctgtatctatcgatggatgtacccgtggcttgtcttaacatctcgcagagagagagatcaatataatgcttagctgaaactgttgaaaggaaattggtgcaag

SEQ ID NO: 3479 - DNA, 2337 bp, Triticum aestivum
cggggggcctccttcctctctcttcaccctccaccgacgatggccctgccggctgccaaggcggcgccggcgacgcctttctcgtcgcagccgcacggcggaggcgtactcctccggcgacctccgtcaccgccgccgcccgccgcggcgctgcgcctcggacccctcttctggccgtggcaaaaggtgaaagttgggcccctttcggtttcccccatgggttttggaacatgggcatggggcaaccagctgctctggggctaccaggaaagcatggatagtgaactgcaggagtgtttcaatttggctctgaagaatggcataaaccttttcgacaccgccgactcttatggaactgggaagttgaatggccaaagcgaaaggctgctcggcaaatttatccgcgagtgccaagggccaataaagtctccagacgatgtgattatcgcaactaagtttgccgcatatccttggcgactgacgtcaggccagtttgtcaacgcctgcaagtcatcattagaaaggttacagatcgatcggctcggaatagggcagctgcattggtctactgctaactacgcacctctgcaggagcgcgctctctgggacggtctagttgaaatgtatgacaagggtcttgtccgggccgtgggtgtgagcaattacgggccgaagcagcttctgaagatccacagctacctagcatccagaggtgttcccctgagctcagctcaggtgcagttctctctgctgagcatgggcgatgagcagatggagctgaaaaccgtgtgcgattccctgggtgttcggctaatcgcttatagccctcttgggttgggcatgctcaccgggaaatatgacgcctctaaccttccaaatgggccaagatctgtgttgttccggcagattcttcctgggctggaatccctgctgtcttgcttgaagagtattgccgaccgaaagggcaagaccatgtcccaggtggctataaactggtgcatttgcaacggcgcaattccgattccgggcgtgaaaacagtcagacatgtggaggacaacctgggtgcgctcggctggaggctgagccctgatgagatctcagagctggaagccgcggcgatggagtgcccgaagaagatggttcagaacatatttcagaccgcgtgagcaaactggaaactgcagtaacgccaatattaaacatggcagcaacctgaaataaagagcagagagagatacccttcgatttgtgcagaaaggagacatgttgctttctcttctctgcctagttcagagttcagttcagaacttccgacttcagagtccctgactggatatcttagagctttagctgattgctgaaacagcattctggtgttggtatggacagcaactagtcacagtaaatgcagagtcgaagcgtgcgagcgaaaagaaaaatcgggatggcagttgacaaatcatcactgacagggaattacgccaatttattccgataatacatgcatgatgcatctcgcagtacgctccccaaagactaatcaggcgtgctgcttaacacactggcatgtccatccatctgatctggtccagatggcgcttaaccgtacttacttagctagtaaatgtaggagcatataatatattacacgccatgaggatcagggcttggtttactcagactcttccgtcgtcagacggccttgccgtacttggcggcggcgcgggggtgtcctgctgctgcatgagcgcagggcgcgctcgaactgcgtccagcgctgctccagggtgccgttgtagccgacggacatgcggatgaggcccggggagatgccggcgcgggcgcggtcctcggggtccatctcgctgctggtgctattgccggagcaggacatgagggtgtcgtagtagccgaggctgacggccatgaggccgaactgggtggtgttctgcaggtggtacatgaggcggttggcccgctcctcggtgcccatgtcgaggcagagcatgccgccggcgccgtagcccgggttgcccatggcgcgcagccgggcgtggtgcgggtggtcggggaggcccgggtaggtgacgcggaggccctggcggcgcatccgggcggcgaactcggcggcgcggcgcgagtgctcctgcatccgcagcggcaggtgcgggaggcggccagccagctcggacgccaccttggcgttcatcgtggggcccagcagcatcagtgcgccgtcctgcaggtccatcatggagttcaccaggctcgccggcccacagatcgcaccggcgatgatgtctgcgccgccgctgatgaacttggacacgctgtgg

SEQ ID NO: 3480 - DNA, 3115 bp, Triticum aestivum
tacgatcccaatggcccacgtcctcgccgccgccgagcccctcaccctcctcaagcgcccgccgccgcagaacgacggcttcggcgacgacaacggcagcacggaggagaaggcgcccaaggcgcgccgccgggagtccgacccggcggcggcactggccgcggcgcggcacgagttcggggagcacggcggcgtgaacatgtccatcgaggcctcggccacgttcaccgtgatggagccggacaccatgcgccggctcttcacgggggagctgggcccggagcgcggcgacctgtacatctacagccgccacttcaacccgacggtgctggcgctggggcggcagatggccgcgctggaggggaccgaggccgcctactgcacggcgtccggcatgtcggccatctcctgcgtgctgatgcagctggtgggcgccggcgggcacgtggtggcgtcgcgctgcctgtacggcggcacccacgcgctgctgtcccggttcctgccgcgcacctccggcgtgcaggcgacgttcgtggacgcggacgacgaggcggccgtgcgcgcggccatcaggccgggggagacgcgggtggtgtacgtggagacgatgtcgaacccgacgctggccgtggccgacatcccgatgctggcgcgggtggcgcacgaggccggggccaagctggtggtggacaacaccttcacccccgtcgtcgtctcgcccgcgcggctcggcgccgacgtcgtcgtccacagcgtgtccaagttcatcagcggcggcgccgacatcatcgccggtgcgatctgcgggccggcgagcctggtgaactccatgatggacctgcaggacggcgcgctgatgctgctgggccccacgatgaacgccaaggtggcgtccgagctggcggcgcgcctcccgcacctgccgctgcggatgcaggagcactcgcggcgcgccgccgagttcgcggcccggatgcggcgccagggcctgcgcgtcacctacccgggcctgcccgaccacccgcaccacgccaggctgcgcgccatgggcaacccgggctacggcgccggcggcatgctgtgcctcgacatgggcaccgaggagcgcgccaaccgcctcatgtaccacctgcagaacaccacccagttcggcttcatggccgtcagcctcggcttctacgacaccctcatgtcctgctccggcaacagcaccagcagcgagatggacccggaggaccgcgcccgcgccggcatctcccccggcctcatccgcatgtccgtcggctacaacggcaccttggagcagcgctgggcgcagttcgagcgcgccctcgcgctcatgcagcagcaggacacccccgccgccgccgccaagtacggcaagcccgtctgacgacccaagaggctgcgtaaaccaccaagcgctgatgcctcatggcatgtaatgtattatagtatatactcctacatttactagctaagtaagcgccatctgaatctgttcagatggatggacatgctagtgtgttaagcagcacgctaaattagtctttggggagcgtactgcgagatgcatcatgcatgtattatcggaataaatttggcgtaatttcctgtcagtgatgatttgtcaactgccatcccgatttctctttttgctcgcacgcttcgattctgcgtttaccgtggcttgttgctgtccataccaacaccagaatactctgtctcagcaatcagctacagttagttatctagtcagagcttacaatggcatgtctctgaactcggaagttctgaactgaactctgaacgcagaggagagaaagcaacatgtctcttttctgcacaaaacgaagggtatctctctgctctttattttaggttgatgtcgtgtttaatattggcgttactgcagtttccagtttgctcatgcggtctgaaatatgttctgaaccatcttcttggggcactccatcgccgcggcttccagctctgagatctcatcagggctcagcctccagccgagcgcacccaagttgtcctccacatgtctgactgttttcacgcccggaatcggaattgcgcctttgcaaatgcaccagtttatagccacctgagacatggttttgccctttcggtcggcaataccactcaagcaagacagcagggattccagcccaggaagaatctgccggaacaacacagatcttggcccatttggaaggttagaggcgtcatatttcccggtgagcatgcccaacccaagagggctataagcgattagctgaacacccagggaatcgcacacggttttcagctccatctgctcatcgcccatgctcagcagcgagaactgcacctgagctgagctcagggggacacctctggatgctaggtagctgtggatcttcacaagctgcttcggcccataattgctcacacccacggcccggacaagacccttgtcatacatttcaactagaccgtcccagagagcgcgctcctgcagaggtgcatagttagcagtagaccaatgcagctgccctattccgagccgatcgatctgtaacctttctaatgatgacttgcaggcgttgacaaactggcctgacgttagtcgccaaggatacgcagcaaacttagttgcgataatcacatcatctggagactttattggcccttggcactcgcggataaattttccgagcagcctttcgctttggccattcaacttcccagttccataagagtcggcggtgtcgaaaaggtttatgccattcttcagagccaaattgaaacactcctgcagttcactatccatgctttcctggtagccccagagcagctggttgccccaagcccatgttccaaaacccatgggggaaaccgaaaggggcccaactttcaccttttgccacggccagaagaggggtccgaggcgcagcgccgcggcgggcggcggcggtgacgaaggtcgccggaggaggacgcctccgccgtgcggctgcgacgagaaaggcgtcgccggcgccgccttggcagccggctgggccatcgtcggtggagggtgaagagagaggaaggaggcgcgctcgttcgtgtccgttcgtctcgc

SEQ ID NO: 3481 - DNA, 1452 bp, Avena sativa
gaacgaacgcgcccagagtccgtgcctcctcccggtctccaccccacctccaccgactatgtctctgccggctgctaaggcggcgccggcgatgcctttcgcatcgcagccgcacggcggaggtatcctcctccggcggccgtcgtccccgcccgtgcctgccgcggcgctgcgcctgggccccctcttctggccatgggaaaaggtgaaagttggccccctttcagtatcccccatgggttttggaacatgggcatggggcaaccagctgctctggggctaccaagaaagcatggacagtgaactgcaggattgtttcaatttggctctgaagaatggcataaaccttttcgatactgccgactcatatggaactggaaagttgaacgggcagagtgaaaggcttctcggaaaatttatcagcgaaggcccaatcaaatctccagatgatgtggtcattgcaacgaagtttgccgcctatccttggcgactaacatcgggccagtttgtcaacgcctgcaagtcatcgttggacaggttgcagattgatcggctcggaatagggcagctgcactggtctactgctaactatgcacctctgcaggagcgcgctctctgggacgggctagttgatatgtatgacaagggtcttgtccgggccgtaggtgtgagtaattacgggccgaagcagcttctgaagatccacggctatctagcatccagaggtgttcccctgagcacagctcaggttcagttctcgctgctgagcatgggcgatgagcagatggagctgaaaaccgtgtgcgaatccctgggtgttcgtgtcatcgcttatagtccgcttgggctgggcatgctcaccgggaagtatgatgcctcaaaccttccaaatgggccaaggtctgtgttgttccggcagattcttcctgggctagagtctctgctgtcttgcctgaagagtattgcagatagaaagggcaaaaccatgtctcaagttgctataaactggtgcatatgcaaaggcgctatcccgattcccggcgtgaaaacagtcaggcacgtggaggacaacttgggtgcgctcggctggaggctgagccctgatgagatttcagagctggaagccgcggcgatggagtgcccgaagaagatggtccagaacatattccaaactgcatgagcatagtgcaggaacgccagtgacagcaacctgaagcaagagcagagagtatcctttgctctgctatgcctagttcagaactacagagagttcggacacatgcgattgtaaatcctgacgagatgtctagagctgtatgctgaaacgatggtactacagcagctattgcagaatgaagcgtgcgagtggaaggaaaacgcgatggaatatttgtcctacgtactggaatactactaccaattgggatggaagtggtaaatcattaaggacgg

SEQ ID NO: 3482 - DNA, 4507 bp, Setaria italica
gacgagagcgggcgcgcgtctgaagtccgaacctgtgctgctccaccaccgatggctctgccgccggccgcaggggcggcagcggcgccggtgacgcccttcgccgcgcagccgcgtgggcacggtggaggcggtctcaggcggacgtcgccggcgccgccggccgcggcgctgcggctcgggcccctcttctggccgtgggaaaaggtgaaagttggtcccctgtctgtttcccccatgggctttggaacgtgggcttggggaaatcagctgctctggggctatcaagaaagtatggacagtgaacttcaggaatgcttcaatctggctctgaagaatggcataaacctttttgacactgcggactcttacggaactggaaagttgaatggacagagcgaacggttacttggtagatttatacgtgagtttgaagggccgatcaaatctccagatgatgtggtcattgcaacgaagtttgctgcatatccttggcgacttacatcgggccagtttgtcggagcttgcaaatcttctttggaaagattgcaactagatcggcttggaatagggcagctgcattggtccactgctaactatgcacctttacaggaacgtgctctctgggatggtctagttgaaatgtatgaaaagggcctcgttcgtgctgttggtgtcagcaattacggaccgaagcagcttctgaagatccacagctatctagcttctaaaggtgttcccttgagctcagctcaggttcagttctcactactgagcatgggtgacgagcagatggaactgaaaaccgtgtgtgactcgttgggcattcgtctcatcgcatatagtccgcttgggttagggatgctgaccggaaagtatgatgcttctaaccttccaaaaggaccaaggtctgtgttgttccggcaaattcttcctgggttggagtctttgctgtcctgtctaagaagaattgcagaaaagaaggggaaaaccatgtctcaggtggccataaactggtgcatctgcagaggcacgatccctatccccggcgtgaaaacggtcaggcacgtcgaggagaacttgggcgcgctcggctggaggctgagccccgctgagatctcagagctcgagtccgcggcgatggcagctccgaagagaatgatccagaacgtctttcagactgcctgaatcatgtgcaggaacctgaatctcggtaccaaacatgacagaacaatgtccggaattcagatagagcagagagacgcttcattcgctgatctcagaaatcttgccagtagtaagcagtagccaaggagctgcacgcacgcacgcatgtatcttacttcttgctgatgaagttcgattagcagcaaacaactgattacaacgacacacttattcatgtcgtttccaggatccccagaccgagatgaagcggcttgcactcactggcttatccatctgaaccagagggatcagacggcgcttacttaacctttacccacttaaatggtactgtagtaaatagtaatatacaccagaagcatgcatgttccctgccggcacacccttgacatctgttgggggaggacgcgcgccggtcagtgcttgcggtggatggtggtgccggcgtcgaggacgtcgcggtcggcggcggcgccgggcttgtggtgcagcggcgccggtactggctgcatgagcgcgagggcgcgctcgaactgcgcccaacgctgctcgagcgtgccgttgtagccgacggacatgcggacgagccccggcgagatcccggccttggcgcggtcctcgggcggcatctcgctgctggtgctgctcccggagcaggacatgagcgtctcgtagtaccccaggctgacggccatgaggccgaactgggtggtgttctggaggtggtgcatgaggcggttggcgcggtcctcggtgcccatgtcgacgcagagcataccgccggagccgtagcccgggttggccatggcgctcaggcgggcgtggtgcgggtggtccgggaggcccgggtagaggacgcgcaggcccaggcgctgcattcgggacgcgaacgccagggcgcggcgcgagtgctcctgcatgcgtagggggaggtgggggaggcgctccgagagctcgaaggccaccttggcgttcatcgtcgggcccagcagcatcagcgcgccctcctgcaggtccatcatcgcgttcaccaggctcgccggcccgcagatggcgcctgcgtgcaacgaaaacaacaagcacagacgtgccatcaaaattcaagctgtacaagtgccacctgcaagatttcgttcacgcgcgtggcaggttagttcgtcacacacacgtctcggtcgtgtcttctgtgcaccgcgcgtggaggcccagacgacaagagagcatggtcagcccttggccgcttgcacgcacggagtcgggacaaagcacacgcgggtgcagtactgcagatcgcatatctctcagcgaccgagctgctagctgcatgcatgattgacggttcaaccaagggcgaaatggaggtggggttcgtggtacgaaaacaaagacaaaaggacgtgcatcacgggtgacaccagcgctcgcaaccgctgctgcaccagcgcaggaggtgggggaaaacggagaaaaaagacacggcgcggcaggcaaaatgattagccggatgacgcgcggggccgcgcgcgaaccaagcacgaggcgactgcgagagatctcggcgcgggatggagcctggccctgacatgcaacacatggagcgtgccagagccaggccgagacggacgcccgggtatggcaatggctagctagatgaggtgggtcaccacgtcacgtaccgcggctaggtagtgcaagaccactgcgcctgcatgactcactggcttgtcgtttatctggatgtcctcggcatgggtcgtcgccacatgggtggtgtgccatggccgagcgtttttgtcgtggtcggaagaggtaaaggaagaagaaaaaatagaaaagtgacgtggacgtgtcgaggatcagttgggtaaaagtgcagggcagtgtgaatcctgccacacattttgcgttagagaaatgtgcagacgaagaatttggagagcgcacgtgtgtgtgtaggtgttggggtcttgggagatgcagacacgcagtgccgtgacgctctgataagagttacgacgtgatcactgacggcctttaccactttctagaccggtagtttcttttcaccttttccctacgcagaatatccctccccccacagctccggggattccttgtgacgacggccaagcttttcagctccagcttcactggaacgtgacgcactcacgtagccgtacaggacaaacgagacggtccagcagtacgtatctactcgtagcacgtgacaacgcttaagataggcttcaatttttaattgcagcttgcaaataacttatttttatactaagcgtgtgcatgcgacccgctaatgctgcgcgccgtagaacagaacgcccattccgcggctaggtaaattccagccgcagaccgataggcgctctctgtcgttgcatgcagtcgcgagatgatgcagacgatcgggggcaataagaggccgtgtcgtccttaccggcgatgatgtcggcgccgccgctgatgaacttggacacgctgtggacgacgacgtcggcgcccaggcgggccggggtgacgacgacgggggtgaaggtgttgtccaccacgagcttggccccggcctcgtgcgccacccgcgccagcatcgggatgtccgcgacggccagcgtcgggttcgacatcgtctccacgtacaccacccgcgtctccccgggcaccacggcggcgcgcacggcggcctcgtcgtcggcgtccacgaacgtggcgcgcaccccggaggtccgcggcaggaacgtggacagcagcgcgtgggtgccgccgtacaggcacctcgacgccaccacgtggccccccaccccgaccagctgcatcagcacggaggagatggcggacatccccgacgccgtgcagtaggcggcctcggtggcctccagcgccgccatctgccggcccagcgccagcaccgtagggttgaagtgacggctgtagatgtacatgtcgccgcggtcggggccgagctccccggcgaagagacgccgcatggtgtccggctccatcaccgtgaacgtcgccgacgcctcgatggacatgttcacgccgccgtgctccccgaactcgtgccgcgctgcggccagcgccgccgcggggtccgcctcccggcggcgcgccttgggcttctcgtcggcgtgggcgagcgcgccgccgccgttgtcgtcgccgagtggcccgtcgctcccgaacgggcgcttcagggtggtgctgatcagctcggaggcggcggccatggcctgggccatcgggatgggtgggtgcgttgcaggggaggagtgcaggaggtcgggggcttgggactcggtcagagagc

SEQ ID NO: 3483 - DNA, 4623 bp, Oryza sativa
cacttccggaacaattttagcccaggttccaacagggcctacctttgcacggcaaaaacgttgaatcacctcgcaagtacgcaacgccacgaggggatttttatcaagagatttaacggacgagaacgcgccgcccaaattccgcgcctcgtcgacctcggctccggccaccgatcgatggctctgccggtgaccaccagggcggcgccggcgatgcccttcgcgccgcagccgcgcaccgccggcggcggcctcctccggcgaccgtcgccgcctgccgccgcgctgcgcatcgcgccgcccctcttctggccgtggcagaaggtgaaagtcggtcccctttctgtttcgcctatgggatttggaacatgggcttgggggaaccagctactttggggatatcaagaaagcatggatactgaacttcaggagtgtttcaatttggctctgaagaatggcataaacctttttgacactgctgactcttatggaactggaaggttgaatggtcagagcgaaaggctcctcggtaaatttatccgcgagtatgaagggccgatgaagtcccctgatgatgtgatcattgcaaccaagtttgcagcatatccttggcggctaacatcaggccaatttgtcagcgcctgcaagtcttctttggaaagattgcagcttgatcggctcgggataggacagctgcattggtctactgctaactatgcacctctgcaggagcgtgctctttgggatggtctagttgagatgtatgaaaagggtttggttcgtgctgtcggcgtcagcaattatgggcccaagcagcttctgaagatccacagccatctatcatctagaggtgttccattgagctcagctcaggttcagttctcactactgagcatgggggatgagcagatggagctgaaaactgtgtgtgattctttgggcattcgtctgattgcttatagtccacttggattaggaatgctgacaggaaagtatactacttctaaccttccaagtggaccaaggtctgtgttgttccggcaaattcttcctgggttggaatctctgctgacttgtctgaaaagaattgcagaaaggaaggggaagaccatgtctcaagtggccataaattggtgcatctgcaagggcacaattcctattccaggtgtcaaaacagtcaggcacgtcgaggataacttgggagcactgggctggaggcttagccctgctgaagtttcagagctcgaagctgcagcaatggagtctccgaagagaatggtccagaacatattccaaactgcatgagcacacatatatataaggatcgctccaaccatcagtaattcagtgagagagaattagaagtgtgcatttctcctaattgagaattcatcactgtaaatacatattccagccaagtgtttcagtctgaagaatatatatagactgtgacacgcacgaagtgccataatcttactgagaaagaaggttgctgcagaaacattgtccatataacatttcaccagcttattccaatacactcagtttcccagagaacaagcagcttagctgtgccattcaactatctgaaccagagcgatcagatagtactcagtttaacagcttaaaccttacttataggtagcactagtaattacataataaactatatatacaaaccagcaacacggggcagatacaacaaatcggatcgtcgctaatgcgcaccatcaatggcggggctcgtgacgtcacaccttgcagtacttggcggcggcgtcgcggtcgggatgctgctgctgctgctgctgcatgagcgagagcgcgcgctcgaactgcgcccaccgctgctcgagcgtgccgttgtacccgacggacatgcggacgaggccgggggagatgccggcgcgagcgcggtcctcgggcggcatctcgctgctggtgctgctgccggagcacgacatgagggtctcgtagtagccgaggctgacggccatgaggccgaagcgggtggtgttctggaggtggtgcatgaggcggttggcgcggtcctcggtgcccatgtcgacgcagagcatgccgccggcgccgtagcccgggttggcgatggcgaggaggcgggcgtggtgcgggtggtcggggaggcccgggtaggcgacgcggaggccgaggcggcgcatccgggacgcgtactcggcggcgcgccgcgagtgctcctgcatccggagcgggaggtgcgggaggcgctccgagagctcgaaggccaccttggcgttcatcgtcgggcccagcagcatcagggccccctcctgcagatcttcgtgtctatagcacgtaagcatcatatgcacttgatagtgtagtagtaatagtgtgtgtttttaacaccgaagtctcgtgtttaattctcaacacgtttataatttttcttaaaaaaaatatatttctgtcaacatttcatcgaagtcgaaataaagttacaaatatggagaattcttgatgtatcaaaaccgatttcataaagctaatataataatgctattgtttctaaccattttcatgccgggtcaggcagggtgcaacgaatcgggggtaaatgatatgcgctattgaatcacgggtgacactgtggcgcaaatgagcgccacacatcggcaatgattcatttgatttggctagacgtacgacgcatgcgaaaaaagcaaacaaatccgtcatttagctccggcgatccagggccgtccatggtgatgggtagcttttggcttggcagacatgcaacacatggtgggtgcagtgcaaagccatgccaaatgggcagtaggttccgacctagatgggtcaccaccacgtcaatctgactcactgccttgtccgttccgcctcgcgcgttgtcggcacgtgagacgggtggtaaaattcttactaccaagaatccaagatttaacctagtaggagtagtagtttctttttttcgatggattaaccttatagtaatttttttcctactagtatgatgatgaattcgtgactcgtgctactacatacttcatcatgttttttcttatgtaccattagcacttctgcgagatttaattgccgcacgtgtgctctattaatcctaatctattccgggggaaattaaacgtagagtaacaaataggggtacgttgtccgtatcctagtcgcgatcaccttattaattaattaattaattaattaattgtttatttagcttaatccactagaccccgtgagtatgagtcatgacggcgcaagcctcacccaaggcctggggctggcacgtgtttgggcggctttgagccccagctaccttggaacgacatggtaggtgacagtgcgatacacgagtggcacacgacaaagacgtacacgacgacgacgctgatcgtgcacgcgcgctctgatgctcgcgtacactgccgctaacgtaagagctagcctctttaattgagcgtgtcaagcgtgtgtatgtgcatgcaacacgtcacgatgatatagctaaaaatggagaacggctaaggcgtccggcgtattcgtccttacctgcgatgatgtcggcgccgccgctgatgaacttggagacgctgtggacgacgacgtcggcgccgaggcgggccggcgagacgaccatgggcgtgaacgtgttgtccaccaccagcttggcgccggcgtcgtgcgcgacgcgggccagcatcgggatgtcggccacggccagcgtcgggttcgacatcgtctccacgtacaccacccgcgtctcccccgggcgcaccgcggcgcgcaccgccgcctcgtcgtcagcgtccacgaacgttgcgcgcaccccggacgcgcgcggcaggaaccgggacagcagcgcgtgcgtgccgccgtacaggcaccgcgacgccaccacgtgcccccccgcgccgacgagctgcatcagcacggaggagatggcggacatcccggacgccgtgcagtacgcggcctcggtgccctccagcgccgccatctgccgccccagcgccagcaccgtcgggttgaagtggcggctgtagatgtacaggtcgccgcgctccgggccgagctccccggagaagaggcggcgcatggtgtccggctccatcaccgtgaacgtcgccgacgcctcgatggacatgttcaccccgccgtgctcgccgaactcgtggcgcgccgcggccagcgccgccgccgggtcggcctcccggcgccgcgccttgggcttcccgtcggcgttgccgttgccgttgctgctgttgtcgtcgtcgttctggaaggggcgcttgatggtggcggtgacgagctcggaggcggccatgacgtgggccatttgggatgcgtgtgtgtacgttcgagacaggagagcgggtgcggcgtgtctgtcgaacaggagtcgcgggcaatttatagacgggggttggatcttctgcggccagaaaagaagggagacgcgtcgctgtgacgtggtgtgtgacggttaggtccgcggctcgtggaggaacggacggctgacactgacagcctggggcaatgaaccgggcccatttttacggccaggggggagaagggacaagattagaacagtgtaaacaagcagca

SEQ ID NO: 3484 - DNA, 2294 bp, Oryza sativa
ctcgcaagtacgcaacgccacgaggggatttttatcaagagatttaacggacgagaacgcgccgcccaaattccgcgcctcgtcgacctcggctccggccaccgatcgatggctctgccggtgaccaccagggcggcgccggcgatgcccttcgcgccgcagccgcgcaccgccggcggcggcctcctccggcgaccgtcgccgcctgccgccgcgctgcgcatcgcgccgcccctcttctggccgtggcagaaggtgaaagtcggtcccctttctgtttcgcctatgggatttggaacatgggcttgggggaaccagctactttggggatatcaagaaagcatggatactgaacttcaggagtgtttcaatttggctctgaagaatggcataaacctttttgacactgctgactcttatggaactggaaggttgaatggtcagagcgaaaggctcctcggtaaatttatccgcgagtatgaagggccgatgaagtcccctgatgatgtgatcattgcaaccaagtttgcagcatatccttggcggctaacatcaggccaatttgtcagcgcctgcaagtcttctttggaaagattgcagcttgatcggctcgggataggacagctgcattggtctactgctaactatgcacctctgcaggagcgtgctctttgggatggtctagttgagatgtatgaaaagggtttggttcgtgctgtcggcgtcagcaattatgggcccaagcagcttctgaagatccacagccatctatcatctagaggtgttccattgagctcagctcaggttcagttctcactactgagcatgggggatgagcagatggagctgaaaactgtgtgtgattctttgggcattcgtctgattgcttatagtccacttggattaggaatgctgacaggaaagtatactacttctaaccttccaagtggaccaaggtctgtgttgttccggcaaattcttcctgggttggaatctctgctgacttgtctgaaaagaattgcagaaaggaaggggaagaccatgtctcaagtggccataaattggtgcatctgcaagggcacaattcctattccaggtgtcaaaacagtcaggcacgtcgaggataacttgggagcactgggctggaggcttagccctgctgaagtttcagagctcgaagctgcagcaatggagtctccgaagagaatggtccagaacatattccaaactgcatgagcacacatatatataaggatcgctccaaccatcagtaattcagtgagagagaattagaagtgtgcatttctcctaattgagaattcatcactgtaaatacatattccagccaagtgtttcagtctgaagaatatatatagactgtgacacgcacgaagtgccataatcttactgagaaagaaggttgctgcagaaacattgtccatataacatttcaccagcttattccaatacactcagtttcccagagaacaagcagcttagctgtgccattcaactatctgaaccagagcgatcagatagtactcagtttaacagcttaaaccttacttataggtagcactagtaattacataataaactatatatacaaaccagcaacacggggcagatacaacaaatcggatcgtcgctaatgcgcaccatcaatggcggggctcgtgacgtcacaccttgcagtacttggcggcggcgtcgcggtcgggatgctgctgctgctgctgctgcatgagcgagagcgcgcgctcgaactgcgcccaccgctgctcgagcgtgccgttgtacccgacggacatgcggacgaggccgggggagatgccggcgcgagcgcggtcctcgggcggcatctcgctgctggtgctgctgccggagcacgacatgagggtctcgtagtagccgaggctgacggccatgaggccgaagcgggtggtgttctggaggtggtgcatgaggcggttggcgcggtcctcggtgcccatgtcgacgcagagcatgccgccggcgccgtagcccgggttggcgatggcgaggaggcgggcgtggtgcgggtggtcggggaggcccgggtaggcgacgcggaggccgaggcggcgcatccgggacgcgtactcggcggcgcgccgcgagtgctcctgcatccggagcgggaggtgcgggaggcgctccgagagctcgaaggccaccttggcgttcatcgtcgggcccagcagcatcagggccccctcctgcagatcttcgtgtctatagcacgtaagcatcatatgcacttgatagtgtag

SEQ ID NO: 3485 - DNA, 1711 bp, Secale cereale
cgcctcggaccctcttctggccgtggcaaaaggtgaaagttgggccctttccagtttcccccatgggttttggaacatgggcatggggcaaccagctgctttggggctaccaggaaagcatggatagtgaactgcaggagtgtttcaatttggctctgaagaatggcataaaccttttcgacaccgccgactcttatggaaccgggaagctgaatggccagagcgaaaggctcctcggcaaatttatccgcgagtgccaagggccaataaaaaactccagacgatgtgatcatcgcaactaagtttgccgcgtatccttggcgactaacgtcaggccagtttgtcagcgcctgcaagtcatcattagaaaggttacagattgatcggctcggaatagggcagctgcattggtctactgcgaactatgcacctctgcaggagcgcgctctctgggacggtctagttgaaatgtatgacaagggtcttgtccgggccgtgggtgtgagcaattatgggccgaagcagcttctgaagatccacagctacctagcatccagaggtgtccccctgagctcagctcaggtgcagttctcgctgctcagcatgggcgatgagcagatggagctgaaaaccgtgtgcgattccctgggtgttcggctaatagcttatagccctcttgggttgggcatgctcaccgggaaatatgacgcctctaaccttccaaatgggccaagatctgtgttgttccggcagattcttcctgggctggaatccctgctgtcttgcttgaagagtattgccgaccgaaagggcaaaaccatgtcccaggtggctataaactggtgcatttgcaaaggcgcaattccgattcccggcgtgaaaacagtgagacacgtggaggacaacttgggcgcgctcggctggaggctgagccctggtgagatctcagagctggaagccgcggcgatggagtgcccgaagaagatggttcagaacatatttcagaccgcatgagcaaactggaaactgcagcaccccaatgttaaacatgacaacaaactgagataaagagcagagattttgtgcagaaaagagacatgttgctttctcttctctgcctagttcagagttcagttcagaacttcagagttcagagacatgccactgcagttgacaaatcatcactgacaagaaaaattacgccaatttattccgatgatacatgcatgcatgatgcatcttgcagtacgctcccaaacgacgactaattaagcgtgctgcttaacacactggcatgtccatccatctgaacagattcagatggagcttaaccgtacttacttagctagtagaaggaggagtatataatacacgccatcagcaggcatcagcggccgcttggtggtttgcgcaggctcttgggtcgtcagacggccttgccgtacttggcggcggcggcggggttgtcctgctgctgcatgagcgcgagggcgcgctcgaactgcgcccagcgctgctccagggtgccgttgtagccgacggacatgcggatgaggcccggggagatgccggcgcgggcgcggtcctctgggtccatctcgctgctggtgctgttgccggagcaggacatgagggtgtcgtagtagccgaggctgacggccatgaggccgaactgggtggtgttctgcaggtggtacatgaggcggttggc

SEQ ID NO: 3486 - DNA, 1436 bp, Sorghum bicolor
gacgagagcgggtgcgcggctgaactcccacccgcgacccaccaccaccaccgatggctctgcttcccgccgcaggggcggcggcgccggcgacgccgtccgccgccaagccgtgcggcctcaggcggccgtctgctcctcctgccgcggccctgcggctcgggccgctcttctggccgtgggaaaaggtgaaaattggtcccctttctgtttcccccatgggttttggaacatgggcatggggaaaccagttactttggggctatgaagaaagcatggacaacgaacttcaggactgcttcaatctggctctaaggaatggcataaacctttttgacactgctgactcttatggaactggaaggctgaatggacaaagcgaacggctactcggtaaattcatccttgagtgtgaagggacgattaaatctccagatgatgtgatcattgcaactaagtttgctgcatatccttggcgacttacatcggggcagtttgtcagcgcctgcaagtcttctttggaaagattacaacttgatcggctcggaatagggcagctgcattggtctactgcaaactatgcgcccttgcaggagcgcgccctctgggatggactagttgaaatgtatgacaagggtctcgttagtgctgtcggcgtcagcaattatgggccaaagcagcttctgaagatccacagctatctagcttctaaaggagttccgttgagctcagctcaggttcagttctcactactgagcatgggtgacgatcagatggaactgaaaactgtgtgtgattcattgggcattcgtctcatcgcatatagtccgcttggactaggaatgctcactgggaaatatgatgcttctaacctcccaaaaggaccaaggtcagtgctgttccgacaaattcttcctgggctggagtctttgctgtcttgcctgagaaggattgctgaaaagaaggggaaaaccatgtctcaggtggccatcaactggtgcatctgcaaaggcacaattcctatcccaggcgttaaaatggtcaggcacgtcgaggagaacttgggtgcgctcggctggaggctgagttctgctgagatcgcagagcttgaggccgcggcgatggcagctccaaagaagatggtccagaatgtcttccagactgcctgatcatgtgcaggaacctgagtctgaaactctgaataccgaccccaggatgattttgaacctgaatctcggtaccaaatataacagacaatggtgtcagatgagagtagaggggtggtttctttgctgagttcagatttccactcgcagcaaaccctgctcactgatttaaaatagcgttgcagtatgcagatctcaagaagctgtgtatgcatgtttctgcaaccatcattctgaaactctgaaacaggacagccgtgaactttcttc

SEQ ID NO: 3487 - DNA, 1564 bp, Sorghum bicolor
gcttcgccctcgcgtccgcgtcgtcgcaggctcgcagcaccgtttggttgggcctgggccgcaaaaaccaggccaggcttggtctcctactgggccacgtcacgccggagaacgagaggcctaggagcaaaactgcaaagaggaaccggtcggattttttatcggcggacgaacggacgagagcgggtgcgcggctgaactcccacccgcgacccaccaccaccaccgatggctctgcttcccgccgcaggggcggcggcgccggcgacgccgtccgccgccaagccgtgcggcctcaggcggccgtctgctcctcctgccgcggccctgcggctcgggccgctcttctggccgtgggaaaaggtgaaaattggtcccctttctgtttcccccatgggttttggaacatgggcatggggaaaccagttactttggggctatgaagaaagcatggacaacgaacttcaggactgcttcaatctggctctaaggaatggcataaacctttttgacactgctgactcttatggaactggaaggctgaatggacaaagcgaacggctactcggtaaattcatccttgagtgtgaagggacgattaaatctccagatgatgtgatcattgcaactaagtttgctgcatatccttggcgacttacatcggggcagtttgtcagcgcctgcaagtcttctttggaaagattacaacttgatcggctcggaatagggcagctgcattggtctactgcaaactatgcgcccttgcaggagcgcgccctctgggatggactagttgaaatgtatgacaagggtctcgttagtgctgtcggcgtcagcaattatgggccaaagcagcttctgaagatccacagctatctagcttctaaaggagttccgttgagctcagctcaggttcagttctcactactgagcatgggtgacgatcagatggaactgaaaactgtgtgtgattcattgggcattcgtctcatcgcatatagtccgcttggactaggaatgctcactgggaaatatgatgcttctaacctcccaaaaggaccaaggtcagtgctgttccgacaaattcttcctgggctggagtctttgctgtcttgcctgagaaggattgctgaaaagaaggggaaaaccatgtctcaggtggccatcaactggtgcatctgcaaaggcacaattcctatcccaggcgttaaaatggtcaggcacgtcgaggagaacttgggtgcgctcggctggaggctgagttctgctgagatcgcagagcttgaggccgcggcgatggcagctccaaagaagatggtccagaatgtcttccagactgcctgatcatgtgcaggaacctgagtctgaaactctgaataccgaccccaggatgattttgaacctgaatctcggtaccaaatataacagacaatggtgtcagatgagagtagaggggtggtttctttgctgagttcagatttccactcgcagcaaaccctgctcactgatttaaaatagcgttgcagtatgcagatctcaagaagctgtgtatgcatgtttctgc

SEQ ID NO: 3488 - DNA, 1397 bp, Zea mays
gcgcggctgaaccagtgccagtcccacccgttcccagaccagcctcacgcgctcaccgtgctgcctccaccaccgatggctctccctcccggcgcaggggcggtggcgccggcgacgcccttcgccgcgaatccgtgccgtctccggcgggcgtctggtcctcctgccgccgcccttcggctcgggccgctcttctggccatgggaaaaggtgaaaatcggtcccctttctgtttcccccatgggttttggaacatgggcatggggaaaccagctactttggggctatcaagaaagcatggacaacgaacttcaggattgcttcaatctggctctaaggaatggcataaacctttttgacactgctgactcttacggaactggaaggctgaacggacagagcgaacggctactcggtaaattcatccttgagtttgaagggaggattaaatctccagatgatgtggtcatagcaactaagtttgctgcatatccttggcgacttacatcggggcagtttgtcagcgcctgcaagtcttctttggaaagattacaacttgataggctcgggatagggcagctgcattggtctactgctaactatgcacccttgcaggagcgtgccctctgggatggactagttgaaatgtatgaaaagggccttgtaagtgctgtcggtgtcagcaattacgggccgaagcagcttctgaagatccacagctatctagcttctagaggagttcccttgagctcagctcaggttcagttctcgttactgagcatgggtgacgatcagatggagctgaaaagtgtgtgtgattcattgggcattcgcatcatcgcatatagcccgcttggattaggaatgctcactgggaagtatggtgcttctaacctcccaaaaggaccaaggtcagtgctgttccgacaaatccttcctgggctggagcctctgctgtcttgcctgagaaggattgccgaaaagaaggggaagaccatgcctcaggtggccatcaactggtgcatgtgcaagggcacagttcctatcccaggcgtcaaaacggtgaggcatgtccaggagaacctgggcgcgctcggctggaggctgagttctgccgagatctcggagctcgagtccgcagcgatggcggctccgaggaagatgatccagaatgtcttccagactgcctgaccgtgctgaatacatgtgtgtgtatgcatgtttctgcaatcgtctttactgaaaaatctgaaaccgggcagccgtgaaccttttcttctcgtaagattcataatatagatagtcactgccatgttctattagttgtcgtttttgacaaagtttaaataaaacttataaaattttgactataaataaatgttttattatttagtttg

SEQ ID NO: 3489 - DNA, 1930 bp, Secale cereale
ccgcccgccgcggcgctgcgcctcggacccctcttctggccgtggcaaaaggtgaaagttgggcccctttcagtttcccccatgggttttggaacatgggcatggggcaaccagctgctttggggctaccaggaaagcatggatagtgaactgcaggagtgtttcaatttggctctgaagaatggcataaaccttttcgacaccgccgactcttatggaaccgggaagctgaatggccagagcgaaaggctcctcggcaaatttatccgcgagtgccaagggccaataaaatctccagacgatgtgatcatcgcaactaagtttgccgcatatccttggcgactaacgtctggccagtttgtcaacgcctgcaagtcatcattggaaaggttacagatcgatcggctcggaatagggcagctgcattggtctactgcgaactatgcacctctgcaggagcgcgctctctgggacggtctagttgaaatgtatgacaagggtcttgtccgggccgtgggtgtgagcaattatgggccgaagcagcttctgaagatccacagctacctggcatccagaggtgtccccctgagctcagctcaggtgcagttctcgctgctgagcatgggcgatgagcagatggagctgaaaaccgtgtgcgattccctgggtgttcggctaatagcttatagccctcttgggttgggcatgctcaccgggaagtatgacgcctctaaccttccaaatgggccaagatctgtgttgttccggcagattcttcctgggctggaatccctgctgtcttgcttgaagagtattgccgaccgaaagggcaaaaccatgtcccaggtggctataaactggtgcatttgcaaaggcgcaattccgattcccggcgtgaaaacagtgagacacgtggaggacaacttgggcgcgctcggctggaggctgagccctggtgagatctcagacctggaagccgcggcgatggagtgcccgaagaagatggttcagaacatatttcagaccacatgagcaaactgaaactgcagtgctccagtgttgaacatgacagcaaactgagataaagagcagaggttttgtgcagaaaagagacatgttgctttctcttctctgcctggttcagagttcagttcagaacttcagagttcagagacatgccactgcagttgacaaatcatcgctgacagaaaattacgccaatttattccgataatacatgcatgcatgatgcatcttgcagtacgctcccaaacgacgactaattaagcgtgctgcttaacacactggcatgtccatccatctgaacagattcagatggagcttaaccgtacttactcagctagtagaaggaggagtatgtaatacagtacatactacacgccatcagcaggcatcagcggccgcttggtggtttatgcagtcgctcttgggtggtcagatggccttgccgtacttggcggcggcggcgggggtgtcctgctgctgcatgagcgcgagggcgcgctcgaactgcgcccagcgctgctccagggtgccgttgtagccgacggacatgcggatgaggcccggggagatgccggcgcgggcgcggtcctcggggtccatctcgctgctggtgctgttgccggagcaggacatgagggtgtcgtagtagccgaggctgacggccatgaggccgaactgggtggtgttctgcaggtggtacatgaggcggttggcgcgctcctcggtgcccatgtccaggcacagcatcccgccggcgccgtagcccgggttgcccatggcgcgcagccgggcgtggtgcgggtggtcggggaggcccgggtaggtgacgcggaggccctgccggcgcatccgggcggcgaactcggcggcgcgccgcgagtgctcctgcatccgcagcggcagg

SEQ ID NO: 3490 - DNA, 1506 bp, Brachypodium distachyon
gtgcctccgatccaccgacgatggctcttccgacagccaaggcggcgcctttcgcgtcgcagcctcacggcagaggcaacctcctccggcgaccaccgtcatcagcgcccgcccctgcagccgcgctgcgcctcgggccactcttctggccgtgggaaaagcagttcagaactccagattacactggggcaatcccttgcactaagcactcgcccctgcttagaaatgtcacagaagttctaaactctgtcgagccaactagccaattttgcatctctgtgaaagttgggcccctttcagtctcccccatgggcttcggaacatgggcatggggcaaccagctgctctggggctaccaagaaagcatggacagtgagctccaggagtgcttcaatttggctctgaagaatggcataaacctcttcgataccgccgactcctatggaactgggaagctgaatggccagagcgaaaggctgcttggaaaatttatccgcgagttcgaagggccgatcaaatctccagacgatgtagtcatagcgacaaagtttgccgcgtatccttggcggctaacgtcaggccaatttgtcaacgcttgcaagtcttcgctagaaaggctacagattgaccgcctcgggatagggcagcttcattggtcgactgcaaactacgcgcctctgcaagaacgcgtgctctgggacggtttagttgaaatgtatgccaaggggcttgtccgggccgtaggtgtcagcaattacgggccgaagcagctgctgaagatccatggctatctagcgtctagaggcgtccccttgagttcagctcaggtccagttctcgctactgagcatgggcgatgagcagatggaattgaagtccgtgtgcgattcacttggggttcgcctaatcgcttacagcccgcttgggctgggcatgctcaccgggaagtatgatgcctccaacctaccaaatgggccgaggtctgtgctgttccggcagattcttcccgggcttgagtcgttgctgtcttgtctcgggagtattgcagaaagaaaggggaaaaccatgtctcaagtggccataaactggtgcatctgcaaaggcgcggttcctatccccggcgtgaaaacggtgaagcacgtggaggacaacttgggtgcgcttggctggaggctgagcccctctgagatttcagaactcgaagctgcagccatggattctcccaagaaaatgctccagaacatattccaaaccgcatgatcgagcacaaccaacgcagagagatgacatcaacatgaaacgtacagcttactgttcatcgcctgcctacttcaagttcaattcgcacatgcttattccgttacatctcccagttccccgaagtctaaatcatacatgcagcttaacacattggttggcatccgtctgatcagctgatcagatggcgcttaacctaactttgcagctaatagcactaatatataccatcagcaccgccggtgactca

SEQ ID NO: 3491 - DNA, 1286 bp, Pseudoroegneria spicata
  misc_feature (5)..(8): n is a, c, g, or t
  misc_feature (46)..(48): n is a, c, g, or t
ccggnnnnaaggcggcgccggcgacgcctttctcgtcgcagccgcnnngcggaggcgtcctcctccggcgaccttcgtcaccgccgccgcccgccgcggcgctgcgcctcggacccctcttctggccgtggcaaaaggtgaatgttgggcccctttcggtttcccccatgggttttggaacatgggcttggggcaaccagctgctctggggctaccaggaaagcatggacagtgaactgcaggagtgtttcaatttggctctgaagaatggcataaaccttttcgacaccgccgactcttatggaactgggaagttgaatggccaaagcgaaaggctgctcggcaaatttatccgcgagtgccaagggccaataaaatctccagacgatgtgatcatcgcaactaagtttgccgcatatccttggcgactaacgtcaggccagtttgtcaacgcctgcaagtcatcattagaaaggttacagatcgaccggctcggaataggtcagctgcactggtctactgcgaactatgcacctctgcaggagcgcgctctctgggacggtctagttgaaatgtatgacaagggtcttgtccgggccgtgggtgtgagcaactacgggccgaagcagcttctgaagatccacagctacctagcatccagaggtgtccccctgagctcagctcaggtgcagttctcgctgctgagcatgggcgatgagcagatggagctgaaaaccgtgtgcgactctctgggtgttcgtctcatcgcttacagccctcttgggctgggcatgctcaccgggaagtatgacgcctctaaccttccaaatgggccaagatctgtgttgttccggcagattcttcctgggctggaatccctgctgtcttgcttgaagagtattgccgaccgaaagggcaaaaccatgtcccaggtggctataaactggtgcatttgcaaaggcgcaattccgattcctggcgtgaaaacagtcagacacgtggaggacaacttgggtgcgctcggctggaggctgagccctgatgagatctcagagctggaagcctcggcgatggagtgcccgaagaagatggttcagaacatatttcagaccgcatgagcaaactgcagtaacgccaatattaaaaatgacagcaacctgaaataagagcagagagatgcccttcgttttgtgcagaaaagagacatgttcagagttcagagacatgccatattgccattgtaaaccctgactagatatctagagctttagctgattgctgaaaca

SEQ ID NO: 3492 - DNA, 1288 bp, Triticum aestivum
cggtttcccccatgggttttggaacatgggcttggggcaaccagctgctctggggctaccaggaaagcatggatagtgaactgcaggagtgtttcaatttggctctgaagaatggcataaaccttttcgacaccgccgactcttatggaactgggaagttgaatggccaaagcgaaaggctgctcggaaaatttatccgcgagtgccaagggccaataaagtctccagatgatgtgattatcgcaactaagtttgctgcgtatccttggcgactaacgtcaggccagtttgtcaacgcctgcaagtcatcattagaaaggttacagatcgatcggctcggaatagggcagctgcattggtctactgctaactatgcacctctgcaggagcgcgctctctgggacggtctagttgaaatgtatgacaagggtcttgtccgagccgtgggtgtgagcaattatgggccgaagcagcttgtgaagatccacagctacctagcatccagaggtgtccccctgagctcagctcaggtgcagttctcgctgctgagcatgggcgatgagcagatggagctgaaaaccgtgtgcgactctctcggcgttcgtctcatcgcttatagccctcttgggctgggcatgctcaccgggaaatatgacgcctctaaccttccaaatgggccaagatctgtgttgttccggcagattcttcctgggctggaatccctgctgtcttgcttgagtggtattgccgaccgaaagggcaaaaccatgtctcaggtggctataaactggtgcatttgcaaaggcgcaattccgattccgggcgtgaaaacagtcagacatgtggaggacaacttgggtgcgctcggctggaggctgagccctgatgagatctcagagctggaagccgcggcgatggagtgccccaagaagatggttcagaacatatttcagaccgcatgagcaaactggaaactgcagtaacgccaatattaaacacgacatcaacctaaaataaagagcagagagatacccttcgttttgtgcagaaaagagacatgttgcttcctcttctctgcctagttcagagttcagttcagaacttaagagttcagagacatgccattgtgaattctgactagatatctagagctttagctgattgctgaaacagtattctggtgttggtatggacagcaactagccacagtaaatgcagaatcgaagcgtgcgagcgaaaagaaaaatcgggatggcagttgacaaatcatcaaaaaaaaaaaaaaaag

SEQ ID NO: 3493 - DNA, 1191 bp, Avena sativa
cagtatcccccatgggttttggaacatgggcatggggcaaccagctgctctggggctaccaagaaagcatggacagtgaactgcaggattgtttcaatttggctctgaagaatggcataaaccttttcgatactgccgactcatatggaactggaaagttgaacgggcagagtgaaaggcttctcggaaaatttatcagcgaaggcccaatcaaatctccagatgatgtggtcattgcaacgaagtttgccgcctatccttggcgactaacatcgggccagtttgtcaacgcctgcaagtcatcgttggacaggttgcagattgatcggctcggaatagggcagctgcactggtctactgctaactatgcacctctgcaggagcgcgctctctgggacgggctagttgatatgtatgacaagggtcttgtccgggccgtaggtgtgagtaattacgggccgaagcagcttctgaagatccacggctatctagcatccagaggtgttcccctgagcacagctcaggttcagttctcgctgctgagcatgggcgatgagcagatggagctgaaaaccgtgtgcgaatccctgggtgttcgtgtcatcgcttatagtccgcttgggctgggcatgctcaccgggaagtatgatgcctcaaaccttccaaatgggccaaggtctgtgttgttccggcagattcttcctgggctagagtctctgctgtcttgcctgaagagtattgcagatagaaagggcaaaaccatgtctcaagttgctataaactggtgcatatgcaaaggcgctatcccgattcccggcgtgaaaacagtcaggcacgtggaggacaacttgggtgcgctcggctggaggctgagccctgatgagatttcagagctggaagccgcggcgatggagtgcccgaagaagatggtccagaacatattccaaactgcatgagcatagtgcaggaacgccagtgacagcaacctgaagcaagagcagagagtatcctttgctctgctatgcctagttcagaactacagagggttcggacacatgcgattgtaaatcctgacgagatgtctagagctgtatgctgaaacgagagtactactaaatcctacgtactggaataccaattgggatgaaactgggaaatcatgttggacggaaaatgaggccaatttattcc

SEQ ID NO: 3494 - DNA, 3518 bp, Triticum aestivum
ggggattcgcgcggcctgaggcaagttccccggcgaagatgaggctgactgtgcgtgtgatcggagcgcgcaacctgcgcgccatggatttcaacgggttcagcgacccgtatgtgaaactgcaggttgggaagcagcggttcaagaccaaggtggtcaagatgaacctgaacccggagtgggatcaggagttcagcttcgtcgtcgccgatgtccgggaggtgctcaagttagatgtctatgatgaagacatgatcgggaccgatgacttcctgggccaggtgagggtgacactggaggatcttctggccgtggagaacttctcgctcggtacgcgctggtaccagcttcttcccaagaccaagagtgacaaggcaattaattgtggggagatttgtcttgcaatatctttagaaacagctggggccacacgatcatggtccgatgatcttgcaactgaactaactggtacacagaaagaggattcattgcaatcaagtcaaagcgcaggatcatcatcagcggcattagcttatgaagaaaatgaagcttctaaagaagataatgttaatgagtatttttctgatggaactgaaatccctgaagatgacaaatgtggcgaagtgagagatccagaggacaggtttaatgggattcctactgaaatttctaatgaagccgaaacttctaaaacagaaaagcttgacaagccctcgcttgttgatcgtgtctatcaaatgtttgccaagaaaaatgatgatatttcgtcaacatcattgacaaagaccgaggctttagaagaagttcagcaagcaccagcagtatttgaggctcctttaagccaaaatagtgacatttcttcagagattacatttgctgaactattgagatcttttgaatcgaggcacgaagaagtcgaaatgcctgtgaatttacaaggaattcttgttaaccagtcatattttacgtcacctagtgatttgaataaccttctcttctcaccagattcagattttcggcaaacattggttcagcttcagggttgtactgatttcaaaactgaaccctggagaattgataatgatggggagtccctgaagagagtgataagttatacaactgcaccatccaaattggttaaagctgtaaaggcaacagaggaacaatcttatttgaaggctgatggaaaagagtattcagttttattaagtgctagcactcctgatgttccttgtggtacttattttcggacagaggttcttttccgtattatgccaggccctgaacttgattctgagcaacagacttcacatttggtaatttcttggcgcatgaattttcttcagagtactatgatgaaaagtattatagaaaatggagcaagacaaggcttggagcaaaattattcacagttctctgatctactgtcagagaagatcaagcctattgatgtagatgatgctggatcagataaggagcaggtcttagcttcattgcaaggggggcaggagtctgattggaagatagcattcctatacttctgtaactttggtgtcttgtcctctctttttgttgccttgtacattggtgttcatgtttcactagtgaattcaggtgcagttcagggacttgagtttcctggattagatttgccagattctgtcagtgagattgtcatgggcgggctattgtttcttcaggtgcaacacatatttaagaaaatcatgtgtttttttcaggcaagagaacaaaaagttggtgatcatggtgtgaaagcacaaggcgatggatggttgctaactgttgccttaattgagggaactaatttggcaccagtcgatgctactggtttctctgatccttatgtggtatttacttgcaatggtaaaaccaaaacaagctcaatcaagttccaaacacttgaacctcagtggaacgatatctttgagtttgatgccatggatgatcctccatcagttatgaatgtgcatgtatatgattttgatggaccatttgacgaagttacctctcttggacatgctgaaatcaactttgtgaaatcaaatctgtcagagctagcggatgtatggattcctcttcaaggtaacttggctaagtccaggcagtctaagttacacctaagaatcttcttgaacaactcaaagggcactggtatggtcactgagtatctgagcaaaatggagaaagaagttggtaagaagatgacgttgcggtctcctcgaactaatactgcattccaggagctcttctctctgcctgcagaagaatttctaatcagcagttttacctgctacttgaagcggaaattgcctacacagggccatcttttcttgtctccaagaataattggattttattcaagcatgtttggccggaaaacaaagtttttctttctatgggaggatattgaagacatacaggcaattcccccatcactatcgacatggagtccatcccttgcaataactcttcacagaggtagaggcatggatgcaaagcatggtgcgaagagcgtagagagtggaaagctgaagttttctctgcaatctttcgcatcatttagtgtggccaataggacaataatggcgttatggaaagcaagatcattgagctccgagtctaaagtacagattgctgaggaacaatctcaaaataatacacttcagagtgaggacagtggaatttttgttggtgttgacgattccaagagccttcagatgagtgaagttttctcgtcaaccatttctgctaatatgaattcacttctggaggtgttcgaaggaggttcattggagatgaaagtcatggagaaagttggatgcctcaaatactcggctacacaatgggaatcagataaacccgaggaatatcaaagacaaattcattacaagtttagcaggaagttgtctcctgttggaggagaagtgactgggacccagctgaaatctcctatgcccaataagaaagggtggattattgaagaggtgatggaacttcaaggcgtccttcttggtgacttcttcacgcttcatataaagtatcaaatcgaagaccttgctcctaaacaaaaggcgtgcagtgtccaagtctatcttggaattgaatggtcaaagaccaccaggcatcagaagagaatcgagaagaatgttctttccagttcatctgctcgcctaaaggagatgttcagccttgcatccaagcaactctcgcacaccagataggatcattcatccgtgacaacccatgtgcataatactgaatgaccaaagatttgctgaccagcggtatggtcccctgtacatacattgcttgattgaagggacgcgcgggcagactgattcattcgttagactattttagggcgagctttgcagatttttctgtagctgtgagcaattgtggtgcagcattttctgaactcaggataccaaatccaattttttggtgtactgtatctgatcaaacatagatccaatcagcacagacagcagaaattt

SEQ ID NO: 3495 - DNA, 3772 bp, Secale cereale
ggagtttgtttgggatcgggagcggagcaagccatttccgggcggttcgttgccgggggatccgcgcgggctgaagcaagtccgccggccaagatgaggctgaccgttcgtgtgatcggagcccgcaacctgcgcgccatggatttcaacgggttcagcgacccgtatgtgaagctgcaggtcgggaagcagcggttcaaaaccaaggtggtcaagatgaacctgaacccggagtgggatcaggagttcagcttcgtcgtcgccgatgtccgggaggtgctcaaaatagatgtctacgatgaagacatgatcgggactgatgacttcctggggcaggtgagggtgacactggaggatcttctggccgcggagaacttctccctcggcacgcgctggtaccagcttcttcccaaggccaagagtgacaaggcagttgattgtggtgagatttgtgttgcaatatctttagaaacagctggggccacacgatcatggtctgatgatattgcaactgaactaactggtacacaggaagagtattcattgcgatcaagtcaaagcgcaggagcatcatcggctgcattagcttatgaagaaaatgaagcttctaaagaagataatgttaatgattatttttctgatggaactgaaatccctgaagaggacaaatgtggcgaagtgagagatccagaggacaggtttaatggaattcctactgaaatttctaacgaagccgaaacttctaaaacagagaagcttgacaagccctcgcttgttgatcgtgtctatcaaatgtttgccaagaaaaatgatgatatttcgtcaacatcgttgagaaagaccgaggcatcagaagaagttcaacaagcaccaacagtatttgaggcccctttaagcgaaaatagtgaaatttgttcagaggttacatttgctgaactattgagatcttttgaatcaaggcacgaagaagtcgaaatgcctgtgaatttacaaggaattcttgttaaccagtcatatttcacgtcgcctagcgatttgaataaccttctcttctcaccagattcagattttcggcaaacattggttcagcttcagggttgtaccgatttcaaaactgaaccctggagaattgataatgatggggagtccttgaagagagtgataagttatacaactgcaccatccaaattggttaaagctgtgaaggcaacagaggaacaatcttatttgaaggctaatgataaagagtattcagttttattgagtgctagcactcctgatgttccttgtggtacttattttcggacagaggttcttttccgtattatgccaggccctgaacttgattctgagcaacagacttcacatttggtaatttcttggcgcatgaattttcttcagagtactatgatgaaaagtattatagaaaatggagcaagacaaggcttggagcaaaattattcacagttctctgatctactgtcagagaagatcaagccgattgatgtagacgatgctggatcagataaggagcaggtcttagcttcattgcaagggggtcaggagtctgattggaagatagcattcctatacttctgcaactttggtgtcttgtcctctctttttgttgccttgtacattggtgttcatgtttcactagtgaattcaggtgcagttcagggacttgagtttcctggattagatttgccagattctctcagtgagattgtcatgggtgggctattgtttcttcaggtgcaacacatatttaagaaaatcatgtgttttttccaggcaagagaacaaaaagttggtgatcatggtgtgaaagcacaaggcgatggatggttgctaacggttgcgttaattgagggaaccaatttggcaccagttgatgctactggcttctctgatccttatgtggtatttacttgcaatggtaaaaccaaaacaagttcaatcaagttccaaacgcttgaacctcagtggaacgacatctttgagtttgatgccatggatgatcctccatcagtgatgaatgtacatgtatatgattttgatggacccttcgacgaagttacctctcttggacatgctgaaatcaactttgtcaaatcaaatctgtcagagctagcggatgtatggattcctcttcaaggtaacttggctaagtccaggcagtctaagttacacctaagaatcttcttgaacaactcaaagggcactggtatggtcactgagtatctgagtaaaatggagaaagaagttggtaagaagatgacgttgcggtctcctcgaactaatactgcattccaggagctcttctctctgcctgcagaagaatttctaatcagcagttttacctgctacttgaagcggaaattgcctacacagggccatcttttcttgtctccaagaataattgggttttattcaagcatgtttggccggaaaacaaagtttttctttctatgggaggatattgaagacatacaggcaattcccccatcactagcgacgtggagtccatccctttcaataactcttcacagaggtagaggcatggatgcaaagcatggtgcaaagagtgtagagagtggaaagctgaagttttctctgcaatcttttgcatcatttagtgtggccaataggacaataatggcgttatggaaagcaagatcattgagctccgagtctaaagtacagattgccgaggaacaatctcaaaataatacacttcagagtgaggacagtggaatttttgttggtgttgacgattccaagagccttcagatgagtgaagttttctcgtcaaccatttctgctaatatgaattcacttttggaggtgttcgaaggaggttcattggagatgaaagtcatggagaaagttggatgcctcaaatactcggctacacaatgggaatcagataaacccgacgaatatcaaagacaaattcattacaagtttagcaggaagttgtctcctgttggaggagaagtgactggaacccagctgaaatctcctatgcccaataagaaagggtggattattgaagaggtgatggaacttcaaggcgtccttcttggtgacttcttcacgcttcatataaagtatcaaatggaagaccttgctcctaaacaaaaggcgtgcagtgtccaagtctatcttggaatcgaatggtcaaagaccacgaggcatcagaagagaatcgagaaaaatgttctttccagttcatccgctcgcctaaaggagatgttcagccttgcatccaagcaactctcgaacaccagataggatcattcatccgtgacaacccatgtgcatattactgaatgaccaaagatttgctgactggcggtatgatcccctgtacatacattttgcttgattgaaggtattgcacgggcagaccgattcattcgttagaccattttagagtgagctttgcagatttttctgtagctgtgagcaatcgtggtgcagcattttctgaactgaggataccaaatccatttgtttggtgtactgtatctgatcaaatgttgatccaatcaacacagactgcagcaatttggaccagatatatgatagcagcatcatacatccagttatgaattacactgaactgaagccatggcctgcaatttgttgatctgtagactgtagtgtttgtcttgtatacataggatagcagtgttgttctctgtacgttggaattgggccagttcaactccctgtttcattgatcacacacatgttgatacagaag

SEQ ID NO: 3496 - DNA, 4213 bp, Triticum aestivum
ggtgtgtcgttgacgagatctcgcgtccatgtggccggggttcttttcctttgacttgatccaaccaggaagaagacttcgagccgtgcgaagctagtatattggcggtctgctggttgctcccatcacttggtttcctcctcttcttgccatttctcgtctgcttgcttcttcttcttgcccccctcccctgtccgtcccggagcgtgcaaagtctgatctggttctcctcctgtgtccgtccacatccaggggggtcctggatttggagacggagattggcacctggaaagtggtcgatgtgcctgtcagtcttgttgttttgccgggattggtaacgggcgggcgggcgagagagaagtgatgggagtttgatttgccactttgatcttgggattggttcttggggggcggcggtagttggcccgtttcttggttcttttggggcggagtttgtttgggatcgggagaggagtaagccatttccgggcggttcttgtcgggggattcgcgcgggctgaggcaagttcgtcggcgaagatgaggctgactgtgcgtgtgatcggagcccgcaacctgcgcgccatggatttcaacgggttcagcgacccgtatgtgaaactgcaggttgggaagcagcggttcaagaccaaggtggtcaagatgaacctgaacccggagtgggaccaggagttcagcttcgtcgtcgccgatgtccgggaggtgctcaagttagatgtctatgatgaagacatgatcgggactgatgacttcctgggccaggtgagggtgacactggaggatcttctggccgcggagaacttctcgctcggcacgcgctggtaccagcttcttcccaaggccaagagcgacaaggcagttgattgtggggagatttgtcttgcaatatctttagaaacagctggggccacacgatcatggtctgatgatcttgcaactgaactaactggtacacagaaagagtattcattgcaatccagtcaaagcgcaggagcgtcatcggctgcattagcttatgaagaaaatgaagctactaaagaagatgatgttaatgagtatttttctgatggaactgaaatccctgaagacgacaaatgtggtgaagtgagagatccagaggacaggttgattcctactgaaatttctagtgaagccggaacttctaaaacagaaaagcttgacaagccctcgcttgttgatcgtgtctatcaaatgtttgccaagaaaaatgatgatatttcgtcaacatcattgacaaagaccgaggctttagaagaagttcaacaagcaccagcagtatttgaggctcctttaatccaaactagtgacatttgtttagagattacatttgctgaactattgggatcttttgaatcaaggcacggacaagtcgaaatgcctgtgaatttacaaggaattcttgttaaccagtcatattttacatcacctagtgatttgaataaccttctcttctcaccagattcagattttcggcaaacattggttcagcttcagggttgtactgatttcaaaacggaaccctggagaattgataatgatggggagtccctgaagagagtgataagttatacaactgcaccatccaaattggttaaagctgtaaaggcaacagaggaacaatcttatttgaaggctgatggaaaagagtattcagttctattgagtgctagcactcctgatgttccttgtggtacttattttcggacagaggttcttttccgtattatgccaggccctgaacttgattctgagcaacagacttcacatttggtaatttcttggcgcatgaattttcttcagagtactatgatgaaaagtattatagaaaatggagcaagacaaggcttggagcaaaattattcacagttctctgatctgctgtcagagaagatcaatcctattgatgtagacgatgctggatcagataaggagcaggtcttagcttcattgcaaggggggcaggagtctgattggaagatagcattcctatacttctgcaactttggtgtcttgtcctctctttttgttgccttgtacattggtgttcatgtttcactagtgaattcaggtgcagttcagggacttgagtttcctggattagatttgccagattctatcagtgagattgtcatgggtgggctattgtttcttcaggtgcaacacatatttaagaaaatcatgtgttttttcaggcaagagaacaaaaagttggtgatcatggtgtgaaagcacaaggcgatggatggttgctaactgttgccttaattgagggaaccaatttggcaccagtcgatgctactggtttctctgatccttatgtggtatttacttgcaatggtaaaaccaaaacaagctcaatcaagttccaaacacttgaacctcagtggaacgacatctttgagtttgatgccatggatgatcctccatcagttatgaatgtacatgtatatgattttgatggaccatttgacgaagttacctctcttggacatgctgaaatcaactttgtcaaatcaaatctgtcagagctagcagatgtatggattcctcttcaaggtaacttggctaagtccaggcagtctaagttacacctaagaatcttcttgaacaactcaaagggcactggtatggtcactgagtatctgagcaaaatggagaaagaagttggtaagaagatgacgttgcggtctcctcgaactaatactgcattccaggagctcttctctctgcctgcagaagaatttctaatcagcagttttacctgctacttgaagcggaaattgcctacacagggccatcttttcttgtctccaagaataattggattttattcaagcatgtttggccggaaaacaaagtttttctttctatgggaggatattgaagacatacaggcaattcccccatcactatcgacatggagtccatcccttgcaataactcttcacagaggtagaggcatggatgcaaagcatggtgcgaagagtgtagagagtggaaagctgaagttttctttgcaatcttttgcatcatttagtgtggccaataggacaataatggcgttatggaaagcaagatcattgagctccgagtctaaagtacagattgctgaggaacaatctcaaaataatacacttcagagtgaggacagtggaatttttgttggtgttgacgattccaagagccttcagatgagtgaagttttctcgtcaaccatttctgctaatatgaattcacttctggaggtgttcgaaggaggttcgttggagatgaaagtcatggagaaagttggatgcctcaaatactcggctacacaatgggaatcagataaacctgatgaatatcaacgacaaattcattacaagtttagcaggaagttgtctcctgttggaggagaagtgactgggacccagctgaaatctcctatgcccaataagaaagggtggattattgaagaggtgatggaacttcaaggcgtccttcttggtgacttcttcacgcttcatataaagtatcaaatcgaagaccttgctcctaaacaaaaggcgtgcagtgtccaagtctatcttggaattgaatggtcaaagaccaccagacatcagaagagaatcgagaagaatgttctttccagttcatctgctcgcctaaaggagatgttcagccttgcatccaagcaactctcgcacaccagataggatcattcatccgtgacaacccatgtgcataatactgaatggccaaagatttgctgaccagcggtatggtcccctgtacatacattgcttgattgaaggtacgcgcgcgggcagaccgattcattcgttagactattttagggcgagctttgcagatttttctgtagctgtgagcaattgtggtgcagcattttctgaactcaggattaccaaatccaattttttggtgtactgtatctgatcaaatgtagatccaatcagcacagacagcagaaatttggaccaggcatatgatagcagcatcatacaaccagttatgatttatactgaagccatggcctgcaatttgttgatctgtagacagtagtgtttgtcttgtatacataggatagcagtgttgttctctgtacgttggaattgggccacttcaactccctgtttcattgatcacacacatgttgatacagaaggaaaaa

SEQ ID NO: 3497 - DNA, 3782 bp, Brachypodium distachyon
tgccatttctcggcgattcttattggggaatttgtgtgaagtcgaagcaggattgtcggtggagggcagagatgaggctgaatgtgcgtgtgatcggagcccgcaacctgcgggccatggatttcaacggcttcagcgatccgtacgtgaagctgcaggtcgggaagcagaggttcaagaccaaggtggtcaagatgaacctgaacccggagtgggatcaggagttcagttttgttgtctccgatgtccgggaagtgctcaagttctgtgtctacgacgaagacatgattgggatcgatgacttcctggggcaggtgaaggtgccactggaggacctgctggctgcggagaacttctcgcttggtacacaatggtaccagcttcttccaaagagcaagagcgacaaggcagtcgattgcggggagatttgtctcgcaatatctttagaaacagctggggccacacgatcatggtctgatgatcttgcaactgaattaactggcatacatagcgactattcattatcatcaagtcaaagcactggaacatcacttgcattagcttatcaagaaaatgaagcttcgaaagaagataatatcaatgagtattctgatggatctgaaatccatgaagaggacaaatgtagcattggtagagagcaaacaactgcagaggccaaacctaatgggatttctagtggagcagaaacttctaaagcagagaagcttgataagacctcgcttgttgatcgtgtctgtcaaatgtttgtcaggaaaaatgatgatgctgtaccaacaacatctttagcaaagactgaggcttcagaagaagttcaagaagcaccagcaggatttgaggcttctgtaagccaaagtgatgatatgtgttcagaggctccatttgatgagctactgagatcttttgaatcaaggcatgaaggagttgaaatgcctgtaaatttacaaggaattcttataaaccagtcatattttacgtcgcctaatgatttgaataaccttctcttctcaccggattcggattttcggcgaacactggtccagcttcagggttgtactgatttcacaagtgaaccctggataattggtaatggtggggagacccttaagagagtgataacttatacaactgcaccatccaaattggttaaagctgttagagcaacagaggaacaatcttatttgaaggctgatggaaaagagtattcagttttattgagtgctagcaccccagatgttccttgtggtacttattttcgcacagaagttcttttccgtattatgccaggtcctgaacttgattctgagcaacagacttcacatttggtaatttcttggcgcatgaattttcttcagagtactatgatgaaaggtattatagaaaatggcgcaagacaaggcttggagcaaaattatgcacagtttttggatttactgtcagagaaggtaaagccaattgatgtagaagatgctgggtcagacaaagaacaggtcttatcttcgttgcaagggggtcaggagtctgattggaagatagcattcctatacttctgcaactttggtgtcctgtcctctctttttgtagccctgtacattgttgtgcatgtttcacttgtgaattcaggtgcagttcaggggcttgagtttcctggattagatctgccagattctctcagtgagattgtgatgggtgggctgttgtttcttcaggtgcaaaacatgtataagaaactcatgtgcttttttcaggcaagggaacaaaaagttggtgatcatggtgtgaaagcacaaggtgacggatggttgttgacagtcgccttaattgagggaaccaaattggcaccagttgatgctactggtttctctgatccttatgtggtgtttacttgtaatggtaaaacaaaaacaagttcaatcaagttccaaactctggaacctcagtggaatgatatctttgagtttgatgccatggatgatcctccatcagtgatgaatgtacatgtatatgattttgatggaccatttgacgaagttacctctcttggacatgctgaaataaactttgtcaaatcaaacttgtcagagctagccgatgtatggattcctcttcaaggcaacctggctcagtccaggcagtctaagttacacctaagaatttttttgaacaactcaaagggcactggtatggtgaccgagtatctgagcaaaatggagaaagaagttggtaagaagatgacgttgcggtctcctcgaactaatactgcattccaggagctcttctctctcccagcagaagaatttctcatcagcagttttacttgctacttgaagaggaaattgcatacacagggccaccttttcttgtctccaagaataattgggttttattcaagcatgtttggccgaaaaacaaagtttttctttctatgggaggatattgaagatatacaggcaattcctccatcgctatcgtcatggagtccatcccttgcaataattcttcacaaaggtagaggaatggatgcaaagcatggtgccaagagcgtggagaatggaaagctaaagttttctctgcagtcatttgcatcatttagtgtggccaataggacaataatggcgttatggaaagcaagatctttgagctctgagactaaagtacagattgctgaggaacaatcccataataatacccttcagagtgaggacagtggaatttttgctggtgttgaggattccaagagccttcagatgagcgaagttttctcctcagtcatttctgctaatatggcttcacttatggaggtgtttggaggaggttcgttggagatgaaagtcatggagaaggtcggatgtctcaaatactcggctacacaatgggaaccagataaacctgatgaatatcaacgacaaattcattacaagtttagcaggaaattgtctcctgttggaggagaagttactggaacacagctgaaatctcctatgcccaacaacaaaggctggattattgaagaggtgatggaactccaaggagtccttcttggcgacttcttcacgcttcatataaagtatcaagtcgaagacctggctcctaaacaaaaggcgtgcagtgtccaagtctatcttggaattgaatggtcaaagaccaccaggcatcagaagagaatcgagaagaatgttctttccagttcatctgctcgcctgaaagagatgttcagccttgcatcaaagcagctctcacacgccagataggatcatacacctgtggcaatccctgtgcataatactgagatgactgaacatttctgaccgccgctacgaccccctgtacatacattgcttgattgaagatacacacgggcgactgattcatttgttagacgagtttacagtcagctttgcagatcctgcagtagttgagccattgctttggctgaaatcacgattatacccaatagctttctttgttgtactgtatctgacaagatgttgaaccagtttgcacaccatgataccagcatcgtcaagctgcagtgatgaattacgacgagggccttgggtttgtttctccgtaggtatgttttagtgtacataggatgccgttatttacctatgtgtgcatcttttcttttgttcatggaatcgggtcagctcaactctttttcttaacgatcacatgttgaactcttctttttagatcatcacatgttgaattgtacagaaggaggaaataaattgttcaaataaaattctgatattaccgac

SEQ ID NO: 3498 - DNA, 4240 bp, Brachypodium distachyon
ttgctcgcggtctgctgctggtttggttgcctccaccatttggtctccctcctgttcttgccgttcttcgcgggcaagcgcgtctctttgcttcttcgtcttcttctcgcgcttttctgtctcggcgcgggtaaatccgatccaggcttgtgtgtgtgtccacatcagtggggatctctggattgggaaaggagattggcacctgaagcggaaagtggccgatgtgcctgtcagtcttgttgttttgctgagtggcatgggcaccaacgaagtgacgagagattgatttgccactctgatctcggggttggttggggagtaccggtagtgtggcccgattcttgaaggggtcgttcttccggtgcggagctttgtttgggatcgggaaaacagcgagctttgatcggttcctgccatttctcggcgattcttattggggaatttgtgtgaagtcgaagcaggattgtcggtggagggcagagatgaggctgaatgtgcgtgtgatcggagcccgcaacctgcgggccatggatttcaacggcttcagcgatccgtacgtgaagctgcaggtcgggaagcagaggttcaagaccaaggtggtcaagatgaacctgaacccggagtgggatcaggagttcagttttgttgtctccgatgtccgggaagtgctcaagttctgtgtctacgacgaagacatgattgggatcgatgacttcctggggcaggtgaaggtgccactggaggacctgctggctgcggagaacttctcgcttggtacacaatggtaccagcttcttccaaagagcaagagcgacaaggcagtcgattgcggggagatttgtctcgcaatatctttagaaacagctggggccacacgatcatggtctgatgatcttgcaactgaattaactggcatacatagcgactattcattatcatcaagtcaaagcactggaacatcacttgcattagcttatcaagaaaatgaagcttcgaaagaagataatatcaatgagtattctgatggatctgaaatccatgaagaggacaaatgtagcattggtagagagcaaacaactgcagaggccaaacctaatgggatttctagtggagcagaaacttctaaagcagagaagcttgataagacctcgcttgttgatcgtgtctgtcaaatgtttgtcaggaaaaatgatgatgctgtaccaacaacatctttagcaaagactgaggcttcagaagaagttcaagaagcaccagcaggatttgaggcttctgtaagccaaagtgatgatatgtgttcagaggctccatttgatgagctactgagatcttttgaatcaaggcatgaaggagttgaaatgcctgtaaatttacaaggaattcttataaaccagtcatattttacgtcgcctaatgatttgaataaccttctcttctcaccggattcggattttcggcgaacactggtccagcttcagggttgtactgatttcacaagtgaaccctggataattggtaatggtggggagacccttaagagagtgataacttatacaactgcaccatccaaattggttaaagctgttagagcaacagaggaacaatcttatttgaaggctgatggaaaagagtattcagttttattgagtgctagcaccccagatgttccttgtggtacttattttcgcacagaagttcttttccgtattatgccaggtcctgaacttgattctgagcaacagacttcacatttggtaatttcttggcgcatgaattttcttcagagtactatgatgaaaggtattatagaaaatggcgcaagacaaggcttggagcaaaattatgcacagtttttggatttactgtcagagaaggtaaagccaattgatgtagaagatgctgggtcagacaaagaacaggtcttatcttcgttgcaagggggtcaggagtctgattggaagatagcattcctatacttctgcaactttggtgtcctgtcctctctttttgtagccctgtacattgttgtgcatgtttcacttgtgaattcaggtgcagttcaggggcttgagtttcctggattagatctgccagattctctcagtgagattgtgatgggtgggctgttgtttcttcaggtgcaaaacatgtataagaaactcatgtgcttttttcaggcaagggaacaaaaagttggtgatcatggtgtgaaagcacaaggtgacggatggttgttgacagtcgccttaattgagggaaccaaattggcaccagttgatgctactggtttctctgatccttatgtggtgtttacttgtaatggtaaaacaaaaacaagttcaatcaagttccaaactctggaacctcagtggaatgatatctttgagtttgatgccatggatgatcctccatcagtgatgaatgtacatgtatatgattttgatggaccatttgacgaagttacctctcttggacatgctgaaataaactttgtcaaatcaaacttgtcagagctagccgatgtatggattcctcttcaaggcaacctggctcagtccaggcagtctaagttacacctaagaatttttttgaacaactcaaagggcactggtatggtgaccgagtatctgagcaaaatggagaaagaagttggtaagaagatgacgttgcggtctcctcgaactaatactgcattccaggagctcttctctctcccagcagaagaatttctcatcagcagttttacttgctacttgaagaggaaattgcatacacagggccaccttttcttgtctccaagaataattgggttttattcaagcatgtttggccgaaaaacaaagtttttctttctatgggaggatattgaagatatacaggcaattcctccatcgctatcgtcatggagtccatcccttgcaataattcttcacaaaggtagaggaatggatgcaaagcatggtgccaagagcgtggagaatggaaagctaaagttttctctgcagtcatttgcatcatttagtgtggccaataggacaataatggcgttatggaaagcaagatctttgagctctgagactaaagtacagattgctgaggaacaatcccataataatacccttcagagtgaggacagtggaatttttgctggtgttgaggattccaagagccttcagatgagcgaagttttctcctcagtcatttctgctaatatggcttcacttatggaggtgtttggaggaggttcgttggagatgaaagtcatggagaaggtcggatgtctcaaatactcggctacacaatgggaaccagataaacctgatgaatatcaacgacaaattcattacaagtttagcaggaaattgtctcctgttggaggagaagttactggaacacagctgaaatctcctatgcccaacaacaaaggctggattattgaagaggtgatggaactccaaggagtccttcttggcgacttcttcacgcttcatataaagtatcaagtcgaagacctggctcctaaacaaaaggcgtgcagtgtccaagtctatcttggaattgaatggtcaaagaccaccaggcatcagaagagaatcgagaagaatgttctttccagttcatctgctcgcctgaaagagatgttcagccttgcatcaaagcagctctcacacgccagataggatcatacacctgtggcaatccctgtgcataatactgagatgactgaacatttctgaccgccgctacgaccccctgtacatacattgcttgattgaagatacacacgggcgactgattcatttgttagacgagtttacagtcagctttgcagatcctgcagtagttgagccattgctttggctgaaatcacgattatacccaatagctttctttgttgtactgtatctgacaagatgttgaaccagtttgcacaccatgataccagcatcgtcaagctgcagtgatgaattacgacgagggccttgggtttgtttctccgtaggtatgttttagtgtacataggatgccgttatttacctatgtgtgcatcttttcttttgttcatggaatcgggtcagctcaactctttttcttaacgatcacatgttgaactcttctttttagatcatcacatgttgaattgtacagaaggaggaaataaattgttcaaataaaattctgatattaccgacagtcaagacactgaaccacatttggttgtgttcattgtcgtatatcc

SEQ ID NO: 3499 - DNA, 3419 bp, Triticum aestivum
aagagtgacaaggcagttgattgtggggagatttctcttgcaatatctttagaaacagctggggccacacgatcatggtctgatgatcttgcaactgaactaactggtacacagaaagagtattcattgcaatccagtcaaagcgcaggagcatcatcggctgcattagcttatgaagaaaatgaagcttctaaagaagataatgttaatgagtatttttctgatggaactgaaatccctgaagaggacaaatgtggtgaagtgagagattcagaggacaggtttaatgggattactactgaaatttctaatgaagccgaaacttctaaaacagaaaagcttgacaagccctcgcttgttgatcgtgtctatcaaatgtttgccaagaaaaatgatgatatttcgtcaacatcattgacaaagaccgaggctttagaagaagttcaacaagcaccagcagtatgtgaggctcctttaagccaaaatagtgacatttgttcagagattacatttgctgaactattgagatcttttgaatcaaggcacgaagaagtcgaaatgcctgtgaatttacaaggaattcttgttaaccagtcatattttacgtcacctagtgatttgaataaccttctcttctcaccagattcagattttcggcaaacattggttcagcttcagggttgtactgatttcaaaactgaaccctggagaattgataatgatggggagtccctgaagagggtgataagttatacaactgcaccatccaaattggttaaagctgtaaaggcaacagaggatcaatcttatttgaaggctgatggaaaagagtattcagttttattgagtgctagcactcctgatgttccttgtggtacttattttcggacagaggttcttttccgtattatgccaggccctgaacttgattctgagcaacagacttcacatttggtaatttcttggcgcatgaattttcttcagagtactatgatgaaaagtattatagaaaatggagcaagacaaggcttggagcaaaattattcacagttctctgatctactgtcagagaagatcaagcctattgatgtagacgatgctggatcagataaggagcaggttttagcttcattgcaaggggggcaggagtctgattggaagatagcattcctatacttctgcaactttggtgtcttgtcctctctttttgttgccttgtacattggtgttcatgtttcgctagtgaattcaggtgcagttcagggacttgagtttcctggattagatttgccagattctatcagtgagattgtcatgggtgggctattgtttcttcaggcgcaacacatatttaagaaaatcatgtgttttttcaggcaagagaacaaaaagttggtgatcatggtgtgaaagcacaaggcgacggatggttgctaactgttgccttaattgagggaaccaatttggcaccagtcgacgctactggtttctctgatccttatgtggtatttacttgcaatggtaaaaccaaaacaagctcaatcaagttccaaacacttgaacctcagtggaacgacatctttgagtttgatgccatggatgatcctccatctgttatgaatgtacatgtatatgattttgatggaccatttgacgaagttacctctcttggacatgctgaaatcaactttgtcaaatcaaatctgtcagagctagcggatgtatggattcctcttcaaggtaacttggctaagtccaggcagtctaagttacacctaagaatcttcttgaacaactcaaagggcactggtatggtcactgagtatctgagcaaaatggagaaagaagttggtaagaagatgacgttgcggtctcctcgaactaatactgcattccaggagctcttctctctgcctgcagaagaatttctaatcagcagttttacctgctacttgaagcggaaattgcctacacagggccatcttttcttgtctccaagaataattggattttattcaagcatgtttggccggaaaacaaagtttttctttctatgggaggatattgaagacatacaggcaattcccccatcactatcgacatggagtccatcccttgcaataactcttcacagaggtagaggcatggatgcaaagcatggagcgaagagcgtagagagtggaaagctgaagttttctctgcaatcttttgcatcatttagtgtggccaataggacaataatggcgttatggaaagcaagatcattgagctccgagtctaaagtacagattgctgaggaacaatctcaaaataatacacttcagagtgaggacagtggaatttttgttggtgttgacgattccaagagccttcagatgagtgaagttttctcgtcaaccatttctgctaatatgaattcacttctggaggtgttcgagggtggttcgttggagatgaaagtcatggaaaaagttggatgcctcaaatactcggctacacaatgggaatcagataaacccgacgaatatcaaagacaaattcattacaagtttagcaggaagttgtctcctgttggaggagaagtgactgggacccagctgaaatctcctatgcccaataagaaagggtggattattgaagaggtgatggaacttcaaggcgtccttcttggtgacttcttcacgcttcatataaagtatcaaatcgaagaccttgctcctaaacaaaaggcgtgcagtgtccaagtctatcttggaattgaatggtcaaagaccaccaggcatcagaagagaatcgagaagaatgttctttccagttcatctgctcgcctaaaggagatgttcagccttgcatccaagcaactctcgcacaccagataggatcattcatccgtgacaacccatgtgcataatactgaatgaccaaagatttactgaccagcactatggtcccctgtacatacattgcttgattgaagggacgcgcgggcagactgattcattcgttagactattttagggcgagctttgcagatttttctgtagctgtgagcaattgtggtgcagcattttctgaactcaggataccaaatccaattttttggtgtactgtatctgatcaaacatagatccaatcagcacagacagcagcaatttggaccagacatatgatagcagcatcatacaaccagttatgatttacactgaagccatggcctgcaatttgttgatctgtagacagtagtgtttgtcttgtatacataggatagcagtgttgttctctgtacgttggaattgggccacttcaactccctgtttcattgatcacacacatgttgatacagaaggaaaataaaaagtgatccggtgataaataaaattggatttttattgacactagacgtaaggcccaaagttttt

SEQ ID NO: 3500 - DNA, 4314 bp, Setaria italica
ctcccctgcctgcctcgctctccactccgccgctcctctctctgtgtgtactgtgtggtgcgtgtgtcgtggacgaaatctcgcgtccatgtgggagcttttgacttgatccaaccaagaacgcgcctttcagccgtaaaatactagcggtcctaccagtttcgaagtctggtcgcggtttactttgcttccatcatttgctttcccatttcgcgtgcgcctcggcttacccattcttgcttccgtcggcttggtgcgtgtaaatccgatccgcttgtgtctctatatcattgggccgtctgaagctgaatttggagctggcaatgtccagggaagaaaggagtatttgatccgacttccgtgggagttcttgctgctgttccggtgctgggattgggcggattggagagcggctggtatcctgtcgatttcttcggggaagctactgttgttatgaatttctgatgcggagtttcgcttaggatttgggaaggagggatctttgatcgatttctgcacttctcttggtgattcctgttcttctcgacttggggatttctgccaaggggtgtttcctggctcagttgagcagcagagatgaggctgactgttcgtgtgatcgaggcccgcaacctgcgggccatggattcgaacgggttcagcgatccgtacgtgaagctgcagctcgggaagcagcggttcaagaccaaggtgatcaagatgaacctgaacccgacttgggatcaggagttcagcttccttgtcggcgatgtcagagatgtgctcaagcttgatgtctatgacgaagacatcctccagatggatgacttcctggggcagctgagggtgccattagaggatgttctggcagcggaggacttatcgcttggtacccaatggtaccagcttcttccgaagggcaaaaccaacaaggcggtcgattgtggggagatttgtgtctcaatatatttagaatcagccggagccacacggtcatggtctgatgatctttcagctgaattaactgatatagagagagactactcattgtcaagccaaagcacagctccatctattgcattagcttatagagaaactgaaacttgtaaagaagatagtatcaatgaatattctgatgggtctgaaatccctgcagaggataaatgtagtgaagttactgacagaaatcaagctgctgcacaggacaggtcaaaagaaaattctaatgcagctttgaatggagctgaaacttctagttctaaaactgataagccatcatttgtcgatcgtgtctgccaaatatttggtaaaaaaaatggcgatgtggtgccaacctcctctgaaatctccgaggcttcagaacaagttcaagaggaaccaagaggatatgagattccggtaagccaagatgataagacgtgcccagaggctccattcagtgaactactgaaatctctcgaatcacggcatgaaggagtcgagatgcctgtaaatctaccaggaattcttgttaaccagtcatatcttgcctcgcctagtgatctgaataaccttctcttctcaccagattcagattttaaacaaacaatgattgagcttcaaggttgtactgatttcaaaactgaaccctggaggcttgataatgatggggagtccttgaagagagtggtaacttacacaacggcaccatcgaaattggttaaagccgttcgagcaaccgaggagcaatcttatttgaaggctgatggaaaagagtatgcagttttgttgagtgtaagcacccctgatgttccctgtggtacttattttcggacagaaattcttttccgaatcatgccaggccctgaacttgattctcagcaacagacgtcacatttggtaatttcttggcgcatgaattttcttcagagtactatgatcaaaagtatgattgaaaatggtgcaaggcaaggcttggagcaaaactattcacagttttcggatttactatcacaaaagataaagcctattgatgtagaaggttctggatctgacaaagaacaggtgttagcttctttgcaagggggccaggaatctgattggaagatagcatttctctacttctgcaactttggtgtcttatcctccctttttgtgtctatttacattgttctgcatgttttgcgagtgaattcaagttctgttcaaggccttgagttcccaggattagatctgccagattcgctgagtgaaattatcatgggtgggctgttgtttcttcaagtacagaacatacttaagaaaattacatgctttgttcaagcaagaggacaaaaaggtggtgatcatggcgtgaaagcacaaggtgatggatggttgttaacggttgctttaattgagggaatcaaattggctccagtcgatgctactggtttctccgatccttatgtggtatttacttgcaatggcaaaacaaaaacaagttcaatcaagttccagacactggaacctcagtggaacgaaatatttgaatttgacgccatggatgatccaccatcagtgatgagtgtacatgtgtatgattttgatggaccattcgatgaagttacgtcccttggacatgcagaaattaactttgtaaaatcaaacttgtcagcgttagctgatgtatgggttcctcttaaaggtaacttggcccagtcttggcagtccaagttgcatctgagggttttcctgaacaactcaaaggggactggcatggtcactgagtatctgagtaaaatggagaaggaggttggtaagaagatgacattgaggtctcctcggaccaatactgcattccaggagctcttctctctgccagcagaagaatttctcatcagcagttttacctgttacttgaggaggaaattgcctacacagggtcatcttttcttatctccaagaacaattgggttttattcaagcatgtttgggaggaaaacaaaattttactttttatgggaggatattgaagacatacaaggaataccccaatcaatatcatcatggagtccatccgttgtaataactcttcacagaggtagaggcatggatgcaaagcatggtgcaaagagcgtggacaatggaaagcttaagttctgcctccagtcttttgcatcatttagcgtggcccataggacaataatggcattatggaaagcaagatctctgagcacggagcttaaagtacagcttgctgaagaacagtcccaaaataacacccttcagagcgaggatagtgggatttttgttggtatcgaggatgccaagggccttcagatgactgaagttttctcctcaaccatttcaaccaatatggcctcacttatggaggtgttcgaaggaggtcctttggaaatgaaggtaatggagaaagttggatgtcagaaatactcagctacacaatgggaatcagataaacccaatgagtatcaacgacaaattcattataagtttagcaagaagctgtctcccgttggaggagaagtgacaggaacacagcagaaatctcctatgcccaataagaaaggatggattattgaagaggtgatggagcttcaaggagtccttctcggcgacttctttacgcttcatataaagtaccaaattgaggaccttgcacctaagcaaagggcaagcagtgttcaagtttccctcggaatcgagtggtcaaagtccaccaggcatcagaagcgaattgagaagaacgttctttccagttcatccgctcgcctgaaagagatgttcaacctggcatcaagggagctctcacatgccagataggaccacccttgatctctcaccatccctgtccctgtgcataatactgatcagtgactgaacatttcctaacactggcatggcctgtacatacattgcttggctgaagattacacccagacagcaacattgcttggctgaagatacgcccagacagcaactgattctgattgttgtgttggaagaataatgcggaccactacggtcaaaattttggtgaacctatggtgaccatcctccaccagttttgttgtacctggtcaaatgtagctgaaatctgcagaggttgcagaacttggataccacacaaaggtctaccatataccagcataaagcatgaacttgggataggatagctcaatagacagtagcctgttatcaaaaaaagaaagacagtagctgaatgtctggcttgcaagttctctctgttgtattgccccagaaccagataactctgattctttggccacttgttgaacagtacaaatccgagaataaagtgatggaacaata

SEQ ID NO: 3501 - DNA, 4562 bp, Oryza sativa
cccccactctcgccaagattcggggacctaaaacaaacgagaggagtttcaaaggcgacgcgacggcgacatcctcccctccacacgcggcgccgcaccgacgaagaagccgacacgaagcccggaacctggagaggagaggagccgaatcacgagcgccgaaaagggcgacggcgccgccgaatttaatattagggttagcatcatcatcaccaccatcaccatgctagtcgatcccctttgtgcctcctcctccgacctcgctttgcttgcttgcgcgcgcgcgcgcgttgacgaaatctcgcagtccatgtggtgtttgggcttttgactcgatccaaccaagaacgagcgcgactttgcgctgtacggagtagtagtagtatataactcgaatgctgagatttttcttttttttttccgttcgcgtgcgcgcgcgcttactccttcttccttcctgctcgagtcgtcgtcgtcgttgcgtgtgcgtctgatctagtttagctgtgcctccgcgtcattgggtttgtaatgatccgtggaaagtaggcgctgcgctttttgttcttgttacagaagaagaggtggggggggtttgatctggctgcgcgagagttctttgctacttcgatcttggatttgtccggcctgatttcgtttttggattggggggaaggagcgggctgtgattggttcccaccatttcttgctgtttcgtattgggggggatttgttggaggtgaaggttgtgttcttggaggggggtgagttttgagtcgagatgaggctgaatgttcgtgtgatcgaagcccgcaacctgcgggccatggattccaacgggttcagcgatccgtatgtgaagctgcagctcgggaagcagcggttcaagaccaaggtggtgaagaagaacctgaacccggcttgggatcaggagttcagcttctccgtcggcgatgtccgggacgtgctcaagctgtatgtctacgatgaggacatgattggaatcgatgacttcctggggcaagtcaaggtgccactggaggatgttctagctgctgataactactcgctcggcgcgcggtggtttcagcttcttccgaaaggcaaaaccgagaaggcgattgactgtggagaaatttgtgtcgcgatgtctttggaaacagctggtgccacacgctcatggtccgatgatcttgttagtgaactaactgacatacagaaagattattctctatcaagtcagggcacaggaacatccgttgcattatcttatcaagaaagtgaagcttgtcaagaagaaagtgtcaatgggaatttgggcagagctggtttcactgaagaggacaactgtagtcaagatactgacagaaatcaaactactgcagaggacaaatctaatgggattcctgctgcagcttccactgggattgaagtttctaaaacggataagtccaataagccatcgtttgttgatcgtgtctgtcaaatgtttgtcaggaaaagcgatgatgtggtaactacccccttggtaacaactgacaaatcagaagatgttcaagaagcaacaacaggatatgaagctcctgcaactggaagccaaacttatagtgcatctacagacactccttttgatgaactattgaagtactttgaatcaaaacatcaagaagttgaaatgcctgtagatttacaaggaattcttgttgacaagtcgtacattacatcgcctagtgatctgaacaattttctcttctcgccagattcaaattttcgacaaacagtggttgaactccaaggttgttctgatgtcaaaatggaatcctggaaaattgatagtgatggggagtccttgaagagagtgataacttatacaactgcaccatccaaattggttaaagctgttaaagcaacagaagaacagtcttatttgaaagctgatggaaatggatattcagttttattgagtgttagcacccctgatgttccttgtggtacttattttcggacagaaattcttttccgtattttgccaggtcctgaacttgattctgagcaactgacgtcacatttggtaatttcatggcgcataaattttcttcagagtactatgatgaaaggtatgatagaaaatggagcaaaacaagggttgcaacaaaattatgcacagttttctgatttgctgtcacagaagatcaagcctattgatgtagatgctgggtctgacaagggacaagtcttagcgtcattgcagagggggcaggagtctgattggaatatagcatttctgtacttctgcaactttggtgttttatgctctctttttgtaaccatatacattgctgtgcatgttcaactaaggagttcaggtgcacataaggggctcgagtttcctggattagatctgccagattctctcagtgaaattgtcatgggtgggcttttgtttcttcaattacgacacatctataaaaaaatctcatgctttattcaggcaagagagcaaaaagttggtgatcatggtgtcaaggcacaaggtgatggatggttgttaacagttgccttaattgagggaaccaaactggctccagttgatgctactggtttttctgatccttatgtggtatttacttgcaacggtaaaagtaaaacaagctcaatcaagttccaaacactggaacctcagtggaatgacatctttgaatttgatgccatggatgatccaccatcagtgatgaatgtacatgtatatgattttgatggaccatttgacgaagttacctcacttggacatgctgaaattaactttgtaaaatcaaacttgtcagagctagcggatgtatggattcctcttcaaggtaacttggctcagtcctggcagtcaaagttgcacctgagaatttttttgagcaactcaaaaggatccactatggttactgagtatctgagcaaaatggagaaagaggttggcaaaaagatgacactgcggtctcctcgaactaatactgcattccaggagctgttctctctgccagcagaagaatttctcatcagcagttttacctgctgcttgaagcgaaaattgcacacacagggccatctgttcttatctccaagaacaattggattttactcaagcatgtttggccggaaaacaaagtttttctttttatgggaagatattgaagagatacaggcagtacctcaatcaatatcatcatggagtccatcccttgtaataactcttcacaaaggtagaggcatggatgcaaagcatggtgcaaagagcgtcgacaatggaaggctgaagttttgtctgcagtcttttgcatcatttagtgtggccaataggacaatcatggccttatggaaagcaagatctttgagttccgagtacaaaatgcagattgctgaagaacaatcccaaaacaatgatactcttcagagtgaggacagtggaatatttgttggagtcgaggatgcaaagaaccttcagatgaacgaggttttctcctcctcgatttctgccaatatggcctcactaatggaagtgtttggaggaggttcatttgagatgaaaatcatgaataaagttggatgcctaaattattcagccacacagtgggaatcagataagcctgatgaatatcaaagacaaattcattacaagttcagcaggaagttgtctcccattggaggtgaagtgactggaacccagcagaaatctcctatgcccaacaaggcagggtggattattgaagaggtgatggaactacaaggaatccttttcggtgacttcttcacgattcatatacggtatcagatcgaagaccttgctcctaaacagagggcgtgtagtgtacaagtctttcttgggattgaatggtcgaagaccactaggcaccgtaagagaatcgagaagagtgttctttccggttcatctgctcgcttgaaggagatgttcattctagcatcgaagcagctgccacatgccagataagaattctcacctctacagtccctgtgcataatactgaacgactgaacattcctgaccaccagtatgaccccctgtatatatattgcttgattgaagatacggccgattcatttgttagacctcaagagtgggttttgcgtattctgcaatagcttaggcattgtgatcgatttttttttgctttcaatcaggatgccaacccaaagtttgttgtcgtagaccatatatagttgcaattgcatagattgcaggatttagataccataccattcattatactgtgtcaacatgaagtgatggaatataatctgactggatcatgaagttttttggtcctccgtatttttacacttttctcaatgatttatatagagcgacaatgttctgtaactcgtttctttgcaccattttgatctgtacaaaagcagaaataataagtgaatgatgcaacaaagttgtgaggtacacagaaggcgaaacctccaatcgctattgcttgtgttaatctgtcgtatatcttgtcttttctcctattgagtatggtcttaacaaaagcatcaggatg

SEQ ID NO: 3502 - DNA, 1933 bp, Triticum aestivum
gggtggttccctcactccccggaaatggaggccaccactacactcacgctctcctcgtcccctgccgccgcggcccgccgctcgccggcgagggcgaccatctccgacccccacctccggcagtaccccgtccgcacttcccgcctccgcgttgcccagagcctggcctcacgtcccctatcctcgggttggaggcggcgccggagggggagcgggctggtggtgcgggcagagacgttcgggcagctcaccaccgggctcgagtccgcgtggaacaagctgcgtggcgtcgatgtgctgacgaaggaaaccattgtggagccgatgcgggacatcagaagagcacttctggaagcagatgttagtttgccggttgtcagacggttcgtgtcgtctgtgagcgagaaggctttaggttcagatgttatccgaggaatccgaccagagcagcaattagtcaagattgtgcatgatgaacttgttcaactgatgggtggagaggtatcagacttggtgttcgcaaaaactggcccaacggtcatcctactggcaggtctgcaaggtgttgggaagactactgtttgtgcaaaacttgcattctatctgaagaaactggggaagagttgtatgctggtcgctgcagatgtttacaggcctgctgccattgatcaactcactgtactgggtgaacaggtgggtgtgccagtttactcagaaggaaccgcggccaaacctgcagaaataaccaagaatgccgtggaagaggcgaaaagaaataatattgatgcgatcgtagtggatactgctggcagactgcagattgataaaacaatgatggttgaattgaaagaagtaaagaaggcagttaatcctacagagattttgcttgttgttgatgccatgactggccaggaagctgcagcattggtcacaaccttcaatattgaaattggtatatccggtgctatattgactaaattggatggtgattccaggggtggagcagcacttagtgttaaagaggtgtctggaaagcccatcaagtttgtagggcgaggagagcgaatggaggaccttgagcttttctatcccgaccgcatggcacaacgtgttttgggaatgggagatgtcctttcatttgttgaaaaagcacaagaagtcgttcgccaagaggataccatggaactgcagaagaagatcatgagtgcgaaatttgacttcaatgactttttaaagcagacacaaaatgttgccaaaatgggatccatgagccgtgtaatcggaatgattccaggcatgaacaaggttactcctgcacaaatccgggaagctgagaaaagacttgcattcgtagagtcgatgatcaatgcaatgacagccgaggaaagggaaaaacccgagttactggccgaatcacgcgagaggaggattagggtagcagaggagtccgagaagacagaacaagaggtgagccaactggttgcgcagctcttccaaatgcgcgcgcagatgaagaaattgatgggtatgatgcaagggcaagaagcaattgcaggaatgggagatctcatggactcgctcaatgctgacgagaaggcacctcctggcaccgcacggcggaggagacggcggagcgagccgccgcggcagagggagctggatgcagtgggtggcgccagtaggccttgagttgatgtgcactggagctggaatttttcactggaagagttgtggattggcatgtaggtacgggtcctgctgcatggtgtaatatttcctgtacattttggcatgccgagtttaaggttaatgggaaatgtgtttagtggacggaacatgcattttgagagtggagggaattaattacatgtcttaatataaatacatgattaggttttaaaaacatattcgaaatgaaaacattaagcctgcc

SEQ ID NO: 3503 - DNA, 1827 bp, Triticum aestivum
aggccaccactatactcacgctctcctcgtcccctgccgccgcggcccgccgctcgccggcgagggcgaccatctccgacccccacctccggcagtaccccgtccgcacttcccgcctccgcgttgcccagagcctggcctcacgtcccctatcctcgggttggaggcggcgccggagggggagcgggctggtggtgcgggcagagacgttcgggcagctcaccaccgggctcgagtccgcgtggaacaagctgcgtggcgtcgatgtgctgacgaaggaaaccattgtggagccgatgcgggacatcagaagagcacttctggaagcagatgttagtttgccggtcgtcagacggttcgtgtcgtctgtgagcgagaaggctttaggttcagatgttatccgaggaatccgaccagagcagcaattagtcaagattgtgcatgatgaacttgttcaactgatgggtggagaggtatcagacttggtgttcgcaaaaagtggcccaacggtcatcctactggcaggtctgcaaggtgttgggaagactactgtttgtgcaaaacttgcattctatctgaagaaactggggaagagttgtatgctggtcgctgcagatgtttacaggcctgctgccattgatcaactcactgtactgggtgaacaggtgggtgtgccagtttactcagaaggaaccgcggtcaaacctgcagaaataaccaagaatgccgtggaagaggcgaaaagaaataatattgatgcgatcgtagtggatactgctggcagactgcagattgataaaacaatgatggttgaattgaaagaagtaaagaaggcagttaatcctacagagattttgcttgttgttgatgccatgactggccaggaagctgcagcattggtcacaaccttcaatattgaaattggtatatccggtgctatattgactaaattggatggtgattccaggggtggagcagcacttagtgtgaaagaggtgtctggaaagcccatcaagtttgtagggcgaggagagcgaatggaggaccttgagcttttctatcccgaccgcatggcacaacgtgttttgggaatgggagatgtcctttcatttgttgaaaaagcacaagaagtcgttcgccaagaggataccatggaactgcagaagaagatcatgagtgcgaaatttgacttcaatgactttttaaagcagacacaaaatgttgcgaaaatgggatccatgagccgtgtaatcggaatgattccaggcatgaacaaggttactcctgcacaaatccgggaagctgagaaaagacttgcattcgtagagtcgatgatcaatgcaatgacagccgaggaaagggaaaaacccgagttactggccgaatcacgcgagaggaggattagggtagcagaggagtccgagaagacagaacaagaggtgagccaactggttgcgcagctcttccaaatgcgcgcgcagatgaagaaattgatgggtatgatgcaagggcaagaagcaattgcaggaatgggagatctcatggactcgctcaatgctgacgagaaggcacctcctggcaccgcacggcggaggagacggcggagcgagccgccgcggcagagggagctggatgcagtgggtggcgccagtaggccttgagttgatgtgcactggagctggaatttttcactggaagagttgtggattggcatgtagatacgggtcctgctgcatggtgtaatatttcctgtacattttggcataccgactttacaattcgtgggaaatgtgtttagtggacggaacatggagtttgagggtgagg

SEQ ID NO: 3504 - DNA, 1877 bp, Avena sativa
gccacctcatcttatcctccccgacctttccctcccgttcctccccgtgttccgcggaaatggagggcaccgctacactcacgctctcctcgtccgccgccgccgcagctcgccgctcgccagcgaggtcgaccgtatccgctctccacctctttcgcctccccgtccgcactccccgactccgcgctgcccataacctagcatcgcgtgccctctcctcggggtggaggcggcgacggagggggagcgggctggtggtgcgcgcggagacgttcgggcagctcaccaccgggctcgagtccgcgtggaacaagctgcgtggcgtcgatgttctgtccaaggaaagcattgtggagccgatgcgggacatcagaagagcacttctcgaagcagacgtcagtttgcccgtcgtgagacggttcgtgtcatctgtcagcgagaaggctttaggttcagatgttatccggggcatccgaccggagcagcagttagtcaagattgtgcatgatgaacttgttcaactgatgggtggagaagtatcagacctggtgtttgcgaaaactggtccaacagtcatcctactggcaggtctgcaaggtgttgggaagactactgtttgtgcaaaacttgcattctatctcaagaaactgggcaagagttgtatgctggtcgctgcagatgtgtacaggcctgctgccatcgatcaactcaccgtactgggtgaacaggtgggtgtgccagtttactctgaaggaactgcggctaaacctgcagaaataaccaagaatgctgtggaagaggcaaaaagaaataatatcgatgcgattgtagtggatactgctggaagactgcagattgataaagcaatgatggttgaattgaaagaagtaaagaaggcagttaaccctacagagattttgcttgttgttgatgccatgactggccaagaagctgcagcattggtcaccaccttcaatattgaaattggtatatctggtgctatattgactaaattggatggtgattccaggggtggagcagcacttagtgttaaagaggtgtctggaaagcccatcaagtttgttggacgaggagaacggatggaggaccttgagcttttctatcccgaccgcatggcgcaacgtgttttgggaatgggagacgtcctttcatttgttgaaaaagcacaagaagtcgtccgtcaagaggataccatggaattacagaagaagatactgagtgcaaaattcgacttcaatgacttcttgaagcaaacacaaaatgttgccaaaatgggttccatgagccgtgtaattggaatgattccaggcatgaacaaggttactcctgcacaaatccgggaagctgagaaaagacttgcattcgtagagtcgatgatcaatgcgatgacagatgaggaaagggagaagccagagttacttgctgaatcacgcgagaggaggattagggtagctgaggagtccgaaaagacggaacaagaggtgggccaattggttgcccagctcttccaaatgcgcgcacaaatgcagaagttgatgggtatgatgcaagggcaagaagcaattgcaggaatgggagatctggtggactcgcttaatgctgacgaaaaggcacctcctggtacggcacgacggaggagacggcggagcgtgccgccacggcagagggagctggaagcagtgggtggcgcccagtaggccttgagttgatgtgcaccggggcagaaagctctcgctgaaatagttgtggattagaatgtaatgcacggccttggttcagttgatgtagacacatatcctgcatgttgtaagatttcttgcacgtcgtggtggacttcccgggatcggtcggcatta

SEQ ID NO: 3505 - DNA, 2018 bp, Avena sativa
gccacctcatcttatcctccccgacctttccctcccgttcctccccgtgttccgcggaaatggagggcaccgctacactcacgctctcctcgtccgccgccgccgcagctcgccgctcgccagcgaggtcgaccgtatccgctctccacctctttcgcctccccgtccgcactccccgactccgcgctgcccataacctagcatcgcgtgccctctcctcggggtggaggcggcgacggagggggagcgggctggtggtgcgcgcggagacgttcgggcagctcaccaccgggctcgagtccgcgtggaacaagctgcgtggcgtcgatgttctgtccaaggaaagcattgtggagccgatgcgggacatcagaagagcacttctcgaagcagacgtcagtttgcccgtcgtgagacggttcgtgtcatctgtcagcgagaaggctttaggttcagatgttatccggggcatccgaccggagcagcagttagtcaagattgtgcatgatgaacttgttcaactgatgggtggagaagtatcagacctggtgtttgcgaaaactggtccaacagtcatcctactggcaggtctgcaaggtgttgggaagactactgtttgtgcaaaacttgcattctatctcaagaaactgggcaagagttgtatgctggtcgccgcagatgtgtacaggcctgctgccatcgatcaactcaccgtactgggtgaacaggtgggtgtgccagtttactctgaaggaactgcggctaaacctgcagaaataaccaagaatgctgtggaagaggcaaaaagaaataatatcgatgcgattgtagtggatactgctggaagactgcagattgataaagcaatgatggttgaattgaaagaagtaaagaaggcagttaaccctacagagattttgcttgttgttgatgccatgactggccaagaagctgcagcattggtcaccaccttcaatattgaaattggtatatctggtgctatattgactaaattggatggtgattccaggggtggagcagcacttagtgttaaagaggtgtctggaaagcccatcaagtttgttggacgaggagaacggatggaggaccttgagcttttctatcccgaccgcatggcgcaacgtgttttgggaatgggagacgtcctttcatttgttgaaaaagcacaagaagtcgtccgtcaagaggataccatggaattacagaagaagatactgagtgcaaaattcgacttcaatgacttcttgaagcaaacacaaaatgttgccaaaatgggttccatgagccgtgtaattggaatgattccaggcatgaacaaggttactcctgcacaaatccgggaagctgagaaaagacttgcattcgtagagtcgatgatcaatgcgatgacagatgaggaaagggagaagccagagttacttgctgaatcacgcgagaggaggattagggtagctgaggagtccgaaaagacggaacaagaggtgggccaattggttgcccagctcttccaaatgcgcgcacaaatgcagaagttgatgggtatgatgcaagggcaagaagcaattgcaggaatgggagatctggtggactcgcttaatgctgacgaaaaggcacctcctggtacggcacgacggaggagacggcggagcgtgccgccacggcagagggagctggaagcagtgggtggcgcccagtaggccttgagttgatgtgcaccggggcagaaagctctcgctgaaatagttgtggatttagaatgtaatgcacggccttggttcagttgatgtagacacatatcctgcatgctgtaagcatttcgtggtggactgcccgggatgggtcagcatctaaagatgtaattggtgaggggtcaaaggggctctcacagcgattagccgttctgggctgttggatcggtttagtatgatggatctcagccatctattgtttcctctgtgctagtccaagacatgcaacagccgatttctacccgcctg

SEQ ID NO: 3506 - DNA, 1866 bp, Brachypodium distachyon
atggagtccaccgctgccgccgtgctcacgctctcctccccctcctcctcctccgcggccgccgtcgccgcccgccgccgctcgccttccgtctccgccctccacctctcctccccccgcctccgcgcggccgtccgcagccttgcccttcccgcttcatccctgggttggcggcggcggagggggagcgcactggtggtgcgggcggagacgttcgggcagctcaccacggggctcgagtccgcctggaacaagctgcggggcgtcgatgtgctgaccaaggacagcgtcgcggagccgatgagggacatcaggagagcgctcctggaggctgatgttagtctaccggtcgtcagacggttcgtgtcatctgtcagcgagaaggctttgggttcaggcgttatccgaggaatccgaccggaccagcaattagtcaagatcgtgcatgatgaacttgttcaactgatgggtggagaggtgtcggacctggtgtttgcgaaaactggcccgacggttatcttattggcaggtctgcaaggtgttgggaagactactgtttgcgcaaaactcgcgttctatctgaagaaactggggaagagttgtatgctggtcgctgcagatgtctacaggcctgctgccattgatcaactcactgtactgggtgaacaggtgggtgtaccggtttactctgaaggaacaggggccaaacctgcacagataaccaagaatgccgtggaagaggctaaaagaaagaagattgatgcaattgtggtggatactgctggaaggctacagattgataaaactatgatggatgaattgaaagaagtaaagaaggcagttaatcctacagagattttgctcgttgttgatgccatgactggccaagaagctgcagcattagtgaccactttcaatattgagattggtatatctggtgctatattgactaaattggatggtgattcgaggggtggagcagcactaagtgttaaagaggtgtctggaaagcccatcaaatttgttgggagaggagaacgaatggaggaccttgagcttttctatcctgatcgcatggcacagcgtgttttgggaatgggcgatgtactttcatttgttgaaaaagcacaagaagtcgtgcgtcaagaggacaccatagaattacagaagaagatcatgagcgcaaagtttgacttcaatgacttcttgaagcaaacacaaaatgttgccaaaatgggttccatgagccgtgtaattggaatgattccaggcatgaacaaggttactcctgcacaaattcgggaagctgagaaaagacttgcatttgtcgagtcgatgatcaatgcaatgacagccgaggaaagggagaaacctgagttgctggctgaatcacgcgagaggaggattagagtggccgaggagtctgaaaagacagaacaagaggttggccaactggttgcccagctcttccaaatgcgtgcacagatgcagaaattgatgggtatgatgcaaggacaggaagcaattacaggaatgggagatctcatggactcgcttaatgccgatgagaaggcacctcctggcactgcacgacggaggaggaggcgcaatgtgccgccgcggcagagggaaccggaagtagtgggtggccccagtaggccttgagttgatgcgaactggagctgaaagtttccatttgagtagctttggattagcatgtaatgctccaggtcttggttcagttggtgtagatatgaagcttgtgattgtgtaggatttcatgagcattttcgcatgaatgatgttttagccaagaaacattgattttgagaatgtggagaataaatttcagtttgttagttatat

SEQ ID NO: 3507 - DNA, 2001 bp, Brachypodium distachyon
ctccttcttcctctaggctcaaaacgctcaaaccccaccgagagccatccctggccttatcctccccgccggtttccttccacctccgcgggaaatggagtccaccgctgccgccgtgctcacgctctcctccccctcctcctcctccgcggccgccgtcgccgcccgccgccgctcgccttccgtctccgccctccacctctcctccccccgcctccgcgcggccgtccgcagccttgcccttcccgcttcatccctgggttggcggcggcggagggggagcgcactggtggtgcgggcggagacgttcgggcagctcaccacggggctcgagtccgcctggaacaagctgcggggcgtcgatgtgctgaccaaggacagcgtcgcggagccgatgagggacatcaggagagcgctcctggaggctgatgttagtctaccggtcgtcagacggttcgtgtcatctgtcagcgagaaggctttgggttcaggcgttatccgaggaatccgaccggaccagcaattagtcaagatcgtgcatgatgaacttgttcaactgatgggtggagaggtgtcggacctggtgtttgcgaaaactggcccgacggttatcttattggcaggtctgcaaggtgttgggaagactactgtttgcgcaaaactcgcgttctatctgaagaaactggggaagagttgtatgctggtcgctgcagatgtctacaggcctgctgccattgatcaactcactgtactgggtgaacaggtgggtgtaccggtttactctgaaggaacaggggccaaacctgcacagataaccaagaatgccgtggaagaggctaaaagaaagaagattgatgcaattgtggtggatactgctggaaggctacagattgataaaactatgatggatgaattgaaagaagtaaagaaggcagttaatcctacagagattttgctcgttgttgatgccatgactggccaagaagctgcagcattagtgaccactttcaatattgagattggtatatctggtgctatattgactaaattggatggtgattcgaggggtggagcagcactaagtgttaaagaggtgtctggaaagcccatcaaatttgttgggagaggagaacgaatggaggaccttgagcttttctatcctgatcgcatggcacagcgtgttttgggaatgggcgatgtactttcatttgttgaaaaagcacaagaagtcgtgcgtcaagaggacaccatagaattacagaagaagatcatgagcgcaaagtttgacttcaatgacttcttgaagcaaacacaaaatgttgccaaaatgggttccatgagccgtgtaattggaatgattccaggcatgaacaaggttactcctgcacaaattcgggaagctgagaaaagacttgcatttgtcgagtcgatgatcaatgcaatgacagccgaggaaagggagaaacctgagttgctggctgaatcacgcgagaggaggattagagtggccgaggagtctgaaaagacagaacaagaggttggccaactggttgcccagctcttccaaatgcgtgcacagatgcagaaattgatgggtatgatgcaaggacaggaagcaattacaggaatgggagatctcatggactcgcttaatgccgatgagaaggcacctcctggcactgcacgacggaggaggaggcgcaatgtgccgccgcggcagagggaaccggaagtagtgggtggccccagtaggccttgagttgatgcgaactggagctgaaagtttccatttgagtagctttggattagcatgtaatgctccaggtcttggttcagttggtgtagatatgaagcttgtgattgtgtaggatttcatgagcattttcgcatgaatgatgttttagccaagaaacattgattttgagaatgtggagaataaatttcagtttgttagttatataactatacccctcttaataaatcccgtaaatttcttgctcc

SEQ ID NO: 3508 - DNA, 2055 bp, Setaria italica
atggacgccaccgcgctcgcgctccactctcccccggcggcggtggtcacccgctgctccccggagaagctagccttcgcctccctacaccttcgctgctcctccacagggtcgttccacctccgcgcgtcccggaaccccgccttgcgcgccctctctctgggatggaggagacgcaggaggagggggaacgggctggttgtgcgggcggagatgtttgggcagctcaccacgggactcgagtccgcctggaacaagctgcgtggcgtcgacgtgctaacaaaggaaaatatcactgaaccaatgcgggacattagaaggtcacttctggaagcagatgttagtctgccagttgtgagacgttttgtttcatccattagcgaaaaggctttaggtgcagatactatcaaaggagttcgaccagaccagcaactagtgaagattgtgcatgacgaacttgtacaactgatgggtggagaagtatctgatctggtatttgcaaaaagtggcccgacagttatcttactggcaggtctacaaggtgttgggaagactactgtttgtgcaaagcttgcattctatttgaagaaactggggaagagctgtatgctggtcgctgcagatgtttacaggcctgctgccattgatcaacttactatactgggtgaacaggtgggtgtaccagtttactcagaaggaatgggggccaaacctccacagataaccaagaatgctgtggaagaagcgaaaagcaagaatattgatgccattgtggtagatactgctggaagactgcagattgataaagcgatgatggatgaactgaaagaagtgaagaaggcagttaatcctactgaggtactgcttgttgttgatgccatgactggccaagaagctgcagcacttgtcaccaccttcaatattgagattggtatcactggagccatacttactaaactggacggtgattccaggggtggagcagcactaagtgttaaagaggtatctggaaggcccattaaatttgtaggacgcggagaacgattggaggacctcgagcttttctatcctgatcgcatggcgcaacgagttttgggaatgggagatgtactttcatttgtcgaaaaagcacaagaagttatgcggcaagaagaagctgtagaattacagaagaaaattatgagtgcaaagttcgacttcaatgacttcttaaagcaatctcaaaatgttgcaaagatgggttccatgagccgagtaattgggatgattcctggcatgaacaaggttactcctgcacaaataagggaagctgagaaaagacttgcatttgtggagtcaatgattaatgcaatgactgccgaggaaagagagaagcctgagttactagccgaatcacgtgaaaggaggataagagtggctgaggagtctggaaagaccgagcaagaggtgagccaactggttgctcaacttttccaaatgcgtgctcagatgcagaaattgatgggtatggtgcaaggacaagaagcaatagcaggcatgggagacctcatggactcacttaaagctgaagaaaaggcaccacctggcaccgcacggcggaggaggaggaacatcaagccgaagcagaggaacctggatgcagttttgagctagcctgctggctgatgcaccggagttgaaactcgaagttttggctggggaccctcatcatcaattgtggtaatgtgtttggatttagaagagggtgggaaatgttgtcaaattcaacaagttgtgatccttgccaatgcatggttgggcaccgctgtctggactcgctagaatagtagaatgtgactttggcctagtcaaatgcaatgtccagatgaggccctcgttaaatggtggttacaagtccaaaaatgccacaattatgtatgtatgatttgtgaatacagtttatgtatggatcactagtttggtagtttaatgataattgatgaaatactagatatgcttggtatttctcatgcataaatatgtatgtaagcaggataaaaagtttcttttacggta

SEQ ID NO: 3509 - DNA, 2077 bp, Sorghum bicolor
ctctttctcctctctcccctccgccgcggaaaaatggaggccaccgcgcccgcgctctcgctctcgctcgcgctccactcgtccccggccgtcgcccgccgctcggcagggaagccaatcttcgcctacctccaccgtggcgggccttccacggcctcctccgtccacctccgcgcgtcccggacccccgccagctctccggtatggagaagacggaggagggggagcgggctggttgtgcgcgcggagatgttcggccaactcaccaccgggctcgagtccgcctggaacaagctgcgcggcgttgacgtgctaacaaaggaaaatatcgccgaaccaatgcgggacattaggcgagcacttctggaagcagatgttagtttgcccgttgtgagacgatttgtttcatctgttagtgataaggctctaggtgcaaatgctatcagaggagtccggccagaccagcaattagtgaagattgtgcatgacgaacttgtacaactgatgggtggagaagtatcagatctggtattttcaaaaagtggcccgacagttatcttgctcgcaggtctacagggtgttgggaagactactgtttgcgcaaagcttgcattctatttgaagaaactggggaagagctgtatgctggttgctgcagatgtttacaggcctgccgccattgatcaactcactatactgggtaaacaggtgggtgtaccagtttactcggaagggacagaagccaaacctacacaaataaccaagaatgctatggaagaggccaaaagcaagaatattgatgctattgtggtggatactgctggaagactgcagattgataaatcaatgatggatgaattgaaagaagtgaagaaggctgttaatcctacagaagttctgcttgtcgttgatgccatgactggccaagaagctgcagcactagtcaccaccttcaatattgagattggtatcactggtgctatattgactaaattggatggtgactccaggggcggagccgcactaagtgttaaagaggtctctgggaagcccatcaagtttgttgggcgtggggaacgattggaggaccttgagcttttctaccctgatcgcatggcacagcgagtattgggaatgggagatgtactctcatttgttgaaaagacacaagaagttatgcggcaagaagaggctgtagaattacagaaaaagatcatgagtgcaaaattcgacttcaacgacttcttaaaacaatctcaaaatgttgcgaaaatgggttccatgagccgcattattggaatgatgccaggcatgaacaagataactcctgcacaaattcgagaagctgagaaaagacttgcattcgtggagtcaatgatcaatgccatgactgctgaggaaagggagaagccagagttactggctgagtcacgtgagaggaggataagagtagcagaggagtctggaaagactgaacaagaggtgagccaactagttgcccagcttttccaaatgcgtgctcagatgcagaagttgatgagtatggtgcaaggacaagatgcaatagcagggatgggagatctcatggactcgcttaaagctgaagagaaggctcctcctggcaccgcgcggcgcaggagaaggaatagcaagcccaaacaaagggagttggacgcagttctgagctagtgatctagtgtatgtgctgcactggtcttggagttgaaagtttttgactggaagtggctcccgcatgcaagagctagactgaggacaagacctacacactcctcatcgactgtgcaaatgtgtttgggttcaggactgggacatgtatattgtgaaaatgcatagttgggcactgtgccactgccactgtgtagtgtaattgtggttaatcagcgacaaatatttgtacataaagtttactctcatgaggaaagatatgcttgtttaaacgacggagacaattattgatgctagacaatgggattctagtcagaactgtccattctgatgtaaattatactgaattacatcttgttcttgggtcaggtggagattagaaatttcatca

SEQ ID NO: 3510 - DNA, 2184 bp, Sorghum bicolor
ccggaaaccaagcgctcgatcgctcttatccagcaatcgtctcccttctctttctcctctctcccctccgccgcggaaaaatggaggccaccgcgcccgcgctctcgctctcgctcgcgctccactcgtccccggccgtcgcccgccgctcggcagggaagccaatcttcgcctacctccaccgtggcgggccttccacggcctcctccgtccacctccgcgcgtcccggacccccgccagctctccggtatggagaagacggaggagggggagcgggctggttgtgcgcgcggagatgttcggccaactcaccaccgggctcgagtccgcctggaacaagctgcgcggcgttgacgtgctaacaaaggaaaatatcgccgaaccaatgcgggacattaggcgagcacttctggaagcagatgttagtttgcccgttgtgagacgatttgtttcatctgttagtgataaggctctaggtgcaaatgctatcagaggagtccggccagaccagcaattagtgaagattgtgcatgacgaacttgtacaactgatgggtggagaagtatcagatctggtattttcaaaaagtggcccgacagttatcttgctcgcaggtctacagggtgttgggaagactactgtttgcgcaaagcttgcattctatttgaagaaactggggaagagctgtatgctggttgctgcagatgtttacaggcctgccgccattgatcaactcactatactgggtaaacaggtgggtgtaccagtttactcggaagggacagaagccaaacctacacaaataaccaagaatgctatggaagaggccaaaagcaagaatattgatgctattgtggtggatactgctggaagactgcagattgataaatcaatgatggatgaattgaaagaagtgaagaaggctgttaatcctacagaagttctgcttgtcgttgatgccatgactggccaagaagctgcagcactagtcaccaccttcaatattgagattggtatcactggtgctatattgactaaattggatggtgactccaggggcggagccgcactaagtgttaaagaggtctctgggaagcccatcaagtttgttgggcgtggggaacgattggaggaccttgagcttttctaccctgatcgcatggcacagcgagtattgggaatgggagatgtactctcatttgttgaaaagacacaagaagttatgcggcaagaagaggctgtagaattacagaaaaagatcatgagtgcaaaattcgacttcaacgacttcttaaaacaatctcaaaatgttgcgaaaatgggttccatgagccgcattattggaatgatgccaggcatgaacaagataactcctgcacaaattcgagaagctgagaaaagacttgcattcgtggagtcaatgatcaatgccatgactgctgaggaaagggagaagccagagttactggctgagtcacgtgagaggaggataagagtagcagaggagtctggaaagactgaacaagaggtgagccaactagttgcccagcttttccaaatgcgtgctcagatgcagaagttgatgagtatggtgcaaggacaagatgcaatagcagggatgggagatctcatggactcgcttaaagctgaagagaaggctcctcctggcaccgcgcggcgcaggagaaggaatagcaagcccaaacaaagggagttggacgcagttctgagctagtgatctagtgtatgtgctgcactggtcttggagttgaaagtttttgactggaagtggctcccgcatgcaagagctagactgaggacaagacctacacactcctcatcgactgtgcaaatgtgtttgggttcaggactgggacatgtatattgtgaaaatgcatagttgggcactgtgccactgccactgtgtagtgtaattgtggttaatcagcgacaaatatttgtacataaagtttactctcatgaggaaagatatgcttgtttaaacgacggagacaattattgatgctagacaatgggattctagtcagaactgtccattctgatgtaaattatactgaattacatcttgttcttgggtcaggtggagattagaaatttcatcataaaaaaagactttgtaatataatctatctatgtttaatataatataattttggtagaaa

SEQ ID NO: 3511 - DNA, 2247 bp, Zea mays
gtctgctccagcctccaggcattcggttccggctcctgcttccctctcccttctccggttctccccctccgccgcggagatggaggccaccgcgctcgcgtcccactcgtccccgttcgccgtccaccgctcgacagggaagccagccttcgcctacccccaccgtggagggccctcgatggtctcctctgtccacctccgcacgtcccggacccccgcccgctctgcggcatggagaaggcggaggagggggaccgggctggttgtgcgcgcggagatgttcggccagctcaccaccggcctcgagtccgcctggaacaagctgcgcggcgttggcgtgctaacaaaggaaaatattgccgaaccaatgcgggacattagacgagcacttctggaagcagatgttagtttgcctgttgtgagacggtttgtttcatctgttagtgataaggctttaggtgcaaatgctatcagaggagtccgaccagaccagcaattagtgaagattgtgcatgacgaactggtacaactgatgggtggagaggtatcggatattgtatttgcaaaaagtggcccgacagttatcttgcttgcaggtctacagggtgttgggaagactactgtctgtgcaaagcttgcgttctatttgaagaaactggggaagagttgtatgctggttgctgcagacatttacaggcctgcagccattgatcaactcactatactgggtaaacaggtgggtgtaccagtttactcagaaggaacagaagccaaacctacacaaataactaagaatgctatggaagaggcaaaaagcaagaatattgatgctattgtggtggatactgctggaaggctgcagattgatagatcaatgatggatgaattgaaagaagtgaagaaggctgttaatcctacagaagttctgcttgtcgttgatgccatgactggccaagaagcagcagcactagtcaccaccttcaatattgagattggtataactggtgcaatactgactaaattggatggtgactccaggggcggagccgcactaagcgttaaagaggtctctgggaggcccataaaatttgttgggcgtggggagcgattagaggaccttgagcttttctaccctgatcgcatggcacagcgagttctgggaatgggagacgtgctttcatttgtcgaaaagacacaagaagtgatgaggcaagaagaagctatagaattacagaagaagatcatgagtgcaaaattcgacttcaacgatttcttaaaacaatctcaaaacgttgcgaaaatgggttccatgagccgcattattggaatgatgccaggcatgaacaagataactcccgcacaaatccgagaagctgagaaaagacttgcattcgtggagtcaatgatcaatgccatgactgctgaggaaagggagaagccagagttactggctgaatcacgtgagaggaggataagagtggctgaggagtctggaaagactgaacaagaggtgagtcaattggttgcccagcttttccaaatgcgtgctcagatgcagaagttgatgggtatggtgcaaggacaagaagcaatagctggcatgggagatctcatggactcgcttaaatctgaagagaaggcacctcctggcaccgcgcggcggaagagaaggaataacacgtctaagcagagggacctggacgcagtgctgagctagtgagtagtggcctagtgtgctgtattatgaaaatgcataggtgggcactgaacctgtgtaattgcggttaattcggcacacattttttttgtacataacgtttagtcccatgagggaagatatgttggtcgctcttgaaattggagtaggttgtcatgaggacatatctagtgcacatagaagattggtgtacatgatgtacatattaaattaccaccactcattttagatttaacgtctctagttgatcattcaatttacaaataacacatttcactactacacaccaccacgttggatgatgtttttagcaaaatataccaaacaactagagacgttaaatctaaaataagtggtgatgatttaatatgtgcatcatgtgcatcaatctttcatgtgcattagatatgttctctgttgtcatacagggcccagaagaactcaggtcttgtaccggaggcctggagcccagtatctttcagttgcaacacttgatgtaaaaaaataagaaaaaacattttacctttctt

SEQ ID NO: 3512 - DNA, 1827 bp, Secale cereale
gactatcgctcatcaatcaaacagaaaaaaagctatccctagctaactcggtgggatacccataatcaccctagcaccccctctaaccaaacacatcctggttgtccaccacatgctgtactagctagtactcgctggttctgagaaatttactcaaaatctttttagaagctcgcaaattgatttgtgattctgtgaagattcaggtgatggtgcatcgcttagaattccggcatttacatgtcgacggtgttcatcgtcatctttctaatctaaagaaagttcctctctcccttattcatcgtcactgatttctcccctcggacgctcccttcccactcccatttgttgttctcttccccgcaatttcccgggccgacggtgaacggggcgggggcgggggcggggtgcataaagcaaagggcaactgcctactggcactggattagcgtcgattaatttcctcttttgttggttcctctacttccgttcgcaagatcggtctgaggcgcggcagctaatctcgtcggaaaatcgagggttcaactgaagccaatatgcccaacgtcaagtccgccggtggtgctggtgccggtgccatccctgccggatcctccggcggcgacggcgaggtggaggctgggttcgccaagctgcagggtgaggatttcgagtactacatgcagacctactccatcatgctgggccgcaacagcaagaaatccacggtggatgtggatctctccagcctcggtggggggatgaacatctcgcgccaccacgcgcggatattctacgacttccagcgccgccgcttcgcgctcgacgtcatcggcaagaacggctgcctggttgagggcgtcctgcacctccctgggaaccctcctgttaagcttgactcgcaggacctccttcagatcggagacaagaagttttatttcctcttgcccacgaggtctatctttgcctcgttcgctgctcgacagtcccctgttattcctccacagatcccgccgccagcgtatgtgcggccagggcaccctcgtgtgtccgatttccatgaccgcttctctgaaggtgattatggccgggacagtgatgacattggtaatggtgttggtgaaggtggaatgaagggcaagctgaagagaaccaagaagtctcctggagatttggacatctatggtgggcacagaatcaatgttgaagcaataggaacactgggagaagacaatagatcagaaataagatcaaggggtgacaaggatgtggacaaccagcaccttcaaatggaagagaaggaagtcgtgtcatctgttgcgactgtgttatctgacctctgtggccctggagaatggatgcctatgaaaacactccatacagagctgatggaccagtttggcaacgtgtggcaccacagcagggtgcggaagtacctgacggcggacgactggtcgccgattgaagccaaggggaggccatggtacgggctgctggggctgctcaggaagtacccggagcacttcgtcataaacacgaaatccaagggcagggcgatctcggagttcgtctcgctggtttccttgctctcctgaccagcgaggtgaggctgtctctaaagctttgcttaggtttttgtccgtcagtcagtcggttcgttcgtgtctggaaggttgagtggcgtcctgatttgtctctggagttttgcatcagttaaatgaacattgctgtaatgtactgtactcctggctgcttttccccgtgtttttacctatagctctgtagtgtcgagaatgttatattcggaaacaggacttataagtagtt

SEQ ID NO: 3513 - DNA, 1819 bp, Triticum aestivum
actttttctcatgagcggacaaagataactccatcctcatggttgtccaccaaacactagctagtactcgctggtcgtgagaaatttactcaaattccttttagaagctcgcaaattgaattagtatcgggccttgatctgtgaagattcaggtgatggtgcaccgcttagaattccggcatctccatgtcgacggtgttcatcatcatcttgtaaagaaagttcccctctcccttattcatcgtcactgatttctcccctcggacgccctcttccccactcccactcgttgttcttctcttccccgcaatttcccgggccgacggcgacgggggcgggggcggggcgcataaagcaaagggcaactgcctactggcactggattagcgccgattaatttcctcttttgttggttcctctacttccgcgcgcaagatcgatctgaggcgcggcagctaatctcgtcggaaaatcgagggtccaactgaagccaatatgcccaacgtcaagtccgccgctggtgccggtgccatccctgccggatcctccggcggcgacggcgaggtggaggcagggttcgccaagctgcagggtgaggatttcgagtactacatgcagacctactccatcatgctgggccgcaacagcaagaaatccacggtggatgtggatctctccagccttggcggggggatgaacatctcgcgccaccacgcgcggatattctacgacttccagcgccgccgcttcgcgctcgacgtcatcggcaagaacggctgcctggttgagggtgtcctgcacctccctgggaaccctcctgttaagcttgactcgcaggacctccttcagattggagacaagaagttttatttcctcttgcccacgaggtctatctttgcctcgttcgctgctcggcaagcccctgttattcctccacagatcccgccgccagcttatgcgcggccagggcaccctcgtgtgtccgatttccatgaccgcttctctgaaggtgattatggccgggacagtgatgacattgggaatggtgttggggaaggtggaatgaagggcaagctgaagagaaccaagaagtctcccggagatttggacatctatggtgggcacagaatcaatgttgaagcaataggaacattgggtgaagacaacagatcagaaataagatcaaggggtgacaaggatgtggacaaccagcaccttcaaacggaagagaaggaagtcgtgtcatctgttgcgactgtgttatctgacctctgtggccccggagaatggatgcctatgaaaacactccatacagagcttatggaccagtttggcaacgtgtggcaccacagcagggtgcggaagtacctgacggcggacgactggtcggtgatagaagccaaggggaggccatggtacgggctgctggggctgctcaggaagtacccggagcacttcgtcatcaacacgaaatccaagggcagggcgatctcggagttcgtctcgctggtttccttgctctcctgaccagcgaggtgaggctgtctccaaagctttgcttgggttttgttctgcatccttgccgtcgccgtcagtcggtcggttcgttcgtgtctggaaggtcgagtggcgtcctgatttgcctctgcagttttgcatcagttaaatgaactttgctgtaatgtactgtacacctggctggtttcttccgtgtttttacctatagcaatgtagtgtcgagaatgttatgcggaaacaggacttttaagtagtttgcagttcgctcctcttcaggtttaatgttgcctctttgaactac

SEQ ID NO: 3514 - DNA, 1397 bp, Pseudoroegneria spicata
ataattttctgttccatggtccgattaggttcctctacttccgcgcgcaagatcggtctgaggcgcggcagctaatcctgtcgaaaaatcgagggctcaactgaagccgatatgcctaacgtcaaatccgccgctggtgctggcgccggcgccatccctgccggatcctccggcggcgacggggaagtggaggcagggttcgccaagctgcagggtgaggatttcgagtactacatgcagacctactccatcatgctgggccgcaacagcaagaaatccacggtggatgtggatctctccagccttggtggggggatgaacatctcgcgccaccacgcccggatattctacgacttccagcgccgccgcttcgcgctcgacgtcatcggcaagaacggctgcctggtcgagggtgtcctgcacctccccgggaaccctcctgtcaagcttgactcgcaggacctccttcagattggagacaagaagttttatttcctcttgcccacgaggtctatctttgcctcgttcgccgctcgtcaatcccctgttattcctccacagatcccgccgccagcgtatgcgcggccagggcaccctcgtgtgtccgatttccatgaccgtttctctgaaggcgattatggtcgggacagtgatgacattgggaatggtgttggtgaaggtggaatgaagggcaagctgaagagaaccaagaagtctcccggagatttggacatctatggtgggcacagaatcaatgttgaagcaataggaacattgggtgaagacaatagatcagaaataagatcaaggggtgacaaggatgtggacaaccagcaccttcaaatggaagagaaggaagtcgtgtcatctgttgcgactgtgttatctgacctctgtggccccggagaatggatgcctatgaaaacactccatacagagctcatggaccagtttggcaacgtgtggcaccacaccagggtgcggaagtacctgacggcggacgactggtcgccgatagaagccaaggggaggccatggtacgggctgctggggctgctcaggaagtacccggagcacttcgtcatcaacacgaaatccaagggcagggcgatctcggagttcgtctcgctggtttccttgctctcctagagggaatcacggaccagcgaggcgaggctgtctctaaagctttgcttgcgttttgttccgcatcctgctgccgtcagccggtcggttcgttcgtgtctggaaggtcgagtggtgttctgagttttgtctctgcagtttgcgtcagttaaatgaaccttgctgtaatgtactgtacccccgtgtttttacctctagctctgtggtgtcgagaatgttatgcggaaacaggacttctccacttgttttta

SEQ ID NO: 3515 - DNA, 1785 bp, Triticum aestivum
actttttctcatgagcggacaaagataactccatcctcatggttgtccaccaaacactagctattatactcgctggttctgagaaatttactcaaattccttttagaagctcacaaattgaattagtatcgggccttgatctgtgtagattcaggtgatggtgcaccgcttagaattccggcatctccatgtcgacggtgttcatcgtcatcttgtaaagaaagttctcctctcccttattcatcgtcactgatttctcccctcggacgcccttttccccactcccactcgttgttcttctcttccccgcaatttcccgggccgacggcgacgggggcgggggcggggcgcataaagcaaagggcaactgcctactggcactggattagcgccgattaatttcctcttttgttggttcctctacttccgcgcgcaagatcgatctgaggcgcggcagctaatctcgtcggaaaatcgagggtccaactgaagccaatatgcccaacgtcaagtccgccggtggtgctggtgccagtgccatccctgccggcggcgacggcgaggtggaggctgggttcgccaagctgcagggtgaggatttcgagtactacatgcagacctactccatcatgctgggccgcaacagcaagaaatccacggtggacgtggatctctccagccttggcggggggatgaacatctcgcgccaccacgcgcggatattctacgacttccagcgccgccgcttcgcgctcgacgtcatcggcaagaacggctgcctggttgagggtgtcctgcacctccctgggaaccctcctgtcaagcttgactcgcaggacctccttcagattggagacaagaagttttatttcctcttgcccacgaggtctatctttgcctcgttcgctgctcggcaagcccctgttattcctccacagatcccgccgccagcttatgcgcggccagggcaccctcgtgtgtccgatttccatgaccgcttctctgaaggtgattatggccgggacagtgatgacattgggaatggtgttggggaaggtggaatgaagggcaagctgaagagaaccaagaagtctcccggagatttggacatctatggtgggcacagaatcaatgttgaagcaataggaacattgggtgaagacaacagatcagaaataagatcaaggggtgacaaggatgtggacaaccagcaccttcaaacggaagagaaggaagtcgtgtcatctgttgcgactgtgttatctgacctctgtggccccggagaatggatgcctatgaaaacactccatacagagcttatggaccagtttggcaacgtgtggcaccacagcagggtgcggaagtacctgacggcggacgactggtcggtgatagaagccaaggggaggccatggtacgggctgctggggctgctcaggaagtacccggagcacttcgtcatcaacacgaaatccaagggcagggcgatctcggagttcgtctcgctggtttccttgctctcctgaccagcgaggtgaggctgtctccaaagctttgcttgggttttgttctgcatccttgccgtcgccgtcagtcggtcggttcgttcgtgtctggaaggtcgagtggcgtcctgatttgcctctgcagttttgcatcagttaaatgaactttgctgtaatgtactgtacacctggctggtttcttccgtgtttttacctatagctctgtagtgtcgagaatgttatgcggaaacaggacttataagtacgtagttttcagttc

SEQ ID NO: 3516 - DNA, 1893 bp, Avena sativa
ggggatggagggagtatatcgtacacttttttttggcatcagtaccgtatgcacgtggttatccggtacttctgtgctagtaacgcttttctgctcccgacggggcaaaagaccatctccatggtcgtccagtgtccacgaaatatcgctccctgttccaagagatctgcccagattttatttttttgcgagcactctgatcagcgaattaggcgatgttgtacaaattaaaattccggaatttccatgtcgctagtgttcttcctcatcatcatctaaagaagtccgcccgtctcctttactcttcctcgctgatttctctcctcaaacacgcgcttcctcctttactagttgttcttttcttcctcggaatttcccgggccgacggcgcataaagcaaggactactaccaactggcacatgactatccttgattaattccctcttttgttggggggtaaggaaaccctagctcacgcgtgcgctgttccaggagttgattggtccaactgaatcccgtgtgcctcacgtgaagtccgccgccggcgctggtgcgatgcctcccggatcctcggctggagatgccgaagtggaggcagggttcgcgaagctgcagggcgaggatttcgagtactacatgcagacctactcgatcatgctgggccgcaacagcaagaaatccacagtcgatgtggatctctccagccttggtggggggatgaacatctcgcgccaccacgcgcggattttctacgacttccagcgccgccgcttcgccctcgatgtcatcggcaagaacggctgccttgtcgagggcgtcctgcacctccctgggaaccctcctgtcaagcttgactcgcaggaccttcttcagatcggagacaagaagttctacttcctcctgcccacgcgctccatctttgcctctttcgccgccgccgccgctgctgctcaacaagcccctgttatcccgccacagatgccgccgccgtcgtacgtgcggccaggccacccccgtgcgtccgagttccatgaccgcttctctgaaggtgattatggccgggacagcggtgaaattgggaatggtatcagtgaaagtggaatgaagggcaagctgaagagaaccaagaagcctcctgtagatctggagatgtatggtgggcatagaatcaatgttgaaccgataggaacacttggtgaagacaatagatcagaaataagaatgagggttgacagggatatggacaatcagcaaatacttcaaacagaagagaaggaagttgtttcatctgttgcgactgtgttatctgacctctgtggtcctggagaatggatgcctatgagaaagctacatacagagcttctggaccagtttggcaacgtgtggcaccacaccagggtgcggaagtacctgacggcggaggactggtcgccgatcgaagccaaggggaggccatggtttgggctgctggggctgctcaggaagtacccagagcactttgtcatcaacaccaagtgcaagggcagggcgatctcggagttcgtctcgctggtttccctgctctcctagaggcaatcacagagcagagcgaggccgtccgtctatcaggctgctgcttgcgtttcgtcccgtgtctcgccgtcggttagtctgtccgtccgtctgtccgtgtccagaaggtggagccgtgacctgttttgtctctgcagtttgcaacagttaaaatgaaccttgctgtgctgtgctgtatcctgagttacctctggctccctagtgtcggaaatgttatgtggaatcagaacttctagtagcccttcagttcgtgtctcttcagactagtgccatgaatgttatatctggacacagaactatcaaaagtggtactgtttgaa

SEQ ID NO: 3517 - DNA, 1894 bp, Avena sativa
ggggatggagggagtatatcgtacacttttttttggcatcagtaccgtatgcacgtggttatccggtacttctgtgctagtaacgcttttctgctcccgacggggcaaaagaccatctccatggtcgtccagtgtccacgaaatatcgctccctgttccaagagatctgcccagattttatttttttgcgagcactctgatcagcgaattaggcgatgttgtacaaattaaaattccggaatttccatgtcgctagtgttcttcctcatcatcatctaaagaagtccgcccgtctcctttactcttcctcgctgatttctctcctcaaacacgcgcttcctcctttactagttgttcttttcttcctcggaatttcccgggccgacggcgcataaagcaaggactactaccaactggcacatgactatccttgattaattccctcttttgttggggggtaaggaaaccctagctcacgcgtgcgctgttccaggagttgattggtccaactgaatcccgtgtgcctcacgtgaagtccgccgccggcgctggtgcgatgcctcccggatcctcggctggagatgccgaagtggaggcagggttcgcgaagctgcagggcgaggatttcgagtactacatgcagacctactcgatcatgctgggccgcaacagcaagaaatccacagtcgatgtggatctctccagccttggtggggggatgaacatctcgcgccaccacgcgcggattttctacgacttccagcgccgccgcttcgccctcgatgtcatcggcaagaacggctgccttgtcgagggcgtcctgcacctccctgggaaccctcctgtcaagcttgactcgcaggaccttcttcagatcggagacaagaagttctacttcctcctgcccacgcgctccatctttgcctctttcgccgccgccgccgctgctgctcaacaagcccctgttatcccgccacagatgccgccgccgtcgtacgtgcggccaggccacccccgtgcgtccgagttccatgaccgcttctctgaaggtgattatggccgggacagcggtgaaattgggaatggtatcagtgaaagtggaatgaagggcaagctgaagagaaccaagaagcctcctgtagatctggagatgtatggtgggcatagaatcaatgttgaaccgataggaacacttggtgaagacaatagatcagaaataagaatgagggttgacagggatatggacaatcagcaaatacttcaaacagaagagaaggaagttgtttcatctgttgcgactgtgttatctgacctctgtggtcctggagaatggatgcctatgagaaagctacatacagagcttctggaccagtttggcaacgtgtggcaccacaccagggtgcggaagtacctgacggcggaggactggtcgccgatcgaagccaaggggaggccatggtttgggctgctggggctgctcaggaagtacccagagcactttgtcatcaacaccaagtgcaagggcagggcgatctcggagttcgtctcgctggtttccctgctctcctagaggcaatcacagagcagagcgaggccgtccgtctatcaggctgctgcttgcgtttcgtcccgtgtctcgccgtcggttagtctgtccgtccgtctgtccgtgtccagaaggtggagccgtgacctgttttgtctctgcagtttgcaacagttaaaatgaaccttgctgtgctgtgctgtatcctgagttacctctggctccctagtgtcggaaatgttatgtggaatcagaacttctagtagcccttcagttcgtgtctcttcagactagtgccatgaatgttatatctggacacagaactatcaaaagtggtactgtttgaac

SEQ ID NO: 3518 - DNA, 1725 bp, Setaria italica
cctttccctattttagcatcacttggcttctcgcccttctcgccttcttctcctgtgaagcactctgtcaagtgatgcgcggctgctggccctttcggccgttcccccaaccctagatcgatcgatctctctgcccgcccctccccgtcagcccaaccgccggaggctcgcagctcccctccgcccgaactcagcacctcctcttcctcccttccacccgacggatccgtccagcgcaggcccgcagctcccctccgacccgacggcgcaggaccctgccgtggtccgattaggtggttcttcttctctccagctcccgagatcaaggttcccaagctgcggctgcatttgatttcccaacaattcggtggttcctccggcccccatgccccacgtcaaggccgtccctgctaccctgggtgcgggcggaatgcccggtgggtcttcgggcgctgatggtgaggtggatgcggggtttgccaagctccagggcgaagatttcgagtactacatgcagacgtactccatcatgctgggccgcaacagcaagaaatcgacggtggatgtggatctctcgagcctcggcgggggtatgaacatctcccgccaccacgcccggatattctacgatttccagcgacgccggttcgccctcgatgttatcggcaagaacggatgccttgttgagggtgttctgcacctccctggaaacccgcctgttaagcttgattcgcaggatctgctgcagattggggacaagaagttttacttcctgctcccgacgcggtccatctttgcgtcggctgctgctgctcggcatgcaccaattattccacagcagctccctccaccatcgtacgcacgtccagggcgccctcgtttgtctgattttcacgaccgctcctttgaaggtgattatggtcgggaggtcgatgacattgggaatggaatcagtgaaagtggggtgagggggaagttgataaagagaaacaagaagtcgtccggagaattggatatctacggtgggcaccgaatcaacgtggaagcaataggaacactaggtgaagacagtagatcagaaataagatcaaggggtgacagggatatggacaaccaacaaatccttcaagcagaagagaaagaggtcgtttcatctgttgccacagtgttatctgacctctgcggtcctggagaatggatgcccatgacaaaactccacaccgagctccttgaacagtttggcaacgtgtggcatcccagcagggtccgaaagtacctaacaacagacgactggtcaccaacggagacgaagggcaggccttggtttggccttctggcgctgctcagaaagtacccggagcatttcgtcatcaacacaagatcgaaaggcagagtgacctcggagtttgtctcgctggtctccttgctctcctagagggaaaactataggggacgagatggcctgccgaggaaataacaggcacaccggctccatttgcagtccgctttcagaagggtcggaggtgtaccgtgtctcatttgcctcgtctcttttgaaccctgttgtactgtatctcgtgtgtttcaacagctgtattggtctgtaccatgatcacctctgtactgttgacatgtatatggaagcatcaagcatgagttttaaccaatgctagcaactcagcagttcggttcggtatcctgtaagtatatccagtgtcttgtttg

SEQ ID NO: 3519 - DNA, 1543 bp, Setaria italica
cgcaggaccctgccgtggtccgattaggtggttcttcttctccagctcccgagatcaaggtacccaagctgcggctgcatttgatttcccaacaattcggtggttcctccggcccccatgccccacgtcaaggccgtccctgctaccctgggtgcgggcggaatgcccggtgggtcttcgggcgctgatggtgaggtggatgcggggtttgccaagctccagggcgaagatttcgaatactacatgcagacgtactccatcatgctgggccgcaacagcaagaaatcgacggtggatgtggatctctcgagcctcggcgggggtatgaacatctcccgccaccacgcccggatattctacgatttccagcgacgccggttcgccctcgatgttatcggcaagaacggatgccttgttgagggtgttctgcacctccctggaaacccgcctgttaagcttgattcgcaggatctgctgcagattggggacaagaagttttacttcctgctcccgacgcggtccatctttgcgtcggctgctgctgctcggcatgcaccaattattccacagcagctccctccaccatcgtatgcacgaccggggcgccctcgtttgtctgattttcacgaccgctcctttgaaggtgattatggtcgggaggtcgatgacattgggaatggaatcagtgaaagtggggtgagggggaagttgataaagagaaacaagaagtcgtccggagaattggatatctacggtgggcaccgaatcaacgtggaagcaataggaacactaggtgaagacagtagatcagaaataagatcaaggggtgacagggatatggacaaccaacaaatccttcaagcagaagagaaagaggtcgtttcatctgttgccacagtgttatctgacctctgcggtcctggagaatggatgcctatgacaaaactccacaccgagctccttgaacagtttggcaacgtgtggcatcccagcagggtccgaaagtacctaacaacagacgactggtcaccaacggagacgaagggcaggccttggtttggccttctggcgctgctcagaaagtacccggagcatttcgtcatcaacacaagatcgaaaggcagagtgacctcggagtttgtctcgctggtctccttgctctcctagagggaaaactataggggacgagatggcctgctgaggaaataacaggcacaccggctccatttgcagtctgctttcagaagggtcggaggtgtaccgtgtctcatttgcctcgtctcttttgaaccctgttgtactgtatctcgtgtgtttcaacagctgtattggtctgtaccatgatcacctctgtactgttgacatgtatatggaagcatcaagcatgagttttaaccaatgctagcaactcagcagttcggttcggtatcctgtaagtatatccagtgtcttgtttggctgttcatgcactgatttctttttttatttcttgcacaattttttgtttatcctcaacttttgcatgatgatagaagatggcgag

SEQ ID NO: 3520 - DNA, 1593 bp, Saccharum officinarum
cgtcgacggggccaggcgaccggacgcaccccgccgacctattcgcagcttcccgggtttcgtcggatcctttgccggcgacgagcacccactgcatcagaccgtcccttgggcgccggtgcaatgcccggcgggtcttcaggtgcagatggtgaagtggatgcaggatttgcgaagctccagggagaggatttcgagtactacatgcagacatactccatcatgctgggacgcaacagcaagaaatcgacagtggatgtggatctctcgagcctcggtgggggtatgaacatctcccgccaccacgcccggatattctacgacttccagcgccgcaggttcgcgctcgacgtcattggcaagaacgggtgtcttgttgagggtgtcctgcaccttccaggaaacccccctgtcaagcttgattcgcaggatctgctgcagattggggacaagaagttctactttctactgccaacgcggtccatcttcgcttcagctgctgctgctcggcatgctcctattattccaccgcagcttcctccaccatcttatgcacatgcgcggccaggccgccctcgtttgtcagagtttcatgatcgctccttcgaaggtgattatggtcgagaggttgatgagattgggaatggtatcaatgaaactgtgatgaggggaaagctgataaagagaaacaagaagtcttctgtagacttggatatctatggtggccatagaatcaatgtggaaccaataggaacactaggtgaagacagtagatcagaaataagatcaaggggtgacagggatattgacaaccaacaagcccttcaagcagaagagaaggatgttgtgtcatctgttgccacagtgttatctgacctctgcggccctggagaatggatgcccatggcaaaactccatacagagcttcttgatcagtttggcaacgtgtggcaccccagcagggtccgaaagtacttaacacaagacgactggtcaccaacagagacgaagggcagaccttggtttggccttttggcactgctcagaaagtacccagagcattttgtcatcaacacaagatcaaaaggtagaatgacctcagagttcgtttcgctggtctccttgctctcctagagggaactagggaccgagagggcatgttgaggaagtaataggcacactggctccctcaatttccagtccgtgttcagaagggtcggaggtgtactggctctcatttgccccttgctgtttctgcagctgttttggaccctgctgtactgtatctcgtgtgtttgagcagctgtactggtccgtgaccatctctgtaatgtcggcagcagtatatggaagcatgagttttaagtcttaacctatgctagcaacttaacaacagctcgattaccgtatccagtatgtatatccaatgtcatgtttgaaatacttgtaaactaactgttgtctggtgtcctcttctcagcagttttccgacttttgtaaactatcctagcatccccggttgaaacgagtttctcgccggagccagtagaaatgtagtagaaaaaaattgtttgttacaggcttgagctaggt

SEQ ID NO: 3521 - DNA, 1726 bp, Oryza sativa
tttttttttaagacagaggtagtaaaacataatccgattgtcctgtgagtgttccccttctccatctacctgtctgtcccccaattccccacttccccaacccaggcgatcctccgccgccgccgccggcggccggccgcctccctccgccgccacgcagccgcgccccctccgccggacactccagaccccggtgagcctcccctcctccgccggccgccttgcccgcgcccgaacgccacgccaagctcaggatcatttcgtcgatttcgtggattggatggccaaccttggcggtggcgcgatgccggcgggatcctcgggcggcgacggcgaggtggaggccgggttcgcgaagctccagggggaggatttcgagtactacatgcagacctactcgatcatgctggggcgcaacagcaagaagtcgacggtggacgtggacctctccagcctcggcggcgggatgaacatctcgcgccaccacgcccggatcttctacgacttccagcgccgccgcttcgcgctcgacgtgatcggcaagaacgggtgcctcgtcgagggcgtcctccacctccccgggaaccaccccgtgaagctggattcccaggatctgctccagattggggacaagaagttctacttcttgctgcccacccggtccatcttcgcgtccgccgccgctgctcggcatccgcctatcatcccgcagcagatgcctccaccatcctatgtgcggacaggccgccctcgtctgtctgaatttcatgacaggtcctttgagggtgactatggccgggagggtgatgagattgggaatggtatcagtgagagtggtgggatgagggggaagttgattaagaggaacaagaagctgtccgcggagtcggagatgtatggcgggcaccggatcaatgttgaagcaatcgggacactcggtgaagacagcagatcagaaataagatcaaggggtgacagggatatggataaccagcacatcctgcaagcagaagaaaaggatgtagtgtcatctgttgcaacagtgttatctgacctctgtggtcctggagaatggatgcctatggcaaaactccacacagagcttcttgaacagtttggcaatgtgtggcaccacagcagggtccggaagtacctttcaccagaggactggtcgccaactgaaacaaaaggtaggccatggtacggtctccttgcattgctgaggaagtatccggaacattttgtcatcaacacaagatcgaaaggcagggtaacatcggagttcgtctcgctggtctctttgctctcctagaggtaacctggaccgtggcataatctgttctcaccgttctggccctgctgaagaatgattcgcatcttcaatcgctgaactgaattgaagcctgttgtactttactggcctgtgtttacccttagctatgtaatccggagaaatacatagggaaacaggattttaacttatgttagtagctgggttcatgtctcactgttgtgtggggtgagaatgtatgtctagtgttgttgagactggaagcgcgaaagttcacagcattttgctgattggaagattttgaaactttgccgtactcgaagaagtgtagttgttcatccttcatatatatgttctgaaatctacatgctgcagggtgaaaccttggacagaagaaaactgaatgagtgctctgcaaatgtttggtcatggatg

SEQ ID NO: 3522 - DNA, 1607 bp, Oryza sativa
gattgtcctgtgagtgttccccttctccatctacctgtctgtcccccaattccccacttccccaacccaggcgatcctccgccgccgccgccggcggccggccgcctccctccgccgccacgcagccgcgccccctccgccggacactccagaccccggtgagcctcccctcctccgccggccgccttgcccgcgcccgaacgccacgccaagctcaggatcatttcgtcgatttcgtggattggatggccaaccttggcggtggcgcgatgccggcgggatcctcgggcggcgacggcgaggtggaggccgggttcgcgaagctccagggggaggatttcgagtactacatgcagacctactcgatcatgctggggcgcaacagcaagaagtcgacggtggacgtggacctctccagcctcggcggcgggatgaacatctcgcgccaccacgcccggatcttctacgacttccagcgccgccgcttcgcgctcgacgtgatcggcaagaacgggtgcctcgtcgagggcgtcctccacctccccgggaaccaccccgtgaagctggattcccaggatctgctccagattggggacaagaagttctacttcttgctgcccacccggtccatcttcgcgtccgccgccgctgctcggcatccgcctatcatcccgcagcagatgcctccaccatcctatgtgcggacaggccgccctcgtctgtctgaatttcatgacaggtcctttgagggtgactatggccgggagggtgatgagattgggaatggtatcagtgagagtggtgggatgagggggaagttgattaagaggaacaagaagctgtccgcggagtcggagatgtatggcgggcaccggatcaatgttgaagcaatcgggacactcggtgaagacagcagatcagaaataagatcaaggggtgacagggatatggataaccagcacatcctgcaagcagaagaaaaggatgtagtgtcatctgttgcaacagtgttatctgacctctgtggtcctggagaatggatgcctatggcaaaactccacacagagcttcttgaacagtttggcaatgtgtggcaccacagcagggtccggaagtacctttcaccagaggactggtcgccaactgaaacaaaaggtaggccatggtacggtctccttgcattgctgaggaagtatccggaacattttgtcatcaacacaagatcgaaaggcagggtaacatcggagttcgtctcgctggtctctttgctctcctagaggtaacctggaccgtggcataatctgttctcaccgttctggccctgctgaagaatgattcgcatcttcaatcgctgaactgaattgaagcctgttgtactttactggcctgtgtttacccttagctatgtaatccggagaaatacatagggaaacaggattttaacttatgttagtagctgggttcatgtctcactgttgtgtggggtgagaatgtatgtctagtgttgttgagactggaagcgcgaaagttcacagcattttgctgattggaagattttgaaactttgccgtactcgaagaagtgtagttgttcatccttcatatata

SEQ ID NO: 3523 - DNA, 1275 bp, Panicum virgatum
ccgtcactgctaccttgggtgccagtgcaatgcccggcggatcttcagctgctgatggtgaagtggaggcaggatttgcaaagctccagggcgaagatttcgagtactacatgcagacatattcaatcatgctgggccgcaacagcaagaagtcgacagtggatgtggatctctcgagcctcggcgggggtatgaacatctcccgccaccatgcccggatattctacgatttccagcgtcgtcggtttgccctcgatgttattggcaagaatggatgccttgttgagggtgttctgcacctccctggaaacccacctgttaagcttgattcgcaggatctgctgcagattggggacaaaaagttttactttctgctgccaacgcgatctatctttgcctcagctgctgctgctcgacatgctcccattattcctccaccgctcccaccaccatcatatgcacgtccaggccgccctcgtttgtctgattttcacgaccgctcctttgaaggtgattatggcagggaagtggatgacattgggactggtatcagtgaaagtggggtgaggggaaagttgataaagagaaacaagaagtcctctggagagttggacatctatggtgggcaccgaatcaatgttgaagcaataggaaccctaggtgaagacagtagatcagaaataagatcaaggggtgacagggatattgacaatcaacaaatccttcaagcagaagagaaggaagtcgtgtcatctgttgccacagtgttatctgacctctgcggtcctggagaatggatgcccatggcaaaactccatacagagcttcttgaacagtttggcaacgtgtggcaccccagcagggtccgaaagtacctaacaacagatgactggtcaccaacggagacgaagggcaggccttggtttggccttctggccctgctcagaaagtacccagagcattttgtcatcaacacaagatcgaaaggcagagtgacgtcggagtttgtttcgctggtctccttgctctcctagaggggaaacgaggggggctagctgtcctgccgaggaaataacaggcgtttcagtctgttcagaagggtaggaggtgtctctctcatttgcctcttctgttttgaaccctatgtacggtatcaactgtgtttgaacagccgtaatgactggatcattatcatctctgtactgttgacttgtatatgtattatggaagcatgagttttaaccaatgctagcaacttggcaccagcgttcatcc

SEQ ID NO: 3524 - DNA, 1716 bp, Pennisetum glaucum
gggccatttttgcatctgtgatgaaataaaagaccttttttcttagtttagcatcactgggcttctcaccttcttctcctgtgaaacactctgtccagtgttgagctgctgctggccatttgccgttcccccaaccctagatcgatcgatcgatctctccgtccgcccgaccgccggaggctctcagctcgtctccgcccgatcgcggcaacctccccctcctcccttctacctggcggatccgtcccgcgtaggcccgcagctcccctccgacccgacggcccaggcgctgccgtggtccgattgggtgcttcttcttccccagctcccgagatcaaggtgctcgagctacggccgcatctgatttccccaccaattcgggcggttcatcgggcccccatgccccacgtcaaggccgccgtccctgctgccctgggtgcgtgcgcgatgccgggtgggtcttcgggcgctgacggcgaagtggatgcggggttcgccaagctccagggcgaagatttcgagtactacatgcagacgtactccatcatgctgggccgcaacagcaagaagtcgacggtggatgtggatctctcgagcctcggcgggggtatgaacatctcccgccaccacgcccggatattctacgacttccagcgccgccggttcgccctcgatgttatcggcaagaacgggtgccttgttgagggtgtcctgcacctccctgggaacccgcccgtcaagcttgactcgcaggatctgctgcagattggggacaagaagttttacttcctgctgccgacgcggtccatcttcgctgcggctgctgctcgacatgctgctatgattccaccgcagctccctccaccatcgtatgcacgtccgggccgccctcgtttgtctgattttcacgaccgctcctatgaaggtgattatggtcgggaggttgatgacattgggaatggaatcagtgaaagtggggtgagggggaagttgataaagagaaacaagaagtcctccggagaattggacatctacggtgggcaccgaatcaacgtggaagcaataggaacacttggtgaagacagtagatcagaaataagatcaaggggtgacagggatatggagaaccaacaaatccttcaagcagaagagaaggaagttgtctcatctgttgccacagtgttatctgacctctgcggtcctggagaatggatgcccatggcaaaactccacacagagctccttgaacagtttggcaacgtgtggcatcccagcagggttcgaaagtacctaacaacagacgactggtcaccaacagagacgaagggcaggccttggtttggccttctggcgctgctcagaaagtacccagagcatttcgtcatcaacacaagatcgaaaggcaggatgacatccgagtttgtctcgctggtctccttgctctcctaaagggaaactgcaggggatgagatggcatgccgaggaaataacaggcgccggctccatttgcagttcgcattcagaagggtcggaggtgtatcgtgcctaatttgcctcctcttttgaactctgttgtactgtgtatctcatgtgtttcgacagatgtatccatgatcatctctttactgttgacatgtatatgaaaggatgagttttaaccaatgctagcgacttagcagcagctcggttcagtatctgtatgtactatatgtggcg

SEQ ID NO: 3525 - DNA, 1751 bp, Sorghum bicolor
ggcgaacaagcgcagtgatgcgcgtgcagctgtagaaaaaaaaaaatcagtcggcccagtagccatggaagaattgctctcctgaggtgtgctcttctgcttgctgtttttcttcccacattcacctcgccgtcgacggggccaggcgaccggacacacccttgacgaccggcgccgccctactcgcagcttcccgggtttcgtcggatcctttgccggcgaggagcaccgactgcatcaggtcgtcccttgggcgccggtgcaatgcccggcgggtcttcaggcgcagatggtgaagtggatgcaggatttgcgaagctccagggggaggatttcgagtactacatgcagacatactccatcatgctgggacgcaacagcaagaaatcgacagtggatgtggatctctcgagcctcggtgggggtatgaacatctcccgccaccacgcccggatattctacgacttccagcgccgcaggttcgcgctcgatgtcattggcaagaacgggtgccttgttgagggtgtcctgcacctcccaggaaaccctcctgtgaagcttgattcgcaggatctgctgcagattggggacaagaagttctactttctactgccaacgcggtccatcttcgcctcagctgctgctgctcggcatgctcctgttattccaccgcagcttcctccaccatcatatgcacatgcacgggggccaggccgccctcgtttgtcagagtttcatgaccgctcctatgaagctgattatggtcgagaggttgatgagattgggaatggtatcagtgaaactgggatgaggggaaagctgataaagagaatcaagaagtcttctgtagacttggatatctatggtgggcatagaatcaatgtggaaccaataggaacactaggtgaagacagtagatcagacataagatcaaggggtgaaagggatattgacaaccaacaagcccttcaagcagaagagaaggatgttgtgtcatctgttgccacagtgttatcggacctctgcggccctggagaatggatgcccatggcaaaactccatacagagcttcttgatcagtttggcaatgtgtggcaccccagcagggtccgaaagtacttaacacaagacgactggtcaccaacagagacgaagggcaggccttggtttggccttctggcgctgctcagaaagtaccctgagcattttgtcatcaacacaagatcgaaaggtagaatgacctctgagttcgtttcgctggtctccttgctctcctagagggaactaggggaccgggaggggcatgctgaggaaataataggcacactggctccccccatttccagtccgtgttcagaaggggccgaggtttcggcagctgttttggaccctgttgtactgtgtcttgtgtgtttgagcagctgtactggtccgtgaccatctctgtaatgtcggcagcagtatatggaagcatgagttttaaagtcttaacctatgctagcaacttaacaacagctcgattaccgtatccagtatgtatatccagtgtcatgattgaaatacttgtaaactaactgttgtctggtgtcctcttctcagcagttttctgacttttggaaactaactatcctagcgtccccggttgacactacatgagtttctcgccgaagccagtagaaatgttgtaggaaaaaaaaatgtttgttacaggcttgagctaggtacacctgagggcttgtttggacatactt

SEQ ID NO: 3526 - DNA, 2501 bp, Sorghum bicolor
ccaaatcccaaccgaagcacacgaatttccgctcgattgaagatcgtccagataacggccgcgcgccaatctgccggaacgacgggagatgagatcctccgtcctaaccgagccgcaagaatctgaggcgcagggagcagcggcccccgcccccgcccccgccccctcctcctccatctcacctaacccgcccggtggtaaaggcaaatctcacccgccgtgcggtaccagccgccgcccggatttcgccaataaaaactccattgacgaaagccttgcccgtgtcgtcctgccgcggttgttacagccagtgagcggcccagtcggtcggtcgagcgagggagctggacccctacccctgcccccgcgttatatctgctgcgctgcgctgcacagacagactccagctcggccggtcactagtgatagtggatagctcgcctcgcccgccagccgccccgctagaagctcgcatcgatcgcgccccagatcccaatgcgccccgccgcgtcgctctaggccgcggaagatagctgtgtgacacgccgtgcagccatcatcagccatgaaggtcctcgccgtgctggcgctcgtcgccgccgccgcgccgttcctccgcgccgccggccagggcgaggaaggggccgggccgctgccgttcgcggtgggcgcggcgccggcgggctgcgacgtcgcacagggcgagtgggtgcgcgacgacgacgcccgcccgttgtaccaggagtgggagtgcccctacatccagccgcagctgacgtgccaggcgcacggccgccccgacaaggcgtaccagagctggcgctggcagccgcgcggctgctccctgcccagcttcaacgcgacgctgatgctggagatgctgcgtgggaagcggatgctgttcgtgggcgactcgctgaaccgggggcagtacgtgtccctgctgtgcctcctgcaccgtgccatccccgacggcgccaagtcgttcgagacggtggactcgctgagcatcttcagggcgaaggactacgacgccaccatcgagttctactgggcgcccatgctggctgagtccaactccgacgacgccgtggtgcactccgccgacgaccgcctcatccgcggcgcgcccatggacaggcactccagcttctggaagggcgccgacgtcctcgtcttcaactcatacctctggtgggtcgccggggacaagatccagatcctgaggggcgccgacaatgacccgagcaaggacatcgtggagatgaaatcggaggaggcctacaggctggtgctgtaccaggtggtccggtggctggagcgcaacgtggacgccaagaagtcgcgggtgttcttcgtcaccgcgtcgccaacgcacacagagggcaaggcgtggggcgacaagaaggagggcgccaattgctacggccagacgtcgccgatcagcgacggcgcctcctcgtacagggacagcacgagccgggagatgcagcgggtgacggaggaggtgctggccacgtcgcgggtgcccgtcgggctcgtcaacatcacgcggctgtccgagtaccgccgggacgcgcacacgcagacctacaagaagcagtgggcggagccgacggcggagcagcgcgccgaccccaggagctacgccgactgcacgcactggtgtcttcccggcgtgccggatacgtggaacgagctgctgtactggaagctcttcttccctagcaacgatcagttcctctgatgatgcgtgcctgcgtgcctctgcctgcatacatacagacacttggacacggccggactgctaggggctagcccaaagtaacatcctttgtgccggcatgcacagcgtcgatcgaaacagaacaaagaaatgtagatgaagaactgaacctcgtgtaagtgtaagtggtgtacatggatgcgtgcgccatgctcaacgttagttcgtggttcatggagcagaaactttccgttgatgtaatcagtttttctttcttttttgggggtcgctgtaagatcgaggctcttttttgtgtcaatttcaaagaatccaggggaaaaaaaatcttcttctgcgtaaaacaagattcagcaaacaatctcgttttttttttaaaaaaaaggggaaatctaaaccttggggaaaaaaaaccggatgcctgcatgcaccgggctgaaaaagtgaaaaggacttcgtttttgctgaggagtttgagttactacacagctcaaaaaggcaaaaactagaaacatctctggtattggctctaaattcagcaagctcgaaaggaactaaggaaatatcctttttatattatttcttcaatgcttatagaagctcaagtatgaaatttagttaagctttttgctgcttaattgcttatcctgtctttatccacatctgtcacttctagtgaagaaggtaaatgacgccgcccttgttctctgatattcaaccatacctggtgcagatgttatatatatcctttgatgta

SEQ ID NO: 3527 - DNA, 1702 bp, Saccharum officinarum
ctcggccgttcagtagtggatagctcgcctcgccctccagccgcccgctagaagctcgcaccgcgccccagatcccaatgcgccccgccgcgtcgctctaggccgcggaagctagctgtgcgacacgccgggggcggtagtggtcgtggtcacggtcgcgcgcggacgtacgggtgcgccgtgcagccatcagccatgaaggtcctcgccgtgctggcgctcgtcgccgccgccgcgccgttcctccgcgccgccggccagggcgaggatggggccgggccattgccgttcgcggtgggcgcggcgccggcgggctgcgacgtcgcccagggcgagtgggtgcgcgacgacgacgcccgcccgctgtaccaggagtgggagtgcccctacatccagccgcagctgacgtgccaggcgcacggccgccccgacaaggcgtaccagagctggcgctggcagccgcgcggctgctccctgcccagcttcaacgcgacgctgatgctggagatgctgcgtgggaagcggatgctgttcgtgggcgactcgctgaaccgggggcagtacgtctccctgctgtgcctcctgcaccgtgccatccccgacggcgccaagtcgttcgagacggtggactcgctgagcatcttcagggccagggactacgacgccaccatcgagttctactgggcgcccatgctggccgagtccaactccgacgacgccgtggtgcactccgccgacgaccgcctcatccgcggcgcgcccatggacaggcactccagcttctggaagggcgccgacgtcctcgtcttcaactcctacctctggtgggtcgccggggacaagatccagatcctgaggggcgccgacaatgacccgagcaaggacatcgtggagatgaaatcggaggaggcctaccggctggtgctgtaccaggtggtccggtggctggagcgcaacgtggacgccaagaagtcgcgggtgttcttcgtcaccgcgtcgccaacgcacacagagggcaaggcgtggggcgacaaggcggagggcgccaactgctacggccagacgtcgccgataagcgccgcctcctcctaccaaggcagcacgagccgggagatgatgcgggtgacggaggaggtgctggccacgtcgcgggtgcccgtcgggctggtcaacatcacgcgcctgtccgagtaccgccgggacgcgcacacgcagacctacaagaagcagtgggcggagcagcgcgccgaccccaagagctacgccgactgcacgcactggtgcctccccggcgtgccggacacgtggaacgagctgctctactggaagctcttcttccccagcaacgatcagttcctctgatgatgttgcgggcctgcgtgcctgcctgcatacatacagacacttggaaacggactactaggggctagcccaaagtagcatccatctacattgtcgatcgaaacaaaacaaagaaatgtagatgaagaactgaacctcgcggtgtaagtgtgacgtgtgagtggtgtagatgcatgcgtgcgccatgctctccgttagttcgtacgtggttcatggagcagaagaaaccttccgttgatgtaatcagtttttctgtctttttttttctcgggtcgttgtaagaggctctcctttttgtttcaatttcaaagaattcaggaaaaaaaatcttcttgtacgt

SEQ ID NO: 3528 - DNA, 1772 bp, Panicum virgatum
gggtcgacccacgcgtccgcggacgcgtgggcggtgcgcccttttgttagagtggagtcacagcggccggccgaggcagctggagccggagctggacccctgtccgtcgctcgctatatctgctgcagcctgctagcacaggggagtcccattcggtcagtgcagtgatagctcccgctagcagctcgccgcagctcagggcggctcgcacccagatcccaatgcgcgccgccgcgtcgctctaggccgagagaagctgaggtgagaccgagacgcccgggggtcgcgcgcccgagatacccagatcgacgtgcagccatgaaggtcctcgccgtgctggcgctcgtcgccgccgccgcgccgttcctcggcgccgccggccagggcgacggggccgggccgctgccgttcgcggtgggcgcggcgccggcggggtgcgacatcgggcagggggagtgggtgcgcgacgaggcggcgcggccgtggtaccaggagtgggagtgcccctacatccagccgcagctcacgtgccaggcgcacggccgccccgacaagggctaccagaactggcgctggcagccgcgcggctgctcgctgccgagcttcaacgcgacgatgatgctggagatgctgcggggcaagcggatgctgttcgtgggcgactcgctgaaccggggacagtacgtgtccctgctgtgcctcctccaccgcgccatccccgacggcgccaagtcgttcgagacggtcgactcgctcagcatcttccgggccaaggactacgacgccaccatcgagttctactgggcgcccatgctggccgagtccaactccgacgacgccgtcgtgcaccgcgtcgacgaccgcgtcatccgcggcgcgcccatggacaagcactcccgcttctggcaaggcgcccacatcctcgtcttcaactcctacctctggtggacggccggggacaagatcaagatcctgaggggcgccgacaacgacttgagcaaggacatcgtggagatgaaggcggcggaggcctaccggctggtgctgcaccaggtggtccggtggctggagcgcaacgccgaccccaagaactcgcgggccttcttcgtcaccgcgtcgccgacccacacagatagctcagcgtggggcgacgagacggagggcggcaactgctacaaccagacgacgccgatcggcgacgcctcctactggggcagcacgagccgggagatcctgcgggtgacggaggaggtgctggccacgtcgcgggtgcccatcggggtggtgaacatcacgcagctgtcggagtaccgccgggacggccacacgcagacctacaagaagcagtgggcggagccgacgccggagcagcgcgccgaccccaggagctacgccgactgcacgcactggtgcctccccggcgtgccggacacctggaacgagctgctctactggaagctcttcttccccagcaacgaccaggccctctgatcgatgaaggcatgcgtacatacacttgaacccattgttggaaggggctagcccatgtgacatgatcgatcacgcagcacacatgcatcgtcaagagaaacaaatgtagattaagaattgaacgtcgtgtgtgattagttgcggttgttcatgaggcagaaaccttgggtggtggccgtcgatgtaatcttttttatttttctgttttctttttcgatcagtgtaatgacgctcttttggtgaatgaaggaaaacaaaatcatagaaaaacttatccttgt

SEQ ID NO: 3529 - DNA, 1606 bp, Panicum virgatum
gtgatagctagcagcagccagcaggcagctcgccgcagctcagggcggctcgcacccagatcccaatgcgcgccgccgccgcgtcgctctaggccgagagaagcagcggtgagtgagaccgagacgcccggacgtgcagccatgaaggtcctcgccgtgctggcgctcgtcgccgccgccgcgccgttcctccgcgccgccggccagggcggcgagggcgacgacggggccgggccgctgccgttcgcggtgggcgcggcgccggcggggtgcgacatcgggcagggggagtgggtgcgcgacgaggcggcgcggccgtggtaccaggagtgggagtgcccctacatccagccgcagctgacgtgccaggcgcacggccgccccgacaagggctaccagaactggcgctggcagccgcgcggctgctcgctgccgagcttcaacgcgacgatgatgctggagatgctgcggggcaagcggatgctgttcgtgggcgactcgctgaaccgggggcagtacgtgtccctgctgtgcctcctccaccgcgccatccccgacggcgccaagtcgttcgagacggtcgactcgctcagcatcttccgggccaagaactacgacgccaccatcgagttctactgggcgcccatgctggccgagtccaactccgacgacgccgtcgtgcaccgcgtcgacgaccgcgtcatccgcggcgcgcccatggacaagcactcgcggttctggcagggcgcccacatcctcgtcttcaactcctacctctggtggacggccggcgacaagatcaagatcctgaggggcgctgacaacgacttgagcaaggacattgtggagatgaaggcggcggaggcctaccggctggtgctgtaccaggtggtccggtggctggagcttaacgccgaccccaagaactcgcgggccttcttcgtcaccgcgtcgccgacccacacagatagctccgcgtggggcgacgagacggagggcggcaactgctacgaccagacgacgccgatcggcgacgcctcctactggggcagcacgagccgggagatgctgcgggtgacggaggaggtgctggccacgtcgcgggtgcccgtcggcgtggtcaacatcacgcagctgtcggagtaccgccgggacggccacacgcagacctacaagaagcagtgggcggagccgacgccggagcagcgcgccgaccccaggagctacgccgactgcacgcactggtgcctccccggcgtgccggacacctggaacgagctgctctactggaagctcttcttccccagcaacgaccaggccctctgatcgatgaccaaaggcatgcgtacatacactcggaacccattgttggaagaggctagcccatgtgacatcatcgatcacgcagcacatgcatcgtaaagagaaacaaatgtagattaagaattgaacgtcatgtgtgattagttgctgctgttcatgaggcagaaacctttgggtggtggccgtcgatgtaatttttttttctgttttctttttcggtcagtgtaatgacgctcttttggtgaatgaaggggaaaaatcatagaaaaacttatccttgtat

SEQ ID NO: 3530 - DNA, 1005 bp, Setaria italica
ggcaattaatgactttgaaaacgcgaaatagctgatgagagaagttgttgtttagaaataggaaagtggaatgaaatctagtcttagtcaaatatttcatatctcttcttgtccaaacagaaggaaaagaagacaatttgagctgagcggaaaatccatacctctcttatccatttagagcatatggatcgatttataagaatcgaatgttttgtttttatgttattttgtgatagaatgaaaagaattctatatagaatgggttgggaattatgcctagatcccgtataaatggaaatttcattgataagaccttctcgattgtagccaatattttattgcaaataattccgacaacctccggggaaaaaagggcatttacttattatagagatgggatgttggctcaatccgaaggaaattatgcggaagctttgcagaattattatgaagctatgcgactagaaattgatccctatgatcgaagttatatactatataacataggccttatacacacaagcaatggagagcatacaaaggctttggaatattatttccgggcgctagaacgaaaccccttcttaccgcaagcttttaataatatggccgtgatctgtcattaccgaggagaacaggccattctacagggcgattcggaaattgcggaagcttggtttgatcaagctgctgagtattggaaacaagctatagcgcttactccgggaaattatattgaagcacagaactggttgaagattacgaagcgctttgaatttgaataaaacaactctccatttccataaaatgggtggtttggttgttgatccattaatcaaataatttaggtaagaagatcaaatcaagaatttcattatatccctttcttctaccttcgattttatatcatatttcataaagataaataatagggataggctctggaacagaagtaataaagcacataaaaggtggcaatctaaatattcctacctaatctatcag

SEQ ID NO: 3531 - DNA, 537 bp, Saccharum officinarum
atgcctagatcccgtataaatggaaatttcattgataagaccttctcgattgtagccaatattttattgcaaataattccgacaacctccggggaaaaaagggcatttacttattatagagatgggatgttggctcaatccgaaggaaattatgcggaagctttgcagaattattatgaagctatgcgactagaaattgatccctatgatcgaagttatatactatataacataggccttatacacacaagcaatggagagcatacaaaggctttggaatattatttccgggcgctagaacgaaaccccttcttaccgcaagcttttaataatatggccgtgatctgtcattaccgaggagaacaggccattctacagggcgattcggaaattgcggaagcttggtttgatcaagctgctgagtattggaaacaagctatagcgcttactccaggaaattatattgaagcacagaactggttaaagattacgaagcgctttgaatttgaataagaccactctccattttcataaaaa

SEQ ID NO: 3532 - DNA, 1068 bp, Oryza sativa
ttttttttttatgttattttgtgaaggaatgaaaagaattctatatagaatgatagaatgggttgggaattatgcctagatcccgtataaatggaaatttcattgataagaccttctcaattgtagccaatattttattgcgaataattccgacaacctccggggaaaaaagggcatttacttattatagagatgggatgttggctcaatccgaaggaaattatgcggaagctttgcaaaattattatgaagctatgcgactagaaattgatccctatgatcgaagttatatactctataacataggccttatacacacaagcaatggagagcatacaaaggctttggaatattatttccgggcactagaacgaaaccccttcttaccacaagcttttaataatatggccgtgatctgtcattacggagaacaggccattctacagggtgattcagaaattgcagaagcttggtttgatcaagctgctgagtattggaaacaagctatagcgcttactccgggaaattatattgaagcacagaactggttgaagattacgaagcgctttgaatttgaataagaccactctcctttttcagaaaatgggggtttggttgttgatccattaatcaaataaattaggtcggaagatcgaatcaagaatttcattatatctctttcctctgccttctattttatattatatttcataaggataaacgatagggtctagaatagaagtaataaagcgaataaaaaaggggcatataaaatattgctaatatatcaggaccatctttattaataattctaatgagttatcttggaatttggaatcgaataaaaaaatctatattatgctcaaggaaagtagatatagatagggacttatactcttaaaaaaaatagactagctttttaaattaaaaaaaggtttttttgttacgtggagaaatccaagataaaaaaagtccgttaggcacccatccttatgtcataatagatccgaacacttgcctcagattgacttcaatatataattgctccagtgaataactaaaaaaaaa

SEQ ID NO: 3533 - DNA, 1066 bp, Oryza sativa
tttttttttttatgttattttgtgaaggaatgaaaagaattctatatagaatgatagaatgggttgggaattatgcctagatcccgtataaatggaaatttcattgataagaccttctcaattgtagccaatattttattgcgaataattccgacaacctccggggaaaaaagggcatttacttattatagagatgggatgttggctcaatccgaaggaaattatgcggaagctttgcaaaattattatgaagctacgcgactagaaattgatccctatgatcgaagttatatactctataacataggccttatacacacaagcaatggagagcatacaaaggctttggaatattatttccgggcactagaacgaaaccccttcttaccacaagcttttaataatatggccgtgatctgtcattacggagaacaggccattctacagggtgattcagaaattgcagaagcttggtttgatcaagctgctgagtattggaaacaagctatagcgcttactccgggaaattatattgaagcacagaactggttgaagattacgaagcgctttgaatttgaataagaccactctcctttttcagaaaatgggggtttggttgttgatccattaatcaaataaattaggtcggaagatcgaatcaagaatttcattatatctctttcctctgccttctattttatattatatttcataaggataaacgatagggtctagaatagaagtaataaagcgaataaaaaggggcatataaatattgctaatatatcaggaccatcttattaataattctaatgagttatcttggaatttggaatcgaataaaaaaatctatattatgctcaaggaaagtagatatagatagggacttatactcttaaaaaaaatagactagctttttaaattaaaaaaaggtttttttgttacgtggagaaatccaagataaaaaaagtccgttaggcacccatccttatgtcataatagatccgaacacttgcctcagattgacttcaatatataattgctccagtgaataactaaaaaaaaa

SEQ ID NO: 3534 - DNA, 1124 bp, Lolium multiflorum
agcgtggtcgcggccgaggtacgcgggtttgttttatgttattttgtgaaggaaatagaaacaattctatatggaatgggttgggaattatgcctagatcccgcgcaaatggaaatttcattgataagaccttctcaattgtagccaatattttattgcgaataattccgacaacctcaggagaaaaaaaggcatttacttattatagagatgggatgttggctcaatccgaaggaaattatgcggaagctttgcaaaattattatgaagctacgcgactagaaatcgatccctatgatcgaagttatatactctataacataggccttatacacacaagcaatggagagcatacaaaggctttggaatattattttcgggcactagaacgaaaccccttcttaccgcaagcttttaataatatggccgtgatctgtcattaccgaggagaacaggccattctacagggtgattcggaaattgcggaagcttggtttgatcaagctgctgagtattggaaacaagctatagcgcttactccgggaaattatattgaagcacagaactggttgaagattacgaagcgctttgaatttgaataagaaagaccacgctccttctttttcataaaatgggtggtttggttgttgatccattaatcaaataaattaggtcgtaagatcctcgaatccagaatttcattatatccctttcttctaccttctattttatctgatatttcataaggataaaccatagggatagggtctataatagaagtaataaagtgaataaaaagaaaaaataggggcaatctaaatatcgctagtatatcaggactgtattattaataactctaatgagttatcttggaatttagaataaaataaaaaaccctatattatgctcaaggaaagtagatgtatataggagcttacaccctaaaaaaaaatacactagtttctaaaattgcaaaaatatttttttttcttacgtcgggaaatatttgtttttcaagataaacagcgtcccttaggcacccaatctttatgtcataatagatccgaacacttgcctcggattgacttcaatatataattgctccagtgaataactaaaaaaat

SEQ ID NO: 3535 - DNA, 632 bp, Hordeum vulgare
gtcggaattatgcctagatcccgtgtaaatggaaatttcattgataagaccttctcaattatagccaatattttattgcgaataattccgacaacctcaggagaaaaaaaggcatttacttattatagagatgggatgttggctcaatccgaaggaaattatgcggaagctttgcaaaattattatgaagctatgcgactagaaatcgatccctatgatcgaagttatatactctataacataggccttatacacacaagcaatggagagcatacaaaggctttggaatattatttccgggcactagaacgaaaccccttcttaccgcaagcttttaataatatggccgtgatctgtcattaccgaggagaacaggccattctagagggtgattcggaaattgcggaagcttggtttgatcaagctgctgaatattggaaacaagctatagcgcttactccgggaaattatattgaagcacaaaactggttgaagattacgaagcgctttgaatttgaataagaccatgctccttttttttcctaaaatggatggtttggttgttgatccattaatcaaataaattaggtcgtaagatcgaatcaagaatttcattatatccatttcttata

SEQ ID NO: 3536 - DNA, 696 bp, Hordeum vulgare
aatcgaatgtgtttgtttttatgttattttgtgaaggaatgaaaacaattctatatagaatggcttgggaattatgcctagatcccgtgtaaatggaaatttcattgataagaccttctcaattatagccaatattttattgcgaataattccgacaacctcaggagaaaaaaaggcatttacttattatagagatggtatgttggctcaatccgaaggaaattatgcggaagctttgcaaaattattatgaagctatgcgactagaaatcgatccctatgatcgaagttatatactctataacataggccttatacacacaagcaatggagagcatacaaaggctttggaatattatttccgggcactagaacgaaaccccttcttaccgcaagcttttaataatatggccgtgatctgtcattaccgaggagaacaggccattctagagggtgattcggaaattgcggaagcttggtttgatcaagctgctgaatattggaaacaagctatagcgcttactccgggaaattatattgaagcacaaaactggttgaagattacgaagcgctttgaatttgaataagaccatgctccttttttttcctaaaatggatggtttggttgttgatccattaatcaaataaattaggtcgtaagatcgaatcaagaatttcattatatccatttcttata

SEQ ID NO: 3537 - DNA, 510 bp, Oryza sativa
atgcctagatcccgtataaatggaaatttcattgataagaccttctcaattgtagccaatattttattgcgaataattccgacaacctccggggaaaaaagggcatttacttattatagagatgggatgttggctcaatccgaaggaaattatgcggaagctttgcaaaattattatgaagctacgcgactagaaagtgatccctatgatcgaagttatatactctataacataggccttatacacacaagcaatggagagcatacaaaggctttggaatattatttccgggcactagaacgaaaccccttcttaccacaagcttttaataatatggccgtgatctgtcattacggagaacaggccattctacagggtgattcagaaattgcagaagcttggtttgatcaagctgctgagtattggaaacaagctataggccttactccgggaaattatattgaagcacagaactggttgaagattacgaagcgctttgaatttgaataa

SEQ ID NO: 3538 - DNA, 625 bp, Sesamum indicum
caaatcactctgtttttatgttatttcgtactgtacaattcttttctttgtgggatcattttcccccgagagggaatgagaagaattatagaatggattgctagctatgcctagatcgcggataaatggaaattttattgataagaccttttcaattgtagccaatatcttattgcaaataattccgacaacttcaggagaaaaggaggcatttacctattacagagatgggatgtcagctcaatccgaaggaaattatgcggaagctttacagaattattatgaagctatgcgactagaaattgatccctatgatcgaagttatatactctataatataggtcttatccatacaagtaatggagaacatacgaaagctttggaatattattttcgagcactagaacgaaatccattcttaccacaagcttttaataatatggccgtgatctgtcattaccggggagaacaggccattcgccagggagattctgaaattgcggaggcttggtttgatcaagccgctgagtattggaaacaggctatagcgcttactcctggtaattatattgaagcacataattggttgaagatcacgaggcgtttcgaataaaagaaggcaccg

SEQ ID NO: 3539 - DNA, 1066 bp, Zostera marina
tcatgatgaaatacaaatttctataattatagaatccaatctgcaggaaataaaattattgattctttaacttaatagtaatacttttgttcactgttatactacttaagtaagataataattagataaaatatttagtatttcttatttttcaaaaaaaactatttgagtataaagtccatcttttagtctatttttatgttatttcgtactgtagaattcctttgtttgtgagatcatctttcttcgacgagggaaatgagaagaattaaaaatggattgctaattatgcctagatctcgtataaatggaaattttattgataagaccttctcaattgtggccaatatcttattacaaataattccgacaacttcaggagaaaaggaggcatttacctattacagagatgggatgtcggctcaatccgaaggaaattatgcggaagctttacagaattattatgaagctatgcgactagaaagcgatccctacgatcgaagttatatactctataacataggacttatacacacaagcaacggagaacatacgaaagctttggaatattattttcgggcactagaacgaaatccgttcttaccacaagctttaataatatggccgtgatctgtcattaccggggagaacaggccattcgacagggggattctgaaattgcagaggcttggttcgatcaagctgctgagtattggaaacaagctatagcgcttactccaggcaattatattgaagcacgtaattggttaaagatcacaaggcggtttgaatttgaataagaccactcttttttttttatttggttattggatacattaattaaatcaaatagatccttctctggtaggattcaatcaacaaggaatttcattatattcttttcgaaactaattttattttttatttgtagattatttcataagaataaaaggtaggaacacaatagaatatagaatgaatataactcataaaagatacctttttttaaggtaatggttaaatatagatatcataatatattctattaattattaataattgatct

SEQ ID NO: 3540 - DNA, 507 bp, Lactuca sativa
atgcctagatcgcggataaatggaaattttattgataaaaccttttcaattgtagccaatatcttattacgaataattccgacaacttcaggagaaaaagaggcatttacctattacagagatgggatgtcagctcaatccgaaggaaattatgcggaagctttacagaattattatgaagctatgcgactagaaattgatccctatgaccgaagttatatactctataacataggacttatccacacaagtaacggagaacatacgaaagctttggaatattattttcgagcgctcgaacgaaacccattcttaccacaagcttttaataatatggccgtgatctgtcattaccggggagaacaggccattcggcagggggattctgaaattgcggaggcttggttcgaccaagccgctgagtattggaaacaggctatagcacttactcctggtaattatattgaagcgcataattggttgaagatcactagacgtttcgaataa

SEQ ID NO: 3541 - DNA, 627 bp, Olea europaea
ggacccataatcttttttttttttaattcaatctatttttatgttatttcgtactgtacaattcttggatcattttcccacgagaggtaatgagaagaattatagaatggattgctacctatgcctagatcgcggataaatggaaattttattgataagaccttttcaattgtagccaatatcttattacgaataattccgacaacttcaggagaaaaagaggcatttacctattacagagatgggatgtcagctcaatccgaaggaaattatgcggaagctttacagaattattatgaagctatgcgactagaaattgatccctatgatcgaagttatatactctataatataggtcttatccatacaagtaatggagaacatacgaaagctttggaatattattttcgagcactagaacgaaacccattcttaccccaagcttttaataatatggccgtgatctgtcattaccggggagaacaggccattcgccagggagattctgaaattgcggaggcttggtttgatcaagcagctgagtattggaaacaggctatagcgcttacacctggtaattatattgaagcacataattggttgaagatcacggggcgtttcgaataa

SEQ ID NO: 3542 - DNA, 510 bp, Oryza sativa
atgcctagatcccgtataaatggaaatttcattgataagaccttctcaattgtagccaatattttattgcgaataattccgacaacctccggggaaaaaagggcatttacttattatagagatgggatgttggctcaatccgaaggaaattatgcggaagctttgcaaaattattatgaagctacgcgactagaaattgatccctatgatcgaagttatatactctataacataggccttatacacacaagcaatggagagcatacaaaggctttggaatattatttccgggcactagaacgaaaccccttcttaccacaagcttttaataatatggccgtgatctgtcattacggggagaaacggccttctaccggtgattcagaaattgcagaagcttggtttgatcaagctgctgagtattggaaacaagctatagcgcttactccgggaaattatattgaagcacagaactggttgaagattacgaagcgctttgaatttgaataa

SEQ ID NO: 3543 - DNA, 1548 bp, Gossypium hirsutum
actattaatttaaatattcaaattgactagaaaatcgaatttaataatttaaatagtaccgtaatttatttaattaaattaaatattaaacgtaaatgggatttaatagaaattaaatagaaatagaattaaattagaattctctaatttctaatcgaatttcgaatcctaaactaaaataataataaataaacagagagctcttgttcttattcgaaacgccgcgtgatctttaaccaattctgcgcttcaatataattaccaggagtaagcgctatagcctgtttccaatactcagcggcttgatcgaaccaagcctccgctatttcagaatccccctgtcgaatggcctgttctccccggtaatgacagatcacagccatattattaaaagcttgtggtaagaacgggtttcgttctagtgctcgaaaataatattctaaagcttttgtatgctctccattacttgtgtggataaggcctatgttatatagtatataacttcgatcatagggatcaatttctagtcgcatagcttcataataattctgtaaggcctccgcataattccttcggattgagccgacataccatctctgtaataagtaaatgcctctttttctcctgaagttgtcggaattattcgtaataagatattggctacaattgaaaaggtcttatcaataaaatttccatttatctgcgatctaggcataggtagcaatccattctataactcttttcattacccctcgtgagaaaataaaatgatctcacaaacaaaggaagtgtacagtacgaaataacataaaagtagacccattccatttttaaaaattcttcgagcccggaggctaaagaaaaagtgataaaaaaaagtgatgaaaagttttctatttttatagcaagtttcctagttagaattgatattgttcgtacctatcgaacaatctaatatgagtaactcgctattcgctcggggtatcggccataataattatgtaggagagatggccgagtggttcaaggcgtagcattggaactgctatgtagactcttgtttaccgagggttcgaatccctctctttccgcaccttcacctaattcgccaatgtaactgactacaatgtatcaaataagaacatatactaaagaattagacccttctttagtatagattctctattcccaattcctttttaatatggaatacgtaaaatagcatacaggggatgaaaatctccttacgtatctatcatacatgaataggagaaaaatctccgaatcaaacccattcccctgtcttcctttacttaaccttaactcaggtgaaaagggggcagaacccttgttttgttattttagttaggtttaagtctgacgagaataatattctacgacaagcaattcatttattttcaaaccaacccatttcctatctattatttgattgactaatcctttatattgtaatgtgtgaaaggtcaaatgttttggtaattcctcattggtggatgaatcaagataattttgaatcagagttctaga

SEQ ID NO: 3544 - DNA, 6147 bp, Oryza sativa
atgcctagatcccgtataaatggaaatttcattgataagaccttctcaattgtagccaatattttattgcgaataattccgacaacctccggggaaaaaagggcatttacttattatagagatggtgcgatttgaggatgttggctcaatccgaaggaaattatgcggaagctttgcaaaattattatgaagctacgcgactagaaattgatccctatgatcgaagttatatactctataacataggccttatacacacaagcaatggagagcatacaaaggctttggaatattatttccgggcactagaacgaaaccccttcttaccacaagcttttaataatatggccgtgatctgtcattacgtgcgacggggagaacaggccattctacagggtgattcagaaattgcagaagcttggtttgatcaagctgctgagtattggaaacaagctatagcgcttactccgggaaattatattgaagcacagaactggttgaagattacgaagcgctttgaatttgaataagaccactctcctttttcagaaaatggggtaggtcggaagatcgaatcaagaatttcattatatctctttcctctgccttctattttatattatatttcataaggataaacgatagggtctagaatagaagtaataaagcgaataaaaaggggcaatataaatattgctaatatatcaggaccatcttattaataattctaatgagttatcttggaatttggaatcgaataaaaaaatctatattatgctcaaggaaagtagatatagatagggacttatactcttaaaaaaaatagactagctttttaaattaaaaaaaggtttttttgttacgtggagaaatccaagataaaaaaagtccgttaggcacccaatccttatgtcataatagatccgaacacttgcctcagattgacttcaatatataattgctccagtgaataactaaaaaaaaatagaaggacggtagatagtaaagaaaaggactaatcataatatctatctttcaaaggttcactaaaaagttggcgggtctctttgtatgtcttgtccggaaagaggaggacttaatgatgattcgttcgccggaaccagaagtaaaaattgttgtggatagggatcctgtaaaaacatcttttgaggaatgggccagacccggccatttctcaagaacaatagctaagggccctgatactaccacttggatctggaacctacatgctgatgctcacgatttcgatagtcatacaggtgatttggaggagatctctcgaaaagtctttagtgctcatttcggtcaactctccattatctttctttggttgagtggcatgtacttccatggtgcccgtttttccaattatgaagcatggctaagtgatcctactcacattggacccagtgctcaggtagtttggccaatcgtagggcaagaaatattgaatggtgatgtaggcgggggtttccgaggaatccaaataacctccgggttttttcagatttggcgagcatccggaataactagtgaattacaactctattgtaccgcaatcggtgcattgatttttgcatcgttaatgctttttgctgggtggttccattatcacaaagccgctcccaaattagcctggttccaagacgtagaatccatgttgaatcatcacttagcagggttattaggacttgggtctctttcttgggcggggcaccaaatccatgtatctttaccgattaaccaatttcttgacgctggggttgatcctaaggagataccacttcctcatgaatttatcttgaatcgcgaccttttggctcaactttatcctagttttgccgaaggagcaaccccttttttcaccttgaattggtccaaatacgcagaatttcttagttttcgcggagggctagatccaataaccggcggtctatggttgagcgatattgcgcaccatcatttagctattgctattcttttcctgatcgcaggtcatatgtataggaccaactggggtattggtcatggcctgaaagatattttggaggctcataaaggcccatttacaggacagggccataaaggtctctatgaaattctaacaacgtcatggcatgctcaattatctcttaacctagctatgctaggctctacaaccattgttgtagctcatcatatgtactctatgcccccctatccatacctagctactgactatggtacacaactttccttgttcacacaccacatgtggattggcggatttctaatagttggtgctgctgcacatgcagccatttttatggtaagagactatgatccaacgactcgatacaacgatctattagatcgtgtccttagacaccgtgatgcaatcatatcccaccttaactgggtatgtatatttctaggttttcacagttttggtttatacattcataatgataccatgagtgctttaggtcgtccccaagatatgttttcggataccgccatacaaatacaaccgatctttgctcaatgggtacaaaatctccatgctggcgcgcctagcgtaacagctcctggtgcaacaacaagtaccagcttaacgtggggaggtggcgagttagtagcagtaggcggcaaagttgctttgttacctattccattaggaaccgcagattttttagtccatcacattcacgcatttacaatccatgtgactgtattaatacttttgaaaggtgttttatttgctcgcagttcccgtttgatacccgataaagcaaatcttggttttcgcttcccttgcgatgggcctgggcgagggggaacatgtcaagtatccgcctgggatcatgttttcttaggtctattctggatgtacaattccatttcggtagtcattttccatttcagttggaaaatgcagtcggatgtttggggtactataagtgatcaaggggtggtaactcatatcacagggggaaactttgcacagagttccattacgattaatgggtggctccgagatttcttgtgggcacaggcatcccaagtaattcagtcttatggttcttcattatccacatatggtctttttttcttaggtgctcattttgtctgggccttcagtttaatgtttttattcagcggccgtggttattggcaagaactaattgaatctatcgtttgggctcataacaaattaaaagttgctcctgctactcagcctagagccttgagcattatacaaggacgtgctgtaggagtaacccattaccttctgggtggaattgccacaacatgggcattcttcttagcgagaattattgcagtaggatagtggctaggaggatttgaaaggcattatggaattaagatttcccaggtttagccaaggcttagctcaggaccccactactcgtcgtatttggtttggtattgctaccgcacatgatttcgaaagtcatgatgatattactgaggaacgtctttatcagaacatttttgcttctcactttgggcaattagcaataatctttctatggacgtccggaaatctgtttcatgtcgcttggcaaggaaattttgaatcatggatacaggatcctttacacgtaagacctattgctcatgcgatttgggatcctcattttggtcaacccgctgtggaagcctttactcgaggaggcgccgccggtccagtgaatatcgcctattctggggtttatcagtggtggtatacaattggattacggaccaatgaagatctttatacaggagctctttttctattatttctttctaccctatccttaatagggggttggttacatctacaacccaaatggaaaccaagcctttcgtggttcaaaaacgcggaatctcgtctcaatcatcatttgtcaggacttttcggggtaagttctttggcttggacaggacatttagttcatgtcgctattccagcatccaggggagagtacgttcgatggaataatttcttagatgtattaccctatccacaggggttgggaccccttctgacgggtcagtggaatctttatgcccaaaaccccgattcgagtaatcatttatttggtaccactcaaggagcgggaactgctattctaactcttcttgggggattccatccacaaacacaaagtttgtggctgaccgatattgctcatcatcatttagctattgcatttatttttctcattgccggtcatatgtatcgaactaacttcggaattgggcacagtatcaaagatcttttagaagcacatactcctccggggggtcgattagggcgtgggcataagggcctttacgacacaatcaataattcgattcattttcaattaggtcttgctctagcttctttaggggttattacttccttagtagctcaacatatgtactctttaccttcttatgcattcatagcacaagactttactactcaagcagctttatatactcatcaccaatacattgcagggttcatcatgacaggggcttttgctcatggagctatttttttcattagagattacaatccggaacagaatgaggataatgtattggcaagaatgttagaccataaagaagctatcatatctcatttaagttgggctagtctcttcctaggattccataccttgggcctttatgttcataatgacgtcatgcttgcttttggtactccagaaaagcaaatcttgatcgaacctatatttgctcaatggatacaatcggctcatggtaagacgacatatgggttcgatatactcttatcttcaacgagcggtcccgctttcaatgcgggtcgaaccctatggttacccagatggttgaatgctgttaacgagaatagtaattcgcttttcttaacaataggacctggagatttcttggttcatcatgctattgctttaggtttgcatacaattgtgatatttctgcttgggacgcgttttatttggcagttttctggatgttaaataccattggatgggttactttttattggcattggaaacacatcacattatggcagggcaacgtttcacaatttaatgaatcctccacttatttgatgggatggttaagagattacctatggttaaactcttcacaacttatcaatggatataatccttttgggatgaatagtttatcggtatgggcgtggatgttcttatttggacatcttgtttgggcgactggatttatgttcttaatttcctggcgtggatattggcaggaattaattgagactgtagcatgggctcatgaacggacacctttggctaatttaattcgctggagagataagcccgtggctctttccattgtgcaagcaagattggtgggattagctcacttttccgtgggttatatattcacttatgccgctttcttgattgcctcaacatcaggcaagtttggttaatttagttaattttgttgtactgtatcagcacctagttcattactcttgatggagggggaggatccgccttcttagatttctttttctatttatttttccatctaggattagaaccgtatacttggtagatagtaggaacggcacattatggcaaaaaaaagtttgattcagagagagaggaagcggcagaaattagaacagaaatatcatttgattcgtcgatcttcaaaaaaaaagataagaagcaaagtttaccctttgagtttgagtgaaaaaacgaaaatgcgagaaaaattgcaatccctgccacgtaatagtgcaccgacacgccttcatcgacgttgttttttgaccggaagacctagagctaactatcgagactttgggctatccggacacatacttcgagaaatggtttatgcatgtttgttaccgggtgcaacaagatccagttggtaaggataaaataccctttcgtatttgtatggatttctagaattgatgatcgtagaagagccctctttaccattctgtataaatggactattctatttgtatagatatggtagaggggcgtattcaaccccccttttatccactagttcccctctctttagtttaacaggatagaacagtttggtagctgacaaggctcataaccgtggggttgcgggttc

SEQ ID NO: 3545 - DNA, 1083 bp, Oryza sativa
tttttttagttattcactggagcaattatatattgaagtcaatctgaggcaagtgttcggatctattatgacataaggattgggtgcctaacggactttttttatcttggatttctccacgtaacaaaaaaacctttttttaatttaaaaagctagtctattttttttaagagtataagtccctatctatatctactttccttgagcataatatagatttttttattcgattccaaattccaagataactcattagaattattaataagatggtcctgatatattagcaatatttatattgcccctttttattcgctttattacttctattctagaccctatcgtttatccttatgaaatataatataaaatagaaggcagaggaaagagatataatgaaattcttgattcgatcttccgacctaatttatttgattaatggatcaacaaccaaacccccattttctgaaaaaggagagtggtcttattcaaattcaaagcgcttcgtaatcttcaaccagttctgtgcttcaatataatttcccggagtaagcgctatagcttgtttccaatactcagcagcttgatcaaaccaagcttctgcaatttctgaatcaccctgtagaatggcctgttctccccgtcgcacgtaatgacagatcacggccatattattaaaagcttgtggtaagaaggggtttcgttctagtgcccggaaataatattccaaagcctttgtatgctctccattgcttgtgtgtataaggcctatgttatagagtatataacttcgatcatagggatcaatttctagtcgcgtagcttcataataattttgcaaagcttccgcataatttccttcggattgagccaacatcctcaaatcgcaccatctctataataagtaaatgcccttttttccccggaggttgtcggaattattcgcaataaaatattggctacaattgagaaggtcttatcaatgaaatttccatttatacgggatctaggcataattcccaacccattctatcattctatatagaattcttttcattccttcacaaaataacataaaaaaaa

SEQ ID NO: 3546 - DNA, 2969 bp, Amorphophallus konjac
tatattttttttagaattagtctctttttatgttattttgtactgtacaattcctttgtttgtgagatcattttccccgaggggaaatgagaagaattatagaatgggttgctaattatgcctagatctcggataaatggaaattttattgataagaccttttcaattgtagccaatatcttattacgaataattccgacaacttcaggagaaaaagaggcatttacctattacagagatgggatgtcagctcaatctgaaggaaattatgcggaagctttacaaaattattatgaagctatgcgattagaaattgatccctatgatcgaagttatatactctataacataggccttatacacacaagtaatggagagcatacgaaggctttggaatattattttcgagcactagagcggaatccattcttaccacaagcttttaataatatggccgtgatctgtcattaccggggagaacaggccattcgacagggtgattctgaaattgcggaggcttggtccgatcaagctgctgagtattggaaacaagctatagcgcttactccgggtaattatattgaagcacataattggttgaagataacgaggcggttcgaataagaccacctctcctttttaattcatgaaaatgggttagttggatccatcaaattaattaaaaaaaaaatggatcgtttccctgagaagatccaatcaaggaatttcatcccttccctttctaaaatcattcttctattttgttttggatggtgtctcataaggaaggataaatcaaatggtacgaatacagtatagaatataactaataaaaccaaaaaagatacttttgagtggttaaatatagataaagatatcggaatgatctttatcttattgattactaatgaaattatcttgtgatttgtaattagaatttgtaattagagtaataaggtatttattatgttccatccaagtggatccatacatattcagatatgaatacacgagattgcacaaaaagtgttttttcgtcagaccgggaaagtggtcaaaagcaaaaaaggtccgttgagcacctaatcgctatgtcataatagatccgaacacttgccccgaatcgacttcaatatcataattgctctagtgaataactaaaaaaataaatggatagatgggaggtagcaaagaagggaactaatcataaatatctatctctcagaggttcactaaaaacttgactgttggcaggtctctttgtatgtgttgttcggaaagaggaggactcaatgattattagttcgccggaaccagaagttaaaattttggtggataggaatcccgtaaaaacgtcttttgaggaatgggccagacccggccacttctcaagaacaatagccaagggccctgatactaccacttggatctggaacctacatgctgatgctcacgattttgatagtcataccagtgatttggaggagatctctcgaaaagtatttagtgctcatttcggtcaactctccattatctttctttggctgagtggcatgtacttccatggcgctcgtttttctaattatgaagcatggctaagtgatcctactcacattgcacccagtgcccaggttgtttggccaatagtggggcaagaaatattaaatggtgatgtgggcgggggtttccgaggaatacaaataacctctgggttttttcagatttggcgagcatctggaataactaatgaattacaactctattgtactgcaatcggtgcattggtctttgcagcattaatgctttttgccggttggttccattatcacaaagctgccccaaaactggcttggttccaagatgtagaatccatgttgaatcaccacttagcggggttactaggacttgggtctctttcttgggcggacaccaaatccatgtatctttgccgattaaccaatttctcaacgctggagtggatcctaaggagataccacttcctcatgaatttatcttgaatcgggatcttttggctcagctttatcccagttttgccgagggagcaaccccttttttcaccttgaattggtcaaaatacgcggattttctgagttttcgtggaggattagatccaataactggaggtctatggttgagcgatactgcacaccatcatttagccattgctattctttcctgatagctggtcatatgtataggaccaactgggggattggtcatggcttgaaagacattttagaggctcataaaggtccatttaccggtcagggacataaaggcctatatgaaatcctaacaacatcatggcatgctcaattatctcttaacctggctatgttaggctctttaaccattgttgtagctcaccacatgtactcaatgcccccttatccatacttagctattgactatggtacacaactttcattgttcacacaccatatgtggattggtggatttctcatagttggggctgccgcacatgcagccatttttatggtaagagactacgatccaactactcgatacaacgatctattagatcgtgtccttaggcaccgcgatgcaatcatatcacatctcaactgggtctgtatatttctaggttttcacagtttcggcttgtatattcataatgataccatgagcgctttagggcgtcctcaagatatgttttcagataccgctatacaattacaacccatctttgcccaatggatacaaaacacccatgctttagcacctggtacaacagctcctggtgcaacagcaagcaccagcttaacttggggaggaggtgagttagtagcagtaggcggcaaagtcgcttgttacctatccattagtaccgcagctttttggccatcacattcatgcatttacgatccatgtgactgtattgatactactaaaaggtgttctatttgctcgcagttcccgtttaatac

SEQ ID NO: 3547 - DNA, 7092 bp, Tragopogon dubius
gagggaaagagagggattcgaaccctcggtaagcgaaagcctacatagcagttccaatgctacgccttcaaccactcggccatctctcctacataatgattatgacccaaaaacctaaaatcgagtgaatagtgaatcattctagattattgggtaggtacaaccaatcaattctaactatacagcgatctaaatcgaaaatttttcatcataatcatagtaaaagcaggatctttccttctaggctgggggataaagataaaattgttttcttacaaaaactgttcaaaaaattctattcatgtttgcaaaaacaatgttctcttctttttctgaattctctatttatactatcccgactggattaaatcaataaattagaaattctaatgaatcgactgagcgagtggtctatattttgtagactatggttaatggatatctttagatcatgattctatttagactacgattccatatcagaagaattctcaaattactttctaggccagttttagagttatcaacaaaaatccttatcccatctatctattacaaatacaaattgataaacaatttttttatagttgattgtatagtgtatacccctaagtacacaacacaaaaaaataggtggttattctattttcatgatacaatgattattcgatcctttttcttctttgtatcataattcaatcaactgaggttattctaagctgtaacttcaatcaaataagaatagtttctttcgttggtagactgttctagtaagatggaatcgaatctggttcccatatttctttcttagttcttatcaattcctgtaatgtaaaaaataacaatttgaatattgaatttttgaatagaaggaccatatctttttttgttttttttaatgagaatgaatctgtttttatgttatttcgtactgtataattcttttccttgtgggatcattttcccgcgagaagtaatgagaacaatgatagaatggattgctacctatgcctagatcgcggataaatggaaattttattgataaaaccttttcaattgtagccaatatcttattacgaataattccgacaacttcaggagaaaaagaggcatttacctattacagagatgggatgtcagctcaatccgaaggaaattatgcggaagctttacagaattattatgaagctatgcgactagaaattgatccctatgaccgaagttatatactctataacataggacttatccacacagtaacggagaacatacgaaagctttggaatattattttcgagcgctcgaacgaaacccattcttaccacaagcttttaataatatggccgtgatctgtcattaccggggagaacaggccattcggcagggggattctgaaattgcggaggcttggttcgaccaagccgctgagtattggaaacaggctatagcacttactcctggtaattatattgaggcgcataattggttgaagatcactagacgtttcgaataaaagacgatacccttttgtttattttagttattatttaggttgttttagatattttttttagattgttttagatattttttgatttgttataattaattgtttgttggccccatcagtcaaataaaatagatcattcctttgggaagaaccaatcaaagaatttctttatatcccttctaagcgttctatttcgtatggtatttagtaggaataaaggatacttacaaaatctattttttcttgtctttctttttttctattaaaaaaaaaagactattactattaaaactaatcaaatcaaaaatacttcgaatcactgaatatatgaaaatttattagtaatggctaatgcctgctcgcgtgatttggaatagagtaatagtactctatctaaaaaacatgaagcagctccatctaagaacttttcattgaaaaaagtagtttttgtatcaatctaaagtcagaaagggttttataagatccaaaaggtccgttgagcgcctcatggctatgtcataatagatccgaacacttgccccggatcgacttccagatcataattgctctagtgaataactaaagaaaatagatagatgggagatagaaaactagaagagaaagaaactaattatataatagaaatatctctccgagattcactaattatttgactgttggcgggtctctttgtatgtgttgtccggaaagaggaggactcaatgattattcgttcgccggaaccagaagtaaaaattttggtagatagggatcacataaaaacttcattcgaggaatgggctagaccgggtcatttttcaagaacaatagctaaaggccctgaaactaccacttggatctggaacctacatgctgatgctcacgatttcgatagccataccagtgatttggaggagatctctcgaaaagtatttagtgcgcatttcggtcaactctccatcatcttcctttggctgagtggcatgtatttccacggtgctcgtttttccaattatgaagcatggctaagtgatccgactcacattgggcctagtgcccaggtggtttggccaatagtgggccaagaaatattgaatggtgatgtgggcgggggcttccgaggaatacaaataacctctggtttttttcagatttggcgagcatctggaataactagcgaattacaactctattgtaccgcaattggtggattgatctttgcagcattaatgctttttgctggttggtttcattatcataaagctgctccaaaattggcttggtttcaagatgtagaatctatgttgaatcaccatttagcggggctactaggacttgggtctctctcttgggcggggcatcaagtacatgtatctttaccgattaaccaatttctaaacgctggagtagatcctaaagaaataccacttcctcatgaatttatcttgaatcgggatcttttggctcaactttatcccagttttgccgagggagcaaccccatttttcaccttgaattggtcaaaatatgcggactttcttacttttcgtggaggattagacccagtaactggaggtctatggctaactgatactgcacaccatcatttagctattgcaattctttttctgatagcgggtcacatgtataggaccaactggggcattggtcatggtctaaaagatattttagaagctcataaaggtccatttacgggccagggccataagggtctatatgagatcctaacaacgtcatggcatgctcaattagctcttaacctagctatgttaggctctttaaccattgttgtagctcaccatatgtatgccattccatatctagctactgactatggtacacaactgtcattgttcacacatcatatgtggattggtggatttctcatagttggtgctgctgcgcatgcagccatttttatggtaagagactatgatccaactactcgatacaacgatctattagatcgtgttcttaggcatcgcgatgcaatcatatcacatctcaactgggcatgtatatttctaggctttcacagttttggtttgtatattcataatgataccatgagcgctttagggcgtcctcaagatatgttttcagataccgctatccaattacaacccgtctttgctcaatggatacaaaacacccacgctttagcacccggtgcaacggcccctggtgcaacagcaagcaccagtttaacttgggggggcggtgatttagtagcagtgggtggcaaggtagctttgttacctattccattaggaaccgcggattttttggtacatcacattcatgcatttacgattcatgtgacggtattgatacttctgaaaggtgttctatttgctcgtagctcccgtttgataccggataaagcaaatcttggttttcgttttccttgtgatgggcctggaaggggggggacatgtcaagtatcggcttgggaccatgtcttctggatgtacaatgcaatttcagtagtcatatttcatttcagttggaaaatgcagtcagatgtttggggcagtataagcgatcaaggagtagtaactcatatcacaggaggaaactttgcgcagagttctattactattaatgggtggctccgcgatttcttatgggcacaggcatcccaggtaattcagtcttatggttcttcattatccgcatatggcctttttttcctaggtgctcattttgtatgggcttttagtttaatgtttttattcagtggacgtggttattggcaagaacttattgaatcgatcgtttgggctcataataaattaaaagttgctcctgctacccagccgagagccttaagcattgtacaaggacgtgctgtaggagtaacccattaccttctgggtggaattgccacaacatgggcgttcttcttagcaagaattattgcagtaggataatggctaggaggatttgaaaggcattatggcattaagatttccaaggtttagccaaggcttagctcaggaccccactactcgtcgtatttggtttggtattgctactgcgcatgacttcgagagtcatgatgatattactgaggaacgtctttatcagaatatttttgcttctcacttcggtcaattagcaataatttttctgtggacttccggaaatctctttcatgtagcttggcaaggaaattttgagtcatgggtacaggaccctttacatgtaagaccattgctcatgcaatttgggatcctcattttggtcaaccggctgtagaagcttttactcgagggggtgctcttggcccagtgaatatcgcctattctggtgtttatcagtggtggtatacaatcggtttacgaactaatgaagatctttatactggagctctttttctattatttatttctgccatatctttaatagcgggttggttacacctacaaccgaaatggaaaccgagtgtttcctggttcaaaaatgcagaatctcgtctcaatcatcatttatcaggactcttcggcgtaagctccttggcttggacagggcatttagtccatgtcgctattcctgcatccagaggggagtacgttcgatggaataatttcttagatgtattaccacatccccaagggttaggcccactttttacaggtcagtggaatctttatgctcaaaatcccgattcaagtagtcatttatttggtacctcccaaggagcaggaactgccattttaacccttctcgggggattccatccacaaacccaaagtttatggctgactgatatggctcatcatcatttagctattgcatttcttttctcattgctgggcatatgtatagaactaattttgggattgggcacagtatgaaagatcttttagatgcacatatccctccgggagggcgattggggcgtgggcataaaggcctttatgacacaattaataattcgcttcattttcaattaggtcttgctctagcttctttaggggttattacttctttggtagctcaacacatgtactctttacccgcttatgcatttatagcacaagactttactactcaagctgcgttatatactcatcaccaatacatcgcaggattcatcatgacaggagcttttgctcatggagctatattttttattagggattacaatccggaacagaatgaggataatgtattggcacgaatgttagaacataaagaagctatcatatctcatttaagttgggccagcctatttttgggtttccataccttgggactttatgttcataatgatgtcatgcttgcctttggtactccggagaagcaaatcttaatcgaacctatatttgctcaatggatacaatccgctcatggtaaaacttcatatgggttcgatatacttttatcttcaacgaatggcccggcattcaatgcgggtcgaagcatatggttgccgggttggttaaatgctattaatgagaatagtaattcactattcttaacaataggtcctggagactttttggttcatcatgctattgctctgggtttacatacaactacgttgatcttagtaaaaggggcgttagatgcacgtggttccaagttaatgccagataaaaaggatttcggttatagttttccgtgcgatggcccaggacgaggcggtacttgtgatatttcggcttgggacgcattttatttggcagttttttggatgttaaataccattggatgggttactttttattggcattggaagcacattacattatggcagggtaatgtttcgcagtttaatgaatcttccacttatttgatgggctggttaagagattatttatggttaaactcttcacaacttattaatggatataacccttttggtatgaatagtttatcagtctgggcatggatgtttttatttggacatcttgtttgggctactggatttatgtttttaatttcctggcgtggatattggcaggaattgattgaaactttagcatgggctcatgaacgcacacctttggccaatttgattcgttggagagataaaccagtggcactttccattgtacaagcaagattggttggattagcccacttttctgtaggttatatatttacttatgcagctttcttgattgcctctacatcagggaaatttggttaattttgttaattgaatcttttgtatccgcgataatctcatttctttcgatgaagaagagatccaccttcttatcttatatttctacatctaggatccgacttgtatcatggatactaataggaacttaatgagtatggcaaaaaaaagtttgattcagagggaaaagaagaggcaaaaattggaacagaaatatcatttgattcgtcgatccttaaaaaaagaaataagcaaagttcgatcgttgagtgacaaatgggaaatttatggaaagttacaatccctaccgcggaatagtgcacctacacgccttcatcgacgttgtttttcaacttgggaccatgttcttcttaggactattctggatgtacaatgcaatttcagtagtcatatttcatttcag

SEQ ID NO: 3548 - DNA, 507 bp, Panax ginseng
atgcctagatcgaggataaatggaaattttattgataagaccttttcaattgtagccaatatcttattacgaataattcccacaacttcaggagaaaaagaggcatttacctattacagagatgggatgtcagctcaatccgaaggaaattatgcggaagctttacagaattattatgaagctatgcgactagaaattgatccctacgatcgaagttatatactctataacataggacttatccacacaagtaacggagaacatacaaaagctctggaatattattttcgagcgctagaacgaaatccgttcttaccacaagcttttaataatatggctgtgatctgtcattaccggggagaacaggccattcgacagggagattctgaaatagcggaggcttggttcgatcaagccgctgagtattggaaacaagctatggcgcttactcctggtaattatattgaagcgcataattggttgaagatcacgaggcgtttcgaataa

SEQ ID NO: 3549 - DNA, 507 bp, Populus trichocarpa
atgcctagatcccggataactggaaatttgattgataagaccttttcaattgtagccaatatcttattacgaataattccgacaacttcaggagaaaaagaggcatttacttattacagagatggtatgtctgctcaatccgaaggaaattatgcggaagctttacagaattattatgaagctatgcgactagaaatcgatccctatgatagaagttatatactctataatataggccttattcacacaagtaatggagaacacacaaaagctttggaatattattttcgggcattagaacgaaaccctttcttaccacaagcttttaataatatggccgtaatctgtcattaccgaggagaacaggccattcggcagggagattctgaaattgcggaggcttggttcgaccaagccgcggagtattggaaacaagctatagcgcttactcctggaaattatattgaagcgcagaattggttgaagatcacaaggcgtttcgaataa

SEQ ID NO: 3550 - DNA, 1144 bp, Guizotia abyssinica
acggggaccggattaaatcaataaattagaaattataatgaagttactgagcgaggggtctatattttatgattaatagatatctttagatcatgagtctatttagactatgattccatatcagaagaattctcaaattgctctataggacccgttttagagttatcaacaaaaatccttatcctatctatattctattaaaaatacaaattgataattttttatagttgattggatagtgtatacccgtaaatacacaacacaaaaaatgggcggttattctattttcatcatacaatgattctttttcttctttggatcataattcaatcaactgaggttattctaagctgtaacttcaatcaaataagaagagtttctttcgttggtagactattccagtaagatggaatcgaatccggttcccatatttatttcttagttcttatcaattcttgtaatgtaaaaaagaacaatttgaatattaaaaaatttaatattgaatagacggaccatatctttttttttatgataatgaatgtgtttttatgttatttcgtactgtataattcttttccttgtgggatcattttcccgcgagaagtaatgagaacaatgatagaatggattgttacctatgtctagatcgcggataaatggaaattttattgataaaaccttttcaattgtagccaatatattattacgaataattccgacaacttcaggagaaaaagaggcatttacctattacagagatgggatgtcagctcaatccgaaggaaattatgcggaagctttacagaattattatgaagctatgcgactagaagttgatccctatgaccgaagttatatactctataacataggacttatccacacaagtaacggagaacacacgaaagctttggaatattattttcgagcgctcgaacgaaacccattcttaccacaagcttttaataatatggccgtgatctgtcattaccggggagaacaggccattcggcagggggattctgaaattgcggaggcttggttcgaccaagccgctgagtattggaaacaggctatagcacttactcctggtaattatattgaagctcataattggttgaagatcactagacgtttcgaatag

SEQ ID NO: 3551 - DNA, 507 bp, Pisum sativum
atgactagatctaggataaatggaaattttattgataagacctttaccattgtagccaatatcttattacgaataattccgacaacttctggagaaaaagaggcattcacttattacagagatgggatgtcggctcaatcggaaggaaattatgcggaagctttacagaattattatgaggctatgcgactggaaattgatccctatgatcgaagttatatactttataacataggccttatccacacaagtaacggagaacatacaaaagctttggaatactattttcgggcactcgaacgaaaccctttcttacctcaagcttttaacaatatggccgtgatctgtcattaccgcggagaacaggccattcgacagggagattctgaaattgcagaatcttggtttgatcaagctgctgaatattggaaacaagctatagcccttacccctggtaattatattgaggcacaaaattggttgaagatcacagggcgttttgaataa

SEQ ID NO: 3552 - DNA, 895 bp, Vigna unguiculata
atgcctagatctcggataaatgaaaattttattgataagaccttttcaattgtagccaatatcttattacgaataattccgacaacttcaggagaaaaaagggcattcacttattacagagatggtatgtcagctcaatctgaaggaaattatgcagaagctttacagaattattatgaggctatgcgactggaaattgatccctatgatcgaagttatatactttataacataggccttattcacacaagtaacggagaacatactaaagctttggaatattattttcgggcgctcgaacgaaacccatttttaccccaagcttttaataatatggccgtgatctgtcattaccgaggagaacaggccattcggcagggagactcagaagttgcggagtcttggtttaatcaagccgctgaatattggaaacaagctatagctctcacccccggtaattatattgcagcacagaattggttgaagatcacagggcgttttgaataagaacactctgtttcttttttttcttatatatttatctatctatataaagatatagatagataaatatatattgttataaattcttgtttcttgtccctatcaaattcaaaaatcatttctataggaacgaccaatcacataatttaaatatatcccttctaattttgttcgattttgtctagtatttcatagaaataaacgagatgtggatacagtagataattttctccttttttctgttatttaaactaatattcaatcaaattaagaaaagagaccttcaaaaaaagaaataaaatataggtatattgcctaataatgaatgctaatgcctgctcaatttgaaatagagtacatacttatactttatctaaaaaaaaaaaaaaaa

SEQ ID NO: 3553 - DNA, 650 bp, Cicer arietinum
tttttacgttatttcgtactgtattgtacaattcctttgtttgggggattattttctcacgcgaaaaaaaaatgaaattatagaatggattgctacctatgactagatctcgtataaatggaaattttattgataagaccttttcgattgtagccaatatattattacgaataattccgacaacttctggagaaaaagaggcattcagttattaccgagatgggatgtcggctcaatctgaaggaaattatgcggaagctttagagaattattatgaggctatgcgactggaaattgatccctatgatcgaagttatatactttataatataggccttatccacacaagtaacggagaacatacgaaagcgttggaatactattttcgggcactcgaacgaaacccgtttttacctcaagcttttaacaatatggccgtgatctgtcattaccgtggagaacaggccattcgacagggagattctgaaattgccgaatcttggtttgatcaagctgctgaatattggaaacaagctatagcgcttacccccggtaattatattgaagcacagaattggttgaagatcacagggcgttttgaataagaaccctctgtttattattttctttgaatttgaattcctgcagcc

SEQ ID NO: 3554 - DNA, 507 bp, Solanum tuberosum
atgcctagatcacggacaaatggaaattttattgataagaccttttcaattgtagccgatatcttattacgagtaattccgacaacttcaggagaaaaagaggcatttacctattacagagatgggatgtcggctcaatccgaaggaaattacgcggaagctttgcagaattattatgaagctatgcgactagaaattgatccctatgatcgaagttatatactctataatatagggcttatccacacaagtaatggagaacatacgaaagctttggaatattattttcgagcactagaacgaaacccattcttaccacaagcttttaataatatggccgtgatctgtcattaccggggagaacaggccattcaacagggagattctgaaattgcagaggcttggttcgatcaagccgctgagtattggaaacaggctatagcgcttactcccggtaattatattgaagcgcataattggttgaagatcacgagacgtttcgaataa

SEQ ID NO: 3555 - DNA, 784 bp, Solanum phureja
aaaaaaaataagtttttatgttatttcgtactatacaattcttttctttgtgggatctttttcccacgagaggtaatgaaaagaattctagaatggattgctacctatgcctagatcacggacaaatggaaattttattgataagaccttttcaattgtagccgatatcttattacgagtaattccgacaacttcaggagaaaaagaggcatttacctattacagagatgggatgtcggctcaatccgaaggaaattacgcggaagctttgcagaattattatgaagctatgcgactagaaattgatccctatgatcgaagttatatactctataatatagggcttatccacacaagtaatggagaacatacgaaagctttggaatattattttcgagcactagaacgaaacccattcttaccacaagcttttaataatatggccgtgatctgtcattaccggggagaacaggccattcaacagggagattctgaaattgcagaggcttggttcgatcaagccgctgagtattggaaacaggctatagcgcttactcccggtaattatattgaagcgcataattggttgaagatcacgagacgtttcgaataaaagaggaccccgtttatttattatcctttatttagaatcttagcctagtattttatttttttatttagaatttagatatttgttataattaattgtttgttggacccatcagatcagttaacgaaaaaacggattattcctttgcttttggaagacccaatcacataattt

SEQ ID NO: 3556 - DNA, 610 bp, Plantago ovata
attcttttctttgcgagattattttcccgcgagtcggatgagaagaattatagaatggattgttatttatgtctagatcgcgtacaaatggaaattttattgataagaccttttcaattgtagccaacatcttattgcaaataattccgacaacttcaggagaaaaggaggcatttacctattacagagatggaatgtcagctcaatccgaaggaaattatgcggaagctttacagaattattatgaagctatgcgactagaaatggatccctatgatcgaagttatatactctataatataggtcttatccatacaagtaatggagaacatacgaaagctttggaatattattttcgagcactcgaacgaaaccccttcttaccacaagcttttaataatatggccgtgatctgtcattaccggggagaacaggccgttcgcgagggagattcggaaattgcggaggcttggtttgatcaagccgccgagtattggaaacaggctatagcgcttactcccggtaattatattgaagcacataattggttgaagatcacaaggcgtttcgaataaaaaggcatcatttttctatttatttgatttgttat

SEQ ID NO: 3557 - DNA, 507 bp, Coffea canephora
atgcctagatcacaaataaatggaaattttattgataagaccttttcaattgtagccaatatcttattacgaataattccgacaacttcaggagaaagagaggcatttacctattacagagatggtatgtcagctcaatccgaaggaaattatgcggaagctttacagaattattatgaagctatgcgactagaaattgatccctatgatcgaagttatatactctataatataggccttatccacacaagtaatggagaacatacgaaagctttggaatattattttcgagcactagaaagaaacccattcttaccacaagcttttaataatatggccgtcatctgtcattaccgtggagaacaggccattcgacagggagattcggaaatagcggaggcttggttcgatcaagccgctgagtattggaaacaggctatatcgcttactcctggtaattatattgaagcgcataattggttgaagatcacggggcgtttcggataa

SEQ ID NO: 3558 - DNA, 506 bp, Cajanus cajan
aatggattgctacctatgcctagatctcggataaatggaaattttattgataagaccttttcaattgtagccaatatcttattacgaataattccgacaacttcaggagaaaaggaggcattcacctattacagagatgctcaatctgaaggaaattatgcggaagctttacagaattattatgaggctatgcgactggaaattgatccctatgatcgaagttatatactttataacataggccttatccacacaagtaacggagaacatacgaaagctttggaatattattttcgggcactagaacgaaacccgttcttaccacaagcttttaataatatggccgtgatctgtcattacgccattcgacagggagattctgaaattgcggaggcttggtttgatcaagccgctgagtattggaaacaagctatagcccttacccctggtaattatattgaagcgcagaattggttgaagatcacagggcgttttgaataagagca

SEQ ID NO: 3559 - DNA, 6117 bp, Arabidopsis thaliana
attatgactgagtatctgggtgaatagcgagttattcatcgttttttagattatggttaatagataccctttttgaccggaaaatttggaagtagatagaaggttttttttaatgagtccgcttttatgttagttcgtactatacaattcctttgtttgtgagaaaattttctcacaaaagaaaaggtaaaggaaataaaaagagttagagaatggattactacctatgccaagatcgcgtataaatggaaattttattgataaaacctttacaattgtagccgatatcttattacgagtcattccgacaacttccggagaaaaagaggcatttacttattacagagatgggatgtcggctcaatctgaaggaaattatgcggaagcattacagaattattatgaagctatgcgactagaaattgacccctatgatcgaagttatatactctataatataggccttatccatacaagtaatggggaacataccaaagctttagaatattattttcgggcattagaacgaaacccctttttaccacaagcttttaataatatggctgtgatctgtcattaccgtggagaacaggccattcaacaaggagattctgaaatggcggaggcttggttcgctcaagccgctgagtattggaaacaggctataacgcttactcctggtaattatattgaagcacagaattggttgacgatcacgaggcgcttcgaataagaactttccctttgtttctttttttttttattctattctataatatttgctatttgtttttataattaattgttttttggtttcttggtcctctcggtcaaataaaacagatccttgttcctattagaagaaccaataaaagacaaaaatttcattatatccttttctcaaatcgttctattttatctggtagtctctaggggtaagtagtacatgaatatgagaatatctatatatttagttttttctatttgttattttctactattaaaactaaaaccaataaaagatatttcaaaatgactaaatatcaatactagactttttcttagtaatgactaataagcatttattgaaataggataatattatctataaaaaaaataggctacatttcggaacttaataattgaaatatgaatacactcgattaggttataaaaaaagctctttgtgtaccaatgtaaaggcgctaaaactttttttaattataaaaaagggtccgttgagcaccctatggatatgtcataatagatccgaacacttgccccagatcgacttccagatcataattgctctagtgaataactaaagaaaatagatgaatagatggaagatagaagagaaagaaaaaaaaattctaagtatctatcatcggttcactaattacttgagtgactgttggcgggtttctttgtatgtgttgtccggaaagaggaggactcaatgattattcgttcgccggaaccagaagtcaaaattttggtagatagggatcccataaaaacttctttcgaggaatgggctaaacccggtcatttctcaagaacaatagctaagggacctgatactaccacttggatctggaacctacatgctgatgctcacgattttgatagtcataccagtgatttggaggaaatctctcgaaaagtatttagtgcccatttcggccaactctctatcatctttctttggctgagtggcatgtatttccatggtgctcgtttttccaattatgaagcatggctgagtgatcctactcacattggacctagtgctcaggtggtttggccaatagtgggccaagaaatcctgaatggagatgtgggcggaggcttccgaggaatacaaataacctcaggcttttttcagatttggcgagcatccggaataactagtgaattacaactttattgtaccgcaattggcgcattggtcttcgcagccttaatgctttttgctggttggttccattatcacaaagcagctccaaaattggcttggttccaagatgtagaatctatgttgaatcaccatttagcagggctactaggacttgggtccctttcttgggcaggacatcaagtacatgtatctttaccgattaaccaatttctaaacgctggagtagatcctaaagaaataccgcttcctcatgaatttatcttgaatcgggatcttttggctcaactttatccaagttttgctgaaggagcaactcccttttttaccttaaattggtcaaaatactcggaatttcttacttttcgtggcggattagatccagtgactgggggtctatggttaaccgatatagcacatcatcatttagctatcgcaattctttttctaatcgcgggtcatatgtataggaccaactggggtattggtcatggtataaaagatattttagaggctcataaaggtccatttacaggccaaggccataaaggcctatatgaaattctaacaacatcatggcatgctcaattatctcttaacctagctatgttaggctctttaaccattattgtagctcaccatatgtattccatgcccccttatccatatctagctactgactatgctacacaactgtcattgttcacacatcacatgtggattggtggatttctcatagttggtgctgctgcgcatgcagccatttttatggtaagagactatgatccaactaatcgatataacgatttattagatcgtgtcctgaggcatcgcgatgcaatcatatcacatctcaactgggtatgtatatttctaggcttccacagttttggtttgtatattcataatgataccatgagtgctttagggcgtccacaagatatgttttcagatactgctatacaattacaaccagtctttgctcaatggatacaaaatacccatgctttagcacctggtgtaacagcccctggtgaaacagcgagcaccagtttgacttgggggggcggtgagttagtagcagtgggtggcaaagtagctttgttacctattccattaggaacggcagattttttggtacatcatattcatgcatttacaattcatgtgacggtattgatactgttgaaaggtgttctatttgctcgtagctcgcgtttaataccagataaagcaaatcttggttttcgtttcccttgtgatgggccgggaagaggaggaacatgtcaagtatctgcttgggatcatgtcttcttaggactattctggatgtacaatgctatttccgtagtaatattccatttcagttggaaaatgcagtcagatgtttggggtagtataagtgatcaaggggtggtaactcatattactggaggaaactttgcacagagttccattactattaatgggtggctccgcgatttcttatgggcacaagcatctcaggtaattcagtcttatggttcttcgttatctgcatatggtctttttttcctaggtgctcattttgtatgggctttcagtttaatgtttctattcagcgggcgtggttattggcaagaacttattgaatccattgtttgggctcataataaattaaaagttgctcctgctactcagcctagagccttgagcattatacaaggacgtgctgtaggagtaacccattaccttctgggtggaattgccacaacatgggcgttcttcttagcaagaattattgcagtaggataatggctaggaggatttgaaaggcattatggcattaagatttccaaggtttagccaaggcttagctcaggaccccactactcgtcgtatttggtttggtattgctaccgcacatgacttcgagagtcatgatgatattactgaagaacgtctttatcagaatatttttgcttctcatttcgggcaattagcaataatttttctgtggacttccggaaatttgtttcatgtagcttggcaaggaaattttgagacatgggtacaagaccctttacatgtaagaccgattgctcatgctatttgggatcctcattttggtcaaccggctgtggaagcgtttactcgaggaggtgctcttggcccggtgaatatagcttattctggtgtttatcagtggtggtatacaatcggtttacgtactaatgaagatctttatactggagctctttttctattatttctttctgccctatccttaatagggggttggttacacctacaaccaaaatggaaaccaagagtttcgtggttcaaaaatgctgaatctcgtctgaatcatcatttgtcaggactattcggggtaagctcattggcttggacaggtcatttagtccatgtcgctattcctgcatccaggggggaatatgttcgatggaataatttcttaaatgtattaccgcatccccaagggttaggcccactttttacgggtcagtggaatctttatgctcaaaaccccgactcgagtagtcatttatttggtacctcccaaggatccggaactgccattctaacccttcttgggggattccatccacaaacgcaaagtttatggctaaccgatatggcacatcatcatttagctatcgcaattcttttcctcattgcgggtcatatgtatagaacgaactttggaatcggacacagtataaaagatcttttagaagcacatattcctccgggaggacgattggggcgtgggcataagggtctttatgacacaatcaataattcgattcattttcaattaggccttgctctagcctccttaggagttattacttccttggtagctcaacacatgtactctttacctgcttatgcgttcatagcgcaagattttacgactcaagctgcgttatatacccatcaccaatatattgcaggattcatcatgacaggagcttttgctcatggagctatcttttttattagagattacaatccagaacagaatgaggataacgtattagcaagaatgttagaccataaagaagctatcatatcccatttaagttgggccagcctctttctagggttccatactttgggactttatgttcataacgacgtcatgcttgcttttggtactcccgaaaaacaaatcttgatcgaacctatatttgcccaatggatacaatctgctcatgggaaaacttcatatggatttgatgtacttttatcttcgacaagtggcccagcatttaatgcgggtcgcagcatatggttgcctggctggttaaatgctattaatgagaatagtaattcattattcttaacaataggtcctggagatttcttggttcatcatgctattgctttaggtttacatacaactacattgatcttagtaaaaggtgctttagatgcacgtggttccaagttaatgccagataaaaaggatttcgggtatagttttccttgcgatggtccgggacgaggtggtacttgtgatatttcggcttgggacgcattttatttggcagttttctggatgttaaatactattggatgggttactttttattggcattggaaacacatcacattatggcagggtaacgtttcacagtttaatgaatcttccacttatttgatgggatggttaagagattatctatggttaaactcttcacaacttatcaatggatataacccgtttggtatgaatagtttatcagtctgggcatggatgttcttatttgggcatcttgtttgggctacaggatttatgttcttaatttcctggcgtggttattggcaggaattgattgaaactttagcgtgggctcatgaacgcacacctttggcaaatttgattcgctggaaagataaaccagtagctctttcaatcgtgcaagcaagattggttggattagctcacttttctgtaggttatatattcacttatgcggctttcttgattgcctccacatcgggcaaattcggttaattatttatgtattctatccgcaatcatatattttttttaataaaaaaaatataggtatgcactcttatatttatttctacatctaggatccgatttgtatcattatcattgataataagaggaactgaagcattatggcaaagaaaagtttgatttatagggagaagaagaggca

SEQ ID NO: 3560 - DNA, 516 bp, Lactuca sativa
aatggattgctacctatgcctagatcgcggataaatggaaattttattgataaaaccttttcaattgtagccaatatcttattacgaataattccgacaacttcaggagaaaaagaggcatttacctattacagagatgctcaatccgaaggaaattatgcggaagctttacagaattattatgaagctatgcgactagaaattgatccctatgaccgaagttatatactctataacataggacttatccacacaagtaacggagaacatacgaaagctttggaatattattttcgagcgctcgaacgaaacccattcttaccacaagcttttaataatatggccgtgatctgtcattacgccattcggcagggggattctgaaattgcggaggcttggttcgaccaagccgctgagtattggaaacaggctatagcacttactcctggtaattatattgaagcgcataattggttgaagatcactagacgtttcgaataaaagacgatacccttt

SEQ ID NO: 3561 - DNA, 495 bp, Medicago truncatula
aatggattgctacctatgactagatctcggataaatggaaattttattgataagacctttaccattgtagccaatatcttattacgaataattccgacaacttctggagaaaaagaggcattcacttattacagagatggaaattatgcggaagctttacaaaattattatgaggctatgcgactggaaattgatccctatgatcgaagttatatactttataacataggccttatacacacaagtaacggagaacatacgaaagctttggaatactattttagggcactcgaacgaaaccctttcttacctcaagcttttaacaatatggccgtgatctgtcattacgccattcgacagggagattctgaaattgcggaatcttggtttgatcaagccgctgaatattggaaacaagctatagcccttacccctgggaattatattgaagcacagaattggttgaagatcacagggcgttttgaataagaacac

SEQ ID NO: 3562 - DNA, 3161 bp, Oryza sativa
agttcaaaaaaatctatctaactttattttatgaagttctagtatttttttctaagtagaacttccaatttcgaactagttaatagctaagattaataattaagatctgacattttacggatttcctatactatacatatttctatttgttacactatttctgttatgtaagcccacttagctcagaggttagagcatcgcatttgtaatgcgagggtcatcggttcaaatccgatagtcggcttttttctctatcaatgttccatgaacaaaaatacctctttttctccgaattaaatggagaagccaggatctattatgtcgttctaccctacaattttgctagatacaaaacaataaaataaataatatatatacaaaaattcagatgttgatgaaattccatttttttgtggtacttttagtagattttactctgtttatcctttactttaattcagttttaatttcgatgtattctgtaatgtaaatacaatgaaattaattgtgtaaaatgaaatttcaataaaaaaaggagtcttcatgtcccgttatcgaggacctcgttttaaaaaaatacgccgtctgggagctttaccaggactcactagaaaaacacctaaatccggaagtaatctgaaaaagaaattccattctgggaaaaaagaacaatatcgtattcgtcttcaagaaaaacagaaattgcgttttcattatggtctgacagaacgacaattacttagatatgtacatatcgctggaaaagcaaaaagttcaacaggtcaggttttactacaattacttgaaatgcgtttggataatatcctttttcgattaggtatggcttcaaccattcccgaggcccggcaattagttaaccatagacatattttagttaatggtcgtatagtcgatataccaagttttcgttgcaaaccccgagatattattactacgaaggataaccaaagatcaaaacgtctggttcaaaattctattgcttcatccgacccggggaaattgccaaagcatttgacgattgacacattgcaatataaaggactagtaaaaaaaatcctggataggaagtgggtcggtctcaaaataaatgagttgttagttgtagaatattactctcgtcaaacttgaacttaaggaaaaacggaaaggttcatagaattttcttccccttcccctttcccccgaactaaatcgacctaaggctcttaattcgtattttcccattcacctaacagaaatggattaaccctaggattcctttttgttttttgttctttcctctatgtgtattttacataccatagtaatttggtatagagaatttctattaaataaaggtattgtattattgctggaataaattgtcatttgatttgatacattgtaatcattaacgttgctgaattaagaaaaacggaaagagagggattcgaaccctcggtaaacaaaagtctacatagcagttccaatgctacgccttgaaccgctcggccatctctcctccataatcttattatggaaaaaaaactgagtgaatagcgagttttcctattcctgcagtacaggtacaaccacaaccgcgcgagagttccattgttctattagatagaaaaattccttttcatctaagtggacgggtccaggatttttttactaggaattccgctccctcgaaaagttttagtttgggttttccccaaaccaaagaaaaagagaatggaagaattcttcttattcgataaaaaaggaaccctagaattctgtttgcataaggtatcctaccccatacaatcaaatagaaaatagggtatgggacgattaatgactttgaaaatgcgaaatagttgatgagagaagttgttgttgagaaaagaaataggaaagtggaatgaaatccaatcttagtcaaatattttctatctcttcttgttcaaacagaaggaaaaagagagaatttgggctgagcagaaatacctctcttatccatttggagcatagggatcgatttataagaattgaatggatttgtttttttttatgttattttgtgaaggaatgaaaagaattctatatagaatgatagaatgggttgggaattatgcctagatcccgtataaatggaaatttcattgataagaccttctcaattgtagccaatattttattgcgaataattccgacaacctccggggaaaaaagggcatttacttattatagagatgattttttgaatagaacgaacgaccgtaacggatgttggctcaatccgaaggaaattatgcggaagctttgcaaaattattatgaagctacgcgactagaaattgatccctatgatcgaagttatatactctataacataggccttatacacacaagcaatggagagcatacaaaggctttggaatattatttccgggcactagaacgaaaccccttcttaccacaagcttttaataatatggccgtgatctgtcattactacctatccgacggggagaaacggccttctaccggtgattcagaaattgcagaagcttggtttgatcaagctgctgagtattggaaacaagctatagcgcttactccgggaaattatattgaagcacagaactggttgaagattacgaagcgctttgaatttgaataagaccactctcctttttcagaaaatgggggtttggttgtcggaagatcgaatcaagaatttcattatatctctttcctctgccttctattttatattatatttcataaggataaacgatagggtctagaatagaagtaataaagcgaataaaaaggggcaatataaatattgctaatatatcaggaccatcttattaataattctaatgagttatcttggaatttggaatcgaataaaaaaatctatattatgctcaaggaaagtagatatagatagggacttatactcttaaaaaaaatagactagctttttaaattaaaaaaaggtttttttgttacgtggagaaatccaagataaaaaaagtccgttaggcacccaatccttatgtcataatagatccgaacacttgcctcagattgacttcaatatataattgctccagtgaataactaaaaaaaaatagaaggacggtagatagtaaagaaaaggac

SEQ ID NO: 3563 - DNA, 1574 bp, Triticum aestivum
cccggagtaagcgctatagcttgtttccaatattcagcagcttgatcaaaccaagcttccgcaatttccgaatcaccctgtagaatggcctgttgtcctcggtaatgacagatcacggccatattattaaaagctggcggtaagaaggggtttcgttctagtgcccggaaataatattccaaagcctttgtatgctctccattgcttgtgtgtataaggcctatgttatagagtatataacttcgatcatagggatcgatttctagtcgcatagcttcataataattttgcaaagcttccgcataatttccttcggattgagccaacatcccatctctataataagtaaatgccttttttctcctgaggttgtcggaattattcgcaataaaatattggctacaattgagaaggtcttatcaatgaaatttccatttacacgggatctaggcataattcccaacccattctatatagaattgttttcattccttcacaaaataacataaaaacaaacacattcgattcttataattataaataaattgatccatatgctctactctaaatccatatgctttaaatggataagagagatatggattttccgctcagctcaaattgtatccttttccttctgcttggacacgaagagatatgaaatatttgactaagactggatttcattccactttcctatttctgaacaacaacttatgttatcaactatttcgtgttttcaaagttattttattaattgtctcataccctatttttgatttcgatagtatggtgtagcgtatcttatgcaaacggaattctaaggtttctttattttattttattatgcaataagaagaattcttccattttctttttctttagttgcgggaaaacccaaattaaaacttttattttatagcgagcgcaatttctagtaaaaaatcctgtatccttccacttagatcaaaaggaatttttccaatagaactatggaacccccgagtggttgcggttgtacctgtactgcaggaataagaaaactcgctattcactcagtttattttccataataagttatgtaggagagatggccgagcggttcaaggcgtagcattggaactgctatgtagacttttgtttaccgagggttcgaatccctctctttccgtttttattaattcatcaacgttaaggatcacaatgtatcaaatcaaataacaattttttccagcaataatataatatcttatattatcttattttgatttaatagaaattagaaattctctatagcaaattactgtggtatgtaaaatacacatagaggaaaaagaaaaaggatcctaatcctagggttaatcaattttagctagttgatgggaaaatacgaattaatggtaatggtcttagggcgatttagttcggggaaaggggaaggggaagaaattctatgaacctttccttttttcgttaagttcaagtctgacgagagtaatattctacaactaacaactcatttattttgagaccgacccacttcctatctaggattttatttactagtcctttat

SEQ ID NO: 3564 - DNA, 543 bp, Amborella trichopoda
aatgaatttctgcctatgtctagatctcgaataaatggaaattttattgataagaccttttcaattgtagccaatatcttattacgaataattccgacaacttcgggcgagaaagaggcattcgcctattatcgagatggaaattatgcagaagctttacagaattattatgaagctatgcgactagaaattgatccctatgatcgaagttatatactctataacataggccttatccacacaagaaacggagaacatacgaaagctttggaatattattttcgtgccctagagcgaaatccattcttaccacaagcttttaataatatggccgtgatctgtcattacggaaggaatttatccgcctattccgaccggggagaacaagccattcggcaaggagattcagaaattgcggaggcttggttcgatcaagctgccgaatattggaaacaagctctagcgcttactcctggtaattatattgaagcgcagaattggttgaagattacaaggcgtttcgaataagaacacttttttatt

SEQ ID NO: 3565 - DNA, 736 bp, Cannabis sativa
ttctattttcatttggatgaaatctaatcggcttcaaatatttcttagtttttattgattccttttgacaggaatctatttgagtagaagtttcattttaatgagtctgtttttatgttatttcgtattgtaaaatgcccttgtttgtgggattttttattttctcacgaaaggtaattaaaagaaagtatagaatgaatttctgcctatgtctagatctcgaataaatggaaattttattgataagaccttttcaattgtagccaatatcttattacgaataattccgacaacttcgggcgagaaagaggcattcgcctattatcgagatggaaattatgcagaagctttacagaattattatgaagctatgcgactagaaattgatccctatgatcgaagttatatactctataacataggccttatccacacaagaaacggagaacatacgaaagctttggaatattattttcgtgccctagagcgaaatccattcttaccacaagcttttaataatatggccgtgatctgtcattacggaaggaatttatccgcctattccgaccggggagaacaagccattcggcaaggagattcagaaattgcggaggcttggttcgatcaagctgccgaatattggaaacaagctctagcgcttactcctggtaattatattgaagcgcagaattggttgaagattacaaggcgtttcgaataagaacacttttttatt

SEQ ID NO: 3566 - DNA, 515 bp, Ricinus communis
atgcctagatcccagataactggaaattttattgataagaccttttcaattgtagccaatatcttattacaaataattctgaaaactttgggagaaaaagaggcatttacttattacagagatggttatttgctcaatctgaaggaaattacgcaaaagctttacagaattattatgaagctatgcaactagaaattgatccctatgatcgaagttatatactctataatataggccttattcacacaagtaatggagaacatacaaaagctttggaatattatttttgggcactagaacgaaaccccttcttaccacaagctttaaataatatggtcgtgatctgtcattacgagaacaggccattcggcagggagattctaaaattgtagaggcttggttcgatcaagccgcagagtattggaaataagctatagcgcttactcccgaaaattatattgaattgcagaattggttgaagatcacaaggcattttgaataagataagtcccttt

SEQ ID NO: 3567 - DNA, 583 bp, Medicago truncatula
aatggattgctacctatgactagatctcggataaatggaaattttattgataagacctttaccattgtagccaatatcttattacgaataattccgacaacttctggagaaaaagaggcattcacttattacagagatgattctttgaaccgaatgacgaccgtaacggatgtcggctcaatctgaaggaaattatgcggaagctttacagaattattatgaggctatgcgactggaaattgatccctatgatcgaagttatatactttataacataggccttatacacacaagtaacggagaacatacgaaagctttggaatactattttagggcactcgaacgaaaccctttcttacctcaagcttttaacaatatggccttgatctgtcattacggaaggaatttactcaccaattccgaccgcggagaacaggccattcgacagggagattctgaaattgcggaatcttggtttgatcaagccgctgaatattggaaacaagctatagcccttacccctgggaattatattgaagcacagaattggttgaagatcacagggcgttttgaataagaacac

SEQ ID NO: 3568 - DNA, 586 bp, Pinus taeda
gtgcaccagaaaaaatttcgttcatggaatcatttgcgtaagggaatgaaggaaattataaaatctgtaattgactatgcctagatctcagagaaatgacaattttattgataagaccttcacaattgtagcagatatcttattgcgaataatcccgatggctccgggggagaaagaagcatttacctattacagagatggaatgtcagctcaatcggaaggggaatatgcggaagctttacaaaattattatgaagctatgcgactggaaactgatccttatgatcgaagttatatactatataatataggtcttgtgcatacaagtaatggggaacatacgaaggctttggaatattatttccaagcattagaacggaacccatccttaccacaagctcttaataatacggccttgatctgtcattaccgaggagaacaggccattcgacagggagatcctgaaactgcggaggcttggttcgatcaagctgctgagtattgggaacaagctatagcacttgctccgggcaattacatcgaagcacaaaattggttaaagattacaggacgctttggagaatga

SEQ ID NO: 3569 - DNA, 514 bp, Ricinus communis
aataaaatggattgctacttatgcctagatcccagataactggaaattttattgataagaccttttcaattgtagccaatatcttattacaaataattctgaaaactttgggagaaaaagaggcatttacttattacagagatgtatttgctcaatctgaaggaaattacgcaaaagctttacagaattattatgaagctatgcaactagaaattgatccctatgatcgaagttatatactctataatataggccttattcacacaagtaatggagaacatacaaaagctttggaatattatttttgggcactagaacgaaaccccttcttaccacaagctttaaataatatggtcgtgatctgtcattacgccattcggcagggagattctaaaattgtagaggcttggttcgatcaagccgcagagtattggaaataagctatagcgcttactcccgaaaattatattgaattgcagaattggttgaagatcacaaggcattttgaataaga

SEQ ID NO: 3570 - DNA, 539 bp, Cannabis sativa
aatttctgcctatgtctagatctcgaataaatggaaattttattgataagaccttttcaattgtagccaatatcttattacgaataagtccgacaacttcgggcgagaaagaggcattcgcctattatcgagatggaaattatgcagaagctttacagaattattctgaagctatgcgactagaaattgatccctatgatcgaagttatatactatataacataggccttatccacacaagaaacggagaacatacgaaagctttggaatattattttcgtgccctagagcgaaatccattcttaacacaagcttttaataatatggccgtgatctgtcattacggaaggaatttatccgcctattccgaccggggagaacaagccattcggcaaggagatccagaaattgcggaggcttggttcgatcaagctgccgaatattggaaacaagctctagcgcttactcctggtaattatattgaagcgcagaattggttgaagattacaaggcgtttcgaataagaacacttttttatt

SEQ ID NO: 3571 - DNA, 755 bp, Beta vulgaris
ttgattcttacgttcgatgaaatcggaatagctcctatactactacatttcatttgtatgaattcgaatgggattccactatttcttattgattcttaaaaaggagcaatttgtttgggtatttgcaataattgggataaatagcagtataagtagtagtagaaaatttggctctcttatttgtaatttttggttgtaaatgaatctgtttttatgttatttcgtactgtacaaatcctttgtttgtgtaatcgttttcccacaaggggtaatgagaagaattttagaatggattgatacctatgcctagatcgcggataaatggaaattttattgataagaccttttcaattgtggccaatatcttattacgaataattccgacaacttcaggagaaaaagaggcatttactattacagagatgggatgtcagctcaatccgaagaaattatgcggaagctttacagaattattatgaagctatgcgactagaaatcgatccctacgatcgaagttatatactctataatataggccttattcacacaagtaatggagaacatacaaaagctttagaatattattttagggcactagagcgaaacccattcttaccacaagcttttaataatatggcagtgatctgtcattaccggggagaacaggccattcaacagggggattctcaaattgcggaggctttgttcgatcaagccgctgagtactcgaacaagctataacgcttactcctgga

SEQ ID NO: 3572 - DNA, 513 bp, Cedrus atlantica
atgcctagatctcagagaaatgacaattttatcgataagaccttcacaattatagcggatatcttattgcgcataatcccgatggctccgggggagaaagaagcatttacctattacagagatggtgtgatgtcagctcaatcggaaggggaatatgcggaagctttacaaaattattatgaagctatgcgaccggaaactgacccttatgatcgaagttatatactatataatataggtcttgtccatacaagtaatggggaacatacgaaggctttggaatattatttccaggcattagaacggaacccatccttaccacaagctcttaataatacggccttgatctgtcattaccgaggagaacaggccattcgacagggagatcctgaaactgcggaggcttggttcgatcaagctgctgagtattgggaacaagctatagcacttgctccgggcaattacatcgaagcacaaaattggttaaagattacaggacgctttggagaatga

SEQ ID NO: 3573 - DNA, 615 bp, Ricinus communis
ttattcaaaatgccttgtgatcttcaaccaattctgcaattcaatataattttcgggagtaagcgctatagcttatttccaatactctgcggcttgatcgaaccaagcctctacaattttagaatctccctgccgaatggcctgttctccttgtcgcacgtaatgacagatcacgaccatattatttaaagcttgtggtaagaaggggtttcgttctagtgcccaaaaataatattccaaagcttttgtatgttctccattacttgtgtgaataaggcctatattatagagtatataacttcgatcatagggatcaatttctagttgcatagcttcataataattctgtaaagcttttgcgtaatttccttcagattgagcaaatacttgttacgaataaaattaaatgcctctttttctcccaaagttttcagaattatttgtaataagatattggctacaattgaaaaggtcttatcaataaaatttccagttatctgggatctaggcataagtagcaatccattttattatttcttttaattacctgtcatgagaaaacgatcccacaaaaaagtagttgtacggtacaaaataatataaaaatagatcgtt

SEQ ID NO: 3574 - DNA, 620 bp, Citrus clementina
ttattcgaaacgtcccgtgatcttcaaccaattctgcgcttgaatataattaccaggagtaagcgcaatagcttgtttccaatactcggcagcttgattgaaccaagcctccgcaatttcagaatctccctgtcgaacggcctgttccccccggtaatgatagatcacaaccatattattaaaaacttgtggtaagaacggattttgttctagtgtccaaaaataatagtctaaagcttttgtatgttctccgctacttgtgtggataaggcctatgttatagagtttatagcttcgatcgtaaggatcaatttctagttgtatagcttcataataattatataaagcttagcataattcccttcaaattgagctgacatccgttacgactaaaagcagtaaatgcctctttttctcctacaattgttggaattattcgtaataatatattggctacaatcgaaaaggtcttatcaatcaaattttcatttttccgcgatctaggcataggtaaaaatccattctataatttgtttcattacctcttgtgagaaaatgatcccatgaacgaaggaattgtatagtataaaataacataaatgtaaatgcattaaaaaaat

SEQ ID NO: 3575 - DNA, 1226 bp, Panicum virgatum
  misc_feature (27)..(27): n is a, c, g, or t
  misc_feature (32)..(32): n is a, c, g, or t
  misc_feature (46)..(46): n is a, c, g, or t
  misc_feature (49)..(51): n is a, c, g, or t
  misc_feature (55)..(56): n is a, c, g, or t
  misc_feature (58)..(58): n is a, c, g, or t
  misc_feature (60)..(60): n is a, c, g, or t
  misc_feature (75)..(75): n is a, c, g, or t
  misc_feature (78)..(78): n is a, c, g, or t
  misc_feature (81)..(81): n is a, c, g, or t
  misc_feature (209)..(209): n is a, c, g, or t
  misc_feature (236)..(236): n is a, c, g, or t
  misc_feature (270)..(270): n is a, c, g, or t
  misc_feature (279)..(279): n is a, c, g, or t
  misc_feature (414)..(414): n is a, c, g, or t
  misc_feature (436)..(436): n is a, c, g, or t
  misc_feature (473)..(473): n is a, c, g, or t
  misc_feature (590)..(590): n is a, c, g, or t
  misc_feature (630)..(630): n is a, c, g, or t
ccatcccctcgccatctttagctcganccccncctccaaatctccntcnnngccnngnancccgcgtccgttccntcncancccattccgccgccctgatccgcccgcccgaaccgaccatgacggtgtcgccgccgtcgccgctgctgccgccggcgggggagccgttccgcgtgttcgtggggtacgacccgcgggagcacgaggcntacgaggtgtgccgccgcagcctgctncggcacgcctcgatcccgctcgacgtgcgccccntccggcagncggacctccgcgccgcggggctctactggcgggcgcgcgggcccaccgagagcaccgagttctccttcacgcgcttcctcaccccctacctcgcgggctaccgcggctgggcgctcttcgtcgactgcgacttcntctacctcgccgacctcgcggngctcctcgccgccgccgccccgccgggcgccgacgcngcccgcctcgccgtcgcctgcgtcaagcacgagtaccagcccgccgaggccaccaagatggacggcgccatccagacggtgtacccgcgcaagaactggtcctccatggtgctctanaactgcgcccaccccaagaacgtcgccgcgctcacgcccnacgccgtcagcacccagaccggcgccttcctccaccgcttcgcctggctcgacgacgacgagatcggggaggtgcccttcgtctggaacttcctcgtcggccacaacagggtcgaccccgccgacccggacacgcggcccagggccatacactacacctgcggcggcccgtggttcgagcgctacagggactgcgagttcgccgacctctggatcaaggaggccgaggagctcagggccgagaaggagaagctcaagctcctcgaggacaaggacgctgacgaggaggccaagaacaaggaggggaattgatcgattggttagtcataccgcattagattggttcgtttttcgctgcagaaatctcattctttttctcctcagcattctattcatttcacgcgccaatgtagtttatttcatgtatctgattgttgatactgatatgtcgggagattaggattggatgggtaggctatgggtggatagctggagtgagtaaattgatggtagtatactccgtagcttctgtgtagctgcaattggccggttctacgagtgctcatcgttaaggaataacaaacgtatttttccagc

SEQ ID NO: 3576 - DNA, 1548 bp, Setaria italica
ccgcagtcccgccgcgcacgcgctcagcgctccacaccaccaccgacatctccccgtggctggattggattacatgcatgccactgccagcgcgagactgccgccgctacctcccaccgcgatccccgcccccgcgcatcactgacaaccggaccccagcccctcctggttccacgcgtcattgacccatgtgcgtgcgggtgcacgcgccttatttttaggagcgagtgcccaccgaaaacgcgccgcggcaccgacatgacagatcctttctccatccgccggtgaaactgaaaggaatcccctcacgcccccctcgccatctttagctcgagccctacctcccaatctccggtcccccgcccattaaaggcccggcacccccgcgcccgttccgtctccgtccccatcccattccaccgcaccccacctcccgcacccatccatgtcgccggcgccgccgccgtcgccgcttctgccgccggcgggggagccattccgcgtgttcgtggggtacgacccgcgggagcacgaggcgtacgaggtgtgccgccgcagcctgctccggcacgccaccatgccgctcgacgtgcgccccgtccgccagccggacctccgcgccgcggggctctactggcgggcgcgcgggcccaccgagagcaccgagttctccttcacgcgcttcctcaccccctacctcgcgggctaccgcggctgggcgctcttcgtcgactgcgacttcctctacctcgccgacgtcgccgacctcctcgccgccgccgccccgccgggcgccgacgccgaccgcctcgccgtcgcctgcgtcaagcatgtgtacgagcccgccgaggccaccaagatggacggcgccatccagacgacgtacccgcgcaagaactggtcctccatggtgctctacaactgcgcccacccaaagaacgtcgccgcgctcacgcccgacgccgttagcacccagaccggcgcattcctccatcgcttcgcctggctcaacgacgacgagatcggggaggtgcccttcgtctggaacttcctcgtcggccacaacagggtcgaccccgccgacccggccacgcaccccagggccatacactacacctgcggcgggccatggttcgagcgatacagggactgcgagttcgccgacctctggatcaaggaggccgaggagctcaaggccgagaaggacaagctcgaggacggggagaagctcaagctcatcgaggacaaggacgccaaggagcaagacgacaacaaggaggagaattgatcgatcgattggttggtgatactgcattgggttggattggttcgttttgtgctgcagagatttcattcctcaacattctgttcatttctcgcaccaatgcagtttctttcatcgatctggtctgttaatagtgagatgtcgggagattaggattgtgtcgtatgtagcctatgagtgggtagctggagtgagtctattgtgtagctgcaatcggtctatgaatgaatgctcatcgttaaggaatatcaatcgtgtttttt

SEQ ID NO: 3577 - DNA, 2310 bp, Saccharum officinarum
acagcgcatcgcatctactgcgagtctctctccgcacacggagtccgccgccgcggcggctccggctccggcgccgcatccgtcataggattacccttctccgcgcggtagagacagcttgattatttctcagtcttaaactgatgatgctggtgctcgtttaatcaacttgattcagagatatatcaactatgggttatctgaatcatggaaggtctctccctctacttctctgtctacatcttttgttgccactacttccgtttgctacggcagatatagcctccgagaagcaagcactccttgcttttgcctctgcagtctaccgtggcaacaagctgaattggagtcaaaatatcccactgtgctcttggcatggtgtgacatgctcaccggatcgatcgcgtatatcggcccttagggtgccaggtgctggtttgattggtactattcctgctaatactcttggcaggcttgtgttcctccaagttttaagcctgaggtctaaccgtttgagtggaagccttccatacgatgttgcctcactttcttctttacaagccatatttcttcagcacaacgaactgtcaggagacttgcctccatttctttccccaaaccttatacccttgatctctcttacaactcctttacaggacaaatcccatcaggtttgcagaatcttaccaaattatctgtcctgaatttagcaggaaattccctgtccgggccaattcctgatctcaaacttcctagcctaagacagctaaatctgagcaacaacgaactgaatggttcaattcctccctttctccaaatcttctcaaatagctccttcttagggaactctggtttgtgtgggccgcctctaactgaatgttcctttctatcttcaccaacaccatcgcaagcgccttcaccaccaaaattgccacatcatgagaagaaggctggcaatggcttggtaattgcggctgtcgctgggagctttgtcatatttctgctagctgctgtgatgttcactatgtgcatttcaaagaggaaggagaagaaagatgaagtgggttacaacggtaaggtcactgatggtttaaggattgagaagcgcaaagaggatgtcagtagcggtgtccaaatggctcataagaacaagttagttttcttggagggatgtagttacaactttgacttggaggatttattgagagcatctgccgaagttcttggaaaagggagctatggaactgcctacaaggctatacttgaggatagcactagtgtggtagtcaagaggctaaaggatgttgtggcggggaagaaagaatttgagcagcagatggagctcatagggagggtaggtaaacatgcaaacattgcacctattcgggcctactactactcgaaggatgagaagcttgttgtttatgagtatatcgctactggcagcttctcagctctgttgcatggtattaagggcgtgtgtgagaagaccccattagattggaacaccaggatgaagatcatacttggaacagcacgcagtatagagcacattcattcagaaggtggctccaagttcgcacatggcaatatcaagtcaaccaatgtcctgctcgatcaagaccacaacccttatgtctcagactttgggctgagctctttgatgagccttccaatcaacacttcccgagttggcactggttaccgggctcaagagacctttgaatcaaggaagttcactcacaagtctgacgtgtacagctttggtgttctcctcatggagatgctgacaggcaaagccccccttcagtcacagggtcaggatgatgtcgccattgatctaccaagatgggtgcattcagtggtccgtgaggagtggaccgctgaagtgtttgatgtccagctgatgaagtatcctaacatagaagatgagctggtccagatgctccatatcgccatggcatgcacggcgtggtctccagaccgacgtccgacgatggtggaggtgatcaggatgatggaggagctccggcagcctgcttccgagagccgcactccctccattggcaatcccaacgaatccagtcctctgtcagcctgaaatgttagattttttcagtctaatctgtgattctgattcagaattcgtgtatccatgacattgatgtacgtatgtggtgccgaggcttttgcactgggaccatgcagcgttgtatcggtatatgcagctgtagcgttattcccggtgcacacatggtctgccccctcatcctgccatgctaccgtaactttggttcaatggaatgcttc

SEQ ID NO: 3578 - DNA, 2409 bp, Sorghum bicolor
actccatactgatcacagcgcatcacatctactgcgagtctctctcggcacacgcgtgagtccgcctccgccgcggctccggcgccgcatccgtctcaggaatccccttctccgcgtgctagaggcagcttgattatttctcaatcttaaactgatgatgctggtgctcgtttaatcaacttgattcagcgatatatcagctatgggtgatctgaatcatggaagctctctccctctacttctctgtttacatctgttgttgccactacttccgtttgctatggcagatatagcctccgagaagcaagcgctccttgcttttgcctctgcagtctaccgtggcaacaagctgaattggagtcaaaatatcccactgtgctcgtggcatggtgtgatatgctcaccggatcgatcgcgtatattggctcttagggtgccaggtgctggtttgattggtactattcctgctaatactcttggcaggcttgtgttcctccaagttttaagcctgaggtctaaccgtttgagtggaagccttccatacgatgttgcctcacttccttctttacaagccatatttcttcagcacaacgaactgtcaggagacttgccaccatttctctccccaaaccttaatacccttgatctctcttacaactcctttacaggagaaatcccaccaggtttgcagaatcttaccaaattatctatcctgaatttagcaggaaattccctgtccgggccaattcctgatctcaaacttcctagcctaagacagctaaatcttagcaacaatgaactgaatggttcaattcctccctttctccaaatcttctcaaatagctccttcttagggaactctggattgtgtgggccgcctctacccgaatgttcctttctatcttcaccaacaccatcgcaagtgccttcaccatcaaaattgccacatcatgagaagaaggctggcaatggcttggtaattgcggctgtcgctgggagctttgtcatattactgctagctgctgtgatgttcactatgtgcatttcaaagaggaaggagaagaaagatgaagtgggttacaacggtaaggttactgatggtttaaggattgagaagcgcaaagaggatgtcagtagcggtgtccaaatggctcataagaacaagttagttttcttggagggatgtagttacaactttgacttagaggatttattgagagcatctgccgaagttcttggaaaagggagctatggaactgcctacaaggctatacttgaggatagcactagtgtggtagtcaagaggctaaaggatgttgtggcagggaagaaagaatttgagcagcagatggagctcatagggagggtaggtaaacatgcaaacatcgcacctattcgtgcctactactactcgaaggatgagaagcttgttgtttatgagtatattgctactggcagcttctcggctctgttgcatggtattaagggcgtatgtgagaagaccccattagattggaacaccaggatgaagattatacttggtacagcacgcggtatagagcacattcattcagaaggtggctccaagttcgcacatggtaatatcaagtcaaccaatgtcctgctggatcaagaacgcaacccttatgtctcagactatgggctgagctctttgatgagccttccaatcaacacttcccgagttggcactggttaccgggctcaagagacctttgaatcaaggaagttcactcacaagtctgacgtgtacagttttggtgttctcctcatggagatgctgacaggcaaagccccccttcagtcacagggtcaggatgatgtcgccattgatctaccaagatgggtgcactcagtggtccgcgaggagtggactgctgaagtgtttgatgtccagctgatgaagtatcccaacatagaagacgaactggtccagatgctccatatcgccatggcatgcacggcgtggtctccagaccgacgtccaacaatggcagaggtcatcaggatgatggaggagctccggcggcctgcttctgagagccgcactccctccattggcaatcccaaggagtcgagtcctctgtcagcctgaattgttagatctttcagtctaatccgtgattctgattcagaattcgtgtatccatatcattgatgatgtcctgtatgtggtgctgaggaggcactgggaccatacagcgttgtatcgttatatatagctgtagcgttattcccggtgcacacattgtctgcctactcatcctaccatgctaccgtaactttggttcaatggaatgttcaagaaacaatggcggaatagctattttcgtctctcaactattaattttgtccttcattacaaaaatggacgtttcagttcttacagtc

SEQ ID NO: 3579 - DNA, 2608 bp, Sorghum bicolor
gtttgactgacggggcccgcacgatccggtggtgaaacggtaaagagagaggagccatcgccatgggcagcgagaagagcgtggcgcacccaacagtcgcggcgccggttgccaggctccggctccacctccactcctcgttttaaacgctcccttcttctccctggcccctactccatactgatcacagcgcatcacatctactgcgagtctctctcggcacacgcgtgagtccgcctccgccgcggctccggcgccgcatccgtctcaggaatccccttctccgcgtgctagaggcagcttgattatttctcaatcttaaactgatgatgctggtgctcgtttaatcaacttgattcagcgatatatcagctatgggtgatctgaatcatggaagctctctccctctacttctctgtttacatctgttgttgccactacttccgtttgctatggcagatatagcctccgagaagcaagcgctccttgcttttgcctctgcagtctaccgtggcaacaagctgaattggagtcaaaatatcccactgtgctcgtggcatggtgtgatatgctcaccggatcgatcgcgtatattggctcttagggtgccaggtgctggtttgattggtactattcctgctaatactcttggcaggcttgtgttcctccaagttttaagcctgaggtctaaccgtttgagtggaagccttccatacgatgttgcctcacttccttctttacaagccatatttcttcagcacaacgaactgtcaggagacttgccaccatttctctccccaaaccttaatacccttgatctctcttacaactcctttacaggagaaatcccaccaggtttgcagaatcttaccaaattatctatcctgaatttagcaggaaattccctgtccgggccaattcctgatctcaaacttcctagcctaagacagctaaatcttagcaacaatgaactgaatggttcaattcctccctttctccaaatcttctcaaatagctccttcttagggaactctggattgtgtgggccgcctctacccgaatgttcctttctatcttcaccaacaccatcgcaagtgccttcaccatcaaaattgccacatcatgagaagaaggctggcaatggcttggtaattgcggctgtcgctgggagctttgtcatattactgctagctgctgtgatgttcactatgtgcatttcaaagaggaaggagaagaaagatgaagtgggttacaacggtaaggttactgatggtttaaggattgagaagcgcaaagaggatgtcagtagcggtgtccaaatggctcataagaacaagttagttttcttggagggatgtagttacaactttgacttagaggatttattgagagcatctgccgaagttcttggaaaagggagctatggaactgcctacaaggctatacttgaggatagcactagtgtggtagtcaagaggctaaaggatgttgtggcagggaagaaagaatttgagcagcagatggagctcatagggagggtaggtaaacatgcaaacatcgcacctattcgtgcctactactactcgaaggatgagaagcttgttgtttatgagtatattgctactggcagcttctcggctctgttgcatggtattaagggcgtatgtgagaagaccccattagattggaacaccaggatgaagattatacttggtacagcacgcggtatagagcacattcattcagaaggtggctccaagttcgcacatggtaatatcaagtcaaccaatgtcctgctggatcaagaacgcaacccttatgtctcagactatgggctgagctctttgatgagccttccaatcaacacttcccgagttggcactggttaccgggctcaagagacctttgaatcaaggaagttcactcacaagtctgacgtgtacagttttggtgttctcctcatggagatgctgacaggcaaagccccccttcagtcacagggtcaggatgatgtcgccattgatctaccaagatgggtgcactcagtggtccgcgaggagtggactgctgaagtgtttgatgtccagctgatgaagtatcccaacatagaagacgaactggtccagatgctccatatcgccatggcatgcacggcgtggtctccagaccgacgtccaacaatggcagaggtcatcaggatgatggaggagctccggcggcctgcttctgagagccgcactccctccattggcaatcccaaggagtcgagtcctctgtcagcctgaattgttagatctttcagtctaatccgtgattctgattcagaattcgtgtatccatatcattgatgatgtcctgtatgtggtgctgaggaggcactgggaccatacagcgttgtatcgttatatatagctgtagcgttattcccggtgcacacattgtctgcctactcatcctaccatgctaccgtaactttggttcaatggaatgttcaagaaacaatggcggaatagctattttcgtctctcaactattaattttgtccttcattacaaaaatggacgtttcagttcttacagtctagttttgggttcaatttcaactctta

SEQ ID NO: 3580 - DNA, 2382 bp, Panicum virgatum
ctctcccccatgctgatcacaccgcatcgcatctctctctcgcttgtttcgttcgcagaaccccgcctccgccgcggctccggcgccgcatccatatccaggagcagtcagtcccttccccgcgcggggcggtggagacggcttggttatttctcagatgtaatttggtgatgctggggcttgtttagtcatcttggtttgaagataccagccatgggtcatctgaattatggagtctctcttcctctactgctccgtctacaacttttgctgccactacttcttccttttgctatggcagatatagcctctgagaagcaagcactccttgattttgcctctgcagtctaccgtggcaacaagctcaattggagtccaaatatcccactgtgctcatggcatggtgtcacatgctcaccagatcgatcacatatatgggcccttagggtaccaggggctggtttgattggtacaattccagctaatactcttggcaggcttgtgtccctccaagttttaagcctgaggtctaatcgtttgagtggaagtcttccattggatgttgcctcacttccttctttacaagccatatttcttcagcacaacgaactgttgggagacttgccttcatttttctctccaagcctcaataccctcgatctctcttacaactcctttacaggacaaataccatcaggtttgcaaaatcttacccaattatctatcctgaatttagcaggaaattccttgtccgggccaatccctgacctcaaacttccaagcctaagacagctaaatctgagcaacaatgaactaaatggttcaattcctccctttctccaaatattctcaaatagctccttcttagacaaccctggattgtgtgggccacctctagctgaatgctcctttctatcttcacctacaccatcacaagtgcctttacttccatcatcgccacatcatgagaagaagacatgcaatggcatgataattgccgctgttgttgggggctttgttatatttctgctagctgctgtgatgttcactatgtgcttttcaaagagaaaggacaagaaagatgaggtggcttacaacagtaaggtgactgatggtgcaaggattgagaagcgcaaagaagatgttagtagtgggtgtccaaatggctcataagaacaagctggtattcttggatggatgcagttacaactttgacttggaggatttactgagggcttctgctgaagttcttggcaaagggagttatggaactgcctacaaagctatacttgaggatggcactattgtggtagtcaagaggctaaaggatgttgtggcagggaagaaagaatttgagcagcagatggagctcatagggagggtaggcaaacatgcaaacatggcacctattcgtgcttactactactcaaaggatgagaagcttgttgtttatgagtatcttcctgctggcagcttctcagctatgttgcatggtattaaaggcatttgtgagaagaccccattagactggaataccaggatgaagattatacttggaactgcatgtggaattgagcacatccattcagaaggtggctccaagttcgcccatggcaatatcaagtcaaccaatgtcctgctcgatcaagaccacaacccatatgtctcagactatggtctgagtgctttgatgagccttccaatcaacacctcccgggttgtcgccggttaccgagctccggagacctttgaatccaggaaattcacacacaagtctgacgtgtacagctttggcgtccttctcatggagatgctgactggaaaagcccccctccagtcacaggggcaggatgatgtcgttgatctaccaagatgggtgcattccgtggtccgtgaggagtggaccgccgaagtgtttgatgtccagctgatgaaatatcctaacatagaggatgagctggtccagatgctccatattgccatggcgtgcacgtcgtggtcgccagaccgacgcccaacaatggcggatgtggtccggatgatggaggagctagggcagtctgcttcccagagccgcactccctccaatggcaatcccagggagtccaatcctccatcggtgtgagtctataatttctgtgattctgatccggaattggtgaatccatgacatcgatgatatcctctattgcctttatgtggtcctgaagcttacactgttacacgtaggaaccacatatgctgtatgatacggcgttgtatccagctgtaatgttattccctgttcttgttaaagttgttaactgggagatgttaacatttcttcctactcgaatgcctaatgtctggtaacagtctcattatactatggtgttcgttgac

SEQ ID NO: 3581 - DNA, 1990 bp, Setaria italica
acggcttggttatttctcagacataatttggtgatgctggggctctagtagtcatattgcttcgaagatatcagctatggatcatctgaatcatgaaagctatttccctctactgctctgcctacatcttttgctgctactactacttccttttgctatggcagatatagcctctgagaagcaagcactccttgcttttgcctctgcagtctaccatggcaacaagctcaattggggtccaaatatcccactgtgctcatggcatggtgtgacatgctcaccggaccgatcacgtatatgggcccttagggtaccaggggctggtttgattggtacgattcctgctaatactcttggcaggcttgcatccctccaagttttgagcctgaggtctaatcgtttgagtgggagccttccatctgatgttgcctcacttccttctttacaagctacatttcttcagcacaacgaactgtcgggagacttgccttcatttttctctcccaagccttaatacccttgatctctcttacaactcctttaccggacaaatcccattaggtttgcagaatcttacccaactatctgtcctgaatttagccggaaattccctgtctgggccaatccctgatctcaaacttccaagcctaagacagctaaatctcagcaacaatgaactaatgggttcgattcctccatttctccaaatattctcaaatagctgcttcttagggaaccctggattgtgtggtccgcctctagccgaatgctcctttctaccttcatcaacaccatcacaagtgccttcacttccatcatcgccacatcgtgagaagaaggcaggcaatggcttgataattgcggctgttgttgggggctttgtcatatgtttgctagccgcggtgatgttccttgtgtgcttttcaaagaggaaggagaagaaagatgaggttggttacaacagtaaggtgactgatggtgcaaggattgagaagcacaaagaggatgtcagtagtggtgtccaaatggctcataagaacaagttggtattcttggatggatgcagttataactttgacttggaggatttactgagagcttctgctgaagttcttggcaaagggagctatggaactgcctacaaggctatacttgaggatggcaccattgtggtagtcaagaggctaaaggatgttgtggcagggaagaaagaatttgagcagcagatggagcttatagggagggtaggcaaacatgcaaacatcgcacctattcgtgcttactactactcaaaggatgagaagcttgttgtttatgagtatattgctactggcagcttctcagcattgttgcacggtattaaaggcgtttgtgagaagaccccgttagattggaataccaggatgaagatcatacttggaacagcacgcggtatcgagcacattcatgcagaaggtggctccaagctcgcccatggcaatatcaagtcaaccaatgtcctgctggatcaaggccacaacccttatgtgtcagactatgggctgagtgctttgatgagccttccaatcaacacctcccgggtcattgctggttaccgagctccggagacctttgaatccaggaaattcacacacaagtctgatgtatacagtttcggtgtcctcctcatggagatgctgaccggcaaaactcccctccagtcacaggggcaggatgatgtcgttgatctaccaagatgggtgcattctgttgtccgcgaggagtggacagccgaagtgtttgatgtccagctgatgaaatatcctaacatagaagatgagctggtccagatgctccatatcgccatggcgtgcacgtcgtggtcaccagaccgacgcccgacaatggcagaggtgatcaggatgatggaggaactccgtcagtctgcttcggagagccgcactccctccaatggcaatcccagggaatccaatcctccatcggtgtgaat

SEQ ID NO: 3582 - DNA, 2183 bp, Setaria italica
gcttggttatttctcagacataatttggtgatgctggggctctagtagtcatattgcttcgaagatatcagctatggatcatctgaatcatgaaagctatttccctctactgctctgcctacatcttttgctgctactactacttccttttgctatggcagatatagcctctgagaagcaagcactccttgcttttgcctctgcagtctaccatggcaacaagctcaattggggtccaaatatcccactgtgctcatggcatggtgtgacatgctcaccggaccgatcacgtatatgggcccttagggtaccaggggctggtttgattggtacgattcctgctaatactcttggcaggcttgcatccctccaagttttgagcctgaggtctaatcgtttgagtgggagccttccatctgatgttgcctcacttccttctttacaagctacatttcttcagcacaacgaactgtcgggagacttgccttcatttttctctcccaagccttaatacccttgatctctcttacaactcctttaccggacaaatcccattaggtttgcagaatcttacccaactatctgtcctgaatttagccggaaattccctgtctgggccaatccctgatctcaaacttccaagcctaagacagctaaatctcagcaacaatgaactaatgggttcgattcctccatttctccaaatattctcaaatagctgcttcttagggaaccctggattgtgtggtccgcctctagccgaatgctcctttctaccttcatcaacaccatcacaagtgccttcacttccatcatcgccacatcgtgagaagaaggcaggcaatggcttgataattgcggctgttgttgggggctttgtcatatgtttgctagccgcggtgatgttccttgtgtgcttttcaaagaggaaggagaagaaagatgaggttggttacaacagtaaggtgactgatggtgcaaggattgagaagcacaaagaggatgtcagtagtggtgtccaaatggctcataagaacaagttggtattcttggatggatgcagttataactttgacttggaggatttactgagagcttctgctgaagttcttggcaaagggagctatggaactgcctacaaggctatacttgaggatggcaccattgtggtagtcaagaggctaaaggatgttgtggcagggaagaaagaatttgagcagcagatggagcttatagggagggtaggcaaacatgcaaacatcgcacctattcgtgcttactactactcaaaggatgagaagcttgttgtttatgagtatattgctactggcagcttctcagcattgttgcacggtatgaggtattaaaggcgtttgtgagaagaccccgttagattggaataccaggatgaagatcatacttggaacagcacgcggtatcgagcacattcatgcagaaggtggctccaagctcgcccatggcaatatcaagtcaaccaatgtcctgctggatcaaggccacaacccttatgtgtcagactatgggctgagtgctttgatgagccttccaatcaacacctcccgggtcattgctggttaccgagctccggagacctttgaatccaggaaattcacacacaagtctgatgtatacagtttcggtgtcctcctcatggagatgctgaccggcaaaactcccctccagtcacaggggcaggatgatgtcgttgatctaccaagatgggtgcattctgttgtccgcgaggagtggacagccgaagtgtttgatgtccagctgatgaaatatcctaacatagaagatgagctggtccagatgctccatatcgccatggcgtgcacgtcgtggtcaccagaccgacgcccgacaatggcagaggtgatcaggatgatggaggaactccgtcagtctgcttcggagagccgcactccctccaatggcaatcccagggaatccaatcctccatcggtgtgaattgttggattttccagcttagtcaatgtgattctgattcagaactcgtgtatccaatatccatgacatcgatgatatatcctccatgatataaagccacactggaaccatacagcgttgtatcattacagttgtaacgttattccctgtgcctgttaactgggagacgttagcatatctgctcttattat

SEQ ID NO: 3583 - DNA, 2257 bp, Setaria italica
cttggttatttctcagacataatttggtgatgctggggctctagtagtcatattgcttcgaagatatcagctatggatcatctgaatcatgaaagctatttccctctactgctctgcctacatcttttgctgctactactacttccttttgctatggcagatatagcctctgagaagcaagcactccttgcttttgcctctgcagtctaccatggcaacaagctcaattggggtccaaatatcccactgtgctcatggcatggtgtgacatgctcaccggaccgatcacgtatatgggcccttagggtaccaggggctggtttgattggtacgattcctgctaatactcttggcaggcttgcatccctccaagttttgagcctgaggtctaatcgtttgagtgggagccttccatctgatgttgcctcacttccttctttacaagctacatttcttcagcacaacgaactgtcgggagacttgccttcatttttctctcccaagccttaatacccttgatctctcttacaactcctttaccggacaaatcccattaggtttgcagaatcttacccaactatctgtcctgaatttagccggaaattccctgtctgggccaatccctgatctcaaacttccaagcctaagacagctaaatctcagcaacaatgaactaatgggttcgattcctccatttctccaaatattctcaaatagctgcttcttagggaaccctggattgtgtggtccgcctctagccgaatgctcctttctaccttcatcaacaccatcacaagtgccttcacttccatcatcgccacatcgtgagaagaaggcaggcaatggcttgataattgcggctgttgttgggggctttgtcatatgtttgccttgtgtgcttttcaaagaggaaggagaagaaagatgaggttggttacaacagtaaggtgactgatggtgcaaggattgagaagcacaaagaggatgtcagtagtggtgtccaaatggctcataagaacaagttggtattcttggatggatgcagttataactttgacttggaggatttactgagagcttctgctgaagttcttggcaaagggagctatggaactgcctacaaggctatacttgaggatggcaccattgtggtagtcaagaggctaaaggatgttgtggcagggaagaaagaatttgagcagcagatggagcttatagggagggtaggcaaacatgcaaacatcgcacctattcgtgcttactactactcaaaggatgagaagcttgttgtttatgagtatattgctactggcagcttctcagcattgttgcacggtattaaaggcgtttgtgagaagaccccgttagattggaataccaggatgaagatcatacttggaacagcacgcggtatcgagcacattcatgcagaaggtggctccaagctcgcccatggcaatatcaagtcaaccaatgtcctgctggatcaaggccacaacccttatgtgtcagactatgggctgagtgctttgatgagccttccaatcaacacctcccgggtcattgctggttaccgagctccggagacctttgaatccaggaaattcacacacaagtctgatgtatacagtttcggtgtcctcctcatggagatgctgaccggcaaaactcccctccagtcacaggggcaggatgatgtcgttgatctaccaagatgggtgcattctgttgtccgcgaggagtggacagccgaagtgtttgatgtccagctgatgaaatatcctaacatagaagatgagctggtccagatgctccatatcgccatggcgtgcacgtcgtggtcaccagaccgacgcccgacaatggcagaggtgatcaggatgatggaggaactccgtcagtctgcttcggagagccgcactccctccaatggcaatcccagggaatccaatcctccatcggtgtgaattgttggattttccagcttagtcaatgtgattctgattcagaactcgtgtatccaatatccatgacatcgatgatatatcctccatgatataaagccacactggaaccatacagcgttgtatcattacagttgtaacgttattccctgtgcctgttaactgggagacgttagcatatctgctcttattatctgcctactcagatgtacggtaactttggttcatcagaacgtgtttgtttacacgagtgtgtaattgagtcgcttattgtgatggaaatataacgggcg

SEQ ID NO: 3584 - DNA, 1586 bp, Avena sativa
gtttccgcaacaaaacggcccgggtgcgtgtgtgcgtgccagagaaaaacagacagacagacagacagacagcagccagtgaccagacgaaggcgaaggcgaagcgcgagaggagaaagagagatgccggggctcacggcgccgtcggactacgcggaggagccgccgcgccaccccgacctcaggatcaactccaaggaaccgtttaatgctgagccccatcggtctgcgttggtttcgtcttatgtcaccccagtagatttcttctacaagaggaatcatggaccaattccaaaaatcgatgatatctcgagatacagtgtttccatcaatggccttgtgaacaagcatattcagctatccatggccgacattagattgcttccaaagtacaatgtcactgcaacgttgcagtgcgcaggcaataagaggactgcaatgagtaaggtacgaaaagtgagaggtgttggatgggacgtatctgctcttggaaatgcaacttggggaggagcaaaactatctgatgtccttgaactagttggaatacctaaactcagttccgttacagctttaggaggcaaacatgttgagtttgtcagtgttgacaggtgtaaagaggagaaaggtggtccctataaggcatcaattccattaaagcaggctacagatcctgatgctgatgtcttgcttgcatatgaaatgaacggagagatcatcaaccgtgaccatggatacccactccgtgttgtcgtacctggtgtcataggcgcacgttctgtaaaatggctggacagcatcagcataatcaaggaagaatgtcagggtttttttatgcaaaaagattacaagatgtttccacctaccgtagactgggacaatattgattggtcgactagaagaccacaaatggattttcctgtacagtctgctatttgcaccctggaggatgtggatgttatcaaggaaggaaaggctagaattgctggatatgcagtctcaggtggtggtcgtggcattgagagagtagatatatctgtcgatggaggtaaaacatgggttgaggctcatagatatcagaaaagcagtgttccatacatctctgatggacctcaaagtgacaagtgggcatgggttctctttgaggctacgttggacgtaccagcaaatgccgagatagtagctaaggcggtggactcagccgcaaatattcaaccggaaaaagtggaggacatatggaacctcagaggaatcctcaatacatcttggcaccggatcaaaatacaaaattcaagatccaaaatgtgaaagaagtatgttgctgtgtctagaacacgcaacatgctggtccttacgcctccatgatagtctaagaaataataagcactggagcttactttatctaattttcatttagactgtgccacggaactatgtttgagtcgtgttgctggtctgtaactttttttctgtaaccatatcagtgttacaaatactcctgcttgtgccagatgatctgatatgaagttcaccatgacgtatgctttaaaagtgaagatattaataaaatgctttaacaaaaaaaaaaa

SEQ ID NO: 3585 - DNA, 1569 bp, Avena sativa
ccgcaacaaaacggcccgggtgcgtgtgtgcgtgccagagaaaaacagacagacagacagacagacagcagccagtgaccagacgaaggcgaaggcgaagcgcgagaggagaaagagagatgccggggctcacggcgccgtcggactacgcggaggagccgccgcgccaccccgacctcaggatcaactccaaggaaccgtttaatgctgagccccatcggtctgcgttggtttcgtcttatgtcaccccagtagatttcttctacaagaggaatcatggaccaattccaaaaatcgatgatatctcgagatacagtgtttccatcaatggccttgtgaacaagcatattcagctatccatggccgacattagattgcttccaaagtacaatgtcactgcaacgttgcagtgcgcaggcaataagaggactgcaatgagtaaggtacgaaaagtgagaggtgttggatgggacgtatctgctcttggaaatgcaacttggggaggagcaaaactatctgatgtccttgaactagttggaatacctaaactcagttccgttacagctttaggaggcaaacatgttgagtttgtcagtgttgacaggtgtaaagaggagaaaggtggtccctataaggcatcaattccattaaagcaggctacagatcctgatgctgatgtcttgcttgcatatgaaatgaacggagagatcatcaaccgtgaccatggatacccactccgtgttgtcgtacctggtgtcataggcgcacgttctgtaaaatggctggacagcatcagcataatcaaggaagaatgtcagggtttttttatgcaaaaagattacaagatgtttccacctaccgtagactgggacaatattgattggtcgactagaagaccacaaatggattttcctgtacagtctgctatttgcaccctggaggatgtggatgttatcaaggaaggaaaggctagaattgctggatatgcagtctcaggtggtggtcgtggcattgagagagtagatatatctgtcgatggaggtaaaacatgggttgaggctcatagatatcagaaaagcagtgttccatacatctctgatggacctcaaagtgacaagtgggcatgggttctctttgaggctacgttggacgtaccagcaaatgccgagatagtagctaaggcggtggactcagccgcaaatattcaaccggaaaaagtggaggacatatggaacctcagaggaatcctcaatacatcttggcaccggatcaaaatacaaaattcaagatccaaaatgtgaaagaagtatgttgctgtgtctagaacacgcaacatgctggtccttacgcctccatgatagtctaagaaataataagcactggagcttactttatctaattttcatttagactgtgccacggaactatgtttgagtcgtgttgctggtctgtaactttttttctgtaaccatatcagtgttacaaatactcctgcttgtgccagatgatctgatatgaagttcaccatgacgtatgctttaaaagtgaagatattaataaaatgcttta

SEQ ID NO: 3586 - DNA, 1560 bp, Brachypodium distachyon
cgactcaccacacacaccaaggcgctctccttgccatcatcatctcccaaaatatattgtgcgagccaggaaacgaaaaaccagcgagcgaccaagtgaccagacgaagacgatcgaagcgcgacagagatgccggggctgacggcgccgtcgggctacgcggaggagccgccgcgccatccggccctcaggatcaactctaaggaaccattcaatgctgagcctcatcgatctgcgttagtttcatcttatgtcaccccagtggatttcttttacaagaggaatcatggaccaattccaaaagtagatgatatatcaagatacagtgtttccatcaatggccttgtcagcaatcatatgcagctattcatggccgacattaggatgcttccaaagtacaatgtcactgcaacattacagtgcgcaggcaataagaggactgcgatgagcaaggtacggaaagtgagaggtgttggatgggacgtgtctgctcttggaaatgcaacttggggaggagcaaagctagctgatgtccttgaactagctggaatacctaaactcagttcagtcacatctttaggaggcaaacacgttgagtttgtcagtgttgacaggtgtaaagaggagaaaggtggcccctataaggcatcaattccactcaagcaggcaacagatcctgatgctgatgtgttacttgcatatgaaatgaatggagagaccatcaaccgtgaccacggatacccactccgtgttgtcgtacctggtgttataggcgcacgttctgttaaatggctggacagcatcaaccttatcgaggaggaatgccagggcttttttatgcaaaaagattacaagatgtttccacctactgtagactgggacaacattgattggtctactagaagaccacaaatggattttcctgtacagtctgctatttgcaccctggaggatgtggatgttatcaaggaaggaaaggctaggattgctggatatgcagtctcaggtggtggccgtggcatcgagagggtagatgtatctgttgatgggggtaaaacatgggttgaggcccacagatatcagaaaagcaatgtgccatacgtttctgatagagctcaaagtgacaagtgggcatgggttctctttgaggctacattagacataccagcaaatgctgagatagtagctaaggcggtggactcagctgcaaacattcaacctgaaaaagtggaggacatatggaacctgagaggaattctcaatacatcttggcatcggatcaagatacagaattcgttgtgcgcagcaaggtcgaatatgtgaaagaagtattttgctgcgcccttggacaagcagcatgctagacctcacgagtcaatgatagcctcgaataataagctgcatcagcttaatttctgcgatttccgtataatgctgtgccacggtactatggtgggagtagtgttactggtctgaatttgtttctgtgttcacatatcagtcttaaaaataactgtccgtgctggttgatctgatatgaagaaattttctgtgtcggtc

SEQ ID NO: 3587 - DNA, 2375 bp, Brachypodium distachyon
aatcgccgactcaccacacacaccaaggcgctctccttgccatcatcatctcccaaaatatattgtgcgagccaggaaacgaaaaaccagcgagcgaccaagtgaccagacgaagacgatcgaagcgcgacagagatgccggggctgacggcgccgtcgggctacgcggaggagccgccgcgccatccggccctcaggatcaactctaaggaaccattcaatgctgagcctcatcgatctgcgttagtttcatcttatgtcaccccagtggatttcttttacaagaggaatcatggaccaattccaaaagtagatgatatatcaagatacagtgtttccatcaatggccttgtcagcaatcatatgcagctattcatggccgacattaggatgcttccaaagtacaatgtcactgcaacattacagtgcgcaggcaataagaggactgcgatgagcaaggtacggaaagtgagaggtgttggatgggacgtgtctgctcttggaaatgcaacttggggaggagcaaagctagctgatgtccttgaactagctggaatacctaaactcagttcagtcacatctttaggaggcaaacacgttgagtttgtcagtgttgacaggtgtaaagaggagaaaggtggcccctataaggcatcaattccactcaagcaggcaacagatcctgatgctgatgtgttacttgcatatgaaatgaatggagagaccatcaaccgtgaccacggatacccactccgtgttgtcgtacctggtgttataggcgcacgttctgttaaatggctggacagcatcaaccttatcgaggaggaatgccagggcttttttatgcaaaaagattacaagatgtttccacctactgtagactgggacaacattgattggtctactagaagaccacaaatggattttcctgtacagtctgctatttgcaccctggaggatgtggatgttatcaaggaaggaaaggctaggattgctggatatgcagtctcaggtggtggccgtggcatcgagagggtagatgtatctgttgatgggggtaaaacatgggttgaggcccacagatatcagaaaagcaatgtgccatacgtttctgatagagctcaaagtgacaagtgggcatgggttctctttgaggctacattagacataccagcaaatgctgagatagtagctaaggcggtggactcagctgcaaacattcaacctgaaaaagtggaggacatatggaacctgagaggaattctcaatacatcttggcatcggatcaagatacagaattcgttgtgcgcagcaaggtcgaatatgtgaaagaagtattttgctgcgcccttggacaagcagcatgctagacctcacgagtcaatgatagcctcgaataataagctgcatcagcttaatttctgcgatttccgtataatgctgtgccacggtactatggtgggagtagtgttactggtctgaatttgtttctgtgttcacatatcagtcttaaaaataactgtccgtgctggttgatctgatatgaagaaattttctgtgtcggtcttaaaaataactgtccttgctggttgatctgatatgaagaaattttctgtgtcagtctaaaaaataactgtccttgctggttgatctgatatgaagaaattgtggattatgctttacaaattcattaattgttcgtttgagaattaaccacattttattaggcataactccaagcagttcgatgaacacaacatctttttttcgtggagaattactctgcattacagtatctctacttcttcagaagcttgatggtgttatttaacagcatgctcgttatgcttgttgccatcaaacctgagtcgcgtactagaaaaggctgaagaacatggcagggaactgcattctatctgataaaaccacacaacaattccagttgcaaagatgtgatgtaggaatatttccctcatctgtgcaaagacttcagcctgcagttgcaatggcactgataccaccagtgaatttacacatggatcacctaaaacctagcacctctcgttgtaaccaaacacagctttggcatcgtttcctaagtgccccctgctgcttcctcatgcccgttaacatcggcctgcaaaagataataagaaacattagcaactataattactagaaccatgtgaaattgtaaacgagaggaaaaaaagcaacacgggccgtggaataggggtaattactaacagcatttgacacttgctccttgtttgggtacatatccttcagcattttgtctaaagaatccttagctaaccggagcttcacttctttctgtcctgatttcgatgaatcctcaactgatgatgtaccgc

SEQ ID NO: 3588 - DNA, 1977 bp, Pennisetum glaucum
tgatgcccattcattcattatggacttgcaccagttgttaaagtacagattaactggtgctaacttcttctacgaatttcccacagagaacagcttagcaagcaatccctggccagctactccactgaagtcggaattcagcaactccctgtacagtcccctttcaacccagcttgagtgtgacaattcgtctgctattagcaaccctccagataaccagagctctacagaaaccatttcagcacaaccaatatcaccgctagaagttgatagctccaacagacaggctggtatactttgggaaaacacccaagtgagacctgatcaattgtacactacatcaaggcataatatgcaacacgctttacgggaaatagagactgttctgatggcacctgatgctgatgatgctgccactagcaccaagcatgagtttgaggaacacaaacatgctccgttgatgaggcagcggtcaaggacatggagtcatgaatcaagacagccatcaccaggagttgtccggacacaattgcatctggataccccacaacaagctatgaattccgccagaaagcgacaaagggagttaagggaggatccacagagcatggtgaagcagttgttaacaaagtgtgctgaagcattaagtgaggagaggatagaggagttccttaagcttgttcagcaagctcgtggagttgtatcaattactggggaaccaatacagaggttaggtgcttaccttcttgagggtttggttgctaggcatggaaactcgggtacgaacatatatcgtgctttgaagtgccgtgagccagagagtaatgaacttctgtcctacatgaagattttatacactatctgtccgtattttaagtttggctatatggctgccaatggggcaattgcagaggcattgagaaatgaagacaaaatacatataattgatttccagattgctcaagggacacaatggataacactgatccaagcactagctgcaaggcctgggggcccaccacatgtgcggatcactggaatagatgatccagtgtcagagtacgcccgtggtgaaggtctggaccttgtagggaagatgttgaaaagcatgtctgaagaattcaggatacctctggagtttacccctctacccggtgtctatgccacccaagtcacaaaagaaatgctagacatcaggccaggcgaagcacttgctgtcaacttcactctgcagctacaccacaccccagatgagagcgtggacgtcaacaacccacgggacgggctactccggatggtgaaagggctgtccccgaaggtgaccacactggtggagcaggagtcgcacaccaacacgacaccattcctgatgaggttcagtgagaccatggactactactcggctatgtttgagtcgattgacgcaaacttgccacgggacaacaaggagcggatcaacgtggagcagcactgccttgccaaggacattgtgaacatcatcgcctgcgaggggaaggatcgggtagagcggcatgagctcctgggcaagtggaagtcaaggctgacaatggctgggttcaagccgtacccgctaagctcgtacgttaactcggtgatcaggaagctcctcgggtgctactccgacaagtacaccctggaggagaaggatggcgctatgctgctcggctggaagagcaggaagttgatatctgcttctgcgtggcactgacaaaaagtttcagaagaacatgagtaaacaccttctcttacatatgaatatatatagtgaattccctggtctgtttccccagaaaagattttctttttggtacttgtacaggatcctgtatccttagtttttccctaaatcgcagaccaggatataaacattgacattagattgtagctgtatgataattacaattttcttgtttcaacccctgccccccacatctcacatcgcttgaatacttgatg

SEQ ID NO: 3589 - DNA, 1056 bp, Saccharum officinarum
gaaccagccaagagccatcagtctccactgtgactgtgactccgtgagctgcctgccctgcacactccccgcaccgccgcaccagctcagcaatcatggctcgcctactcctcctcgccgccgccgcagcggcgttcctggccgcgtcggctgcatcgccggtggccagcgacttcatccgcaagtcgtgccgcgcgacgcagtacccatcagtgtgcgagcagagcctggcgtcgtacgggggctccccgccgccgcggagcccgcgggagctggcgcgcgcggcgctgtccgtgagcgcggaccgcgcgcgcgccgcgtccgcgtacgtgggccgcctctgcggcggctccggctccgggggttcccgtggcgccggcgcaaagggcgcgaagaaggggtcggggtctgcggcatcggcggcgggccccgtgcgcgactgcctggagaacctggcggacagcgtgggccacctccgcgacgcggcgcaggagatgggcggcgccgggatgtcccgcgcgggcacgcccgcgttcaagtggcacctcagcaacgtgcagacctggtgcagcgccgcgctcaccgacgagaacacctgcctcgacggcctctccgcccgcggcgtcgacgccggcacgcgcgcagccatccgcggcaaggtcgtcgaggtcgcgcaggtcaccagcaacgcgctcgccctcgtcaacaaggtcgggccagggtactagcccaagacccaggcccagatctaggcccaagctcagtccatataacaccccttggccccagatggaccagatgttcgttgttatgcgtcggttagaaaaaaaaaaactagttcggttttccatgtgttttttttaactagtgcttcctgcatatatatgctttgcttgtgtggtgtaagatacagttaagggcgataaacttgtattttgggtggtgagaagtacagtaagacgtatgtactcctctgtccgatcctgtcacggcaaataaagctaagtgtcatcgttaacatggatatggtctttgaaaatatacattcttttacac

SEQ ID NO: 3590 - DNA, 2549 bp, Sorghum bicolor
gactcttcctcccctttgcttccccagaccgctctgccgcgtcaatctcgcgccccgtcccgcttccgctgccgcttgcccgcttcctcgtcgccgccatcttgctctggtccccgtggcagcggccgctgctccaagtaggagccgagtgattctctggccgaagatccaggctgagtcggcgtcgccggcagcagaggcgggagactccgccatcatgtcgttggactcggaggcctcctcgcagggcggggactaccgtagcttccgccagatcactcgagatcgtttattatttgaaatgctcagatcaactaggaagaattcgaaatcaacatggaaggtccttatcatggataagtttacagtcaagattatgtcttatgcatgcaagatggcagatatcacagaagaaggggtttcattggtcgaagacttatataaacgaaggcagccattgccttcactggatgccatatatttcatccaaccaactaaagaaaacattgtcatgttcctatctgacatgtcaggaagaagccctttgtacaagaaggcatatgtgtttttcagttctcccgtgcataaagaattggttgctcaaataaaaaaggattcaagtgtactacctcgtattgctgcacttagtgagatgaatttggagtactttgctattgattcccagggtttcacaactgaccatgagagggcattggaagaactttttagtgaaaatgcagaaggatctcacaagtataatgcttgtctgaacacaatggctactcgtatatctacagtatttgcatcaatgagggaattccctcgtgtacactaccgtgttgccaagacgattgatgcttctacaatgacaacactacgagacttgatccccacaaaacttgctgctagtgtatggaattgtcttgcgaaatataaaacgacagtacctgaatttcctcaaacagaaacatgtgaattacttatagtagaccgttcattggatcagattgcgccaattattcatgaatggacttatgatgctatgtgccatgatctgctttgtatggatggcaataagtatgttcatgaggttccaactaaaaatgggtcggcaactgaaaaaaaggaggttctgttagaagatcatgaccctgtctggcttgagcttaggcatgcacatatagcagatgcaagtgagagactacatgataaaatgactaacttcatttcaaagaacaaagctgcacaattgcaccaagcacgaaccggtggggaattatctacaagagatttacaaaaaatggttcaggctcttccacagtacaatgatcaaattgataagctttccctgcatgttgagattgcaggaaaactcaataacataatacgggaacaatgtcttcgggatgttggacaactagagcaagatcttgtgtttggtgatgctggaacaaaagaactaatcaactttttgagaacacaattggttgtaagtcgtgaaaataagttgcgcttgctgatgatttatgcagcacttaacccggagaagtttgaaagcgacaagggtgcaaaattaatgcagttggcaggattatctgctgatgacatgattgctgtaaataatatgcgttgcttatgtgggcctgataccaaaaagtcttcagtagggggttttgcactgaaatttgatgtccataagaagaagcacgcacatcgaaaagagcgaacaggggaagaatcagcatgggcactatcccgattttatcctattttggaggaattgattgaaaagcttagcaaaggtgagcttccaaaagatgaatataactgtatgaacgaccctagtcctagtgctcatggaccgccaaccagtagctctgcccgatcaagtcccgctcactctatgcgatccagacgaacaggtggcacatgggctagacctcgtggctctgatgatggatattcaagtgattctgtgttgaaacatgcctccagtgacttcaggaagcttggtcagcgtatatttgtttttgtaataggcggtgctactcgatcagagttacgtgctgcacacaagctttcatccaagctgaagcgagacatcatccttggttcatctagccttgatgatcctccccagttcatcacaaaattaaagttgatgtcagcagaagaattgacacttgatgatcttcagctgtaaatggcgtcatcgccccctttgaatgggttagttcaatatgaactttcgccataagttgtatgtaacctttttattttctttttagttttctgtccgctcttgtttgtgcgggcatatcatattcattcggtgaaatgtattcttaacaccacttttactggtgaatgtatataaatagtggccgacataactatacggatcagtttttttagattgggttggtttgttggtttccttctctacgaacttctgtatccacatgtgatgaggcaggttatacttttgaatgtattccctcagttttcaaatacacaaagtttgaataagctaaatagttacaaaaata

SEQ ID NO: 3591 - DNA, 2633 bp, Setaria italica
cagcggggggtagtctggtaatttccttggctggtggcggccgacgacctcttcgagaacagggaaagactcttcctcctcgttgcttccccctgcccgcactctgacgcggcaatctcgcgccccgtctcccgcttccgctccgcttactcgtcgttgccgtcgtgctccgatctccgccgccgcggccgctgcaccaagtcggggctgagtgatctctccggctgacgagtctaggccgaggcgccgtcgccggcagcaggaggcggggaagatctccggcgccatgtcgttggattcggacacctcctcgcagggcggggaccacaggagcttccgccatatcacgcgagatcgtctattatttgaaatgctaagatcaactaggaagaattcgaaatcaacatggaaggttcttatcatggataagtttacagtcaagattatgtcgtatgcatgtaagatggcagatatcacagaagaaggggtttcattggtcgaagatttatataaacggaggcaaccattgccgtcactggatgccatatatttcatccaaccaactaaagaaaacattgtcatgttcctatctgacatgtcaggaagaagccctttgtacaagaaggcatatgtgtttttcagttctcccgtacataaagaattagttgctcaaataaagaaggattcaagtgtactacctcgtatcggcgcacttagtgagatgaatctggagtactttgctattgattcccagggtttcacaactgaccatgagagggcattggaagaactttttagcgaaaatgcagaagggtctcacaagtacaatgcttgtctgaacacaatggctactcgtatatctacagtatttgcatcaatgagggaattcccccgtgtacactaccgtgttgccaagacaattgatgcttctacaatgacaacactacgagacttggtccccacaaagcttgctgctggtgtgtggaattgtcttgcgaagtataaaacgacaatacctgaatttcctcaaacagaaacatgtgaattacttatagtagaccgttcaatagaccagattgcgccaattattcatgaatggacgtatgatgccatgtgccatgatctgctatgtatggatggcaacaagtatgttcatgaggttccaagtaaaaatgggtcagcaactgaaaaaaaggaggtcctgttagaagatcatgaccctatctggcttgagcttaggcatgcccatatagcagatgcaagcgagaggcttcatgataagatgaccaacttcgtttcaaagaacaaagcagcacaactgcaccaagcaagaaacggtggagaagtatctacaagagatttacaaaaaatggttcaggctcttccacagtacagcgatcaaattgacaagctttccctgcatgttgagattgcaggaaaactcaataacataatacgggagcaatgtctgcgggatgttggacagctagaacaagatcttgtgtttggcgatgctggaacgaaagaactaatcaattttttgagaacacaattgggtgtaagtcgtgaaaataagttgcgcttgctgatgatttatgcagcacttaacccggagaagttcgaaagcgacaagggtgcaaaattgatgcagttggcaggattatctgttgatgacatgattgctgtaaataatatgcgttgcttatgtgggcctgatacaaaaaagtcctcaggaggaggttttacactaaaatttgatgttcataagaagaaacatgcacatcgaaaagagcgaacatgggaagaatcagcatgggcgctctcccgattttatcctgttttagaggaattgattgagaagcttagcaaaggtgagctgccaaaagatgaatataactgtatgaacgaccctagtcctagtgctcatggagtgccaaccagtagctctgtccgaacaagtccagctcactcaatgcgatctagacgaacaggtggcacatgggccagacctcgtggatctgatgatggatattcaagtgattctgtgttgaagcatgcatccagtgacttcaaaaaacttgggcagcgtatatttgtttttgtaattggcggtgctactcgttcagagttacgtgctgcacacaaactttcgtccaagctgaagcgggaggtcatccttggttcatctagccttgacgatcccccccaattcatcacaaaactgaagttgatgtcagcagaactgtcacttgatgatcttcagatataaatagcgtcatacccacttggaagttggaatggtgctgttcaatgttcaccgtaaattgtatgtatcctttttattttcttcataattcttgtatcagctcgtgtgtgaggcagcatcatattcatttggtagaaagtgtatcatcaacactacctgtagtcttgattgcgaaagtgtataatcaacaccacctgtagtcttgattgaatgaatgtacataatagtgggcaacagctctaaccatacggatcatcttttttaagattgggccaatgatttgttggtttctttatccacatatgttgaaactggttacatacactgtaaatgtaattgtatgatggtagtagttcattaatgttgg

SEQ ID NO: 3592 - DNA, 2220 bp, Pennisetum glaucum
ccggcatcatgtcattggattcggacacctcctcgcagggcggggaccacaggagcttccgacagatcacacgagatcgtctattatttgaaatgctaagatcaaccaggaagaattcaaaatcaacatggaaggttcttatcatggataagtttacagtgaagattatgtcgtgtgcatgtaagatggcagatatcacagaagaaggggtttcattggtcgaagatttatataaacggaggcaaccattgccttcactggatgccatatatttcatccaaccaactaaagaaaacattgttatgttcctatctgacatgtcaggaagaagtcctttgtacaagaaggcatatgtgtttttcagttctcccgtacataaagaattagttgctcaaataaagaaggattcaagtgtactacctcgtattggcgcacttagtgagatgaatctggagtacttggctattgattcccagggtttcacaactgaccatgagagggcattggaagaactttttagcgaaaatgcagaagggtctcacaaatacaatgcttgtctgaacacaatggctactcgtatatctacagtatttgcatcaatgcgggaattcccccgtgtacactaccgtgttgccaagacaattgatgcttctacaatgacaacactaagagacttggtccccacaaagcttgctgctggggtgtggaattgtcttgcgaagtataaaacaaaattacctgaatttcctcaaactgaaacatgtgaattacttatagtagaccgttcaatagaccagattgcaccaattattcatgaatggacgtatgatgccatgtgccatgatcttctatgtatggatggcaacaagtatgttcatgaggttccaagtaaaaatgggtcagcaactgaaaaaaaggaggtcctgttagaagatcatgaccctatctggcttgagcttaggcatgcccatatagcagacgcaagcgagaggcttcatgataagatgaccaacttcgtttcaaagaacaaagcagcacaactgcaccaagcaagaaacggtggagaagtatctacaagagatttacaaaaaatggttcaggctcttccacagtacagcgatcaaattgacaagctttccctgcatgttgagattgcaggaaaactcaatagcataatacgggaacaatgcctgcgggatgttggacagctagaacaagatcttgtgtttggtgatgctagcacaaaagaactaatcaattttttgagaacacaattgggtgtaagtcgtgaaaataagttgcgcttgctgatgatttatgcagcacttaacccggataaatttgaaagtgacaagggtgcaaaactgatgcagttggcaggattatctgctgatgacatgattgctgtaaataatatgcgttgcttatgtggtcctgatacaaaaaagtcctcaggaggaggttttacactaaaatttgatgttcataagaagaaacatgcacatcgaaaggagagaacaggggaggaatcagcatgggcactctcccgcttttatcctgttttagaggaattgattgagaagctcagcaaaggtgagctgccgaaagaagaatataactgtatgaacgaccctagtcctagtgctcatggactgccaaccagtagctctgtccgtacaagtccagctcactcaatgcgctctaggcgaacaggtggcacatgggccagacctcgtggatctgatgatggatattcaagtgactctgtgctgaagcatgcatccagtgacttcaaaaaacttgggcagcgtatatttgtttttgtcattggtggggctactcgttcagagttacgtgctgcacacaaactttcatccaagctgaagcgggaggtcatccttggttcatctagccttgacgatccccctgagttcatcacaaaactgaaattgatgtcagcagaagaactgtcacttgatgatcttcagatatagatggcgtcatacccacttggaagttggatcggtgttcaacgtgcaccgtaaatttgttcaaaaaaaacttgcaccgtaaattgtatgtatcatttttattttcttcataattcttgtatcagctcatgtgtggggcaccatcatattccggtataaagtgtatcatcaacactacctttagtcttgattgaatgaatgtatataatagtggccaacagatctaatt

SEQ ID NO: 3593 - DNA, 2389 bp, Brachypodium distachyon
gagatctcccggcgtcatgtcgttggactcagattcctcgtcgcagggcggtgacaaccggagcttccgccagatcacacgagaccgtttattatttgaaatgctcagatcaactaggaaggattcgaaatcagcatggaaggttcttatcatggataagtttacagtgaagataatgtcatactcatgtaagatggcagatattacagaggaaggagtttcattggttgaagatttatacaaacggaggcagccattgccttcactggatgctatatatttcatccaaccaactaaagaaaacatcgttatgttcctctctgacatgtcaggaagaagcccattgtacaagaaggcttttgtatttttcagttctcccatacagaaagacttagttgctcaaataaagaaagattcaagtgtattacctcgtattggtgcacttagtgagatgaatttggagtacattcctattgaatcccagggtttcgtgactgaccatgaaagggcattagaggagcttttctgtgagagtgcagaaggctttaacaaatacaatgcttgtttgaatgcaatggctactcgtatatctacagtatttgcatcaatgagggaatttccccgtgtgcactaccgtgttgccaagacaattgatgcttctacaatgacaacactaagggacatggtgcccacaaagattgctgctggtgtgtggaattatctctccaaatataagacgtcgattcctgaatttcctcagacagaaacttgtgaactgctcattgtagaccgttcagtagatcagattgcaccaattattcatgaatggacttatgatgccatgtgccatgatctactatgcatggatggcaacaagtatgtacatgagattccgagtaaaaatggttcagcctcggagaaaaaggaggtcctgttagacgatcatgatccagtttggcttgaacttcgacatgctcatatagcagatgcaagtgaaaggctgcatgataagatgacacatttcgtctcgaaaaataaagctgcccaactacaccaagcaagaactggaggagagctatcaactagagacttgcaaaaaatggttcaagctcttccacagtacagtgatcaaattgacaagctttctctgcatgtcgagattgcaggaaaactcaatagcataataagggaacaatgtcttcgagatgttggacagctagagcaagatcttgtgtttggtgatgccgggacaaaagaattaatcaattttttgaggacacaattgggtgtaagtcgtgaaaataagttgcgtttgctgatgatttatgcagcaatcaacccagaaaagtttgaaagtgataagggcacaaaattgatgcagttggcaggattatccgctgacgacatgattgctgtgaataatatgcgttcgttatgttctgatacaaaaaagccctcaggaggaggctttacactgaaatttgatgttcacaagaaaaaacatggatacagaaaagagcgaacaggggaagagtcagcatgggcgctgtcccgattttatccagttctagaggaattaattgagaagctcagcaagggtgaattgccaaaagatgaatataactgcatgaatgaccctagtcccagtttccatggattaccaacgaccactaccagcagctcagcccgcacaagcccagctcactcgatgagatctagaaggacgggtggctcatgggctaggcctcgtggttctgatgatggatattcaagtgattcggtattgaagcatgcatctagtgatttcaaaaagcggggccagcgaatatttgtttttgtcattggtggtgctactcgatcagagttacgtgctgcacacaagcttacatccaagctgaagcgggaggtcatccttggttcatccagccttgatgatccaccccagttcatcacaaaactgaagatgatgtcagctgaagagttgacattggacgatcttcagatataaaaaaaaataacggacatggactctggctccatcaggaatttctccttgtacttattttagtattttctttgtgatcgttaggtctagttatgagctaattgcattaaccacaggctatcgatgcattaaccacaggcagtcctgtatcatattcattttagtagggagtgtattctctacaccggctactcataattgaatgaatgtacataacagtggccggcaactgtaactatgtgattttatttttggttgggctggtggttggtttgttatctccacttaatgagaaatgttgtatgtttgtgacccaagtaacatgcacacgcctgtgagttttcctggtattataaatggaatgatctacattattccatttca

SEQ ID NO: 3594 - DNA, 3161 bp, Triticum aestivum
cccttacctccccttggtcggttcggtcccgttgggctacgtctcaaggaacggaccgggccgggcccgaacgcggtaagggttggttaacgtaccaaccgacgaagacggtacggcggggcgccggtggcggccgatgacggtctggtcctggtggtcttgggagcctcgtactcccgtttcttcttcctctcgcacgcggtcgctgcatattctcccacaccccaatttctgcttctacttcgtgtcctccgatcgcacccaacttcagcaagttaaagccgtgggttgtctctaccctacggccacaaacagaggcctcgtcaccggagggaggcggtgagatctcccggcggcatgtcgttggattcggactcctcttcgcagggcggcgaccgccggagcttccggcagatcacacgagaccgattattatttgaaatgctcaggtcgactaggaaggattcaaaatcagcatggaaggttcttatcatggataagtttacggtcaagataatgtcctactcatgtaagatggcagacatcacagaagaaggggtttcattggttgaagatctatacaaacggagacagccattgccttcactggatgctatatatttcatccaaccaactaaagaaaacgttgttatgttcctctctgacatgtcaggaagaagcccgttatacaagaaggcgtatgtgtttttcagttctcccatacagaaagacttagttgctcaaataaaaagggattcaagtatattacctcgtattggtgcacttagtgagatgaatttggagtacttccctattgattcccagggtttcataactgaccatgaaagggcattggaagagcttttctgtgagagtgcagaaggcttcaacaaatacaatgcttgtttgaatgcaatggctactcgtatatctacagtatttgcatcaatgagggaatttccccgtgtgcactaccgcattgccaagaccattgatgcttctacaatgacaacactaagggacatggtgcccacaaagattgctgctggtgtatggaattacctctccaaatataaaacgtcaattcctgaattcccgcagacagaaacttgtgaacttctcatagtagaccgttcagtagatcagatcgcaccaataattcatgaatggacttatgatgccatgtgccatgatctgctatgcatggatggtaacaagtacgtacatgaggtttcaagtaaaaatggttcagcctcagaaaaaaaggaggtcctgttagaggaccatgatccagtttggcttgaacttcgacattcccatatagcagatgcaagtgaaagacttcatgataagatgacacattttgtctcgaagaacaaagctgcccaactacagcaagcaagaactggaggagagctatcaactagagacctacaaaaaatggttcaagctcttccacagtacactgatcaaattgacaagctttcgctgcatgtcgagattgcaggaaaactcaatgtcataataagggagcaatgtcttagagatgttggacaactagagcaagatcttgtatttggtgatgctgggacaaaagaattaatcaattttttccggacacaattgggtgtaagtcgtgaaaataagttgcgtctgctcatgatttacgcagcaatcaatccagagaagtttgaaagcgataagggtacaaaaatgatgcagttggcaggattatctgctgatgacatgatcgctgtgaataatatgcgctgcttatgcactgacacaaaaaagtcctcaggaggaggttttacactgaaatttgatgttcagaagaaaaaacatgcacatagaaaagagcgaacaacggaacaatcagcatgggcactgtcccgattttatccggttctggaggaattgattgagcagctcagcaagggtgaattaccaaaagatgaatataactgcatgaacgaccctagtcccagtttccatgtagtacctaccactaccagtacctcagcccgcacaagcccagctcactcgatgagatctaggaggactggtggatcatgggctaggcctcgtggttctgatgatggttattcaagtgattctgtattgaagcatgcatcgagtgatttccaaaagcatggccagcgtatatttgtttttgtcattggtggtgctactcgatcagagttacgtgctgcacacaagctttcatcgaagctgaagcgtgaggtcatccttggttcgtccagccttgatgatccaccccagttcatcacaaaactgaagatgatgtccgccgaagagctaacactggacgatcttcacatataaaaagacattatgcacatgtacttcagggctccatcgggaattctcctttattttggtattttctttgtgatcgtttggtttgttacacactagttgcatcaaaaccacaggctatcaatacgttaagctgcataatattcattctgtaaggagcgacttcccaaaacccgctactcataattgaatgaatgtacataacagtcgccagaaactgtaactatgtgagttttatttatttggctgacggttcatttttctctctagtggatgagaaaatattctctgtttgagtatcaagtaatgtgcaatgcgtacctgatctatctatttctttgggtaaatttgggtttattcgataaatgccactgcaatttttgccaaatcgagaaatgccactggaactttcacatgcttctttgttgttgatatagccatttgaacccatgttttgtcaaatagatcgcccatatgcatcctttatttttatgtggacagggagtgctcctgccccatttgataccagccatggtcagctcagcccggtcacccttttcctcgcttcatcttgacagggtgccgcagcagcgtgtcgcttgatagaggcgaagatgtcgtgatgttttgatgagatagttatcgttttctgtgagagtcgactttgatgatctgactacgaacgtgcgaagacgtcgtgccttagcaattgctaaaccaactttcgagggttattgaccacgtcggagcatgattaacctgaccacgaaggtctatttcttgcgagcaaacgaagaataagcaagaaactgagattgcaa

SEQ ID NO: 3595 - DNA, 2471 bp, Triticum aestivum
ggcacgaggccgatgacggtcttggtcttggtggtcttgggagcctcgtactcccgtttcttcttcctctcgcacgcggtcgctgcatattctcccacaccccaatttctgcttctacttcgtgtcctccgatcgcacccaacttcagcaagttaaagccgtgggttgtctctaccctacggcctcgtcaccggagggaggcggtgagatctcccggcggcatgtcgttggattcggactcctcttcgcagggaggcgaccgccggagcttccggcagatcacacgagaccgattattatttgaaatgctcaggtcgactaggaaggattcaaaatcagcatggaaggttcttatcatggataagtttacggtcaagataatgtcctactcatgtaagatggcagacatcacagaagaaggggtttcattggttgaagatctatacaaacggagacagccattgccttcactggatgctatatatttcatccaaccaactaaagaaaacgttgttatgttcctctctgacatgtcaggaagaagcccgttatacaagaaggcgtatgtgtttttcagttctcccatacagaaagacttagttgctcaaataaaaagggattcaagtatattacctcgtattggtgcacttagtgagatgaatttggagtacttccctattgattcccagggtttcataactgaccatgaaagggcattggaagagcttttctgtgagagtgcagaaggcttcaacaaatacaatgcttgtttgaatgcaatggctactcgtatatctacagtatttgcatcaatgagggaatttccccgtgtgcactaccgcattgccaagaccattgatgcttctacaatgacaacactaagggacatggtgcccacaaagattgctgctggtgtatggaattacctctccaaatataaaacgtcaattcctgaattcccgcagacagaaacttgtgaacttctcatagtagaccgttcagtagatcagatcgcaccaataattcatgaatggacttatgatgccatgtgccatgatctgctatgcatggatggtaacaagtacgtacatgaggtttcaagtaaaaatggttcagcctcagaaaaaaaggaggtcctgttagaggaccatgatccagtttggcttgaacttcgacattcccatatagcagatgcaagtgaaagacttcatgataagatgacacattttgtctcgaagaacaaagctgcccaactacagcaagcaagagctggaggagagctatcaactagagacctacaaaaaatggttcaagctcttccacagtacactgatcaaattgacaagctttcgctgcatgtcgagattgcaggaaaactcaatgtcataataagggagcaatgtcttagagatgttggacaactagagcaagatcttgtatttggtgatgctgggacaaaagaattaatcaattttttccgaacacaattgggtgtaagtcgtgaaaataagttgcgtctgctcatgatttacgcagcaatcaatccagagaagtttgaaagcgataagggtacaaaaatgatgcagttggcaggattatctgctgatgacatgatcgctgtgaataatatgcgctgcttatgcactgacacaaaaaagtcctcaggaggaggttttacactgaaatttgatgttcagaagaaaaaacatgcacatagaaaagagcgaacaacggaacaatcagcatgggcactgtcccgattttatccggttctggaggaattgattgagcagctcagcaagggtgaattaccaaaagatgaatataactgcatgaacgaccctagtcccagtttccatgtaggacctaccactaccagtacctcagcccgcacaagcccagctcactcgatgagatctaggaggactggtggatcatgggctaggcctcgtggttctgatgatggttattcaagtgattctgtattgaagcatgcatcgagtgatttccaaaagcatggccagcgtatatttgtttttgtcattggtggtgctactcgatcagagttacgtgctgcacacaagctttcatcgaagctgaagcgtgaggtcatccttggttcgtccagccttgatgatccaccccagttcatcacaaaactgaagatgatgtccgccgaagagctaacactggacgatcttcacatataaaaagcattatgcacatgtacttcagggctccatcgggaattctcctttattttggtattttctttgtgatcgtttggtttgttacacactagttgcatcaaaaccacaggctatcaatacgttaagctgcataatattcattctgtaaggagcgacttcccaaaacccgctactcataattgaatgaatgtacataacagtcgccagaaactgtaactatgtgagttttatttatttggctgacggttcatttttctctcc

SEQ ID NO: 3596 - DNA, 2722 bp, Secale cereale
tcttcctctcgcacgcggtcgttgcatattccccaacacccccgtttctgcttctacttcctgtcctccgatcgcacccaacttcagcaagttaaagccgtgggttgtctctaccctacggccacaaacagaggcctcgtcaccggagggaggcggtgagatctcccggcggcatgtcgttggattcggactcctcttcgcagggcggcgaccgccggagcttccggcagatcacacgagaccgattattgtttgaaatgctcaggtcgactaggaaggattcaaaatcagcatggaaggttcttatcatggataagtttacagtcaagataatgtcctactcatgtaagatggcagatataacagaagaaggggtttcattggttgaagatctatacaaacggaggcagccattgccttcactggatgctatatatttcatccaaccaactaaagaaaatgttgttatgttcctctctgacatgtcaggaagaagcccgttatacaaaaaggcgtatgtgtttttcagttctcccatacagaaagacttagttgctcaaattaaaagggattcaagtatattacctcgtattggtgctcttagtgagatgaatttggagtacttccctattgattcccagggtttcataactgaccatgaaagggcattggaagagcttttctgtgagagtgcagaaggcttcgacaaatacaatgcttgtttaaatgcaatgtctactcgtatatctacagtatttgcatcaatgagggaatttccccgtgtgcactaccgcattgccaagaccattgatgcttctacaatgacaacactaagggacatggtgcccacaaagattgctgctggcgtatggaattatctctccaaatataaaacgtcaattcctgaattcccgcagacagaaacttgtgaacttctcatagtagaccgttcagtagatcagatcgcaccaataattcatgaatggacttatgatgccatgtgccatgatctgctatgcatggatggtaacaagtacgtacatgaggtttcaagtaaaaatggttcagcctcagaaaaaaaggaggtcctgttagaggaccatgatccagtttggcttgaacttcgacattcccatatagcagatgctagtgaaagacttcatgataagatgacacattttgtctcgaagaacaaagctgcccaagtacaccaagcaagaactggaggagagctatcaactagagacctacaaaaaatggttcaagctcttccacagtacactgatcaaattgacaagctttcgctgcatgtcgagattgcaggaaaactcaatgccataataagggagcaatgtcttagagatgttggacaactagagcaagatcttgtatttggtgatgctgggacaaaagaattaatcaatttttttcggacacaattgggtgtaagtcgtgaaaataagttgcgtctgctcatgatttacgcagcaatcaatccagagaagtttgaaagcgataagggtacaaaaatgatgcagttggcaggattatctgctgatgacatgatcgctgtgaataatatgcgctgcttatgcgctgacacaaaaaagtcctcaggaggaggttttacactgaaatttgatgttcagaagaaaaaacatgcacatagaaaagagcgaacaacggaacaatcagcatgggcgctgtcccgattttatccggttctggaggaattgattgagcagctcagcaagggtgaattaccaaaagatgaatataactgcatgaacgaccctagtcccagtttccatgtagtacctaccactaccagtacctcagcccgcacaagcccagctcactcgatgagatctaggaggactggtggatcatgggctaggcctcgtggttctgatgatggttattcaagtgattctgtattgaggcatgcatcgagtgatttccaaaagcatggccagcgtatatttgtttttgtcattggtggtgctactcgatcagagttacgcactgcacacaagcttacatcgaagctaaagcgtgaggtcatccttggttcgtccagccttgatgatccaccccagttcatcacaaaactgaagatgatgtcagccgaagagctaacactggacgatcttcacatataaaaagcattatgcacatgtacttcggggctccatcaggaattctcctttattttggtattttctttgtgatcgtttggtttgttacacactagttgcatcaaaaccacatgctatcaatacgttaagctgcataatattcattttgtaaggagtgacttcccaaaacccgctactcataattgaatgaatgtacataacagtggccagaaactgtaactatgtgagttttatttatttggctgacggttcatttttctcactagtggatgagaaaatattctctgtttgattatcaagtaatgtgcgatgcgtacctgatctatctatttcgtttagggttaatttggttaattcgataaatgatgtagagataacttaccaatgactaattgtcgtagtattggattgggtgcgggtgctagttgtatacaagaaagtattaaccttaaaaaattaaaaaaaaaaaaaaaaaacaaaaaaaaaaaaaaacaaaaaaaaaaaaaaacaaaaaaaaaactaaaaaaaaaaacgagtaacgtagaccgtagacagaacggacg

SEQ ID NO: 3597 - DNA, 2739 bp, Oryza sativa
gggggggggggggggcaatctggtaaaatctcctcggccgccaccgtccgacgacctcttggagacgcgcacgcgcttcctccccccaattctcttcttcctctctccggcacgcggccacacggagcattccctctgatctctctccgacttccccttcttctgcttgctcgccgcccgccgatcaccgcctcctctacgcggggcgggtcaaaggctagtggttctctccaccctactagcgcagcccgaggcggcgtcgccggaagtaggcgggggagatctccggcgccatgtcgatggactcggacacctcctcccagggcggggaccaccggagcttccgccaaatcacgcgagaccgtttattatttgaaatgctcaggtcaactaggaaacattcaaaatcaacatggaaggttcttattatggataaacttacagtcaagataatatcatgttcatgtaagatggcagatattacagaagaaggggtttcattggttgaagatttgtacaaacggagacaaccgttgccttcactagatgctatatatttcattcaaccaactaaagaaaacattgggatgttcctgaatgacatgtccggaagaaatccgttatacaagaaggcgtatgtgtttttcagttctcccatacagaaagaattagttactcaaataaaaaaagattcaagtgtactaccccgtattggtgcacttagtgagatgaatttggagtactttgctattgattcccagggtttcaccactgaccatgaaagagcattggaggagctttttagtgaaaatgctttggattcacacaagtacaatgcttgtttgaacacaatggctactcgcatatctacagtgtttgcatcaatgagggaattccctagagtgcactaccgtgtcgccaagacaattgatgcttctgtaacgacaacactacgagatttagtgcctacaaaacttgctgctgctgtttggaattgcctttcaaaattgaaaacatcaataccggattatcctcaaactgagacatgtgagctacttatagttgatcgttcagtagaccagattgcaccaatcattcatgaatggacatatgacgcgatgtgccatgatcttctatgtatggatggcaacaagtatgtccatgaggttccgagtaaaaatggttcatcaactgaaaagaaggatgtcctattggaggatcatgatccaatatgggttgagctccggcatgcccacatagcagatgcaagcgaaagactgcatgacaagatgagcaattttgtgtccaagaataaagctgctcaactgcagcaagcaagaactgggggagagatatccaatagagatttgcaaaaaatggttcaagctcttccacagtacagcgatcaaattgagaagctttctcttcatgttgagattgcaggtaaactcaatagcataataagggagcaaggtcttcgagatgttggacagctagagcaagatcttgtatttggtgatgctggaactaaagaattaatcaattttttgaggacacaattgggtgtaagtcgtgaaaacaagttgcgtttgctgatgatctatgcagcaatcaacccagacaagttcgaaagtgacaagggtgaaaaattgatgcagttggcaggattatccactgatgacatgattgctgtgagtaatatgcgttgcttatgtggccctgacaccaaaaagtcctcgggaggaggttttacgtttaaatttgatgttcacaagaagaagcatggacttagaaaggagcgaactggggaagaatctacatgggcactttcccgattttatcctgttctagaggacttgattgagaagcttagcaagggagaattaccaaaagacgaatactattgcatgaacgaccctagcccaagtttccacggtctgccaatgagcagctcagtcagaactagcccagctcaccaaccagctcattctatgagatccagacggacaggtggtacatgggctcggccacgtggctctgatgatgggtattcaagtgattcagtgctgaagcattcgtcgagtgacttcaaaaagcttggtcagcgtatatttgtgtttgtcattggtggcgccactcggtcggagttacgtgctgtgcacaagcttacatccaagctaaagcgggaagtcatacttggttcatctagtctggatgatcctccccagttcatcacgaaactgaagatgatgtcagtcgatgaactgacgctggatgatcttcaaatataaatagcaacactgcacacatggaattatgcggctctatctagatttgctccatttgtagctatatatataatttttaatctgtgatttgtaggactagttattatgcacgggttgatctctataccgcaggttgtcaatacgaggggctgcatcatattcatttgctagggagagtccgcacaacattaggtgattcttaacggaatgaatgtacataacagtggccggcagatgtaactatgtaacgattttctcgattgggccaatgatcgattggttgccttctccacggaatgtgagatgttctctatttgcccacgaacctccatccacatttaaaattgcaaacgtgaacttatgaagtagtagtattagtaagatgcaagttatgacttgtgagttgtgactgtaaatgtgtttagtattagtaagttatcacttgtttggg

SEQ ID NO: 3598 - DNA, 2355 bp, Hordeum vulgare
gtttcttcttcctctcccacccccatttctacttctactctgtgtcctccgatcgcacctaacggccacaaacagaggcctcgtcaccggagggaggcggtgagatctcccggtggcatgtcgttagattcggactcctcttcgcagggcggccaccgccggagcttccggcagatcacacgagaccgattattatttgaaatgctcaggtcgactaggaagggttcaaaatcagcatggaaggttcttatcatggataagtttacagtcaagataatgtcctactcctgtaagatggcggatatcacagaagaaggggtttcattggttgaagatctatacaaacggaggcagccattaccttcactggatgctatatatttcatccaaccaactaaagaaaacgttgttatgttcctctctgacatgtcaggaagaagcccgttatacaagaaggcatatgtgtttttcagttctcccatacagaaagacttagttgctcaaataaaaagggattcaagtatattacctcgtattggtgcactcagtgagatgaatttggagtacttccctattgattcccagggtttcataactgaccatgaaagggcattggaagagcttttctgtgagagtgcagaaggcttcaacaaatacaatgcttgtttgaatgcaatggctactcgtatatctacagtatttgcatcaatgagggaatttccccgtgtgcactaccgcattgccaagaccattgatgcttctacaatgacaacactaagggacatggtacccacaaagattgctgctggtgtatggaattatctctccaaatataaaacgtcaattcctgaattcccgcagacagaaacttgtgaacttctcatagtagaccgttcagtagatcagattgcaccaataattcatgaatggacttatgatgccatgtgccatgatctgctatgcatggatggtaacaagtacgtacatgaggtttcaagtaaaaatggttcagcctcaggaaacaaggaggtcctgttagaggaccatgatccagtttggcttgaacttcgacattcccatatagcagatgcaagtgaaagacttcatgataagatgacacattttgtctcgaagaacaaagccgcccaactacaccaagtgagaactggaggagagctatcaactagagacctacaaaaaatggttcaagctcttccacagtacacagatcaaattgacaagctttcgctgcatgtcgagattgcaggaaagctcaatgccataataagggagcaatgtcttcgagatgttggacaactagagcaagatcttgtatttggtgatgctgggacaaaagaattgatcaatttttttcagacacaattgggtgtaagtcgtgaaaataagttgcgtctgctcatgatttacgcagcaatcaatccagagaagtttgaaaacgataagggtacaaaaatgatgcagctggcaggattatctgctgatgacatgattgctgtgaataatatgcgctgcttatgcgctgacacaaaaaagtcctcaggaggaggttttacactgaaatttgatgttcagaagaaaaaacatgcacatagaaaagagcgaacaatggaacaatcagcatgggcgctgtcccgattttatccggttctggaggaattgattgagcagctcagcaagggtgaattaccaaaagatgaatataactgcatgaacgaccctagtcccagtttccatgtagtacctaccactaccagtacttcagcccgcacgagcccagctcactcgatgagatctaggaagactggtggatcatgggctaggcctcgtggttctgatgatggttattcaagtgattctgtattgaagcatgcatcgagtgatttccaaaagcatggccagcgtatatttgtttttgtcattggtggtgctactcgatcagagttacgcgctgcgcacaagcttacatcgaagctgaagcgtgaggtcatccttggttcgtccagccttgatgatcccccccagttcatcacaaaactgaagatgatgtcagccgaagagctgacactggacgatcttcacatataaaaagcattatgcacatgtactctggggcttcatcaggaattctcctttattttggtattttctttgtgatcgtttggtttgttccacactagttgcatcaaaaccacatgctatcaatctgttaagctgcataatattcattttgtaaggactgacttcccaaaacccgctacttataattgaatggatgtacataacagtggccagaaactgtaactatgtggttttatttatttggctcacagttca

SEQ ID NO: 3599 - DNA, 2693 bp, Oryza sativa
gggggggggggggggcaatctggtaaaatctcctcggccgccaccgtccgacgacctcttggagacgcgcacgcgcttcctccccccaattctcttcttcctctctccggcacgcggccacacggagcattccctctgatctctctccgacttccccttcttctgcttgctcgccgcccgccgatcaccgcctcctctacgcggggcgggtcaaaggctagtggttctctccaccctactagcgcagcccgaggcggcgtcgccggaagtaggcgggggagatctccggcgccatgtcgatggactcggacacctcctcccagggcggggaccaccggagcttccgccaaatcacgcgagaccgtttattatttgaaatgctcaggtcaactaggaaacattcaaaatcaacatggaaggttcttattatggataaacttacagtcaagataatatcatgttcatgtaagatggcagatattacagaagaaggggtttcattggttgaagatttgtacaaacggagacaaccgttgccttcactagatgctatatatttcattcaaccaactaaagaaaacattgggatgttcctgaatgacatgtccggaagaaatccgttatacaagaaggcgtatgtgtttttcagttctcccatacagaaagaattagttactcaaataaaaaaagattcaagtgtactaccccgtattggtgcacttagtgagatgaatttggagtactttgctattgattcccagggtttcaccactgaccatgaaagagcattggaggagctttttagtgaaaatgctttggattcacacaagtacaatgcttgtttgaacacaatggctactcgcatatctacagtgtttgcatcaatgagggaattccctagagtgcactaccgtgtcgccaagacaattgatgcttctgtaacgacaacactacgagatttagtgcctacaaaacttgctgctgctgtttggaattgcctttcaaaattgaaaacatcaataccggattatcctcaaactgagacatgtgagctacttatagttgatcgttcagtagaccagattgcaccaatcattcatgaatggacatatgacgcgatgtgccatgatcttctatgtatggatggcaacaagtatgtccatgaggttccgagtaaaaatggttcatcaactgaaaagaaggatgtcctattggaggatcatgatccaatatgggttgagctccggcatgcccacatagcagatgcaagcgaaagactgcatgacaagatgagcaattttgtgtccaagaataaagctgctcaactgcagcaagcaagaactgggggagagatatccaatagagatttgcaaaaaatggttcaagctcttccacagtacagcgatcaaattgagaagctttctcttcatgttgaggtaaactcaatagcataataagggagcaaggtcttcgagatgttggacagctagagcaagatcttgtatttggtgatgctggaactaaagaattaatcaattttttgaggacacaattgggtgtaagtcgtgaaaacaagttgcgtttgctgatgatctatgcagcaatcaacccagacaagttcgaaagtgacaagggtgaaaaattgatgcagttggcaggattatccactgatgacatgattgctgtgagtaatatgcgttgcttatgtggccctgacaccaaaaagtcctcgggaggaggttttacgtttaaatttgatgttcacaagaagaagcatggacttagaaaggagcgaactggggaagaatctacatgggcactttcccgattttatcctgttctagaggacttgattgagaagcttagcaagggagaattaccaaaagacgaatactattgcatgaacgaccctagcccaagtttccacggtctgccaatgagcagctcagtcagaactagcccagctcaccaaccagctcattctatgagatccagacggacaggtggtacatgggctcggccacgtggctctgatgatgggtattcaagtgattcagtgctgaagcattcgtcgagtgacttcaaaaagcttggtcagcgtatatttgtgtttgtcattggtggcgccactcggtcggagttacgtgctgtgcacaagcttacatccaagctaaagcgggaagtcatacttggttcatctagtctggatgatcctccccagttcatcacgaaactgaagatgatgtcagtcgatgaactgacgctggatgatcttcaaatataaatagcaacactgcacacatggaattatgcggctctatctagatttgctccatttgtagctatatatataatttttaatctgtgatttgtaggactagttattatgcacgggttgatctctataccgcaggttgtcaatacgaggggctgcatcatattcatttgctagggagagtccgcacaacattaggtgattcttaacggaatgaatgtacataacagtggccggcagatgtaactatgtaacgattttctcgattgggccaatgatcgattggttgccttctccacggaatgtgagatgttctctatttgcccacgaacctccatccacatttaaaattgcaaacgtgaacttatgaagtagtagtattagtaagatgcaagttatgacttgtgagttgtgactg

SEQ ID NO: 3600 - DNA, 2173 bp, Setaria italica
cagatatcacagaagaaggggtttcattggtcgaagatttatataaacggaggcaaccattgccgtcactggatgccatatatttcatccaaccaactaaagaaaacattgtcatgttcctatctgacatgtcaggaagaagccctttgtacaagaaggcatatgtgtttttcagttctcccgtacataaagaattagttgctcaaataaagaaggattcaagtgtactacctcgtatcggcgcacttagtgagatgaatctggagtactttgctattgattcccagggtttcacaactgaccatgagagggcattggaagaactttttagcgaaaatgcagaagggtctcacaagtacaatgcttgtctgaacacaatggctactcgtatatctacagtatttgcatcaatgagggaattcccccgtgtacactaccgtgttgccaagacaattgatgcttctacaatgacaacactacgagacttggtccccacaaagcttgctgctggtgtgtggaattgtcttgcgaagtataaaacgacaatacctgaatttcctcaaacagaaacatgtgaattacttatagtagaccgttcaatagaccagattgcgccaattattcatgaatggacgtatgatgccatgtgccatgatctgctatgtatggatggcaacaagtatgttcatgaggttccaagtaaaaatgggtcagcaactgaaaaaaaggaggtcctgttagaagatcatgaccctatctggcttgagcttaggcatgcccatatagcagatgcaagcgagaggcttcatgataagatgaccaacttcgtttcaaagaacaaagcagcacaactgcaccaagcaagaaacggtggagaagtatctacaagagatttacaaaaaatggttcaggctcttccacagtacagcgatcaaattgacaagctttccctgcatgttgagattgcaggaaaactcaataacataatacgggagcaatgtctgcgggatgttggacagctagaacaagatcttgtgtttggcgatgctggaacgaaagaactaatcaattttttgagaacacaattgggtgtaagtcgtgaaaataagttgcgcttgctgatgatttatgcagcacttaacccggagaagttcgaaagcgacaagggtgcaaaattgatgcagttggcaggattatctgttgatgacatgattgctgtaaataatatgcgttgcttatgtgggcctgatacaaaaaagtcctcaggaggaggttttacactaaaatttgatgttcataagaagaaacatgcacatcgaaaagagcgaacatgggaagaatcagcatgggcgctctcccgattttatcctgttttagaggaattgattgagaagcttagcaaaggtgagctgccaaaagatgaatataactgtatgaacgaccctagtcctagtgctcatggagtgccaaccagtagctctgtccgaacaagtccagctcactcaatgcgatctagacgaacaggtggcacatgggccagacctcgtggatctgatgatggatattcaagtgattctgtgttgaagcatgcatccagtgacttcaaaaaacttgggcagcgtatatttgtttttgtaattggcggtgctactcgttcagagttacgtgctgcacacaaactttcgtccaagctgaagcgggaggtcatccttggttcatctagccttgacgatcccccccaattcatcacaaaactgaagttgatgtcagcagaactgtcacttgatgatcttcagatataaatagcgtcatacccacttggaagttggaatggtgctgttcaatgttcaccgtaaattgtatgtatcctttttattttcttcataattcttgtatcagctcgtgtgtgaggcagcatcatattcatttggtagaaagtgtatcatcaacactacctgtagtcttgattgcgaaagtgtataatcaacaccacctgtagtcttgattgaatgaatgtacataatagtgggcaacagctctaaccatacggatcatcttttttaagattgggccaatgatttgttggtttctttatccacatatgttgaaactggttacatacactgtaaatgtaattgtatgatggtagtagttcattaatgttggtacgggg

SEQ ID NO: 3601 - DNA, 2597 bp, Sorghum bicolor
gagcagattccttgtgttgctgtagcctgtagtaccccgtccaaccccgcagcggcggcaaccactgcccgtaaattccattccaccgcgtccggctttcctcaccgcgcgaccattcgccattccctccgctcgaatcggcaagcccccatttcgagtcccggaggcggccgcgaaccctaactctacagggaggcctcgccggcgaggagtgggggctccgttggccatgtcgatcgactcggacagctcgtcgcagagcggcgccgactacaggagcttccgccagataacccgagaccgtttgttagttgagatgctgagatcgactcggaagagttcaaaatcaacatggaaggttctaatcatggacaaacttacggtcaagataatgtcattttcatgcaagatggcagatatcacagaagaaggggtttcattggttgaagacctatacaaacggaggcagccattgccttcaatggatgcaatttatttcatgcagcctactaaagaaaatgttcgcatattcatgtctgacatgtcaggaaaaaattcactgtacaagaaagcttatgtttttttcagttctcccgtacagagggaattggtagctcatataaaaaaggattcgactgtactaactcgcatcagtgcactcagtgagatgaacttggaatactttgctattgatagtcagggattcataactgaccatgacaaggccttggaggagttgtttagtgaagatgcagaaggctcacacaaatacaatgcatgccttaacacaatggctacaagaattgctacagtgtttgcatcattgagggaatttcctcgtgtgcactaccgtgtagccaggacaatcgatgcatctactctgacgacactacgagatttggtcccaacaaagcttgctgcttctgtgtggaattcccttgccagatataagtcgacgatacctgaatttccacaaacagaaacatgtgaactacttattgttgaccgatcaatagatcagattgcaccaattattcatgagtggacatatgatgctatgtgccatgatctactgtatatggatggcaacaagtatgtgcaagaggttccaagtaagaatggttcagcaaatgagaaaaaggaggttttgttggaggatcatgatccagtatggcttgagctgcggcatgcgcatatagctgatgctaatgaaaggctgtatgaaaagatgaccagttttgtatcaaagaataaagcagctcaactacaacaggcaagatctggtggagagttatctaccaagcagttgcagaaaatggttcaagctcttccacaatatagtgatcaaattgacaagctcacccttcatgttgagattgcaggaaagcttaataatataatcaaagaacaacaccttaaagatgttggacagctagagcaagatcttgtgtttggtgatgctgggacaaaagaactaatcagtttcttacgaacccgcatggatgtaagtcgtgaaaataagttgcgtttgctgatgatttatgcttccatcaacccagagaagttttttgaaagtgataaaggtgcaaagctgatgcagcttgcaggattatctgctgatgacatgattgtagtaaataatatgcgctgcttacgtggacctgatactaaaaagtcttcagttggggcctttactttgaaatttgatcttcagaagaaaaagcctggtatcagaaaggagcgggttggggaagagtcaacttggatgctatctcgattttatcccatcctggaggacttgattgagaaacttagtaagggtgagctaccgaaggatgagtaccactgcatgaatgaccctagtcctagtttccgtggaattccaggaagcacatctgctcgaacaagcccagctcatcagccagcccaatccatgagatctagacgaataggtggcacatgggctagacctcggaactctgatgatggttattcgagtgactctgtactgaagcatgcatcaagtgaccttagaaagttgggcccgcgcttatttatctttgtaattgggggtgctactcggtctgagttgcgtgttgcccacaagctgtcaagcaaactgaagagagaaattatccttggctcctctagtcttgatgacccaccgcagttcatcactaaattgaagatgttatcaaccgaggagctgtcgctggatgatttgcaaatataataatgtcaagtacaatggccttacattctccactgtaattatttacttgcatcactacaacgggtttagttgtactcccttaaccttgtatcgagccacaggctctcttacacaggctagaggggcatgatatttattcggccaccgtcagatactaaccatccagtgtacatacatgacagcgaccagagactgtaacataggtggcaactttattagattggtggatcagcgaaattcaatgtccagaggacttcaatttttgtcctcagattgctgttattttgcggggaaaatagatctatgtatatttttaactcaaaccggaattcatgtctaatataagagcaaagaaagcacaaca

SEQ ID NO: 3602 - DNA, 3341 bp, Sorghum bicolor
gaaggaaacccctctcttttccttccatccctctggaacagctcaacacgccttcggcatcctccgttcaactttcaaccgcgctttctcttctggaaccatcacacgaagagttctcaatgacgcgtgggtctagaaacctaacagcgcgtcgcggtcccatctgccatagacccactcaaaaccccacaccacacgactactccccgtctggtcgtccatggaggaaaaaaaacccggtcgagcagattccttgtgttgctgtagcctgtagtaccccgtccaaccccgcagcggcggcaaccactgcccgtaaattccattccaccgcgtccggctttcctcaccgcgcgaccattcgccattccctccgctcgaatcggcaagcccccatttcgagtcccggaggcggccgcgaaccctaactctacagggaggcctcgccggcgaggagtgggggctccgttggccatgtcgatcgactcggacagctcgtcgcagagcggcgccgactacaggagcttccgccagataacccgagaccgtttgttagttgagatgctgagatcgactcggaagagttcaaaatcaacatggaaggttctaatcatggacaaacttacggtcaagataatgtcattttcatgcaagatggcagatatcacagaagaaggggtttcattggttgaagacctatacaaacggaggcagccattgccttcaatggatgcaatttatttcatgcagcctactaaagaaaatgttcgcatattcatgtctgacatgtcaggaaaaaattcactgtacaagaaagcttatgtttttttcagttctcccgtacagagggaattggtagctcatataaaaaaggattcgactgtactaactcgcatcagtgcactcagtgagatgaacttggaatactttgctattgatagtcagggattcataactgaccatgacaaggccttggaggagttgtttagtgaagatgcagaaggctcacacaaatacaatgcatgccttaacacaatggctacaagaattgctacagtgtttgcatcattgagggaatttcctcgtgtgcactaccgtgtagccaggacaatcgatgcatctactctgacgacactacgagatttggtcccaacaaagcttgctgcttctgtgtggaattcccttgccagatataagtcgacgatacctgaatttccacaaacagaaacatgtgaactacttattgttgaccgatcaatagatcagattgcaccaattattcatgagtggacatatgatgctatgtgccatgatctactgtatatggatggcaacaagtatgtgcaagaggttccaagtaagaatggttcagcaaatgagaaaaaggaggttttgttggaggatcatgatccagtatggcttgagctgcggcatgcgcatatagctgatgctaatgaaaggctgtatgaaaagatgaccagttttgtatcaaagaataaagcagctcaactacaacaggcaagatctggtggagagttatctaccaagcagttgcagaaaatggttcaagctcttccacaatatagtgatcaaattgacaagctcacccttcatgttgagattgcaggaaagcttaataatataatcaaagaacaacaccttaaagatgttggacagctagagcaagatcttgtgtttggtgatgctgggacaaaagaactaatcagtttcttacgaacccgcatggatgtaagtcgtgaaaataagttgcgtttgctgatgatttatgcttccatcaacccagagaagttttttgaaagtgataaaggtgcaaagctgatgcagcttgcaggattatctgctgatgacatgattgtagtaaataatatgcgctgcttacgtggacctgatactaaaaagtcttcagttggggcctttactttgaaatttgatcttcagaagaaaaagcctggtatcagaaaggagcgggttggggaagagtcaacttggatgctatctcgattttatcccatcctggaggacttgattgagaaacttagtaagggtgagctaccgaaggatgagtaccactgcatgaatgaccctagtcctagtttccgtggaattccaggaagcacatctgctcgaacaagcccagctcatcagccagcccaatccatgagatctagacgaataggtggcacatgggctagacctcggaactctgatgatggttattcgagtgactctgtactgaagcatgcatcaagtgaccttagaaagttgggcccgcgcttatttatctttgtaattgggggtgctactcggtctgagttgcgtgttgcccacaagctgtcaagcaaactgaagagagaaattatccttggctcctctagtcttgatgacccaccgcagttcatcactaaattgaagatgttatcaaccgaggagctgtcgctggatgatttgcaaatataataatgtcaagtacaatggccttacattctccactgtaattatttacttgcatcactacaacgggtttagttgtactcccttaaccttgtatcgagccacaggctctcttacacaggctagaggggcatgatatttattcggccaccgtcagatactaaccatccagtgtacatacatgacagcgaccagagactgtaacataggtggcaactttattagattggtggatcagcgaaattcaatgtccagaggacttcaatttttgtcctcagattgctgttattttgcggggaaaatagatctatgtatatttttaactcaaaccggaattcatgtctaatataagagcaaagaaagcacaacagcaggagtccggctgaacacgaagatacacagcgtgccatgagccggaacagtactttgcataggacccgcttgattggtggagcagggtacaagtagcttgtgggcggagtgaagctgttttggtaaaacagcttcgaggtgtggataaaaaaagacaaaatgcttagtctttttttcctagtacccttcttttttttgcttattgtttcccttttcttctttgttcttatccttttaccgtcccttaggccacgtggctccacgccttccaaacggtcgcgcaaaactatgttaaacagcggttcctccatgctcagccgcttggtgggtgcggccatgtgccctagttgggtggctcctccatgctcagtcgctactctacactcggcgaaagagcttggcttttttgcaagtagggataaaaatgatacgaatattttcttgcacgtagggataaaaatggtatgaatattttctgactgtattcgagatcgaatcca

SEQ ID NO: 3603 - DNA, 2644 bp, Zea mays
caaaaccccacaccacaccgtctggtcgtccatggagaaaactcgttgagcagattccttgttcctgcagtaaccctgtccaacccccgcagcggcggcaaccacagaaacactgcctgtaaattccattcctccgcgttcggcctccctcatcgcgcgaccgttccctctgctcgaatcggcaagcccgcatttcgagccccggaggtggccgcgaaccctaaccctacagcgaggcgtcgccggagttgtgggggctccgttggccatgtcgatggactcggacagctcgtcgcacagcggcgccgactacaggagtttccgccagatcacccgagaccgtttgttagttgaaatgctgagatcgactcgaaagagctcaaaatcatcatggaaggttctaatcatggacaaacttactgtcaagataatgtcattttcatgcaagatggcagatatcacagaagaaggggtttcattggttgaagacctatacaaacggaggcagccattgccttcaatggatgcaatttattttatgcagcctactaaagaaaatgttgacatattcatgtcggacatgtcaggaaaaaattcattgtacaagaaagcttatgtatttttcagttctcctgtacagagggagttggtagctcatataaaaaaggattcgactgtgctaacacgcatcagtgcacttagtgagatgaacttagaatactttgctattgacagtcagggcttcataactgaccatgacaaggccttggaggagttgtttagtgaagatgcagaaggctcacacaagtacaatgcatgccttaacacaatggctacaagaattgctacagtgtttgcatcattgagggaatttcctcgtgtgcactatcgtgtagccaggacaatcgatgcatctactctgacgacactacgagatttggtcccaacaaagcttgctgcttccctgtggaattcccttgtcagatttaagtcaacgatacctgaatttccacaaacagaaacatgtgaactacttattgttgaccggtcaatagatcagattgcaccaattattcatgagtggacgtatgatgctatgtgccatgatctattgtgtatggatggcaacaagtacgtgcaagaggttccaagtaagaatggttcagcaaatgagaaaaaggaggttttgttggaggatcatgatccagtatggcttgagctgcggcatgcacatatagctcatgttaatgaaacgctacatgaaaagatgaccagttttgtatcaaagaacaaagcagctcaactacagcaggcaagatctggtggagagttatctaccaagcagttgcagaaaatggttcaagctcttccacaatacagtgatcaaattgacaagctcacccttcatgttgagattgcaggaaaactcaataacataatcaaagaacaccaccttaaagatgttggacagctagagcaagatcttgtgtttggtgatgctgggacaaaagaactaatcagtttcttacgaacccgcatggatgtaagtcgtgaacataagctgcgtttgctgatgatttatgcttccataaacccagagaaatttttcgaaagtgagaaaggtgcaaagctgatgcagcttgcaggattatctgctgatgatatgattgtagtaaataatatgcgctgcttacgtggagctgattctaagaagtcttcagttggggcttttactttgaaatttgatcttcagaagaaaaagcctggtatcaggaaggagcggactggagaagagtcaacatggatgctatctcgattttatcccatcctggaggacttgattgagaaacttagtaagggtgagctaccaaaagatgagtaccactgcatgaatgatcctagtcctagtttccgtggaattccagggagcacatctgctcgaacgagcccagctcatcagccagcccaatccatgagatctagacgaataggtggcacatgggctagacctcggaactccgatgatggttattcgagtgactctgtactgaagcatgcatcaagtgacttcagaaagttgggccagcgcctatttatctttgtaattggaggtgctactcggtctgagttgcgtgttgcccataagctgtcaggcaaactgaagagagaaattatccttggctcctctagtcttgatgacccaccgcagttcatcactaaactgaagatgttatcaaccgaggaactgtcgcttgatgatttgcaaatataacaattccaaggacgattgtccgtggcattctacactgtaattatttatttatttgcatctctacaacgggtttagttttactcccttaaccgaaccacaggtgctcttacacaggctagaggggcatgatattcattcggtagccaatgtcagttacaatcgagtgtacacacatggcagcgaccagagactgtaatataggtggcgtctttattagattggtggatcagtgaagttcaatgttccgaggacttctatttgtcctcagattgctgctattttgtggggaaagtgtatattttttcctcaaaccggtgagattaattcgtgtaataataacaacaaaaagaagagctagagtaagaacaaaaa

SEQ ID NO: 3604 - DNA, 2829 bp, Brachypodium distachyon
atgacgcgtgggacttgcagcacagcttaacccgactggccccgcgtgcgatggacccaaaagcttaaaccccacacaacggcgcatgccgctcggcaaacctccttcgtcgtcgtcctcgttggaacaagagagaagttacctccaatcccgcggcggtggcgaaccccgtaaaatattctcctactttcccttgcctcccctccctccccgccgcacgccggcacgcgcgatcctctcctccggccgaaccgccgcctcgtcttccgacagtgttgtgctgccgcggaccctaaccctagcgctggtggcgtccttcgccggcgaccatgtcgacggactccgacacctcctcgcgaaatggcgccgacaggaggagcttccgtgagatcacccgggaccgtctattaattgaaatgctaagatcagctaagaataactcaagatcaacatggaaggttcttatcatggacaaacttacagtcaagataatgtcattttcatgcaagatggctgatatcacggaacaaggggtttcattggttgaggacctatacaaacggaggcaaccgttgccatcaatggatgcaatttatttcatgcaaccaaccaaagaaaatgttcgcatttttatgtcggacatgtcagggaaacatccattgtacaagaaagcctatgtatttttcagttctcccgtgcagaaagaattagtgtctcaaataagaaaagattcaagtcttataacacgtgttggtgcacttagtgagatgaatttggaatactttgctattgatagccagggcttcataaccgaccatgacaaggctatagaagagctgttcactgaaaatgcagaaggttcaatgaagtacaattcatgcattaacatgatgggcactcgaattgctaccgtatttgcgtcaatgagggagtttcctcgtgttcactatcgtgttgctaggacaattgatgcttctactttgacaactctacgagatttagtccccacaaagcttgcggcctctgtgtggaattgcttggcgagatataaatcaaccatacctgaattccctcagacagagacatgtgaattacttattgcagaccgctcgatggatcagattgcacctatcattcacgaatggacttatgatgcaatgtgtcatgatctgctgtgcatggatggtaacaaatatgtacaagaggtgccaagtaagaccggttcaggtactgagaaaaaggaggtgttgttggaagatcatgatccgatatggcttgagcttcggcatttacatatagcggatgctaatttaagattgcatgagaagatgaccaattttatatcaaaaaacaaagcagcacaactatacaaagcaaagtttggtcaacaaacaagaactggcggagagttatcaacaaaagaactacaaaaaatggtccaagctcttccacagtacagtgatcaaattgacaagctttctctccatgttgagattgcagacaagctcagtgacatgatcaaacaacagcatttgaaagatgtcgggcagctcgagcaagaccttgtgtttggtgaagctgggacaaaagaactaatcaatttctttaggacacgtctggatacaagtcgtgaaaacaagctgcgtttgctaatgatttatgctgcaattaacccagagaagatacaaggtgacaagggagcaaagctgatgcagctggctggattatcagcggatgacatgattgcagtgaataatatgcattgcctatgtgcgcatgatactaaaaagtcttcaactggtggctttactatgaaatttgatttacataagaaaaagcgtggtatcagaaaagaacgagtaggggaagaatcaacatggttgctgtcccggttttatcccatccttgaggagttgatcgagaaacttagtaaaggcgagcttccaaaagatgagtatcactgtatgagtgaccctagttctagtttccgtggaatcccaagcagcatgtcggcccgagcaagtccagctcatccgccagctcaatccatgagatctagatggacaggtggcacatgggcgaggcctcgaaattccgatgatggctattcaagtgactctgtactgaagcatgcatcaagcgatatgagaaagttgggtcggcgcttgtttatctttgtagttgggggtgctactcggtctgagttacgcgctgctcacaagctgtcttccaaactgaatagagaaattatccttggctcttctagtcttgatgatccaccccaattcatcacgaaactaaagatgctatctactgaggagttgacactggacgatctgcatatataacaactggaatggagcatccactgtaattatctactgatttctcagtgctctagatttacttgttgaacatcatacaaaccacaggctagaggagcatgctgtttacttggtagggcagccctccattaactcataatccagtgtacatctgtgttgctagcagctttagggtgtgtggtacatttattggatctgtaaatgagttgagatgttcagtattcttttctgggggaaaagatatgtgatattcatgattgaagtttggcggctggcactgagaatgttacgaggggaatcttcttcttttttcaatcctgagtttgttctttatctgtcgcccacctgtgtggttttgaagttgtttgcagtaagattaccatgtataaatggcttgaaatttgaaccgggctattaccgtttacacggtgattccatcatgctatcgcgatcccagtaatcggaaaagtaatgtttatgctca

SEQ ID NO: 3605 - DNA, 1951 bp, Setaria italica
ccaccacctccggctggctacttttgccgcctccaccgccctttcaggccttcgcccaaccgactgcgcgttccctcccaaacgcgcaccccctcctctcctcccgtgaccaccgcctcagcctcgcgtcctcgggttccctccaatccgtgccaccgggcttctcgtcccggctcgtgctgcggttcagtgtgcaagtaatggagcggcggcggtcaccgaggctgctgctccaagtgttcttcttgctcgccgcttcttctccgctcgggagtgcagggattggaggcctcggagttggcccggagagcaatggagcttccgttagtcctaggaattccagaaggctgttgcagattggagatggaaacgaagatagcctatttcatctcccacatgcaaggactttctcacacaagagcagatctcgtaaaagagctccaacgccagcagcagcaccaacgtctgctccatcaccgtcaccattcatatccccaccagaaagctcaccttctacatcaccacatgcttcaggatccatgccacgccaatctccttcacaccatcatccaactgcagcccctccacatttggacaggtctaggcctacaactaagccggacgaacacgatcgttcagttgaaactccagttcattcttcgcataaacattcctggacaacctatggtttggttgcagcagggattgctgttttcattctggtatcagcagccagtgttctctgcttccgagctaagaaaatgggaactgtgaggccatgggcgacaggtctcagtggtcaattgcagaaagcctttgtaactggtgtaccttcattgcaacggtcagagctggaaacagcatgtgaggatttcagcaatataattggttctacctctagctgcatgctgtacaaggggaccttgtccagtggagttgaaattgcagtggcctcaagcttggtaacatctgctaaggattggtcgaaagaaaatgaatcacagtacaggaagaagatcacaagtttgtccaaagtaagccacaagaattttatgaatttgcttggctactgcgaggaagagcatccatttaccagagtgatggtatttgaatatgctccaaatgggacactttttgagcatctccacatcagggaagcagagaagcttgactggatggcacggctcaggatatccatgggcattgcttactgtcttgagcacatgcatcagctgaaaacaccagttgtgcctaggaatttcgactctactacgatataccttacggatgactttgctgcaaaagtctcagatcttgaattttggaatgatgcaaagggacataattcaaccaacgacaacctcacatcatcatcggacctggaaagtgttgtgcgcaagtatggcatagtgctgctggaaatattgaccggacgagctccccattctgaggtggatgggccacttgaacactgggcttcacgctacttcgacggccagatgcgtcttgaggagctgattgaccccagcatgggttccttccccgaagacgctgcgcgtgcgctttgcgaggttgtaaggtcctgcattgatccagatccaaagaagagaccacggatggcagaggttgcagctcggatgagagagatcactgcgttggggcctgacggagcgactccgaaggtgtcgccgctgtggtgggcggagcttgagatcatgtcttctgagacctgaagttggcggccagccagatgatattctttaatctgttggttgctgctaatcttgtttcgtggacttgattaggtagagggtggttgagaatttgttctgtgtgcaaaattgcatagggagtggtattgtacatgtaaagaagattaacaatgtaacaggcattacagccaacttgagaaatagaaaagggcgcgtggtttgtttttagattttcaggc

SEQ ID NO: 3606 - DNA, 1592 bp, Sorghum bicolor
aacgaacatataccgctggctcccttccgcaggcaggcagcctctttgctgacaccgccgcgcccccaccaccgatacagaggagtcggtgcaaccgaaacggtgcagagactggtaggtttggtgcctcgtcgccgtcgcgctcagcaaacagtggagtggagtatcctactaccttgaccaatggccaatgctacctagctctagctgtgctcttgccatatccgtcgagccgaagcaaccagcagccccatttcgatacgcgcgagggagccggatcgggatcgggatcgggatcggaagagaagtgtgggcgggcacacaagagacacacagggagggagggggaaccggggaacattccaatcaactgccgatgcagcgggacgcgagaagctggtcgccggcggcggccacggaggccggcggccgcccttacgcgatgccttcgcccgtgcagccgtcgtccacgagtccgtgccccgcgcggtgccacatgtcatatctcctgctgtccggcaccaaggagacggtgaagaatgcactgtcgcggtgggggcggaaggtcggcgaggcgacgaggaaggccgaggatctgtcgcgcaacacatggcagcacttgaggacggcgcctagcatcgcggaggccgcggtggggaggatcgcgcaggggaccaaggtgctggcggaaggcggccacgacaggatattccggcaggccttcagcgccccgccggacgagcagctgcgcaagtcctacgcgtgctacctctccacggccgccggcccggtgatgggcgtcatgtacctgtccacggccagggtcgccttctgcagcgacagccccctgtcctacgaggcctccggcggcgacaggacggagtggagccactacaaggtggcgattcctcttcaccggctgagggcggcgagcccgtcagccaacaagctgaagcccgcggagaagttcatccagctggtgtcggtggacagccacgagttctggttcttgggcttcgtcaactacgacagcgcggtagcgcacctgcaggaagcgctgagcggcttccgcaacctgcaggcgtgacgtacgtgaattgattcaacagagcgtttcttctgttccccttgtcgaatcgtttcattcagatttcagagaagagaccatgattatcctggtgtggttgccattgtctgcgagagaacagtcgaatcgtttcattcagatttcagagaagaccatgattatcctggtgtggttgccattgtcagcgagagaacagtcgaatcgtttcattcagatttcagagaagaccatgattatccatggcgttggctgtaatgatcatgggccagattaacctgtggatgtcacgattgttttttaaagtgattaagtgatcatgtcttgcaacaagaggattcatgctgctgcgcgaattgctcgtttgctgagaagcgcatgtttggtttccttcactcgtccaacgaacatactagtctgttttcattattcctacacacttcttctctattaatatatgcccggcatattcttgtcactggctcttcaaattactcctgtacaaaaa

SEQ ID NO: 3607 - DNA, 881 bp, Sorghum bicolor
gtcgagccgaagcaaccagcagccccatttcgatacgcgcgagggagccggatcgggatcgggatcgggatcggaagagaagtgtgggcgggcacacaagagacacacagggagggagggggaaccggggaacattccaatcaactgccgatgcagcgggacgcgagaagctggtcgccggcggcggccacggaggccggcggccgcccttacgcgatgccttcgcccgtgcagccgtcgtccacgagtccgtgccccgcgcggtgccacatgtcatatctcctgctgtccggcaccaaggagacggtgaagaatgcactgtcgcggtgggggcggaaggtcggcgaggcgacgaggaaggccgaggatctgtcgcgcaacacatggcagcacttgaggacggcgcctagcatcgcggaggccgcggtggggaggatcgcgcaggggaccaaggtgctggcggaaggcggccacgacaggatattccggcaggccttcagcgccccgccggacgagcagctgcgcaagtcctacgcgtgctacctctccacggccgccggcccggtgatgggcgtcatgtacctgtccacggccagggtcgccttctgcagcgacagccccctgtcctacgaggcctccggcggcgacaggacggagtggagccactacaaggtggcgattcctcttcaccggctgagggcggcgagcccgtcagccaacaagctgaagcccgcggagaagttcatccagctggtgtcggtggacagccacgagttctggttcttgggcttcgtcaactacgacagcgcggtagcgcacctgcaggaagcgctgagcggcttccgcaacctgcaggcgtgacgtacgtgaattgattcaac

SEQ ID NO: 3608 - DNA, 1118 bp, Brachypodium distachyon
atgcaggcgcctgccgggaggacgtggtcgccgatggcaacggaggccaacccctacgcgatgccggcgccggcgcagaagagcaccaaggagacggtgaagaacgcgctgtcgctgtgggggcggaaggtcggcgaggcgaccaggaaggccgaggacctgtcacgcaacacatggcagcaccttcggacagcgccgagcatcacggaggcggcggtggggaggatagcgcaggggaccaaggtcctggcggaaggcggccacgacaagatcttccggcaggccttcagcgcgccgccggacgagcagctccgaaagtcgtacgcgtgctacctgtccacgtccgccggcccggtcatgggggtcatgtacctctccacggccagggttgccttctgcagcgacaacccgctctcctacgaggcctccggcggcgacaggacagaatggagctattacaaggtggcgattcctctgcaccggctgagggccgcgatcccgtcggccagcaagctgaagcccgcggagaagttcatccagctcgtttcggtggagaaccacgagttctggctgatggggttcgtcaactacggcagcgcggtcatgcacttgcaagaagttctcagcggcttccacaatttgcaggcgtgaccgtgtgacgtacgacgacggtcgatcggcatcggcgttgagtatacctgtggactgtggtggtagtggttgttcgctaatacagtccggagtagccgcgtgtctgtgctttgttggtgttgctgaggaaccgacgcattgcaatttgcagtatgttgcttactgctactctggtgctacagcgactactgttcgattatcttcctgataccgaagttgtacttacccagggaatgtttgctgtaaaaattatacagagagccaaaggaagaaatcagacgattacgaaattgcatgttacgtcgtgcaaattgaagccggccggcctcccactcggagcgacaacaatggccaacagggacatgtgtttccgtatcgctaccaacttacgcagataccttttttttttttccttttttagggagatgtcgatgactcgcgtgtagtgctggagccggcagattaga

SEQ ID NO: 3609 - DNA, 1094 bp, Hordeum vulgare
gggcggaagcaaccatcccatttcgacacccgcggcgggcacgaggcggaacattccaaggtttccaggctccgacaagaggaagaagcgcgggctgttctgctgtagatccagggatgcaggcacccgccgggagaacgtggtcgcccatggcgacggaggtcaacccctacgcgatgccggcgccggcgcagaagagcaccaaggagacggtgaagaacgcgctgtcgctgtgggggcggaaggtcggcgaggcgacccggaaggccgaggacctgtcgcgcaacacatggcagcaccttcggacggcgcctagcatcacggaggcggccgtggggaggatcgcgcaggggaccaaggtcctggcggagggcggccacgacaggatcttccggcaggccttcagcgccccgccggacgagcagctccgcaagtcctatgcctgctacctctccacgtccgccggcccggtcatgggggtcatgtacctctccaccgcccgggtcgccttctgcagcgacaacccgctctcctacgaagccggcggaggcggcgacaacacggaatggagctactacaaggtggcgattcctctgcaccggctgagggcggcgatcccgtcggccagcaagctgaagccggcggagaagttcatccagctcgtgtcggtggagaaccacgagttctggctcatggggttcgtcaactacagcggcgccgtcgtgcacttgcaagaagctctcagcggcttccacaacctgcaggcgtgacgacgaccaccaccatcgcgcctgcggtctgtggtaatggtgctttcgccaatcgtccggcgtgggagtgtttctgcagttcctactgttttcgtgtttggcgttgcagagcagccgagtaattgcagcatgctgtttactgagagcattcacaggatcatgtcaatattattattttgcggggaagatcttgacaatattgatgcgagtactttttttttaaacgactgtgtctacataatgtccttttttttagtcgtccacataatgtccttggtagacaacaattattttggaattaataaaagttaaaaattgtattac

SEQ ID NO: 3610 - DNA, 1029 bp, Secale cereale
gcgagagtacatagccggcagcggcggtcacgaggtggaacattccgagttccaggctccaaggaggagaagaagaggcgcggggcgttctgctgcagatccggcgatgcaggcgcctgccgagagaacgtggtcgccgatggcgacggaggccaacccctacgcgatgccggcgccggcgcagaagagtgccaaggagacagtgaagaacgcgctgtcgctgtgggggcggaaggtcggggaggcgggcaggaaggccgaggacctgtcgcgcaacacatggcagcaccttcggacggcgcctagcatggcggaggcggccgtggggaggatcgcgcaggggaccaaggtgctggcggagggcggccacgacaggatcttccggcaggccttcagcgccccgccggacgagcagctccgcaagtcctacgcctgctacctctccacgtccgccggcccggtcatgggggtcatgtacctctccaccgcccgggtcgccttctgcagcgacgccccgctctcctacgaggcccacgggcacgccggcgacaacacggaatggagctactacaaggtggcgattcctctgcaccggctgagggcggcgatcccgtcggccagcaagctcaagccggcggagaagttcatccagctcgtgtcggtggagaaccacgagttctggctgatgggcttcgtcaactacagcagcgccgtcgtgcacttgcaagaagccctcagcggcttccacaacctgcaagcgtgacgacgacgacgacccgcatcgcacacgcctgcggtctgtggtactgctggttgttttggccaatcgtcagacgtgggagtgtttctacgattgctactgttttcatgtttttctttggtgttggagcggagccgagtaattgcagcatgctgtttactgagagcattcaaaggatcgtgacaatataaggtgcatagatttttttagaaaaatccaaaatataaggtttattgcgttgcaaaccaaaaaagaaaaaactaaagaga

SEQ ID NO: 3611 - DNA, 1003 bp, Triticum aestivum
ggtaggtgacccggtcatcatcacaatcccgacttcccggttcggtagattatatcatggcagatgcgtgccatgtgagctgccaccgtagctactagctagccagccatcgggcggaagcaaccagcccatttcgacgatcgcgagagtacatagccggcagcggcgggcacgaggtggaacattccgagtttcccaggctccaagaagaagaagaagaagcgcgggccgttctgctgcggatcctgtgatgcaggcgcccgccgggagaacgtggtcgccgatggcgacggaggccaacccctacgccatgccggcgccggcgcataagagcaccaaggagacggtgaagaacgcgctgtcgctgtgggggcggaaggtcggcgaggcgagcaggaaggcggaggacctgtcgcgcaacacatggcagcaccttcggacggcgcctagcatgacggaggcggccgtggggaggatcgcgcaggggaccaaggtgctggcggagggcggccacgacaggatcttccggcaggccttcagcgccccgccggacgagcagctccgcaagtcctacgcctgctacctctccacgtccgccggcccggtcatgggggtcatgtacctctccaccgcccgggtcgccttctgcagcgacaccccgctctcctacgaggcccacgccggcgacaacacggaatggagctactacaaggtggcgattcctctgcaccggctgagggcggccatcccgtcggccagcaaggtcaagccggcggagaagttcatccagctcgtgtcggtggagaaccacgagttctggctgatgggcttcgtcaactacagcagcgccgtcgtgcacttgcaagaagccctcagcggcttccacaacctgcaagcgtgacgacgacgacccgcatcgcgcacgcctttggtctgtctgtggtactggtgttttcgccaatcgtcgggcgtgggagtgtttctgcagttcctactgctttca

SEQ ID NO: 3612 - DNA, 946 bp, Brachypodium distachyon
gatgcaggcgcctgccgggaggacgtggtcgccgatggcaacggaggccaacccctacgcgatgccggcgccggcgcagaagagcaccaaggagacggtgaagaacgcgctgtcgctgtgggggcggaaggtcggcgaggcgaccaggaaggccgaggacctgtcacgcaacacatggcagcaccttcggacagcgccgagcatcacggaggcggcggtggggaggatagcgcaggggaccaaggtcctggcggaaggcggccacgacaagatcttccggcaggccttcagcgcgccgccggacgagcagctccgaaagtcgtacgcgtgctacctgtccacgtccgccggcccggtcatgggggtcatgtacctctccacggccagggttgccttctgcagcgacaacccgctctcctacgaggcctccggcggcgacaggacagaatggagctattacaaggtggcgattcctctgcaccggctgagggccgcgatcccgtcggccagcaagctgaagcccgcggagaagttcatccagctcgtttcggtggagaaccacgagttctggctgatggggttcgtcaactacggcagcgcggtcatgcacttgcaagaagttctcagcggcttccacaatttgcaggcgtgaccgtgtgacgtacgacgacggtcgatcggcatcggcgttgagtatacctgtggactgtggtggtagtggttgttcgctaatacagtccggagtagccgcgtgtctgtgctttgttggtgttgctgaggaaccgacgcattgcaatttgcagtatgttgcttactgctactctggtgctacagcgactactgttcgattatcttcctgataccgaagttgtacttacccagggaatgtttgctgtaaaaattatacagagagccaaaggaagaaatcagacgattacgaaattgc

SEQ ID NO: 3613 - DNA, 746 bp, Setaria italica
atgcagccggccgcgagaagttggtcgtcgccgccggcggcaacggaggccagcccttacgcgatgccttcgcctgtacagccggcgtcgtccaacgtccggcgcttcttacacagttttgctgttccgcgctcaggcaccaaggaggcggtgaagaatgcgctgtcgcggtgggggcggaaggtcggggaggcgaccaggaaggccgaggatctgtcgcgcaacacttggcagcacttgaggacggcgccaagcatcggggaggcggccgtggcgaggatcgcgcaggggaccaaggtgctggcggaaggcggccacgacaagatattccggcgggccttcagtgccccgccggacgagcagctccgcaagtcctacgcctgctacctctccacggccgccggcccggtgatgggcatcctctacctctccacggccagggtcgccttctgcagcgacagccccctgtcctacgacgccggcggcggtgacaggacggaatggagctactacaaggtggcgattcctctgcaccggctgagggcggccagcgcgtcggcgagcgagctcaagcccgcagagaagttcatccagctggtgtcggcggacaagcacgagttctggttcatggggttcgtcaactacgacggcgcggtagcgcacctccaggaagcgctgagcggcttccataacttgcaggccctttgatctcaggagatcgacggcgttgtgttcgtgctcgccag

SEQ ID NO: 3614 - DNA, 530 bp, Secale cereale
aggagaaggggacgctgcaggcgatgagggggtgggtcgtggaccacaagctgcgggccgtagggacgctgtggctcacggggatcgcgggatccatcgcctacaactggtccaggcccgggatgaagaccagcgtcaagctcatccacgccaggcttcacgctcaggccctcactctggctgccttgggttgttctgcgcttgtggagtactatgatcaccagtcaggttcaggatcaaaggttcacgactatgcaaagcagttccttccatcggacagaaacgccaaaaaggactccgtgtagaagaggcagcaagttataatataggcttccattagctgatatggaatttgttgatgttattttctgagcaaacaatctggcatttcacatgccgttatccaagttctgcaggcttcctgttctctgtataagctaccgaaccagcatttagatgcagccgtatgcaaatccgtggggatggaaatatgtgctttcctgaaccgtgcatgaatgtaatgaatgaaa

SEQ ID NO: 3615 - DNA, 1710 bp, Saccharum officinarum
ctcgttcctcccgttggggtattgcgccccgacgaaccctaataatcgccgggaaccgaccggcggccgatcgccccgcccgccggcccgccggtatgcacccgcagcagcggatgaagcaggccgcggccgcggcgcagcagcagcagctgatgcagcaggccttgctcctgcagcagcagcaggcgcagccgcccttgttccccgggcagcaccacccgcaccccggcctcctcgccgcgccacagatggagcccatagttagtggaaacctgcctcctgggtttgattcaagtacatgccgcagcgtgtatgttggcaatatcagtcttcaagtgacggatgcggtactgcaggaagtcttccaaagtattggtccagtagaagggtgcaagctcatcagaaaagaaaagtcatcctttggtttcattgactactatgaccgcagatatgctgcactagcaattttatctctcaatggcagaccactgtatggtcagccgataaaagttaattgggcatatacaagtactcagagggaggatacatcaggtcattttaatatttttgttggggatctttgcccagaagtcactgatgctactttgtttgcatttttctctggatactctacctgctcagatgctagggttatgtgggaccagaaaacaggacgatccagagggtttggttttgtttctttcaggaaccagcaggatgctcaaagtgcgataaatgacttgaatgggaagtggcttggcaaccgtcaaattcgttgcaattgggcaacgaaaggtgctagtgctggtgaagagaaacagattgtggattccaaggctgacctgacaaatggcacatcagaatctggaaaagagaatctaaacgaagatggtcctgaaagtaaccctcagtttactactgtctatgttggcaatcttcctcacgaggctaccaacaatgatgtgcacctgtttttccattcacttggggctggctcaattgaagaagtccgtgtaactcgtgataaaggctttggctttgttaggtacagcacccatgaggaggctgcactggcaattcagatgggtaatggccaacttattggcgggaggcagataaagtgttcctggggaagcaagccgactccaccagggacagcatcctcgcctctgcctcctccagcaccagcaccattctccactggagtgtcggcgacagatttcatggcctaccagcgcctggccctgagcaagatggccacgaacccagccttaatgggtcagcatgccttgaagcaggtcgctgcactggggatgggcggtggagccagccagtccgtctatgacggcggcttccagggcatcaatactgccaccgccacaacctccgcccagcaacagcagcagcagctcatgtactactagagagtactacaacatgaggcaccagctacctatcccttcaagaggaaagcgaggatgaatggatgatgccccttactacacccctatacatatagtagatgatgaattattaccaggaccttttttttttctaatcgtttaagacccatctaagtaacatgtcctctatgctagctatatatatacaccgtagaacgtatgtatttccgaatacatgaagacccaaggttcttagtataattttctggcttcaccatcttttattggctgatggattttcattgcc

SEQ ID NO: 3616 - DNA, 1724 bp, Panicum virgatum
cagttttttttggttcctcctccccgttggggttttcggccccgacgaaaccctaataaccggcggggggcgatcgccggcggcatgcaccagcagcggatgaagcaggccgcagcggcggcggcggcgcagcagcagcagctgatgcagcaggcgctgctcctgcagcagcagcagcagcagcagcaggcgcagccgcccttgttccccgggcaccacccgcaccccggcctcctcgccgcgccgcagatagagcccatagttagcggaaaccttcctcctgggtttgattcaagtacatgccgcagcgtgtatgttggcaatatccatcttcaagtgacggacatgttactgcaggaagtcttccaaagtattggtccagtagaaggttgcaagctcatcagaaaagaaaagtcgtcttttggtttcattgactactatgaccgccgatctgctgcactagcaattttatctctcaacggcaaaccactgtatggtcagccaataaaagttaattgggcatatacaagtactcagagggaggatacatcaggccattttaatatttttgttggggatctttgcccagaaatcactgatgctgctctatttgcctttttttctggatactctacctgctcagatgctagggttatgtgggaccagaaaacaggacgatccagagggttcggttttgtttctttcaggaatcagcaggatgctcaaaatgcgataaatgacttgaatgggaagtggcttggcaaccgtcaaattcgttgcaattgggcgacgaaaggcgctaatgctggtgatgaaaaacaaagtgtggacaccaaggtggaccagacaaatggttcatcagaagctggaaaggagaattcaaatgaagatggtcctgaaaataacccactttttaccactgtttatgttggtggtcttcctcatgaggccaccaacaatgatgtgcacctgtttttccattcacttggggctggctcaatcgaggaggtccgtgtaacacgtgacaagggctttggctttgtgaggtacagcacccatgaggaagctgcactagcaattcagatgggcaatggccaactgattggcgggaggccgataaggtgctcctggggaaacaagccaactccaccggggacagcatcttcgccgctcccccctccggcaccgtctccattccccaccggcgcgtccgcaactgacctcctggcttaccagcgcctggccctgagcaagattgccgcgaacccatccctaatgggccagcacgccctgaagcaggctgcactggggatgggcgccggggccagccaggctatctacgacggcggctaccctggcatcaacgctgcagccgcagcccagcagcagcagcagcaacagcagctcatgtacttttagagtgacggctaccgcatgaggcgccagctacccgtctctgcaagaggaaggcgaggatgatgccccatttacagccccccatatacatatactagtagtatcgtagtagatcaagccttaccaggaccttttttttatttacctttaatctttcgttacaccgtctaagtaacttgccctgtatgccggctctctatatatattcaccaccgtagaacatatatatgtatttctagagacatggaaaccaagtctgggtgggtgtcacgctggctttctagtataatttcctgtgttcggatcat

SEQ ID NO: 3617 - DNA, 1924 bp, Cenchrus ciliaris
  misc_feature (1003)..(1003): n is a, c, g, or t
  misc_feature (1034)..(1034): n is a, c, g, or t
  misc_feature (1058)..(1058): n is a, c, g, or t
  misc_feature (1253)..(1253): n is a, c, g, or t
ggcgggactacccgctgagtttaagcatataaataagcggaggattttcattttccttttttttttcgttttattttctttttctttcttcttttcttgttcctcccgttgggggttttcccacccaccggcgacgaaccctaactaataatcggcggggcggtcgccggcggcatgcaccagcagcagcggatgaagcaggcggcggcggccgcggcccagcagcagcagcagctgatgcagcaggcgctgctcctgcagcagcagcagcagcagacgcagccgcccgtgttccccgggcaccaccaccaccaccccggcctcctcaccgcgccacagatagagccaatagttagtggaaaccttcctcctgggtttgattcaagtacatgccgcagcgtgtatgttggcaatatccatcttcaggtgacggatgcggtactgcaggaagtcttccaaagtattggtccagtagaaggttgcaagctcatcagaaaagaaaagtcggcttttggtttcgttgactactatgaccgccaatctgctgcactagcaattatgtctctcaatggcagactactgtatggtcagccaataaaagtcaattgggcatatacaagtactcagagggaggatacatcaggccattttaatatttttgttggggacctttgccctgaaatcactgatgccaccttgtttgcgtttttcgctgtatactctacctgctcagatgctagggttatgtgggaccagaaaacaggacgatccagagggtttggttttgtttctttcaggagccagcaggatgctcaaaatgcgataaatgacttgaacggtaagtggcttggcaaccgccaaattcgttgcaattgggcaacaaaaggtgctaatgctggtgaagagaaacaaagtgtggacactaaagtggatcaaacaaatggttcagcagaagctggacaggagaatccaaatgaagttgttcctgaaaataacccactcnttaccactgtttatgttggtggtcttcctcntgaggctagcaacaatgatgtgcncctgttttttcattcacttggggctgggttaatcgaggaggttcgtgtaacacgtgacaagggctttggctttgtgaggtacagcacccatgaggaagcggcactggcaattcagatgggcaatggtcaactgtttggcgggaggccaataaggtgctcctggggaaacaagccaactccgccagggacggcatnttcgccacttccccctccagcgccagctccattccctgctggtgtttccgcaactgacttcctggcctaccagcgcttggccctgagcaagatcgccacgaacccagccctgatgggccagcacgccctgaagcaggctgctcttgggatggacgccggagccagccaggcagtctacgacggcggcttccagggcatcagcactgcggcggccgccgcccagcagcagcatcaacaacagctcatgtacttttagagctacgaaaactacctcatgaggcaccagctacttgtctcttgaagaggaaggcgaggatgatgcgcccagtacaatcccccatataaatatactaatattatatatagtagatgatgaagccttaccaggacctttttttttatttaccttaatctttggttacaccatctaagtaacttgtcctgtatgccagctatatatatatacaacacccctctgcgtagaacatacgtattcctagagacatggaaaccaagtatgggtgtcaccctggcattctaagtataattttctctatttggatcttctttcatactatctccttcgaagtcgatccatttcagttgtagccacatatatcaaaataatcagagtaataatataaatattgatgttagtgataaattgctta

SEQ ID NO: 3618 - DNA, 1605 bp, Panicum virgatum
ggcggcgcagcagcagcagcagctgatgcagcaggcgctgctcctgcagcagcagcagcaggcgcagccgcccttgttcccggggcaccacccgcaccccggcctcctcgacgcgccgcagatagaacccatagttagcggaaaccttcctcctgggtttgattcaagtacatgccgcagcgtgtatgttggcaatatccatcttcaagtgacggacacgttactgcaggaagtcttccaaagtattggtccagtagaaggttgcaagctcatcagaaaagaaaagtcatcttttggtttcatcgactactatgaccgccgatctgctgcactagcaattttatctctcaacggcaaacaactgtatggtcagccaataaaagtcaattgggcatatacaagtactcagagggaggacacatcaggccattttaatatttttgttggggatctttgcccagaaatcactgatgctgctctatttgcctttttctctggatactctacctgctcagatgctagggttatgtgggaccagaaaacaggacgatccagagggttcggttttgtttctttcaggaatcagcaggatgctcaaaatgcaataaatgacttaaatgggaagtggcttggcaaccgtcaaattcgttgcaattgggcgacaaaaggtgctaatgctggtgaagagaaacaaagtgtggacaccaaggtggaccagacaaatggttcatcagaagctggaaaggataatttaaatgaagatggtcctgaaaataacccactttttaccactgtttatgttggtggtcttcctcatgaggccaccaacaatgatgtgcacctgttttttcattcacttggggttggctcaattgaggaggtccgtgtaacacgtgacaaaggctttggctttgtgaggtacagcacccatgaggaagctgcattggcaattcagatgggcaatggccaactgattggcgggaggcccataaggtgctcctggggaaacaaaccaactccaccggggacagcatcttcgccgctcccccctcctgcaccatctgcattccccaccgacgtgtcggcaactgacttcctggcctaccagcgcctggccctgagcaagattgccgcgaacccagccttaatgggccagcacgccctgaagcaggctgcgctggggatggacgctggggccagccaggctatctacgatggcggcttcccaggtgtcaatgctgctgccactgccgctgcccagcagcagcagcagcagcagcagctcatgtacttctagagtgacgactggcgcatgataagccagctacctgtctctgcaagaggaaggcgaggatgatccccagttacagccccccatatacatatactagtagtatcatagtagatgacgccttaccaggatctttttttatttacctaatcttttgttacaccatctaagtaacttgccctgtatgccagctatatatattttcaccaccgtagaacatatgtatttgtagagacatggaaaccaagtctgggtgggtgtcaccccggcattctagtataattttctgtgtttagatcatcgtattttctgtg

SEQ ID NO: 3619 - DNA, 1557 bp, Pennisetum glaucum
cggcggcatgcaccagcagcagcggatgaagcaggcggcggccgcggcagcagcagcagcagcagccgcccgtgttccccgggcaccacggcctcctcgccgcgccgcagatagagccaatagttagtggaaaccttcctcctgggtttgattcaagtacatgccgcagcgtgtatgttggcaatatccatcttcaagtgacggacgcgatactgcaggaagtcttccaaagtattggtccagtagaaggttgcaagctcatcagaaaagaaaagtcggcttttggtttcattgactactatgaccgccaatctgctgcactagcaattatgtctctcaacggcagacaactgtatggtcagccaataaaagtcaattgggcatatacaagtacgcagagggaggatacatcaggccacttcaatatttttgttggggacctttgccctgaaatcactgatgccaccttgtttgcgtttttcgctcgatactctacctgctcagatgctagggttatgtgggaccagaaaacaggacgatccagagggtttggttttgtttccttcaggaaccagcaggatgctcaaaatgcgataaatgacttgaatggtaagtggcttggcaaccgccaaattcgttgcaattgggcaacgaaaggcgctaatgctggtgaagagaaacaaagtgtggacactaaagtggaccagacaaatggttcatcagaagctggacaggagaatccaaatgaagttggtcctgaaaataacccactctttaccactgtttatgttggtggtcttcctcatgaggctagcaacaatgatctacacctgtttttccattcacttggggctggcttaatcgaggaggttcgtgtaacacgtgacaagggctttggctttgtgaggtacagcacccatgaggaagcagcactggcaattcagatgggcaatggtcaattgtttggcgggaggtcgataaggtgctcctggggaaacaagccaactccgccagggacagcatcttcacctcttccccctccggcaccagctccattccctgccggtgtttctgcaactgacttcctggcctaccagcgcctggccctgagcaaggtcgccgccaactcagccctgatgggccagcatgccctgaagcaggccgcgctggggatggaccccggagccagccaggcaatctacgacggcggcttccagggcatcaacgctgctgccgccgcccagcagcagcagcaacaacagctcatgtacttctagagctaccacaactaccccatgaggcacaccgaggaaggcgaggacgatgccccccagtacaaccccccatataaatatactagtattatatagtagaagatgccttaccaggacctttttttaaatttaccttcatctttcggtataccatctaagtaacttgccctgtatgcctgctatatatatgtataacaccctgcgcagcagaacatatgtattcctagagacatggagaccaaggctgggtgttaccctggcattctagtataatttctctcta

SEQ ID NO: 3620 - DNA, 1810 bp, Brachypodium distachyon
tgttcttccctttttttcctctttccgtttcgattttcatcttcgttctcttgttgttccgtttgggttggatttcatcccgacccaaaccctaataaatcgatctccctgctccacgggggaggcgggcgggccggcgatgtccatgcagcagcggatgaagcaggccgcggcggtggcggcccagcagcagcagatgatgcagcaggcgctgctcatgcagcagcagcagcaggcggctaccgcggcgcagcagcagccgcctatgttcccgcagcaccacccgcacccgggcctcctcgcagcgccgcagatagagcccattgttagcggaaacctgcctcctgggtttgattcaagcacatgccgcagcgtgtatgttggcaatatccatctgcaagttacggattcactactccacgaggtctttcaaagtatcggtccagtagaagggtgcaaactcatcagaaaagaaaagtcatcttttggtttcgttgactattatgaccgtagatctgctgcacttgcaattgtgtcactaaacggtagacaactgtttggccagccaataaaagtcaactgggcatatgcaagtacccagagagaggatacatcaggtcattttaacatctttgtgggggatctttgcccagaggtcacagatgctgctttgtttgcttttttctcggcatattctacttgctcagatgctagggttatgtgggatcagaagactggacgatcaagaggtttcggttttgtttctttcaggaatcagcaggatgcacaaactgccataaatgagttgaatgggaagtggcttggcaaccgtcagattcgttgcaattgggcaacaaagggtgctaatgctggtgaagagaagcaaaatacggactcgaagggcatggtagagttgataaacggctcatcagaagctggcaaggagaatgcaaatgaagatggtcctgaaaataatccacagtatacaactgtttatgttggcaatcttccccatgatatcaacagcaatgatgtgcatcgatttttccatttactcggggctggctcaattgaggaggttcgcgtaacacgtgataaaggatttggctttgtgaggtacagcacccatgaagaagctgcactggcaattcagacgggtaatggccaacttgttggtggaaggcagatcaagtgctcttggggaagcaagccaactccaccagggacagcatccgcgcctctgccccctccagccctggcagtggcaccatacactcctggcgtgtcagccgctgacctcttctcctatgagcgctccctggctctgagcaagatggccggcaacccggccctgatgggccagcatgccgccctgaggcaggccgcgatgggtatgggcgccggagccagccaggccatctacgacggcggcttccagggcgtcaacccgcagcagcagcagcagcaacaacagcagcagctcatgtactactagagttgaggacgatgatgccctccccctaatatatatacatcgtagataaaagcctcagcaggggctttccctttctaatccttgttattgccatctagtacttctattatcctttgccgctgctgccttttgtcttctgccccggggtcgcacggctatatataatatcactgacatgtattcctactagtgaacttggaaatgtttgagttgctctgccggctctttttcttctttgtaatcgacagcttttctttcacctccacgcgtttactgagacttgagaaatcaagtgaaaatcatgattgcgatttc

SEQ ID NO: 3621 - DNA, 1940 bp, Brachypodium distachyon
agggggggtcgcccaccccaccacactcgcctccttcctccttcttcctcttcacttcgcccctcggcttcgagggttttttttctttcttttttctttttctttttttgttcttccctttttttcctctttccgtttcgattttcatcttcgttctcttgttgttccgtttgggttggatttcatcccgacccaaaccctaataaatcgatctccctgctccacgggggaggcgggcgggccggcgatgtccatgcagcagcggatgaagcaggccgcggcggtggcggcccagcagcagcagatgatgcagcaggcgctgctcatgcagcagcagcagcaggcggctaccgcggcgcagcagcagccgcctatgttcccgcagcaccacccgcacccgggcctcctcgcagcgccgcagatagagcccattgttagcggaaacctgcctcctgggtttgattcaagcacatgccgcagcgtgtatgttggcaatatccatctgcaagttacggattcactactccacgaggtctttcaaagtatcggtccagtagaagggtgcaaactcatcagaaaagaaaagtcatcttttggtttcgttgactattatgaccgtagatctgctgcacttgcaattgtgtcactaaacggtagacaactgtttggccagccaataaaagtcaactgggcatatgcaagtacccagagagaggatacatcaggtcattttaacatctttgtgggggatctttgcccagaggtcacagatgctgctttgtttgcttttttctcggcatattctacttgctcagatgctagggttatgtgggatcagaagactggacgatcaagaggtttcggttttgtttctttcaggaatcagcaggatgcacaaactgccataaatgagttgaatgggaagtggcttggcaaccgtcagattcgttgcaattgggcaacaaagggtgctaatgctggtgaagagaagcaaaatacggactcgaagggcatggtagagttgataaacggctcatcagaagctggcaaggagaatgcaaatgaagatggtcctgaaaataatccacagtatacaactgtttatgttggcaatcttccccatgatatcaacagcaatgatgtgcatcgatttttccatttactcggggctggctcaattgaggaggttcgcgtaacacgtgataaaggatttggctttgtgaggtacagcacccatgaagaagctgcactggcaattcagacgggtaatggccaacttgttggtggaaggcagatcaagtgctcttggggaagcaagccaactccaccagggacagcatccgcgcctctgccccctccagccctggcagtggcaccatacactcctggcgtgtcagccgctgacctcttctcctatgagcgctccctggctctgagcaagatggccggcaacccggccctgatgggccagcatgccgccctgaggcaggccgcgatgggtatgggcgccggagccagccaggccatctacgacggcggcttccagggcgtcaacccgcagcagcagcagcagcaacaacagcagcagctcatgtactactagagttgaggacgatgatgccctccccctaatatatatacatcgtagataaaagcctcagcaggggctttccctttctaatccttgttattgccatctagtacttctattatcctttgccgctgctgccttttgtcttctgccccggggtcgcacggctatatataatatcactgacatgtattcctactagtgaacttggaaatgtttgagttgctctgccggctctttttcttctttgtaatcgacagcttttctttcacctccacgcgtttactgagacttgagaaatcaagtgaaaatcatgattgcgatttcaaaaaataggaagcgaacatcc

SEQ ID NO: 3622 - DNA, 1924 bp, Setaria italica
gcacgcggaaatatcctctcgccccgcgcccgacggccggcggcaccccgcaacgcctccgcgctcgccttcttcttctcttccccccctcggcttcgagggttttcttttctcttttcttttccttttttttctttttattttctttttattttcttttcttgttcctcccgttggggtttcccccccaccccaccggcgacgaaaccctaactaataatcggcggggggaaggcggtcgctcgccggcggcatgcaccagcagcagcagcggatgaagcaggcggcggcggcggcggcgggccgcggcgcagcagcagcaagcagctgatgcagcaggcgctgctcctgcagcagcagcagcagcagccgcagccgcccttgttccccggggcaacacccgcacccccggcctcctcgccgcgccgcaagatagagcccatagttagcggaaaccttcctcctgggtttgattcaagcacatgccgcagcgtgtatgttggcaatatccatcttcaagtgacggacgcagtactgcaggaagtcttccaaagtattggtccagtagaaggttgcaagctcatcagaaaagaaaagtcatcttttggtttcattgactactatgaccgccgatctgctgcactagcaattatgtctctcaatggcagacagctgtatggtcagccaataaaagtcaattgggcatatacaagtactcagagggaggatacatcaggccattttaatatttttgttggggacctttgccctgaaatcactgatgccgccttgtttgcgtttttctctggatactctacctgctcagatgctagggttatgtgggaccagaaaacaggacgatccagagggtttggttttgtttctttcaggaaccagcaggatgctcaaaatgcgataaatgatttgaacggtaagtggcttggcaaccgccaaattcgttgcaattgggcaacgaaaggcgctaatgctggtgaagagaaacaaagtgtggacactaaagtggaccagaccaatggttcatcagaagctggacaggagaatccaaatgaagttggtcctgaaaacaacccactctttaccactgtttatgttggtggtcttcctcatgaggccagcaacaatgatgttcacctgttttttcattcacttggggctggcttaattgaggaggtccgtgtaacgcgtgacaagggctttggctttgtgaggtacagcacccatgaggaagcggcactggcaattcagatgggcaatggtcaactgattggcgggaggccgataaggtgctcctggggaaacaagccaactccgccagggacagcatcttcgccacttccccctccggcgccatctccattcctcggcggtgtttccgcaactgacttcctggcctaccagcgtctggccctgagcaagatcgccgctaacccagccctgatgggccaacacgccctgaagcaggccacgctggggatggacaccggagccagccaggctatctacgatggtggcttccagggcatcaatgctgccactgccgccgcccagcagcagcagcagcagcaacagctcatgtacttctagagtgacgacgactaccccatgaggcaccagctacctgtctctgcgaggaggatgatgccccagtacacccccctatacatatactagtagtattatatagtagatgatgaatccttaccaggacctttttttatttaccttaatctaagtaacttgtcctgtatgccagctatatatatacgacaccccgcgtagaacatatgtattcctagagacatggaaaccaagtctgggtgttaccctggcattctagtataattttctgtgtttgggttatccttcatactccctccttttcaaagtcaaatgttttaaattt

SEQ ID NO: 3623 - DNA, 1742 bp, Avena sativa
ttcttctccttttttcgtttcgattttcttcttccttccgtttgggttggattaatccgacccagaccctaataatcgatctccctgacccggaaggcgggacggggatcgatcgccatgcagcagcggatgaagcaggcggcggcggtagcggcgcagcagcagcagatgatgcagcaggcgctgctcatgcagcaccaacagcagcagcagcaggcgcagcagcaacaggcagccgcggggccgcccatgttcccgacgcaccatccgcacccgggcctcctcgccgcgccgcagatagagcctatcgttagtggaaacctgcctcctggcttcgattcaagtacatgccgcagtgtgtatgttggcaatatccatcttcaagtcacggatgcactactccatgaggttttccaaagtattggcccagtagaagggtgcaagctcatcagaaaagaaaagtcatcttttggttttgttgactattatgaccgtagatatgctgcacttgcaattgtgtcactcaatggtagacaactgtttggccagccaataaaagtcaattgggcatacacaagtacccagagagaggatacatcaggccattttaacatctttgtcggggatctttgcccggaggtcacggatgcagctttgtttgcttttttctcggcatattctacctgctcagatgctagggttatgtgggatcagcagactggacgatcccgagggttcggttttgtttcttttaggaaccagcaggatgcacaaactgccataaatgaattgaatggaaagtggcttggcaaccgtcaaattcggtgcaattgggcaacaaagggcgcgaatgctggcgaagaaaagcaaagtacagactccaagggtatggtagagttgataaatggaacatcagaagctggcaaggagaatgcaaatggagatggccctgaaaataacccacagtatacaactgtttatgttggcaatcttccccatgatatcaacagcaatgatgtgcatcgattttttcatttacttggggccggctcaattgaggaggtccgcgtaacacgcgataaagggtttggctttgtgaggtatagcacccatgaagaagctgcactagcaattcagacggggaatggccaagttattggtgggaggcagatcaagtgctcttggggaagcaagccaaccccaccagggacagcatctgcgcctctgccccctccggcattggcgccatacacccctggcatgtcggctgctgacctcttctcctatgagcgatccctcgctctgagcaagatggctgctaacccaggtctgatgggtcagcacgccgccttgaggcaggctgctatgggtatgggtgccggagccagccaggccatctatgatggtggcttccagagtgtcaaccctcagcagcagcaacagcagcaggtcatgtattactgagttgctttgtgaagcaagtttgacgcgacgatgatgacaaccgacgccctcccctcctaatatatatacatagtagatgaagcctcaccagggctttcctttttctttttatttactgccatctagtaatgtactatccttcgctgctgttgcatttggtttcctggtcgcccggctatatatatattactaccgagtactgtagaacatatatttgttcctaacgtgtcaagagttttggtaattccctggcctatactttcatgtgctctggttgg

SEQ ID NO: 3624 - DNA, 1687 bp, Setaria italica
ttattttcttttcttgttcctcccgttggggtttccccccaccccaccggcgacgaaaccctaactaataatcggcgggggaaggcggtcgctcgccggcggcatgcaccagcagcagccgcccttgttccccgggcaacacccgcaccccggcctcctcgccgcgccgcagatagagcccatagttagcggaaaccttcctcctgggtttgattcaagcacatgccgcagcgtgtatgttggcaatatccatcttcaagtgacggacgcagtactgcaggaagtcttccaaagtattggtccagtagaaggttgcaagctcatcagaaaagaaaagtcatcttttggtttcattgactactatgaccgccgatctgctgcactagcaattatgtctctcaatggcagacagctgtatggtcagccaataaaagtcaattgggcatatacaagtactcagagggaggatacatcaggccattttaatatttttgttggggacctttgccctgaaatcactgatgccgccttgtttgcgtttttctctggatactctacctgctcagatgctagggttatgtgggaccagaaaacaggacgatccagagggtttggttttgtttctttcaggaaccagcaggatgctcaaaatgcgataaatgatttgaacggtaagtggcttggcaaccgccaaattcgttgcaattgggcaacgaaaggcgctaatgctggtgaagagaaacaaagtgtggacactaaagtggaccagacaaatggttcatcagaagctggacaggagaatccaaatgaagttggtcctgaaaacaacccactctttaccactgtttatgttggtggtcttcctcatgaggccagcaacaatgatgttcacctgttttttcattcacttggggctggcttaattgaggaggtccgtgtaacgcgtgacaagggctttggctttgtgaggtacagcacccatgaggaagcggcactggcaattcagatgggcaatggtcaactgattggcgggaggccgataaggtgctcctggggaaacaagccaactccgccagggacagcatcttcgccacttccccctccggcgccatctccattcctcgccggtgtttccgcaactgacttcctggcctaccagcgtctggccctgagcaagatcgccgcgaacccagccctgatgggccaacacgccctgaagcaggccacgctggggatggacaccggagccagccaggctatctacgatggtggcttccagggcatcaatgctgccactgccgccgcccagcagcagcagcagcagcaacagctcatgtacttctagagtgacgacgactaccccatgaggcaccagctacctgtctctgcgaggaggatgatgccccagtacacccccctatacatatactagtagtattatatagtagatgatgaatccttaccaggacctctttttttatttaccttaatctaagtaacttgtcctgtatgccagctatatatatacgacaccccgcgtagaacatatgtattcctagagacatggaaaccaagtctgggtgttaccctggcattctagtataattttctgtgtttgggttatccttcatactccctctgtcctgctacctgtctctgcgaggaggatgatgccccagtacacccc

SEQ ID NO: 3625 - DNA, 1590 bp, Setaria italica
tgtctctcccttatcctttataaaaagagggtaaaatatggtattacaattcatctcaggaccatctgtccaattgcaactaatatatatcatcacatgccagtgtaagctatagttcagtgcagggtgtgtcttgtcttaaaccaggtctatctgatgactagctgcttcaacggcggcgccggctggccggagccggtggtgcgcgtgcagaccgtgtcggacacctgcggcgacacgatccccgaccggtacgtcaagcctcagtcggaccggccgtcgccccctgcctccggcggcgtcgccggaggcggcccgaacatcccggtggtggacctgtcaatgccggacagcgacgcgacgtcccgcgccgtggcggcggcgtgccgggagtggggcttcttccaggcggtgaaccacggcgtgcgcccggagctgctgcgcggcgcgcgcgcggcgtggcgcggcttcttccggcagcccgcggaggtgcgcgagcgctacgcgaactcgccggcgacgtacgagggctacggcagccgcctcggcaccgccaagggcggccccctcgactggggcgactactacttcctccacctcctgccgccgtccctcaagagccacgagaaatggccttccctccccgcctccctacgggagacgacggaggagtacggcgaggaggtggtgcaactgtgccggagggtgatgcggctgctgtcgagcgggctggggctggaggccgggaggctgcaggaggcgttcggcggggcgggcggggagggagcgtgcatgcgcgtcaacttctacccgcggtgcccgcagcccgagctgacgctcggcgtggcggcgcactccgaccccggcggcatgaccatgctgctggtcgacgaccacgtcaggggcctgcaggtaaggagccccgacggccagtggatcaccgtcgagcccgtccccgatgccttcatcgtcaacgtcggcgaccagatacaggtgctgagcaacgcggcgtacaagagcgtggagcaccgggtgacggtgagcgcggcggaggagcggctgtcgatggccttcttctacaacccgcggagcgacctgcccatcgcgccgatgccggagctggtggcgcccggccgcccggcgctgtacccggagatgaccttcgacgagtaccgcgtcttcatccggcagcgcggcctggccggcaaggcgcagctcgagtccctgaaggccagcaacaaggccgccgccgctcctgtcacagctgatggctcgccctcttcctctagctagcacagctgtaccctagcagcaaccgagctactccttgcaagatatatcatctgcccgccgcaaccgagctgtgcatatcatcactggatccatcgttgaataatttgatgtttaatttctgtggaactgtgcaatggtgtacattattcgtctcgtgaaactgaaattaaatgtcgtgatgagcagtaaattaaatgtacacatatgcatatatagtatatagaaaagtggagtactcttagcttgatgccaattggtgttgagttgacaagagaagtgtaagccagtttaccatga

SEQ ID NO: 3626 - DNA, 1482 bp, Zea mays
tgtctctcccttatcctttgatttataaaagggggtaaaatacggtattattattactagacatctcagctctctggaccatcacgtgtacaattgcgaccgctatatatcaacaaatatatgccatgagtgtgcaagtgtaagttgtgcacacaatatacagggcggttttgtcttaagccagcagctccccggccgatggcaataagctgcttcaacggcggcgccggctggccggagcccgtggtgcgcgtccaggctgtgtctgacacgtgcggcgacacgatccccgagcggtatgtgaagcccctgtcggagcggccccggctctcaccggcctccgatggcagcggcccgaatatcccagtcgtagacctgtcaatgctagacgtggacgcgacatccagcgccgtggcggcggcgtgccgggagtggggctttttccaggcagtgaaccacggcgtccgcccggagctgctgcgcggcgcgcgcgcggcgtggcgtggcttcttccggcagcccgcggaggtgcgcgagcgttacgcgaactcgccggcgacgtacgagggctacggcagccgcctcggcaccgccaagggcggcccgctggactggggcgactactacttcctccatctgctgccggcttccctcaagagccacgagaagtggccttccctgccttcctccctacggggggcaacggaggagtacggcgaggaagtgttgcagctgtgccggagggtgatgcggctgctctccagcgggctggggctggaagccgggagactgcaggcggcgttcggcggagagggcggcgaaggggcgtgcttgcgggtcaacttctacccgcagtgcccgcagccagagctgacgctgggcgtagcggggcactccgaccccggcggcatgaccatgctgctggtggacgaccacgtcaagggcctgcaggtaaggagccccgacggccagtggatcgtcgtcgaacccgtccccgacgccttcatcgtcaacgtcggcgaccagatccaggtgctgagcaacgcggcatacaagagcgtggagcaccgggtgacggtaagcgcggcagaggaccggctgtctatggctttcttctacaacccgcgaagcgacctgcccatcgcgccgatggcggagctggtggggcccgaccgcccggcgctgtacccggagatgaccttcgacgagtaccgtgtttttatccggcaacgtggtttggccggcaaggcgcagcttgagtccctgcaggtaaagaaaaagtttgatggtgatttcacatcgaaggaaatgtttgttagtgggaagagtaggtcagactatgtgttgttgcccttgcacaacgagggccaatggtcacgctacataatggtagtgcaagggtcaaatatgacattgattgagggtttggtggagaatgaatataggaggtcatttcatggtcttggagtggatgaacagtaa

SEQ ID NO: 3627 - DNA, 6848 bp, Zea mays
tccgatccgccttcctccgccgcagctcccatggccaacctcggcggtggcgccgaggcgcacgcgcgattcaagcagtacgagtatcgcgccaactccagcctcgtcctcaccacagactcccgcccgcgcgacacccacgagcccaccggagagcccgagacgctctggggcaggatcgaccccaggtccttcggcgaccgcgccgtccagaacaggccgcccgagctcgaggagaagctctccaagtcgcgcaccaaaaagtctaagcgcgacgctgctgccgcgctcgactccgccgacctcccccgtcgcgacgccaagcgcaggcgccgcgctgcttccgcccaggaggtctccgtcctctccctcaccgacgacgccgtgtacaagccccagaccaaggagacgcgtgccgcctatgaggccttgctcagcctcatccaacagcagcttggcggccagcccctcgatgtccttgctggggcagctgatgaggtgctcgctacactcaagaatgacaaggtcaagaaccctgataagaagaaggacattgagcagctgctcaaccctatctccagccagctctttgatcagcttgtctccattggcaagctcatcaccgacttccatgatgcggcagctggtgatgcttccggtgcgccttccgccgacgctgtggacaccactctggatgatgatgttggtgttgctgttgagtttgaagaagacgaagacgaggagagtgattttgatcaggtgcaagacgagctggatgaggatgaggaagatgacatggctgagttgaatggtcctggaggtatgcagatgggtggtgagttagacgacgatgacatgcagaacgccaatcaggggctgaccgtcaatgttcaggacatcgatgcttactggctccagaggaagatatcccaggcatacggggatggggacattgatgctcaacagagccagaagcttgctgaggatatcttgaagatcattgccgagggtgacgacagagacgtcgagaatcgccttgtcatgctcttggactatgagaagtttgatctcattaagttgttgctgcgcaaccgtctcaagattgtttggtgcacccgcttagccagggccgaagatcaggaacagaggaagaatatagaggaagagatggcaagtgacccaagtttggctccgatattggagcagctacatgcaaccagagcatccgcaaaggagaggcagaagaacctggagaaaagcatcagggatgaggccaagaggctcctcaacaatgatgctgctgctgctggtgctgatggtgccagggaccacagggcagccgagtgggacatggagagtggatggctgaaaggacagaggcagttgcttgatcttgaaagcctctcgttccatcagggtggtctctttatggctaacaagaaatgtgaacttccgactggatcgtttagaacccctcataagggatatgaggaggttcatgtgccagcactgaaggctaagccctatgaaacaggagagaagattgtgaagatatctgatatgccagagtgggcacggtcagcttttgatgggatgacacagctgaacagagttcagagcagggtctatgatactgctcttttcaaaccagacaatatccttctctgtgctccgactggtgctggcaaaacaaatgtggctgtgcttaccatccttcagcagattggtctgcatatgcaggatggagagtttgataataccaagtacaaaattgtctatgtggccccgatgaaagcattggttgctgaagtcgttggaaacctgtctaagcgtttggcaggttacaatgttactgttagggagctcagtggagaccagaacttgaccaagcaacagattgatgaaacacagattattgtcacaacacctgagaaatgggacattgtgaccaggaaatcaggggacagaacctatacccaaatggtgaagctgttaatcattgatgagattcatctgctacacgataacagagggcctgttctggagagcattgttgctaggacagtcaggcagattgagacgacaaaggagaatattcgtctggttgggctctctgcgactctaccaaactatgaagatgttgcattattcttgcgcgttcgcaaagaaagcctcttctattttgacaacagttaccgaccttgccctcttgcccagcaatacattgggatcactgttaggaagccactacagaggatgcagttgatgaatgagatttgttatgagaaggttatggctgccgctggtaagcatcaagtgcttatatttgtacactcaaggaaggagacggcaaagactgccaaagccatcagagatacggcgttggcaaatgacactgtcagccgctttctgaagaatgagagtgcaagccaagagatccttggcactcatgctgaacttgtcaaaaacaatgatcttaaagaccttttgccttatggatttgctattcatcatgctgggatggcaagggttgaccgtgagcttgttgaagaactttttgctgacaagcatattcaagtacttgtatccactgctacccttgcatggggtgtcaatttgcctgcacatactgttatcataaagggtacacagatttacaatccagaaaaaggtgcttggacagaactaagccctctggatgttatgcagatgcttggtcgtgcaggaaggcctcagtatgatacgcatggagaggggataatcttgactggccacagtgaattgcagttctacctgtctcttatgaaccagcagctgcctattgagagtcagttcatatccaaattggctgatcaattgaatgcagagattgttctggggactattcagaatgctcgtgaagcatgctcgtggcttggctatacttacctctatattcggatgctccgcaatccaacattgtatggtttgccagcagatatcttggagagtgataaaacacttgatgaaaggagagctgatttgatacattccgctgcaaatctactggataggaacaatctgataaagtatgacaggaaaacaggatacttccaagttactgacctgggaaggattgccagttattattatatcagtcatggaactatttcaacatacaatgagtacttaaaacctacaatgggtgatatcgaactgtgccgactgttttctctgagtgaagaatttaagtatgtaggtgtcaggcttgatgagaaaatggaactggcaaagcttttggatcgtgtgccaatacctgtgaaagagagcttggaggaacccagtgcaaagatcaatgttctgctgcaagcatatatttctaggttgaaactggaaggcctttctcttagttctgatatggtctacatcagacagagtgctggacgtctcttacgggcactattcgagattgttttgaagaggggatgggctcaactagcggagaaagcactgaatctttgcaagatggttgataaacaaatgtggagtgtccaaactcccttgaggcagtttactggaattcctaaggagatcttgatgaaacttgagaagaaggagttggcttgggagaggtactatgatctgtcctcacaagaaattggtgagctgatccgctatcccaagatggggaggccgctgcacaagtgcatccaccagttaccaaagctgaatctttcagcccatgtccagcccattactcgtacagttttgggttttgagctgacaattacacctgatttccagtgggatgataaggtacatggatatgtggagcccttttgggttattgttgaggataatgatggcgagtacattcttcaccatgaatatttcatgcttaagaaacagtatgttgacgaagatcatacattgaacttcacagtgccgatatatgagccgctgcctcctcagtatttcatacgtgttgtgtctgacaagtggcttggttctcagacaattctccctgtctgctttaggcatttaattctaccagaaaaatatgctccaccaactgaattgcttgatctgcagcctcttcctgttagtgcattgagaaatgcaagatatgagggcctctatagtgcttttaagcatttcaatcccatccagactcaagtattcactgtcttgtataacagcgatgacagcgtgttggtcgctgcgccaacaggcagtgggaagacgatatgtgcagagtttgctatactaaggaaccaccagaaggcattgtctggcgagagcaacatgcgggttgtttatatagctcccattgaagctctcgcaaaagaaagatacagggactgggagcggaaatttggagagtttgccaaggtagttgagctcactggtgaaacggcagctgatttgaagcttctggataaaggtgaaatcataatcagtactcctgaaaagtgggatgcattgtctcgccggtggaaacagcgaaagcacatccaacaggtcagcttattcatagttgatgaacttcatctacttggatctgataagggacatgttttggaagtcattgtatctaggatgaggcgtatttccagtcatattggcagtaacatacggatcgtagcactttcagcatcacttgctaatgctaaagatcttggtgaatggattggtgccacctctcatggccttttcaacttccctccagcagtgagacctgtgccactggaaattcacatccagggtgtggatatagcgaactttgaggcaaggatgcaagcaatgacaaagcctacctacactgccatcacacagcatgcaaagaacaataaacctgccctggtgtatgtaccgacaaggaagcatgcaaggttgactgcattggacttgtgtgcgtactctagtgttgagggtgctggaactccatttcttcttgggtcaggagatgagatggatactttcaccagaggtgttgaagaagagactcttaagaatacacttaaatgtggtgttggctatttgcatgagggtctaagtgagcttgatcaggaacttgtaacccagctgttccttggtgggaggatccaagtgtgtgttgcaagcagcacaatgtgttggggaagaccattgcctgctcatttggtcgttgtcatggggactcagtattatgatgggcgggagaatgctcacaccgactatccaattacagatctgcttcaaatgatgggtcatgccagtagaccacttcaagataactcagggaaatgtgttatattgtgtcatgcacctcgcaaagagtactacaagaagtttctttttgaggccttccctgtcgaaagcaatcttcaccatttcttgcatgatcacatgaatgctgaggtggtggttggtgttgtagagaataagcaagatgctgtggattatcttacttggacgttcatgtatcggcggctagctaagaatcctaacttctacaatcttcagggtgtaagtcacaggcatctttcagaccatctttctgagctagttgagactattctgaatgatcttgaatcgagcaagtgtgtggctatagaggaggacatgtacctgaagcccctcaaccttggccttattgcttcatactactatattagctacacaactattgagcgttttagttctatgctgacccagaagactaaggtgaaaggactcctagagattctagcatctgcctcagaatatgcagagcttccgggtcgtcctggtgaggaagaattcattgagaggcttgttcgtcaccagaggttctctatcgagaaacccaagtatggggatccacatgtgaaggccaatgctctgctgcaagcccatttttcaaggcacacagtggtcggaaatctggcagctgatcagcgcgagattctcctttctgctcataggttgctccaggcaatggttgatgttatatccagcaatggttggcttagtcttgctcttagtacaatggagctgagtcaaatggtgacacaaggcatgtgggatcgggattctgtgctgcttcaagttccacacttcacaaaagacttggctcggaggtgccaggaaaatgaagggaagcccatcgagagtatctttgatctagctgagatggctgtcgatgagatgcgggatctcttacaactatcgaactctcagctgcaagacatcattgaattcatcaagcggttccccaatgttgatatgacctatgaggtccgtgagggtgatgatataagcgctggtgacaatgtaaccgtgcaggtaactctggagcgtgacatgactaacgtttcatctgaggttggtccagtccatgcgccaaggtttcccaagcctaaggaagaaggctggtggctggtgattggggacagctccacaaaccagttactggcaatcaaaagagtggcactccagaagagggcgagagtgaaacttgagttctctgctccggcagaggctgggagaaaggactacatgatttacttgatgtcagactcttacttgggctgcgatcaggagtatgaattcaccgttgatgtcaaggatgctggaggggattgatgatgaagactgtgacactatgtcgcatagaagtagaattgagtgtgtactgtaacgcgatattggaacattctgtgttgtaacctcgaacatgtggaagctgtaacttattttgcatgttgaccggtgcactttgggcgttgctgtgttatcctattctagtattattgtaaggattacgctcggttacacttgagccacagtattttggatcaacttgttgcttctataagcttgctgatgctataatgtttgatcgacct

SEQ ID NO: 3628 - DNA, 6861 bp, Setaria italica
cacccatggcgaacctcggcggcggcgccgaggcgcacgcgcgcttcaagcagtacgagtaccgcgccaactccagcctcgtcctcaccaccgactcccgcccccgcgacacccacgagcccaccggcgagcccgagacgctctatggccgcatcgaccccaggtccttcggcgaccgcgccgtccagaacaggccgcccgagctcgaggagaagctcaccaaggcgcgcaccaagaagaccaagcgcgacgccgccgaccccgacatcccccgacgcgacgccaagcgcaggcgccgcgccgcctccacccaggacgtcagcgtcctctccctcaccgacgacgtcgtctacaagccccagaccaaggagacgcgcgccgcctacgaggccctgctcagcgtcatccagcagcagctcggcggccagccgctcgatgtcctagctggggccgccgacgaggtgctcgccaccctcaagaatgacaagatcaagaaccctgacaagaagaaggacattgagcagctcctcaaccccatctccaaccagctctttgaccagctcgtctccattggcaagctcatcaccgacttccacgatgcggcagctggcgacgctgccggtgggccatctggcgatgccatggacaccaccctggatgatgatgtcggtgttgctgtcgagtttgaagagtcagatgaagacgaggagagtgattttgatcaggtgcaagatgacttggatgaggatgatgaggacgaagcaacggagttgaatggtcctggaggcatgcagatgggtggcgagttggatgacgatgacatgcagaacgccaaccagggactggccatcaatgttcaggacattgatgcttactggctccagaggaagatatcccaagcatatggggacgggaacattgacgcccagcagagccagaagcttgcggaggagatcttgaagatcattgctgagggtgatgacagagatgtcgagaatcgccttgtcatgctcctggactatgacaagtttgatctcattaagttgctgctgcgcaaccgtctcaagattgtttggtgcacccgcttggccagggctgaagatcaggaacagaggaccaagatagaggaagagatggctagtgacccgagcttggctccaatattggagcagctacatgcaaccagagcatctgcaaaggagaggcagaagaacctcgagaaaagcatcagggatgaggccaagaggctcctcaacaatgatggtgctggcgccgatggtccgagggatcgcagggcagccgagagggatatggagagtggatggttgaaaggacagaggcagctgcttgatcttgacagcctcgcttttcaccagggtggtctcttcatggctaacaagaaatgtgaacttcctgctgggtcgtttagaacccctcacaagggatacgaggaggttcatgtgccagcattgaaagctaagccatatgaaaccggggagaagattgtgaagatatctgacttgccagagtgggcgcagccagcttttgaagggatgtctgcgctgaacagagttcagagcagggtctatgatactgctcttttcaagccggataatatccttctatgtgctccgactggtgctggtaaaacaaacgtggctgttcttacgatccttcaacagattggtctgcatatgaaggatggagagtttgacaataccaagtacaaaattgtctatgtggccccgatgaaggctttggtcgctgaagttgttggaaatctatcaaagcgtttggcacctttcaatgttactgttagggaactcagcggagaccagaacctgaccaagcaacagattgatgaaacacagattattgtcacgacacctgagaaatgggatattgtgactaggaaatcaggggacagaacctatacccaaatggtaaagctgttaatcattgatgagatccatctgctacatgataacagagggcctgttctggagagcattgttgccaggactgtcaggcagattgagacgaccaaggaacatattcgtctggttgggctttctgcgacactaccaaactatgaagatgttgcgttatttttgcgtgttcctaaaaagagcattttccattttgacaacagttaccggccttgccctcttgctcagcaatacattgggatcactgtgaggaaaccactacagaggttccagttgatgaatgagatttgttatgagaaggttatggctgctgctggtaagcatcaagtgcttatatttgtacactcaaggaaggagacggcgaaaactgccaaagcaatcagagatacagctttggctaacgacacagttagccgcttcctgaagaacgagagtgcaagccaagagatccttggcactcatgcagaacttgtcaaaaacaatgatcttaaagacctcctcccgtatgggtttgctattcatcatgctgggatggcaagggttgaccgtgaactcgttgaggaactttttgctgataagcacatacaggttcttgtgtcgactgccacccttgcatggggtgtcaatttgcctgcacatactgttattataaagggtacccagatttacaacccggaaaaaggtgcttggacagaactaagtccgctggatgttatgcagatgcttggtcgtgcaggaaggcctcagtatgatacacatggagagggaataatcttgactggccacagtgaattgcagttttacctgtctcttatgaatcagcagctacctattgagagtcagtttgtatcccaattagctgatcaattgaatgcagagattgttctggggactattcagaatgctcgggaggcatgctcgtggcttggctacacttacctctatattcggatgctccgcaatccagcattgtatggtttgccagcagacatctttgagagtgataaaacacttgatggaaggagagctgacttgatacattctgctgcaaatctactggataggaacaatttgataaagtatgacaggaagacaggatactttcaagttactgacctgggaaggattgccagttattactatattagtcatgggactatctcaacatacaatgagtacctgaagcctacaatgggtgatattgagctgtgtcgactgttttcgctgagtgaagaattcaagtatgttggtgtcaggcaagatgagaaaatggaacttgcgaagcttttggatcgcgtcccgattcctgtgaaagagagcttggaggaacccagtgcaaagatcaatgttctgctgcaagcatacatttctaggctgaaactggaaggcctttctcttagttctgatatggtctacattagacagagtgctggccgtcttttacgagcactatttgagattgttttgaagaggggatgggctcaactagcagagaaggcactgaatctttgcaagatggttgataaacaaatgtggagtgttcaaactcccttgcgccaatttcctggaattccaaaggagattttgatgaaactggagaagaaggagttggcttgggagaggtactatgatctttcatcacaggaaattggtgaacttatccgctatcccaagatggggaggcagctgcacaagtgcatccaccagctaccaaaattgaatctgtcagcccatgtccaaccctttacccgtacagttttgggttttgagctgaccattactcctgatttccagtgggatgataaaatacatggatatgtggagcccttctgggttatagttgaggacaatgatggcgagtacattcttcaccatgaatattttttgcttaagaaacaatatgttgatgaagatcatacattgaacttcacagtgccaatatatgagccgcttcccccacagtattttattcgtgttgtgtctgataagtggcttggttctcagacaattctccctgtctgcttcaggcatttaattctaccagaaaaatatgcaccaccaactgaattgcttgatctgcagcctcttcctgttagtgcactgagaaatgcacgatatgagggcctctacagttctttcaagcatttcaatcccatccagactcaagtattcaccgtcttgtataatagtgatgatagcgtgttggttgctgcaccaacaggcagtgggaagacaatatgtgctgagtttgctatactaaggaaccaccagagggcagtgtctggtgagagcaacatgcgggttgtgtatatagctcccattgaagctcttgcaaaagaaagatacagggactgggagcggaaatttggagaatttgccaaggtagttgagctcactggtgaaactgcagctgatttgaagcttctggataaaggggagatcataatcagtactcctgagaagtgggatgcactgtctcgccggtggaaacagcgaaagcacattcaacaggtcagcttattcatagttgatgaacttcatctacttgggtctgacaagggacatgttttggaggtcattgtatctaggatgaggcgtatttcaagccatattggtagtaacatacggatcgtagcactttcagcatcactcgcaaatgctaaagatcttggtgagtggattggtgccacctctcacggcctctttaacttccctccggcagtgcgacctgtgccattggaaattcacattcaaggtgtggatatagcaaactttgaggcaaggatgcaagcaatgacaaagcctacatacactgccatcacacagcatgcaaagagtggtaagcctgccctggtgtatgtaccgacaaggaagcatgcaaggttgactgcattggacttgtgtgcgtactctagtgttgagggtggtggaacaccatttctccttgggtcagaagaagagatggatactttcaccagtggcgtcgaagaagagacgcttaagaatacgcttaaatgtggtgtaggctacttgcatgagggtctaagtgaacttgatcaggaacttgtaacccagctgttccttggtgggaggattcaagtgtgtgttgcaagcagcacaatgtgctggggaagaccattgcctgctcatttggttgttgtcatggggactcagtattatgatggccgtgagaatgctcacactgattatccaataacagatctgctccagatgatgggtcatgccagcaggccacttcaagacaactcagggaaatgtgttatattatgtcatgcacctcgcaaagagtactacaagaagttcctttttgaggccttccctgttgagagcaatcttcaccatttcttgcacgatcatatgaatgctgaggtggtggttggtgttgtggagaacaagcaagatgctgtagactaccttacatggactttcatgtaccggcggctgaccaagaatcctaactactataatcttcagggtgtaagtcacaggcatctttcagatcatctttcagagttgattgagacaatcctgaatgacctggaatcaagcaagtgtgtggctatagaggaggacatgtacctgaagcctcttaaccttggccttattgcttcatactactatattagctacacaactattgaacgtttcagttctatgctgacccagaagactaagatgaaaggactcctagagattctagcatctgcatcagaatatgcagaacttccaggtcgtccaggtgaggaagatttcattgagaggcttgttcgccaccagagattctctattgagaagcccaagtatggtgatccacatgtgaaggccaatgctctactgcaagcccatttttcaaggcacaatgttgttgggaacctggcagctgatcagcgggaaattctcctttctgcccataggttgctccaggcaatggttgatgttatatccagcaatggttggcttagtcttgctcttaatacaatggagttgagtcaaatggtgacacaaggcatgtgggatcgtgattctgtactgcttcaagttccacacttcacaaaggatttggctcggaggtgccaggaaaatgaagggaagcccattgagagcatctttgatcttgctgagatgggtattgatgagatgcgggatctgttgcagctatcaaactctcagctgcaggatatcattgagttcttcaagcggttccccaatgttgatatggcctatgaggtccgtgagggtgacgacattagtgccggtgacaatgtgacagtgcaggtaacgctggagcgtgacatgacgaacctgccgtctgaggttgggccagttcatgcgccgaggttccccaagcccaaggaagaaggctggtggctggtgattggtgacagctccaccaaccagttgctggcaatcaagagagtcgcactgcagaagcgggcaagggtgaagcttgagttcagtgctcctgcagaagctgggagaaaggattacatgatttatttgatgtcagattcttacttgggctgcgaccaggagtatgagttcacggttgatgtcaaggatgctggagattgatgatgaagagcgacagatttatgtcatctgacacggggttgcttgtactcatatttctagagtgtattgtaactcgtaaccaaacgttttagatatatctttatgtgcttgtactcttgcacctgtaagctgctgcttgtggtcagccatgagccttacaggtagccttagtcctgttttgaacttttgatatttgcaaggacgatgatgtgctctataatagttgagactcttcctggttggatgcaaattttgacaattgcagttttgagcacgtcatgcatgatgttatcactagttaatagttgacagtatctgc

SEQ ID NO: 3629 - DNA, 6777 bp, Sorghum bicolor
atgtccaacctcggcggcgccgaggcgcacgcgcgcttcaagcagtacgactacggcgccaactccagcctcgtgctcaccaccgactcccgcccgcgcgacacccacgagcccacaggcgagcccgagacgctccggggcaggatcgacccgaggtccttcggcgaccgcgccgtccacaacaagccgcccgagctcgacgagaagctctccaaggcgcgatcaaaaaagtccaagcgccgggacgacgcgcccgacctcccccgccgcgacgccaagcgcaggcgccgcgccgcctccgtacacgaggtctccgtcctctctctcaccgaagacgccgtctacaagccccagaccaaggagacgcgcgccgcatacgaggccctgctcagcctcatccagcaccagctcggcggccagcccctcgacgtcctcgctggggccgccgacgaggtgctcgccacgctcaagaacgacaaggtcaagaaccctgacaagaagaaggtgatcgagcagctgctcaaccctatctccagccagctctttgaccagctcgtctccatcggcaagctcatcaccgacttccatgatgccggtgcaccttctgccgacgccatggacactaccctggatgatgatgttggggttgctgtcgagtttgaggaagatgaagccgaggagagtgattttgatcaggtgcaagatgacctggatgaggatgatgaagatgatgcagctgagttgaatggtcctggaggtatgcagatgggcagtgagttagacgacgacaacgacatgcacaacgccaaccaggggctggccgtcaatgttcaggacatcgatgcttactggctccagaggaagatatcccaggcatatggggatggggtcattgatgcccagcagggccagaagcttgccgaggatattttgaagatcattgctgagggcgacgacagagacatcgagaattgcctcctcatgctcttggactttgataagtttgatctcatcaagttgctgctacgcaaccgtctcaagattgtgtggtgtacccgcttagccagggccgaagatcaggaacagaggaagaagatagaggaagagatggcaagtgacccaagcttggctctgatattggagcagctacatgcaaccagagcatccgcaaaggagaggcagaagaacctggagaaaagcatcagggatgaggctaagaggctcctcaacaatgatgctgccgccggcgctgatggtgccagggaccgcagggcagccgagcgggacatggagagtggaatgctgaaaggacagaggaagctgcttgatctcaagagcctctcgttccagcagggtggtctctttatggctaacaagaaatgtgaacttcctactgggtcctttagaacctctcataagggatatgaggaggttcatgtgccagcactgaaggctatgccctatgaaacaggggagaagattgtcaagatatgtgatatgccagagtttgcacgggcagctttcgaagggatgacacagctgaacagagttcagagcagggtctatgatactgctcttttgaaaccagacaatatccttctctgtgctccaactggtgctggcaaaacaaacgtggctgtgcttaccatccttcaacagattggtatgcatatgcaggatggagagtttgacaataccaagtacaaaattgtctatgtggccccaatgaaagcattggtcgctgaagtcgttgggaacttgtcgaagcgtctggcaggttacaacgttactgtcaaggagctcagtggagatcagaacttgaccaagcaacagattgatgaaacacaggttattgtcacgacacctgagaaatgggatattgtaaccaggaaatcaggggacagaacctatacccaaatggtgaagctgttaatcattgatgagatccatctgctacatgataacagagggcctgttctggaaagtattgttgctaggactgtcaggcagattgagacaaccaaggagcatattcgtctggttgggctctctgcgactctaccaaactacgaagatgttgcactattcttgcgcgttcccaaagaaagcctcttctactttgacaacagttaccgaccttgccctcttgctcagcaatacattgggattacagtgaggaagccagtacagaggatgccattgatgaatgagatctgttatgagaaggttatggccgctgctggtaagcatcaagtgctcatatttgtacactcgaggaaggagacagcaataactgccaaagccatcagagacatggcgttggcaaatgacacagtcagccgctttctgaagaacgatagtgtaagccaagagatccttggcactaacgctgaacttgtcaaaagcaatgatcttaaagacctcctgccatatgggtttgctattcatcatgctggtatggcaagggttgaccgtgagcttgttgaggcactttatgctgacaagcacattcaagtacttgtatccactgctacccttgcatggggtgtcaatttgcctgcacatactgttattataaagggtacacagatttacaacccagaggaaggtgattggacagaactaagccctctggatgttatgcagatgcttggtcgtgcaggaaggcctcagtatgatacacatggagagggaataatcttgactagccacagtgaattgcggttctacctgtctcttatgaaccagcagctgcctattgagagtcagttcatatccaaattggctgatcaattgaatgcagagattgttctggggactattcagaatgctcgtgaagcatgctcgtggcttggctatacttacctctatatccggatgctccgaaatccaacattgtatggtttgccagcagatatcttggagagtgacaaaacacttgatgaaatgagagctgatttggtacattccgctgcaaatctactggataagaataatctgataaagtatgacaggaaaacaggatactttcaagttactgacctgggaaggattgccagttattactacattagtcatggaacaatctcaacatacaatgaatacctgaaacctacaatgggtgatatcgagctgtgtcgactgttttctctgagtgaagaatttaagtatgtaggtgtcaggctagatgagaaaatggaactggcaaagcttttggaccgtgtgccaattcctgtgaaagagagcttggacgaacccagtgcaaagataaatgttctgctgcaagcatatatttctaggttgaaactggaaggacattctcttagttctgatatggtctacatccaacagagtgctggacgtctcctacgagcactatttgagattgttttgaagaggggatgggctcaactagcagagaaagcgctgaatctttgcaggatggttgataaacaaatgtggagtgtccagactcccttgcggcaatttactggaattccaaaggcgatcttaatgaaactggagaaaaaggagttggcttgggagagatactatgatctgtcctcacaagaaattggtgaactaatccgctatcccaagatggggaggcagctgcacaagtgcatccaccagttaccaaagttgaatctttcagctcatgtccagcccatcactcgtacagttttgggctttgaactgacaattacacctgatttccagtgggatgataaggtacatggatatgtggagcccttttgggttattgttgaggataatgatggcgagtacattcttcacactgaatatttcatgcttaagaaacagtatgttgatgaagatcatactttgaacttcacagtgccaacatatgagccactgccgcctcaatatttcatacgtgttgtgtctgacaagtggcttggttctctgacaattctccctgtctgctttaggcacttgattctaccagaaaaatatgctccgccaactgaattgcttgatctgcagcctctacctgttagtgcattgaggaatgcaagatatgagggcctctatagtgcctttaagcatttcaatcccatccagactcaggtattcactgtcttgtataacaccgatgacagcgtgttggtcgctgcaccaacgggcagtgggaagacgatatgtgctgagtttgctatactaaggaaccaccagagggcagtgtccggtgagagcaacatgcgggtcgtttatatagctcccattgaagctctcacaaaagaaagatacagggactgggaacggaaatttggagaatttgccaaggtagttgagctcactggtgaaaccgcagctgatttgaagcttctggataaaggagaaatcataatcagtactcctgaaaagtgggatgcactgtctcgccggtggaaacagcgaaagcacatccaacaggtcagcttattcatagttgatgaacttcatctacttgggtctgataagggacatgttttggaagtcattgtatctaggatgaggcgtatttcaagtcatactggcagtaacatacggatcgtagcactttcagcttcacttgctaatgctaaggatctcggtgaatggattggtgctacctctcatggcctcttcaacttccctccagcagtgagacctgtgccattggaaatttacattcagggtgtggatatagcaaactttgaggcaaggatgcaagcaatgacaaagcccacctacactgccatcacacagcatgcaaagaacagtaaacctgccctggtgtatgtaccgacaaggaagcatgcaaggttgactgcattggacttgtgtgcatactctagtgttgacggtggtggaactctgtttctccttgggtcagaagatgagatggatactttcacccgaggtgttgaagaagagacacttaagaatacacttaaatgtggtgtaggatatgtgcatgagggtctaagtgaacttgatcaagaacttgtaacccagctgttccttgctgggaggatccaagtgtgtgttgcgagcagcacaatgtgttggggaagaccattgcctgctcatttggttgttgtcatggggacccagtattatgatggccgtgagaatgctcacactgattatccaattacagatcttcttcaaatgatgggtcatgccagcagaccacttaaagacaactcggggaaatgtgttatattgtgtcacgcacctcgcaaagagtactacaagaagttcctttttgaggccttccctgttgagagcaatcttcaccatttcttgcatgatcatatgaatgctgaggtggtggttggtgttgtagagaataagcaagatgccgtggattatcttacttggactttcatgtatcggcggctgacaaagaatcctaacttctacaatctccagggtgtaactcacaggcatctttcagatcatctttctgagctagttgaggctttcctgaatgatcttgaatcaagcaagtgtgtggctatagaggaggacatgtacctgaagcccctgaaccttggccttattgcttcatactactatgttagctacacgactattgagcgtttcagctctatgctgacccagaagactaagatgaaaggactcctagagattctagcatctgcttcagaatatgcagagcttctgggtcgtccgggtgaggaagaattcattgagaggcttgttcgccaccagaggttctctatcgacaagcctaagtatggtgatccacatgtgaaggccaatgctctgctgcaagcccatttttcaaggcacacagtggtcggaaacctggcagctgatcagcgtgagattcttttttctgcccataggttgctccaggcaatggttgatgttatatccagcaatggttggcttagcgttgctcttagtgcaatggagtcgagtcaaatggtgacacaaggcatgtgggatcgggattctgtgctgcttcaagttccacacttcacgaaagacatggcccggaggtgccaggaaaatgaagcgaagcccattgagagtatctttgatcttgctgaggtgggtgttgatgagatgcgggatcttttacagctatcaaactctcagctgcaggacatcattgaattcttcaagcggttccctaatgttgatatgacctatgtggtccgtgcgggtgacgatataagcactggtgacaatgtaaccgtgcaggtaacgctggagcgcgacatgactaacttgccatctgaggttggttcagtccatgcgccaaggttccccaagcccaaggaagaaggctggtggctggtgatcggtgacagctccacaaaccagttactggccatcaaaagagtggcactccagaagagggcgagagtgaaacttgagttctctgctcctccagaagcagggagaaaaaattacatgatttacttgatgtcagactcttacttgggctgtgaccaggagtatgagttcaccgttgatgtcaaggatgctggtggggattgatgatgaagactgacactgtgtcgcatagaagcagttgacttggagtgtgtattgtaggcttgtagcacgttattagtgtcttggaacattctatgtctgcaacctctgaacttgtggaagctgtagcttattttggatgttaataactagtgcaccttgggagttgctgccttatcctgttatggtattattctatggatcatgcaggattatacttgagccacacagtatttgtttatcaacttgttgcttcca
